United States Patent 11,078,247 (RNA ENCODING A THERAPEUTIC PROTEIN) - sequence listing, part 24

SEQ ID NO: 42126 - RNA, 2643 nt, Artificial Sequence
  derived and/or modified sequence opt2 from DDX11__Homo_sapiens__NP_001244074
auggccgagcucuaccgcguccucgaggccggcaagaucggcaucuucgagucccccaccggcaccggcaagucccucucccucaucugcggcgcccucuccuggcuccgcgacuucgagcagaagaagcgcgaggaggaggcccgccuccucgagaccggcaccggcccccuccacgacgagaaggacgagucccucugccucuccuccuccugcgagggcgccgccggcaccccccgccccgccggcgagcccgccugggucacccaguucguccagaagaaggaggagcgcgaccucgucgaccgccucaaggccgagcaggcccgccgcaagcagcgcgaggagcgccuccagcagcuccagcaccgcguccagcucaaguacgccgccaagcgccuccgccaggaggaggaggagcgcgagaaccuccuccgccucucccgcgagaugcucgagaccggccccgaggccgagcgccucgagcagcucgaguccggcgaggaggagcucguccucgccgaguacgaguccgacgaggagaagaaggucgccucccgcgucgacgaggacgaggacgaccucgaggaggagcacaucaccaagaucuacuacugcucccgcacccacucccagcucgcccaguucguccacgaggucaagaagucccccuucggcaaggacguccgccucgucucccucggcucccgccagaaccucugcgucaacgaggacgucaagucccucggcuccguccagcucaucaacgaccgcugcgucgacaugcagcgcucccgccacgagaagaagaagggcgccgaggaggagaagcccaagcgccgccgccaggagaagcaggccgccugccccuucuacaaccacgagcagaugggccuccuccgcgacgaggcccucgccgaggucaaggacauggagcagcuccucgcccucggcaaggaggcccgcgccugccccuacuacggcucccgccucgccauccccgccgcccagcucgucguccuccccuaccagaugcuccuccacgccgccacccgccaggccgccggcauccgccuccaggaccaggucgucaucaucgacgaggcccacaaccucaucgacaccaucaccggcaugcacuccgucgaggucuccggcucccagcucugccaggcccacucccagcuccuccaguacgucgagcgcuacggcaagcgccucaaggccaagaaccucauguaccucaagcagauccucuaccuccucgagaaguucgucgccguccucggcggcaacaucaagcagaaccccaacacccagucccucucccagaccggcaccgagcucaagaccaucaacgacuuccucuuccagucccagaucgacaacaucaaccucuucaagguccagcgcuacugcgagaaguccaugaucucccgcaagcucuucggcuucaccgagcgcuacggcgccgucuucuccucccgcgagcagcccaagcucgccggcuuccagcaguuccuccagucccuccagccccgcaccaccgaggcccucgccgcccccgccgacgagucccaggccuccacccuccgccccgccuccccccucaugcacauccagggcuuccucgccgcccucaccaccgccaaccaggacggccgcgucauccucucccgccagggcucccucucccaguccacccucaaguuccuccuccucaaccccgccguccacuucgcccaggucgucaaggagugccgcgccgucgucaucgccggcggcaccaugcagcccgucuccgacuuccgccagcagcuccucgccugcgccggcgucgaggccgagcgcgucgucgaguucuccugcggccacgucaucccccccgacaacauccucccccucgucaucugcuccggcaucuccaaccagccccucgaguucaccuuccagaagcgcgagcucccccagaugauggacgaggucggccgcauccucugcaaccucugcggcgucguccccggcggcgucgucugcuucuuccccuccuacgaguaccuccgccagguccacgcccacugggagaagggcggccuccucggccgccucgccgcccgcaagaagaucuuccaggagcccaaguccgcccaccaggucgagcagguccuccucgccuacucccgcugcauccaggccugcggccaggagcgcggccaggucaccggcgcccuccuccucuccgucgucggcggcaagauguccgagggcaucaacuucuccgacaaccucggccgcugcgucgucauggucggcaugcccuuccccaacauccgcuccgccgagcuccaggagaagauggccuaccucgaccagacccucccccgcgcccccggccaggccccccccggcaaggcccucgucgagaaccucugcaugaaggccgucaaccaguccaucggccgcgccauccgccaccagaaggacuucgccuccgucguccuccucgaccagcgcuacgcccgcccccccguccucgccaagcuccccgccuggauccgcgcccgcgucgaggucaaggccaccuucggccccgccaucgccgccguccagaaguuccaccgcgagaaguccgccuccuccuga

SEQ ID NO: 42127 - RNA, 2196 nt, Artificial Sequence
  derived and/or modified sequence opt2 from DDX17__Homo_sapiens__NP_001091974
augcccaccggcuucgucgcccccauccucugcguccuccuccccucccccacccgcgaggccgccaccgucgccuccgccaccggcgacuccgccuccgagcgcgaguccgccgcccccgccgccgcccccaccgccgaggcccccccccccuccgucgucacccgccccgagccccaggcccuccccucccccgccauccgcgccccccuccccgaccucuaccccuucggcaccaugcgcggcggcggcuucggcgaccgcgaccgcgaccgcgaccgcggcggcuucggcgcccgcggcggcggcggccucccccccaagaaguucggcaaccccggcgagcgccuccgcaagaagaagugggaccucuccgagcuccccaaguucgagaagaacuucuacgucgagcaccccgaggucgcccgccucacccccuacgaggucgacgagcuccgccgcaagaaggagaucaccguccgcggcggcgacgucugccccaagcccgucuucgccuuccaccacgccaacuucccccaguacgucauggacguccucauggaccagcacuucaccgagcccacccccauccagugccagggcuucccccucgcccucuccggccgcgacauggucggcaucgcccagaccggcuccggcaagacccucgccuaccuccuccccgccaucguccacaucaaccaccagcccuaccucgagcgcggcgacggccccaucugccucguccucgcccccacccgcgagcucgcccagcagguccagcaggucgccgacgacuacggcaagugcucccgccucaaguccaccugcaucuacggcggcgcccccaagggcccccagauccgcgaccucgagcgcggcgucgagaucugcaucgccacccccggccgccucaucgacuuccucgaguccggcaagaccaaccuccgccgcugcaccuaccucguccucgacgaggccgaccgcaugcucgacaugggcuucgagccccagauccgcaagaucgucgaccagauccgccccgaccgccagacccucaugugguccgccaccuggcccaaggagguccgccagcucgccgaggacuuccuccgcgacuacacccagaucaacgucggcaaccucgagcucuccgccaaccacaacauccuccagaucgucgacgucugcauggaguccgagaaggaccacaagcucauccagcucauggaggagaucauggccgagaaggagaacaagaccaucaucuucgucgagaccaagcgccgcugcgacgaccucacccgccgcaugcgccgcgacggcuggcccgccaugugcauccacggcgacaagucccagcccgagcgcgacuggguccucaacgaguuccgcuccggcaaggcccccauccucaucgccaccgacgucgccucccgcggccucgacgucgaggacgucaaguucgucaucaacuacgacuaccccaacuccuccgaggacuacguccaccgcaucggccgcaccgcccgcuccaccaacaagggcaccgccuacaccuucuucacccccggcaaccucaagcaggcccgcgagcucaucaagguccucgaggaggccaaccaggccaucaaccccaagcucaugcagcucgucgaccaccgcggcggcggcggcggcggcggcaagggcggccgcucccgcuaccgcaccaccuccuccgccaacaaccccaaccucauguaccaggacgagugcgaccgccgccuccgcggcgucaaggacggcggccgccgcgacuccgccuccuaccgcgaccgcuccgagaccgaccgcgccggcuacgccaacggcuccggcuacggcucccccaacuccgccuucggcgcccaggccggccaguacaccuacggccagggcaccuacggcgccgccgccuacggcaccuccuccuacaccgcccaggaguacggcgccggcaccuacggcgccuccuccaccaccuccaccggccgcuccucccaguccuccucccagcaguucuccggcaucggccgcuccggccagcagccccagccccucaugucccagcaguucgcccagccccccggcgccaccaacaugaucggcuacaugggccagaccgccuaccaguaccccccccccccccccccccccccccccucccgcaaguga

SEQ ID NO: 42128 - RNA, 2013 nt, Artificial Sequence
  derived and/or modified sequence opt2 from DDX18__Homo_sapiens__NP_006764
augucccaccuccccaugaagcuccuccgcaagaagaucgagaagcgcaaccucaagcuccgccagcgcaaccucaaguuccagggcgccuccaaccucacccucuccgagacccagaacggcgacgucuccgaggagaccaugggcucccgcaaggucaagaaguccaagcagaagcccaugaacgucggccucuccgagacccagaacggcggcaugucccaggaggccgucggcaacaucaaggucaccaaguccccccagaaguccaccguccucaccaacggcgaggccgccaugcaguccuccaacuccgaguccaagaagaagaagaagaagaagcgcaagauggucaacgacgccgagcccgacaccaagaaggccaagaccgagaacaagggcaaguccgaggaggaguccgccgagaccaccaaggagaccgagaacaacgucgagaagcccgacaacgacgaggacgaguccgagguccccucccucccccucggccucaccggcgccuucgaggacaccuccuucgccucccucugcaaccucgucaacgagaacacccucaaggccaucaaggagaugggcuucaccaacaugaccgagauccagcacaaguccauccgcccccuccucgagggccgcgaccuccucgccgccgccaagaccggcuccggcaagacccucgccuuccucauccccgccgucgagcucaucgucaagcuccgcuucaugccccgcaacggcaccggcguccucauccucucccccacccgcgagcucgccaugcagaccuucggcguccucaaggagcucaugacccaccacguccacaccuacggccucaucaugggcggcuccaaccgcuccgccgaggcccagaagcucggcaacggcaucaacaucaucgucgccacccccggccgccuccucgaccacaugcagaacacccccggcuucauguacaagaaccuccagugccucgucaucgacgaggccgaccgcauccucgacgucggcuucgaggaggagcucaagcagaucaucaagcuccuccccacccgccgccagaccaugcucuucuccgccacccagacccgcaaggucgaggaccucgcccgcaucucccucaagaaggagccccucuacgucggcgucgacgacgacaaggccaacgccaccgucgacggccucgagcagggcuacgucgucugccccuccgagaagcgcuuccuccuccucuucaccuuccucaagaagaaccgcaagaagaagcucauggucuucuucuccuccugcauguccgucaaguaccacuacgagcuccucaacuacaucgaccuccccguccucgccauccacggcaagcagaagcagaacaagcgcaccaccaccuucuuccaguucugcaacgccgacuccggcacccuccucugcaccgacgucgccgcccgcggccucgacauccccgaggucgacuggaucguccaguacgacccccccgacgaccccaaggaguacauccaccgcgucggccgcaccgcccgcggccucaacggccgcggccacgcccuccucauccuccgccccgaggagcucggcuuccuccgcuaccucaagcaguccaaggucccccucuccgaguucgacuucuccugguccaagaucuccgacauccagucccagcucgagaagcucaucgagaagaacuacuuccuccacaaguccgcccaggaggccuacaaguccuacauccgcgccuacgacucccacucccucaagcagaucuucaacgucaacaaccucaaccucccccaggucgcccucuccuucggcuucaaggucccccccuucgucgaccucaacgucaacuccaacgagggcaagcagaagaagcgcggcggcggcggcggcuucggcuaccagaagaccaagaaggucgagaaguccaagaucuucaagcacaucuccaagaaguccuccgacucccgccaguucucccacuga

SEQ ID NO: 42129 - RNA, 1437 nt, Artificial Sequence
  derived and/or modified sequence opt2 from DDX19A__Homo_sapiens__NP_060802
auggccaccgacuccugggcccucgccgucgacgagcaggaggccgccgucaaguccaugaccaaccuccagaucaaggaggagaaggucaaggccgacaccaacggcaucaucaagaccuccaccaccgccgagaagaccgacgaggaggagaaggaggaccgcgccgcccagucccuccucaacaagcucauccgcuccaaccucgucgacaacaccaaccaggucgagguccuccagcgcgaccccaacuccccccucuacuccgucaaguccuucgaggagcuccgccucaagccccagcuccuccagggcgucuacgccaugggcuucaaccgccccuccaagauccaggagaacgcccuccccaugaugcucgccgagcccccccagaaccucaucgcccagucccaguccggcaccggcaagaccgccgccuucguccucgccaugcucucccgcgucgagcccuccgaccgcuacccccagugccucugccucucccccaccuacgagcucgcccuccagaccggcaaggucaucgagcagaugggcaaguucuaccccgagcucaagcucgccuacgccguccgcggcaacaagcucgagcgcggccagaagaucuccgagcagaucgucaucggcacccccggcaccguccucgacuggugcuccaagcucaaguucaucgaccccaagaagaucaaggucuucguccucgacgaggccgacgucaugaucgccacccagggccaccaggaccaguccauccgcauccagcgcaugcucccccgcaacugccagaugcuccucuucuccgccaccuucgaggacuccgucuggaaguucgcccagaaggucguccccgaccccaacgucaucaagcucaagcgcgaggaggagacccucgacaccaucaagcaguacuacguccucugcuccucccgcgacgagaaguuccaggcccucugcaaccucuacggcgccaucaccaucgcccaggccaugaucuucugccacacccgcaagaccgccuccuggcucgccgccgagcucuccaaggagggccaccaggucgcccuccucuccggcgagaugauggucgagcagcgcgccgccgucaucgagcgcuuccgcgagggcaaggagaagguccucgucaccaccaacgucugcgcccgcggcaucgacgucgagcaggucuccgucgucaucaacuucgaccuccccgucgacaaggacggcaaccccgacaacgagaccuaccuccaccgcaucggccgcaccggccgcuucggcaagcgcggccucgccgucaacauggucgacuccaagcacuccaugaacauccucaaccgcauccaggagcacuucaacaagaagaucgagcgccucgacaccgacgaccucgacgagaucgagaagaucgccaacuga

SEQ ID NO: 42130 - RNA, 2223 nt, Artificial Sequence
  derived and/or modified sequence opt2 from DDX1__Homo_sapiens__NP_004930
auggccgccuucuccgagaugggcgucaugcccgagaucgcccaggccgucgaggagauggacuggcuccuccccaccgacauccaggccgaguccaucccccucauccucggcggcggcgacguccucauggccgccgagaccggcuccggcaagaccggcgccuucuccauccccgucauccagaucgucuacgagacccucaaggaccagcaggagggcaagaagggcaagaccaccaucaagaccggcgccuccguccucaacaaguggcagaugaaccccuacgaccgcggcuccgccuucgccaucggcuccgacggccucugcugccagucccgcgaggucaaggaguggcacggcugccgcgccaccaagggccucaugaagggcaagcacuacuacgaggucuccugccacgaccagggccucugccgcgucggcugguccaccaugcaggccucccucgaccucggcaccgacaaguucggcuucggcuucggcggcaccggcaagaagucccacaacaagcaguucgacaacuacggcgaggaguucaccaugcacgacaccaucggcugcuaccucgacaucgacaagggccacgucaaguucuccaagaacggcaaggaccucggccucgccuucgagauccccccccacaugaagaaccaggcccucuuccccgccugcguccucaagaacgccgagcucaaguucaacuucggcgaggaggaguucaaguucccccccaaggacggcuucgucgcccucuccaaggcccccgacggcuacaucgucaagucccagcacuccggcaacgcccaggucacccagaccaaguuccuccccaacgcccccaaggcccucaucgucgagcccucccgcgagcucgccgagcagacccucaacaacaucaagcaguucaagaaguacaucgacaaccccaagcuccgcgagcuccucaucaucggcggcgucgccgcccgcgaccagcucuccguccucgagaacggcgucgacaucgucgucggcacccccggccgccucgacgaccucgucuccaccggcaagcucaaccucucccagguccgcuuccucguccucgacgaggccgacggccuccucucccagggcuacuccgacuucaucaaccgcaugcacaaccagaucccccaggucaccuccgacggcaagcgccuccaggucaucgucugcuccgccacccuccacuccuucgacgucaagaagcucuccgagaagaucaugcacuuccccaccugggucgaccucaagggcgaggacuccguccccgacaccguccaccacgucgucguccccgucaaccccaagaccgaccgccucugggagcgccucggcaagucccacauccgcaccgacgacguccacgccaaggacaacacccgccccggcgccaacucccccgagaugugguccgaggccaucaagauccucaagggcgaguacgccguccgcgccaucaaggagcacaagauggaccaggccaucaucuucugccgcaccaagaucgacugcgacaaccucgagcaguacuucauccagcagggcggcggccccgacaagaagggccaccaguucuccugcgucugccuccacggcgaccgcaagccccacgagcgcaagcagaaccucgagcgcuucaagaagggcgacguccgcuuccucaucugcaccgacgucgccgcccgcggcaucgacauccacggcguccccuacgucaucaacgucacccuccccgacgagaagcagaacuacguccaccgcaucggccgcgucggccgcgccgagcgcaugggccucgccaucucccucgucgccaccgagaaggagaaggucugguaccacgucugcuccucccgcggcaagggcugcuacaacacccgccucaaggaggacggcggcugcaccaucugguacaacgagaugcagcuccucuccgagaucgaggagcaccucaacugcaccaucucccaggucgagcccgacaucaagguccccgucgacgaguucgacggcaaggucaccuacggccagaagcgcgccgccggcggcggcuccuacaagggccacgucgacauccucgcccccaccguccaggagcucgccgcccucgagaaggaggcccagaccuccuuccuccaccucggcuaccuccccaaccagcucuuccgcaccuucuga

SEQ ID NO: 42131 - RNA, 2352 nt, Artificial Sequence
  derived and/or modified sequence opt2 from DDX21__Homo_sapiens__NP_004719
augcccggcaagcuccgcuccgacgccggccucgaguccgacaccgccaugaagaagggcgagacccuccgcaagcagaccgaggagaaggagaagaaggagaagcccaaguccgacaagaccgaggagaucgccgaggaggaggagaccgucuuccccaaggccaagcaggucaagaagaaggccgagcccuccgaggucgacaugaacucccccaaguccaagaaggccaagaagaaggaggagcccucccagaacgacaucucccccaagaccaagucccuccgcaagaagaaggagcccaucgagaagaaggucgucuccuccaagaccaagaaggucaccaagaacgaggagcccuccgaggaggagaucgacgcccccaagcccaagaagaugaagaaggagaaggagaugaacggcgagacccgcgagaagucccccaagcucaagaacggcuucccccaccccgagcccgacugcaaccccuccgaggccgccuccgaggaguccaacuccgagaucgagcaggagauccccgucgagcagaaggagggcgccuucuccaacuuccccaucuccgaggagaccaucaagcuccucaagggccgcggcgucaccuuccucuuccccauccaggccaagaccuuccaccacgucuacuccggcaaggaccucaucgcccaggcccgcaccggcaccggcaagaccuucuccuucgccaucccccucaucgagaagcuccacggcgagcuccaggaccgcaagcgcggccgcgccccccagguccucguccucgcccccacccgcgagcucgccaaccaggucuccaaggacuucuccgacaucaccaagaagcucuccgucgccugcuucuacggcggcacccccuacggcggccaguucgagcgcaugcgcaacggcaucgacauccucgucggcacccccggccgcaucaaggaccacauccagaacggcaagcucgaccucaccaagcucaagcacgucguccucgacgaggucgaccagaugcucgacaugggcuucgccgaccaggucgaggagauccucuccgucgccuacaagaaggacuccgaggacaacccccagacccuccucuucuccgccaccugcccccacugggucuucaacgucgccaagaaguacaugaaguccaccuacgagcaggucgaccucaucggcaagaagacccagaagaccgccaucaccgucgagcaccucgccaucaagugccacuggacccagcgcgccgccgucaucggcgacgucauccgcgucuacuccggccaccagggccgcaccaucaucuucugcgagaccaagaaggaggcccaggagcucucccagaacuccgccaucaagcaggacgcccagucccuccacggcgacaucccccagaagcagcgcgagaucacccucaagggcuuccgcaacggcuccuucggcguccucgucgccaccaacgucgccgcccgcggccucgacauccccgaggucgaccucgucauccaguccuccccccccaaggacgucgaguccuacauccaccgcuccggccgcaccggccgcgccggccgcaccggcgucugcaucugcuucuaccagcacaaggaggaguaccagcucguccaggucgagcagaaggccggcaucaaguucaagcgcaucggcguccccuccgccaccgagaucaucaaggccuccuccaaggacgccauccgccuccucgacuccgucccccccaccgccaucucccacuucaagcaguccgccgagaagcucaucgaggagaagggcgccgucgaggcccucgccgccgcccucgcccacaucuccggcgccaccuccgucgaccagcgcucccucaucaacuccaacgucggcuucgucaccaugauccuccagugcuccaucgagaugcccaacaucuccuacgccuggaaggagcucaaggagcagcucggcgaggagaucgacuccaaggucaagggcauggucuuccucaagggcaagcucggcgucugcuucgacguccccaccgccuccgucaccgagauccaggagaaguggcacgacucccgccgcuggcagcucuccgucgccaccgagcagcccgagcucgagggcccccgcgagggcuacggcggcuuccgcggccagcgcgagggcucccgcggcuuccgcggccagcgcgacggcaaccgccgcuuccgcggccagcgcgagggcucccgcggcccccgcggccagcgcuccggcggcggcaacaaguccaaccgcucccagaacaagggccagaagcgcuccuucuccaaggccuucggccaguga

SEQ ID NO: 42132 - RNA, 1452 nt, Artificial Sequence
  derived and/or modified sequence opt2 from DDX25__Homo_sapiens__NP_037396
auggccucccuccucuggggcggcgacgccggcgccgccgaguccgagcgccucaacucccacuucuccaaccucucccagccccgcaagaaccucuggggcaucaaguccaccgccguccgcaacaucgacggcuccaucaacaacaucaacgaggacgacgaggaggacgucgucgaccucgccgccaacucccuccucaacaagcucauccaccagucccucgucgaguccucccaccgcgucgagguccuccagaaggaccccuccuccccccucuacuccgucaagaccuucgaggagcuccgccucaaggaggagcuccucaagggcaucuacgccaugggcuucaaccgccccuccaagauccaggagauggcccuccccaugaugcucgcccaccccccccagaaccucaucgcccagucccaguccggcaccggcaagaccgccgccuucguccucgccaugcucucccgcgucaacgcccucgagcucuucccccagugccucugccucgcccccaccuacgagcucgcccuccagaccggccgcgucgucgagcagaugggcaaguucugcgucgacguccaggucauguacgccauccgcggcaaccgcaucccccgcggcaccgacaucaccaagcagaucaucaucggcacccccggcaccguccucgacuggugcuucaagcucaagcucaucgaccucaccaagauccgcgucuucguccucgacgaggccgacgucaugaucgacacccagggcuucuccgaccacuccauccgcauccagcgcgcccuccccuccgagugccagaugcuccucuucuccgccaccuucgaggacuccgucuggcacuucgccgagcgcaucauccccgaccccaacgucaucaagcuccgcaaggaggagcucacccucaacaacauccgccaguacuacguccucugcgagcaccgcaaggacaaguaccaggcccucugcaacaucuacggcuccaucaccaucggccaggccaucaucuucugccagacccgccgcaacgccaaguggcucaccgucgagaugauccaggacggccaccaggucucccuccucuccggcgagcucaccgucgagcagcgcgccuccaucauccagcgcuuccgcgacggcaaggagaagguccucaucaccaccaacgucugcgcccgcggcaucgacgucaagcaggucaccaucgucgucaacuucgaccuccccgucaagcagggcgaggagcccgacuacgagaccuaccuccaccgcaucggccgcaccggccgcuucggcaagaagggccucgccuucaacaugaucgaggucgacgagcuccccucccucaugaagauccaggaccacuucaacuccuccaucaagcagcucaacgccgaggacauggacgagaucgagaagaucgacuacuga

SEQ ID NO: 42133 - RNA, 2391 nt, Artificial Sequence
  derived and/or modified sequence opt2 from DDX27__Homo_sapiens__NP_060365
augguccucgcccagcgccgccgcggcggcugcgagaagcuccgcgccggcccccaggccguccucgccuccggcuccggcuucugcgacaacaugcucgccgaccucggccucaucggcaccaucggcgaggacgacgagguccccgucgagcccgaguccgacuccggcgacgaggaggaggagggccccaucguccucggccgccgccagaaggcccucggcaagaaccgcuccgccgacuucaaccccgacuucgucuucaccgagaaggagggcaccuacgacggcuccugggcccucgccgacgucaugucccagcucaagaagaagcgcgccgccaccacccucgacgagaagaucgagaagguccgcaagaagcgcaagaccgaggacaaggaggccaaguccggcaagcucgagaaggagaaggaggccaaggagggcuccgagcccaaggagcaggaggaccuccaggagaacgacgaggagggcuccgaggacgaggccuccgagaccgacuacuccuccgccgacgagaacauccucaccaaggccgacacccucaaggucaaggaccgcaagaagaagaagaagaagggccaggaggccggcggcuucuucgaggacgccucccaguacgacgagaaccucuccuuccaggacaugaaccucucccgcccccuccucaaggccaucaccgccaugggcuucaagcagcccacccccauccagaaggccugcauccccgucggccuccucggcaaggacaucugcgccugcgccgccaccggcaccggcaagaccgccgccuucgcccuccccguccucgagcgccucaucuacaagccccgccaggcccccgucacccgcguccucguccucguccccacccgcgagcucggcauccagguccacuccgucacccgccagcucgcccaguucugcaacaucaccaccugccucgccgucggcggccucgacgucaagucccaggaggccgcccuccgcgccgcccccgacauccucaucgccacccccggccgccucaucgaccaccuccacaacugccccuccuuccaccucuccuccaucgagguccucauccucgacgaggccgaccgcaugcucgacgaguacuucgaggagcagaugaaggagaucauccgcaugugcucccaccaccgccagaccaugcucuucuccgccaccaugaccgacgaggucaaggaccucgccuccgucucccucaagaaccccguccgcaucuucgucaacuccaacaccgacgucgcccccuuccuccgccaggaguucauccgcauccgccccaaccgcgagggcgaccgcgaggccaucgucgccgcccuccucacccgcaccuucaccgaccacgucaugcucuucacccagaccaagaagcaggcccaccgcaugcacauccuccucggccucaugggccuccaggucggcgagcuccacggcaaccucucccagacccagcgccucgaggcccuccgccgcuucaaggacgagcagaucgacauccucgucgccaccgacgucgccgcccgcggccucgacaucgagggcgucaagaccgucaucaacuucaccaugcccaacaccaucaagcacuacguccaccgcgucggccgcaccgcccgcgccggccgcgccggccgcuccgucucccucgucggcgaggacgagcgcaagaugcucaaggagaucgucaaggccgccaaggcccccgucaaggcccgcauccucccccaggacgucauccucaaguuccgcgacaagaucgagaagauggagaaggacgucuacgccguccuccagcucgaggccgaggagaaggagaugcagcaguccgaggcccagaucaacaccgccaagcgccuccucgagaagggcaaggaggccgucguccaggagcccgagcgcuccugguuccagaccaaggaggagcgcaagaaggagaagaucgccaaggcccuccaggaguucgaccucgcccuccgcggcaagaagaagcgcaagaaguucaugaaggacgccaagaagaagggcgagaugaccgccgaggagcgcucccaguucgagauccucaaggcccagauguucgccgagcgccucgccaagcgcaaccgccgcgccaagcgcgcccgcgccaugcccgaggaggagcccguccgcggccccgccaagaagcagaagcagggcaagaaguccgucuucgacgaggagcucaccaacaccuccaagaaggcccucaagcaguaccgcgccggccccuccuucgaggagcgcaagcagcucggccucccccaccagcgccgcggcggcaacuucaaguccaagucccgcuacaagcgccgcaaguga

SEQ ID NO: 42134 - RNA, 1623 nt, Artificial Sequence
  derived and/or modified sequence opt2 from DDX28__Homo_sapiens__NP_060850
auggcccucacccgccccguccgccucuucucccucgucacccgccuccuccucgccccccgccgcggccucaccguccgcucccccgacgagccccuccccgucguccgcauccccgucgcccuccagcgccagcucgagcagcgccagucccgccgccgcaaccucccccgccccguccucguccgccccggcccccuccucgucuccgcccgccgccccgagcucaaccagcccgcccgccucacccucggccgcugggagcgcgccccccucgccucccagggcuggaagucccgccgcgcccgccgcgaccacuucuccaucgagcgcgcccagcaggaggcccccgccguccgcaagcucuccuccaagggcuccuucgccgaccucggccucgagccccgcguccuccacgcccuccaggaggccgcccccgaggucguccagcccaccaccguccaguccuccaccauccccucccuccuccgcggccgccacgucgucugcgccgccgagaccggcuccggcaagacccucuccuaccuccucccccuccuccagcgccuccucggccagcccucccucgacucccuccccauccccgccccccgcggccucguccucguccccucccgcgagcucgcccagcagguccgcgccgucgcccagccccucggccgcucccucggccuccucguccgcgaccucgagggcggccacggcaugcgccgcauccgccuccagcucucccgccagcccuccgccgacguccucgucgccacccccggcgcccucuggaaggcccucaagucccgccucaucucccucgagcagcucuccuuccucguccucgacgaggccgacacccuccucgacgaguccuuccucgagcucgucgacuacauccucgagaagucccacaucgccgagggccccgccgaccucgaggaccccuucaaccccaaggcccagcucguccucgucggcgccaccuuccccgagggcgucggccagcuccucaacaaggucgccucccccgacgccgucaccaccaucaccuccuccaagcuccacugcaucaugccccacgucaagcagaccuuccuccgccucaagggcgccgacaaggucgccgagcucguccacauccucaagcaccgcgaccgcgccgagcgcaccggccccuccggcaccguccucgucuucugcaacuccuccuccaccgucaacuggcucggcuacauccucgacgaccacaagauccagcaccuccgccuccagggccagaugcccgcccucaugcgcgucggcaucuuccaguccuuccagaaguccucccgcgacauccuccucugcaccgacaucgccucccgcggccucgacuccaccggcgucgagcucgucgucaacuacgacuucccccccacccuccaggacuacauccaccgcgccggccgcgucggccgcgucggcuccgagguccccggcaccgucaucuccuucgucacccaccccugggacgucucccucguccagaagaucgagcucgccgcccgccgccgccgcucccuccccggccucgccuccuccgucaaggagccccucccccaggccaccuga

SEQ ID NO: 42135 - RNA, 2556 nt, Artificial Sequence
  derived and/or modified sequence opt2 from DDX31__Homo_sapiens__NP_073616
auggcccccgaccucgccucccagcgccacuccgaguccuuccccuccgucaacucccgccccaacgucauccuccccggccgcgagggccgccgcgagggccucccccccggcggcggcacccgcggcucccucguccccacccgccccgucccccccucccccgccccccucggcaccucccccuacuccuggucccgcuccggccccggccgcggcggcggcgccggcuccucccgcgucccccgcggcguccccggccccgccgucugcgcccccggcucccuccuccaccacgccucccccacccagaccauggccgccgccgacggcucccucuucgacaacccccgcaccuucucccgccgcccccccgcccaggccucccgccaggccaaggccaccaagcgcaaguaccaggccuccuccgaggccccccccgccaagcgccgcaacgagaccuccuuccuccccgccaagaagaccuccgucaaggagacccagcgcaccuucaagggcaacgcccagaagauguucucccccaagaagcacuccgucuccaccuccgaccgcaaccaggaggagcgccagugcaucaagaccuccucccucuucaagaacaaccccgacauccccgagcuccaccgccccgucgucaagcagguccaggagaaggucuucaccuccgccgccuuccacgagcucggccuccacccccaccucaucuccaccaucaacaccguccucaagauguccuccaugaccuccguccagaagcaguccauccccguccuccucgagggccgcgacgcccucguccgcucccagaccggcuccggcaagacccucgccuacugcauccccgucguccagucccuccaggccauggaguccaagauccagcgcuccgacggccccuacgcccucguccucguccccacccgcgagcucgcccuccaguccuucgacaccguccagaagcuccucaagcccuucaccuggaucguccccggcguccucaugggcggcgagaagcgcaaguccgagaaggcccgccuccgcaagggcaucaacauccucaucuccacccccggccgccucgucgaccacaucaaguccaccaagaacauccacuucucccgccuccgcuggcucgucuucgacgaggccgaccgcauccucgaccucggcuucgagaaggacaucaccgucauccucaacgccgucaacgccgagugccagaagcgccagaacguccuccucuccgccacccucaccgagggcgucacccgccucgccgacaucucccuccacgaccccgucuccaucuccguccucgacaagucccacgaccagcucaaccccaaggacaaggccguccaggaggucugccccccccccgccggcgacaagcucgacuccuucgccauccccgagucccucaagcagcacgucaccgucguccccuccaagcuccgccucgucugccucgccgccuucauccuccagaagugcaaguucgaggaggaccagaagauggucgucuucuucuccuccugcgagcucgucgaguuccacuacucccucuuccuccagacccuccucuccuccuccggcgcccccgccuccggccagcuccccuccgccuccaugcgccucaaguuccuccgccuccacggcggcauggagcaggaggagcgcaccgccgucuuccaggaguucucccacucccgccgcggcguccuccucugcaccgacgucgccgcccgcggccucgaccucccccaggucaccuggaucguccaguacaacgcccccuccucccccgccgaguacauccaccgcaucggccgcaccgcccgcaucggcugccacggcuccucccuccucauccucgcccccuccgaggccgaguacgucaacucccucgccucccacaagaucaacgucuccgagaucaagauggaggacauccucugcguccucacccgcgacgacugcuucaagggcaagcgcuggggcgcccagaagucccacgccgucggcccccaggagauccgcgagcgcgccaccguccuccagaccgucuucgaggacuacguccacuccuccgagcgccgcgucuccugggccaagaaggcccuccaguccuucauccaggccuacgccaccuacccccgcgagcucaagcacaucuuccacguccgcucccuccaccucggccacgucgccaaguccuucggccuccgcgacgccccccgcaaccucuccgcccucacccgcaagaagcgcaaggcccacgucaagcgccccgaccuccacaagaagacccaguccaagcacucccucgccgagauccuccgcuccgaguacuccuccggcauggaggccgacaucgccaaggucaagaagcagaacgcccccggcgagcccggcggccgcccccuccagcacucccuccagcccacccccugcuucggccgcggcaagacccucaaguggcgcaagacccagaagggcguccagcgcgacuccaagaccucccagaaggucuga

SEQ ID NO: 42136 - RNA, 1284 nt, Artificial Sequence
  derived and/or modified sequence opt2 from DDX39A__Homo_sapiens__NP_005795
auggccgagcaggacgucgagaacgaccuccucgacuacgacgaggaggaggagccccaggccccccaggaguccacccccgccccccccaagaaggacaucaagggcuccuacgucuccauccacuccuccggcuuccgcgacuuccuccucaagcccgagcuccuccgcgccaucgucgacugcggcuucgagcaccccuccgagguccagcacgagugcaucccccaggccauccucggcauggacguccucugccaggccaaguccggcaugggcaagaccgccgucuucguccucgccacccuccagcagaucgagcccgucaacggccaggucaccguccucgucaugugccacacccgcgagcucgccuuccagaucuccaaggaguacgagcgcuucuccaaguacaugcccuccgucaaggucuccgucuucuucggcggccucuccaucaagaaggacgaggagguccucaagaagaacugcccccacgucgucgucggcacccccggccgcauccucgcccucguccgcaaccgcuccuucucccucaagaacgucaagcacuucguccucgacgagugcgacaagaugcucgagcagcucgacaugcgccgcgacguccaggagaucuuccgccucaccccccacgagaagcagugcaugauguucuccgccacccucuccaaggacauccgccccgucugccgcaaguucaugcaggaccccauggaggucuucgucgacgacgagaccaagcucacccuccacggccuccagcaguacuacgucaagcucaaggacuccgagaagaaccgcaagcucuucgaccuccucgacguccucgaguucaaccaggucaucaucuucgucaaguccguccagcgcugcauggcccucgcccagcuccucgucgagcagaacuuccccgccaucgccauccaccgcggcauggcccaggaggagcgccucucccgcuaccagcaguucaaggacuuccagcgccgcauccucgucgccaccaaccucuucggccgcggcauggacaucgagcgcgucaacaucgucuucaacuacgacaugcccgaggacuccgacaccuaccuccaccgcgucgcccgcgccggccgcuucggcaccaagggccucgccaucaccuucgucuccgacgagaacgacgccaagauccucaacgacguccaggaccgcuucgaggucaacgucgccgagcuccccgaggagaucgacaucuccaccuacaucgagcagucccgcuga

SEQ ID NO: 42137 - RNA, 1287 nt, Artificial Sequence
  derived and/or modified sequence opt2 from DDX39B__Homo_sapiens__NP_542165
auggccgagaacgacgucgacaacgagcuccucgacuacgaggacgacgaggucgagaccgccgccggcggcgacggcgccgaggcccccgccaagaaggacgucaagggcuccuacgucuccauccacuccuccggcuuccgcgacuuccuccucaagcccgagcuccuccgcgccaucgucgacugcggcuucgagcaccccuccgagguccagcacgagugcaucccccaggccauccucggcauggacguccucugccaggccaaguccggcaugggcaagaccgccgucuucguccucgccacccuccagcagcucgagcccgucaccggccaggucuccguccucgucaugugccacacccgcgagcucgccuuccagaucuccaaggaguacgagcgcuucuccaaguacaugcccaacgucaaggucgccgucuucuucggcggccucuccaucaagaaggacgaggagguccucaagaagaacugcccccacaucgucgucggcacccccggccgcauccucgcccucgcccgcaacaagucccucaaccucaagcacaucaagcacuucauccucgacgagugcgacaagaugcucgagcagcucgacaugcgccgcgacguccaggagaucuuccgcaugaccccccacgagaagcaggucaugauguucuccgccacccucuccaaggagauccgccccgucugccgcaaguucaugcaggaccccauggagaucuucgucgacgacgagaccaagcucacccuccacggccuccagcaguacuacgucaagcucaaggacaacgagaagaaccgcaagcucuucgaccuccucgacguccucgaguucaaccaggucgucaucuucgucaaguccguccagcgcugcaucgcccucgcccagcuccucgucgagcagaacuuccccgccaucgccauccaccgcggcaugccccaggaggagcgccucucccgcuaccagcaguucaaggacuuccagcgccgcauccucgucgccaccaaccucuucggccgcggcauggacaucgagcgcgucaacaucgccuucaacuacgacaugcccgaggacuccgacaccuaccuccaccgcgucgcccgcgccggccgcuucggcaccaagggccucgccaucaccuucgucuccgacgagaacgacgccaagauccucaacgacguccaggaccgcuucgaggucaacaucuccgagcuccccgacgagaucgacaucuccuccuacaucgagcagacccgcuga

SEQ ID NO: 42138 - RNA, 1986 nt, Artificial Sequence
  derived and/or modified sequence opt2 from DDX3X__Homo_sapiens__NP_001180345
augucccacgucgccgucgagaacgcccucggccucgaccagcaguucgccggccucgaccucaacuccuccgacaaccaguccggcggcuccaccgccuccaagggccgcuacauccccccccaccuccgcaaccgcgaggccaccaagggcuucuacgacaaggacuccuccggcugguccuccuccaaggacaaggacgccuacuccuccuucggcucccgcuccgacucccgcggcaaguccuccuucuucuccgaccgcggcuccggcucccgcggccgcuucgacgaccgcggccgcuccgacuacgacggcaucggcucccgcggcgaccgcuccggcuucggcaaguucgagcgcggcggcaacucccgcuggugcgacaaguccgacgaggacgacugguccaagccccucccccccuccgagcgccucgagcaggagcucuucuccggcggcaacaccggcaucaacuucgagaaguacgacgacauccccgucgaggccaccggcaacaacugccccccccacaucgaguccuucuccgacgucgagaugggcgagaucaucaugggcaacaucgagcucacccgcuacacccgccccacccccguccagaagcacgccauccccaucaucaaggagaagcgcgaccucauggccugcgcccagaccggcuccggcaagaccgccgccuuccuccuccccauccucucccagaucuacuccgacggccccggcgaggcccuccgcgccaugaaggagaacggccgcuacggccgccgcaagcaguaccccaucucccucguccucgcccccacccgcgagcucgccguccagaucuacgaggaggcccgcaaguucuccuaccgcucccgcguccgccccugcgucgucuacggcggcgccgacaucggccagcagauccgcgaccucgagcgcggcugccaccuccucgucgccacccccggccgccucgucgacaugauggagcgcggcaagaucggccucgacuucugcaaguaccucguccucgacgaggccgaccgcaugcucgacaugggcuucgagccccagauccgccgcaucgucgagcaggacaccaugccccccaagggcguccgccacaccaugauguucuccgccaccuuccccaaggagauccagaugcucgcccgcgacuuccucgacgaguacaucuuccucgccgucggccgcgucggcuccaccuccgagaacaucacccagaaggucgucugggucgaggaguccgacaagcgcuccuuccuccucgaccuccucaacgccaccggcaaggacucccucacccucgucuucgucgagaccaagaagggcgccgacucccucgaggacuuccucuaccacgagggcuacgccugcaccuccauccacggcgaccgcucccagcgcgaccgcgaggaggcccuccaccaguuccgcuccggcaagucccccauccucgucgccaccgccgucgccgcccgcggccucgacaucuccaacgucaagcacgucaucaacuucgaccuccccuccgacaucgaggaguacguccaccgcaucggccgcaccggccgcgucggcaaccucggccucgccaccuccuucuucaacgagcgcaacaucaacaucaccaaggaccuccucgaccuccucgucgaggccaagcaggagguccccuccuggcucgagaacauggccuacgagcaccacuacaagggcuccucccgcggccgcuccaagucccgcuucuccggcggcuucggcgcccgcgacuaccgccaguccuccggcgccuccuccuccuccuucuccuccucccgcgccuccuccucccgcuccggcggcggcggccacggcuccucccgcggcuucggcggcggcggcuacggcggcuucuacaacuccgacggcuacggcggcaacuacaacucccagggcgucgacugguggggcaacuga

SEQ ID NO: 42139 - RNA, 1974 nt, Artificial Sequence
  derived and/or modified sequence opt2 from DDX3Y__Homo_sapiens__NP_001289481
auggagaucggccgcccccgcaaggacaccuggaagcucgccaaccucgaccucaacuccgagaagcaguccggcggcgccuccaccgccuccaagggccgcuacauccccccccaccuccgcaaccgcgaggccuccaagggcuuccacgacaaggacuccuccggcugguccugcuccaaggacaaggacgccuacuccuccuucggcucccgcgacucccgcggcaagcccggcuacuucuccgagcgcggcuccggcucccgcggccgcuucgacgaccgcggccgcuccgacuacgacggcaucggcaaccgcgagcgccccggcuucggccgcuucgagcgcuccggccacucccgcuggugcgacaaguccgucgaggacgacugguccaagccccucccccccuccgagcgccucgagcaggagcucuucuccggcggcaacaccggcaucaacuucgagaaguacgacgacauccccgucgaggccaccggcuccaacugccccccccacaucgagaacuucuccgacaucgacaugggcgagaucaucaugggcaacaucgagcucacccgcuacacccgccccacccccguccagaagcacgccauccccaucaucaagggcaagcgcgaccucauggccugcgcccagaccggcuccggcaagaccgccgccuuccuccuccccauccucucccagaucuacaccgacggccccggcgaggcccucaaggccgucaaggagaacggccgcuacggccgccgcaagcaguaccccaucucccucguccucgcccccacccgcgagcucgccguccagaucuacgaggaggcccgcaaguucuccuaccgcucccgcguccgccccugcgucgucuacggcggcgccgacaucggccagcagauccgcgaccucgagcgcggcugccaccuccucgucgccacccccggccgccucgucgacaugauggagcgcggcaagaucggccucgacuucugcaaguaccucguccucgacgaggccgaccgcaugcucgacaugggcuucgagccccagauccgccgcaucgucgagcaggacaccaugccccccaagggcguccgccacaccaugauguucuccgccaccuuccccaaggagauccagaugcucgcccgcgacuuccucgacgaguacaucuuccucgccgucggccgcgucggcuccaccuccgagaacaucacccagaaggucgucugggucgaggaccucgacaagcgcuccuuccuccucgacauccucggcgccaccggcuccgacucccucacccucgucuucgucgagaccaagaagggcgccgacucccucgaggacuuccucuaccacgagggcuacgccugcaccuccauccacggcgaccgcucccagcgcgaccgcgaggaggcccuccaccaguuccgcuccggcaagucccccauccucgucgccaccgccgucgccgcccgcggccucgacaucuccaacguccgccacgucaucaacuucgaccuccccuccgacaucgaggaguacguccaccgcaucggccgcaccggccgcgucggcaaccucggccucgccaccuccuucuucaacgagaagaacaugaacaucaccaaggaccuccucgaccuccucgucgaggccaagcaggagguccccuccuggcucgagaacauggccuacgagcaccacuacaagggcggcucccgcggccgcuccaaguccaaccgcuucuccggcggcuucggcgcccgcgacuaccgccaguccuccggcuccuccuccuccggcuucggcgccucccgcggcuccuccucccgcuccggcggcggcggcuacggcaacucccgcggcuucggcggcggcggcuacggcggcuucuacaacuccgacggcuacggcggcaacuacaacucccagggcgucgacugguggggcaacuga

SEQ ID NO: 42140 - RNA, 1869 nt, Artificial Sequence
  derived and/or modified sequence opt2 from DDX41__Homo_sapiens__NP_057306
auggaggaguccgagcccgagcgcaagcgcgcccgcaccgacgagguccccgccggcggcucccgcuccgaggccgaggacgaggacgacgaggacuacguccccuacgucccccuccgccagcgccgccagcuccuccuccagaagcuccuccagcgccgccgcaagggcgccgccgaggaggagcagcaggacuccggcuccgagccccgcggcgacgaggacgacaucccccucggcccccaguccaacgucucccuccucgaccagcaccagcaccucaaggagaaggccgaggcccgcaaggaguccgccaaggagaagcagcucaaggaggaggagaagauccucgaguccgucgccgagggccgcgcccucauguccgucaaggagauggccaagggcaucaccuacgacgaccccaucaagaccuccuggacccccccccgcuacguccucuccauguccgaggagcgccacgagcgcguccgcaagaaguaccacauccucgucgagggcgacggcauccccccccccaucaaguccuucaaggagaugaaguuccccgccgccauccuccgcggccucaagaagaagggcauccaccaccccacccccauccagauccagggcauccccaccauccucuccggccgcgacaugaucggcaucgccuucaccggcuccggcaagacccucgucuucacccuccccgucaucauguucugccucgagcaggagaagcgccuccccuucuccaagcgcgagggccccuacggccucaucaucugccccucccgcgagcucgcccgccagacccacggcauccucgaguacuacugccgccuccuccaggaggacuccuccccccuccuccgcugcgcccucugcaucggcggcauguccgucaaggagcagauggagaccauccgccacggcguccacaugauggucgccacccccggccgccucauggaccuccuccagaagaagauggucucccucgacaucugccgcuaccucgcccucgacgaggccgaccgcaugaucgacaugggcuucgagggcgacauccgcaccaucuucuccuacuucaagggccagcgccagacccuccucuucuccgccaccaugcccaagaagauccagaacuucgccaaguccgcccucgucaagcccgucaccaucaacgucggccgcgccggcgccgccucccucgacgucauccaggaggucgaguacgucaaggaggaggccaagauggucuaccuccucgagugccuccagaagacccccccccccguccucaucuucgccgagaagaaggccgacgucgacgccauccacgaguaccuccuccucaagggcgucgaggccgucgccauccacggcggcaaggaccaggaggagcgcaccaaggccaucgaggccuuccgcgagggcaagaaggacguccucgucgccaccgacgucgccuccaagggccucgacuuccccgccauccagcacgucaucaacuacgacaugcccgaggagaucgagaacuacguccaccgcaucggccgcaccggccgcuccggcaacaccggcaucgccaccaccuucaucaacaaggccugcgacgaguccguccucauggaccucaaggcccuccuccucgaggccaagcagaaggucccccccguccuccagguccuccacugcggcgacgaguccaugcucgacaucggcggcgagcgcggcugcgccuucugcggcggccucggccaccgcaucaccgacugccccaagcucgaggccaugcagaccaagcaggucuccaacaucggccgcaaggacuaccucgcccacuccuccauggacuucuga

SEQ ID NO: 42141 - RNA, 2817 nt, Artificial Sequence
  derived and/or modified sequence opt2 from DDX42__Homo_sapiens__NP_987095
augaacuggaacaagggcggccccggcaccaagcgcggcuucggcuucggcggcuucgccaucuccgccggcaagaaggaggagcccaagcucccccagcagucccacuccgccuucggcgccaccuccuccuccuccggcuucggcaaguccgcccccccccagcuccccuccuucuacaagaucggcuccaagcgcgccaacuucgacgaggagaacgccuacuucgaggacgaggaggaggacuccuccaacgucgaccuccccuacauccccgccgagaacucccccacccgccagcaguuccacuccaagcccgucgacuccgacuccgacgacgacccccucgaggccuucauggccgaggucgaggaccaggccgcccgcgacaugaagcgccucgaggagaaggacaaggagcgcaagaacgucaagggcauccgcgacgacaucgaggaggaggacgaccaggaggccuacuuccgcuacauggccgagaaccccaccgccggcgucguccaggaggaggaggaggacaaccucgaguacgacuccgacggcaaccccaucgcccccaccaagaagaucaucgacccccucccccccaucgaccacuccgagaucgacuacccccccuucgagaagaacuucuacaacgagcacgaggagaucaccaaccucaccccccagcagcucaucgaccuccgccacaagcucaaccuccgcgucuccggcgccgcccccccccgccccggcuccuccuucgcccacuucggcuucgacgagcagcucaugcaccagauccgcaaguccgaguacacccagcccacccccauccagugccagggcguccccgucgcccucuccggccgcgacaugaucggcaucgccaagaccggcuccggcaagaccgccgccuucaucuggcccaugcucauccacaucauggaccagaaggagcucgagcccggcgacggccccaucgccgucaucgucugccccacccgcgagcucugccagcagauccacgccgagugcaagcgcuucggcaaggccuacaaccuccgcuccgucgccgucuacggcggcggcuccaugugggagcaggccaaggcccuccaggagggcgccgagaucgucgucugcacccccggccgccucaucgaccacgucaagaagaaggccaccaaccuccagcgcgucuccuaccucgucuucgacgaggccgaccgcauguucgacaugggcuucgaguaccagguccgcuccaucgccucccacguccgccccgaccgccagacccuccucuucuccgccaccuuccgcaagaagaucgagaagcucgcccgcgacauccucaucgaccccauccgcgucguccagggcgacaucggcgaggccaacgaggacgucacccagaucgucgagauccuccacuccggccccuccaaguggaacuggcucacccgccgccucgucgaguucaccuccuccggcuccguccuccucuucgucaccaagaaggccaacgccgaggagcucgccaacaaccucaagcaggagggccacaaccucggccuccuccacggcgacauggaccaguccgagcgcaacaaggucaucuccgacuucaagaagaaggacauccccguccucgucgccaccgacgucgccgcccgcggccucgacauccccuccaucaagaccgucaucaacuacgacgucgcccgcgacaucgacacccacacccaccgcaucggccgcaccggccgcgccggcgagaagggcgucgccuacacccuccucacccccaaggacuccaacuucgccggcgaccucguccgcaaccucgagggcgccaaccagcacgucuccaaggagcuccucgaccucgccaugcagaacgccugguuccgcaagucccgcuucaagggcggcaagggcaagaagcucaacaucggcggcggcggccucggcuaccgcgagcgccccggccucggcuccgagaacauggaccgcggcaacaacaacgucauguccaacuacgaggccuacaagcccuccaccggcgccaugggcgaccgccucaccgccaugaaggccgccuuccagucccaguacaagucccacuucgucgccgccucccucuccaaccagaaggccggcuccuccgccgccggcgccuccggcuggaccuccgccggcucccucaacuccguccccaccaacuccgcccagcagggccacaacucccccgacucccccgucaccuccgccgccaagggcauccccggcuucggcaacaccggcaacaucuccggcgcccccgucaccuaccccuccgccggcgcccagggcgucaacaacaccgccuccggcaacaacucccgcgagggcaccggcggcuccaacggcaagcgcgagcgcuacaccgagaaccgcggcuccucccgccacucccacggcgagaccggcaaccgccacuccgacuccccccgccacggcgacggcggccgccacggcgacggcuaccgccaccccgaguccuccucccgccacaccgacggccaccgccacggcgagaaccgccacggcggcuccgccggccgccacggcgagaaccgcggcgccaacgacggccgcaacggcgagucccgcaaggaggccuucaaccgcgaguccaagauggagcccaagauggagcccaaggucgacuccuccaagauggacaaggucgacuccaagaccgacaagaccgccgacggcuucgccguccccgagccccccaagcgcaagaagucccgcugggacuccuga

SEQ ID NO: 42142 - RNA, 1947 nt, Artificial Sequence
  derived and/or modified sequence opt2 from DDX43__Homo_sapiens__NP_061135
augucccaccacggcggcgcccccaaggccuccaccugggucgucgccucccgccgcuccuccaccgucucccgcgcccccgagcgccgccccgccgaggagcucaaccgcaccggccccgagggcuacuccgucggccgcggcggccgcuggcgcggcaccucccgcccccccgaggccgucgccgccggccacgaggagcucccccucugcuucgcccucaagucccacuucgucggcgccgucaucggccgcggcggcuccaagaucaagaacauccaguccaccaccaacaccaccauccagaucauccaggagcagcccgagucccucgucaagaucuucggcuccaaggccaugcagaccaaggccaaggccgucaucgacaacuucgucaagaagcucgaggagaacuacaacuccgagugcggcaucgacaccgccuuccagcccuccgucggcaaggacggcuccaccgacaacaacgucgucgccggcgaccgcccccucaucgacugggaccagauccgcgaggagggccucaaguggcagaagaccaagugggccgaccucccccccaucaagaagaacuucuacaaggaguccaccgccaccuccgccauguccaaggucgaggccgacuccuggcgcaaggagaacuucaacaucaccugggacgaccucaaggacggcgagaagcgccccauccccaaccccaccugcaccuucgacgacgccuuccagugcuaccccgaggucauggagaacaucaagaaggccggcuuccagaagcccacccccauccagucccaggccuggcccaucguccuccagggcaucgaccucaucggcgucgcccagaccggcaccggcaagacccucugcuaccucaugcccggcuucauccaccucguccuccagcccucccucaagggccagcgcaaccgccccggcaugcucguccucacccccacccgcgagcucgcccuccaggucgagggcgagugcugcaaguacuccuacaagggccuccgcuccgucugcgucuacggcggcggcaaccgcgacgagcagaucgaggagcucaagaagggcgucgacaucaucaucgccacccccggccgccucaacgaccuccagauguccaacuucgucaaccucaagaacaucaccuaccucguccucgacgaggccgacaagaugcucgacaugggcuucgagccccagaucaugaagauccuccucgacguccgccccgaccgccagaccgucaugaccuccgccaccuggccccacuccguccaccgccucgcccaguccuaccucaaggagcccaugaucgucuacgucggcacccucgaccucgucgccgucuccuccgucaagcagaacaucaucgucaccaccgaggaggagaaguggucccacaugcagaccuuccuccaguccauguccuccaccgacaaggucaucgucuucgucucccgcaaggccgucgccgaccaccucuccuccgaccucauccucggcaacaucuccgucgagucccuccacggcgaccgcgagcagcgcgaccgcgagaaggcccucgagaacuucaagaccggcaagguccgcauccucaucgccaccgaccucgccucccgcggccucgacguccacgacgucacccacgucuacaacuucgacuucccccgcaacaucgaggaguacguccaccgcaucggccgcaccggccgcgccggccgcaccggcgucuccaucaccacccucacccgcaacgacuggcgcgucgccuccgagcucaucaacauccucgagcgcgccaaccaguccauccccgaggagcucgucuccauggccgagcgcuucaaggcccaccagcagaagcgcgagauggagcgcaagauggagcgcccccagggccgccccaagaaguuccacuga

SEQ ID NO: 42143 - RNA, 3099 nt, Artificial Sequence
  derived and/or modified sequence opt2 from DDX46__Homo_sapiens__NP_001287789
augggccgcgagucccgccacuaccgcaagcgcuccgccucccgcggccgcuccggcucccgcucccgcucccgcucccccuccgacaagcgcuccaagcgcggcgacgaccgccgcucccgcucccgcgaccgcgaccgccgccgcgagcgcucccgcucccgcgacaagcgccgcucccgcucccgcgaccgcaagcgccuccgccgcucccgcucccgcgagcgcgaccgcucccgcgagcgccgccgcucccgcucccgcgaccgccgccgcucccgcucccgcucccgcggccgccgcucccgcuccuccucccccggcaacaaguccaagaagaccgagaaccgcucccgcuccaaggagaagaccgacggcggcgaguccuccaaggagaagaagaaggacaaggacgacaaggaggacgagaaggagaaggacgccggcaacuucgaccagaacaagcucgaggaggagaugcgcaagcgcaaggagcgcgucgagaaguggcgcgaggagcagcgcaagaaggccauggagaacaucggcgagcucaagaaggagaucgaggagaugaagcagggcaagaaguggucccucgaggacgacgacgacgacgaggacgaccccgccgaggccgagaaggagggcaacgagauggagggcgaggagcucgacccccucgacgccuacauggaggaggucaaggaggaggucaagaaguucaacaugcgcuccgucaagggcggcggcggcaacgagaagaaguccggccccaccgucaccaaggucgucaccgucgucaccaccaagaaggccgucgucgacuccgacaagaagaagggcgagcucauggagaacgaccaggacgccauggaguacuccuccgaggaggaggaggucgaccuccagaccgcccucaccggcuaccagaccaagcagcgcaagcuccucgagcccgucgaccacggcaagaucgaguacgagcccuuccgcaagaacuucuacgucgagguccccgagcucgccaagaugucccaggaggaggucaacgucuuccgccucgagauggagggcaucaccgucaagggcaagggcugccccaagcccaucaaguccuggguccagugcggcaucuccaugaagauccucaacucccucaagaagcacggcuacgagaagcccacccccauccagacccaggccauccccgccaucauguccggccgcgaccucaucggcaucgccaagaccggcuccggcaagaccaucgccuuccuccuccccauguuccgccacaucauggaccagcgcucccucgaggagggcgagggccccaucgccgucaucaugacccccacccgcgagcucgcccuccagaucaccaaggagugcaagaaguucuccaagacccucggccuccgcgucgucugcgucuacggcggcaccggcaucuccgagcagaucgccgagcucaagcgcggcgccgagaucaucgucugcacccccggccgcaugaucgacaugcucgccgccaacuccggccgcgucaccaaccuccgccgcgucaccuacgucguccucgacgaggccgaccgcauguucgacaugggcuucgagccccaggucaugcgcaucgucgacaacguccgccccgaccgccagaccgucauguucuccgccaccuucccccgcgccauggaggcccucgcccgccgcauccucuccaagcccaucgagguccaggucggcggccgcuccgucgucugcuccgacgucgagcagcaggucaucgucaucgaggaggagaagaaguuccucaagcuccucgagcuccucggccacuaccaggaguccggcuccgucaucaucuucgucgacaagcaggagcacgccgacggccuccucaaggaccucaugcgcgccuccuaccccugcaugucccuccacggcggcaucgaccaguacgaccgcgacuccaucaucaacgacuucaagaacggcaccugcaagcuccucgucgccaccuccgucgccgcccgcggccucgacgucaagcaccucauccucgucgucaacuacuccugccccaaccacuacgaggacuacguccaccgcgccggccgcaccggccgcgccggcaacaagggcuacgccuacaccuucaucaccgaggaccaggcccgcuacgccggcgacaucaucaaggcccucgagcucuccggcaccgccgucccccccgaccucgagaagcucugguccgacuucaaggaccagcagaaggccgagggcaagaucaucaagaaguccuccggcuucuccggcaagggcuucaaguucgacgagaccgagcaggcccucgccaacgagcgcaagaagcuccagaaggccgcccucggccuccaggacuccgacgacgaggacgccgccgucgacaucgacgagcagaucgaguccauguucaacuccaagaagcgcgucaaggacauggccgcccccggcaccuccuccguccccgcccccaccgccggcaacgccgagaagcucgagaucgccaagcgccucgcccuccgcaucaacgcccagaagaaccucggcaucgagucccaggucgacgucaugcagcaggccaccaacgccauccuccgcggcggcaccauccucgcccccaccgucuccgccaagaccaucgccgagcagcucgccgagaagaucaacgccaagcucaacuacgucccccucgagaagcaggaggaggagcgccaggacggcggccagaacgaguccuucaagcgcuacgaggaggagcucgagaucaacgacuucccccagaccgcccgcuggaaggucaccuccaaggaggcccuccagcgcaucuccgaguacuccgaggccgccaucaccauccgcggcaccuacuucccccccggcaaggagcccaaggagggcgagcgcaagaucuaccucgccaucgaguccgccaacgagcucgccguccagaaggccaaggccgagaucacccgccucaucaaggaggagcucauccgccuccagaacuccuaccagcccaccaacaagggccgcuacaagguccucuga

SEQ ID NO: 42144 - RNA, 2073 nt, Artificial Sequence
  derived and/or modified sequence opt2 from DDX4__Homo_sapiens__NP_001136021
augggcgacgaggacugggaggccgagaucaacccccacauguccuccuacguccccaucuucgagaaggaccgcuacuccggcgagaacggcgacaacuucaaccgcacccccgccuccuccuccgagauggacgacggccccucccgccgcgaccacuucaugaaguccggcuucgccuccggccgcaacuucggcaaccgcgacgccggcgagugcaacaagcgcgacaacaccuccaccaugggcggcuucggcgucggcaaguccuucggcaaccgcggcuucuccaacucccgcuucgaggacggcgacuccuccggcuucuggcgcgaguccuccaacgacugcgaggacaaccccacccgcaaccgcggcuucuccaagcgcggcgacaacgaccucgaccccgacgagugcaugcagcgcaccggcggccucuucggcucccgccgccccguccucuccggcaccggcaacggcgacaccucccagucccgcuccggcuccggcuccgagcgcggcggcuacaagggccucaacgaggaggucaucaccggcuccggcaagaacuccuggaaguccgaggccgagggcggcgaguccuccgacacccagggccccaaggucaccuacauccccccccccccccccgaggacgaggacuccaucuucgcccacuaccagaccggcaucaacuucgacaaguacgacaccauccucgucgaggucuccggccacgacgccccccccgccauccucaccuucgaggaggccaaccucugccagacccucaacaacaacaucgccaaggccggcuacaccaagcucacccccguccagaaguacuccauccccaucauccucgccggccgcgaccucauggccugcgcccagaccggcuccggcaagaccgccgccuuccuccuccccauccucgcccacaugaugcacgacggcaucaccgccucccgcuucaaggagcuccaggagcccgagugcaucaucgucgcccccacccgcgagcucgucaaccagaucuaccucgaggcccgcaaguucuccuucggcaccugcguccgcgccgucgucaucuacggcggcacccagcucggccacuccauccgccagaucguccagggcugcaacauccucugcgccacccccggccgccucauggacaucaucggcaaggagaagaucggccucaagcagaucaaguaccucguccucgacgaggccgaccgcaugcucgacaugggcuucggccccgagaugaagaagcucaucuccugccccggcaugcccuccaaggagcagcgccagacccucauguucuccgccaccuuccccgaggagauccagcgccucgccgccgaguuccucaaguccaacuaccucuucgucgccgucggccaggucggcggcgccugccgcgacguccagcagaccguccuccaggucggccaguucuccaagcgcgagaagcucgucgagauccuccgcaacaucggcgacgagcgcaccauggucuucgucgagaccaagaagaaggccgacuucaucgccaccuuccucugccaggagaagaucuccaccaccuccauccacggcgaccgcgagcagcgcgagcgcgagcaggcccucggcgacuuccgcuucggcaagugccccguccucgucgccaccuccgucgccgcccgcggccucgacaucgagaacguccagcacgucaucaacuucgaccuccccuccaccaucgacgaguacguccaccgcaucggccgcaccggccgcugcggcaacaccggccgcgccaucuccuucuucgaccucgaguccgacaaccaccucgcccagccccucgucaagguccucaccgacgcccagcaggacguccccgccuggcucgaggagaucgccuucuccaccuacauccccggcuucuccggcuccacccgcggcaacgucuucgccuccgucgacacccgcaagggcaaguccacccucaacaccgccggcuucuccuccucccaggcccccaaccccgucgacgacgaguccugggacuga

SEQ ID NO: 42145 - RNA, 2214 nt, Artificial Sequence
  derived and/or modified sequence opt2 from DDX50__Homo_sapiens__NP_076950
augcccggcaagcuccucuggggcgacaucauggagcucgaggccccccucgaggaguccgagucccagaagaaggagcgccagaaguccgaccgccgcaagucccgccaccacuacgacuccgacgagaaguccgagacccgcgagaacggcgucaccgacgaccucgacgcccccaaggccaagaaguccaagaugaaggagaagcucaacggcgacaccgaggagggcuucaaccgccucuccgacgaguucuccaagucccacaagucccgccgcaaggaccuccccaacggcgacaucgacgaguacgagaagaaguccaagcgcgucuccucccucgacaccuccacccacaaguccuccgacaacaagcucgaggagacccucacccgcgagcagaaggagggcgccuucuccaacuuccccaucuccgaggagaccaucaagcuccucaagggccgcggcgucaccuaccucuuccccauccaggucaagaccuucggccccgucuacgagggcaaggaccucaucgcccaggcccgcaccggcaccggcaagaccuucuccuucgccaucccccucaucgagcgccuccagcgcaaccaggagaccaucaagaagucccgcucccccaagguccucguccucgcccccacccgcgagcucgccaaccaggucgccaaggacuucaaggacaucacccgcaagcucuccgucgccugcuucuacggcggcaccuccuaccagucccagaucaaccacauccgcaacggcaucgacauccucgucggcacccccggccgcaucaaggaccaccuccaguccggccgccucgaccucuccaagcuccgccacgucguccucgacgaggucgaccagaugcucgaccucggcuucgccgagcaggucgaggacaucauccacgaguccuacaagaccgacuccgaggacaacccccagacccuccucuucuccgccaccugcccccagugggucuacaaggucgccaagaaguacaugaagucccgcuacgagcaggucgaccucgucggcaagaugacccagaaggccgccaccaccgucgagcaccucgccauccagugccacuggucccagcgccccgccgucaucggcgacguccuccaggucuacuccggcuccgagggccgcgccaucaucuucugcgagaccaagaagaacgucaccgagauggccaugaacccccacaucaagcagaacgcccagugccuccacggcgacaucgcccagucccagcgcgagaucacccucaagggcuuccgcgagggcuccuucaagguccucgucgccaccaacgucgccgcccgcggccucgacauccccgaggucgaccucgucauccaguccucccccccccaggacgucgaguccuacauccaccgcuccggccgcaccggccgcgccggccgcaccggcaucugcaucugcuucuaccagccccgcgagcgcggccagcuccgcuacgucgagcagaaggccggcaucaccuucaagcgcgucggcguccccuccaccauggaccucgucaaguccaaguccauggacgccauccgcucccucgccuccgucuccuacgccgccgucgacuucuuccgccccuccgcccagcgccucaucgaggagaagggcgccgucgacgcccucgccgccgcccucgcccacaucuccggcgccuccuccuucgagccccgcucccucaucaccuccgacaagggcuucgucaccaugacccucgagucccucgaggagauccaggacgucuccugcgccuggaaggagcucaaccgcaagcucuccuccaacgccgucucccagaucacccgcaugugccuccucaagggcaacaugggcgucugcuucgacguccccaccaccgaguccgagcgccuccaggccgaguggcacgacuccgacuggauccucuccguccccgccaagcuccccgagaucgaggaguacuacgacggcaacaccuccuccaacucccgccagcgcuccggcugguccuccggccgcuccggccgcuccggccgcuccggcggccgcuccggcggccgcuccggccgccagucccgccagggcucccgcuccggcucccgccaggacggccgccgccgcuccggcaaccgcaaccgcucccgcuccggcggccacaagcgcuccuucgacuga

SEQ ID NO: 42146 - RNA, 2001 nt, Artificial Sequence
  derived and/or modified sequence opt2 from DDX51__Homo_sapiens__NP_778236
auggcccucuucuacgucgcccgcuaccccggccccgacgccgccgccgccgccggccccgagggcgccgaggccggcgcccacggccgcgcccgcgcccuccucgagcgccuccagucccgcgcccgcgagcgccagcagcagcgcgagcccgcccagaccgaggccgccgccuccaccgagcccgccacccgccgccgccgccgcccccgccgccgccgccgcgucaacgacgccgagcccggcucccccgaggccccccagggcaagcgccgcaaggccgacggcgaggacgccggcgccgaguccaacgaggaggcccccggcgagcccuccgccggcuccuccgaggaggcccccggcgagcccuccgccggcuccuccgaggaggcccccggcgagcgcuccaccuccgccuccgccgaggccgcccccgacggccccgcccucgaggaggccgccggcccccucguccccggccucguccucggcggcuucggcaagcgcaaggcccccaagguccagcccuuccucccccgcuggcucgccgagcccaacugcguccgccgcaacgucaccgaggaccucguccccaucgaggacauccccgacguccaccccgaccuccagaagcagcuccgcgcccacggcaucuccuccuacuuccccguccaggccgccgucauccccgcccuccucgaguccgccgccugcggcuuccucgucggccgcggcggcuaccgccccuccgaccucugcgucuccgcccccaccggcuccggcaagacccucgccuucgucauccccgucguccaggcccuccucucccgcgucgucugccacauccgcgcccucgucguccuccccaccaaggagcucgcccagcaggucuccaaggucuucaacaucuacaccgacgccaccccccuccgcgucucccucgucaccggccagaagucccucgccaaggagcaggagucccucguccagaagaccgccgacggcuaccgcugccucgccgacaucgucgucgccacccccggccgccucgucgaccacaucgaccagacccccggcuucucccuccagcagcuccgcuuccucaucaucgacgaggccgaccgcaugaucgacuccaugcaccaguccuggcucccccgcgucgucgccgccgccuuccaguccgaggaccccgccgaccccugcgcccuccuccagcgccgccaggcccaggccgucaccgccgccuccaccugcugcccccagaugccccuccagaagcuccucuucuccgccacccucacccagaaccccgagaagcuccagcagcucggccuccaccagccccgccucuucuccaccggccucgcccaccgcggccucgaggacaccgacggcgacggcgacuccggcaaguacgccuuccccgucggccucacccaccacuacguccccugcucccucuccuccaagccccucgucguccuccaccucguccucgagaugggcuucucccgcguccucugcuucaccaacucccgcgagaacucccaccgccucuuccuccucguccaggccuucggcggcgucgacgucgccgaguucuccucccgcuacggccccggccagcgccgcaugauccucaagcaguucgagcagggcaagauccagcuccucaucuccaccgacgccaccgcccgcggcaucgacguccagggcgucgagcucgucgucaacuacgacgccccccaguaccuccgcaccuacguccaccgcgucggccgcaccgcccgcgccggcaagaccggccaggccuucacccuccuccucaagguccaggagcgccgcuuccuccgcaugcucaccgaggccggcgcccccgagcuccagcgccacgagcucuccuccaagcuccuccagccccucgucccccgcuacgaggaggcccucucccagcucgaggaguccgucaaggaggagcgcaagcagcgcgccgccuga

SEQ ID NO: 42147 - RNA, 1800 nt, Artificial Sequence
  derived and/or modified sequence opt2 from DDX52__Homo_sapiens__NP_008941
auggacguccacgaccucuuccgccgccucggcgccggcgccaaguucgacacccgccgcuucuccgccgacgccgcccgcuuccagaucggcaagcgcaaguacgacuucgacuccuccgagguccuccagggccucgacuucuucggcaacaagaaguccguccccggcgucugcggcgccucccagacccaccagaagccccagaacggcgagaagaaggaggagucccucaccgagcgcaagcgcgagcaguccaagaagaagcgcaagaccaugaccuccgagaucgccucccaggaggagggcgccaccauccaguggauguccuccgucgaggccaagaucgaggacaagaagguccagcgcgaguccaagcucaccuccggcaagcucgagaaccuccgcaaggagaagaucaacuuccuccgcaacaagcacaagauccacguccagggcaccgaccuccccgaccccaucgccaccuuccagcagcucgaccaggaguacaagaucaacucccgccuccuccagaacauccucgacgccggcuuccagaugcccacccccauccagaugcaggccauccccgucaugcuccacggccgcgagcuccucgccuccgcccccaccggcuccggcaagacccucgccuucuccauccccauccucaugcagcucaagcagcccgccaacaagggcuuccgcgcccucaucaucucccccacccgcgagcucgccucccagauccaccgcgagcucaucaagaucuccgagggcaccggcuuccgcauccacaugauccacaaggccgccgucgccgccaagaaguucggccccaaguccuccaagaaguucgacauccucgucaccacccccaaccgccucaucuaccuccucaagcaggacccccccggcaucgaccucgccuccgucgaguggcucgucgucgacgaguccgacaagcucuucgaggacggcaagaccggcuuccgcgaccagcucgccuccaucuuccucgccugcaccucccacaagguccgccgcgccauguucuccgccaccuucgccuacgacgucgagcaguggugcaagcucaaccucgacaacgucaucuccgucuccaucggcgcccgcaacuccgccgucgagaccgucgagcaggagcuccucuucgucggcuccgagaccggcaagcuccucgccguccgcgagcucgucaagaagggcuucaacccccccguccucgucuucguccaguccaucgagcgcgccaaggagcucuuccacgagcucaucuacgagggcaucaacgucgacgucauccacgccgagcgcacccagcagcagcgcgacaacaccguccacuccuuccgcgccggcaagaucuggguccucaucugcaccgcccuccucgcccgcggcaucgacuucaagggcgucaaccucgucaucaacuacgacuuccccaccuccuccgucgaguacauccaccgcaucggccgcaccggccgcgccggcaacaagggcaaggccaucaccuucuucaccgaggacgacaagccccuccuccgcuccgucgccaacgucauccagcaggccggcugccccguccccgaguacaucaagggcuuccagaagcuccucuccaagcagaagaagaagaugaucaagaagccccucgagcgcgaguccaucuccaccacccccaagugcuuccucgagaaggccaaggacaagcagaagaaggucaccggccagaacuccaagaagaaggucgcccucgaggacaaguccuga

SEQ ID NO: 42148 - RNA, 1896 nt, Artificial Sequence
  derived and/or modified sequence opt2 from DDX53__Homo_sapiens__NP_874358
augucccacugggcccccgaguggaagcgcgccgaggccaacccccgcgaccucggcgccuccugggacguccgcggcucccgcggcuccggcugguccggccccuucggccaccagggcccccgcgccgccggcucccgcgagcccccccucugcuucaagaucaagaacaacauggucggcgucgucaucggcuacuccggcuccaagaucaaggaccuccagcacuccaccaacaccaagauccagaucaucaacggcgaguccgaggccaagguccgcaucuucggcaaccgcgagaugaaggccaaggccaaggccgccaucgagacccucauccgcaagcaggaguccuacaacuccgaguccuccgucgacaacgccgccucccagacccccaucggccgcaaccucggccgcaacgacaucgucggcgaggccgagccccucuccaacugggaccgcauccgcgccgccgucgucgagugcgagaagcgcaagugggccgaccucccccccgucaagaagaacuucuacaucgaguccaaggccaccuccugcauguccgagaugcaggucaucaacuggcgcaaggagaacuucaacaucaccugcgacgaccucaaguccggcgagaagcgccucauccccaagcccaccugccgcuucaaggacgccuuccagcaguaccccgaccuccucaaguccaucauccgcgucggcaucgucaagcccacccccauccagucccaggccuggcccaucauccuccagggcaucgaccucaucgucgucgcccagaccggcaccggcaagacccucuccuaccucaugcccggcuucauccaccucgacucccagcccaucucccgcgagcagcgcaacggccccggcaugcucguccucacccccacccgcgagcucgcccuccacgucgaggccgagugcuccaaguacuccuacaagggccucaaguccaucugcaucuacggcggccgcaaccgcaacggccagaucgaggacaucuccaagggcgucgacaucaucaucgccacccccggccgccucaacgaccuccagaugaacaacuccgucaaccuccgcuccaucaccuaccucgucaucgacgaggccgacaagaugcucgacauggaguucgagccccagauccgcaagauccuccucgacguccgccccgaccgccagaccgucaugaccuccgccaccuggcccgacaccguccgccagcucgcccucuccuaccucaaggaccccaugaucgucuacgucggcaaccucaaccucgucgccgucaacaccgucaagcagaacaucaucgucaccaccgagaaggagaagcgcgcccucacccaggaguucgucgagaacaugucccccaacgacaaggucaucauguucgucucccagaagcacaucgccgacgaccucuccuccgacuucaacauccagggcaucuccgccgagucccuccacggcaacuccgagcaguccgaccaggagcgcgccgucgaggacuucaaguccggcaacaucaagauccucaucaccaccgacaucgucucccgcggccucgaccucaacgacgucacccacgucuacaacuacgacuucccccgcaacaucgacgucuacguccaccgcgucggcuacaucggccgcaccggcaagaccggcaccuccgucacccucaucacccagcgcgacuccaagauggccggcgagcucaucaagauccucgaccgcgccaaccaguccguccccgaggaccucgucgucauggccgagcaguacaagcucaaccagcagaagcgccaccgcgagacccgcucccgcaagcccggccagcgccgcaaggaguucuacuuccucuccuga

SEQ ID NO: 42149 - RNA, 2649 nt, Artificial Sequence
  derived and/or modified sequence opt2 from DDX54__Homo_sapiens__NP_001104792
auggccgccgacaagggccccgccgccggcccccgcucccgcgccgccauggcccaguggcgcaagaagaagggccuccgcaagcgccgcggcgccgccucccaggcccgcggcuccgacuccgaggacggcgaguucgagauccaggccgaggacgacgcccgcgcccgcaagcucggccccggccgcccccuccccaccuuccccaccuccgagugcaccuccgacgucgagcccgacacccgcgagaugguccgcgcccagaacaagaagaagaagaaguccggcggcuuccaguccaugggccucuccuaccccgucuucaagggcaucaugaagaagggcuacaagguccccacccccauccagcgcaagaccauccccgucauccucgacggcaaggacgucgucgccauggcccgcaccggcuccggcaagaccgccugcuuccuccuccccauguucgagcgccucaagacccacuccgcccagaccggcgcccgcgcccucauccucucccccacccgcgagcucgcccuccagacccucaaguucaccaaggagcucggcaaguucaccggccucaagaccgcccucauccucggcggcgaccgcauggaggaccaguucgccgcccuccacgagaaccccgacaucaucaucgccacccccggccgccucguccacgucgccgucgagaugucccucaagcuccaguccgucgaguacgucgucuucgacgaggccgaccgccucuucgagaugggcuucgccgagcagcuccaggagaucaucgcccgccuccccggcggccaccagaccguccucuucuccgccacccuccccaagcuccucgucgaguucgcccgcgccggccucaccgagcccguccucauccgccucgacgucgacaccaagcucaacgagcagcucaagaccuccuucuuccucguccgcgaggacaccaaggccgccguccuccuccaccuccuccacaacgucguccgcccccaggaccagaccgucgucuucgucgccaccaagcaccacgccgaguaccucaccgagcuccucaccacccagcgcgucuccugcgcccacaucuacuccgcccucgaccccaccgcccgcaagaucaaccucgccaaguucacccucggcaagugcuccacccucaucgucaccgaccucgccgcccgcggccucgacaucccccuccucgacaacgucaucaacuacuccuuccccgccaagggcaagcucuuccuccaccgcgucggccgcgucgcccgcgccggccgcuccggcaccgccuacucccucgucgcccccgacgagauccccuaccuccucgaccuccaccucuuccucggccgcucccucacccucgcccgcccccucaaggagcccuccggcgucgccggcgucgacggcaugcucggccgcgucccccaguccgucgucgacgaggaggacuccggccuccaguccacccucgaggccucccucgagcuccgcggccucgcccgcgucgccgacaacgcccagcagcaguacguccgcucccgccccgcccccucccccgaguccaucaagcgcgccaaggagauggaccucgucggccucggccuccacccccucuucuccucccgcuucgaggaggaggagcuccagcgccuccgccucgucgacuccaucaagaacuaccgcucccgcgccaccaucuucgagaucaacgccuccucccgcgaccucugcucccaggucaugcgcgccaagcgccagaaggaccgcaaggccaucgcccgcuuccagcagggccagcagggccgccaggagcagcaggagggccccgucggccccgcccccucccgccccgcccuccaggagaagcagcccgagaaggaggaggaggaggaggccggcgaguccgucgaggacaucuucuccgaggucgucggccgcaagcgccagcgcuccggccccaaccgcggcgccaagcgccgccgcgaggaggcccgccagcgcgaccaggaguucuacauccccuaccgccccaaggacuucgacuccgagcgcggccucuccaucuccggcgagggcggcgccuucgagcagcaggccgccggcgccguccucgaccucaugggcgacgaggcccagaaccucacccgcggccgccagcagcucaagugggaccgcaagaagaagcgcuucgucggccaguccggccaggaggacaagaagaagaucaagaccgaguccggccgcuacaucuccuccuccuacaagcgcgaccucuaccagaaguggaagcagaagcagaagaucgacgaccgcgacuccgacgaggagggcgccuccgaccgccgcggccccgagcgccgcggcggcaagcgcgaccgcggccaggccggcgccucccgcccccacgcccccggcacccccgccggccgcguccgccccgagcucaagaccaagcagcagauccucaagcagcgccgccgcgcccagaagcuccacuuccuccagcgcggcggccucaagcagcucuccgcccgcaaccgccgccgcguccaggagcuccagcagggcgccuucggccgcggcgcccgcuccaagaagggcaagaugcgcaagcgcauguga

SEQ ID NO: 42150 - RNA, 1524 nt, Artificial Sequence
  derived and/or modified sequence opt2 from DDX56__Homo_sapiens__NP_001244118
auggaggacuccgaggcccucggcuucgagcacaugggccucgacccccgccuccuccaggccgucaccgaccucggcuggucccgccccacccucauccaggagaaggccaucccccucgcccucgagggcaaggaccuccucgcccgcgcccgcaccggcuccggcaagaccgccgccuacgccauccccaugcuccagcuccuccuccaccgcaaggccaccggccccgucgucgagcaggccguccgcggccucguccucguccccaccaaggagcucgcccgccaggcccaguccaugauccagcagcucgccaccuacugcgcccgcgacguccgcgucgccaacgucuccgccgccgaggacuccgucucccagcgcgccguccucauggagaagcccgacgucgucgucggcacccccucccgcauccucucccaccuccagcaggacucccucaagcuccgcgacucccucgagcuccucgucgucgacgaggccgaccuccucuucuccuucggcuucgaggaggagcucaagucccuccucugccaccucccccgcaucuaccaggccuuccucauguccgccaccuucaacgaggacguccaggcccucaaggagcucauccuccacaaccccgucacccucaagcuccaggagucccagcuccccggccccgaccagcuccagcaguuccaggucgucugcgagaccgaggaggacaaguuccuccuccucuacgcccuccucaagcucucccucauccgcggcaagucccuccucuucgucaacacccucgagcgcuccuaccgccuccgccucuuccucgagcaguucuccauccccaccugcguccucaacggcgagcucccccuccgcucccgcgccuccgaccccgaggccggcgucgcccgcggcaucgacuuccaccacgucuccgccguccucaacuucgaccucccccccacccccgaggccuacauccaccgcgccggccgcaccgcccgcgccaacaaccccggcaucguccucaccuucguccuccccaccgagcaguuccaccucggcaagaucgaggagcuccucuccggcgagaaccgcggccccauccuccuccccuaccaguuccgcauggaggagaucgagggcuuccgcuaccgcugccgcgacgccaugcgcuccgucaccaagcaggccauccgcgaggcccgccucaaggagaucaaggaggagcuccuccacuccgagaagcucaagaccuacuucgaggacaacccccgcgaccuccagcuccuccgccacgaccucccccuccaccccgccgucgucaagccccaccucggccacguccccgacuaccucgucccccccgcccuccgcggccucguccgcccccacaagaagcgcaagaagcucuccuccuccugccgcaaggccaagcgcgccaagucccagaacccccuccgcuccuucaagcacaagggcaagaaguuccgccccaccgccaagcccuccuga

SEQ ID NO: 42151 - RNA, 2778 nt, Artificial Sequence
  derived and/or modified sequence opt2 from DDX58__Homo_sapiens__NP_055129
augaccaccgagcagcgccgcucccuccaggccuuccaggacuacauccgcaagacccucgaccccaccuacauccucuccuacauggcccccugguuccgcgaggaggagguccaguacauccaggccgagaagaacaacaagggccccauggaggccgccacccucuuccucaaguuccuccucgagcuccaggaggagggcugguuccgcggcuuccucgacgcccucgaccacgccggcuacuccggccucuacgaggccaucgaguccugggacuucaagaagaucgagaagcucgaggaguaccgccuccuccucaagcgccuccagcccgaguucaagacccgcaucauccccaccgacaucaucuccgaccucuccgagugccucaucaaccaggagugcgaggagauccuccagaucugcuccaccaagggcaugauggccggcgccgagaagcucgucgagugccuccuccgcuccgacaaggagaacuggcccaagacccucaagcucgcccucgagaaggagcgcaacaaguucuccgagcucuggaucgucgagaagggcaucaaggacgucgagaccgaggaccucgaggacaagauggagaccuccgacauccagaucuucuaccaggaggaccccgagugccagaaccucuccgagaacuccugcccccccuccgaggucuccgacaccaaccucuacucccccuucaagccccgcaacuaccagcucgagcucgcccuccccgccaugaagggcaagaacaccaucaucugcgcccccaccggcugcggcaagaccuucgucucccuccucaucugcgagcaccaccucaagaaguucccccagggccagaagggcaaggucgucuucuucgccaaccagauccccgucuacgagcagcagaaguccgucuucuccaaguacuucgagcgccacggcuaccgcgucaccggcaucuccggcgccaccgccgagaacguccccgucgagcagaucgucgagaacaacgacaucaucauccucaccccccagauccucgucaacaaccucaagaagggcaccauccccucccucuccaucuucacccucaugaucuucgacgagugccacaacaccuccaagcagcaccccuacaacaugaucauguucaacuaccucgaccagaagcucggcggcuccuccggcccccucccccaggucaucggccucaccgccuccgucggcgucggcgacgccaagaacaccgacgaggcccucgacuacaucugcaagcucugcgccucccucgacgccuccgucaucgccaccgucaagcacaaccucgaggagcucgagcaggucgucuacaagccccagaaguucuuccgcaaggucgagucccgcaucuccgacaaguucaaguacaucaucgcccagcucaugcgcgacaccgagucccucgccaagcgcaucugcaaggaccucgagaaccucucccagauccagaaccgcgaguucggcacccagaaguacgagcaguggaucgucaccguccagaaggccugcauggucuuccagaugcccgacaaggacgaggagucccgcaucugcaaggcccucuuccucuacaccucccaccuccgcaaguacaacgacgcccucaucaucuccgagcacgcccgcaugaaggacgcccucgacuaccucaaggacuucuucuccaacguccgcgccgccggcuucgacgagaucgagcaggaccucacccagcgcuucgaggagaagcuccaggagcucgaguccgucucccgcgaccccuccaacgagaaccccaagcucgaggaccucugcuucauccuccaggaggaguaccaccucaaccccgagaccaucaccauccucuucgucaagacccgcgcccucgucgacgcccucaagaacuggaucgagggcaaccccaagcucuccuuccucaagcccggcauccucaccggccgcggcaagaccaaccagaacaccggcaugacccuccccgcccagaagugcauccucgacgccuucaaggccuccggcgaccacaacauccucaucgccaccuccgucgccgacgagggcaucgacaucgcccagugcaaccucgucauccucuacgaguacgucggcaacgucaucaagaugauccagacccgcggccgcggccgcgcccgcggcuccaagugcuuccuccucaccuccaacgccggcgucaucgagaaggagcagaucaacauguacaaggagaagaugaugaacgacuccauccuccgccuccagaccugggacgaggccgucuuccgcgagaagauccuccacauccagacccacgagaaguucauccgcgacucccaggagaagcccaagcccguccccgacaaggagaacaagaagcuccucugccgcaagugcaaggcccucgccugcuacaccgccgacguccgcgucaucgaggagugccacuacaccguccucggcgacgccuucaaggagugcuucgucucccgcccccaccccaagcccaagcaguucuccuccuucgagaagcgcgccaagaucuucugcgcccgccagaacugcucccacgacuggggcauccacgucaaguacaagaccuucgagauccccgucaucaagaucgaguccuucgucgucgaggacaucgccaccggcguccagacccucuacuccaaguggaaggacuuccacuucgagaagauccccuucgaccccgccgagauguccaaguga

SEQ ID NO: 42152 - RNA, 1860 nt, Artificial Sequence
  derived and/or modified sequence opt2 from DDX59__Homo_sapiens__NP_001026895
auguucgucccccgcucccucaagaucaagcgcaacgccaacgacgacggcaaguccugcgucgccaagaucaucaagcccgaccccgaggaccuccagcucgacaagucccgcgacguccccgucgacgccgucgccaccgaggccgccaccaucgaccgccacaucuccgaguccugccccuuccccucccccggcggccagcucgccgagguccacuccgucucccccgagcagggcgccaaggacucccaccccuccgaggagcccgucaaguccuucuccaagacccagcgcugggccgagcccggcgagcccaucugcgucgucugcggccgcuacggcgaguacaucugcgacaagaccgacgaggacgucugcucccucgagugcaaggccaagcaccuccuccaggucaaggagaaggaggagaaguccaagcucuccaacccccagaaggccgacuccgagcccgaguccccccucaacgccuccuacgucuacaaggagcaccccuucauccucaaccuccaggaggaccagaucgagaaccucaagcagcagcucggcauccucguccagggccaggaggucacccgccccaucaucgacuucgagcacugcucccuccccgagguccucaaccacaaccucaagaaguccggcuacgagguccccacccccauccagaugcagaugauccccgucggccuccucggccgcgacauccucgccuccgccgacaccggcuccggcaagaccgccgccuuccuccuccccgucaucaugcgcgcccucuucgaguccaagacccccuccgcccucauccucacccccacccgcgagcucgccauccagaucgagcgccaggccaaggagcucauguccggccucccccgcaugaagaccguccuccucgucggcggccucccccuccccccccagcucuaccgccuccagcagcacgucaaggucaucaucgccacccccggccgccuccucgacaucaucaagcaguccuccgucgagcucugcggcgucaagaucgucgucgucgacgaggccgacaccaugcucaagaugggcuuccagcagcagguccucgacauccucgagaacauccccaacgacugccagaccauccucgucuccgccaccauccccaccuccaucgagcagcucgccucccagcuccuccacaaccccguccgcaucaucaccggcgagaagaaccuccccugcgccaacguccgccagaucauccucugggucgaggaccccgccaagaagaagaagcucuucgagauccucaacgacaagaagcucuucaagccccccguccucgucuucgucgacugcaagcucggcgccgaccuccucuccgaggccguccagaagaucaccggccucaaguccaucuccauccacuccgagaagucccagaucgagcgcaagaacauccucaagggccuccucgagggcgacuacgaggucgucgucuccaccggcguccucggccgcggccucgaccucaucuccguccgccucgucgucaacuucgacaugcccuccuccauggacgaguacguccaccagaucggccgcgucggccgccucggccagaacggcaccgccaucaccuucaucaacaacaacuccaagcgccucuucugggacaucgccaagcgcgucaagcccaccggcuccauccuccccccccagcuccucaacucccccuaccuccacgaccagaagcgcaaggagcagcagaaggacaagcagacccagaacgaccucgucaccggcgccaaccucauggacaucauccgcaagcacgacaaguccaacucccagaaguga

SEQ ID NO: 42153 - RNA, 1845 nt, Artificial Sequence
  derived and/or modified sequence opt2 from DDX5__Homo_sapiens__NP_004387
auguccggcuacuccuccgaccgcgaccgcggccgcgaccgcggcuucggcgccccccgcuucggcggcucccgcgccggcccccucuccggcaagaaguucggcaaccccggcgagaagcucgucaagaagaaguggaaccucgacgagcuccccaaguucgagaagaacuucuaccaggagcaccccgaccucgcccgccgcaccgcccaggaggucgagaccuaccgccgcuccaaggagaucaccguccgcggccacaacugccccaagcccguccucaacuucuacgaggccaacuuccccgccaacgucauggacgucaucgcccgccagaacuucaccgagcccaccgccauccaggcccagggcuggcccgucgcccucuccggccucgacauggucggcgucgcccagaccggcuccggcaagacccucuccuaccuccuccccgccaucguccacaucaaccaccagcccuuccucgagcgcggcgacggccccaucugccucguccucgcccccacccgcgagcucgcccagcagguccagcaggucgccgccgaguacugccgcgccugccgccucaaguccaccugcaucuacggcggcgcccccaagggcccccagauccgcgaccucgagcgcggcgucgagaucugcaucgccacccccggccgccucaucgacuuccucgagugcggcaagaccaaccuccgccgcaccaccuaccucguccucgacgaggccgaccgcaugcucgacaugggcuucgagccccagauccgcaagaucgucgaccagauccgccccgaccgccagacccucaugugguccgccaccuggcccaaggagguccgccagcucgccgaggacuuccucaaggacuacauccacaucaacaucggcgcccucgagcucuccgccaaccacaacauccuccagaucgucgacgucugccacgacgucgagaaggacgagaagcucauccgccucauggaggagaucauguccgagaaggagaacaagaccaucgucuucgucgagaccaagcgccgcugcgacgagcucacccgcaagaugcgccgcgacggcuggcccgccaugggcauccacggcgacaagucccagcaggagcgcgacuggguccucaacgaguucaagcacggcaaggcccccauccucaucgccaccgacgucgccucccgcggccucgacgucgaggacgucaaguucgucaucaacuacgacuaccccaacuccuccgaggacuacauccaccgcaucggccgcaccgcccgcuccaccaagaccggcaccgccuacaccuucuucacccccaacaacaucaagcaggucuccgaccucaucuccguccuccgcgaggccaaccaggccaucaaccccaagcuccuccagcucgucgaggaccgcggcuccggccgcucccgcggccgcggcggcaugaaggacgaccgccgcgaccgcuacuccgccggcaagcgcggcggcuucaacaccuuccgcgaccgcgagaacuacgaccgcggcuacuccucccuccucaagcgcgacuucggcgccaagacccagaacggcgucuacuccgccgccaacuacaccaacggcuccuucggcuccaacuucgucuccgccggcauccagaccuccuuccgcaccggcaaccccaccggcaccuaccagaacggcuacgacuccacccagcaguacggcuccaacguccccaacaugcacaacggcaugaaccagcaggccuacgccuaccccgccaccgccgccgcccccaugaucggcuaccccaugcccaccggcuacucccaguga

SEQ ID NO: 42154 - RNA, 5139 nt, Artificial Sequence
  derived and/or modified sequence opt2 from DDX60__Homo_sapiens__NP_060101
auggagcgcaacguccucaccaccuucucccaggagaugucccagcucauccucaacgagaugcccaaggccgaguacuccucccucuucaacgacuucgucgaguccgaguucuuccucaucgacggcgacucccuccucaucaccugcaucugcgagaucuccuucaagcccggccagaaccuccacuucuucuaccucgucgagcgcuaccucgucgaccucaucuccaagggcggccaguucaccaucgucuucuucaaggacgccgaguacgccuacuucaacuuccccgagcuccucucccuccgcaccgcccucauccuccaccuccagaagaacaccaccaucgacguccgcaccaccuucucccgcugccucuccaaggaguggggcuccuuccucgaggaguccuaccccuacuuccucaucgucgccgacgagggccucaacgaccuccagacccagcucuucaacuuccucaucauccacuccugggcccgcaaggucaacgucguccucuccuccggccaggaguccgacguccucugccucuacgccuaccuccuccccuccauguaccgccaccagaucuucuccuggaagaacaagcagaacaucaaggacgccuacaccacccuccucaaccagcucgagcgcuucaagcucuccgcccucgccccccucuucggcucccucaaguggaacaacaucaccgaggaggcccacaagaccgucucccuccucacccaggucuggcccgagggcuccgacauccgccgcgucuucugcgucaccuccugcucccucucccuccgcauguaccaccgcuuccucggcaaccgcgagcccuccuccggccaggagaccgagauccagcaggucaacuccaacugccucacccuccaggagauggaggaccucugcaagcuccacugccucaccgucgucuuccuccuccaccucccccucucccagcgcgccugcgcccgcgucaucaccucccacugggccgaggacaugaagccccuccuccagaugaagaaguggugcgaguacuucauccuccgcaacauccacaccuucgaguucuggaaccucaaccucauccaccucuccgaccucaacgacgagcuccuccucaagaacaucgccuucuacuacgagaacgagaacgucaagggccuccaccucaaccucggcgacaccaucaugaaggacuacgaguaccucuggaacaccgucuccaagcucguccgcgacuucgaggucggccagcccuucccccuccgcaccaccaaggucugcuuccucgagaagaagcccucccccaucaaggacuccuccaacgagaugguccccaaccucggcuucauccccaccuccuccuucgucgucgacaaguucgccggcgacauccucaaggaccuccccuuccucaaguccgacgaccccaucgucaccucccucgucaagcagaaggaguucgacgagcucguccacuggcacucccacaagccccucuccgacgacuacgaccgcucccgcugccaguucgacgagaagucccgcgacccccgcguccuccgcuccguccagaaguaccacgucuuccagcgcuucuacggcaacucccucgagaccgucuccuccaagaucaucgucacccagaccaucaaguccaagaaggacuucuccggccccaaguccaagaaggcccacgagaccaaggccgagaucaucgcccgcgagaacaagaagcgccucuucgcccgcgaggagcagaaggaggagcagaaguggaacgcccucuccuucuccaucgaggagcagcucaaggagaaccuccacuccggcaucaagucccucgaggacuuccucaaguccugcaaguccuccugcgucaagcuccaggucgagauggucggccucaccgccugccucaaggccuggaaggagcacugccgcuccgaggagggcaagaccaccaaggaccucuccaucgccguccaggucaugaagcgcauccacucccucauggagaaguacuccgagcuccuccaggaggacgaccgccagcucaucgcccgcugccucaaguaccucggcuucgacgagcucgccuccucccuccaccccgcccaggacgccgagaacgacgucaaggucaagaagcgcaacaaguacuccgucggcaucggccccgcccgcuuccagcuccaguacaugggccacuaccucauccgcgacgagcgcaaggaccccgacccccgcguccaggacuucauccccgacaccuggcagcgcgagcuccucgacgucgucgacaagaacgaguccgccgucaucgucgcccccaccuccuccggcaagaccuacgccuccuacuacugcauggagaagguccucaaggaguccgacgacggcgucgucgucuacgucgcccccaccaaggcccucgucaaccaggucgccgccaccguccagaaccgcuucaccaagaaccuccccuccggcgagguccucugcggcgucuucacccgcgaguaccgccacgacgcccucaacugccagguccucaucaccguccccgccugcuucgagauccuccuccucgccccccaccgccagaacugggucaagaagauccgcuacgucaucuucgacgagguccacugccucggcggcgagaucggcgccgagaucugggagcaccuccucgucaugauccgcugccccuuccucgcccucuccgccaccaucuccaaccccgagcaccucaccgaguggcuccaguccgucaagugguacuggaagcaggaggacaagaucaucgagaacaacaccgccuccaagcgccacgucggccgccaggccggcuuccccaaggacuaccuccaggucaagcaguccuacaagguccgccucguccucuacggcgagcgcuacaacgaccucgagaagcacgucugcuccaucaagcacggcgacauccacuucgaccacuuccaccccugcgccgcccucaccaccgaccacaucgagcgcuacggcuucccccccgaccucacccucuccccccgcgaguccauccagcucuacgacgccauguuccagaucuggaaguccuggccccgcgcccaggagcucugccccgagaacuucauccacuucaacaacaagcucgucaucaagaagauggacgcccgcaaguacgaggagucccucaaggccgagcucaccuccuggaucaagaacggcaacgucgagcaggcccgcaugguccuccagaaccucucccccgaggccgaccucucccccgagaacaugaucaccauguucccccuccucgucgagaagcuccgcaagauggagaagcuccccgcccucuucuuccucuucaagcucggcgccgucgagaacgccgccgaguccgucuccaccuuccucaagaagaagcaggagaccaagcgcccccccaaggccgacaaggaggcccacgucauggccaacaagcuccgcaaggucaagaaguccaucgagaagcagaagaucaucgacgagaagucccagaagaagacccgcaacgucgaccagucccucauccacgaggccgagcacgacaaccucgucaagugccucgagaagaaccucgagaucccccaggacugcaccuacgccgaccagaaggccgucgacaccgagacccuccagaaggucuucggccgcgucaaguucgagcgcaagggcgaggagcucaaggcccucgccgagcgcggcaucggcuaccaccacuccgccauguccuucaaggagaagcagcucgucgagauccucuuccgcaagggcuaccuccgcgucgucaccgccaccggcacccucgcccucggcgucaacaugcccugcaaguccgucgucuucgcccagaacuccgucuaccucgacgcccucaacuaccgccagauguccggccgcgccggccgccgcggccaggaccucaugggcgacgucuacuucuucgacauccccuuccccaagaucggcaagcucaucaaguccaacguccccgagcuccgcggccacuucccccucuccaucacccucguccuccgccucaugcuccucgccuccaagggcgacgaccccgaggacgccaaggccaagguccucuccguccucaagcacucccuccucuccuucaagcagccccgcgucauggacaugcucaagcucuacuuccucuucucccuccaguuccucgucaaggagggcuaccucgaccaggagggcaaccccaugggcuucgccggccucgucucccaccuccacuaccacgagcccuccaaccucgucuucgucuccuuccucgucaacggccucuuccacgaccucugccagcccacccgcaagggcuccaagcacuucucccaggacgucauggagaagcucguccucguccucgcccaccucuucggccgccgcuacuucccccccaaguuccaggacgcccacuucgaguucuaccaguccaaggucuuccucgacgaccuccccgaggacuucuccgacgcccucgacgaguacaacaugaagaucauggaggacuucaccaccuuccuccgcaucgucuccaagcucgccgacaugaaccaggaguaccagcucccccucuccaagaucaaguucaccggcaaggagugcgaggacucccagcucgucucccaccucauguccugcaaggagggccgcgucgccaucucccccuucgucugccucuccggcaacuucgacgacgaccuccuccgccucgagacccccaaccacgucacccucggcaccaucggcgucaaccgcucccaggcccccguccuccucucccagaaguucgacaaccgcggccgcaagaugucccucaacgccuacgcccucgacuucuacaagcacggcucccucaucggccucguccaggacaaccgcaugaacgagggcgacgccuacuaccuccucaaggacuucgcccucaccaucaaguccaucuccgucucccuccgcgagcucugcgagaacgaggacgacaacgucguccucgccuucgagcagcucuccaccaccuucugggagaagcucaacaaggucuga

SEQ ID NO: 42155 - RNA, 1452 nt, Artificial Sequence
  derived and/or modified sequence opt2 from DDX6__Homo_sapiens__NP_004388
auguccaccgcccgcaccgagaaccccgucaucaugggccucuccucccagaacggccagcuccgcggccccgucaagcccaccggcggccccggcggcggcggcacccagacccagcagcagaugaaccagcucaagaacaccaacaccaucaacaacggcacccagcagcaggcccaguccaugaccaccaccaucaagcccggcgacgacuggaagaagacccucaagcucccccccaaggaccuccgcaucaagaccuccgacgucaccuccaccaagggcaacgaguucgaggacuacugccucaagcgcgagcuccucaugggcaucuucgagaugggcugggagaagcccucccccauccaggaggaguccauccccaucgcccucuccggccgcgacauccucgcccgcgccaagaacggcaccggcaaguccggcgccuaccucaucccccuccucgagcgccucgaccucaagaaggacaacauccaggccauggucaucguccccacccgcgagcucgcccuccaggucucccagaucugcauccaggucuccaagcacaugggcggcgccaaggucauggccaccaccggcggcaccaaccuccgcgacgacaucaugcgccucgacgacaccguccacgucgucaucgccacccccggccgcauccucgaccucaucaagaagggcgucgccaaggucgaccacguccagaugaucguccucgacgaggccgacaagcuccucucccaggacuucguccagaucauggaggacaucauccucacccuccccaagaaccgccagauccuccucuacuccgccaccuucccccucuccguccagaaguucaugaacucccaccuccagaagcccuacgagaucaaccucauggaggagcucacccucaagggcgucacccaguacuacgccuacgucaccgagcgccagaagguccacugccucaacacccucuucucccgccuccagaucaaccaguccaucaucuucugcaacuccucccagcgcgucgagcuccucgccaagaagaucucccagcucggcuacuccugcuucuacauccacgccaagaugcgccaggagcaccgcaaccgcgucuuccacgacuuccgcaacggccucugccgcaaccucgucugcaccgaccucuucacccgcggcaucgacauccaggccgucaacgucgucaucaacuucgacuuccccaagcucgccgagaccuaccuccaccgcaucggccgcuccggccgcuucggccaccucggccucgccaucaaccucaucaccuacgacgaccgcuucaaccucaaguccaucgaggagcagcucggcaccgagaucaagcccauccccuccaacaucgacaagucccucuacgucgccgaguaccacuccgagcccgucgaggacgagaagcccuga

SEQ ID NO: 42156 - RNA, 1473 nt, Artificial Sequence
  derived and/or modified sequence opt2 from DEAF1__Homo_sapiens__NP_001280563
auggaggacuccgacuccgccgccaagcagcucggccucgccgaggccgccgccgucgccgccgccgccgccgucgccgccgccgccgccgccgccgccggcggcgaggccgaggagcccguccucucccgcgacgaggacuccgaggaggacgccgacuccgaggccgagcgcgagaccccccgcgucaccgccgucgccgucauggccgccgagcccggccacauggacaugggcgccgaggcccuccccggccccgacgaggccgccgccgccgccgccuucgccgaggucaccaccgucaccgucgccaacgucggcgccgccgccgacaacgucuucaccaccuccgucgccaacgccgccuccaucuccggccacguccucuccggccgcaccgcccuccagaucggcgacucccucaacaccgagaaggccacccucaucgucguccacaccgacggcuccaucgucgagaccaccggccucaagggccccgccgccccccucacccccggcccccaguccccccccaccccccucgcccccggccaggagaagggcggcaccaaguacaacugggaccccuccgucuacgacuccgagcuccccguccgcugccgcaacaucuccggcacccucuacaagaaccgccucggcuccggcugggaccucaagcccucccgcugccuccuccaccucugcugccuccuccgccgccacgaccucaucaccgucacccccuccggccagaucaccaccuccggcgcccucaccuucgaccgcgccuccaccgucgaggccaccgccgucaucuccgagucccccgcccagggcgacgucuucgccggcgccaccguccaggaggccuccguccagccccccugccgcgccucccaccccgagccccacuaccccggcuaccaggacuccugccagaucgcccccuuccccgaggccgcccuccccaccucccaccccaagaucguccucaccucccuccccgcccucgccguccccccccccacccccaccaaggccgccccccccgcccucgucaacggccucgagcucuccgagccccgcuccuggcucuaccucgaggagauggucaacucccuccucaacaccgcccagcagcucaagacccucuucgagcaggccaagcacgccuccaccuaccgcgaggccgccaccaaccaggccaagauccacgccgacgccgagcgcaaggaggucauccaccccccccgccuccccaagguccucggccuccagcaguccugcgucaacugcggccgcgaggccauguccgagugcaccggcugccacaaggucaacuacugcuccaccuucugccagcgcaaggacuggaaggaccaccagcacaucugcggccaguccgccgccgucaccguccaggccgacgagguccacgucgccgaguccgucauggagaaggucaccgucuga

SEQ ID NO: 42157 - RNA, 213 nt, Artificial Sequence
  derived and/or modified sequence opt2 from DEC1__Homo_sapiens__XP_011517055
augaccaugaacguccucgaggccggcaaguggaaguccaucguccccgcccccggcgagggccuccucgccguccuccacaugauggucuucaccgacgcccuccaccgcgagcgcuccgucaaguggcaggccggcgucugcuacaacggcggcaaggacuucgccgucucccucgcccgccccaaggccgccgagggcaucgccgacuga

SEQ ID NO: 42158 - RNA, 1008 nt, Artificial Sequence
  derived and/or modified sequence opt2 from DECR1__Homo_sapiens__NP_001350
augaagcuccccgcccgcgucuucuucacccucggcucccgccuccccugcggccucgccccccgccgcuucuucuccuacggcaccaagauccucuaccagaacaccgaggcccuccaguccaaguucuucuccccccuccagaaggccaugcucccccccaacuccuuccagggcaaggucgccuucaucaccggcggcggcaccggccucggcaagggcaugaccacccuccucuccucccucggcgcccagugcgucaucgccucccgcaagauggacguccucaaggccaccgccgagcagaucuccucccagaccggcaacaagguccacgccauccagugcgacguccgcgaccccgacaugguccagaacaccgucuccgagcucaucaaggucgccggccaccccaacaucgucaucaacaacgccgccggcaacuucaucucccccaccgagcgccucucccccaacgccuggaagaccaucaccgacaucguccucaacggcaccgccuucgucacccucgagaucggcaagcagcucaucaaggcccagaagggcgccgccuuccucuccaucaccaccaucuacgccgagaccggcuccggcuucgucguccccuccgccuccgccaaggccggcgucgaggccauguccaagucccucgccgccgaguggggcaaguacggcaugcgcuucaacgucauccagcccggccccaucaagaccaagggcgccuucucccgccucgaccccaccggcaccuucgagaaggagaugaucggccgcauccccugcggccgccucggcaccgucgaggagcucgccaaccucgccgccuuccucugcuccgacuacgccuccuggaucaacggcgccgucaucaaguucgacggcggcgaggagguccucaucuccggcgaguucaacgaccuccgcaaggucaccaaggagcagugggacaccaucgaggagcucauccgcaagaccaagggcuccuga

SEQ ID NO: 42159 - RNA, 957 nt, Artificial Sequence
  derived and/or modified sequence opt2 from DEDD__Homo_sapiens__NP_001034801
auggccggccucaagcgccgcgccucccaggucuggcccgaggagcacggcgagcaggagcacggccucuacucccuccaccgcauguucgacaucgucggcacccaccucacccaccgcgacguccgcguccucuccuuccucuucgucgacgucaucgacgaccacgagcgcggccucauccgcaacggccgcgacuuccuccucgcccucgagcgccagggccgcugcgacgaguccaacuuccgccagguccuccagcuccuccgcaucaucacccgccacgaccuccuccccuacgucacccucaagcgccgccgcgccgucugccccgaccucgucgacaaguaccucgaggagaccuccauccgcuacgucaccccccgcgcccucuccgaccccgagccccgccccccccagcccuccaagaccguccccccccacuaccccgucgucugcugccccaccuccggcccccagaugugcuccaagcgccccgcccgcggccgcgccacccucggcucccagcgcaagcgccgcaaguccgucacccccgaccccaaggagaagcagaccugcgacauccgccuccgcguccgcgccgaguacugccagcacgagaccgcccuccagggcaacgucuucuccaacaagcaggacccccucgagcgccaguucgagcgcuucaaccaggccaacaccauccucaagucccgcgaccucggcuccaucaucugcgacaucaaguucuccgagcucaccuaccucgacgccuucuggcgcgacuacaucaacggcucccuccucgaggcccucaagggcgucuucaucaccgacucccucaagcaggccgucggccacgaggccaucaagcuccucgucaacgucgacgaggaggacuacgagcucggccgccagaagcuccuccgcaaccucaugcuccaggcccuccccuga

SEQ ID NO: 42160 - RNA, 1896 nt, Artificial Sequence
  derived and/or modified sequence opt2 from DEF6__Homo_sapiens__NP_071330
auggcccuccgcaaggagcuccucaaguccaucugguacgccuucaccgcccucgacgucgagaaguccggcaaggucuccaagucccagcucaagguccucucccacaaccucuacaccguccuccacaucccccacgaccccgucgcccucgaggagcacuuccgcgacgacgacgacggccccgucuccucccagggcuacaugcccuaccucaacaaguacauccucgacaaggucgaggagggcgccuucgucaaggagcacuucgacgagcucugcuggacccucaccgccaagaagaacuaccgcgccgacuccaacggcaacuccaugcucuccaaccaggacgccuuccgccucuggugccucuucaacuuccucuccgaggacaaguacccccucaucaugguccccgacgaggucgaguaccuccucaagaagguccucuccuccaugucccucgaggucucccucggcgagcucgaggagcuccucgcccaggaggcccaggucgcccagaccaccggcggccucuccgucuggcaguuccucgagcucuucaacuccggccgcugccuccgcggcgucggccgcgacacccucuccauggccauccacgaggucuaccaggagcucauccaggacguccucaagcagggcuaccucuggaagcgcggccaccuccgccgcaacugggccgagcgcugguuccagcuccagcccuccugccucugcuacuucggcuccgaggagugcaaggagaagcgcggcaucaucccccucgacgcccacugcugcgucgagguccuccccgaccgcgacggcaagcgcugcauguucugcgucaagaccgccaaccgcaccuacgagauguccgccuccgacacccgccagcgccaggaguggaccgccgccauccagauggccauccgccuccaggccgagggcaagaccucccuccacaaggaccucaagcagaagcgccgcgagcagcgcgagcagcgcgagcgccgccgcgccgccaaggaggaggagcuccuccgccuccagcagcuccaggaggagaaggagcgcaagcuccaggagcucgagcuccuccaggaggcccagcgccaggccgagcgccuccuccaggaggaggaggagcgccgccgcucccagcaccgcgagcuccagcaggcccucgagggccagcuccgcgaggccgagcaggcccgcgccuccaugcaggccgagauggagcucaaggaggaggaggccgcccgccagcgccagcgcaucaaggagcucgaggagaugcagcagcgccuccaggaggcccuccagcucgaggucaaggcccgccgcgacgaggaguccguccgcaucgcccagacccgccuccucgaggaggaggaggagaagcucaagcagcucaugcagcucaaggaggagcaggagcgcuacaucgagcgcgcccagcaggagaaggaggagcuccagcaggagauggcccagcagucccgcucccuccagcaggcccagcagcagcucgaggagguccgccagaaccgccagcgcgccgacgaggacgucgaggccgcccagcgcaagcuccgccaggccuccaccaacgucaagcacuggaacguccagaugaaccgccucaugcaccccaucgagcccggcgacaagcgccccgucaccuccuccuccuucuccggcuuccagcccccccuccucgcccaccgcgacuccucccucaagcgccucacccgcuggggcucccagggcaaccgcacccccucccccaacuccaacgagcagcagaagucccucaacggcggcgacgaggcccccgcccccgccuccaccccccaggaggacaagcucgaccccgcccccgagaacuga

SEQ ID NO: 42161 - RNA, 285 nt, Artificial Sequence
  derived and/or modified sequence opt2 from DEFA1B__Homo_sapiens__NP_001035965
augcgcacccucgccauccucgccgccauccuccucgucgcccuccaggcccaggccgagccccuccaggcccgcgccgacgaggucgccgccgcccccgagcagaucgccgccgacauccccgaggucgucgucucccucgccugggacgagucccucgcccccaagcaccccggcucccgcaagaacauggccugcuacugccgcauccccgccugcaucgccggcgagcgccgcuacggcaccugcaucuaccagggccgccucugggccuucugcugcuga

SEQ ID NO: 42162 - RNA, 285 nt, Artificial Sequence
  derived and/or modified sequence opt2 from DEFA3__Homo_sapiens__NP_005208
augcgcacccucgccauccucgccgccauccuccucgucgcccuccaggcccaggccgagccccuccaggcccgcgccgacgaggucgccgccgcccccgagcagaucgccgccgacauccccgaggucgucgucucccucgccugggacgagucccucgcccccaagcaccccggcucccgcaagaacauggacugcuacugccgcauccccgccugcaucgccggcgagcgccgcuacggcaccugcaucuaccagggccgccucugggccuucugcugcuga

SEQ ID NO: 42163 - RNA, 294 nt, Artificial Sequence
  derived and/or modified sequence opt2 from DEFA4__Homo_sapiens__NP_001916
augcgcaucaucgcccuccucgccgccauccuccucgucgcccuccagguccgcgccggcccccuccaggcccgcggcgacgaggcccccggccaggagcagcgcggccccgaggaccaggacaucuccaucuccuucgccugggacaaguccuccgcccuccaggucuccggcuccacccgcggcauggucugcuccugccgccucgucuucugccgccgcaccgagcuccgcgucggcaacugccucaucggcggcgucuccuucaccuacugcugcacccgcgucgacuga

SEQ ID NO: 42164 - RNA, 285 nt, Artificial Sequence
  derived and/or modified sequence opt2 from DEFA5__Homo_sapiens__NP_066290
augcgcaccaucgccauccucgccgccauccuccucgucgcccuccaggcccaggccgagucccuccaggagcgcgccgacgaggccaccacccagaagcaguccggcgaggacaaccaggaccucgccaucuccuucgccggcaacggccucuccgcccuccgcaccuccggcucccaggcccgcgccaccugcuacugccgcaccggccgcugcgccacccgcgagucccucuccggcgucugcgagaucuccggccgccucuaccgccucugcugccgcuga

SEQ ID NO: 42165 - RNA, 303 nt, Artificial Sequence
  derived and/or modified sequence opt2 from DEFA6__Homo_sapiens__NP_001917
augcgcacccucaccauccucaccgccguccuccucgucgcccuccaggccaaggccgagccccuccaggccgaggacgacccccuccaggccaaggccuacgaggccgacgcccaggagcagcgcggcgccaacgaccaggacuucgccgucuccuucgccgaggacgccuccuccucccuccgcgcccucggcuccacccgcgccuucaccugccacugccgccgcuccugcuacuccaccgaguacuccuacggcaccugcaccgucaugggcaucaaccaccgcuucugcugccucuga

SEQ ID NO: 42166 - RNA, 204 nt, Artificial Sequence
  derived and/or modified sequence opt2 from DEFB103B__Homo_sapiens__NP_061131
augcgcauccacuaccuccucuucgcccuccucuuccucuuccucguccccguccccggccacggcggcaucaucaacacccuccagaaguacuacugccgcguccgcggcggccgcugcgccguccucuccugccuccccaaggaggagcagaucggcaagugcuccacccgcggccgcaagugcugccgccgcaagaaguga

SEQ ID NO: 42167 - RNA, 219 nt, Artificial Sequence
  derived and/or modified sequence opt2 from DEFB104B__Homo_sapiens__NP_001035792
augcagcgccucguccuccuccucgccaucucccuccuccucuaccaggaccuccccguccgcuccgaguucgagcucgaccgcaucugcggcuacggcaccgcccgcugccgcaagaagugccgcucccaggaguaccgcaucggccgcugccccaacaccuacgccugcugccuccgcaagugggacgagucccuccucaaccgcaccaagcccuga

SEQ ID NO: 42168 - RNA, 237 nt, Artificial Sequence
  derived and/or modified sequence opt2 from DEFB105A__Homo_sapiens__NP_689463
auggcccucauccgcaagaccuucuacuuccucuucgccauguucuucauccucguccagcuccccuccggcugccaggccggccucgacuucucccagcccuuccccuccggcgaguucgccgucugcgaguccugcaagcucggccgcggcaagugccgcaaggagugccucgagaacgagaagcccgacggcaacugccgccucaacuuccucugcugccgccagcgcaucuga

SEQ ID NO: 42169 - RNA, 198 nt, Artificial Sequence
  derived and/or modified sequence opt2 from DEFB106A__Homo_sapiens__NP_689464
augcgcaccuuccucuuccucuucgccguccucuucuuccucacccccgccaagaacgccuucuucgacgagaagugcaacaagcucaagggcaccugcaagaacaacugcggcaagaacgaggagcucaucgcccucugccagaagucccucaagugcugccgcaccauccagcccugcggcuccaucaucgacuga

SEQ ID NO: 42170 - RNA, 222 nt, Artificial Sequence
  derived and/or modified sequence opt2 from DEFB108B__Homo_sapiens__NP_001002035
augcgcaucgccguccuccucuucgccaucuucuucuucaugucccagguccuccccgcccgcggcaaguucaaggagaucugcgagcgccccaacggcuccugccgcgacuucugccucgagaccgagauccacgucggccgcugccucaacucccagcccugcugccucccccucggccaccagccccgcaucgaguccaccacccccaagaaggacuga

SEQ ID NO: 42171 - RNA, 342 nt, Artificial Sequence
  derived and/or modified sequence opt2 from DEFB112__Homo_sapiens__NP_001032587
augaagcuccucaccaccaucugccgccucaagcucgagaagauguacuccaagaccaacaccuccuccaccaucuucgagaaggcccgccacggcaccgagaagaucuccaccgcccgcuccgagggccaccacaucaccuucucccgcuggaaguccugcaccgccaucggcggccgcugcaagaaccagugcgacgacuccgaguuccgcaucuccuacugcgcccgccccaccacccacugcugcgucaccgagugcgaccccaccgaccccaacaacuggauccccaaggacuccgucggcacccaggagugguaccccaaggacucccgccacuga

SEQ ID NO: 42172 - RNA, 471 nt, Artificial Sequence
  derived and/or modified sequence opt2 from DEFB125__Homo_sapiens__NP_697020
augaacauccucaugcucaccuucaucaucugcggccuccucacccgcgucaccaagggcuccuucgagccccagaagugcuggaagaacaacgucggccacugccgccgccgcugccucgacaccgagcgcuacauccuccucugccgcaacaagcucuccugcugcaucuccaucaucucccacgaguacacccgccgccccgccuuccccgucauccaccucgaggacaucacccucgacuacuccgacgucgacuccuucaccggcucccccgucuccaugcucaacgaccucaucaccuucgacaccaccaaguucggcgagaccaugacccccgagaccaacacccccgagaccaccaugccccccuccgaggccaccacccccgagaccaccaugccccccuccgagaccgccaccuccgagaccaugcccccccccucccagaccgcccucacccacaacuga

SEQ ID NO: 42173 - RNA, 336 nt, Artificial Sequence
  derived and/or modified sequence opt2 from DEFB126__Homo_sapiens__NP_112193
augaagucccuccucuucacccucgccgucuucaugcuccucgcccagcucgucuccggcaacugguacgucaagaagugccucaacgacgucggcaucugcaagaagaagugcaagcccgaggagaugcacgucaagaacggcugggccaugugcggcaagcagcgcgacugcugcguccccgccgaccgccgcgccaacuaccccgucuucugcguccagaccaagaccacccgcaucuccaccgucaccgccaccaccgccaccaccacccucaugaugaccaccgccuccauguccuccauggcccccacccccgucucccccaccggcuga

SEQ ID NO: 42174 - RNA, 207 nt, Artificial Sequence
  derived and/or modified sequence opt2 from DEFB1__Homo_sapiens__NP_005209
augcgcaccuccuaccuccuccucuucacccucugccuccuccucuccgagauggccuccggcggcaacuuccucaccggccucggccaccgcuccgaccacuacaacugcgucuccuccggcggccagugccucuacuccgccugccccaucuucaccaagauccagggcaccugcuaccgcggcaaggccaagugcugcaaguga

SEQ ID NO: 42175 - RNA, 195 nt, Artificial Sequence
  derived and/or modified sequence opt2 from DEFB4A__Homo_sapiens__NP_004933
augcgcguccucuaccuccucuucuccuuccucuucaucuuccucaugccccuccccggcgucuucggcggcaucggcgaccccgucaccugccucaaguccggcgccaucugccaccccgucuucugcccccgccgcuacaagcagaucggcaccugcggccuccccggcaccaagugcugcaagaagcccuga

SEQ ID NO: 42176 - RNA, 972 nt, Artificial Sequence
  derived and/or modified sequence opt2 from DEGS1__Homo_sapiens__NP_003667
augggcucccgcgucucccgcgaggacuucgagugggucuacaccgaccagccccacgccgaccgccgccgcgagauccucgccaaguaccccgagaucaagucccucaugaagcccgaccccaaccucaucuggaucaucaucaugaugguccucacccagcucggcgccuucuacaucgucaaggaccucgacuggaagugggucaucuucggcgccuacgccuucggcuccugcaucaaccacuccaugacccucgccauccacgagaucgcccacaacgccgccuucggcaacugcaaggccauguggaaccgcugguucggcauguucgccaaccuccccaucggcauccccuacuccaucuccuucaagcgcuaccacauggaccaccaccgcuaccucggcgccgacggcgucgacgucgacauccccaccgacuucgagggcugguucuucugcaccgccuuccgcaaguucaucugggucauccuccagccccucuucuacgccuuccgcccccucuucaucaaccccaagcccaucaccuaccucgaggucaucaacaccgucgcccaggucaccuucgacauccucaucuacuacuuccucggcaucaagucccucgucuacaugcucgccgccucccuccucggccucggccuccaccccaucuccggccacuucaucgccgagcacuacauguuccucaagggccacgagaccuacuccuacuacggcccccucaaccuccucaccuucaacgucggcuaccacaacgagcaccacgacuuccccaacauccccggcaagucccucccccucguccgcaagaucgccgccgaguacuacgacaaccucccccacuacaacuccuggaucaagguccucuacgacuucgucauggacgacaccaucucccccuacucccgcaugaagcgccaccagaagggcgagaugguccucgaguga

SEQ ID NO: 42177 - RNA, 972 nt, Artificial Sequence
  derived and/or modified sequence opt2 from DEGS2__Homo_sapiens__NP_996801
augggcaacuccgccucccgcuccgacuucgagugggucuacaccgaccagccccacacccagcgccgcaaggagauccucgccaaguaccccgccaucaaggcccucaugcgccccgacccccgccucaagugggccguccucguccucguccucguccagaugcucgccugcuggcucguccgcggccucgccuggcgcuggcuccucuucugggccuacgccuucggcggcugcgucaaccacucccucacccucgccauccacgacaucucccacaacgccgccuucggcaccggccgcgccgcccgcaaccgcuggcucgccgucuucgccaaccuccccgucggcguccccuacgccgccuccuucaagaaguaccacgucgaccaccaccgcuaccucggcggcgacggccucgacgucgacguccccacccgccucgagggcugguucuucugcacccccgcccgcaagcuccucuggcucguccuccagcccuucuucuacucccuccgcccccucugcguccaccccaaggccgucacccgcauggagguccucaacacccucguccagcucgccgccgaccucgccaucuucgcccucuggggccucaagcccgucgucuaccuccucgccuccuccuuccucggccucggccuccaccccaucuccggccacuucgucgccgagcacuacauguuccucaagggccacgagaccuacuccuacuacggcccccucaacuggaucaccuucaacgucggcuaccacgucgagcaccacgacuuccccuccauccccggcuacaaccucccccucguccgcaagaucgcccccgaguacuacgaccaccucccccagcaccacuccugggucaagguccucugggacuucgucuucgaggacucccucggccccuacgcccgcgucaagcgcgucuaccgccucgccaaggacggccucuga

SEQ ID NO: 42178 - RNA, 1026 nt, Artificial Sequence
  derived and/or modified sequence opt2 from DEK__Homo_sapiens__NP_001128181
auguccgccuccgcccccgccgccgagggcgagggcacccccacccagcccgccuccgagaaggagcccgagaugcccggcccccgcgaggaguccgaggaggaggaggacgaggacgacgaggaggaggaggaggaggagaagggcaagggccagaagcucugcgagaucgagcgcauccacuucuuccucuccaagaagaagaccgacgagcuccgcaaccuccacaagcuccucuacaaccgccccggcaccgucuccucccucaagaagaacgucggccaguucuccggcuuccccuucgagaagggcuccguccaguacaagaagaaggaggagaugcucaagaaguuccgcaacgccaugcucaaguccaucugcgagguccucgaccucgagcgcuccggcgucaacuccgagcucgucaagcgcauccucaacuuccucaugcaccccaagcccuccggcaagccccuccccaaguccaagaagaccugcuccaagggcuccaagaaggagcgcaacuccuccggcauggcccgcaaggccaagcgcaccaagugccccgagauccucuccgacgaguccuccuccgacgaggacgagaagaagaacaaggaggaguccuccgacgacgaggacaaggaguccgaggaggagccccccaagaagaccgccaagcgcgagaagcccaagcagaaggccaccuccaaguccaagaaguccgucaaguccgccaacgucaagaaggccgacuccuccaccaccaagaagaaccagaacuccuccaagaaggaguccgaguccgaggacuccuccgacgacgagccccucaucaagaagcucaagaagccccccaccgacgaggagcucaaggagaccaucaagaagcuccucgccuccgccaaccucgaggaggucaccaugaagcagaucugcaagaaggucuacgagaacuaccccaccuacgaccucaccgagcgcaaggacuucaucaagaccaccgucaaggagcucaucuccuga

SEQ ID NO: 42179 - RNA, 3030 nt, Artificial Sequence
  derived and/or modified sequence opt2 from DENND1A__Homo_sapiens__NP_065997
augggcucccgcaucaagcagaaccccgagaccaccuucgaggucuacgucgaggucgccuacccccgcaccggcggcacccucuccgaccccgagguccagcgccaguuccccgaggacuacuccgaccaggagguccuccagacccucaccaaguucugcuuccccuucuacgucgacucccucaccgucucccaggucggccagaacuucaccuucguccucaccgacaucgacuccaagcagcgcuucggcuucugccgccucuccuccggcgccaaguccugcuucugcauccucuccuaccuccccugguucgaggucuucuacaagcuccucaacauccucgccgacuacaccaccaagcgccaggagaaccaguggaacgagcuccucgagacccuccacaagcuccccauccccgaccccggcgucuccguccaccucuccguccacuccuacuucaccguccccgacacccgcgagcuccccuccauccccgagaaccgcaaccucaccgaguacuucgucgccgucgacgucaacaacaugcuccaccucuacgccuccaugcucuacgagcgccgcauccucaucaucugcuccaagcucuccacccucaccgccugcauccacggcuccgccgccaugcucuaccccauguacuggcagcacgucuacauccccguccuccccccccaccuccucgacuacugcugcgcccccaugcccuaccucaucggcauccaccucucccucauggagaagguccgcaacauggcccucgacgacgucgucauccucaacgucgacaccaacacccucgagacccccuucgacgaccuccagucccuccccaacgacgucaucuccucccucaagaaccgccucaagaaggucuccaccaccaccggcgacggcgucgcccgcgccuuccucaaggcccaggccgccuucuucggcuccuaccgcaacgcccucaagaucgagcccgaggagcccaucaccuucugcgaggaggccuucgucucccacuaccgcuccggcgccaugcgccaguuccuccagaacgccacccagcuccagcucuucaagcaguucaucgacggccgccucgaccuccucaacuccggcgagggcuucuccgacgucuucgaggaggagaucaacaugggcgaguacgccggcuccgacaagcucuaccaccaguggcucuccaccguccgcaagggcuccggcgccauccucaacaccgucaagaccaaggccaaccccgccaugaagaccgucuacaaguucgccaaggaccacgccaagaugggcaucaaggaggucaagaaccgccucaagcagaaggacaucgccgagaacggcugcgcccccacccccgaggagcagcuccccaagaccgcccccuccccccucgucgaggccaaggaccccaagcuccgcgaggaccgccgccccaucaccguccacuucggccagguccgccccccccgcccccacgucgucaagcgccccaaguccaacaucgccgucgagggccgccgcaccuccguccccucccccgagcagccccagcccuaccgcacccuccgcgaguccgacuccgccgagggcgacgaggccgagucccccgagcagcagguccgcaaguccaccggccccguccccgccccccccgaccgcgccgccuccaucgaccuccucgaggacgucuucuccaaccucgacauggaggccgcccuccagccccucggccaggccaagucccucgaggaccuccgcgcccccaaggaccuccgcgagcagcccggcaccuucgacuaccagcgccucgaccucggcggcuccgagcgcucccgcggcgucaccgucgcccucaagcucacccaccccuacaacaagcucuggucccucggccaggacgacauggccauccccuccaagccccccgccgccucccccgagaagcccuccgcccuccucggcaacucccucgcccucccccgccgcccccagaaccgcgacuccauccucaaccccuccgacaaggaggagguccccacccccacccucggcuccaucaccaucccccgcccccagggccgcaagacccccgagcucggcaucgucccccccccccccaucccccgccccgccaagcuccaggccgccggcgccgcccucggcgacgucuccgagcgccuccagaccgaccgcgaccgccgcgccgcccucucccccggccuccuccccggcgucgucccccagggccccaccgagcuccuccagccccucucccccggccccggcgccgccggcaccuccuccgacgcccuccucgcccuccucgacccccucuccaccgccugguccggcuccacccuccccucccgccccgccacccccaacgucgccacccccuucaccccccaguucuccuucccccccgccggcacccccacccccuucccccagcccccccucaaccccuucguccccuccaugcccgccgccccccccacccucccccucgucuccacccccgccggccccuucggcgccccccccgccucccucggccccgccuucgccuccggccuccuccucuccuccgccggcuucugcgccccccaccgcucccagcccaaccucuccgcccucuccaugcccaaccucuucggccagaugcccaugggcacccacaccuccccccuccagccccucggcccccccgccgucgcccccucccgcauccgcacccucccccucgcccgcuccuccgcccgcgccgccgagaccaagcagggccucgcccuccgccccggcgaccccccccuccuccccccccgccccccccagggccucgagcccacccuccagcccuccgccccccagcaggcccgcgaccccuucgaggaccuccuccagaagaccaagcaggacgucucccccucccccgcccucgcccccgcccccgacuccgucgagcagcuccgcaagcagugggagaccuucgaguga

SEQ ID NO: 42180 - RNA, 1191 nt, Artificial Sequence
  derived and/or modified sequence opt2 from DENND1B__Homo_sapiens__NP_001287787
auggccgccgccccccgcgaggagaagcgcuggccccagcccgucuucuccaaccccgucguccucuggaaguuccccgaggacuucggcgaccaggagauccuccaguccguccccaaguucugcuuccccuucgacgucgagcgcgucucccagaaccaggucggccagcacuucaccuucguccucaccgacaucgaguccaagcagcgcuucggcuucugccgccucaccuccggcggcaccaucugccucugcauccucuccuaccuccccugguucgaggucuacuacaagcuccucaacacccucgccgacuaccucgccaaggagcucgagaacgaccucaacgagacccuccgcucccucuacaaccaccccguccccaaggccaacacccccgucaaccucuccguccacuccuacuucaucgcccccgacgucaccggccuccccaccauccccgagucccgcaaccucaccgaguacuucgucgccgucgacgucaacaacaugcuccagcucuacgccuccaugcuccacgagcgccgcaucgucaucaucuccuccaagcucuccacccucaccgccugcauccacggcuccgccgcccuccucuaccccauguacuggcagcacaucuacauccccguccuccccccccaccuccucgacuacugcugcgcccccaugcccuaccucaucggcauccacuccucccucaucgagcgcgucaagaacaagucccucgaggacgucgucaugcucaacgucgacaccaacacccucgagucccccuucuccgaccucaacaaccuccccuccgacgucgucuccgcccucaagaacaagcucaagaagcaguccaccgccaccggcgacggcgucgcccgcgccuuccuccgcgcccaggccgcccucuucggcuccuaccgcgacgcccuccgcuacaagcccggcgagcccaucaccuucugcgaggaguccuucgucaagcaccgcuccuccgucaugaagcaguuccucgagaccgccaucaaccuccagcucuucaagcaguucaucgacggccgccucgccaagcucaacgccggccgcggcuucuccgacgucuucgaggaggagaucaccuccggcggcuucugcggcggcaaggacaagcuccaguacgacuaccccuucucccaguga

SEQ ID NO: 42181 - RNA, 3030 nt, Artificial Sequence
  derived and/or modified sequence opt2 from DENND2A__Homo_sapiens__NP_056504
auggacauguucucccucgacaugaucaucuccgaccccgccgccgaggccucccgcgccggcaagaagcagcuccgcggcguccagaaccccugccccuccgcccgcgcccgcccccgccacaagucccucaacaucaaggacaagaucuccgagugggagggcaagaaggagguccccacccccgcccccucccgccgcgccgacggccaggaggacuaccuccccuccuccaccgucgagcgccgcuccuccgacggcguccgcacccaggucaccgaggccaagaacggcaugcgccccggcaccgaguccaccgagaaggagcgcaacaagggcgccgucaacgucggcggccaggaccccgagcccggccaggaccucucccagcccgagcgcgaggucgaccccuccuggggccgcggccgcgagccccgccucggcaagcuccgcuuccagaacgacccccucuccguccucaagcaggucaagaagcucgagcaggcccucaaggacggcuccgccggccucgacccccagcuccccggcaccugcuacuccccccacugcccccccgacaaggccgaggccggcuccacccuccccgagaaccucggcggcggcuccggcuccgaggucucccagcgcguccaccccuccgaccucgagggccgcgagcccacccccgagcucgucgaggaccgcaagggcuccugccgccgccccugggaccgcucccucgagaacgucuaccgcggcuccgagggcucccccaccaagcccuucaucaacccccuccccaagccccgccgcaccuucaagcacgccggcgagggcgacaaggacggcaagcccggcaucggcuuccgcaaggagaagcgcaaccuccccccccuccccucccuccccccccccccccuccccuccucccccccccccuccuccgucaaccgccgccucuggaccggccgccagaaguccuccgccgaccaccgcaaguccuacgaguucgaggaccuccuccaguccuccuccgaguccucccgcgucgacugguacgcccagaccaagcucggccucacccgcacccucuccgaggagaacgucuacgaggacauccucgacccccccaugaaggagaaccccuacgaggacaucgagcuccacggccgcugccucggcaagaagugcguccucaacuuccccgccucccccaccuccuccauccccgacacccucaccaagcagucccucuccaagcccgccuucuuccgccagaacuccgagcgccgcaacuucaagcuccucgacacccgcaagcucucccgcgacggcaccggcucccccuccaagaucuccccccccuccacccccuccucccccgacgacaucuucuucaaccucggcgacccccagaacggccgcaagaagcgcaagauccccaagcucguccuccgcaucaacgccaucuacgagguccgccgcggcaagaagcgcgucaagcgccucucccaguccauggaguccaacuccggcaaggucaccgacgagaacuccgaguccgacuccgacaccgaggagaagcucaaggcccacucccagcgccucgucaacgucaagucccgccucaagcaggccccccgcuaccccucccucgcccgcgagcucaucgaguaccaggagcgccagcucuucgaguacuucgucgucgucucccuccacaagaagcaggccggcgccgccuacguccccgagcucacccagcaguucccccucaagcucgagcgcuccuucaaguucaugcgcgaggccgaggaccagcucaaggccaucccccaguucugcuuccccgacgccaaggacuggguccccguccagcaguucaccuccgagaccuucuccuucguccucaccggcgaggacggcucccgccgcuucggcuacugccgccgccuccuccccggcggcaagggcaagcgccuccccgaggucuacugcaucgucucccgccucggcugcuucucccucuucucccgcauccucgacgaggucgagaagcgccgcggcaucucccccgcccucguccagccccucaugcgcuccgucauggaggcccccuuccccgcccucggcaagaccauccucgucaagaacuuccuccccggcuccggcaccgaggucaucgagcucugccgcccccucgacucccgccucgagcacgucgacuucgagucccucuucuccucccucuccguccgccaccucgucugcgucuucgccucccuccuccucgagcgccgcgucaucuucaucgccgacaagcucuccauccucuccaagugcugccacgccauggucgcccucaucuaccccuucgccuggcagcacaccuacauccccguccucccccccgccauggucgacaucgucugcucccccacccccuuccucaucggccuccucuccuccucccucccccuccuccgcgagcucccccucgaggagguccucgucgucgaccucgucaacucccgcuuccuccgccagauggacgacgaggacuccauccucccccgcaagcuccaggucgcccucgagcacauccucgagcagcgcaacgagcucgccugcgagcaggacgagggcccccucgacggccgccacggccccgaguccuccccccucaacgaggucgucuccgaggccuucguccgcuucuucgucgagaucgucggccacuacucccucuuccucaccuccggcgagcgcgaggagcgcacccuccagcgcgaggccuuccgcaaggccgucuccuccaagucccuccgccacuuccucgaggucuucauggagacccagauguuccgcggcuucauccaggagcgcgagcuccgccgccaggacgccaagggccucuucgagguccgcgcccaggaguaccucgagacccuccccuccggcgagcacuccggcgucaacaaguuccucaagggccucggcaacaagaugaaguuccuccacaagaaguga

SEQ ID NO: 42182 - RNA, 5721 nt, Artificial Sequence
  derived and/or modified sequence opt2 from DENND4A__Homo_sapiens__NP_001138295
augaucgaggacaagggcccccgcgucgccgacuacuucgucgucgccggccucaccgacgucuccaagccccucgaggaggagauccacuucaacgacgccugccacaaggucgccaagcccaaggagcccaucaccgacgucuccgucaucaucaagucccucggcgaggaggucccccaggacuacaucugcaucgacgucacccccaccggccucuccgccgaccucaacaacggcucccucgucggcccccagaucuaccucugcuaccgccgcggccgcgacaagcccccccucaccgaccucggcguccucuacgacuggaaggagcgccucaagcagggcugcgagaucauccaguccacccccuacggccgccccgccaacaucuccggcuccaccuccucccagcgcaucuacaucaccuaccgccgcgccuccgagaacaugacccagaacacccucgccgucaccgacaucugcaucaucauccccuccaagggcgagucccccccccacaccuucugcaaggucgacaagaaccucaacaacuccauguggggcuccgccgucuaccucugcuacaagaaguccgucgccaagaccaacaccgucuccuacaaggccggccucaucugccgcuacccccaggaggacuacgaguccuucucccuccccgaguccgucccccucuucugccuccccaugggcgccaccaucgagugcuggcccuccaacuccaaguacccccuccccgucuucuccaccuucguccucaccggcgccuccgccgagaaggucuacggcgccgccauccaguucuacgagcccuacuccgaggagaaccucaccgagaagcagcgccuccuccucggccucaccuccgccgacggcaaguccgacuccuccaagaccauccacaccaacaagugcaucugccuccucucccacuggcccuucuucgacgccuuccgcaaguuccucaccuuccucuaccgcuacuccaucuccggcccccacguccuccccaucgagaagcacaucucccacuucaugcacaagguccccuuccccuccccccagcgcccccgcauccucguccagcucuccccccacgacaaccucauccucucccagcccgucuccuccccccucccccucuccggcggcaaguucuccacccuccuccagaaccucggccccgagaacgccgucacccuccucgucuucgccgucaccgagcacaagauccucauccacucccuccgccccuccguccucaccuccgucaccgaggcccucgucuccaugaucuuccccuuccacuggcccugccccuacgucccccucugcccccucgcccucgccgacguccucuccgcccccugccccuucaucgucggcaucgacucccgcuacuucgaccucuacgaccccccccccgacgucuccugcgucgacgucgacaccaacaccaucucccagaucggcgacaagaagaacgucgccuggaagauccuccccaagaagcccugcaagaaccucaugaacacccucaacaaccuccaccagcagcucgccaagcuccagcagcgcccccgcgacgacggccucauggaccucgccaucaacgacuacgacuucaacuccggcaagcgccuccacaugaucgaccucgagauccaggaggccuuccucuucuucauggccuccauccucaagggcuaccgcuccuaccuccgccccaucacccaggcccccuccgagaccgccaccgacgccgccucccucuucgcccuccaggccuuccuccgcucccgcgaccgcucccaccagaaguucuacaacaugaugaccaagacccagauguucauccgcuucaucgaggagugcuccuucgucuccgacaaggacgccucccucgccuucuucgacgacugcgucgacaaggucgacauggacaaguccggcgagguccgccucaucgagcucgacgaguccuucaaguccgagcacaccgucuucgucaccccccccgagaucccccaccuccccaacggcgaggagcccccccuccaguacuccuacaacggcuuccccguccuccgcaacaaccucuucgagcgccccgagggcuuccuccaggccaagaagaacaagcuccccuccaaguccuccucccccaacuccccccuccccauguuccgccgcaccaagcaggagaucaaguccgcccacaagaucgccaagcgcuacuccuccaucccccagauguggucccgcugccuccuccgccacugcuacggccucugguucaucugccuccccgccuacgucaaggucugccacuccaagguccgcgcccucaagaccgccuacgacguccucaagaagaugcaguccaagaagauggacccccccgacgaggucugcuaccgcauccucaugcagcucugcggccaguacgaccagcccguccucgccguccgcguccucuucgagaugcagaaggccggcaucgaccccaacgccaucaccuacggcuacuacaacaaggccguccucgaguccaccuggcccucccgcucccgcuccggcuacuuccucuggaccaagguccgcaacgucguccucggcgucacccaguucaagcgcgcccucaagaagcacgcccaccucucccagaccacccucuccgacggcuccgaccucgacgccgucucccacggcuccauggacuccggccacggcacccacaccgucgagcaggcccccuucaacaccggccucaucaaggucuacgccaccgacgaccgcuccuccaccggcggccaguccgaccucggcuacaacucccucuccaaggacgagguccgccgcggcgacaccuccaccgaggacauccaggaggagaaggacaagaagggcuccgacugcuccucccucuccgaguccgaguccaccaagggcuccgccgacugccuccccaagcucuccuaccagaacuccuccuccaucguccgccucaccggcaccuccaacaacuccgccggcaagaucuccggcgaguccauggaguccacccccgagcuccuccucaucuccucccucgaggacaccaacgagacccgcaacauccagucccgcugcuuccgcaagcgccacaaguccgacaacgagaccaaccuccagcagcaggucgucuggggcaaccgcaaccgcaaccucuccggcggcguccucaugggcuucaugcucaaccgcaucaaccaggaggccacccccggcgacaucgucgagaagcucggcgccgacgccaagauccucuccaacgucaucuccaaguccacccgccccaacacccucgacaucggcaagcccccccuccgcuccaagcgcgacucccucgagaaggaguccuccgacgacgacacccccuucgacggcuccaacuaccucgccgacaaggucgacucccccgucaucuucgaccucgaggaccucgacuccgagaccgacgucuccaaggccggcugcgucgccacccagaaccccaagcgcauccagcgcaugaacuccuccuucuccgucaagcccuucgagaagaccgacgucgccaccggcuucgacccccucucccuccucgucgccgagaccgagcagcagcagaaggaggaggaggaggaggacgaggacgacuccaaguccaucuccacccccuccgcccgccgcgaccucgccgaggagaucgucauguacaugaacaacauguccuccccccucaccucccgcacccccuccaucgaccuccagcgcgccugcgacgacaagcucaacaagaagucccccccccucgucaaggccugccgccgcuccucccucccccccaacucccccaagcccguccgccucaccaaguccaaguccuacaccaaguccgaggagaagccccgcgaccgccucugguccucccccgccuucucccccaccugccccuuccgcgaggagucccaggacacccucacccacuccucccccuccuucaaccucgacacccuccucguccccaagcucgacguccuccgcaacuccauguucaccgccggcaagggcgucgccgagaaggccuccaagugguacucccgcuucaccauguacaccaccuccuccaaggaccaguccuccgaccgcaccucccucuccuccgucggcgcccaggacuccgaguccaccucccucaccgacgaggacgucugccacgagcucgagggccccaucuccucccaggagaccuccgccaccuccggcaccaagcgcaucgaccucucccgcaucucccucgaguccuccgccucccucgagggcucccucuccaaguucgcccuccccggcaaguccgaggucaccuccuccuucaacgccuccaacaccaacaucuuccagaacuacgccauggagguccucaucuccuccugcucccgcugccgcaccugcgacugccucguccacgacgaggagaucauggccggcuggaccgccgacgacuccaaccucaacaccaccugccccuucugcggcaacaucuuccuccccuuccucaacaucgagauccgcgaccuccgccgccccggccgcuacuuccucaaguccucccccuccaccgagaacaugcacuuccccuccuccaucuccucccagacccgccaguccugcaucuccaccuccgccuccggccucgacaccuccgcccucuccguccagggcaacuucgaccucaacuccaaguccaagcuccaggagaacuucugcacccgcuccauccagauccccgccaaccgcuccaagaccgccauguccaagugccccaucuuccccauggcccgcuccaucuccaccuccggcccccucgacaaggaggacaccggccgccagaagcucaucuccaccggcucccuccccgccacccuccagggcgccaccgacucccucggccucgaguggcaccuccccucccccgaccccgucaccguccccuaccucuccccccucgucgucuggaaggagcucgagucccuccucgagaacgagggcgaccacgccaucaccgucgccgacuucgucgaccaccaccccaucgucuucuggaaccucgucugguacuuccgccgccucgaccuccccuccaaccuccccggccucauccucuccuccgagcacugcaacaaguacuccaagaucccccgccacugcauguccgaggacuccaaguacguccucauccagaugcucugggacaacaugaagcuccaccaggaccccggccagccccucuacauccucuggaacgcccacacccagaaguaccccaugguccaccuccuccagaaguccgacaacuccuucaaccaggagcuccucaaguccauggucaaguccaucaagaugaacgacgucuacggccccaugucccagauccucgagacccucaacaagugcccccacuucaagcgccagcgcucccucuaccgcgagauccucuuccucucccucgucgcccucggccgcgagaacaucgacaucgacgccuucgacaaggaguacaagauggccuacgaccgccucacccccucccaggucaaguccacccacaacugcgaccgcccccccuccaccggcgucauggagugccgcaagaccuucggcgagcccuaccucuga

SEQ ID NO: 42183 - RNA, 597 nt, Artificial Sequence
  derived and/or modified sequence opt2 from DENR__Homo_sapiens__NP_003668
auggccgccgacaucuccgaguccuccggcgccgacugcaagggcgacccccgcaacuccgccaagcucgacgccgacuacccccuccgcguccucuacugcggcgucugcucccuccccaccgaguacugcgaguacaugcccgacgucgccaagugccgccaguggcucgagaagaacuuccccaacgaguucgccaagcucaccgucgagaacucccccaagcaggaggccggcaucuccgagggccagggcaccgccggcgaggaggaggagaagaagaagcagaagcgcggcggccgcggccagaucaagcagaagaagaagaccgucccccagaaggucaccaucgccaagaucccccgcgccaagaagaaguacgucacccgcgucugcggccucgccaccuucgagaucgaccucaaggaggcccagcgcuucuucgcccagaaguucuccugcggcgccuccgucaccggcgaggacgagaucaucauccagggcgacuucaccgacgacaucaucgacgucauccaggagaaguggcccgaggucgacgacgacuccaucgaggaccucggcgaggucaagaaguga

SEQ ID NO: 42184 - RNA, 1404 nt, Artificial Sequence
  derived and/or modified sequence opt2 from DEPDC1B__Homo_sapiens__NP_001138680
auggagcaccgcaucgucggccccggccccuaccgcgccacccgccucuggaacgagaccgucgagcucuuccgcgccaagaugccccuccgcaagcaccgcugccgcuucaaguccuacgagcacugcuucaccgccgccgaggccgucgacuggcuccacgagcuccuccgcugcucccagaacuucggccccgaggucacccgcaagcagaccguccagcuccucaagaaguuccucaagaaccacgucaucgaggacaucaagggcaaguggggcgaggaggacuucgaggacaaccgccaccucuaccgcuucccccccuccuccccccucaagcccuaccccaagaagccccccaaccagaaggacgucaucaaguuccccgaguggaacgaccucccccccggcaccucccaggagaacauccccguccgccccgucgucaugaacuccgagaugugguacaagcgccacuccaucgccaucggcgagguccccgccugccgccucguccaccgccgccagcucaccgaggccaacgucgaggagaucuggaaguccaugacccucuccuaccuccagaagauccucggccucgacucccucgaggagguccucgacgucaagcucgucaacuccaaguucaucauccacaacgucuacuccgucuccaagcagggcgucgucauccucgacgacaaguccaaggagcucccccacuggguccucuccgccaugaagugccucgccaacuggcccaacugcuccgaccucaagcagcccauguaccucggcuucgagaaggacgucuucaagaccaucgccgacuacuacggccaccucaaggagccccuccucaccuuccaccucuucgacgccuucgucuccguccucggccuccuccagaaggagaaggucgccgucgaggccuuccagaucugcugccuccuccucccccccgagaaccgccgcaagcuccagcuccucaugcgcaugauggcccgcaucugccucaacaaggagaugcccccccucugcgacggcuucggcacccgcacccucaugguccagaccuucucccgcugcauccucugcuccaaggacgaggucgaccucgacgagcuccucgccgcccgccucgucaccuuccucauggacaacuaccaggagauccucaaggucccccucgcccuccagaccuccaucgaggagcgcgucgcccaccuccgccgcguccaguuccagaaguccuaccccgaggucuaccaggagcgcuuccccacccccgaguccgccgcccuccucuuccccgagaagcccaagcccaagccccagcuccucaugugggcccucaagaagcccuuccagcccuuccagcgcacccgcuccuuccgcauguga

SEQ ID NO: 42185 - RNA, 1680 nt, Artificial Sequence
  derived and/or modified sequence opt2 from DEPDC5__Homo_sapiens__NP_001007189
augcgcaccaccaaggucuacaagcucgucauccacaagaagggcuucggcggcuccgacgacgagcucgucgucaaccccaaggucuucccccacaucaagcucggcgacaucgucgagaucgcccaccccaacgacgaguacuccccccuccuccuccaggucaagucccucaaggaggaccuccagaaggagaccaucuccgucgaccagaccgucacccaggucuuccgccuccgccccuaccaggacgucuacgucaacgucgucgaccccaaggacgucacccucgaccucgucgagcucaccuucaaggaccaguacaucggccgcggcgacauguggcgccucaagaagucccucgucuccaccugcgccuacaucacccagaaggucgaguucgccggcauccgcgcccaggccggcgagcucugggucaagaacgagaaggucaugugcggcuacaucuccgaggacacccgcgucgucuuccgcuccaccuccgccauggucuacaucuucauccagauguccugcgagaugugggacuucgacaucuacggcgaccucuacuucgagaaggccgucaacggcuuccucgccgaccucuucaccaaguggaaggagaagaacugcucccacgaggucaccgucguccucuucucccgcaccuucuacgacgccaaguccgucgacgaguuccccgagaucaaccgcgccuccauccgccaggaccacaagggccgcuucuacgaggacuucuacaaggucgucguccagaacgagcgccgcgaggaguggaccucccuccucgucaccaucaagaagcucuucauccaguaccccguccucguccgccucgagcaggccgagggcuucccccagggcgacaacuccaccuccgcccagggcaacuaccucgaggccaucaaccucuccuucaacgucuucgacaagcacuacaucaaccgcaacuucgaccgcaccggccagauguccgucgucaucacccccggcgucggcgucuucgaggucgaccgccuccucaugauccucaccaagcagcgcaugaucgacaacggcaucggcgucgaccucgucugcaugggcgagcagccccuccacgccgucccccucuucaagcuccacaaccgcuccgccccccgcgacucccgccucggcgacgacuacaacaucccccacuggaucaaccacuccuucuacaccuccaagucccagcucuucugcaacuccuucaccccccgcaucaagcucgccggcaagaagcccgccuccgagaaggccaagaacggccgcgacaccucccucggcucccccaaggaguccgagaacgcccuccccauccaggucgacuacgacgccuacgacgcccaggucuuccgccuccccggccccucccgcgcccagugccucaccaccugccgcuccguccgcgagcgcgagucccacucccgcaaguccgccuccuccugcgacgucuccuccucccccucccuccccucccgcacccuccccaccgaggagguccgcucccaggccuccgacgacuccucccucggcaaguccgccaacauccucaugaucccccacccccaccuccaccaguacgaggucuccuccucccucggcuacaccuccacccgcgagcaccucggcuga

SEQ ID NO: 42186 - RNA, 1230 nt, Artificial Sequence
  derived and/or modified sequence opt2 from DEPTOR__Homo_sapiens__NP_073620
auggaggagggcggcuccaccggcuccgccggcuccgacuccuccaccuccggcuccggcggcgcccagcagcgcgagcucgagcgcauggccgagguccucgucaccggcgagcagcuccgccuccgccuccacgaggagaaggucaucaaggaccgccgccaccaccucaagaccuaccccaacugcuucgucgccaaggagcucaucgacuggcucaucgagcacaaggaggccuccgaccgcgagaccgccaucaagcucaugcagaagcucgccgaccgcggcaucauccaccacgucugcgacgagcacaaggaguucaaggacgucaagcucuucuaccgcuuccgcaaggacgacggcaccuucccccucgacaacgaggucaaggccuucaugcgcggccagcgccucuacgagaagcucaugucccccgagaacacccuccuccagccccgcgaggaggagggcgucaaguacgagcgcaccuucauggccuccgaguuccucgacuggcucguccaggagggcgaggccaccacccgcaaggaggccgagcagcucugccaccgccucauggagcacggcaucauccagcacgucuccaacaagcaccccuucgucgacuccaaccuccucuaccaguuccgcaugaacuuccgccgccgccgccgccucauggagcuccucaacgagaagucccccuccucccaggagacccacgacucccccuucugccuccgcaagcagucccacgacaaccgcaaguccaccuccuucauguccgucucccccuccaaggagaucaagaucgucuccgccguccgccgcuccuccauguccuccugcggcuccuccggcuacuucuccuccucccccacccucuccuccuccccccccguccucugcaaccccaaguccguccucaagcgccccgucaccuccgaggagcuccucacccccggcgcccccuacgcccgcaagaccuucaccaucgucggcgacgccgucggcuggggcuucgucguccgcggcuccaagcccugccacauccaggccgucgaccccuccggccccgccgccgccgccggcaugaaggucugccaguucgucgucuccgucaacggccucaacguccuccacgucgacuaccgcaccgucuccaaccucauccucaccggcccccgcaccaucgucauggaggucauggaggagcucgagugcuga

SEQ ID NO: 42187 - RNA, 957 nt, Artificial Sequence
  derived and/or modified sequence opt2 from DERA__Homo_sapiens__NP_057038
auguccgcccacaaccgcggcaccgagcucgaccucuccuggaucuccaagauccaggucaaccaccccgccguccuccgccgcgccgagcagauccaggcccgccgcaccgucaagaaggaguggcaggccgccuggcuccucaaggccgucaccuucaucgaccucaccacccucuccggcgacgacaccuccuccaacauccagcgccucugcuacaaggccaaguaccccauccgcgaggaccuccucaaggcccucaacaugcacgacaagggcaucaccaccgccgccgucugcgucuaccccgcccgcgucugcgacgccgucaaggcccucaaggccgccggcugcaacauccccgucgccuccgucgccgccggcuuccccgccggccagacccaccucaagacccgccucgaggagauccgccucgccgucgaggacggcgccaccgagaucgacgucgucaucaaccgcucccucguccucaccggccagugggaggcccucuacgacgagauccgccaguuccgcaaggccugcggcgaggcccaccucaagaccauccucgccaccggcgagcucggcacccucaccaacgucuacaaggccuccaugaucgccaugauggccggcuccgacuucaucaagaccuccaccggcaaggagaccgucaacgccaccuuccccgucgccaucgucaugcuccgcgccauccgcgacuucuucuggaagaccggcaacaagaucggcuucaagcccgccggcggcauccgcuccgccaaggacucccucgccuggcucucccucgucaaggaggagcucggcgacgaguggcucaagcccgagcucuuccgcaucggcgccuccacccuccucuccgacaucgagcgccagaucuaccaccacgucaccggccgcuacgccgccuaccacgaccuccccauguccuga

SEQ ID NO: 42188 - RNA, 696 nt, Artificial Sequence
  derived and/or modified sequence opt2 from DERL1__Homo_sapiens__NP_001128143
auguccgacaucggcgacugguuccgcuccauccccgccaucacccgcuacugguucgccgccaccgucgccgucccccucgucggcaagcucggccucaucucccccgccuaccucuuccucuggcccgaggccuuccucuaccgcuuccagaucuggcgccccaucaccgccaccuucuacuuccccgucggccccggcaccggcuuccucuaccucgucaaccucuacuuccucuaccaguacuccacccgccucgagaccggcgccuucgacggccgccccgccgacuaccucuucaugcuccucuucaacuggaucugcaucgucaucaccggccucgccauggacaugcagcuccucaugaucccccucaucauguccguccucuacgucugggcccagcucaaccgcgacaugaucgucuccuucugguucggcacccgcuucaaggccugcuaccuccccugggucauccucggcuucaacuacaucaucggcggcuccuaccccauggaccucggcggccgcaacuuccucuccaccccccaguuccucuaccgcuggcuccccucccgccgcggcggcgucuccggcuucggcgucccccccgccuccaugcgccgcgccgccgaccagaacggcggcggcggccgccacaacuggggccagggcuuccgccucggcgaccaguga

SEQ ID NO: 42189 - RNA, 720 nt, Artificial Sequence
  derived and/or modified sequence opt2 from DERL2__Homo_sapiens__NP_057125
auggccuaccagucccuccgccucgaguaccuccagaucccccccgucucccgcgccuacaccaccgccugcguccucaccaccgccgccguccagcucgagcucaucacccccuuccagcucuacuucaaccccgagcucaucuucaagcacuuccagaucuggcgccucaucaccaacuuccucuucuucggccccgucggcuucaacuuccucuucaacaugaucuuccucuaccgcuacugccgcaugcucgaggagggcuccuuccgcggccgcaccgccgacuucgucuucauguuccucuucggcggcuuccucaugacccucuucggccucuucgucucccucgucuuccucggccaggccuucaccaucaugcucgucuacgucuggucccgccgcaaccccuacguccgcaugaacuucuucggccuccucaacuuccaggcccccuuccuccccuggguccucaugggcuucucccuccuccucggcaacuccaucaucgucgaccuccucggcaucgccgucggccacaucuacuucuuccucgaggacgucuuccccaaccagcccggcggcauccgcauccucaagacccccuccauccucaaggccaucuucgacacccccgacgaggaccccaacuacaacccccuccccgaggagcgccccggcggcuucgccuggggcgagggccagcgccucggcggcuga

SEQ ID NO: 42190 - RNA, 708 nt, Artificial Sequence
  derived and/or modified sequence opt2 from DERL3__Homo_sapiens__NP_001002862
auggccuggcagggccucgccgccgaguuccuccagguccccgccgucacccgcgccuacaccgccgccugcguccucaccaccgccgccguccagcucgagcuccucucccccuuccagcucuacuucaacccccaccucgucuuccgcaaguuccaggucuggcgccucgucaccaacuuccucuucuucggcccccucggcuucuccuucuucuucaacaugcucuucgucuuccgcuacugccgcaugcucgaggagggcuccuuccgcggccgcaccgccgacuucgucuucauguuccucuucggcggcguccucaugacccuccucggccuccucggcucccucuucuuccucggccaggcccucauggccaugcucgucuacgucuggucccgccgcuccccccgcguccgcgucaacuucuucggccuccucaccuuccaggcccccuuccuccccugggcccucaugggcuucucccuccuccucggcaacuccauccucgucgaccuccucggcaucgccgucggccacaucuacuacuuccucgaggacgucuuccccaaccagcccggcggcaagcgccuccuccagacccccggcuuccucaagcuccuccucgacgcccccgccgaggaccccaacuaccucccccuccccgaggagcagcccggcccccaccucccccccccccagcaguga

SEQ ID NO: 42191 - RNA, 1413 nt, Artificial Sequence
  derived and/or modified sequence opt2 from DES__Homo_sapiens__NP_001918
augucccaggccuacuccuccucccagcgcgucuccuccuaccgccgcaccuucggcggcgcccccggcuucccccucggcuccccccucuccucccccgucuucccccgcgccggcuucggcuccaagggcuccuccuccuccgucaccucccgcgucuaccaggucucccgcaccuccggcggcgccggcggccucggcucccuccgcgccucccgccucggcaccacccgcacccccuccuccuacggcgccggcgagcuccucgacuucucccucgccgacgccgucaaccaggaguuccucaccacccgcaccaacgagaaggucgagcuccaggagcucaacgaccgcuucgccaacuacaucgagaagguccgcuuccucgagcagcagaacgccgcccucgccgccgaggucaaccgccucaagggccgcgagcccacccgcgucgccgagcucuacgaggaggagcuccgcgagcuccgccgccaggucgagguccucaccaaccagcgcgcccgcgucgacgucgagcgcgacaaccuccucgacgaccuccagcgccucaaggccaagcuccaggaggagauccagcucaaggaggaggccgagaacaaccucgccgccuuccgcgccgacgucgacgccgccacccucgcccgcaucgaccucgagcgccgcaucgagucccucaacgaggagaucgccuuccucaagaagguccacgaggaggagauccgcgagcuccaggcccagcuccaggagcagcagguccaggucgagauggacauguccaagcccgaccucaccgccgcccuccgcgacauccgcgcccaguacgagaccaucgccgccaagaacaucuccgaggccgaggagugguacaaguccaaggucuccgaccucacccaggccgccaacaagaacaacgacgcccuccgccaggccaagcaggagaugauggaguaccgccaccagauccaguccuacaccugcgagaucgacgcccucaagggcaccaacgacucccucaugcgccagaugcgcgagcucgaggaccgcuucgccuccgaggccuccggcuaccaggacaacaucgcccgccucgaggaggagauccgccaccucaaggacgagauggcccgccaccuccgcgaguaccaggaccuccucaacgucaagauggcccucgacgucgagaucgccaccuaccgcaagcuccucgagggcgaggagucccgcaucaaccuccccauccagaccuacuccgcccucaacuuccgcgagaccucccccgagcagcgcggcuccgagguccacaccaagaagaccgucaugaucaagaccaucgagacccgcgacggcgaggucgucuccgaggccacccagcagcagcacgagguccucuga

SEQ ID NO: 42192 - RNA, 486 nt, Artificial Sequence
  derived and/or modified sequence opt2 from DESI2__Homo_sapiens__NP_001284675
augggcgccaaccagcucgucguccucaacgucuacgacauguacuggaugaacgaguacaccuccuccaucggcaucggcgucuuccacuccggcaucgaggucuacggccgcgccgucguccucggcuccaccgacuuccucgaggacgacaucgagaagaucgucgaggagcucggcaaggaguacaagggcaacgccuaccaccucaugcacaagaacugcaaccacuucuccuccgcccucuccgagauccucugcggcaaggagaucccccgcuggaucaaccgccucgccuacuucuccuccugcauccccuuccuccaguccugccuccccaaggaguggcucacccccgccgcccuccaguccuccgucucccaggagcuccaggacgagcucgaggaggccgaggacgccgccgccuccgccuccgucgccuccaccgccgccggcucccgccccggccgccacaccaagcucuga

SEQ ID NO: 42193 - RNA, 288 nt, Artificial Sequence
  derived and/or modified sequence opt2 from DEXI__Homo_sapiens__NP_054734
augcucggcgcccgcgucgccgcccaccucgacgcccucggcccccucguccccuacgucccccccccccuccuccccuccauguucuacgucggccucuucuucgucaacguccucauccucuacuacgccuuccucauggaguacaucguccucaacgucggccucgucuuccuccccgaggacauggaccaggcccucgucgaccucggcguccucuccgaccccggcuccggccucuacgacgccgacuccgagcucgacgucuucgacgccuaccucgaguga

SEQ ID NO: 42194 - RNA, 885 nt, Artificial Sequence
  derived and/or modified sequence opt2 from DFFB__Homo_sapiens__XP_011539165
augcuccagaagcccaaguccgucaagcuccgcgcccuccgcuccccccgcaaguucggcgucgccggccgcuccugccaggagguccuccgcaagggcugccuccgcuuccagcuccccgagcgcggcucccgccucugccucuacgaggacggcaccgagcucaccgaggacuacuuccccuccguccccgacaacgccgagcucguccuccucacccucggccaggccuggcagggcugcgaguggcagggccucuggcgcaugugccuccuccucgaccgccaccuccucuucgucccccucgucgccgacgucuccgacauccgccgcuuccucuccgccuuccacgagccccaggucggccucauccaggccgcccagcagcuccucugcgacgagcaggccccccagcgccagcgccuccucgccgaccuccuccacaacgucucccagaacaucgccgccgagacccgcgccgaggacccccccugguucgagggccucgagucccgcuuccaguccaaguccggcuaccuccgcuacuccugcgagucccgcauccgcuccuaccuccgcgaggucuccuccuaccccuccaccgucggcgccgaggcccaggaggaguuccuccgcguccucggcuccaugugccagcgccuccgcuccaugcaguacaacggcuccuacuucgaccgcggcgccaagggcggcucccgccucugcacccccgagggcugguucuccugccagggccccuucgacauggacuccugccucucccgccacuccaucaaccccuacuccaaccgcgagucccgcauccucuucuccaccuggaaccucgaccacaucgacggcguccuccucugcggccccggcuga

SEQ ID NO: 42195 - RNA, 1491 nt, Artificial Sequence
  derived and/or modified sequence opt2 from DFNA5__Homo_sapiens__NP_001120925
auguucgccaaggccacccgcaacuuccuccgcgaggucgacgccgacggcgaccucaucgccgucuccaaccucaacgacuccgacaagcuccagcuccucucccucgucaccaagaagaagcgcuucuggugcuggcagcgccccaaguaccaguuccucucccucacccucggcgacguccucaucgaggaccaguuccccucccccgucgucgucgaguccgacuucgucaaguacgagggcaaguucgccaaccacgucuccggcacccucgagaccgcccucggcaaggucaagcucaaccucggcggcuccucccgcgucgagucccaguccuccuucggcacccuccgcaagcaggaggucgaccuccagcagcucauccgcgacuccgccgagcgcaccaucaaccuccgcaaccccguccuccagcagguccucgagggccgcaacgagguccucugcguccucacccagaagaucaccaccaugcagaagugcgucaucuccgagcacaugcaggucgaggagaagugcggcggcaucgucggcauccagaccaagaccguccaggucuccgccaccgaggacggcaacgucaccaaggacuccaacgucguccucgagauccccgccgccaccaccaucgccuacggcgucaucgagcucuacgucaagcucgacggccaguucgaguucugccuccuccgcggcaagcagggcggcuucgagaacaagaagcgcaucgacuccgucuaccucgacccccucgucuuccgcgaguucgccuucaucgacaugcccgacgccgcccacggcaucuccucccaggacggcccccucuccguccucaagcaggccacccuccuccucgagcgcaacuuccaccccuucgccgagcuccccgagccccagcagaccgcccucuccgacaucuuccaggccguccucuucgacgacgagcuccucaugguccucgagcccgucugcgacgaccucgucuccggccucucccccaccgucgccguccucggcgagcucaagccccgccagcagcaggaccucgucgccuuccuccagcucgucggcugcucccuccagggcggcugccccggccccgaggacgccggcuccaagcagcucuucaugaccgccuacuuccucgucuccgcccucgccgagaugcccgacuccgccgccgcccuccucggcaccugcugcaagcuccagaucauccccacccucugccaccuccuccgcgcccucuccgacgacggcgucuccgaccucgaggaccccacccucaccccccucaaggacaccgagcgcuucggcaucguccagcgccucuucgccuccgccgacaucucccucgagcgccucaaguccuccgucaaggccgucauccucaaggacuccaaggucuucccccuccuccucugcaucacccucaacggccucugcgcccucggccgcgagcacuccuga

SEQ ID NO: 42196 - RNA, 2724 nt, Artificial Sequence
  derived and/or modified sequence opt2 from DFNB31__Homo_sapiens__NP_056219
augaacgccccccucgacggccucuccgucuccuccuccuccaccggcucccucggcuccgccgccggcgccggcggcggcggcggcgccggccuccgccuccucuccgccaacguccgccagcuccaccaggcccucaccgcccuccucuccgaggccgagcgcgagcaguucacccacugccucaacgccuaccacgcccgccgcaacgucuucgaccucguccgcacccuccgcguccuccucgacucccccgucaagcgccgccuccuccccaugcuccgccucgucaucccccgcuccgaccagcuccucuucgaccaguacaccgccgagggccucuaccuccccgccaccacccccuaccgccagcccgccuggggcggccccgacuccgccggccccggcgagguccgccucgucucccuccgccgcgccaaggcccacgagggccucggcuucuccauccgcggcggcuccgagcacggcgucggcaucuacgucucccucgucgagcccggcucccucgccgagaaggagggccuccgcgucggcgaccagauccuccgcgucaacgacaagucccucgcccgcgucacccacgccgaggccgucaaggcccucaagggcuccaagaagcucguccucuccgucuacuccgccggccgcauccccggcggcuacgucaccaaccacaucuacaccugggucgacccccagggccgcuccaucuccccccccuccggccucccccagccccacggcggcgcccuccgccagcaggagggcgaccgccgcuccacccuccaccuccuccagggcggcgacgagaagaaggucaaccucguccucggcgacggccgcucccucggccucaccauccgcggcggcgccgaguacggccucggcaucuacaucaccggcgucgaccccggcuccgaggccgagggcuccggccucaaggucggcgaccagauccucgaggucaacggccgcuccuuccucaacauccuccacgacgaggccguccgccuccucaaguccucccgccaccucauccucaccgucaaggacgucggccgccucccccacgcccgcaccaccgucgacgagaccaaguggaucgccuccucccgcauccgcgagaccauggccaacuccgccggcuuccucggcgaccucaccaccgagggcaucaacaagcccggcuucuacaagggccccgccggcucccaggucacccucuccucccucggcaaccagacccgcguccuccucgaggagcaggcccgccaccuccucaacgagcaggagcacgccaccauggccuacuaccucgacgaguaccgcggcggcuccgucuccgucgaggcccucgucauggcccucuucaagcuccucaacacccacgccaaguucucccuccucuccgagguccgcggcaccaucuccccccaggaccucgagcgcuucgaccaccucguccuccgccgcgagaucgaguccaugaaggcccgccagccccccggccccggcgccggcgacaccuacuccauggucuccuacuccgacaccggcuccuccaccggcucccacggcaccuccaccaccgucuccuccgcccgcaacacccucgaccucgaggagaccggcgaggccguccagggcaacaucaacgcccuccccgacgucuccgucgacgacguccgcuccaccucccagggccucuccuccuucaagccccucccccgcccccccccccucgcccagggcaacgaccucccccucggccagccccgcaagcucggccgcgaggaccuccagccccccuccuccaugcccuccugcuccggcaccgucuucuccgccccccagaaccgcuccccccccgccggcaccgcccccacccccggcaccuccuccgcccaggaccuccccuccucccccaucuacgccuccgucucccccgccaaccccuccuccaagcgcccccucgacgcccaccucgcccucgucaaccagcaccccaucggccccuucccccgcguccagucccccccccaccucaagucccccuccgccgaggccaccgucgccggcggcugccuccucccccccucccccuccggccaccccgaccagaccggcaccaaccagcacuucgucauggucgagguccaccgccccgacuccgagcccgacgucaacgagguccgcgcccucccccagacccgcaccgccuccacccucucccagcucuccgacuccggccagacccucuccgaggacuccggcgucgacgccggcgaggccgaggccuccgcccccggccgcggccgccaguccgucuccaccaagucccgcuccuccaaggagcucccccgcaacgagcgccccaccgacggcgccaacaagccccccggccuccucgagcccaccuccacccucguccgcgucaagaaguccgccgccacccucggcaucgccaucgagggcggcgccaacacccgccagccccucccccgcaucgucaccauccagcgcggcggcuccgcccacaacugcggccagcucaaggucggccacgucauccucgaggucaacggccucacccuccgcggcaaggagcaccgcgaggccgcccgcaucaucgccgaggccuucaagaccaaggaccgcgacuacaucgacuuccucgucaccgaguucaacgucaugcucuga

SEQ ID NO: 42197 - RNA, 1059 nt, Artificial Sequence
  derived and/or modified sequence opt2 from DFNB59__Homo_sapiens__NP_001036167
auguucgccgccgccaccaaguccuucgucaagcaggucggcgacggcggccgccucguccccguccccucccucuccgaggccgacaaguaccagccccucucccucgucgucaagaagaagcgcugcuuccucuucccccgcuacaaguucaccuccacccccuucacccucaaggacauccuccucggcgaccgcgagaucuccgccggcaucuccuccuaccagcuccucaacuacgaggacgaguccgacgucucccucuacggccgccgcggcaaccacaucgucaacgacgucggcaucaacgucgccggcuccgacuccaucgccgucaaggccuccuucggcaucgucaccaagcacgaggucgaggucuccacccuccucaaggagaucaccacccgcaagaucaacuucgaccacucccucauccgccagucccgcuccucccgcaaggccguccucugcgucgucauggaguccauccgcaccacccgccagugcucccucuccguccacgccggcauccgcggcgaggccaugcgcuuccacuucauggacgagcagaaccccaagggccgcgacaaggccaucgucuuccccgcccacaccaccaucgccuucuccgucuucgagcucuucaucuaccucgacggcgccuucgaccucugcgucaccuccgucuccaagggcggcuucgagcgcgaggagaccgccaccuucgcccuccucuaccgccuccgcaacauccucuucgagcgcaaccgccgcgucauggacgucaucucccgcucccagcucuaccucgacgaccucuucuccgacuacuacgacaagccccucuccaugaccgacaucucccucaaggagggcacccacauccgcgucaaccuccucaaccacaacauccccaagggccccugcauccucugcggcaugggcaacuucaagcgcgagaccgucuacggcugcuuccagugcuccgucgacggccagaaguacguccgccuccacgccguccccugcuucgacaucuggcacaagcgcaugaaguga

SEQ ID NO: 42198 - RNA, 1467 nt, Artificial Sequence
  derived and/or modified sequence opt2 from DGAT1__Homo_sapiens__NP_036211
augggcgaccgcggcuccucccgccgccgccgcaccggcucccgccccuccucccacggcggcggcggccccgccgccgccgaggaggagguccgcgacgccgccgccggccccgacgucggcgccgccggcgacgcccccgcccccgcccccaacaaggacggcgacgccggcgucggcuccggccacugggagcuccgcugccaccgccuccaggacucccucuucuccuccgacuccggcuucuccaacuaccgcggcauccucaacuggugcgucgucaugcucauccucuccaacgcccgccucuuccucgagaaccucaucaaguacggcauccucgucgaccccauccaggucgucucccucuuccucaaggaccccuacuccuggcccgcccccugccucgucaucgccgccaacgucuucgccgucgccgccuuccaggucgagaagcgccucgccgucggcgcccucaccgagcaggccggccuccuccuccacgucgccaaccucgccaccauccucugcuuccccgccgccgucguccuccucgucgaguccaucacccccgucggcucccuccucgcccucauggcccacaccauccucuuccucaagcucuucuccuaccgcgacgucaacuccuggugccgccgcgcccgcgccaaggccgccuccgccggcaagaaggccuccuccgccgccgccccccacaccgucuccuaccccgacaaccucaccuaccgcgaccucuacuacuuccucuucgcccccacccucugcuacgagcucaacuucccccgcuccccccgcauccgcaagcgcuuccuccuccgccgcauccucgagaugcucuucuucacccagcuccaggucggccucauccagcaguggaugguccccaccauccagaacuccaugaagcccuucaaggacauggacuacucccgcaucaucgagcgccuccucaagcucgccguccccaaccaccucaucuggcucaucuucuucuacuggcucuuccacuccugccucaacgccgucgccgagcucaugcaguucggcgaccgcgaguucuaccgcgacugguggaacuccgaguccgucaccuacuucuggcagaacuggaacauccccguccacaaguggugcauccgccacuucuacaagcccaugcuccgccgcggcuccuccaaguggauggcccgcaccggcgucuuccucgccuccgccuucuuccacgaguaccucgucuccgucccccuccgcauguuccgccucugggccuucaccggcaugauggcccagaucccccucgccugguucgucggccgcuucuuccagggcaacuacggcaacgccgccgucuggcucucccucaucaucggccagcccaucgccguccucauguacguccacgacuacuacguccucaacuacgaggcccccgccgccgaggccuga

SEQ ID NO: 42199 - RNA, 1038 nt, Artificial Sequence
  derived and/or modified sequence opt2 from DGAT2__Homo_sapiens__NP_001240820
augaagacccucaucgccgccuacuccggcguccuccgcggcgagcgccaggccgaggccgaccgcucccagcgcucccacggcggccccgcccucucccgcgagggcuccggccgcuggggcgucgccugcuccgccauccucauguacaucuucugcaccgacugcuggcucaucgccguccucuacuucaccuggcucgucuucgacuggaacacccccaagaagggcggccgccgcucccaguggguccgcaacugggccgucuggcgcuacuuccgcgacuacuuccccauccagcucgucaagacccacaaccuccucaccacccgcaacuacaucuucggcuaccacccccacggcaucaugggccucggcgccuucugcaacuucuccaccgaggccaccgaggucuccaagaaguuccccggcauccgccccuaccucgccacccucgccggcaacuuccgcaugcccguccuccgcgaguaccucauguccggcggcaucugccccgucucccgcgacaccaucgacuaccuccucuccaagaacggcuccggcaacgccaucaucaucgucgucggcggcgccgccgagucccucuccuccaugcccggcaagaacgccgucacccuccgcaaccgcaagggcuucgucaagcucgcccuccgccacggcgccgaccucguccccaucuacuccuucggcgagaacgaggucuacaagcaggucaucuucgaggagggcuccuggggccgcuggguccagaagaaguuccagaaguacaucggcuucgcccccugcaucuuccacggccgcggccucuucuccuccgacaccuggggccucguccccuacuccaagcccaucaccaccgucgucggcgagcccaucaccauccccaagcucgagcaccccacccagcaggacaucgaccucuaccacaccauguacauggaggcccucgucaagcucuucgacaagcacaagaccaaguucggccuccccgagaccgagguccucgaggucaacuga

SEQ ID NO: 42200 - RNA, 1530 nt, Artificial Sequence
  derived and/or modified sequence opt2 from DGCR2__Homo_sapiens__NP_001167004
augguccccaaggccgacuccggcgccuuccuccuccucuuccuccucguccucaccgucaccgagccccuccgccccgaggucaccggcgagguccgcccccaccacggcaaggaggccgucgacccccgccagggccgcgcccgcggcggcgaccccucccacuuccacgccgucaacgucgcccagcccguccgcuucuccuccuuccucggcaagugccccaccggcuggcaccacuacgagggcaccgccuccugcuaccgcgucuaccucuccggcgagaacuacugggacgccgcccagaccugccagcgccucaacggcucccucgccaccuucuccaccgaccaggagcuccgcuucguccucgcccaggagugggaccagcccgagcgcuccuucggcuggaaggaccagcgcaagcucugggucggcuaccaguacgucaucaccggccgcaaccgcucccucgagggccgcugggaggucgccuucaagggcuccuccgaggucuuccucccccccgaccccaucuucgccuccgccauguccgagaacgacaacgucuucugcgcccagcuccagugcuuccacuuccccacccuccgccaccacgaccuccacuccuggcacgccgaguccugcuacgagaaguccuccuuccucugcaagcgcucccagaccugcgucgacaucaaggacaacgucgucgacgagggcuucuacuucacccccaagggcgacgaccccugccucuccugcaccugccacggcggcgagcccgagaugugcgucgccgcccucugcgagcgcccccagggcugccagcaguaccgcaaggaccccaaggagugcugcaaguucaugugccucgaccccgacggcaacucccucuucgacuccauggccuccggcaugcgccucgucgucuccugcaucuccuccuuccucauccucucccuccuccucuucaugguccaccgccuccgccagcgccgccgcgagcgcaucgagucccucaucggcgccaaccuccaccacuucaaccucggccgccgcauccccggcuucgacuacggccccgacggcuucggcaccggccucaccccccuccaccucuccgacgacggcgagggcggcaccuuccacuuccacgacccccccccccccuacaccgccuacaaguaccccgacaucggccagcccgacgacccccccccccccuacgaggccuccauccaccccgacuccgucuucuacgaccccgccgacgacgacgccuucgagcccgucgaggucucccuccccgcccccggcgacggcggcuccgagggcgcccuccuccgccgccucgagcagccccuccccaccgccggcgccucccucgccgaccucgaggacuccgccgacuccuccuccgcccuccucgucccccccgaccccgcccaguccggcuccacccccgccgccgaggcccuccccggcggcggccgccacucccgcuccucccucaacaccgucgucuga

SEQ ID NO: 42201 - RNA, 663 nt, Artificial Sequence
  derived and/or modified sequence opt2 from DGCR6L__Homo_sapiens__NP_150282
auggagcgcuacgccgccgcccucgaggaggucgccgacggcgcccgccagcaggagcgccacuaccagcuccucuccgcccuccagucccucgucaaggagcuccccuccuccuuccagcagcgccucuccuacaccacccucuccgaccucgcccucgcccuccucgacggcaccgucuucgagaucguccagggccuccucgagauccagcaccucaccgagaagucccucuacaaccagcgccuccgccuccagaacgagcaccgcguccuccgccaggcccuccgccagaagcaccaggaggcccagcaggccugccgcccccacaaccuccccgucguccaggccgcccagcagcgcgagcucgaggccgucgagcaccgcauccgcgaggagcagcgcgccauggaccagaagaucauccucgagcucgaccgcaaggucgccgaccagcaguccacccucgagaaggccggcgucgccggcuucuacgucaccaccaacccccaggagcucaugcuccagaugaaccuccucgagcucauccgcaagcuccagcagcgcggcugccgcgccggcaacgccgcccucggccucggcggccccuggcagucccccgccgcccagugcgaccagaagggcucccccgucccccccuga

SEQ ID NO: 42202 - RNA, 2223 nt, Artificial Sequence
  derived and/or modified sequence opt2 from DGCR8__Homo_sapiens__NP_001177255
auggagaccgacgagucccccuccccccuccccugcggccccgccggcgaggccgucauggagucccgcgcccgccccuuccaggcccucccccgcgagcagucccccccccccccccuccagaccuccuccggcgccgaggucauggacgucggcuccggcggcgacggccaguccgagcuccccgccgaggaccccuucaacuucuacggcgccucccuccucuccaagggcuccuucuccaagggccgccuccucaucgaccccaacugcuccggccacuccccccgcaccgcccgccacgcccccgccguccgcaaguucucccccgaccucaagcuccucaaggacgucaagaucuccgucuccuucaccgaguccugccgcuccaaggaccgcaagguccucuacaccggcgccgagcgcgacguccgcgccgagugcggccuccuccucucccccgucuccggcgacguccacgccugccccuucggcggcuccgucggcgacggcgucggcaucggcggcgaguccgccgacaagaaggacgaggagaacgagcucgaccaggagaagcgcgucgaguacgccguccucgacgagcucgaggacuucaccgacaaccucgagcucgacgaggagggcgccggcggcuucaccgccaaggccaucguccagcgcgaccgcgucgacgaggaggcccucaacuuccccuacgaggacgacuucgacaacgacgucgacgcccuccucgaggagggccucugcgcccccaagaagcgccgcaccgaggagaaguacggcggcgacuccgaccaccccuccgacggcgagaccuccguccagcccaugaugaccaagaucaagaccguccucaagucccgcggccgcccccccaccgagccccuccccgacggcuggaucaugaccuuccacaacuccggcguccccgucuaccuccaccgcgagucccgcgucgucaccuggucccgccccuacuuccucggcaccggcuccauccgcaagcacgaccccccccucuccuccauccccugccuccacuacaagaagaugaaggacaacgaggagcgcgagcaguccuccgaccucacccccuccggcgacgucucccccgucaagccccucucccgcuccgccgagcucgaguucccccucgacgagcccgacuccaugggcgccgaccccggcccccccgacgagaaggacccccucggcgccgaggccgcccccggcgcccucggccaggucaaggccaaggucgaggucugcaaggacgaguccgucgaccucgaggaguuccgcuccuaccucgagaagcgcuucgacuucgagcaggucaccgucaagaaguuccgcaccugggccgagcgccgccaguucaaccgcgagaugaagcgcaagcaggccgaguccgagcgccccauccuccccgccaaccagaagcucaucacccucuccguccaggacgcccccaccaagaaggaguucgucaucaaccccaacggcaaguccgaggucugcauccuccacgaguacaugcagcgcguccucaagguccgccccgucuacaacuucuucgagugcgcccgcgccacccucgagauccucauccccgacuucgucaagcagaccuccgaggagaagcccaaggacuccgaggagcucgaguacuucaaccacaucuccaucgaggacucccgcgucuacgagcucaccuccaaggccggccuccucucccccuaccagauccuccacgagugccucaagcgcaaccacggcaugggcgacaccuccaucaaguucgaggucguccccggcaagaaccagaaguccgaguacgucauggccugcggcaagcacaccguccgcggcuggugcaagaacaagcgcgucggcaagcagcucgccucccagaagauccuccagcuccuccacccccacgucaagaacuggggcucccuccuccgcauguacggccgcgaguccuccaagauggucaagcaggagaccuccgacaaguccgucaucgagcuccagcaguacgccaagaagaacaagcccaaccuccacauccucuccaagcuccaggaggagaugaagcgccucgccgaggagcgcgaggagacccgcaagaagcccaagauguccaucgucgccuccgcccagcccggcggcgagccccucugcaccgucgacgucuga

SEQ ID NO: 42203 - RNA, 2208 nt, Artificial Sequence
  derived and/or modified sequence opt2 from DGKA__Homo_sapiens__NP_958853
auggccaaggagcgcggccucaucucccccuccgacuucgcccagcuccagaaguacauggaguacuccaccaagaaggucuccgacguccucaagcucuucgaggacggcgagauggccaaguacguccagggcgacgccaucggcuacgagggcuuccagcaguuccucaagaucuaccucgaggucgacaacgucccccgccaccucucccucgcccucuuccaguccuucgagaccggccacugccucaacgagaccaacgucaccaaggacgucgucugccucaacgacgucuccugcuacuucucccuccucgagggcggccgccccgaggacaagcucgaguucaccuucaagcucuacgacaccgaccgcaacggcauccucgacuccuccgaggucgacaagaucauccuccagaugaugcgcgucgccgaguaccucgacugggacgucuccgagcuccgccccauccuccaggagaugaugaaggagaucgacuacgacggcuccggcuccgucucccaggccgaguggguccgcgccggcgccaccaccgucccccuccucguccuccucggccucgagaugacccucaaggacgacggccagcacauguggcgccccaagcgcuucccccgccccgucuacugcaaccucugcgaguccuccaucggccucggcaagcagggccucuccugcaaccucugcaaguacaccguccacgaccagugcgccaugaaggcccuccccugcgaggucuccaccuacgccaagucccgcaaggacaucggcguccagucccacgucuggguccgcggcggcugcgaguccggccgcugcgaccgcugccagaagaagauccgcaucuaccacucccucaccggccuccacugcgucuggugccaccucgagauccacgacgacugccuccaggccgucggccacgagugcgacugcggccuccuccgcgaccacauccucccccccuccuccaucuaccccuccguccucgccuccggccccgaccgcaagaacuccaagaccucccagaagaccauggacgaccucaaccucuccaccuccgaggcccuccgcaucgaccccguccccaacacccacccccuccucgucuucgucaaccccaaguccggcggcaagcagggccagcgcguccucuggaaguuccaguacauccucaacccccgccaggucuucaaccuccucaaggacggccccgagaucggccuccgccucuucaaggacguccccgacucccgcauccucgucugcggcggcgacggcaccgucggcuggauccucgagaccaucgacaaggccaaccuccccguccucccccccgucgccguccucccccucggcaccggcaacgaccucgcccgcugccuccgcuggggcggcggcuacgagggccagaaccucgccaagauccucaaggaccucgagauguccaaggucguccacauggaccgcugguccgucgaggucaucccccagcagaccgaggagaaguccgaccccguccccuuccagaucaucaacaacuacuucuccaucggcgucgacgccuccaucgcccaccgcuuccacaucaugcgcgagaaguaccccgagaaguucaacucccgcaugaagaacaagcucugguacuucgaguucgccaccuccgaguccaucuucuccaccugcaagaagcucgaggagucccucaccgucgagaucugcggcaagccccucgaccucuccaaccucucccucgagggcaucgccguccucaacauccccuccaugcacggcggcuccaaccucuggggcgacacccgccgcccccacggcgacaucuacggcaucaaccaggcccucggcgccaccgccaaggucaucaccgaccccgacauccucaagaccugcguccccgaccucuccgacaagcgccucgaggucgucggccucgagggcgccaucgagaugggccagaucuacaccaagcucaagaacgccggccgccgccucgccaagugcuccgagaucaccuuccacaccaccaagacccuccccaugcagaucgacggcgagcccuggaugcagacccccugcaccaucaagaucacccacaagaaccagaugcccaugcucaugggcccccccccccgcuccaccaacuucuucggcuuccucuccuga

SEQ ID NO: 42204 - RNA, 2415 nt, Artificial Sequence
  derived and/or modified sequence opt2 from DGKB__Homo_sapiens__NP_004071
augaccaaccaggagaagugggcccaccucucccccuccgaguucucccagcuccagaaguacgccgaguacuccaccaagaagcucaaggacguccucgaggaguuccacggcaacggcguccucgccaaguacaaccccgagggcaagcaggacauccucaaccagaccaucgacuucgagggcuucaagcucuucaugaagaccuuccucgaggccgagcuccccgacgacuucaccgcccaccucuucauguccuucuccaacaaguucccccacuccucccccauggucaaguccaagcccgcccuccucuccggcggccuccgcaugaacaagggcgccaucacccccccccgcaccaccucccccgccaacaccugcucccccgaggucauccaccucaaggacaucgucugcuaccucucccuccucgagcgcggccgccccgaggacaagcucgaguucauguuccgccucuacgacaccgacggcaacggcuuccucgacuccuccgagcucgagaacaucaucucccagaugaugcacgucgccgaguaccucgagugggacgucaccgagcucaaccccauccuccacgagaugauggaggagaucgacuacgaccacgacggcaccgucucccucgaggaguggauccagggcggcaugaccaccaucccccuccucguccuccucggccucgagaacaacgucaaggacgacggccagcacgucuggcgccucaagcacuucaacaagcccgccuacugcaaccucugccucaacaugcucaucggcgucggcaagcagggccucugcugcuccuucugcaaguacaccguccacgagcgcugcgucgcccgcgccccccccuccugcaucaagaccuacgucaaguccaagcgcaacaccgacgucaugcaccacuacugggucgagggcaacugccccaccaagugcgacaagugccacaagaccgucaagugcuaccagggccucaccggccuccacugcgucuggugccagaucacccuccacaacaagugcgccucccaccucaagcccgagugcgacugcggcccccucaaggaccacauccucccccccaccaccaucugccccgucguccuccagacccuccccaccuccggcgucuccguccccgaggagcgccaguccaccgucaagaaggagaaguccggcucccagcagcccaacaaggucaucgacaagaacaagaugcagcgcgccaacuccgucaccgucgacggccagggccuccaggucacccccguccccggcacccacccccuccucgucuucgucaaccccaaguccggcggcaagcagggcgagcgcaucuaccgcaaguuccaguaccuccucaacccccgccaggucuacucccucuccggcaacggccccaugcccggccucaacuucuuccgcgacguccccgacuuccgcguccucgccugcggcggcgacggcaccgucggcuggguccucgacugcaucgagaaggccaacgucggcaagcacccccccgucgccauccucccccucggcaccggcaacgaccucgcccgcugccuccgcuggggcggcggcuacgagggcgagaaccucaugaagauccucaaggacaucgagaacuccaccgagaucaugcucgaccgcuggaaguucgaggucauccccaacgacaaggacgagaagggcgaccccguccccuacuccaucaucaacaacuacuucuccaucggcgucgacgccuccaucgcccaccgcuuccacaucaugcgcgagaagcaccccgagaaguucaacucccgcaugaagaacaaguucugguacuucgaguucggcaccuccgagaccuucuccgccaccugcaagaagcuccacgaguccgucgagaucgagugcgacggcguccagaucgaccucaucaacaucucccucgagggcaucgccauccucaacauccccuccaugcacggcggcuccaaccucuggggcgaguccaagaagcgccgcucccaccgccgcaucgagaagaagggcuccgacaagcgcaccaccgucaccgacgccaaggagcucaaguucgccucccaggaccucuccgaccagcuccucgaggucgucggccucgagggcgccauggagaugggccagaucuacaccggccucaaguccgccggccgccgccucgcccagugcuccugcgucgucauccgcaccuccaagucccuccccaugcagaucgacggcgagcccuggaugcagacccccugcaccaucaagaucacccacaagaaccaggcccccaugcucaugggccccccccccaagaccggccucuucugcucccucgucaagcgcacccgcaaccgcuccaaggaguga

SEQ ID NO: 42205 - RNA, 3513 nt, Artificial Sequence
  derived and/or modified sequence opt2 from DGKD__Homo_sapiens__NP_003639
augaacauguuccucuacuuccagaccaucaucaaggagggcaugcucaccaagcagaacaacuccuuccagcgcuccaagcgccgcuacuucaagcuccgcggccgcacccucuacuacgccaagaccgccaaguccaucaucuucgacgaggucgaccucaccgacgccuccgucgccgaguccuccaccaagaacgucaacaacuccuucaccgucaucacccccugccgcaagcucauccucugcgccgacaaccgcaaggagauggaggacuggaucgccgcccucaagaccguccagaaccgcgagcacuucgagcccacccaguacuccauggaccacuucuccggcaugcacaacugguacgccugcucccacgcccgccccaccuacugcaacgucugccgcgaggcccucuccggcgucaccucccacggccucuccugcgaggucugcaaguucaaggcccacaagcgcugcgccguccgcgccaccaacaacugcaaguggaccacccucgccuccaucggcaaggacaucaucgaggacgccgacggcaucgccaugccccaccaguggcucgagggcaaccuccccgucuccgccaagugcaccgucugcgacaagaccugcggcuccguccuccgccuccaggacuggcgcugccucuggugcaaggccaugguccacaccuccugcaaggagucccuccucaccaagugcccccucggccucugcaaggucuccgucaucccccccaccgcccucaacuccaucgacuccgacggcuucuggaaggccuccugcccccccuccugcaccuccccccuccucgucuucgucaacuccaaguccggcgacaaccagggcgucaaguuccuccgccgcuucaagcagcuccucaaccccgcccaggucuucgaccucaugaacggcggcccccaccucggccuccgccucuuccagaaguucgacaccuuccgcauccucgucugcggcggcgacggcuccgucggcuggguccucuccgagaucgacucccucaaccuccacaagcagugccagcucggcguccucccccucggcaccggcaacgaccucgcccgcguccucggcuggggcuccgccugcgacgacgacacccagcucccccagauccucgagaagcucgagcgcgccuccaccaagaugcucgaccgcugguccgucauggccuacgaggccaagcucccccgccaggccuccuccuccaccgucaccgaggacuucuccgaggacuccgagguccagcagauccucuucuacgaggacuccgucgccgcccaccucuccaagauccucaccuccgaccagcacuccgucgucaucuccuccgccaagguccucugcgagaccgucaaggacuucgucgcccgcgucggcaaggccuacgagaagaccaccgaguccuccgaggaguccgaggucauggccaagaagugcuccguccucaaggagaagcucgacucccuccucaagacccucgacgacgagucccaggccuccuccucccuccccaaccccccccccaccaucgccgaggaggccgaggacggcgacggcuccggcuccaucugcggcuccaccggcgaccgccucgucgccuccgccugccccgcccgcccccagaucuuccgcccccgcgagcagcucaugcuccgcgccaacucccucaagaaggccauccgccagaucaucgagcacaccgagaaggccgucgacgagcagaacgcccagacccaggagcaggagggcuucguccucggccucuccgaguccgaggagaagauggaccaccgcgucugccccccccucucccacuccgaguccuucggcguccccaagggccgcucccagcgcaaggucuccaagucccccugcgagaagcucaucuccaagggcucccucucccucggcuccuccgccucccuccccccccagcccggcucccgcgacggccuccccgcccucaacaccaagauccucuaccccaacguccgcgccggcauguccggcucccuccccggcggcuccgucaucucccgccuccucaucaacgccgaccccuucaacuccgagcccgagacccucgaguacuacaccgagaagugcgucaugaacaacuacuucggcaucggccucgacgccaagaucucccucgacuucaacaacaagcgcgacgagcaccccgagaagugccgcucccgcaccaagaacaugaugugguacggcguccucggcaccaaggagcuccuccaccgcaccuacaagaaccucgagcagaagguccuccucgagugcgacggccgccccaucccccuccccucccuccagggcaucgccguccucaacauccccuccuacgccggcggcaccaacuucuggggcggcaccaaggaggacgacaccuucgccgcccccuccuucgacgacaagauccucgaggucgucgccgucuucggcuccaugcagauggccgucucccgcgucauccgccuccagcaccaccgcaucgcccagugccgcaccgucaagaucuccauccucggcgacgagggcguccccguccaggucgacggcgaggccuggguccagccccccggcuacauccgcaucguccacaagaaccgcgcccagacccucacccgcgaccgcgccuucgaguccacccucaaguccugggaggacaagcagaagugcgagcucccccgcccccccuccugcucccuccaccccgagaugcucuccgaggaggaggccacccagauggaccaguucggccaggccgccggcguccucauccacuccauccgcgagaucgcccagucccaccgcgacauggagcaggagcucgcccacgccgucaacgccuccuccaaguccauggaccgcgucuacggcaagccccgcaccaccgagggccucaacugcuccuucguccucgagauggucaacaacuuccgcgcccuccgcuccgagaccgagcuccuccucuccggcaagauggcccuccagcucgaccccccccagaaggagcagcucggcuccgcccucgccgagauggaccgccagcuccgccgccucgccgacacccccuggcucugccaguccgccgagcccggcgacgaggaguccgucaugcucgaccucgccaagcgcucccgcuccggcaaguuccgccucgucaccaaguucaagaaggagaagaacaacaagaacaaggaggcccacuccucccucggcgcccccguccaccucuggggcaccgaggaggucgccgccuggcucgagcaccucucccucugcgaguacaaggacaucuucacccgccacgacauccgcggcuccgagcuccuccaccucgagcgccgcgaccucaaggaccucggcgucaccaaggucggccacaugaagcgcauccucugcggcaucaaggagcucucccgcuccgcccccgccgucgaggccuga

SEQ ID NO: 42206 - RNA, 1704 nt, Artificial Sequence
  derived and/or modified sequence opt2 from DGKE__Homo_sapiens__NP_003638
auggaggccgagcgccgccccgcccccggcucccccuccgagggccucuucgccgacggccaccucauccucuggacccucugcuccguccuccuccccgucuucaucaccuucuggugcucccuccagcgcucccgccgccagcuccaccgccgcgacaucuuccgcaaguccaagcacggcuggcgcgacaccgaccucuucucccagcccaccuacugcugcgucugcgcccagcacauccuccagggcgccuucugcgacugcugcggccuccgcgucgacgagggcugccuccgcaaggccgacaagcgcuuccagugcaaggagaucaugcucaagaacgacaccaagguccucgacgccaugccccaccacuggauccgcggcaacgucccccucugcuccuacugcauggucugcaagcagcagugcggcugccagcccaagcucugcgacuaccgcugcaucuggugccagaagaccguccacgacgagugcaugaagaacucccucaagaacgagaagugcgacuucggcgaguucaagaaccucaucaucccccccuccuaccucaccuccaucaaccagaugcgcaaggacaagaagaccgacuacgagguccucgccuccaagcucggcaagcaguggaccccccucaucauccucgccaacucccgcuccggcaccaacaugggcgagggccuccucggcgaguuccgcauccuccucaaccccguccaggucuucgacgucaccaagaccccccccaucaaggcccuccagcucugcacccuccuccccuacuacuccgcccgcguccucgucugcggcggcgacggcaccgucggcuggguccucgacgccgucgacgacaugaagaucaagggccaggagaaguacaucccccaggucgccguccucccccucggcaccggcaacgaccucuccaacacccucggcuggggcaccggcuacgccggcgagauccccgucgcccagguccuccgcaacgucauggaggccgacggcaucaagcucgaccgcuggaagguccaggucaccaacaagggcuacuacaaccuccgcaagcccaaggaguucaccaugaacaacuacuucuccgucggccccgacgcccucauggcccucaacuuccacgcccaccgcgagaaggcccccucccucuucuccucccgcauccucaacaaggccgucuaccucuucuacggcaccaaggacugccucguccaggagugcaaggaccucaacaagaaggucgagcucgagcucgacggcgagcgcgucgcccuccccucccucgagggcaucaucguccucaacaucggcuacuggggcggcggcugccgccucugggagggcaugggcgacgagaccuacccccucgcccgccacgacgacggccuccucgaggucgucggcgucuacggcuccuuccacugcgcccagauccaggucaagcucgccaaccccuuccgcaucggccaggcccacaccguccgccucauccucaagugcuccaugaugcccaugcaggucgacggcgagcccugggcccagggccccugcaccgucaccaucacccacaagacccacgccaugaugcucuacuucuccggcgagcagaccgacgacgacaucuccuccaccuccgaccaggaggacaucaaggccaccgaguga

SEQ ID NO: 42207 - RNA, 2301 nt, Artificial Sequence
  derived and/or modified sequence opt2 from DGKG__Homo_sapiens__NP_001074213
augggcgaggagcgcugggucucccucacccccgaggaguucgaccagcuccagaaguacuccgaguacuccuccaagaagaucaaggacgcccucaccgaguucaacgagggcggcucccucaagcaguacgacccccacgagcccaucuccuacgacgucuucaagcucuucaugcgcgccuaccucgaggucgaccucccccagccccucuccacccaccucuuccucgccuucucccagaagccccgccacgagaccuccgaccaccccaccgagggcgccuccaacuccgaggccaacuccgccgacaccaacauccagaacgccgacaacgccaccaaggccgacgaggccugcgcccccgacaccgaguccaacauggccgagaagcaggcccccgccgaggaccaggucgccgccaccccccucgagccccccgucccccgcuccuccuccuccgagucccccgucgucuaccucaaggacgucgucugcuaccucucccuccucgagaccggccgcccccaggacaagcucgaguucauguuccgccucuacgacuccgacgagaacggccuccucgaccaggccgagauggacugcaucgucaaccagaugcuccacaucgcccaguaccucgagugggaccccaccgagcuccgccccauccucaaggagaugcuccagggcauggacuacgaccgcgacggcuucgucucccuccaggaguggguccacggcggcaugaccaccaucccccuccucguccuccucggcauggacgacuccggcuccaagggcgacggccgccacgccuggaccaugaagcacuucaagaagcccaccuacugcaacuucugccacaucaugcucaugggcguccgcaagcagggccucugcugcaccuacugcaaguacaccguccacgagcgcugcgucucccgcaacauccccggcugcgucaagaccuacuccaaggccaagcgcuccggcgaggucaugcagcacgccugggucgagggcaacuccuccgucaagugcgaccgcugccacaaguccaucaagugcuaccaguccgucaccgcccgccacugcgucuggugccgcaugaccuuccaccgcaagugcgagcucuccacccucugcgacggcggcgagcuccgcgaccacauccuccuccccaccuccaucugccccaucacccgcgaccgccccggcgagaaguccgacggcugcgucuccgccaagggcgagcucgucaugcaguacaagaucauccccacccccggcacccacccccuccucguccucgucaaccccaaguccggcggccgccagggcgagcgccucaacuucuuccgcgacacccccgacuuccgcguccucgccugcggcggcgacggcaccgucggcuggauccucgacugcaucgacaaggccaacuucgccaagcacccccccgucgccguccucccccucggcaccggcaacgaccucgcccgcugccuccgcuggggcggcggcuacgagggcggcucccucaccaagauccucaaggacaucgagcaguccccccucgucaugcucgaccgcuggcaccucgaggucaucccccgcgaggaggucgagaacggcgaccagguccccuacuccaucaugaacaacuacuucuccaucggcgucgacgccuccaucgcccaccgcuuccacgucaugcgcgagaagcaccccgagaaguucaacucccgcaugaagaacaagcucugguacuucgaguucggcaccuccgagaccuucgccgccaccugcaagaagcuccacgaccacaucgagcucgagugcgacggcgucggcgucgaccucuccaacaucuuccucgagggcaucgccauccucaacauccccuccauguacggcggcaccaaccucuggggcgagaacaagaagaaccgcgccgucauccgcgagucccgcaagggcgucaccgaccccaaggagcucaaguucugcguccaggaccucuccgaccagcuccucgaggucgucggccucgagggcgccauggagaugggccagaucuacaccggccucaaguccgccggccgccgccucgcccagugcgccuccgucaccauccgcaccaacaagcuccuccccaugcaggucgacggcgagcccuggaugcagcccugcugcaccaucaagaucacccacaagaaccaggcccccaugaugaugggccccccccagaaguccuccuucuucucccuccgccgcaagucccgcuccaaggacuga

SEQ ID NO: 42208 - RNA, 3495 nt, Artificial Sequence
  derived and/or modified sequence opt2 from DGKH__Homo_sapiens__NP_001191433
auggccggcgccggcggccagcaccacccccccggcgccgccggcggcgccgccgccggcgccggcgccgccgucaccuccgccgccgccuccgccggccccggcgaggacuccuccgacuccgaggccgagcaggagggcccccagaagcucauccgcaaggucuccaccuccggccagauccgcaccaagaccuccaucaaggagggccagcuccucaagcagaccuccuccuuccagcgcuggaagaagcgcuacuucaagcuccgcggccgcacccucuacuacgccaaggacuccaagucccucaucuucgacgaggucgaccucuccgacgccuccgucgccgaggccuccaccaagaacgccaacaacuccuucaccaucaucacccccuuccgccgccucaugcucugcgccgagaaccgcaaggagauggaggacuggaucuccucccucaaguccguccagacccgcgagcccuacgaggucgcccaguucaacgucgagcacuucuccggcaugcacaacugguacgccugcucccacgcccgccccaccuucugcaacgucugccgcgagucccucuccggcgucaccucccacggccucuccugcgaggucugcaaguucaaggcccacaagcgcugcgccguccgcgccaccaacaacugcaaguggaccacccucgccuccaucggcaaggacaucaucgaggacgaggacggcgucgccaugccccaccaguggcucgagggcaaccuccccgucuccgccaagugcgccgucugcgacaagaccugcggcuccguccuccgccuccaggacuggaagugccucuggugcaagaccaugguccacaccgccugcaaggaccucuaccaccccaucugcccccucggccagugcaaggucuccaucaucccccccaucgcccucaacuccaccgacuccgacggcuucugccgcgccaccuucuccuucugcgucuccccccuccucgucuucgucaacuccaaguccggcgacaaccagggcgucaaguuccuccgccgcuucaagcagcuccucaaccccgcccaggucuucgaccucaugaacggcggcccccaccucggccuccgccucuuccagaaguucgacaacuuccgcauccucgucugcggcggcgacggcuccgucggcuggguccucuccgagaucgacaagcucaaccucaacaagcagugccagcucggcguccucccccucggcaccggcaacgaccucgcccgcguccucggcuggggcggcuccuacgacgacgacacccagcucccccagauccucgagaagcucgagcgcgccuccaccaagaugcucgaccgcugguccaucaugaccuacgagcucaagcucccccccaaggccucccuccuccccggcccccccgaggccuccgaggaguucuacaugaccaucuacgaggacuccgucgccacccaccucaccaagauccucaacuccgacgagcacgccgucgucaucuccuccgccaagacccucugcgagaccgucaaggacuucgucgccaaggucgagaagaccuacgacaagacccucgagaacgccgucgucgccgacgccgucgccuccaagugcuccguccucaacgagaagcucgagcagcuccuccaggcccuccacaccgacucccaggccgcccccguccuccccggccucuccccccucaucgucgaggaggacgccgucgaguccuccuccgaggagucccucggcgaguccaaggagcagcucggcgacgacgucaccaagcccuccucccagaaggccgucaagccccgcgagaucaugcuccgcgccaacucccucaagaaggccguccgccaggucaucgaggaggccggcaaggucauggacgaccccaccguccaccccugcgagcccgccaaccaguccuccgacuacgacuccaccgagaccgacgaguccaaggaggaggccaaggacgacggcgccaaggaguccaucaccgucaagaccgccccccgcucccccgacgcccgcgccuccuacggccacucccagaccgacuccguccccggccccgccgucgccgccuccaaggagaaccuccccguccucaacacccgcaucaucugccccggccuccgcgccggccucgccgccuccaucgccggcuccuccaucaucaacaagaugcuccucgccaacaucgaccccuucggcgccacccccuucaucgaccccgaccucgacuccgucgacggcuacuccgagaagugcgucaugaacaacuacuucggcaucggccucgacgccaagaucucccucgaguucaacaacaagcgcgaggagcaccccgagaagugccgcucccgcaccaagaaccucaugugguacggcguccucggcacccgcgagcuccuccagcgcuccuacaagaaccucgagcagcgcguccagcucgagugcgacggccaguacaucccccuccccucccuccagggcaucgccguccucaacauccccuccuacgccggcggcaccaacuucuggggcggcaccaaggaggacgacaucuucgccgcccccuccuucgacgacaagauccucgaggucgucgccaucuucgacuccaugcagauggccgucucccgcgucaucaagcuccagcaccaccgcaucgcccagugccgcaccgucaagaucaccaucuucggcgacgagggcguccccguccaggucgacggcgaggccuggguccagccccccggcaucaucaagaucguccacaagaaccgcgcccagaugcucacccgcgaccgcgccuucgaguccacccucaaguccugggaggacaagcagaagugcgacuccggcaagcccguccuccgcacccaccucuacauccaccacgccaucgaccucgccaccgaggaggucucccagaugcagcucugcucccaggccgccgaggagcucaucacccgcaucugcgacgccgccaccauccacugccuccucgagcaggagcucgcccacgccgucaacgccugcucccacgcccucaacaaggccaacccccgcugccccgagucccucacccgcgacaccgccaccgagaucgccaucaacgucaaggcccucuacaacgagaccgagucccuccucgucggccgcgucccccuccagcucgaguccccccacgaggagcgcgucuccaacgcccuccacuccgucgaggucgagcuccagaagcucaccgagauccccuggcucuacuacauccuccaccccaacgaggacgaggagccccccauggacugcaccaagcgcaacaaccgcuccaccgucuuccgcaucguccccaaguucaagaaggagaagguccagaagcagaagaccuccucccagcccggcuccggcgacaccgaguccggcuccugcgaggccaacucccccggcaacuga

SEQ ID NO: 42209 - RNA, 3198 nt, Artificial Sequence
  derived and/or modified sequence opt2 from DGKI__Homo_sapiens__NP_004708
auggacgccgccggccgcggcugccaccuccucccccuccccgccgcccgcggccccgcccgcgcccccgccgccgccgccgccgccgccgccuccccccccggccccugcuccggcgccgccugcgcccccuccgccgccgccggcgccggcgccaugaaccccuccuccuccgccggcgaggagaagggcgccaccggcggcuccuccuccuccggcuccggcgccggcuccugcugccucggcgccgagggcggcgccgacccccgcggcgccggcuccgccgccgccgccggcgccgccgcccucgacgagcccgccgccgccggccagaaggagaaggacgaggcccucgaggagaagcuccgcaaccucaccuuccgcaagcaggucuccuaccgcaaggccaucucccgcgccggccuccagcaccucgcccccgcccacccccucucccuccccgucgccaacggccccgccaaggagccccgcgccacccucgacugguccgagaacgccgucaacggcgagcaccucuggcucgagaccaacgucuccggcgaccucugcuaccucggcgaggagaacugccagguccgcuucgccaaguccgcccuccgccgcaagugcgccgucugcaagaucgucguccacaccgccugcaucgagcagcucgagaagaucaacuuccgcugcaagcccaccuuccgcgagggcggcucccgcuccccccgcgagaacuucguccgccaccacuggguccaccgccgccgccaggagggcaagugcaagcagugcggcaagggcuuccagcagaaguucuccuuccacuccaaggagaucgucgccaucuccugcuccuggugcaagcaggccuuccacaacaaggucaccugcuucaugcuccaccacaucgaggagcccugcucccucggcgcccacgccgccgucaucgucccccccaccuggaucaucaaggucaagaagccccagaacucccucaaggccuccaaccgcaagaagaagcgcaccuccuucaagcgcaaggccuccaagcgcggcauggagcaggagaacaagggccgccccuucgucaucaagcccaucuccuccccccucaugaagccccuccucgucuucgucaaccccaaguccggcggcaaccagggcaccaagguccuccagauguucaugugguaccucaacccccgccaggucuucgaccucucccaggagggccccaaggacgcccucgagcucuaccgcaagguccccaaccuccgcauccucgccugcggcggcgacggcaccgucggcuggauccucuccauccucgacgagcuccagcucuccccccagccccccgucggcguccucccccucggcaccggcaacgaccucgcccgcacccucaacuggggcggcggcuacaccgacgagcccgucuccaagauccucugccaggucgaggacggcaccgucguccagcucgaccgcuggaaccuccacgucgagcgcaaccccgaccucccccccgaggagcucgaggacggcgucugcaagcucccccucaacgucuucaacaacuacuucucccucggcuucgacgcccacgucacccucgaguuccacgagucccgcgaggccaaccccgagaaguucaacucccgcuuccgcaacaagauguucuacgccggcgccgccuucuccgacuuccuccagcgcuccucccgcgaccucuccaagcacgucaaggucgucugcgacggcaccgaccucacccccaagauccaggagcucaaguuccagugcaucgucuuccucaacaucccccgcuacugcgccggcaccaugcccuggggcaaccccggcgaccaccacgacuucgagccccagcgccacgacgacggcuacaucgaggucaucggcuucaccauggccucccucgccgcccuccaggucggcggccacggcgagcgccuccaccagugccgcgaggucaugcuccucaccuacaaguccauccccaugcaggucgacggcgagcccugccgccucgcccccgccaugauccgcaucucccuccgcaaccaggccaacaugguccagaaguccaagcgccgcaccuccaugccccuccucaacgacccccaguccguccccgaccgccuccgcauccgcgucaacaagaucucccuccaggacuacgagggcuuccacuacgacaaggagaagcuccgcgaggccuccaucuccgacuggcuccgcaccaucgccggcgagcucguccaguccuucggcgccaucccccucggcauccucgucguccgcggcgacugcgaccucgagaccugccgcauguacaucgaccgccuccaggaggaccuccaguccgucuccuccggcucccagcgcguccacuaccaggaccacgagaccuccuucccccgcgcccucuccgcccagcgccucuccccccgcuggugcuuccucgacgaccgcucccaggagcaccuccacuucgucauggagaucucccaggacgagaucuucauccucgaccccgacauggucgucucccagcccgccggcaccccccccggcaugcccgaccucgucgucgagcaggccuccggcaucuccgacugguggaaccccgcccuccgcaagcgcaugcucuccgacuccggccucggcaugaucgcccccuacuacgaggacuccgaccucaaggaccucucccacucccgcguccuccagucccccgucuccuccgaggaccacgccauccuccaggccgucaucgccggcgaccucaugaagcucaucgaguccuacaagaacggcggcucccuccucauccagggccccgaccacugcucccuccuccacuacgccgccaagaccggcaacggcgagaucgucaaguacauccucgaccacggccccuccgagcuccucgacauggccgacuccgagaccggcgagaccgcccuccacaaggccgccugccagcgcaaccgcgccgucugccagcuccucgucgacgccggcgccucccuccgcaagaccgacuccaagggcaagaccccccaggagcgcgcccagcaggccggcgaccccgaccucgccgccuaccucgagucccgccagaacuacaaggucaucggccacgaggaccucgagaccgccgucuga

SEQ ID NO: 42210 - RNA, 3816 nt, Artificial Sequence
  derived and/or modified sequence opt2 from DGKK__Homo_sapiens__NP_001013764
auggaccgcggcgccgccgccgcccagggcaccgcccccccccaggacggcgagcagcccgccgagucccccgagccccccccccccuggcccccccccccccccccccccgcccccccccccgcccccccccuccucuccgaggccucccccgagcccauccccgagcccugccccgagcucgcccccggccccugccccgaggccaccuccgaguccgccaccgagcucuacaccgagcccacccccgagcccgccaccgagcccgccuccgagcccgcccccgagcccgccaccgagcccgcccccgagcccgccaccgagcccgcccccgagcccgcccccgagcccgccaccgaguccgcccccgagcccacccccgagcccgcccucgaguccguccccgagcccgcccccgagcucacccccgaggucgcccccgagcucgcccccgagcccacccccgagcccgucaccgagcucgcccccgaguucugccccgaggccgcccccgaguuccgccccucccccgcccccugccuccuccagugccccgucgacacccgcgagcgcggccucaagaccucccccucccccucccccucccccuccccccgcacccccauguccuggucccgcaucaagaagauccucaaggagggccccaugcucaagaacugcaacuccuucaagcgcuggaagcuccgcuacuuccucguccagggccagaagcucuacuucgcccaccaccccgccuucgcccacuucgagaccaucgaccucucccaggccaccgucgccgaguccuccugccgcaaccucugccacuccuucugcgucaucaccccccagcgcaagaucacccucgccgcccccaaccgcaaggacauggaggaguggaucaacaucaucaagaccauccagcagggcgagaucuacaagauccccgccgccgagaacaaccccuuccucgucggcaugcacugcugguacuccuccuacucccaccgcacccagcacugcaacgucugccgcgaguccauccccgcccucucccgcgacgccaucaucugcgaggucugcaaggucaagucccaccgccucugcgcccuccgcgccuccaaggacugcaaguggaacacccucuccaucaccgacgaccuccuccuccccgccgacgaggucaacaugccccaccagugggucgagggcaacaugcccgucuccucccagugcgccgucugccacgaguccugcggcuccuaccagcgccuccaggacuuccgcugccucuggugcaacuccaccguccacgacgacugccgccgccgcuucuccaaggagugcugcuuccgcucccaccgcuccuccgucaucccccccaccgcccucuccgaccccaagggcgacggccagcucgucgucuccuccgacuucuggaaccucgacugguccuccgccugcuccugcccccuccucaucuucaucaacuccaaguccggcgaccaccagggcaucgucuuccuccgcaaguucaagcaguaccucaaccccucccaggucuucgaccuccucaagggcggccccgaggccggccucuccauguucaagaacuucgcccgcuuccgcauccucgucugcggcggcgacggcuccgucuccuggguccucucccucaucgacgccuucggccuccacgagaagugccagcucgccgucaucccccucggcaccggcaacgaccucgcccgcguccucggcuggggcgccuucuggaacaaguccaaguccccccucgacauccucaaccgcgucgagcaggccuccguccgcauccucgaccgcugguccgucaugauccgcgagaccccccgccagaccccccuccucaagggccaggucgagauggacgucccccgcuucgaggccgccgccauccagcaccucgaguccgccgccaccgagcucaacaagauccucaaggccaaguaccccaccgagaugaucaucgccacccgcuuccucugcuccgccgucgaggacuucgucgucgacaucgucaaggccuggggccagaucaagcagaacaacaccgccaucgucuccgucauccucaaguccgaccucauguacgaccgccucuccguccucaucgacguccucgccgaggaggccgccgccaccuccgccgagaaguccgccaccgaguacgccgacuccuccaaggccgaccgcaagcccuucaucccccagaucgaccacaucgccaagugcaagcucgagcucgccaccaaggcccagucccuccagaagucccucaagcucaucaucuuccaggucgagcaggcccucgacgaggagucccgccagaccaucuccgucaagaacuucuccuccaccuucuuccucgaggacgaccccgaggacaucaaccagaccuccccccgccgccgcucccgccgcggcacccucuccuccaucuccucccucaaguccgaggaccucgacaaccucaaccucgaccaccuccacuucacccccgaguccauccgcuucaaggagaagugcgucaugaacaacuacuucggcaucggccucgacgccaagaucucccucgacuucaacacccgccgcgacgagcaccccggccaguacaacucccgccucaagaacaagaugugguacggccuccucggcaccaaggagcuccuccagcgcuccuaccgcaagcucgaggagcgcguccaccucgagugcgacggcgagaccaucucccuccccaaccuccagggcaucgucguccucaacaucaccuccuacgccggcggcaucaacuucuggggcuccaacaccgccaccaccgaguacgaggcccccgccaucgacgacggcaagcucgaggucgucgccaucuucggcuccguccagauggccaugucccgcaucaucaaccuccaccaccaccgcaucgcccagugccacgaggucaugaucaccaucgacggcgaggagggcauccccguccaggucgacggcgaggccuggauccagcgccccggccucaucaagauccgcuacaagaacgccgcccagaugcucacccgcgaccgcgacuucgagaacuccaugaagaugugggaguacaagcacaccgagauccaggccgccccccagccccagcucgacuuccaggacucccaggagucccucuccgacgaggaguacgcccagaugcagcaccucgcccgccucgccgagaaccucaucuccaagcucaacgaccucuccaagauccaccagcacgucuccguccucaugggcuccgucaacgccuccgccaacauccucaacgacaucuucuacggccaggacuccggcaacgagaugggcgccgccuccugcauccccaucgagacccucucccgcaacgacgccgucgacgucaccuucucccucaagggccucuacgacgacaccaccgccuuccucgacgagaagcuccuccgcuccgccgaggacgagaccgcccuccaguccgcccucgacgccaugaacaaggaguucaagaagcucuccgagaucgacuggaugaaccccaucuucguccccgaggagaaguccuccgacaccgacucccgcucccuccgccucaagaucaaguuccccaagcucggcaagaagaaggucgaggaggagcgcaagcccaaguccggccaguccguccaguccuucaucggcaaccucuggcaccgccgccaccgcgaggacgaggccgagggcgacgacccccucacccccucccgcucccagcucuga

SEQ ID NO: 42211 - RNA, 2829 nt, Artificial Sequence
  derived and/or modified sequence opt2 from DGKQ__Homo_sapiens__NP_001338
auggccgccgccgccgagcccggcgcccgcgccuggcucggcggcggcuccccccgccccggcucccccgccugcucccccguccucggcuccggcggccgcgcccgccccggccccggccccggccccggccccgagcgcgccggcguccgcgcccccggccccgccgccgcccccggccacuccuuccgcaaggucacccucaccaagcccaccuucugccaccucugcuccgacuucaucuggggccucgccggcuuccucugcgacgucugcaacuucaugucccacgagaagugccucaagcacguccgcauccccugcaccuccgucgcccccucccucguccgcguccccgucgcccacugcuucggcccccgcggccuccacaagcgcaaguucugcgccgucugccgcaagguccucgaggcccccgcccuccacugcgaggucugcgagcuccaccuccaccccgacugcguccccuucgccugcuccgacugccgccagugccaccaggacggccaccaggaccacgacacccaccaccaccacuggcgcgagggcaaccuccccuccggcgcccgcugcgaggucugccgcaagaccugcggcuccuccgacguccucgccggcguccgcugcgaguggugcggcguccaggcccacucccucugcuccgccgcccucgcccccgagugcggcuucggccgccuccgcucccucguccucccccccgccugcguccgccuccuccccggcggcuucuccaagacccaguccuuccgcaucgucgaggccgccgagcccggcgagggcggcgacggcgccgacggcuccgccgccgucggccccggccgcgagacccaggccacccccgaguccggcaagcagacccucaagaucuucgacggcgacgacgccguccgccgcucccaguuccgccucgucaccgucucccgccucgccggcgccgaggagguccucgaggccgcccuccgcgcccaccacauccccgaggaccccggccaccucgagcucugccgccucccccccuccucccaggccugcgacgccugggccggcggcaaggccggcuccgccgucaucuccgaggagggccgcucccccggcuccggcgaggccacccccgaggccugggucauccgcgcccucccccgcgcccaggagguccucaagaucuaccccggcuggcucaaggucggcgucgccuacgucuccguccgcgucacccccaaguccaccgcccgcuccgucguccucgagguccucccccuccucggccgccaggccgagucccccgaguccuuccagcucgucgaggucgccaugggcugccgccacguccagcgcaccaugcucauggacgagcagccccuccucgaccgccuccaggacauccgccagauguccguccgccaggucucccagacccgcuucuacgucgccgagucccgcgacgucgccccccacgucucccucuucgucggcggccucccccccggccucucccccgaggaguacuccucccuccuccacgaggccggcgccaccaaggccaccgucgucuccgucucccacaucuacuccucccagggcgccgucguccucgacgucgccugcuucgccgaggccgagcgccucuacaugcuccucaaggacauggccguccgcggccgccuccucaccgcccucguccuccccgaccuccuccacgccaagcucccccccgacuccugcccccuccucgucuucgucaaccccaaguccggcggccucaagggccgcgaccuccucugcuccuuccgcaagcuccucaacccccaccaggucuucgaccucaccaacggcggcccccuccccggccuccaccucuucucccagguccccugcuuccgcguccucgucugcggcggcgacggcaccgucggcuggguccucggcgcccucgaggagacccgcuaccgccucgccugccccgagcccuccgucgccauccucccccucggcaccggcaacgaccucggccgcguccuccgcuggggcgccggcuacuccggcgaggaccccuucuccguccuccucuccgucgacgaggccgacgccguccucauggaccgcuggaccauccuccucgacgcccacgaggccggcuccgccgagaacgacaccgccgacgccgagccccccaagaucguccagauguccaacuacugcggcaucggcaucgacgccgagcucucccucgacuuccaccaggcccgcgaggaggagcccggcaaguucaccucccgccuccacaacaagggcgucuacguccgcgucggccuccagaagaucucccacucccgcucccuccacaagcagauccgccuccaggucgagcgccaggaggucgagcuccccuccaucgagggccucaucuucaucaacauccccuccuggggcuccggcgccgaccucuggggcuccgacuccgacacccgcuucgagaagccccgcauggacgacggccuccucgaggucgucggcgucaccggcgucguccacaugggccagguccagggcggccuccgcuccggcauccgcaucgcccagggcuccuacuuccgcgucacccuccucaaggccacccccguccaggucgacggcgagcccuggguccaggcccccggccacaugaucaucuccgccgccggccccaagguccacaugcuccgcaaggccaagcagaagccccgccgcgccggcaccacccgcgacgcccgcgccgacgccgcccccgcccccgaguccgacccccgcuga

SEQ ID NO: 42212 - RNA, 3354 nt, Artificial Sequence
  derived and/or modified sequence opt2 from DGKZ__Homo_sapiens__NP_001099010
auggagaccuucuuccgccgccacuuccgcggcaagguccccggccccggcgagggccagcagcgccccuccuccgucggccuccccaccggcaaggcccgccgccgcucccccgccggccaggccuccuccucccucgcccagcgccgccgcuccuccgcccagcuccagggcugccuccucuccugcggcguccgcgcccagggcuccucccgccgccgcuccuccaccgucccccccuccugcaacccccgcuucaucgucgacaagguccucaccccccagcccaccaccgucggcgcccagcuccucggcgccccccuccuccucaccggccucgucggcaugaacgaggaggagggcguccaggaggacgucgucgccgaggccuccuccgccauccagcccggcaccaagacccccggccccccccccccccgcggcgcccagccccuccucccccucccccgcuaccuccgccgcgccuccucccaccuccuccccgccgacgccgucuacgaccacgcccucuggggccuccacggcuacuaccgccgccucucccagcgccgccccuccggccagcaccccggccccggcggccgccgcgccuccggcaccaccgccggcaccaugcuccccacccgcguccgcccccucucccgccgccgccaggucgcccuccgccgcaaggccgccggcccccaggccugguccgcccuccucgccaaggccaucaccaaguccggccuccagcaccucgccccccccccccccacccccggcgcccccugcuccgaguccgagcgccagauccgcuccaccgucgacugguccgaguccgccaccuacggcgagcacaucugguucgagaccaacgucuccggcgacuucugcuacgucggcgagcaguacugcgucgcccgcaugcucaaguccgucucccgccgcaagugcgccgccugcaagaucgucguccacacccccugcaucgagcagcucgagaagaucaacuuccgcugcaagcccuccuuccgcgaguccggcucccgcaacguccgcgagcccaccuucguccgccaccacuggguccaccgccgccgccaggacggcaagugccgccacugcggcaagggcuuccagcagaaguucaccuuccacuccaaggagaucgucgccaucuccugcuccuggugcaagcaggccuaccacuccaaggucuccugcuucaugcuccagcagaucgaggagcccugcucccucggcguccacgccgccgucgucaucccccccaccuggauccuccgcgcccgccgcccccagaacacccucaaggccuccaagaagaagaagcgcgccuccuucaagcgcaaguccuccaagaagggccccgaggagggccgcuggcgccccuucaucauccgccccacccccuccccccucaugaagccccuccucgucuucgucaaccccaaguccggcggcaaccagggcgccaagaucauccaguccuuccucugguaccucaacccccgccaggucuucgaccucucccagggcggccccaaggaggcccucgagauguaccgcaagguccacaaccuccgcauccucgccugcggcggcgacggcaccgucggcuggauccucuccacccucgaccagcuccgccucaagccccccccccccgucgccauccucccccucggcaccggcaacgaccucgcccgcacccucaacuggggcggcggcuacaccgacgagcccgucuccaagauccucucccacgucgaggagggcaacgucguccagcucgaccgcugggaccuccacgccgagcccaaccccgaggccggccccgaggaccgcgacgagggcgccaccgaccgccucccccucgacgucuucaacaacuacuucucccucggcuucgacgcccacgucacccucgaguuccacgagucccgcgaggccaaccccgagaaguucaacucccgcuuccgcaacaagauguucuacgccggcaccgccuucuccgacuuccucaugggcuccuccaaggaccucgccaagcacauccgcgucgucugcgacggcauggaccucacccccaagauccaggaccucaagccccagugcgucgucuuccucaacaucccccgcuacugcgccggcaccaugcccuggggccaccccggcgagcaccacgacuucgagccccagcgccacgacgacggcuaccucgaggucaucggcuucaccaugaccucccucgccgcccuccaggucggcggccacggcgagcgccucacccagugccgcgaggucguccucaccaccuccaaggccauccccguccaggucgacggcgagcccugcaagcucgccgccucccgcauccgcaucgcccuccgcaaccaggccaccaugguccagaaggccaagcgccgcuccgccgccccccuccacuccgaccagcagcccguccccgagcagcuccgcauccaggucucccgcgucuccaugcacgacuacgaggcccuccacuacgacaaggagcagcucaaggaggccuccgucccccucggcaccgucgucguccccggcgacuccgaccucgagcucugccgcgcccacaucgagcgccuccagcaggagcccgacggcgccggcgccaagucccccaccugccagaagcucucccccaaguggugcuuccucgacgccaccaccgccucccgcuucuaccgcaucgaccgcgcccaggagcaccucaacuacgucaccgagaucgcccaggacgagaucuacauccucgaccccgagcuccucggcgccuccgcccgccccgaccuccccacccccaccuccccccuccccaccucccccugcucccccaccccccgcucccuccagggcgacgccgcccccccccagggcgaggagcucaucgaggccgccaagcgcaacgacuucugcaagcuccaggagcuccaccgcgccggcggcgaccucaugcaccgcgacgagcagucccgcacccuccuccaccacgccgucuccaccggcuccaaggacgucguccgcuaccuccucgaccacgccccccccgagauccucgacgccgucgaggagaacggcgagaccugccuccaccaggccgccgcccucggccagcgcaccaucugccacuacaucgucgaggccggcgccucccucaugaagaccgaccagcagggcgacaccccccgccagcgcgccgagaaggcccaggacaccgagcucgccgccuaccucgagaaccgccagcacuaccagaugauccagcgcgaggaccaggagaccgccgucuga

SEQ ID NO: 42213 - RNA, 834 nt, Artificial Sequence
  derived and/or modified sequence opt2 from DGUOK__Homo_sapiens__NP_550438
auggccgccggccgccucuuccucucccgccuccgcgcccccuucuccuccauggccaaguccccccucgagggcgucuccuccucccgcggccuccacgccggccgcggcccccgccgccucuccaucgagggcaacaucgccgucggcaaguccaccuucgucaagcuccucaccaagaccuaccccgaguggcacgucgccaccgagcccgucgccaccuggcagaacauccaggccgccggcacccagaaggccugcaccgcccagucccucggcaaccuccucgacaugauguaccgcgagcccgcccgcugguccuacaccuuccagaccuucuccuuccucucccgccucaagguccagcucgagcccuuccccgagaagcuccuccaggcccgcaagcccguccagaucuucgagcgcuccgucuacuccgaccgcuacaucuucgccaagaaccucuucgagaacggcucccucuccgacaucgaguggcacaucuaccaggacuggcacuccuuccuccucugggaguucgccucccgcaucacccuccacggcuucaucuaccuccaggccuccccccaggucugccucaagcgccucuaccagcgcgcccgcgaggaggagaagggcaucgagcucgccuaccucgagcagcuccacggccagcacgaggccuggcucauccacaagaccaccaagcuccacuucgaggcccucaugaacauccccguccucguccucgacgucaacgacgacuucuccgaggaggucaccaagcaggaggaccucaugcgcgaggucaacaccuucgucaagaaccucuga

SEQ ID NO: 42214 - RNA, 1428 nt, Artificial Sequence
  derived and/or modified sequence opt2 from DHCR7__Homo_sapiens__NP_001157289
auggccgccaagucccagcccaacauccccaaggccaagucccucgacggcgucaccaacgaccgcaccgccucccagggccaguggggccgcgccugggaggucgacugguucucccucgccuccgucaucuuccuccuccucuucgcccccuucaucgucuacuacuucaucauggccugcgaccaguacuccugcgcccucaccggccccgucgucgacaucgucaccggccacgcccgccucuccgacaucugggccaagaccccccccaucacccgcaaggccgcccagcucuacacccucugggucaccuuccagguccuccucuacaccucccuccccgacuucugccacaaguuccuccccggcuacgucggcggcauccaggagggcgccgucacccccgccggcgucgucaacaaguaccagaucaacggccuccaggccuggcuccucacccaccuccucugguucgccaacgcccaccuccucuccugguucucccccaccaucaucuucgacaacuggaucccccuccucuggugcgccaacauccucggcuacgccgucuccaccuucgccauggucaagggcuacuucuuccccaccuccgcccgcgacugcaaguucaccggcaacuucuucuacaacuacaugaugggcaucgaguucaacccccgcaucggcaagugguucgacuucaagcucuucuucaacggccgccccggcaucgucgccuggacccucaucaaccucuccuucgccgccaagcagcgcgagcuccacucccacgucaccaacgccaugguccucgucaacguccuccaggccaucuacgucaucgacuucuucuggaacgagaccugguaccucaagaccaucgacaucugccacgaccacuucggcugguaccucggcuggggcgacugcgucuggcuccccuaccucuacacccuccagggccucuaccucgucuaccaccccguccagcucuccaccccccacgccgucggcguccuccuccucggccucgucggcuacuacaucuuccgcgucgccaaccaccagaaggaccucuuccgccgcaccgacggccgcugccucaucuggggccgcaagcccaaggucaucgagugcuccuacaccuccgccgacggccagcgccaccacuccaagcuccucgucuccggcuucuggggcgucgcccgccacuucaacuacgucggcgaccucaugggcucccucgccuacugccucgccugcggcggcggccaccuccuccccuacuucuacaucaucuacauggccauccuccucacccaccgcugccuccgcgacgagcaccgcugcgccuccaaguacggccgcgacugggagcgcuacaccgccgccguccccuaccgccuccuccccggcaucuucuga

SEQ ID NO: 42215 - RNA, 1005 nt, Artificial Sequence
  derived and/or modified sequence opt2 from DHDH__Homo_sapiens__NP_055290
auggcccuccgcuggggcaucgucuccgucggccucaucuccuccgacuucaccgccguccuccagacccucccccgcuccgagcaccaggucgucgccgucgccgcccgcgaccucucccgcgccaaggaguucgcccagaagcacgacauccccaaggccuacggcuccuacgaggagcucgccaaggaccccuccgucgaggucgccuacaucggcacccagcacccccagcacaaggccgccgucaugcucugccucgccgccggcaaggccguccucugcgagaagcccaccggcgucaacgccgccgagguccgcgagauggucgccgaggcccgcucccgcgcccucuuccucauggaggccaucuggacccgcuucuuccccgccuccgaggcccuccgcuccguccucgcccagggcacccucggcgaccuccgcgucgcccgcgccgaguucggcaagaaccucauccacgucccccgcgccgucgaccgcgcccaggccggcggcgcccuccucgacaucggcaucuacugcguccaguucaccuccauggucuucggcggccagaagcccgagaagaucuccgucgucggccgccgccacgagaccggcgucgacgacaccgucaccguccuccuccaguaccccggcgagguccacggcuccuucaccugcuccaucaccguccagcucuccaacaccgccuccgucuccggcaccaagggcaugguccagcuccucaaccccugcuggugccccaccgagcucgucgucaagggcgagcacaaggaguucccccucccccccguccccaaggacugcaacuucgacaacggcgccggcauguccuacgaggccaagcacgucugggagugccuccgcaagggcaugaaggagucccccgucaucccccucuccgaguccgagcuccucgccgacauccucgaggagguccgcaaggccaucggcgucaccuucccccaggacaagcgcuga

SEQ ID NO: 42216 - RNA, 564 nt, Artificial Sequence
  derived and/or modified sequence opt2 from DHFR__Homo_sapiens__NP_000782
auggucggcucccucaacugcaucgucgccgucucccagaacaugggcaucggcaagaacggcgaccuccccuggcccccccuccgcaacgaguuccgcuacuuccagcgcaugaccaccaccuccuccgucgagggcaagcagaaccucgucaucaugggcaagaagaccugguucuccauccccgagaagaaccgcccccucaagggccgcaucaaccucguccucucccgcgagcucaaggagcccccccagggcgcccacuuccucucccgcucccucgacgacgcccucaagcucaccgagcagcccgagcucgccaacaaggucgacauggucuggaucgucggcggcuccuccgucuacaaggaggccaugaaccaccccggccaccucaagcucuucgucacccgcaucaugcaggacuucgaguccgacaccuucuuccccgagaucgaccucgagaaguacaagcuccuccccgaguaccccggcguccucuccgacguccaggaggagaagggcaucaaguacaaguucgaggucuacgagaagaacgacuga

SEQ ID NO: 42217 - RNA, 564 nt, Artificial Sequence
  derived and/or modified sequence opt2 from DHFRL1__Homo_sapiens__NP_001182572
auguuccuccuccucaacugcaucgucgccgucucccagaacaugggcaucggcaagaacggcgaccucccccgccccccccuccgcaacgaguuccgcuacuuccagcgcaugaccaccaccuccuccgucgagggcaagcagaaccucgucaucaugggccgcaagaccugguucuccauccccgagaagaaccgcccccucaaggaccgcaucaaccucguccucucccgcgagcucaaggagcccccccagggcgcccacuuccucgcccgcucccucgacgacgcccucaagcucaccgagcgccccgagcucgccaacaaggucgacaugaucuggaucgucggcggcuccuccgucuacaaggaggccaugaaccaccucggccaccucaagcucuucgucacccgcaucaugcaggacuucgaguccgacaccuucuucuccgagaucgaccucgagaaguacaagcuccuccccgaguaccccggcguccucuccgacguccaggagggcaagcacaucaaguacaaguucgaggucugcgagaaggacgacuga

SEQ ID NO: 42218 - RNA, 1191 nt, Artificial Sequence
  derived and/or modified sequence opt2 from DHH__Homo_sapiens__NP_066382
auggcccuccucaccaaccuccucccccucugcugccucgcccuccucgcccuccccgcccaguccugcggccccggccgcggccccgucggccgccgccgcuacgcccgcaagcagcucgucccccuccucuacaagcaguucguccccggcguccccgagcgcacccucggcgccuccggccccgccgagggccgcgucgcccgcggcuccgagcgcuuccgcgaccucguccccaacuacaaccccgacaucaucuucaaggacgaggagaacuccggcgccgaccgccucaugaccgagcgcugcaaggagcgcgucaacgcccucgccaucgccgucaugaacauguggcccggcguccgccuccgcgucaccgagggcugggacgaggacggccaccacgcccaggacucccuccacuacgagggccgcgcccucgacaucaccaccuccgaccgcgaccgcaacaaguacggccuccucgcccgccucgccgucgaggccggcuucgacugggucuacuacgagucccgcaaccacguccacgucuccgucaaggccgacaacucccucgccguccgcgccggcggcugcuuccccggcaacgccaccguccgccucugguccggcgagcgcaagggccuccgcgagcuccaccgcggcgacuggguccucgccgccgacgccuccggccgcgucguccccacccccguccuccucuuccucgaccgcgaccuccagcgccgcgccuccuucgucgccgucgagaccgaguggcccccccgcaagcuccuccucacccccuggcaccucgucuucgccgcccgcggccccgcccccgcccccggcgacuucgcccccgucuucgcccgccgccuccgcgccggcgacuccguccucgcccccggcggcgacgcccuccgccccgcccgcgucgcccgcgucgcccgcgaggaggccgucggcgucuucgccccccucaccgcccacggcacccuccucgucaacgacguccucgccuccugcuacgccguccucgagucccaccagugggcccaccgcgccuucgccccccuccgccuccuccacgcccucggcgcccuccuccccggcggcgccguccagcccaccggcaugcacugguacucccgccuccucuaccgccucgccgaggagcuccucggcuga

SEQ ID NO: 42219 - RNA, 1188 nt, Artificial Sequence
  derived and/or modified sequence opt2 from DHODH__Homo_sapiens__NP_001352
auggccuggcgccaccucaagaagcgcgcccaggacgccgucaucauccucggcggcggcggccuccucuucgccuccuaccucauggccaccggcgacgagcgcuucuacgccgagcaccucaugcccacccuccagggccuccucgaccccgaguccgcccaccgccucgccguccgcuucaccucccucggccuccucccccgcgcccgcuuccaggacuccgacaugcucgagguccgcguccucggccacaaguuccgcaaccccgucggcaucgccgccggcuucgacaagcacggcgaggccgucgacggccucuacaagaugggcuucggcuucgucgagaucggcuccgucacccccaagccccaggagggcaacccccgcccccgcgucuuccgccuccccgaggaccaggccgucaucaaccgcuacggcuucaacucccacggccucuccgucgucgagcaccgccuccgcgcccgccagcagaagcaggccaagcucaccgaggacggccucccccucggcgucaaccucggcaagaacaagaccuccgucgacgccgccgaggacuacgccgagggcguccgcguccucggcccccucgccgacuaccucgucgucaacgucuccucccccaacaccgccggccuccgcucccuccagggcaaggccgagcuccgccgccuccucaccaagguccuccaggagcgcgacggccuccgccgcguccaccgccccgccguccucgucaagaucgcccccgaccucaccucccaggacaaggaggacaucgccuccgucgucaaggagcucggcaucgacggccucaucgucaccaacaccaccgucucccgccccgccggccuccagggcgcccuccgcuccgagaccggcggccucuccggcaagccccuccgcgaccucuccacccagaccauccgcgagauguacgcccucacccagggccgcguccccaucaucggcgucggcggcgucuccuccggccaggacgcccucgagaagauccgcgccggcgccucccucguccagcucuacaccgcccucaccuucuggggcccccccgucgucggcaaggucaagcgcgagcucgaggcccuccucaaggagcagggcuucggcggcgucaccgacgccaucggcgccgaccaccgccgcuga

SEQ ID NO: 42220 - RNA, 984 nt, Artificial Sequence
  derived and/or modified sequence opt2 from DHPS__Homo_sapiens__NP_001193903
augcccaucauccccgccuucugggaggccgaggccggcggcucccgcgaggaggaguucgagaccucccucgccaacaugaucgagaagaagcucgagccccucucccaggacgaggaccagcacgccgaccucacccagucccgccgcccccucaccuccugcaccaucuuccucggcuacaccuccaaccucaucuccuccggcauccgcgagaccauccgcuaccucguccagcacaacauggucgacguccucgucaccaccgccggcggcgucgaggaggaccucaucaagugccucgcccccaccuaccucggcgaguucucccuccgcggcaaggagcuccgcgagaacggcaucaaccgcaucggcaaccuccucguccccaacgagaacuacugcaaguucgaggacuggcucaugcccauccucgaccagauggucauggagcagaacaccgagggcgucaaguggacccccuccaagaugaucgcccgccucggcaaggagaucaacaaccccgaguccgucuacuacugggcccagaagaaccacauccccgucuucucccccgcccucaccgacggcucccucggcgacaugaucuucuuccacuccuacaagaaccccggccucguccucgacaucgucgaggaccuccgccucaucaacacccaggccaucuucgccaagugcaccggcaugaucauccucggcggcggcgucgucaagcaccacaucgccaacgccaaccucaugcgcaacggcgccgacuacgccgucuacaucaacaccgcccaggaguucgacggcuccgacuccggcgcccgccccgacgaggccgucuccuggggcaagauccgcgucgacgcccagcccgucaaggucuacgccgacgccucccucgucuucccccuccucgucgccgagaccuucgcccagaagauggacgccuucaugcacgagaagaacgaggacuga

SEQ ID NO: 42221 - RNA, 783 nt, Artificial Sequence
  derived and/or modified sequence opt2 from DHRS11__Homo_sapiens__NP_077284
auggcccgccccggcauggagcgcuggcgcgaccgccucgcccucgucaccggcgccuccggcggcaucggcgccgccgucgcccgcgcccucguccagcagggccucaaggucgucggcugcgcccgcaccgucggcaacaucgaggagcucgccgccgagugcaaguccgccggcuaccccggcacccucauccccuaccgcugcgaccucuccaacgaggaggacauccucuccauguucuccgccauccgcucccagcacuccggcgucgacaucugcaucaacaacgccggccucgcccgccccgacacccuccucuccggcuccaccuccggcuggaaggacauguucaacgucaacguccucgcccucuccaucugcacccgcgaggccuaccaguccaugaaggagcgcaacgucgacgacggccacaucaucaacaucaacuccauguccggccaccgcguccucccccucuccgucacccacuucuacuccgccaccaaguacgccgucaccgcccucaccgagggccuccgccaggagcuccgcgaggcccagacccacauccgcgccaccugcaucucccccggcgucgucgagacccaguucgccuucaagcuccacgacaaggaccccgagaaggccgccgccaccuacgagcagaugaagugccucaagcccgaggacgucgccgaggccgucaucuacguccucuccacccccgcccacauccagaucggcgacauccagaugcgccccaccgagcaggucaccuga

SEQ ID NO: 42222 - RNA, 843 nt, Artificial Sequence
  derived and/or modified sequence opt2 from DHRS2__Homo_sapiens__NP_005785
augcucuccgccgucgcccgcggcuaccagggcugguuccaccccugcgcccgccucuccguccgcauguccuccaccggcaucgaccgcaagggcguccucgccaaccgcgucgccgucgucaccggcuccaccuccggcaucggcuucgccaucgcccgccgccucgcccgcgacggcgcccacgucgucaucuccucccgcaagcagcagaacgucgaccgcgccauggccaagcuccagggcgagggccucuccgucgccggcaucgucugccacgucggcaaggccgaggaccgcgagcagcucgucgccaaggcccucgagcacugcggcggcgucgacuuccucgucugcuccgccggcgucaacccccucgucggcuccacccucggcaccuccgagcagaucugggacaagauccucuccgucaacgucaagucccccgcccuccuccucucccagcuccuccccuacauggagaaccgccgcggcgccgucauccucgucuccuccaucgccgccuacaaccccgucgucgcccucggcgucuacaacgucuccaagaccgcccuccucggccucacccgcacccucgcccucgagcucgcccccaaggacauccgcgucaacugcgucguccccggcaucaucaagaccgacuucuccaaggucuuccacggcaacgagucccucuggaagaacuucaaggagcaccaccagcuccagcgcaucggcgaguccgaggacugcgccggcaucgucuccuuccucugcucccccgacgccuccuacgucaacggcgagaacaucgccgucgccggcuacuccacccgccucuga

SEQ ID NO: 42223 - RNA, 567 nt, Artificial Sequence
  derived and/or modified sequence opt2 from DHRS4__Homo_sapiens__NP_001269916
augcacaaggccggccuccucggccucugcgcccgcgccuggaacuccguccgcauggccuccuccggcaugacccgccgcgacccccucgccaacaaggucgcccucgucaccgccuccaccgacggcaucggcuucgccaucgcccgccgccucgcccaggacggcgcccacgucgucgucuccucccgcaagcagcagaacgucgaccaggccgucgccacccuccagggcgagggccucuccgucaccggcaccgucugccacgucggcaaggccgaggaccgcgagcgccucgucgccaccgccgucaagcuccacggcggcaucgacauccucgucuccaacgccgccgucaaccccuucuucggcuccaucauggacgucaccgaggaggucugggacaagcgccgccucuccggcgaccgcgucuuccacuccucccuccaguccaucuccucccucgacggccagggcaagcgcggcaagcacgagcgcaaccccgccgacaagaagguccgccgcgcccgcggccucugcuggcaccgcgucuuccccguccucuga

SEQ ID NO: 42224 - RNA, 936 nt, Artificial Sequence
  derived and/or modified sequence opt2 from DHRS7C__Homo_sapiens__NP_001099041
augggcgucauggccaugcucaugcucccccuccuccuccucggcaucuccggccuccucuucaucuaccaggaggucucccgccucugguccaaguccgccguccagaacaaggucgucgucaucaccgacgccaucuccggccucggcaaggagugcgcccgcgucuuccacaccggcggcgcccgccucguccucugcggcaagaacugggagcgccucgagaaccucuacgacgcccucaucuccgucgccgaccccuccaagaccuucacccccaagcucguccuccucgaccucuccgacaucuccugcguccccgacgucgccaaggagguccucgacugcuacggcugcgucgacauccucaucaacaacgccuccgucaaggucaagggccccgcccacaagaucucccucgagcucgacaagaagaucauggacgccaacuacuucggccccaucacccucaccaaggcccuccuccccaacaugaucucccgccgcaccggccagaucguccucgucaacaacauccagggcaaguucggcauccccuuccgcaccaccuacgccgccuccaagcacgccgcccucggcuucuucgacugccuccgcgccgaggucgaggaguacgacgucgucaucuccaccgucucccccaccuucauccgcuccuaccacgucuaccccgagcagggcaacugggaggccuccaucuggaaguucuucuuccgcaagcucaccuacggcguccaccccgucgaggucgccgaggaggucaugcgcaccguccgccgcaagaagcaggaggucuucauggccaaccccauccccaaggccgccgucuacguccgcaccuucuuccccgaguucuucuucgccgucgucgccugcggcgucaaggagaagcucaacguccccgaggagggcuga

SEQ ID NO: 42225 - RNA, 1140 nt, Artificial Sequence
  derived and/or modified sequence opt2 from DHRS9__Homo_sapiens__NP_001276692
augcccgagggccgcucccacugcgccugcuccaucaccucccucacccuccucgucucccucacccgcgucacccucgacauccuccagaagcucgaccccccccagcccgcccacuggcgccaccaccuccucguccucuacaagaagggcgucuaccucucccacaccggcggcaagaugcucuucuggguccucggccuccucauccucugcggcuuccucuggacccgcaagggcaagcucaagaucgaggacaucaccgacaaguacaucuucaucaccggcugcgacuccggcuucggcaaccucgccgcccgcaccuucgacaagaagggcuuccacgucaucgccgccugccucaccgaguccggcuccaccgcccucaaggccgagaccuccgagcgccuccgcaccguccuccucgacgucaccgaccccgagaacgucaagcgcaccgcccagugggucaagaaccaggucggcgagaagggccucuggggccucaucaacaacgccggcguccccggcguccucgcccccaccgacuggcucacccucgaggacuaccgcgagcccaucgaggucaaccucuucggccucaucuccgucacccucaacaugcucccccucgucaagaaggcccagggccgcgucaucaacgucuccuccgucggcggccgccucgccaucgucggcggcggcuacacccccuccaaguacgccgucgagggcuucaacgacucccuccgccgcgacaugaaggccuucggcguccacgucuccugcaucgagcccggccucuucaagaccaaccucgccgaccccgucaaggucaucgagaagaagcucgccaucugggagcagcucucccccgacaucaagcagcaguacggcgagggcuacaucgagaagucccucgacaagcucaagggcaacaaguccuacgucaacauggaccucucccccgucgucgagugcauggaccacgcccucaccucccucuuccccaagacccacuacgccgccggcaaggacgccaagaucuucuggaucccccucucccacaugcccgccgcccuccaggacuuccuccuccucaagcagaaggccgagcucgccaaccccaaggccgucuga

SEQ ID NO: 42226 - RNA, 2760 nt, Artificial Sequence
  derived and/or modified sequence opt2 from DHTKD1__Homo_sapiens__NP_061176
auggccuccgccaccgccgccgccgcccgccgcggccucggccgcgcccucccccuccucuggcgcggcuaccagaccgagcgcggcgucuacggcuaccgcccccgcaagcccgagucccgcgagccccagggcgcccucgagcgcccccccgucgaccacggccucgcccgccucgucaccgucuacugcgagcacggccacaaggccgccaagaucaacccccucuucaccggccaggcccuccucgagaacguccccgagauccaggcccucguccagacccuccagggccccuuccacaccgccggccuccucaacaugggcaaggaggaggccucccucgaggagguccucgucuaccucaaccagaucuacugcggccagaucuccaucgagaccucccagcuccagucccaggacgagaaggacugguucgccaagcgcuucgaggagcuccagaaggagaccuucaccaccgaggagcgcaagcaccucuccaagcucaugcucgagucccaggaguucgaccacuuccucgccaccaaguucuccaccgucaagcgcuacggcggcgagggcgccgaguccaugaugggcuucuuccacgagcuccucaagauguccgccuacuccggcaucaccgacgucaucaucggcaugccccaccgcggccgccucaaccuccucaccggccuccuccaguucccccccgagcucauguuccgcaagaugcgcggccucuccgaguuccccgagaacuucuccgccaccggcgacguccucucccaccucaccuccuccgucgaccucuacuucggcgcccaccacccccuccacgucaccaugcuccccaaccccucccaccucgaggccgucaaccccgucgccgucggcaagacccgcggccgccagcagucccgccaggacggcgacuacucccccgacaacuccgcccagcccggcgaccgcgucaucugccuccagguccacggcgacgccuccuucugcggccagggcaucguccccgagaccuucacccucuccaaccucccccacuuccgcaucggcggcuccguccaccucaucgucaacaaccagcucggcuacaccacccccgccgagcgcggccgcuccucccucuacugcuccgacaucggcaagcucgucggcugcgccaucauccacgucaacggcgacucccccgaggaggucguccgcgccacccgccucgccuucgaguaccagcgccaguuccgcaaggacgucaucaucgaccuccucugcuaccgccaguggggccacaacgagcucgacgagcccuucuacaccaaccccaucauguacaagaucauccgcgcccgcaaguccauccccgacaccuacgccgagcaccucaucgccggcggccucaugacccaggaggaggucuccgagaucaaguccuccuacuacgccaagcucaacgaccaccucaacaacauggcccacuaccgcccccccgcccucaaccuccaggcccacuggcagggccucgcccagcccgaggcccagaucaccaccugguccaccggcgucccccucgaccuccuccgcuucgucggcaugaaguccgucgaggucccccgcgagcuccagaugcacucccaccuccucaagacccacguccagucccgcauggagaagaugauggacggcaucaagcucgacugggccaccgccgaggcccucgcccucggcucccuccucgcccagggcuucaacguccgccucuccggccaggacgucggccgcggcaccuucucccagcgccacgccaucgucgucugccaggagaccgacgacaccuacaucccccucaaccacauggaccccaaccagaagggcuuccucgaggucuccaacuccccccucuccgaggaggccguccucggcuucgaguacggcauguccaucgagucccccaagcuccucccccucugggaggcccaguucggcgacuucuucaacggcgcccagaucaucuucgacaccuucaucuccggcggcgaggccaaguggcuccuccaguccggcaucgucauccuccucccccacggcuacgacggcgccggccccgaccacuccuccugccgcaucgagcgcuuccuccagaugugcgacuccgccgaggagggcgucgacggcgacaccgucaacauguucgucguccaccccaccacccccgcccaguacuuccaccuccuccgccgccagaugguccgcaacuuccgcaagccccucaucgucgccucccccaagaugcuccuccgccuccccgccgccgucuccacccuccaggagauggcccccggcaccaccuucaaccccgucaucggcgacuccuccgucgaccccaagaaggucaagacccucgucuucugcuccggcaagcacuucuacucccucgucaagcagcgcgagucccucggcgccaagaagcacgacuucgccaucauccgcgucgaggagcucugccccuucccccucgacucccuccagcaggagauguccaaguacaagcacgucaaggaccacaucuggucccaggaggagccccagaacaugggccccugguccuucgucuccccccgcuucgagaagcagcucgccugcaagcuccgccucgucggccgccccccccuccccguccccgccgucggcaucggcaccguccaccuccaccagcacgaggacauccucgccaagaccuucgccuga

SEQ ID NO: 42227 - RNA, 2388 nt, Artificial Sequence
  derived and/or modified sequence opt2 from DHX15__Homo_sapiens__NP_001349
auguccaagcgccaccgccucgaccucggcgaggacuaccccuccggcaagaagcgcgccggcaccgacggcaaggaccgcgaccgcgaccgcgaccgcgaggaccgcuccaaggaccgcgaccgcgagcgcgaccgcggcgaccgcgagcgcgagcgcgagaaggagaaggagaaggagcuccgcgccuccaccaacgccaugcucaucuccgccggccuccccccccucaaggccucccacuccgcccacuccacccacuccgcccacuccacccacuccacccacuccgcccacuccacccacgccggccacgccggccacaccucccucccccagugcaucaaccccuucaccaaccucccccacaccccccgcuacuacgacauccucaagaagcgccuccagcuccccgucugggaguacaaggaccgcuucaccgacauccucguccgccaccaguccuucguccucgucggcgagaccggcuccggcaagaccacccagaucccccaguggugcgucgaguacaugcgcucccuccccggccccaagcgcggcgucgccugcacccagccccgccgcgucgccgccauguccgucgcccagcgcgucgccgacgagauggacgucaugcucggccaggaggucggcuacuccauccgcuucgaggacugcuccuccgccaagaccauccucaaguacaugaccgacggcaugcuccuccgcgaggccaugaacgacccccuccucgagcgcuacggcgucaucauccucgacgaggcccacgagcgcacccucgccaccgacauccucaugggcguccucaaggaggucguccgccagcgcuccgaccucaaggucaucgucauguccgccacccucgacgccggcaaguuccagaucuacuucgacaacugcccccuccucaccauccccggccgcacccaccccgucgagaucuucuacacccccgagcccgagcgcgacuaccucgaggccgccauccgcaccgucauccagauccacaugugcgaggaggaggagggcgaccuccuccucuuccucaccggccaggaggagaucgacgaggccugcaagcgcaucaagcgcgaggucgacgaccucggccccgaggucggcgacaucaagaucaucccccucuacuccacccuccccccccagcagcagcagcgcaucuucgagccccccccccccaagaagcagaacggcgccaucggccgcaaggucgucgucuccaccaacaucgccgagaccucccucaccaucgacggcgucgucuucgucaucgaccccggcuucgccaagcagaaggucuacaacccccgcauccgcgucgagucccuccucgucaccgccaucuccaaggccuccgcccagcagcgcgccggccgcgccggccgcacccgccccggcaagugcuuccgccucuacaccgagaaggccuacaagaccgagaugcaggacaacaccuaccccgagauccuccgcuccaaccucggcuccgucguccuccagcucaagaagcucggcaucgacgaccucguccacuucgacuucauggacccccccgcccccgagacccucaugcgcgcccucgagcuccucaacuaccucgccgcccucaacgacgacggcgaccucaccgagcucggcuccaugauggccgaguucccccucgacccccagcucgccaagauggucaucgccuccugcgacuacaacugcuccaacgagguccucuccaucaccgccaugcucuccgucccccagugcuucguccgccccaccgaggccaagaaggccgccgacgaggccaagaugcgcuucgcccacaucgacggcgaccaccucacccuccucaacgucuaccacgccuucaagcagaaccacgaguccguccaguggugcuacgacaacuucaucaacuaccgcucccucauguccgccgacaacguccgccagcagcucucccgcaucauggaccgcuucaaccucccccgccgcuccaccgacuucaccucccgcgacuacuacaucaacauccgcaaggcccucgucaccggcuacuucaugcaggucgcccaccucgagcgcaccggccacuaccucaccgucaaggacaaccaggucguccagcuccaccccuccaccguccucgaccacaagcccgaguggguccucuacaacgaguucguccucaccaccaagaacuacauccgcaccugcaccgacaucaagcccgaguggcucgucaagaucgccccccaguacuacgacauguccaacuucccccagugcgaggccaagcgccagcucgaccgcaucaucgccaagcuccaguccaaggaguacucccaguacuga

SEQ ID NO: 42228 - RNA, 2946 nt, Artificial Sequence
  derived and/or modified sequence opt2 from DHX16__Homo_sapiens__NP_001157711
auguccgaggacccccgcggccccaaggucccccgcaaggccgucgucgagaagcccgcccgcgccgccgagcgcgaggcccgcgcccuccucgagaagaaccgcuccuaccgccuccucgaggacuccgaggaguccuccgaggagaccgucucccgcgccggcuccucccuccagaagaagcgcaagaagcgcaagcaccuccgcaagaagcgcgaggaggaggaggaggaggaggccuccgagaagggcaagaagaagaccggcggcuccaagcagcagaccgagaagcccgaguccgaggacgagugggagcgcaccgagcgcgagcgccuccaggaccucgaggagcgcgacgccuucgccgagcgcguccgccagcgcgacaaggaccgcacccgcaacguccucgagcgcuccgacaagaaggccuacgaggaggcccagaagcgccucaagauggccgaggaggaccgcaaggccaugguccccgagcuccgcaagaagucccgccgcgaguaccucgccaagcgcgagcgcgagaagcucgaggaccucgaggccgagcucgccgacgaggaguuccucuucggcgacgucgagcucucccgccacgagcgccaggagcucaaguacaagcgccgcguccgcgaccucgcccgcgaguaccgcgccgccggcgagcaggagaagcucgaggccaccaaccgcuaccacaugcccaaggagacccgcggccagcccgcccgcgccgucgaccucgucgaggaggaguccggcgcccccggcgaggagcagcgccgcugggaggaggcccgccucggcgccgccucccucaaguucggcgcccgcgacgccgccucccaggagcccaaguaccagcucguccucgaggaggaggagaccaucgaguucguccgcgccacccagcuccagggcgacgaggagcccuccgccccccccaccuccacccaggcccagcagaaggaguccauccaggccguccgccgcucccuccccgucuuccccuuccgcgaggagcuccucgccgccaucgccaaccaccagguccucaucaucgagggcgagaccggcuccggcaagaccacccagaucccccaguaccucuucgaggagggcuacaccaacaagggcaugaagaucgccugcacccagccccgccgcgucgccgccauguccgucgccgcccgcgucgcccgcgagaugggcgucaagcucggcaacgaggucggcuacuccauccgcuucgaggacugcaccuccgagcgcaccguccuccgcuacaugaccgacggcaugcuccuccgcgaguuccucuccgagcccgaccucgccuccuacuccgucgucauggucgacgaggcccacgagcgcacccuccacaccgacauccucuucggccucaucaaggacgucgcccgcuuccgccccgagcucaagguccucgucgccuccgccaccauggacaccgcccgcuucuccaccuucuucgacgacgcccccgucuuccgcauccccggccgccgcuuccccgucgacaucuucuacaccaaggcccccgaggccgacuaccucgaggccugcgucgucuccguccuccagauccacgucacccagccccccggcgacauccucgucuuccucaccggccaggaggagaucgaggccgccugcgagaugcuccaggaccgcugccgccgccucggcuccaagauccgcgagcuccucguccuccccaucuacgccaaccuccccuccgacaugcaggcccgcaucuuccagcccaccccccccggcgcccgcaaggucgucgucgccaccaacaucgccgagaccucccucaccaucgagggcaucaucuacguccucgaccccggcuucugcaagcagaaguccuacaacccccgcaccggcauggagucccucaccgucacccccugcuccaaggccuccgccaaccagcgcgccggccgcgccggccgcgucgccgccggcaagugcuuccgccucuacaccgccugggccuaccagcacgagcucgaggagaccaccguccccgagauccagcgcaccucccucggcaacgucguccuccuccucaagucccucggcauccacgaccucaugcacuucgacuuccucgaccccccccccuacgagacccuccuccucgcccucgagcagcucuacgcccucggcgcccucaaccaccucggcgagcucaccaccuccggccgcaagauggccgagcuccccgucgaccccaugcucuccaagaugauccucgccuccgagaaguacuccugcuccgaggagauccucaccgucgccgccaugcucuccgucaacaacuccaucuucuaccgccccaaggacaaggucguccacgccgacaacgcccgcgucaacuucuuccuccccggcggcgaccaccucguccuccucaacgucuacacccagugggccgaguccggcuacuccucccaguggugcuacgagaacuucguccaguuccgcuccaugcgccgcgcccgcgacguccgcgagcagcucgagggccuccucgagcgcgucgaggucggccucuccuccugccagggcgacuacauccgcguccgcaaggccaucaccgccggcuacuucuaccacaccgcccgccucacccgcuccggcuaccgcaccgucaagcagcagcagaccgucuucauccaccccaacuccucccucuucgagcagcagccccgcuggcuccucuaccacgagcucguccucaccaccaaggaguucaugcgccagguccucgagaucgaguccuccuggcuccucgaggucgccccccacuacuacaaggccaaggagcucgaggacccccacgccaagaagaugcccaagaagaucggcaagacccgcgaggagcucggcuga

SEQ ID NO: 42229 - RNA, 2232 nt, Artificial Sequence
  derived and/or modified sequence opt2 from DHX32__Homo_sapiens__NP_060650
auggaggaggagggccucgagugccccaacuccuccuccgagaagcgcuacuuccccgagucccucgacuccuccgacggcgacgaggaggagguccucgccugcgaggaccucgagcucaaccccuucgacggccuccccuacuccucccgcuacuacaagcuccucaaggagcgcgaggaccuccccaucuggaaggagaaguacuccuucauggagaaccuccuccagaaccagaucgucaucgucuccggcgacgccaagugcggcaaguccgcccaggucccccaguggugcgccgaguacugccucuccauccacuaccagcacggcggcgucaucugcacccagguccacaagcagaccgucguccagcucgcccuccgcgucgccgacgagauggacgucaacaucggccacgaggucggcuacgucauccccuucgagaacugcugcaccaacgagaccauccuccgcuacugcaccgacgacaugcuccagcgcgagaugauguccaaccccuuccucggcuccuacggcgucaucauccucgacgacauccacgagcgcuccaucgccaccgacguccuccucggccuccucaaggacguccuccucgcccgccccgagcucaagcucaucaucaacuccuccccccaccucaucuccaagcucaacuccuacuacggcaacguccccgucaucgaggucaagaacaagcaccccgucgaggucgucuaccucuccgaggcccagaaggacuccuucgaguccauccuccgccucaucuucgagauccaccacuccggcgagaagggcgacaucgucgucuuccucgccugcgagcaggacaucgagaaggucugcgagaccgucuaccagggcuccaaccucaaccccgaccucggcgagcucgucgucgucccccucuaccccaaggagaagugcucccucuucaagccccucgacgagaccgagaagcgcugccaggucuaccagcgccgcgucguccucaccaccuccuccggcgaguuccucaucugguccaacuccguccgcuucgucaucgacgucggcgucgagcgccgcaaggucuacaacccccgcauccgcgccaacucccucgucaugcagcccaucucccagucccaggccgagauccgcaagcagauccucggcuccuccuccuccggcaaguucuucugccucuacaccgaggaguucgccuccaaggacaugaccccccucaagcccgccgagaugcaggaggccaaccucaccuccaugguccucuucaugaagcgcaucgacaucgccggccucggccacugcgacuucaugaaccgccccgcccccgagucccucaugcaggcccucgaggaccucgacuaccucgccgcccucgacaacgacggcaaccucuccgaguucggcaucaucauguccgaguucccccucgacccccagcucuccaaguccauccucgccuccugcgaguucgacugcgucgacgagguccucaccaucgccgccauggucaccgcccccaacugcuucucccacgucccccacggcgccgaggaggccgcccucaccugcuggaagaccuuccuccaccccgagggcgaccacuucacccucaucuccaucuacaaggccuaccaggacaccacccucaacuccuccuccgaguacugcgucgagaaguggugccgcgacuacuuccucaacugcuccgcccuccgcauggccgacgucauccgcgccgagcuccucgagaucaucaagcgcaucgagcuccccuacgccgagcccgccuucggcuccaaggagaacacccucaacaucaagaaggcccuccucuccggcuacuucaugcagaucgcccgcgacgucgacggcuccggcaacuaccucaugcucacccacaagcaggucgcccagcuccacccccucuccggcuacuccaucaccaagaagaugcccgaguggguccucuuccacaaguucuccaucuccgagaacaacuacauccgcaucaccuccgagaucucccccgagcucuucaugcagcucgucccccaguacuacuucuccaaccucccccccuccgaguccaaggacauccuccagcaggucgucgaccaccucucccccgucuccaccaugaacaaggagcagcagaugugcgagaccugccccgagaccgagcagcgcugcacccuccaguga

SEQ ID NO: 42230 - RNA, 3432 nt, Artificial Sequence
  derived and/or modified sequence opt2 from DHX34__Homo_sapiens__NP_055496
augccccccccccgcacccgcgagggccgcgaccgccgcgaccaccaccgcgcccccuccgaggaggaggcccucgagaagugggacuggaacugccccgagacccgccgccuccucgaggacgccuucuuccgcgaggaggacuacauccgccagggcuccgaggagugccagaaguucuggaccuucuucgagcgccuccagcgcuuccagaaccucaagaccucccgcaaggaggagaaggaccccggccagcccaagcacuccauccccgcccucgccgaccucccccgcaccuacgacccccgcuaccgcaucaaccucuccguccucggccccgccacccgcggcucccagggccucggccgccaccuccccgccgagcgcgucgccgaguuccgccgcgcccuccuccacuaccucgacuucggccagaagcaggccuucggccgccucgccaagcuccagcgcgagcgcgccgcccuccccaucgcccaguacggcaaccgcauccuccagacccucaaggagcaccaggucgucgucgucgccggcgacaccggcugcggcaaguccacccaggucccccaguaccuccucgccgccggcuucucccacgucgccugcacccagccccgccgcaucgccugcaucucccucgccaagcgcgucggcuucgagucccucucccaguacggcucccaggucggcuaccagauccgcuucgaguccacccgcuccgccgccaccaagaucgucuuccucaccgucggccuccuccuccgccagauccagcgcgagcccucccucccccaguacgagguccucaucgucgacgagguccacgagcgccaccuccacaacgacuuccuccucggcguccuccagcgccuccuccccacccgccccgaccucaaggucauccucauguccgccaccaucaacaucucccucuucuccuccuacuucuccaacgcccccgucguccagguccccggccgccucuuccccaucaccgucgucuaccagccccaggaggccgagcccaccaccuccaaguccgagaagcucgacccccgccccuuccuccgcguccucgaguccaucgaccacaaguacccccccgaggagcgcggcgaccuccucgucuuccucuccggcauggccgagaucuccgccguccucgaggccgcccagaccuacgccucccacacccagcgcugggucguccucccccuccacuccgcccucuccgucgccgaccaggacaaggucuucgacgucgccccccccggcguccgcaagugcauccucuccaccaacaucgccgagaccuccgucaccaucgacggcauccgcuucgucgucgacuccggcaaggucaaggagauguccuacgacccccaggccaagcuccagcgccuccaggaguucuggaucucccaggccuccgccgagcagcgcaagggccgcgccggccgcaccggccccggcgucugcuuccgccucuacgccgaguccgacuacgacgccuucgcccccuaccccguccccgagauccgccgcgucgcccucgacucccucguccuccagaugaaguccauguccgucggcgacccccgcaccuuccccuucaucgagccccccccccccgccucccucgagaccgccauccucuaccuccgcgaccagggcgcccucgacuccuccgaggcccucacccccaucggcucccuccucgcccagcuccccgucgacgucgucaucggcaagaugcucauccucggcuccauguucucccucgucgagcccguccucaccaucgccgccgcccucuccguccagucccccuucacccgcuccgcccaguccucccccgagugcgccgccgcccgccgcccccucgaguccgaccagggcgaccccuucacccucuucaacgucuucaacgccuggguccaggucaaguccgagcgcucccgcaacucccgcaaguggugccgccgccgcggcaucgaggagcaccgccucuacgagauggccaaccuccgccgccaguucaaggagcuccucgaggaccacggccuccucgccggcgcccaggccgcccaggucggcgacuccuacucccgccuccagcagcgccgcgagcgccgcgcccuccaccagcucaagcgccagcacgaggagggcgccggccgccgccgcaagguccuccgccuccaggaggagcaggacggcggcuccuccgacgaggaccgcgccggccccgccccccccggcgccuccgacggcgucgacauccaggacgucaaguucaagcuccgccacgaccucgcccagcuccaggccgccgccuccuccgcccaggaccucucccgcgagcagcucgcccuccucaagcucguccucggccgcggccucuacccccagcucgccguccccgacgccuucaacuccucccgcaaggacuccgaccagaucuuccacacccaggccaagcagggcgccguccuccaccccaccugcgucuucgccggcucccccgagguccuccacgcccaggagcucgaggccuccaacugcgacggcucccgcgacgacaaggacaagauguccuccaagcaccagcuccucuccuucgucucccuccucgagaccaacaagcccuaccucgucaacugcguccgcauccccgcccuccagucccuccuccucuucucccgcucccucgacaccaacggcgacugcucccgccucgucgccgacggcuggcucgagcuccagcucgccgacuccgaguccgccauccgccuccucgccgccucccuccgccuccgcgcccgcugggaguccgcccucgaccgccagcucgcccaccaggcccagcagcagcucgaggaggaggaggaggacacccccgucucccccaaggaggucgccacccucuccaaggagcuccuccaguucaccgccuccaagauccccuacucccuccgccgccucaccggccucgagguccagaacauguacgucggcccccagaccauccccgccaccccccaccuccccggccucuucggcuccuccacccucuccccccaccccaccaagggcggcuacgccgucaccgacuuccucaccuacaacugccucaccaacgacaccgaccucuacuccgacugccuccgcaccuucuggaccugcccccacugcggccuccacgccccccucaccccccucgagcgcaucgcccacgagaacaccugcccccaggccccccaggacggcccccccggcgccgaggaggccgcccucgagacccuccagaagaccuccguccuccagcgccccuaccacugcgaggccugcggcaaggacuuccucuucacccccaccgagguccuccgccaccgcaagcagcacgucuga

SEQ ID NO: 42231 - RNA, 2985 nt, Artificial Sequence
  derived and/or modified sequence opt2 from DHX36__Homo_sapiens__NP_001107869
auguccuacgacuaccaccagaacuggggccgcgacggcggcccccgcuccuccggcggcggcuacggcggcggccccgccggcggccacggcggcaaccgcggcuccggcggcggcggcggcggcggcggcggcggccgcggcggccgcggccgccaccccggccaccucaagggccgcgagaucggcaugugguacgccaagaagcagggccagaagaacaaggaggccgagcgccaggagcgcgccgucguccacauggacgagcgccgcgaggagcagaucguccagcuccucaacuccguccaggccaagaacgacaaggaguccgaggcccagaucuccugguucgcccccgaggaccacggcuacggcaccgaggucuccaccaagaacacccccugcuccgagaacaagcucgacauccaggagaagaagcucaucaaccaggagaagaagauguuccgcauccgcaaccgcuccuacaucgaccgcgacuccgaguaccuccuccaggagaacgagcccgacggcacccucgaccagaagcuccucgaggaccuccagaagaagaagaacgaccuccgcuacaucgagaugcagcacuuccgcgagaagcuccccuccuacggcaugcagaaggagcucgucaaccucaucgacaaccaccaggucaccgucaucuccggcgagaccggcugcggcaagaccacccaggucacccaguucauccucgacaacuacaucgagcgcggcaagggcuccgccugccgcaucgucugcacccagccccgccgcaucuccgccaucuccgucgccgagcgcgucgccgccgagcgcgccgaguccugcggcuccggcaacuccaccggcuaccagauccgccuccagucccgccucccccgcaagcagggcuccauccucuacugcaccaccggcaucauccuccaguggcuccaguccgaccccuaccucuccuccgucucccacaucguccucgacgagauccacgagcgcaaccuccaguccgacguccucaugaccgucgucaaggaccuccucaacuuccgcuccgaccucaaggucauccucauguccgccacccucaacgccgagaaguucuccgaguacuucggcaacugccccaugauccacauccccggcuucaccuuccccgucgucgaguaccuccucgaggacgucaucgagaagauccgcuacguccccgagcagaaggagcaccgcucccaguucaagcgcggcuucaugcagggccacgucaaccgccaggagaaggaggagaaggaggccaucuacaaggagcgcuggcccgacuacguccgcgagcuccgccgccgcuacuccgccuccaccgucgacgucaucgagaugauggaggacgacaaggucgaccucaaccucaucgucgcccucauccgcuacaucguccucgaggaggaggacggcgccauccucgucuuccuccccggcugggacaacaucuccacccuccacgaccuccucaugucccaggucauguucaaguccgucaaccagacccaggucuucaagcgcaccccccccggcguccgcaagaucgucaucgccaccaacaucgccgagaccuccaucaccaucgacgacgucgucuacgucaucgacggcggcaagaucaaggagacccacuucgacacccagaacaacaucuccaccauguccgccgagugggucuccaaggccaacgccaagcagcgcaagggccgcgccggccgcguccagcccggccacugcuaccaccucuacaacggccuccgcgccucccuccucgacgacuaccagcuccccgagauccuccgcaccccccucgaggagcucugccuccagaucaagauccuccgccucggcggcaucgccuacuuccucucccgccucauggacccccccuccaacgaggccguccuccucuccauccgccaccucauggagcucaacgcccucgacaagcaggaggagcucaccccccucggcguccaccucgcccgccuccccgucgagccccacaucggcaagaugauccucuucggcgcccucuucugcugccucgaccccguccucaccaucgccgccucccucuccuucaaggaccccuucgucaucccccucggcaaggagaagaucgccgacgcccgccgcaaggagcucgccaaggacacccgcuccgaccaccucaccgucgucaacgccuucgagggcugggaggaggcccgccgccgcggcuuccgcuacgagaaggacuacugcugggaguacuuccucuccuccaacacccuccagaugcuccacaacaugaagggccaguucgccgagcaccuccucggcgccggcuucgucuccucccgcaaccccaaggaccccgaguccaacaucaacuccgacaacgagaagaucaucaaggccgucaucugcgccggccucuaccccaaggucgccaagauccgccucaaccucggcaagaagcgcaagauggucaaggucuacaccaagaccgacggccucgucgccguccaccccaaguccgucaacgucgagcagaccgacuuccacuacaacuggcucaucuaccaccucaagaugcgcaccuccuccaucuaccucuacgacugcaccgaggucucccccuacugccuccucuucuucggcggcgacaucuccauccagaaggacaacgaccaggagaccaucgccgucgacgaguggaucgucuuccagucccccgcccgcaucgcccaccucgucaaggagcuccgcaaggagcucgacauccuccuccaggagaagaucgaguccccccaccccgucgacuggaacgacaccaagucccgcgacugcgccguccucuccgccaucaucgaccucaucaagacccaggagaaggccaccccccgcaacuuccccccccgcuuccaggacggcuacuacuccuga

SEQ ID NO: 42232 - RNA, 3684 nt, Artificial Sequence
  derived and/or modified sequence opt2 from DHX38__Homo_sapiens__NP_054722
augggcgacaccuccgaggacgccuccauccaccgccucgagggcaccgaccucgacugccaggucggcggccucaucugcaaguccaaguccgccgccuccgagcagcacgucuucaaggcccccgccccccgccccucccuccucggccucgaccuccucgccucccucaagcgccgcgagcgcgaggagaaggacgacggcgaggacaagaagaaguccaaggucuccuccuacaaggacugggaggaguccaaggacgaccagaaggacgccgaggaggagggcggcgaccaggccggccagaacauccgcaaggaccgccacuaccgcuccgcccgcgucgagacccccucccaccccggcggcgucuccgaggaguucugggagcgcucccgccagcgcgagcgcgagcgccgcgagcacggcgucuacgccuccuccaaggaggagaaggacuggaagaaggagaagucccgcgaccgcgacuacgaccgcaagcgcgaccgcgacgagcgcgaccgcucccgccacuccucccgcuccgagcgcgacggcggcuccgagcgcuccucccgccgcaacgagcccgaguccccccgccaccgccccaaggacgccgccacccccucccgcuccaccugggaggaggaggacuccggcuacggcuccucccgccgcucccagugggagucccccucccccacccccuccuaccgcgacuccgagcgcucccaccgccucuccacccgcgaccgcgaccgcuccguccgcggcaaguacuccgacgacaccccccuccccacccccuccuacaaguacaacgagugggccgacgaccgccgccaccucggcuccaccccccgccucucccgcggccgcggccgccgcgaggagggcgaggagggcaucuccuucgacaccgaggaggagcgccagcagugggaggacgaccagcgccaggccgaccgcgacugguacaugauggacgagggcuacgacgaguuccacaacccccucgccuacuccuccgaggacuacguccgccgccgcgagcagcaccuccacaagcagaagcagaagcgcaucuccgcccagcgccgccagaucaacgaggacaacgagcgcugggagaccaaccgcaugcucaccuccggcgucguccaccgccucgaggucgacgaggacuucgaggaggacaacgccgccaagguccaccucaugguccacaaccucgucccccccuuccucgacggccgcaucgucuucaccaagcagcccgagcccgucauccccgucaaggacgccaccuccgaccucgccaucaucgcccgcaagggcucccagaccguccgcaagcaccgcgagcagaaggagcgcaagaaggcccagcacaagcacugggagcucgccggcaccaagcucggcgacaucaugggcgucaagaaggaggaggagcccgacaaggccgucaccgaggacggcaaggucgacuaccgcaccgagcagaaguucgccgaccacaugaagcgcaaguccgaggccuccuccgaguucgccaagaagaaguccauccucgagcagcgccaguaccuccccaucuucgccguccagcaggagcuccucaccaucauccgcgacaacuccaucgucaucgucgucggcgagaccggcuccggcaagaccacccagcucacccaguaccuccacgaggacggcuacaccgacuacggcaugaucggcugcacccagccccgccgcgucgccgccauguccgucgccaagcgcgucuccgaggagaugggcggcaaccucggcgaggaggucggcuacgccauccgcuucgaggacugcaccuccgagaacacccucaucaaguacaugaccgacggcauccuccuccgcgagucccuccgcgaggccgaccucgaccacuacuccgccaucaucauggacgaggcccacgagcgcucccucaacaccgacguccucuucggccuccuccgcgaggucgucgcccgccgcuccgaccucaagcucaucgucaccuccgccaccauggacgccgagaaguucgccgccuucuucggcaacguccccaucuuccacauccccggccgcaccuuccccgucgacauccucuucuccaagaccccccaggaggacuacgucgaggccgccgucaagcagucccuccagguccaccucuccggcgcccccggcgacauccucaucuucaugcccggccaggaggacaucgaggucaccuccgaccagaucgucgagcaccucgaggagcucgagaacgcccccgcccucgccguccuccccaucuacucccagcuccccuccgaccuccaggccaagaucuuccagaaggcccccgacggcguccgcaagugcaucgucgccaccaacaucgccgagaccucccucaccgucgacggcaucauguucgucaucgacuccggcuacugcaagcucaaggucuucaacccccgcaucggcauggacgcccuccagaucuaccccaucucccaggccaacgccaaccagcgcuccggccgcgccggccgcaccggccccggccagugcuuccgccucuacacccaguccgccuacaagaacgagcuccucaccaccaccguccccgagauccagcgcaccaaccucgccaacgucguccuccuccucaagucccucggcguccaggaccuccuccaguuccacuucauggaccccccccccgaggacaacaugcucaacuccauguaccagcucuggauccucggcgcccucgacaacaccggcggccucaccuccaccggccgccucauggucgaguucccccucgaccccgcccucuccaagaugcucaucgucuccugcgacaugggcugcuccuccgagauccuccucaucgucuccaugcucuccguccccgccaucuucuaccgccccaagggccgcgaggaggaguccgaccagauccgcgagaaguucgccguccccgaguccgaccaccucaccuaccucaacgucuaccuccaguggaagaacaacaacuacuccaccaucuggugcaacgaccacuucauccacgccaaggccaugcgcaagguccgcgagguccgcgcccagcucaaggacaucaugguccagcagcgcaugucccucgccuccugcggcaccgacugggacaucguccgcaagugcaucugcgccgccuacuuccaccaggccgccaagcucaagggcaucggcgaguacgucaacauccgcaccggcaugcccugccaccuccaccccaccuccucccucuucggcaugggcuacacccccgacuacaucgucuaccacgagcucgucaugaccaccaaggaguacaugcagugcgucaccgccgucgacggcgaguggcucgccgagcucggccccauguucuacuccgucaagcaggccggcaagucccgccaggagaaccgccgccgcgccaaggaggaggccuccgccauggaggaggagauggcccucgccgaggagcagcuccgcgcccgccgccaggagcaggagaagcgcuccccccucggcuccguccgcuccaccaagaucuacacccccggccgcaaggagcagggcgagcccaugaccccccgccgcacccccgcccgcuucggccucuga

SEQ ID NO: 42233 - RNA, 2109 nt, Artificial Sequence
  derived and/or modified sequence opt2 from DHX40__Homo_sapiens__NP_001159773
augucccgcuuccccgccgucgccggccgcgccccccgccgccaggaggagggcgagcgcucccgcgaccuccaggaggagcgccucuccgccgucugcaucgccgaccgcgaggagaagggcugcaccucccaggagggcggcaccacccccaccuuccccauccagaagcagcgcaagaagaucauccaggccgagaccgccaucaaguacaugaccgacggcugccuccucaagcacauccucggcgaccccaaccucaccaaguucuccgucaucauccucgacgaggcccacgagcgcacccucaccaccgacauccucuucggccuccucaagaagcucuuccaggagaagucccccaaccgcaaggagcaccucaaggucgucgucauguccgccaccauggagcucgccaagcucuccgccuucuucggcaacugccccaucuucgacauccccggccgccucuaccccguccgcgagaaguucugcaaccucaucggcccccgcgaccgcgagaacaccgccuacauccaggccaucgucaaggucaccauggacauccaccucaacgagauggccggcgacauccucgucuuccucaccggccaguucgagaucgagaaguccugcgagcuccucuuccagauggccgaguccgucgacuacgacuacgacguccaggacaccacccucgacggccuccucauccuccccugcuacggcuccaugaccaccgaccagcagcgccgcaucuuccucccccccccccccggcauccgcaagugcgucaucuccaccaacaucuccgccaccucccucaccaucgacggcauccgcuacgucgucgacggcggcuucgucaagcagcucaaccacaacccccgccucggccucgacauccucgaggucguccccaucuccaaguccgaggcccuccagcgcuccggccgcgccggccgcaccuccuccggcaagugcuuccgcaucuacuccaaggacuucuggaaccagugcaugcccgaccacgucauccccgagaucaagcgcaccucccucaccuccgucguccucacccucaagugccucgccauccacgacgucauccgcuuccccuaccucgacccccccaacgagcgccucauccucgaggcccucaagcagcucuaccagugcgacgccaucgaccgcuccggccacgucacccgccucggccucuccauggucgaguucccccuccccccccaccucaccugcgccgucaucaaggccgccucccucgacugcgaggaccuccuccuccccaucgccgccaugcucuccgucgagaacgucuucauccgccccgucgaccccgaguaccagaaggaggccgagcagcgccaccgcgagcucgccgccaaggccggcggcuucaacgacuucgccacccucgccgucaucuucgagcagugcaaguccuccggcgcccccgccuccuggugccagaagcacuggauccacuggcgcugccucuucuccgccuuccgcgucgaggcccagcuccgcgagcucauccgcaagcucaagcagcaguccgacuuccccaaggagaccuucgagggccccaagcacgagguccuccgccgcugccucugcgccggcuacuucaagaacgucgcccgccgcuccgucggccgcaccuucugcaccauggacggccgcggcucccccguccacauccaccccuccuccgcccuccacgagcaggagaccaagcucgaguggaucaucuuccacgagguccucgucaccaccaaggucuacgcccgcaucgucugccccauccgcuacgaguggguccgcgaccuccuccccaagcuccacgaguucaacgcccacgaccucuccuccgucgcccgccgcgagguccgcgaggacgcccgccgccgcuggaccaacaaggagaacgucaagcagcucaaggacggcaucuccaaggacguccucaagaagaugcagcgccgcaacgacgacaaguccaucuccgacgcccgcgcccgcuuccucgagcgcaagcagcagcgcacccaggaccacuccgacacccgcaaggagaccggcuga

SEQ ID NO: 42234 - RNA, 2037 nt, Artificial Sequence
  derived and/or modified sequence opt2 from DHX58__Homo_sapiens__NP_077024
auggagcuccgcuccuaccagugggaggucaucaugcccgcccucgagggcaagaacaucaucaucuggcuccccaccggcgccggcaagacccgcgccgccgccuacgucgccaagcgccaccucgagaccgucgacggcgccaaggucgucguccucgucaaccgcguccaccucgucacccagcacggcgaggaguuccgccgcaugcucgacggccgcuggaccgucaccacccucuccggcgacaugggcccccgcgccggcuucggccaccucgcccgcugccacgaccuccucaucugcaccgccgagcuccuccagauggcccucaccucccccgaggaggaggagcacgucgagcucaccgucuucucccucaucgucgucgacgagugccaccacacccacaaggacaccgucuacaacgucaucaugucccaguaccucgagcucaagcuccagcgcgcccagccccucccccagguccucggccucaccgccucccccggcaccggcggcgccuccaagcucgacggcgccaucaaccacguccuccagcucugcgccaaccucgacaccuggugcaucauguccccccagaacugcugcccccagcuccaggagcacucccagcagcccugcaagcaguacaaccucugccaccgccgcucccaggaccccuucggcgaccuccucaagaagcucauggaccagauccacgaccaccucgagaugcccgagcucucccgcaaguucggcacccagauguacgagcagcaggucgucaagcucuccgaggccgccgcccucgccggccuccaggagcagcgcgucuacgcccuccaccuccgccgcuacaacgacgcccuccucauccacgacaccguccgcgccgucgacgcccucgccgcccuccaggacuucuaccaccgcgagcacgucaccaagacccagauccucugcgccgagcgccgccuccucgcccucuucgacgaccgcaagaacgagcucgcccaccucgccacccacggccccgagaaccccaagcucgagaugcucgagaagauccuccagcgccaguucuccuccuccaacuccccccgcggcaucaucuucacccgcacccgccaguccgcccacucccuccuccucuggcuccagcagcagcagggccuccagaccgucgacauccgcgcccagcuccucaucggcgccggcaacuccucccaguccacccacaugacccagcgcgaccagcaggaggucauccagaaguuccaggacggcacccucaaccuccucgucgccaccuccgucgccgaggagggccucgacaucccccacugcaacgucgucguccgcuacggccuccucaccaacgagaucuccaugguccaggcccgcggccgcgcccgcgccgaccaguccgucuacgccuucgucgccaccgagggcucccgcgagcucaagcgcgagcucaucaacgaggcccucgagacccucauggagcaggccgucgccgccguccagaagauggaccaggccgaguaccaggccaagauccgcgaccuccagcaggccgcccucaccaagcgcgccgcccaggccgcccagcgcgagaaccagcgccagcaguuccccgucgagcacguccagcuccucugcaucaacugcauggucgccgucggccacggcuccgaccuccgcaaggucgagggcacccaccacgucaacgucaaccccaacuucuccaacuacuacaacgucucccgcgaccccgucgucaucaacaaggucuucaaggacuggaagcccggcggcgucaucuccugccgcaacugcggcgaggucuggggccuccagaugaucuacaaguccgucaagcuccccguccucaagguccgcuccaugcuccucgagaccccccagggccgcauccaggccaagaaguggucccgcguccccuucuccguccccgacuucgacuuccuccagcacugcgccgagaaccucuccgaccucucccucgacuga

SEQ ID NO: 42235 - RNA, 3546 nt, Artificial Sequence
  derived and/or modified sequence opt2 from DHX8__Homo_sapiens__NP_001289552
auggccgucgccgucgccauggccggcgcccucaucggcuccgagcccggccccgccgaggagcucgccaagcucgaguaccucucccucgucuccaaggucugcaccgagcucgacaaccaccucggcaucaacgacaaggaccucgccgaguucgucaucucccucgccgagaagaacaccaccuucgacaccuucaaggccucccucgucaagaacggcgccgaguucaccgacucccucaucuccaaccuccuccgccucauccagaccaugcgcccccccgccaagcccuccaccuccaaggaccccgucgucaagcccaagaccgagaaggagaagcucaaggagcucuuccccguccucugccagcccgacaaccccuccguccgcaccaugcucgacgaggacgacgucaaggucgccgucgacguccucaaggagcucgaggcccucaugcccuccgccgccggccaggagaagcagcgcgacgccgagcaccgcgaccgcaccaagaagaagaagcgcucccgcucccgcgaccgcaaccgcgaccgcgaccgcgaccgcgagcgcaaccgcgaccgcgaccacaagcgccgccaccgcucccgcucccgcucccgcucccgcacccgcgagcgcaacaaggucaagucccgcuaccgcucccgcucccgcucccaguccccccccaaggaccgcaaggaccgcgacaaguacggcgagcgcaaccucgaccgcuggcgcgacaagcacgucgaccgccccccccccgaggagcccaccaucggcgacaucuacaacggcaaggucaccuccaucaugcaguucggcugcuucguccagcucgagggccuccgcaagcgcugggagggccucguccacaucuccgagcuccgccgcgagggccgcgucgccaacgucgccgacgucgucuccaagggccagcgcgucaaggucaagguccucuccuucaccggcaccaagaccucccucuccaugaaggacgucgaccaggagaccggcgaggaccucaaccccaaccgccgccgcaaccucgucggcgagaccaacgaggagaccuccaugcgcaaccccgaccgccccacccaccucucccucgucuccgcccccgaggucgaggacgacucccucgagcgcaagcgccucacccgcaucuccgaccccgagaagugggagaucaagcagaugaucgccgccaacguccucuccaaggaggaguuccccgacuucgacgaggagaccggcauccuccccaaggucgacgacgaggaggacgaggaccucgagaucgagcucgucgaggaggagccccccuuccuccgcggccacaccaagcaguccauggacaugucccccaucaagaucgucaagaaccccgacggcucccucucccaggccgccaugaugcaguccgcccucgccaaggagcgccgcgagcucaagcaggcccagcgcgaggccgagauggacuccauccccaugggccucaacaagcacugggucgacccccuccccgacgccgagggccgccagaucgccgccaacaugcgcggcaucggcaugaugcccaacgacauccccgaguggaagaagcacgccuucggcggcaacaaggccuccuacggcaagaagacccagauguccauccucgagcagcgcgagucccuccccaucuacaagcucaaggagcagcucguccaggccguccacgacaaccagauccucaucgucaucggcgagaccggcuccggcaagaccacccagaucacccaguaccucgccgaggccggcuacaccucccgcggcaagaucggcugcacccagccccgccgcgucgccgccauguccgucgccaagcgcgucuccgaggaguucggcugcugccucggccaggaggucggcuacaccauccgcuucgaggacugcaccucccccgagaccgucaucaaguacaugaccgacggcaugcuccuccgcgagugccucaucgaccccgaccucacccaguacgccaucaucaugcucgacgaggcccacgagcgcaccauccacaccgacguccucuucggccuccucaagaagaccguccagaagcgccaggacaugaagcucaucgucaccuccgccacccucgacgccgucaaguucucccaguacuucuacgaggcccccaucuucaccauccccggccgcaccuaccccgucgagauccucuacaccaaggagcccgagaccgacuaccucgacgccucccucaucaccgucaugcagauccaccucaccgagccccccggcgacauccucgucuuccucaccggccaggaggagaucgacaccgccugcgagauccucuacgagcgcaugaagucccucggccccgacguccccgagcucaucauccuccccgucuacuccgcccuccccuccgagaugcagacccgcaucuucgaccccgccccccccggcucccgcaaggucgucaucgccaccaacaucgccgagaccucccucaccaucgacggcaucuacuacgucgucgaccccggcuucgucaagcagaaggucuacaacuccaagaccggcaucgaccagcucgucgucacccccaucucccaggcccaggccaagcagcgcgccggccgcgccggccgcaccggccccggcaagugcuaccgccucuacaccgagcgcgccuaccgcgacgagaugcucaccaccaacguccccgagauccagcgcaccaaccucgccuccaccguccucucccucaaggccaugggcaucaacgaccuccucuccuucgacuucauggacgccccccccauggagacccucaucaccgccauggagcagcucuacacccucggcgcccucgacgacgagggccuccucacccgccucggccgccgcauggccgaguucccccucgagcccaugcucugcaagaugcucaucauguccguccaccucggcugcuccgaggagaugcucaccaucgucuccaugcucuccguccagaacgucuucuaccgccccaaggacaagcaggcccucgccgaccagaagaaggccaaguuccaccagaccgagggcgaccaccucacccuccucgccgucuacaacuccuggaagaacaacaaguucuccaaccccuggugcuacgagaacuucauccaggcccgcucccuccgccgcgcccaggacauccgcaagcagaugcucggcaucauggaccgccacaagcucgacgucgucuccugcggcaaguccaccguccgcguccagaaggccaucugcuccggcuucuuccgcaacgccgccaagaaggacccccaggagggcuaccgcacccucaucgaccagcaggucgucuacauccaccccuccuccgcccucuucaaccgccagcccgagugccccaagcacuuccuccccgucgucgccgucgccgucucccucgagcagugccucuccaaguucgaggaccucaacaaggagcucggccucgucaccugcuga

SEQ ID NO: 42236 - RNA, 3813 nt, Artificial Sequence
  derived and/or modified sequence opt2 from DHX9__Homo_sapiens__NP_001348
augggcgacgucaagaacuuccucuacgccuggugcggcaagcgcaagaugacccccuccuacgagauccgcgccgucggcaacaagaaccgccagaaguucaugugcgagguccaggucgagggcuacaacuacaccggcaugggcaacuccaccaacaagaaggacgcccaguccaacgccgcccgcgacuucgucaacuaccucguccgcaucaacgagaucaaguccgaggagguccccgccuucggcgucgccuccccccccccccucaccgacacccccgacaccaccgccaacgccgagggcgaccuccccaccaccaugggcggcccccuccccccccaccucgcccucaaggccgagaacaacuccgaggucggcgccuccggcuacggcguccccggccccaccugggaccgcggcgccaaccucaaggacuacuacucccgcaaggaggagcaggagguccaggccacccucgaguccgaggaggucgaccucaacgccggccuccacggcaacuggacccucgagaacgccaaggcccgccucaaccaguacuuccagaaggagaagauccagggcgaguacaaguacacccaggucggccccgaccacaaccgcuccuucaucgccgagaugaccaucuacaucaagcagcucggccgccgcaucuucgcccgcgagcacggcuccaacaagaagcucgccgcccaguccugcgcccucucccucguccgccagcucuaccaccucggcgucgucgaggccuacuccggccucaccaagaagaaggagggcgagaccgucgagcccuacaaggucaaccucucccaggaccucgagcaccagcuccagaacaucauccaggagcucaaccucgagauccuccccccccccgaggaccccuccguccccgucgcccucaacaucggcaagcucgcccaguucgagcccucccagcgccagaaccaggucggcgucguccccuggucccccccccaguccaacuggaaccccuggaccuccuccaacaucgacgagggcccccucgccuucgccacccccgagcagaucuccauggaccucaagaacgagcucauguaccagcucgagcaggaccacgaccuccaggccauccuccaggagcgcgagcuccuccccgucaagaaguucgaguccgagauccucgaggccaucucccagaacuccgucgucaucauccgcggcgccaccggcugcggcaagaccacccaggucccccaguucauccucgacgacuucauccagaacgaccgcgccgccgagugcaacaucgucgucacccagccccgccgcaucuccgccgucuccgucgccgagcgcgucgccuucgagcgcggcgaggagcccggcaaguccugcggcuacuccguccgcuucgaguccauccucccccgcccccacgccuccaucauguucugcaccgucggcguccuccuccgcaagcucgaggccggcauccgcggcaucucccacgucaucgucgacgagauccacgagcgcgacaucaacaccgacuuccuccucgucguccuccgcgacgucguccaggccuaccccgagguccgcaucguccucauguccgccaccaucgacaccuccauguucugcgaguacuucuucaacugccccaucaucgaggucuacggccgcaccuaccccguccaggaguacuuccucgaggacugcauccagaugacccacuucguccccccccccaaggacaagaagaagaaggacaaggacgacgacggcggcgaggacgacgacgccaacugcaaccucaucugcggcgacgaguacggccccgagacccgccucuccaugucccagcucaacgagaaggagacccccuucgagcucaucgaggcccuccucaaguacaucgagacccucaacguccccggcgccguccucgucuuccuccccggcuggaaccucaucuacaccaugcagaagcaccucgagaugaacccccacuucggcucccaccgcuaccagauccucccccuccacucccagaucccccgcgaggagcagcgcaaggucuucgaccccguccccgucggcgucaccaaggucauccucuccaccaacaucgccgagaccuccaucaccaucaacgacgucgucuacgucaucgacuccugcaagcagaaggucaagcucuucaccgcccacaacaacaugaccaacuacgccaccgucugggccuccaagaccaaccucgagcagcgcaagggccgcgccggccgcguccgccccggcuucugcuuccaccucugcucccgcgcccgcuucgagcgccucgagacccacaugacccccgagauguuccgcaccccccuccacgagaucgcccucuccaucaagcuccuccgccucggcggcaucggccaguuccucgccaaggccaucgagccccccccccucgacgccgucaucgaggccgagcacacccuccgcgagcucgacgcccucgacgccaacgacgagcucaccccccucggccgcauccucgccaagcuccccaucgagccccgcuucggcaagaugaugaucaugggcugcaucuucuacgucggcgacgccaucugcaccaucgccgccgccaccugcuuccccgagcccuucaucaacgagggcaagcgccucggcuacauccaccgcaacuucgccggcaaccgcuucuccgaccacgucgcccuccucuccgucuuccaggccugggacgacgcccgcaugggcggcgaggaggccgagauccgcuucugcgagcacaagcgccucaacauggccacccuccgcaugaccugggaggccaagguccagcucaaggagauccucaucaacuccggcuuccccgaggacugccuccucacccaggucuucaccaacaccggccccgacaacaaccucgacgucgucaucucccuccucgccuucggcgucuaccccaacgucugcuaccacaaggagaagcgcaagauccucaccaccgagggccgcaacgcccucauccacaaguccuccgucaacugccccuucuccucccaggacaugaaguaccccucccccuucuucgucuucggcgagaagauccgcacccgcgccaucuccgccaagggcaugacccucgucaccccccuccagcuccuccucuucgccuccaagaagguccaguccgacggccagaucguccucgucgacgacuggaucaagcuccagaucucccacgaggccgccgccugcaucaccggccuccgcgccgccauggaggcccucgucgucgaggucaccaagcagcccgccaucaucucccagcucgaccccgucaacgagcgcaugcucaacaugauccgccagaucucccgccccuccgccgccggcaucaaccucaugaucggcuccacccgcuacggcgacggcccccgcccccccaagauggcccgcuacgacaacggcuccggcuaccgccgcggcggcuccuccuacuccggcggcggcuacggcggcggcuacuccuccggcggcuacggcuccggcggcuacggcggcuccgccaacuccuuccgcgccggcuacggcgccggcgucggcggcggcuaccgcggcgucucccgcggcggcuuccgcggcaacuccggcggcgacuaccgcggccccuccggcggcuaccgcggcuccggcggcuuccagcgcggcggcggccgcggcgccuacggcaccggcuacuucggccagggccgcggcggcggcggcuacuga

SEQ ID NO: 42237 - RNA, 561 nt, Artificial Sequence
  derived and/or modified sequence opt2 from DIABLO__Homo_sapiens__NP_001265233
augaaguccgacuucuacuuccagaaguccgagccccacucccucuccuccgaggcccucaugcgccgcgccgucucccucgucaccgacuccaccuccaccuuccucucccagaccaccuacgcccucaucgaggccaucaccgaguacaccaaggccgucuacacccucaccucccucuaccgccaguacaccucccuccucggcaagaugaacuccgaggaggaggacgaggucuggcaggucaucaucggcgcccgcgccgagaugaccuccaagcaccaggaguaccucaagcucgagaccaccuggaugaccgccgucggccucuccgagauggccgccgaggccgccuaccagaccggcgccgaccaggccuccaucaccgcccgcaaccacauccagcucgucaagcuccaggucgaggagguccaccagcucucccgcaaggccgagaccaagcucgccgaggcccagaucgaggagcuccgccagaagacccaggaggagggcgaggagcgcgccgaguccgagcaggaggccuaccuccgcgaggacuga

SEQ ID NO: 42238 - RNA, 3792 nt, Artificial Sequence
  derived and/or modified sequence opt2 from DIAPH1__Homo_sapiens__NP_001073280
auggagccccccggcggcucccucggccccggccgcggcacccgcgacaagaagaagggccgcucccccgacgagcuccccuccgccggcggcgacggcggcaaguccaagaaguuccucgagcgcuucaccuccaugcgcaucaagaaggagaaggagaagcccaacuccgcccaccgcaacuccuccgccuccuacggcgacgaccccaccgcccagucccuccaggacgucuccgacgagcagguccucguccucuucgagcagaugcuccucgacaugaaccucaacgaggagaagcagcagccccuccgcgagaaggacaucaucaucaagcgcgagauggucucccaguaccucuacaccuccaaggccggcaugucccagaaggaguccuccaaguccgccaugauguacauccaggagcuccgcuccggccuccgcgacaugccccuccucuccugccucgagucccuccgcgucucccucaacaacaaccccgucuccuggguccagaccuucggcgccgagggccucgccucccuccucgacauccucaagcgccuccacgacgagaaggaggagaccgccggcuccuacgacucccgcaacaagcacgagaucauccgcugccucaaggccuucaugaacaacaaguucggcaucaagaccaugcucgagaccgaggagggcauccuccuccucguccgcgccauggaccccgccguccccaacaugaugaucgacgccgccaagcuccucuccgcccucugcauccucccccagcccgaggacaugaacgagcgcguccucgaggccaugaccgagcgcgccgagauggacgaggucgagcgcuuccagccccuccucgacggccucaaguccggcaccaccaucgcccucaaggucggcugccuccagcucaucaacgcccucaucacccccgccgaggagcucgacuuccgcguccacauccgcuccgagcucaugcgccucggccuccaccagguccuccaggaccuccgcgagaucgagaacgaggacaugcgcguccagcucaacgucuucgacgagcagggcgaggaggacuccuacgaccucaagggccgccucgacgacauccgcauggagauggacgacuucaacgaggucuuccagauccuccucaacaccgucaaggacuccaaggccgagccccacuuccucuccauccuccagcaccuccuccucguccgcaacgacuacgaggcccgcccccaguacuacaagcucaucgaggagugcaucucccagaucguccuccacaagaacggcgccgaccccgacuucaagugccgccaccuccagaucgagaucgagggccucaucgaccagaugaucgacaagaccaaggucgagaaguccgaggccaaggccgccgagcucgagaagaagcucgacuccgagcucaccgcccgccacgagcuccaggucgagaugaagaagauggaguccgacuucgagcagaagcuccaggaccuccagggcgagaaggacgcccuccacuccgagaagcagcagaucgccaccgagaagcaggaccucgaggccgaggucucccagcucaccggcgaggucgccaagcucaccaaggagcucgaggacgccaagaaggagauggccucccucuccgccgccgccaucaccgucccccccuccguccccucccgcgcccccgucccccccgcccccccccuccccggcgacuccggcaccaucaucccccccccccccgcccccggcgacuccaccaccccccccccccccccccccccccccccccccccccccccccuccccggcggcgucugcaucuccuccccccccucccuccccggcggcaccgccaucucccccccccccccccucuccggcgacgccaccaucccccccccccccccccuccccgagggcgucggcauccccucccccuccucccuccccggcggcaccgccaucccccccccccccccccuccccggcuccgcccgcauccccccccccccccccccccuccccggcuccgccggcauccccccccccccccccccccuccccggcgaggccggcaugcccccccccccccccccccuccccggcggccccggcauccccccccccccccccuuccccggcggccccggcauccccccccccccccccggcaugggcaugcccccccccccccccuucggcuucggcguccccgccgcccccguccuccccuucggccucacccccaagaagcucuacaagcccgagguccagcuccgccgccccaacugguccaagcucgucgccgaggaccucucccaggacugcuucuggaccaaggucaaggaggaccgcuucgagaacaacgagcucuucgccaagcucacccucaccuucuccgcccagaccaagaccuccaaggccaagaaggaccaggagggcggcgaggagaagaaguccguccagaagaagaaggucaaggagcucaagguccucgacuccaagaccgcccagaaccucuccaucuuccucggcuccuuccgcaugcccuaccaggagaucaagaacgucauccucgaggucaacgaggccguccucaccgaguccaugauccagaaccucaucaagcagaugcccgagcccgagcagcucaagaugcucuccgagcucaaggacgaguacgacgaccucgccgaguccgagcaguucggcgucgucaugggcaccgucccccgccuccgcccccgccucaacgccauccucuucaagcuccaguucuccgagcaggucgagaacaucaagcccgagaucgucuccgucaccgccgccugcgaggagcuccgcaaguccgaguccuucuccaaccuccucgagaucacccuccucgucggcaacuacaugaacgccggcucccgcaacgccggcgccuucggcuucaacaucuccuuccucugcaagcuccgcgacaccaaguccaccgaccagaagaugacccuccuccacuuccucgccgagcucugcgagaacgacuaccccgacguccucaaguuccccgacgagcucgcccacgucgagaaggccucccgcgucuccgccgagaaccuccagaagaaccucgaccagaugaagaagcagaucuccgacgucgagcgcgacguccagaacuuccccgccgccaccgacgagaaggacaaguucgucgagaagaugaccuccuucgucaaggacgcccaggagcaguacaacaagcuccgcaugaugcacuccaacauggagacccucuacaaggagcucggcgaguacuuccucuucgaccccaagaagcucuccgucgaggaguucuucauggaccuccacaacuuccgcaacauguuccuccaggccgucaaggagaaccagaagcgccgcgagaccgaggagaagaugcgccgcgccaagcucgccaaggagaaggccgagaaggagcgccucgagaagcagcagaagcgcgagcagcucaucgacaugaacgccgagggcgacgagaccggcgucauggacucccuccucgaggcccuccaguccggcgccgccuuccgccgcaagcgcggcccccgccaggccaaccgcaaggccggcugcgccgucaccucccuccucgccuccgagcucaccaaggacgacgccauggccgccguccccgccaaggucuccaagaacuccgagaccuuccccaccauccucgaggaggccaaggagcucgucggccgcgccuccuga

SEQ ID NO: 42239 - RNA, 3306 nt, Artificial Sequence
  derived and/or modified sequence opt2 from DIAPH2__Homo_sapiens__NP_006720
auggagcagcccggcgccgccgccuccggcgccggcggcggcuccgaggagcccggcggcggccgcuccaacaagcgcuccgccggcaaccgcgccgccaacgaggaggagaccaagaacaagcccaagcucaacauccagaucaagacccucgccgacgacguccgcgaccgcaucaccuccuuccgcaaguccaccgucaagaaggagaagccccucauccagcaccccaucgacucccaggucgccauguccgaguuccccgccgcccagccccucuacgacgagcgcucccucaaccucuccgagaaggagguccucgaccucuucgagaagaugauggaggacaugaaccucaacgaggagaagaaggccccccuccgcaacaaggacuucaccaccaagcgcgagauggucguccaguacaucuccgccaccgccaaguccggcggccucaagaacuccaagcacgagugcacccucuccucccaggaguacguccacgagcuccgcuccggcaucuccgacgagaagcuccucaacugccucgagucccuccgcgucucccucaccuccaaccccgucuccugggucaacaacuucggccacgagggccucggccuccuccucgacgagcucgagaagcuccucgacaagaagcagcaggagaacaucgacaagaagaaccaguacaagcucauccagugccucaaggccuucaugaacaacaaguucggccuccagcgcauccucggcgacgagcgcucccuccuccuccucgcccgcgccaucgaccccaagcagcccaacaugaugaccgagaucgucaagauccucuccgccaucugcaucgucggcgaggagaacauccucgacaagcuccucggcgccaucaccaccgccgccgagcgcaacaaccgcgagcgcuucucccccaucgucgagggccucgagaaccaggaggcccuccagcuccaggucgccugcaugcaguucaucaacgcccucgucaccucccccuacgagcucgacuuccgcauccaccuccgcaacgaguuccuccgcuccggccucaagaccaugcuccccgaccucaaggagaaggagaacgacgagcucgacauccagcucaaggucuucgacgagaacaaggaggacgaccucaccgagcucucccaccgccucaacgacauccgcgccgagauggacgacaugaacgaggucuaccaccuccucuacaacaugcucaaggacaccgccgccgagaacuacuuccucuccauccuccagcacuuccuccucauccgcaacgacuacuacauccgcccccaguacuacaagaucaucgaggagugcgucucccagaucguccuccacugcuccggcauggaccccgacuucaaguaccgccagcgccucgacaucgaccucacccaccucaucgacuccugcgucaacaaggccaaggucgaggaguccgagcagaaggccgccgaguucuccaagaaguucgacgaggaguucaccgcccgccaggaggcccaggccgagcuccagaagcgcgacgagaagaucaaggagcucgaggccgagauccagcagcuccgcacccaggcccagguccucuccuccuccuccggcauccccggcccccccgccgcccccccccuccccggcgucggcccccccccccccccccccgcccccccccuccccggcggcgccccccuccccccccccccccccccccuccccggcaugaugggcaucccccccccccccccccccccccuccucuucggcggccccccccccccccccccccucggcggcgucccccccccccccggcaucucccucaaccuccccuacggcaugaagcagaagaagauguacaagcccgaggucuccaugaagcgcaucaacugguccaagaucgagcccaccgagcucuccgagaacugcuucuggcuccgcgucaaggaggacaaguucgagaaccccgaccucuucgccaagcucgcccucaacuucgccacccagaucaagguccagaagaacgccgaggcccucgaggagaagaagaccggccccaccaagaagaaggucaaggagcuccgcauccucgaccccaagaccgcccagaaccucuccaucuuccucggcuccuaccgcaugcccuacgaggacauccgcaacgucauccucgaggucaacgaggacaugcucuccgaggcccucauccagaaccucgucaagcaccuccccgagcagaagauccucaacgagcucgccgagcucaagaacgaguacgacgaccucugcgagcccgagcaguucggcgucgucauguccuccgucaagaugcuccagccccgccucuccuccauccucuucaagcucaccuucgaggagcacaucaacaacaucaagcccuccaucaucgccgucacccucgccugcgaggagcucaagaaguccgaguccuucaaccgccuccucgagcucguccuccucgucggcaacuacaugaacuccggcucccgcaacgcccagucccucggcuucaagaucaacuuccucugcaagauccgcgacaccaaguccgccgaccagaagaccacccuccuccacuucaucgccgacaucugcgaggagaaguaccgcgacauccucaaguuccccgaggagcucgagcacgucgaguccgccuccaaggucuccgcccagauccucaaguccaaccucgccuccauggagcagcagaucguccaccucgagcgcgacaucaagaaguucccccaggccgagaaccagcacgacaaguucgucgagaagaugaccuccuucaccaagaccgcccgcgagcaguacgagaagcucuccaccaugcacaacaacaugaugaagcucuacgagaaccucggcgaguacuucaucuucgacuccaagaccgucuccaucgaggaguucuucggcgaccucaacaacuuccgcacccucuuccucgaggccguccgcgagaacaacaagcgccgcgagauggaggagaagacccgccgcgccaagcucgccaaggagaaggccgagcaggagaagcucgagcgccagaagaagaagaagcagcucaucgacaucaacaaggagggcgacgagaccggcgucauggacaaccuccucgaggcccuccaguccggcgccgccuuccgcgaccgccgcaagcgcaucccccgcaaccccgacaaccgccgcgucccccucgagcgcucccgcucccgccacaacggcgccaucuccuccaaguga

SEQ ID NO: 42240 - RNA, 3582 nt, Artificial Sequence
  derived and/or modified sequence opt2 from DIAPH3__Homo_sapiens__NP_001035982
auggagcgccaccagccccgccuccaccaccccgcccagggcuccgccgccggcacccccuaccccuccuccgccucccuccgcggcugccgcgaguccaagaugccccgccgcaagggcccccagcacccccccccccccuccggccccgaggagcccggcgagaagcgccccaaguuccaccucaacauccgcacccucaccgacgacaugcucgacaaguucgccuccauccgcauccccggcuccaagaaggagcgccccccccuccccaaccucaagaccgccuucgccuccuccgacugcuccgccgccccccucgagaugauggagaacuuccccaagccccucuccgagaacgagcuccucgagcucuucgagaagaugauggaggacaugaaccucaacgaggacaagaaggccccccuccgcgagaaggacuucuccaucaagaaggagauggucaugcaguacaucaacaccgccuccaagaccggcucccucaagcgcucccgccagaucuccccccaggaguucauccacgagcucaagaugggcuccgccgacgagcgccucgucaccugccucgagucccuccgcgucucccucaccuccaaccccgucuccugggucgaguccuucggccacgagggccucggccuccuccucgacauccucgagaagcucaucuccggcaagauccaggagaaggucgucaagaagaaccagcacaaggucauccagugccucaaggcccucaugaacacccaguacggccucgagcgcaucauguccgaggagcgcucccucucccuccucgccaaggccgucgacccccgccaccccaacaugaugaccgacgucgucaagcuccucuccgccgucugcaucgucggcgaggaguccauccucgaggagguccucgaggcccucaccuccgccggcgaggagaagaagaucgaccgcuucuucugcaucgucgagggccuccgccacaacuccguccagcuccaggucgccugcaugcagcucaucaacgcccucgucaccucccccgacgaccucgacuuccgccuccacauccgcaacgaguucaugcgcugcggccucaaggagauccuccccaaccucaagugcaucaagaacgacggccucgacauccagcucaaggucuucgacgagcacaaggaggaggaccucuucgagcucucccaccgccucgaggacauccgcgccgagcucgacgaggccuacgacgucuacaacauggucugguccaccgucaaggagacccgcgccgagggcuacuucaucuccauccuccagcaccuccuccucauccgcaacgacuacuucauccgccagcaguacuucaagcucaucgacgagugcgucucccagaucguccuccaccgcgacggcauggaccccgacuucaccuaccgcaagcgccucgaccucgaccucacccaguucgucgacaucugcaucgaccaggccaagcucgaggaguucgaggagaaggccuccgagcucuacaagaaguucgagaaggaguucaccgaccaccaggagacccaggccgagcuccagaagaaggaggccaagaucaacgagcuccaggccgagcuccaggccuucaagucccaguucggcgcccuccccgccgacugcaacaucccccucccccccuccaaggagggcggcaccggccacuccgcccucccccccccccccccccuccccuccggcggcggcgucccccccccccccccccccccccccccccccccccuccccggcaugcgcaugcccuucuccggccccgucccccccccccccccccucggcuuccucggcggccagaacucccccccccuccccauccuccccuucggccucaagcccaagaaggaguucaagcccgagaucuccaugcgccgccucaacuggcucaagauccgcccccacgagaugaccgagaacugcuucuggaucaaggucaacgagaacaaguacgagaacgucgaccuccucugcaagcucgagaacaccuucugcugccagcagaaggagcgccgcgaggaggaggacaucgaggagaagaaguccaucaagaagaagaucaaggagcucaaguuccucgacuccaagaucgcccagaaccucuccaucuuccucuccuccuuccgcguccccuacgaggagauccgcaugaugauccucgaggucgacgagacccgccucgccgaguccaugauccagaaccucaucaagcaccuccccgaccaggagcagcucaacucccucucccaguucaaguccgaguacuccaaccucugcgagcccgagcaguucgucgucgucauguccaacgucaagcgccuccgcccccgccucuccgccauccucuucaagcuccaguucgaggagcaggucaacaacaucaagcccgacaucauggccgucuccaccgccugcgaggagaucaagaaguccaaguccuucuccaagcuccucgagcucguccuccucaugggcaacuacaugaacgccggcucccgcaacgcccagaccuucggcuucaaccucuccucccucugcaagcucaaggacaccaaguccgccgaccagaagaccacccuccuccacuuccucgucgagaucugcgaggagaaguaccccgacauccucaacuucgucgacgaccucgagccccucgacaaggccuccaaggucuccgucgagacccucgagaagaaccuccgccagaugggccgccagcuccagcagcucgagaaggagcucgagaccuuccccccccccgaggaccuccacgacaaguucgucaccaagaugucccgcuucgucaucuccgccaaggagcaguacgagacccucuccaagcuccacgagaacauggagaagcucuaccaguccaucaucggcuacuacgccaucgacgucaagaaggucuccgucgaggacuuccucaccgaccucaacaacuuccgcaccaccuucaugcaggccaucaaggagaacaucaagaagcgcgaggccgaggagaaggagaagcgcguccgcaucgccaaggagcucgccgagcgcgagcgccucgagcgccagcagaagaagaagcgccuccucgagaugaagaccgagggcgacgagaccggcgucauggacaaccuccucgaggcccuccaguccggcgccgccuuccgcgaccgccgcaagcgcacccccaugcccaaggacguccgccagucccucucccccaugucccagcgccccguccucaaggucugcaaccacgagaaccagaagguccagcucaccgagggcucccgcucccacuacaacaucaacugcaacuccacccgcacccccgucgccaaggagcucaacuacaaccucgacacccacaccuccaccggccgcaucaaggccgccgagaagaaggaggccugcaacgucgaguccaaccgcaagaaggagaccgagcuccucggcuccuucuccaagaacgaguccguccccgaggucgaggcccuccucgcccgccuccgcgcccucuga

SEQ ID NO: 42241 - RNA, 5490 nt, Artificial Sequence
  derived and/or modified sequence opt2 from DICER1__Homo_sapiens__NP_001182502
augaagucccccgcccuccagccccucuccauggccggccuccagcucaugacccccgccuccucccccaugggccccuucuucggccuccccuggcagcaggaggccauccacgacaacaucuacaccccccgcaaguaccaggucgagcuccucgaggccgcccucgaccacaacaccaucgucugccucaacaccggcuccggcaagaccuucaucgccguccuccucaccaaggagcucuccuaccagauccgcggcgacuucucccgcaacggcaagcgcaccgucuuccucgucaacuccgccaaccaggucgcccagcaggucuccgccguccgcacccacuccgaccucaaggucggcgaguacuccaaccucgaggucaacgccuccuggaccaaggagcgcuggaaccaggaguucaccaagcaccagguccucaucaugaccugcuacgucgcccucaacguccucaagaacggcuaccucucccucuccgacaucaaccuccucgucuucgacgagugccaccucgccauccucgaccaccccuaccgcgagaucaugaagcucugcgagaacugccccuccugcccccgcauccucggccucaccgccuccauccucaacggcaagugcgaccccgaggagcucgaggagaagauccagaagcucgagaagauccucaaguccaacgccgagaccgccaccgaccucgucguccucgaccgcuacaccucccagcccugcgagaucgucgucgacugcggccccuucaccgaccgcuccggccucuacgagcgccuccucauggagcucgaggaggcccucaacuucaucaacgacugcaacaucuccguccacuccaaggagcgcgacuccacccucaucuccaagcagauccucuccgacugccgcgccguccucgucguccucggccccuggugcgccgacaaggucgccggcaugaugguccgcgagcuccagaaguacaucaagcacgagcaggaggagcuccaccgcaaguuccuccucuucaccgacaccuuccuccgcaagauccacgcccucugcgaggagcacuucucccccgccucccucgaccucaaguucgucacccccaaggucaucaagcuccucgagauccuccgcaaguacaagcccuacgagcgccagcaguucgaguccgucgagugguacaacaaccgcaaccaggacaacuacgucuccugguccgacuccgaggacgacgacgaggacgaggagaucgaggagaaggagaagcccgagaccaacuuccccucccccuucaccaacauccucugcggcaucaucuucgucgagcgccgcuacaccgccgucguccucaaccgccucaucaaggaggccggcaagcaggaccccgagcucgccuacaucuccuccaacuucaucaccggccacggcaucggcaagaaccagccccgcaacaagcagauggaggccgaguuccgcaagcaggaggagguccuccgcaaguuccgcgcccacgagaccaaccuccucaucgccaccuccaucgucgaggagggcgucgacauccccaagugcaaccucgucguccgcuucgaccuccccaccgaguaccgcuccuacguccaguccaagggccgcgcccgcgcccccaucuccaacuacaucaugcucgccgacaccgacaagaucaaguccuucgaggaggaccucaagaccuacaaggccaucgagaagauccuccgcaacaagugcuccaaguccgucgacaccggcgagaccgacaucgaccccgucauggacgacgacgacgucuucccccccuacguccuccgccccgacgacggcggcccccgcgucaccaucaacaccgccaucggccacaucaaccgcuacugcgcccgccuccccuccgaccccuucacccaccucgcccccaagugccgcacccgcgagcuccccgacggcaccuucuacuccacccucuaccuccccaucaacuccccccuccgcgccuccaucgucggcccccccauguccugcguccgccucgccgagcgcgucgucgcccucaucugcugcgagaagcuccacaagaucggcgagcucgacgaccaccucaugcccgucggcaaggagaccgucaaguacgaggaggagcucgaccuccacgacgaggaggagaccuccguccccggccgccccggcuccaccaagcgccgccagugcuaccccaaggccauccccgagugccuccgcgacuccuacccccgccccgaccagcccugcuaccucuacgucaucggcaugguccucaccaccccccuccccgacgagcucaacuuccgccgccgcaagcucuacccccccgaggacaccacccgcugcuucggcauccucaccgccaagcccaucccccagaucccccacuuccccgucuacacccgcuccggcgaggucaccaucuccaucgagcucaagaaguccggcuucaugcucucccuccagaugcucgagcucaucacccgccuccaccaguacaucuucucccacauccuccgccucgagaagcccgcccucgaguucaagcccaccgacgccgacuccgccuacugcguccucccccucaacgucgucaacgacuccuccacccucgacaucgacuucaaguucauggaggacaucgagaaguccgaggcccgcaucggcauccccuccaccaaguacaccaaggagacccccuucgucuucaagcucgaggacuaccaggacgccgucaucaucccccgcuaccgcaacuucgaccagccccaccgcuucuacgucgccgacgucuacaccgaccucaccccccucuccaaguuccccucccccgaguacgagaccuucgccgaguacuacaagaccaaguacaaccucgaccucaccaaccucaaccagccccuccucgacgucgaccacaccuccucccgccucaaccuccucaccccccgccaccucaaccagaagggcaaggcccucccccucuccuccgccgagaagcgcaaggccaagugggagucccuccagaacaagcagauccucguccccgagcucugcgccauccaccccauccccgccucccucuggcgcaaggccgucugccuccccuccauccucuaccgccuccacugccuccucaccgccgaggagcuccgcgcccagaccgccuccgacgccggcgucggcguccgcucccuccccgccgacuuccgcuaccccaaccucgacuucggcuggaagaaguccaucgacuccaaguccuucaucuccaucuccaacuccuccuccgccgagaacgacaacuacugcaagcacuccaccaucguccccgagaacgccgcccaccagggcgccaaccgcaccuccucccucgagaaccacgaccagauguccgucaacugccgcacccuccucuccgagucccccggcaagcuccacgucgaggucuccgccgaccucaccgccaucaacggccucuccuacaaccagaaccucgccaacggcuccuacgaccucgccaaccgcgacuucugccagggcaaccagcucaacuacuacaagcaggagauccccguccagcccaccaccuccuacuccauccagaaccucuacuccuacgagaaccagccccagcccuccgacgagugcacccuccucuccaacaaguaccucgacggcaacgccaacaaguccaccuccgacggcucccccgucauggccgucaugcccggcaccaccgacaccauccagguccucaagggccgcauggacuccgagcagucccccuccaucggcuacuccucccgcacccucggccccaaccccggccucauccuccaggcccucacccucuccaacgccuccgacggcuucaaccucgagcgccucgagaugcucggcgacuccuuccucaagcacgccaucaccaccuaccucuucugcaccuaccccgacgcccacgagggccgccucuccuacaugcgcuccaagaaggucuccaacugcaaccucuaccgccucggcaagaagaagggccuccccucccgcauggucgucuccaucuucgacccccccgucaacuggcucccccccggcuacgucgucaaccaggacaaguccaacaccgacaagugggagaaggacgagaugaccaaggacugcaugcucgccaacggcaagcucgacgaggacuacgaggaggaggacgaggaggaggagucccucauguggcgcgcccccaaggaggaggccgacuacgaggacgacuuccucgaguacgaccaggagcacauccgcuucaucgacaacaugcucaugggcuccggcgccuucgucaagaagaucucccucucccccuucuccaccaccgacuccgccuacgaguggaagaugcccaagaaguccucccucggcuccaugcccuucuccuccgacuucgaggacuucgacuacuccuccugggacgccaugugcuaccucgaccccuccaaggccgucgaggaggacgacuucgucgucggcuucuggaaccccuccgaggagaacugcggcgucgacaccggcaagcaguccaucuccuacgaccuccacaccgagcagugcaucgccgacaaguccaucgccgacugcgucgaggcccuccucggcugcuaccucaccuccugcggcgagcgcgccgcccagcucuuccucugcucccucggccucaagguccuccccgucaucaagcgcaccgaccgcgagaaggcccucugccccacccgcgagaacuucaacucccagcagaagaaccucuccgucuccugcgccgccgccuccgucgccuccucccgcuccuccguccucaaggacuccgaguacggcugccucaagauccccccccgcugcauguucgaccaccccgacgccgacaagacccucaaccaccucaucuccggcuucgagaacuucgagaagaagaucaacuaccgcuucaagaacaaggccuaccuccuccaggccuucacccacgccuccuaccacuacaacaccaucaccgacugcuaccagcgccucgaguuccucggcgacgccauccucgacuaccucaucaccaagcaccucuacgaggacccccgccagcacucccccggcguccucaccgaccuccgcuccgcccucgucaacaacaccaucuucgccucccucgccgucaaguacgacuaccacaaguacuucaaggccgucucccccgagcucuuccacgucaucgacgacuucguccaguuccagcucgagaagaacgagaugcagggcauggacuccgagaaguccuuccuccagauguaccccgucccccucugcgagaacugccucaaguggaaccagaagcuccccaaccucgcccgccuccgcgagcucaccaccggccgcuccgagucccucuggaaguga

SEQ ID NO: 42242 - RNA, 1689 nt, Artificial Sequence
  derived and/or modified sequence opt2 from DIDO1__Homo_sapiens__NP_071388
auggacgacaagggcgaccccuccaacgaggaggcccccaaggccaucaagcccaccuccaaggaguuccgcaagaccuggggcuuccgccgcaccaccaucgccaagcgcgagggcgccggcgacgccgaggccgacccccucgagcccccccccccccagcagcagcucggccucucccuccgccgcuccggccgccagcccaagcgcaccgagcgcgucgagcaguuccucaccaucgcccgccgccgcggccgccgcuccaugcccgucucccucgaggacuccggcgagcccaccuccugccccgccaccgacgccgagaccgccuccgagggcuccgucgaguccgccuccgagacccgcuccggcccccaguccgccuccaccgccgucaaggagcgccccgccuccuccgagaaggucaagggcggcgacgaccacgacgacaccuccgacuccgacuccgacggccucacccucaaggagcuccagaaccgccuccgccgcaagcgcgagcaggagcccaccgagcgcccccucaagggcauccagucccgccuccgcaagaagcgccgcgaggagggccccgccgagaccgucggcuccgaggccuccgacaccgucgagggcguccuccccuccaagcaggagcccgagaacgaccagggcgucgucucccaggccggcaaggacgaccgcgaguccaagcucgagggcaaggccgcccaggacaucaaggacgaggagcccggcgaccucggccgccccaagcccgagugcgagggcuacgaccccaacgcccucuacugcaucugccgccagccccacaacaaccgcuucaugaucugcugcgaccgcugcgaggagugguuccacggcgacugcgucggcaucuccgaggcccgcggccgccuccucgagcgcaacggcgaggacuacaucugccccaacugcaccauccuccagguccaggacgagacccacuccgagaccgccgaccagcaggaggccaaguggcgccccggcgacgccgacggcaccgacugcaccuccaucggcaccaucgagcagaaguccuccgaggaccagggcaucaagggccgcaucgagaaggccgccaaccccuccggcaagaagaagcucaagaucuuccagcccgucaucgaggcccccggcgccuccaagugcaucggccccggcugcugccacgucgcccagcccgacuccgucuacugcuccaacgacugcauccucaagcacgccgccgccaccaugaaguuccucuccuccggcaaggagcagaagcccaagcccaaggagaagaugaagaugaagcccgagaagcccucccuccccaagugcggcgcccaggccggcaucaagaucuccuccguccacaagcgccccgcccccgagaagaaggagaccaccgucaagaaggccgucgucguccccgcccgcuccgaggcccucggcaaggaggccgccugcgaguccuccacccccuccugggccuccgaccacaacuacaacgccgucaagcccgagaagaccgccgcccccucccccucccuccucuacaagugcauguaccaccucggcgucggccuccucgaccccucccgcuccuucuggaucgccauccccugggccugccccggccucggcgucgccgcccucugcuga

SEQ ID NO: 42243 - RNA, 2271 nt, Artificial Sequence
  derived and/or modified sequence opt2 from DIEXF__Homo_sapiens__NP_055203
augggcaagcgcggcucccgcucccagucccagcuccucaacacccucaccaagaagcagaagaagcaccuccgcgacuucggcgaggagcaccccuucuacgaccgcgucucccgcaaggaggccaagccccagaucugccagcucuccgaguccuccgacuccuccgacuccgaguccgacuccgaguccgagccccagcaggucuccggcuaccaccgccuccucgccacccucaagaacgucuccgaggaggaggaggaggacgaggaggaggaggaggaggaggacuccaucgucgacgacgccgagaugaacgacgaggacggcggcuccgacgucuccgucgaggaggagauggccgccgaguccaccgagucccccgagaacgucgcccucuccgccgaccccgagggcaaggaggacggcgaggagccccccggcaccucccagaccucccccgaggaguucaccgacgccaagcacgagucccucuucucccucgagaccaacuuccucgaggaggaguccggcgacaacuccucccucaaggccucccaggaccccuuccuccagcacgucaacaaggagcucaaggagaaggccauccaggccgucgccaccaaccccaagaccacccacgagcucaaguggcccauccucggccagcucuucuucuccuccaaguuccagaagcucgagaccuucaagccccccaaggacaucgaccucaagucccuccaccuccagaagccccucgaguccaccuggaccaagaccaacucccaguuccucuccggcccccagaaguccuccucccccuucaccccccuccagaaggagcucuuccucaucaugaacuccuaccgcgaccucuucuaccccgagcgcaccgcccucaagaacggcgaggagauccgccacgucuacugccuccacgucaucaaccacauccucaaggccaacgcccagguccucggcaacaacucccgccgccgcucccagaaguucggcgucggcgacgacgacgacuuccgcgaccagggccucacccgccccaagguccucaucgucguccccuuccgcgaggccgcccuccgcgucguccagcucuucaucucccuccucgagggcgacuccaagaagaagaucaucgucuccaacaagaagcgcuuccagggcgaguacggcuccgaccccgaggagcgcccccccaaccucaagcgccccgaggacuacgaggccgucuucgucggcaacaucgacgaccacuuccgcaucggcgucgccauccuccagcgcuccauccgccucuacgcccccuucuacuccuccgacauccucaucgccuccccccucggccuccgcaccaucaucggcggcgagggcgagaagaagcgcgacuucgacuuccucuccuccaucgagcuccucaucaucgaccaggccgacaucuaccucaugcagaacugggagcacguccuccaccucaugaaccacaugaaccuccucccccucgacucccacggcgucgacuucucccgcguccgcauguggucccucaacaacugguccaaguacuaccgccagacccuccucuucggcgcccuccaggacgcccagaucaacuccgucuucaacaaguacugcgucaacaugcagggccaggucgccguccgcaacguccccaugaccggcuccaucucccacguccucguccagcucccccacgucuuccagcgcauggaggccgagaaccucgccuccgucaucgacgcccgcuucaacuucuucgucaacaagauccucccccaguaccgcgacgccgucaugucccacacccucaucuacauccccuccuacuucgacuucguccgccuccgcaacuacuucaagaaggaggagcucaacuucacccacaucugcgaguacacccagaaguccggcgucucccgcgcccgccacuucuuccuccagggcgagaagcaguuccuccucuucaccgagcgcuuccacuucuacaagcgcuacaccaucaagggcauccgcaaccucaucuucuacgagcuccccaccuacccccacuucuacuccgagaucugcaacaugcuccgcgccaccaaccgcggcgaggaggccaccuggaccugcaccguccucuacuccaaguacgacgcccagcgccucgccgccgucgucggcgucgagcgcgccgcccagaugcuccaguccaacaagaacguccaccucuucaucaccggcgagaaguga

SEQ ID NO: 42244 - RNA, 2397 nt, Artificial Sequence
  derived and/or modified sequence opt2 from DIP2A__Homo_sapiens__NP_001139587
auggccgaccgcggcugcccccucgaggccgccccccuccccgccgagguccgcgagucccucgccgagcucgagcucgagcucuccgagggcgacaucacccagaagggcuacgagaagaagcgcgccaagcuccucgcccgcuacaucccccucauccagggcaucgaccccucccuccaggccgagaaccgcauccccggccccucccagaccaccgccgccgcccccaagcagcagaagucccgccccaccgccucccgcgacgagcgcuuccgcuccgacguccacaccgaggccguccaggccgcccucgccaaguacaaggagcgcaagaugcccaugcccuccaagcgccgcuccguccucguccacuccuccgucgagaccuacaccccccccgacaccuccuccgccuccgaggacgagggcucccuccgccgccccggccgccucaccuccaccccccuccagucccacuccuccgucgagcccuggcucgaccgcgucauccagggcuccuccaccuccuccuccgccuccuccaccuccucccaccccggcggccgccccaccaccgcccccuccgccgccgccacccccggcgccgccgccaccaccgcccucgccggccucgaggcccacacccacaucggcguccccgucaacucccgcgucuccuccaagauccagcagcuccucaacacccucaagcgccccaagcgccccccccucaaggaguucuucgucgacgacuucgaggagcuccucgagguccagcagcccgaccccaaccagcccaagcccgagggcuccgagaccuccguccuccgcggcgagccccucaccgccggcgucccccgcccccccucccuccucgccacccuccagcgcuggggcaccacccagcccaagucccccugccucaccgcccucgacaccaccggcaaggccgucuacacccucaccuacggcaagcucuggucccgcucccucaagcucgccuacacccuccucaacaagcucaccuccaagaacgagccccuccucaagcccggcgaccgcgucgcccucgucuuccccaacuccgaccccgucauguucauggucgccuucuacggcugccuccucgccgagcucguccccguccccaucgaggucccccucacccgcaaggacgccggcucccagcaggucggcuuccuccucggcuccugcggcgucuuccucgcccucaccaccgacgccugccagaagggccuccccaaggcccagaccggcgaggucgccgccuucaagggcuggcccccccucuccuggcucgucaucgacggcaagcaccucgccaagccccccaaggacuggcacccccucgcccaggacaccggcaccggcaccgccuacaucgaguacaagaccuccaaggagggcuccaccgucggcgucaccgucucccacgccucccuccucgcccagugccgcgcccucacccaggccugcggcuacuccgaggccgagacccucaccaacguccucgacuucaagcgcgacgccggccucuggcacggcguccucaccuccgucaugaaccgcaugcacgucgucuccguccccuacgcccucaugaaggccaacccccucuccuggauccagaaggucugcuucuacaaggcccgcgccgcccucgucaagucccgcgacaugcacuggucccuccucgcccagcgcggccagcgcgacgucucccucuccucccuccgcaugcucaucgucgccgacggcgccaaccccugguccaucuccuccugcgacgccuuccucaacgucuuccagucccgcggccuccgccccgaggucaucugccccugcgccuccucccccgaggcccucaccgucgccauccgccgcccccccgaccucggcggcccccccccccgcaaggccguccucuccaugaacggccucuccuacggcgucauccgcgucgacaccgaggagaagcucuccguccucaccguccaggacgucggccaggucaugcccggcgccaacgucugcgucgucaagcucgagggcacccccuaccucugcaagaccgacgaggucggcgagaucugcgucuccuccuccgccaccggcaccgccuacuacggccuccucggcaucaccaagaacgucuucgaggccguccccgucaccaccggcggcgcccccaucuucgaccgccccuucacccgcaccggccuccucggcuucaucggccccgacaaccucgucuucaucgucggcaagcucgacggccucauggucaccggcguccgccgccacaacgccgacgacgucgucgccaccgcccucgccgucgagcccaugaaguucgucuaccgcggccgcuga

SEQ ID NO: 42245 - RNA, 4731 nt, Artificial Sequence
  derived and/or modified sequence opt2 from DIP2B__Homo_sapiens__NP_775873
auggccgagcgcggccucgagcccucccccgccgccgucgccgcccucccccccgagguccgcgcccagcucgccgagcucgagcucgagcucuccgagggcgacaucacccagaagggcuacgagaagaagcgcuccaagcuccucucccccuacuccccccagacccaggagaccgacuccgccguccagaaggagcuccgcaaccagacccccgcccccuccgccgcccagaccuccgcccccuccaaguaccaccgcacccgcuccggcggcgcccgcgacgagcgcuaccgcuccgacauccacaccgaggccguccaggccgcccucgccaagcacaaggagcagaagauggcccuccccaugcccaccaagcgccgcuccaccuucguccagucccccgccgacgccugcaccccccccgacaccuccuccgccuccgaggacgagggcucccuccgccgccaggccgcccucuccgccgcccuccagcagucccuccagaacgccgaguccuggaucaaccgcuccauccagggcuccuccaccuccuccuccgccuccuccacccucucccacggcgaggucaagggcaccuccggcucccucgccgacgucuucgccaacacccgcaucgagaacuucuccgccccccccgacgucaccaccaccaccuccuccuccuccuccuccuccuccauccgccccgccaacaucgaccucccccccuccggcaucgucaagggcaugcacaagggcuccaaccgcuccucccucauggacaccgccgacggcguccccgucuccucccgcgucuccaccaagauccagcagcuccucaacacccucaagcgccccaagcgccccccccucaaggaguucuucgucgacgacuccgaggagaucgucgaggucccccagcccgaccccaaccagcccaagcccgagggccgccagaugacccccgucaagggcgagccccucggcgucaucugcaacuggccccccgcccucgaguccgcccuccagcgcuggggcaccacccaggccaagugcuccugccucaccgcccucgacaugaccggcaagcccgucuacacccucaccuacggcaagcucuggucccgcucccucaagcucgccuacacccuccucaacaagcucggcaccaagaacgagcccguccucaagcccggcgaccgcgucgcccucgucuaccccaacaacgaccccgucauguucauggucgccuucuacggcugccuccucgccgaggucauccccguccccaucgaggucccccucacccgcaaggacgccggcggccagcagaucggcuuccuccucggcuccugcggcaucgcccucgcccucaccuccgaggucugccucaagggccuccccaagacccagaacggcgagaucguccaguucaagggcuggccccgccucaagugggucgucaccgacuccaaguaccucuccaagccccccaaggacuggcagccccacaucucccccgccggcaccgagcccgccuacaucgaguacaagaccuccaaggagggcuccgucaugggcgucaccgucucccgccucgccaugcucucccacugccaggcccucucccaggccugcaacuacuccgagggcgagaccaucgucaacguccucgacuucaagaaggacgccggccucuggcacggcauguucgccaacgucaugaacaagaugcacaccaucuccguccccuacuccgucaugaagaccugcccccucuccuggguccagcgcguccacgcccacaaggccaaggucgcccucgucaagugccgcgaccuccacugggccaugauggcccaccgcgaccagcgcgacgucucccucuccucccuccgcaugcucaucgucaccgacggcgccaaccccugguccgucuccuccugcgacgccuuccucucccucuuccagucccacggccucaagcccgaggccaucugccccugcgccaccuccgccgaggccaugaccgucgccauccgccgccccggcguccccggcgccccccuccccggccgcgccauccucuccaugaacggccucuccuacggcgucauccgcgucaacaccgaggacaagaacuccgcccucaccguccaggacgucggccacgucaugcccggcggcaugaugugcaucgucaagcccgacggccccccccagcucugcaagaccgacgagaucggcgagaucugcgucuccucccgcaccggcggcaugauguacuucggccucgccggcgucaccaagaacaccuucgaggucauccccgucaacuccgccggcucccccgucggcgacguccccuucauccgcuccggccuccucggcuucgucggccccggcucccucgucuucgucgucggcaagauggacggccuccucauggucuccggccgccgccacaacgccgacgacaucgucgccaccggccucgccgucgaguccaucaagaccgucuaccgcggccgcaucgccgucuucuccgucuccgucuucuacgacgagcgcaucgucgucgucgccgagcagcgccccgacgccuccgaggaggacuccuuccaguggaugucccgcguccuccaggccaucgacuccauccaccaggucggcgucuacugccucgcccucguccccgccaacacccuccccaagaccccccucggcggcauccacaucucccagaccaagcagcucuuccucgagggcucccuccaccccugcaacauccucaugugcccccacaccugcgucaccaaccuccccaagccccgccagaagcagcccggcgucggccccgccuccgucauggucggcaaccucgucgccggcaagcgcaucgcccaggccgccggccgcgaccucggccagaucgaggagaacgaccucguccgcaagcaccaguuccucgccgagauccuccaguggcgcgcccaggccacccccgaccacguccucuucaugcuccucaacgccaagggcaccaccgucugcaccgccuccugccuccagcuccacaagcgcgccgagcgcaucgccuccguccucggcgacaagggccaccucaacgccggcgacaacgucguccuccucuacccccccggcaucgagcucaucgccgccuucuacggcugccucuacgccggcugcauccccgucaccguccgccccccccacgcccagaaccucaccgccacccuccccaccguccgcaugaucgucgacgucuccaaggccgccugcauccucaccucccagacccucaugcgccuccuccgcucccgcgaggccgccgccgccgucgacgucaagaccuggcccaccaucaucgacaccgacgaccucccccgcaagcgccucccccagcucuacaagccccccacccccgagaugcucgccuaccucgacuucuccgucuccaccaccggcaugcucaccggcgucaagaugucccacuccgccgucaacgcccucugccgcgccaucaagcuccagugcgagcucuacuccucccgccagaucgccaucugccucgaccccuacugcggccucggcuucgcccucuggugccucugcuccgucuacuccggccaccaguccguccucaucccccccauggagcucgagaacaaccucuuccucuggcucuccaccgucaaccaguacaagauccgcgacaccuucugcuccuacuccgucauggagcucugcaccaagggccucggcaaccaggucgagguccucaagacccgcggcaucaaccucuccugcguccgcaccugcgucgucgucgccgaggagcgcccccgcgucgcccuccagcaguccuucuccaagcucuucaaggacaucggccucuccccccgcgccgucuccaccaccuucggcucccgcgucaacgucgccaucugccuccagggcaccuccggccccgaccccaccaccgucuacgucgaccucaagucccuccgccacgaccgcguccgccucgucgagcgcggcgccccccagucccuccuccucuccgaguccggcaagauccuccccggcgucaaggucgucaucgucaaccccgagaccaagggccccgucggcgacucccaccucggcgagaucugggucaacuccccccacaccgccuccggcuacuacaccaucuacgacuccgagacccuccaggccgaccacuucaacacccgccucuccuucggcgacgccgcccagacccucugggcccgcaccggcuaccucggcuucguccgccgcaccgagcucaccgccgccaccggcgagcgccacgacgcccucuacgucgucggcgcccucgacgagacccucgagcuccgcggccuccgcuaccaccccaucgacaucgagaccuccgucucccgcauccaccgcuccaucgccgagugcgccgucuucaccuggaccaaccuccucgucgucgucgucgagcucugcggcuccgagcaggaggcccucgaccucgucccccucgucaccaacgucguccucgaggagcacuaccucaucgucggcgucgucgucgucgucgaccccggcgucauccccaucaacucccgcggcgagaagcagcgcaugcaccuccgcgacuccuuccucgccgaccagcucgaccccaucuacgucgccuacaacauguga

SEQ ID NO: 42246 - RNA, 4671 nt, Artificial Sequence
  derived and/or modified sequence opt2 from DIP2C__Homo_sapiens__NP_055789
auggccgaccgcucccucgagggcauggcccucccccucgagguccgcgcccgccucgccgagcucgagcucgagcucuccgagggcgacaucacccagaagggcuacgagaagaagcgcuccaagcucaucggcgccuaccucccccagcccccccgcgucgaccaggcccucccccaggagcgccgcgcccccgucacccccuccuccgccucccgcuaccaccgccgccgcuccuccggcucccgcgacgagcgcuaccgcuccgacguccacaccgaggccguccaggccgcccucgccaagcacaaggagcgcaagauggccguccccaugcccuccaagcgccgcucccucgucguccagaccuccauggacgccuacaccccccccgacaccuccuccggcuccgaggacgagggcuccguccagggcgacucccagggcacccccaccuccucccagggcuccaucaacauggagcacuggaucucccaggccauccacggcuccaccaccuccaccaccuccuccuccuccacccaguccggcggcuccggcgccgcccaccgccucgccgacgucauggcccagacccacaucgagaaccacuccgccccccccgacgucaccaccuacaccuccgagcacuccauccaggucgagcgcccccagggcuccaccggcucccgcaccgcccccaaguacggcaacgccgagcucauggagaccggcgacggcguccccgucuccucccgcgucuccgccaagauccagcagcucgucaacacccucaagcgccccaagcgccccccccuccgcgaguucuucgucgacgacuucgaggagcuccucgagguccagcagcccgaccccaaccagcccaagcccgagggcgcccagaugcucgccaugcgcggcgagcagcucggcgucgucaccaacuggccccccucccucgaggccgcccuccagcgcuggggcaccaucucccccaaggcccccugccucaccaccauggacaccaacggcaagccccucuacauccucaccuacggcaagcucuggacccgcuccaugaaggucgccuacuccauccuccacaagcucggcaccaagcaggagcccaugguccgccccggcgaccgcgucgcccucgucuuccccaacaacgaccccgccgccuucauggccgccuucuacggcugccuccucgccgaggucguccccguccccaucgaggucccccucacccgcaaggacgccggcucccagcagaucggcuuccuccucggcuccugcggcgucaccgucgcccucaccuccgacgccugccacaagggccuccccaagucccccaccggcgagaucccccaguucaagggcuggcccaagcuccucugguucgucaccgaguccaagcaccucuccaagcccccccgcgacugguucccccacaucaaggacgccaacaacgacaccgccuacaucgaguacaagaccugcaaggacggcuccguccucggcgucaccgucacccgcaccgcccuccucacccacugccaggcccucacccaggccugcggcuacaccgaggccgagaccaucgucaacguccucgacuucaagaaggacgucggccucuggcacggcauccucaccuccgucaugaacaugaugcacgucaucuccauccccuacucccucaugaaggucaacccccucuccuggauccagaaggucugccaguacaaggccaaggucgccugcgucaagucccgcgacaugcacugggcccucgucgcccaccgcgaccagcgcgacaucaaccucuccucccuccgcaugcucaucgucgccgacggcgccaaccccugguccaucuccuccugcgacgccuuccucaacgucuuccaguccaagggccuccgccaggaggucaucugccccugcgccuccucccccgaggcccucaccgucgccauccgccgccccaccgacgacuccaaccagccccccggccgcggcguccucuccaugcacggccucaccuacggcgucauccgcgucgacuccgaggagaagcucuccguccucaccguccaggacgucggccucgucaugcccggcgccaucaugugcuccgucaagcccgacggcgucccccagcucugccgcaccgacgagaucggcgagcucugcgucugcgccgucgccaccggcaccuccuacuacggccucuccggcaugaccaagaacaccuucgaggucuuccccaugaccuccuccggcgcccccaucuccgaguaccccuucauccgcaccggccuccucggcuucgucggccccggcggccucgucuucgucgucggcaagauggacggccucauggucgucuccggccgccgccacaacgccgacgacaucgucgccaccgcccucgccgucgagcccaugaaguucgucuaccgcggccgcaucgccgucuucuccgucaccguccuccacgacgagcgcaucgucaucgucgccgagcagcgccccgacuccaccgaggaggacuccuuccaguggaugucccgcguccuccaggccaucgacuccauccaccaggucggcgucuacugccucgcccucguccccgccaacacccuccccaagaccccccucggcggcauccaccucuccgagaccaagcagcucuuccucgagggcucccuccaccccugcaacguccucaugugcccccacaccugcgucaccaaccuccccaagccccgccagaagcagcccgagaucggccccgccuccgucauggucggcaaccucgucuccggcaagcgcaucgcccaggccuccggccgcgaccucggccagaucgaggacaacgaccaggcccgcaaguuccucuuccucuccgagguccuccaguggcgcgcccagaccacccccgaccacauccucuacacccuccucaacugccgcggcgccaucgccaacucccucaccugcguccagcuccacaagcgcgccgagaagaucgccgucaugcucauggagcgcggccaccuccaggacggcgaccacgucgcccucgucuacccccccggcaucgaccucaucgccgccuucuacggcugccucuacgccggcugcguccccaucaccguccgccccccccacccccagaacaucgccaccacccuccccaccgucaagaugaucgucgaggucucccgcuccgccugccucaugaccacccagcucaucugcaagcuccuccgcucccgcgaggccgccgccgccgucgacguccgcaccuggccccucauccucgacaccgacgaccuccccaagaagcgccccgcccagaucugcaagcccugcaaccccgacacccucgccuaccucgacuucuccgucuccaccaccggcaugcucgccggcgucaagaugucccacgccgccaccuccgccuucugccgcuccaucaagcuccagugcgagcucuaccccucccgcgaggucgccaucugccucgaccccuacugcggccucggcuucguccucuggugccucugcuccgucuacuccggccaccaguccauccucaucccccccuccgagcucgagaccaaccccgcccucuggcuccucgccgucucccaguacaagguccgcgacaccuucugcuccuacuccgucauggagcucugcaccaagggccucggcucccagaccgagucccucaaggcccgcggccucgaccucucccgcguccgcaccugcgucgucgucgccgaggagcgcccccgcaucgcccucacccaguccuucuccaagcucuucaaggaccucggccuccacccccgcgccgucuccaccuccuucggcugccgcgucaaccucgccaucugccuccagggcaccuccggccccgaccccaccaccgucuacgucgacaugcgcgcccuccgccacgaccgcguccgccucgucgagcgcggcuccccccacucccucccccucauggaguccggcaagauccuccccggcguccgcaucaucaucgccaaccccgagaccaagggcccccucggcgacucccaccucggcgagaucuggguccacuccgcccacaacgccuccggcuacuucaccaucuacggcgacgagucccuccaguccgaccacuucaacucccgccucuccuucggcgacacccagaccaucugggcccgcaccggcuaccucggcuuccuccgccgcaccgagcucaccgacgccaacggcgagcgccacgacgcccucuacgucgucggcgcccucgacgaggccauggagcuccgcggcaugcgcuaccaccccaucgacaucgagaccuccgucauccgcgcccacaaguccgucaccgagugcgccgucuucaccuggaccaaccuccucgucgucgucgucgagcucgacggcuccgagcaggaggcccucgaccucgucccccucgucaccaacgucguccucgaggagcacuaccucaucgucggcgucgucgucgucgucgacaucggcgucauccccaucaacucccgcggcgagaagcagcgcaugcaccuccgcgacggcuuccucgccgaccagcucgaccccaucuacgucgccuacaacauguga

SEQ ID NO: 42247 - RNA, 597 nt, Artificial Sequence
  derived and/or modified sequence opt2 from DIRAS1__Homo_sapiens__NP_660156
augcccgagcaguccaacgacuaccgcgucgucgucuucggcgccggcggcgucggcaaguccucccucguccuccgcuucgucaagggcaccuuccgcgacaccuacauccccaccaucgaggacaccuaccgccaggucaucuccugcgacaaguccgucugcacccuccagaucaccgacaccaccggcucccaccaguuccccgccaugcagcgccucuccaucuccaagggccacgccuucauccucgucuucuccgucaccuccaagcagucccucgaggagcucggccccaucuacaagcucaucguccagaucaagggcuccgucgaggacauccccgucaugcucgucggcaacaagugcgacgagacccagcgcgaggucgacacccgcgaggcccaggccgucgcccaggaguggaagugcgccuucauggagaccuccgccaagaugaacuacaacgucaaggagcucuuccaggagcuccucacccucgagacccgccgcaacaugucccucaacaucgacggcaagcgcuccggcaagcagaagcgcaccgaccgcgucaagggcaagugcacccucauguga

SEQ ID NO: 42248 - RNA, 600 nt, Artificial Sequence
  derived and/or modified sequence opt2 from DIRAS2__Homo_sapiens__NP_060064
augcccgagcaguccaacgacuaccgcgucgccgucuucggcgccggcggcgucggcaaguccucccucguccuccgcuucgucaagggcaccuuccgcgaguccuacauccccaccgucgaggacaccuaccgccaggucaucuccugcgacaaguccaucugcacccuccagaucaccgacaccaccggcucccaccaguuccccgccaugcagcgccucuccaucuccaagggccacgccuucauccucgucuacuccaucaccucccgccagucccucgaggagcucaagcccaucuacgagcagaucugcgagaucaagggcgacgucgaguccauccccaucaugcucgucggcaacaagugcgacgagucccccucccgcgagguccaguccuccgaggccgaggcccucgcccgcaccuggaagugcgccuucauggagaccuccgccaagcucaaccacaacgucaaggagcucuuccaggagcuccucaaccucgagaagcgccgcaccgucucccuccagaucgacggcaagaaguccaagcagcagaagcgcaaggagaagcucaagggcaagugcgucaucauguga

SEQ ID NO: 42249 - RNA, 315 nt, Artificial Sequence
  derived and/or modified sequence opt2 from DIRC1__Homo_sapiens__XP_011508847
augcccgaggcccacaugcagcccgccaagcuccagaccucccuccccaccaccgaccacggcuccaagaagcccgucuccugcuaccuccccccccucuccaacgcccaccccaugugcaucgagguccagaacgcccagaacugcuccuccgccgccgccacccucgagcccuccaucaucuccgacaccugcuucuacaagcccaucaccaaggaccagcucuccucccgcuccgagcucaacaccguccgccucaagugccucaacucccuccgcggcuggaagauccucaaccagcucucccucaccuga

SEQ ID NO: 42250 - RNA, 1437 nt, Artificial Sequence
  derived and/or modified sequence opt2 from DIRC2__Homo_sapiens__NP_116228
augggcucccgcugguccuccgaggaggagcgccagccccuccucggccccggccucggccccggccucggcgccuccuggcgcucccgcgaggccgccgccgccgcccuccccgccgccguccccggccccggccgcgucuacggccgccgcuggcucguccuccuccucuucucccuccucgccuucguccagggccucgucuggaacaccuggggccccauccagaacuccgcccgccaggccuacggcuucuccuccugggacaucgcccuccucguccucuggggccccaucggcuuccuccccugcuucgccuucauguggcuccucgacaagcgcggccuccgcaucaccguccuccucaccuccuuccucaugguccucggcaccggccuccgcugcauccccaucuccgaccucauccucaagcgccgccucauccacggcggccagaugcucaacggccucgccggccccaccgucaugaacgccgcccccuuccucuccaccaccugguucuccgccgacgagcgcgccaccgccaccgccaucgccuccaugcucuccuaccucggcggcgccugcgccuuccucgucggcccccucgucguccccgcccccaacggcaccuccccccuccucgccgccgaguccucccgcgcccacaucaaggaccgcaucgaggccguccucuacgccgaguucggcgucgucugccucaucuucuccgccacccucgccuacuuccccccccgccccccccucccccccuccgucgccgccgccucccagcgccucuccuaccgccgcuccgucugccgccuccucuccaacuuccgcuuccucaugaucgcccucgccuacgccaucccccucggcgucuucgccggcugguccggcguccucgaccucauccucacccccgcccacgucucccaggucgacgccggcuggaucggcuucugguccaucgucggcggcugcgucgucggcaucgccauggcccgcuucgccgacuucauccgcggcaugcucaagcucauccuccuccuccucuucuccggcgccacccucuccuccaccugguucacccucaccugccucaacuccaucacccaccucccccucaccaccgucacccucuacgccuccugcauccuccucggcgucuuccucaacuccuccguccccaucuucuucgagcucuucgucgagaccgucuaccccguccccgagggcaucaccugcggcgucgucaccuuccucuccaacauguucaugggcguccuccucuucuuccucaccuucuaccacaccgagcucuccugguucaacuggugccuccccggcuccugccuccucucccuccuccucauccucugcuuccgcgaguccuacgaccgccucuaccucgacgucgucgucuccgucuga

SEQ ID NO: 42251 - RNA, 2787 nt, Artificial Sequence
  derived and/or modified sequence opt2 from DIS3__Homo_sapiens__NP_001121698
augcucaaguccaagaccuuccucaagaagacccgcgccggcggcgucaugaagaucguccgcgagcacuaccuccgcgacgacaucggcugcggcgcccccggcugcgccgccugcggcggcgcccacgagggccccgcccucgagccccagccccaggaccccgccuccuccgucugcccccagccccacuaccuccuccccgacaccaacguccuccuccaccagaucgucuccgccuggcgccccggcaccugggccuccgucgccuccucccuccgccuccccggcucccucgagaccuacgucgagcaggagcagggcgagaacgccaacgaccgcaacgaccgcgccauccgcgucgccgccaagugguacaacgagcaccucaagaagauguccgccgacaaccagcuccaggucaucuucaucaccaacgaccgccgcaacaaggagaaggccaucgaggagggcauccccgccuucaccugcgaggaguacgucaagucccucaccgccaaccccgagcucaucgaccgccucgccugccucuccgaggagggcaacgagaucgaguccggcaagaucaucuucuccgagcaccucccccucuccaagcuccagcagggcaucaaguccggcaccuaccuccagggcaccuuccgcgccucccgcgagaacuaccucgaggccaccgucuggauccacggcgacaacgaggagaacaaggagaucauccuccagggccucaagcaccucaaccgcgccguccacgaggacaucgucgccgucgagcuccuccccaagucccagugggucgcccccuccuccgucguccuccacgacgagggccagaacgaggaggacgucgagaaggaggaggagaccgagcgcaugcucaagaccgccgucuccgagaagaugcucaagcccaccggccgcgucgucggcaucaucaagcgcaacuggcgccccuacugcggcaugcucuccaaguccgacaucaaggagucccgccgccaccucuucacccccgccgacaagcgcaucccccgcauccgcaucgagacccgccaggccuccacccucgagggccgccgcaucaucgucgccaucgacggcuggccccgcaacucccgcuaccccaacggccacuucguccgcaaccucggcgacgucggcgagaaggagaccgagaccgagguccuccuccucgagcacgacgucccccaccagcccuucucccaggccguccucuccuuccuccccaagaugcccugguccaucaccgagaaggacaugaagaaccgcgaggaccuccgccaccucugcaucugcuccgucgacccccccggcugcaccgacaucgacgacgcccuccacugccgcgagcucgagaacggcaaccucgaggucggcguccacaucgccgacgucucccacuucauccgccccggcaacgcccucgaccaggaguccgcccgccgcggcaccaccgucuaccucugcgagaagcgcaucgacaugguccccgagcuccucuccuccaaccucugcucccucaagugcgacgucgaccgccucgccuucuccugcaucugggagaugaaccacaacgccgagauccucaagaccaaguucaccaaguccgucaucaacuccaaggccucccucaccuacgccgaggcccagcuccgcaucgacuccgccaacaugaacgacgacaucaccaccucccuccgcggccucaacaagcucgccaagauccucaagaagcgccgcaucgagaagggcgcccucacccucuccucccccgagguccgcuuccacauggacuccgagacccacgaccccaucgaccuccagaccaaggagcuccgcgagaccaacuccauggucgaggaguucaugcuccucgccaacaucuccgucgccaagaagauccacgaggaguucuccgagcacgcccuccuccgcaagcaccccgcccccccccccuccaacuacgagauccucgucaaggccgcccgcucccgcaaccucgagaucaagaccgacaccgccaagucccucgccgagucccucgaccaggccgagucccccaccuuccccuaccucaacacccuccuccgcauccucgccacccgcugcaugaugcaggccgucuacuucugcuccggcauggacaacgacuuccaccacuacggccucgccucccccaucuacacccacuucaccucccccauccgccgcuacgccgacgucaucguccaccgccuccucgccgucgccaucggcgccgacugcaccuaccccgagcucaccgacaagcacaagcucgccgacaucugcaagaaccucaacuuccgccacaagauggcccaguacgcccagcgcgccuccgucgccuuccacacccagcucuucuucaaguccaagggcaucgucuccgaggaggccuacauccucuucguccgcaagaacgccaucgucguccucauccccaaguacggccucgagggcaccgucuucuucgaggagaaggacaagcccaacccccagcucaucuacgacgacgagauccccucccucaagaucgaggacaccgucuuccacgucuucgacaaggucaaggucaagaucaugcucgacuccuccaaccuccagcaccagaagauccgcaugucccucgucgagccccagauccccggcaucuccauccccaccgacaccuccaacauggaccucaacggccccaagaagaagaagaugaagcucggcaaguga

SEQ ID NO: 42252 - RNA, 1812 nt, Artificial Sequence
  derived and/or modified sequence opt2 from DIS3L2__Homo_sapiens__NP_001244210
augucccaccccgacuaccgcaugaaccuccgcccccucggcaccccccgcggcgucuccgccgucgccggcccccacgacaucggcgccucccccggcgacaagaaguccaagaaccgcuccacccgcggcaagaagaaguccaucuucgagaccuacauguccaaggaggacgucuccgagggccucaagcgcggcacccucauccagggcguccuccgcaucaaccccaagaaguuccacgaggccuucauccccucccccgacggcgaccgcgacaucuucaucgacggcgucgucgcccgcaaccgcgcccucaacggcgaccucgucgucgucaagcuccuccccgaggagcacuggaaggucgucaagcccgaguccaacgacaaggagaccgaggccgccuacgaguccgacauccccgaggagcucugcggccaccaccucccccagcagucccucaaguccuacaacgacucccccgacgucaucgucgaggcccaguucgacggcuccgacuccgaggacggccacggcaucacccagaacguccucgucgacggcgucaagaagcucuccgucugcgucuccgagaagggccgcgaggacggcgacgcccccgucaccaaggacgagaccaccugcaucucccaggacacccgcgcccucuccgagaagucccuccagcgcuccgccaaggucgucuacauccucgagaagaagcacucccgcgccgccaccggcuuccucaagcuccucgccgacaagaacuccgagcucuuccgcaaguacgcccucuucucccccuccgaccaccgcgucccccgcaucuacgucccccucaaggacugcccccaggacuucgucgcccgccccaaggacuacgccaacacccucuucaucugccgcaucgucgacuggaaggaggacugcaacuucgcccucggccagcucgccaagucccucggccaggccggcgagaucgagcccgagaccgagggcauccucaccgaguacggcgucgacuucuccgacuucuccuccgagguccucgagugccucccccagggccuccccuggaccaucccccccgaggaguucuccaagcgccgcgaccuccgcaaggacugcaucuucaccaucgaccccuccaccgcccgcgaccucgacgacgcccucuccugcaagccccucgccgacggcaacuucaaggucggcguccacaucgccgacgucuccuacuucguccccgagggcuccgaccucgacaaggucgccgccgagcgcgccaccuccgucuaccucguccagaaggucguccccaugcucccccgccuccucugcgaggagcucugcucccucaaccccauguccgacaagcucaccuucuccgucaucuggacccucacccccgagggcaagauccucgacgagugguucggccgcaccaucauccgcuccugcaccaagcucuccuacgagcacgcccaguccaugaucgagucccccaccgagaagauccccgccaaggagcucccccccaucucccccgagcacuccuccgaggagguccaccagcagaacgccgacaaggacggcgccgcccaccuccaggccucccacucccccuccgccgaggacgccgaggcccagcccuccaccgaggagcgccuccccgagacccgcggcaucugcgaccgcgaccccgacacccgccucuucuuccuccagcagcagucccgcguccucgaggccaagccccagaacaccauccgcgucgaggagcagaccacccagcuccagaucuga

SEQ ID NO: 42253 - RNA, 3165 nt, Artificial Sequence
  derived and/or modified sequence opt2 from DIS3L__Homo_sapiens__NP_001137160
augcuccagaagcgcgagaagguccuccuccuccgcaccuuccagggccgcacccuccgcaucguccgcgagcacuaccuccgccccugcguccccugccacuccccccucugcccccagcccgccgccugcucccacgacggcaagcuccucuccuccgacgucacccacuacgucauccccgacuggaaggucguccaggacuaccucgagauccucgaguuccccgagcucaagggcaucaucuucaugcagaccgccugccaggccguccagcaccagcgcggccgccgccaguacaacaagcuccgcaaccuccucaaggacgcccgccacgacugcauccucuucgccaacgaguuccagcagugcugcuaccucccccgcgagcgcggcgaguccauggagaaguggcagacccgcuccaucuacaacgccgccgucugguacuaccaccacugccaggaccgcaugcccaucgucauggucaccgaggacgaggaggccauccagcaguacggcuccgagaccgagggcgucuucgucaucaccuucaagaacuaccucgacaacuucuggcccgaccucaaggccgcccacgagcucugcgacuccauccuccagucccgccgcgagcgcgagaacgagucccaggagucccacggcaaggaguaccccgagcaccucccccucgagguccucgaggccggcaucaaguccggccgcuacauccagggcauccucaacgucaacaagcaccgcgcccagaucgaggccuucguccgccuccagggcgccuccuccaaggacuccgaccucgucuccgacauccucauccacggcaugaaggcccgcaaccgcuccauccacggcgacgucgucgucgucgagcuccuccccaagaacgaguggaagggccgcaccgucgcccucugcgagaacgacugcgacgacaaggccuccggcgagucccccuccgagcccaugcccaccggccgcgucgucggcauccuccagaagaacuggcgcgacuacgucgucaccuuccccuccaaggaggagguccagucccagggcaagaacgcccagaagauccucgucacccccugggacuaccgcauccccaagauccgcaucuccacccagcaggccgagacccuccaggacuuccgcgucgucguccgcaucgacuccugggaguccaccuccgucuaccccaacggccacuucguccgcguccucggccgcaucggcgaccucgagggcgagaucgccaccauccucgucgagaacuccaucuccgucauccccuucuccgaggcccagaugugcgagaugcccgucaacacccccgagucccccuggaaggucucccccgaggaggagcagaagcgcaaggaccuccgcaagucccaccucgucuucuccaucgaccccaagggcugcgaggacgucgacgacacccucuccguccgcacccucaacaacggcaaccucgagcucggcguccacaucgccgacgucacccacuucgucgcccccaacuccuacaucgacaucgaggcccgcacccgcgccaccaccuacuaccucgccgaccgccgcuacgacaugcuccccuccguccucuccgccgaccucugcucccuccucggcggcgucgaccgcuacgccgucuccaucaugugggagcucgacaaggccuccuacgagaucaagaaggucugguacggccgcaccaucauccgcuccgccuacaagcucuucuacgaggccgcccaggagcuccucgacggcaaccucuccgucgucgacgacauccccgaguucaaggaccucgacgagaagucccgccaggccaagcucgaggagcucgucugggccaucggcaagcucaccgacaucgcccgccacguccgcgccaagcgcgacggcugcggcgcccucgagcucgagggcgucgaggucugcguccagcucgacgacaagaagaacauccacgaccucauccccaagcagccccucgagguccacgagaccgucgccgagugcaugauccucgccaaccacugggucgccaagaagaucugggaguccuucccccaccaggcccuccuccgccagcacccccccccccaccaggaguucuucuccgagcuccgcgagugcgccaaggccaagggcuucuucaucgacacccgcuccaacaagacccucgccgacucccucgacaacgccaacgacccccacgaccccaucgucaaccgccuccuccgcuccauggccacccaggccauguccaacgcccucuacuucuccaccggcuccugcgccgaggaggaguuccaccacuacggccucgcccucgacaaguacacccacuucaccucccccauccgccgcuacuccgacaucgucguccaccgccuccucauggccgccaucuccaaggacaagaagauggagaucaagggcaaccucuucuccaacaaggaccucgaggagcucugccgccacaucaacaaccgcaaccaggccgcccagcacucccagaagcaguccaccgagcucuuccagugcauguacuucaaggacaaggaccccgccaccgaggagcgcugcaucuccgacggcgucaucuacuccauccgcaccaacggcguccuccucuucaucccccgcuucggcaucaagggcgccgccuaccucaagaacaaggacggccucgucaucuccugcggccccgacuccugcuccgaguggaagcccggcucccuccagcgcuuccagaacaagaucaccuccaccaccaccgacggcgaguccgucaccuuccaccucuucgaccacgucaccguccgcaucuccauccaggccucccgcugccacuccgacaccauccgccucgagaucaucuccaacaagcccuacaagauccccaacaccgagcucauccaccaguccuccccccuccucaaguccgagcucgucaaggaggucaccaaguccgucgaggaggcccagcucgcccaggaggucaaggucaacaucauccaggaggaguaccaggaguaccgccagaccaagggccgcucccucuacacccuccucgaggagauccgcgaccucgcccuccucgacgucuccaacaacuacggcaucuga

SEQ ID NO: 42254 - RNA, 2499 nt, Artificial Sequence
  derived and/or modified sequence opt2 from DISC1__Homo_sapiens__NP_001012975
augcccggcggcggcccccagggcgcccccgccgccgccggcggcggcggcgucucccaccgcgccggcucccgcgacugccucccccccgccgccugcuuccgccgccgccgccucgcccgccgccccggcuacaugcgcuccuccaccggccccggcaucggcuuccucucccccgccgucggcacccucuuccgcuuccccggcggcgucuccggcgaggagucccaccacuccgagucccgcgcccgccagugcggccucgacucccgcggccuccucguccgcucccccgucuccaaguccgccgccgcccccaccgucaccuccguccgcggcaccuccgcccacuucggcauccagcuccgcggcggcacccgccuccccgaccgccucuccuggcccugcggccccggcuccgccggcuggcagcaggaguucgccgccauggacuccuccgagacccucgacgccuccugggaggccgccugcuccgacggcgcccgccgcguccgcgccgccggcucccuccccuccgccgagcucuccuccaacuccugcucccccggcugcggccccgaggucccccccaccccccccggcucccacuccgccuucaccuccuccuucuccuucauccgccucucccucggcuccgccggcgagcgcggcgaggccgagggcugcccccccucccgcgaggccgagucccacugccaguccccccaggagaugggcgccaaggccgccucccucgacggcccccacgaggacccccgcugccucucccgccccuucucccuccucgccacccgcgucuccgccgaccucgcccaggccgcccgcaacuccucccgccccgagcgcgacaugcacucccuccccgacauggaccccggcuccuccuccucccucgaccccucccucgccggcugcggcggcgacggcuccuccggcuccggcgacgcccacuccugggacacccuccuccgcaagugggagcccguccuccgcgacugccuccuccgcaaccgccgccagauggaggucaucucccuccgccucaagcuccagaagcuccaggaggacgccgucgagaacgacgacuacgacaaggccgagacccuccagcagcgccucgaggaccucgagcaggagaagaucucccuccacuuccagcuccccucccgccagcccgcccucuccuccuuccucggccaccucgccgcccagguccaggccgcccuccgccgcggcgccacccagcaggccuccggcgacgacacccacaccccccuccgcauggagccccgccuccucgagcccaccgcccaggacucccuccacgucuccaucacccgccgcgacuggcuccuccaggagaagcagcagcuccagaaggagaucgaggcccuccaggcccgcauguucguccucgaggccaaggaccagcagcuccgccgcgagaucgaggagcaggagcagcagcuccaguggcagggcugcgaccucaccccccucgucggccagcucucccucggccagcuccaggaggucuccaaggcccuccaggacacccucgccuccgccggccagauccccuuccacgccgagccccccgagaccauccgcucccuccaggagcgcaucaagucccucaaccucucccucaaggagaucaccaccaaggucugcauguccgagaaguucugcuccacccuccgcaagaaggucaacgacaucgagacccagcuccccgcccuccucgaggccaagaugcacgccaucuccggcaaccacuucuggaccgccaaggaccucaccgaggagauccgcucccucaccuccgagcgcgagggccucgagggccuccucuccaagcuccucguccucuccucccgcaacgucaagaagcucggcuccgucaaggaggacuacaaccgccuccgccgcgaggucgagcaccaggagaccgccuacgagaccuccgucaaggagaacaccaugaaguacauggagacccucaagaacaagcucugcuccugcaagugcccccuccucggcaaggucugggaggccgaccucgaggccugccgccuccucauccagucccuccagcuccaggaggcccgcggcucccucuccgucgaggacgagcgccagauggacgaccucgagggcgccgccccccccauccccccccgccuccacuccgaggacaagcgcaagaccccccucaaggaguccuacauccucuccgccgagcucggcgagaagugcgaggacaucggcaagaagcuccucuaccucgaggaccagcuccacaccgccauccacucccacgacgaggaccucauccagucccuccgccgcgagcuccagauggucaaggagacccuccaggccaugauccuccagcuccagcccgccaaggaggccggcgagcgcgaggccgccgccuccugcaugaccgccggcguccacgaggcccaggccuga

SEQ ID NO: 42255 - RNA, 4575 nt, Artificial Sequence
  derived and/or modified sequence opt2 from DISP1__Homo_sapiens__NP_116279
auggccauguccaacggcaacaacgacuucgucguccucuccaacuccuccaucgccaccuccgccgccaaccccuccccccucacccccugcgacggcgaccacgccgcccagcagcucacccccaaggaggccacccgcaccaaggucucccccaacggcugccuccagcucaacggcaccgucaaguccuccuuccucccccucgacaaccagcgcaugccccagaugcucccccagugcugccaccccugccccuaccaccacccccucaccucccacuccucccaccaggagugccaccccgaggccggccccgccgcccccuccgcccucgccuccugcugcaugcagccccacuccgaguacuccgccucccucugccccaaccacucccccgucuaccagaccaccugcugccuccagcccucccccuccuucugccuccaccaccccuggcccgaccacuuccagcaccagcccguccagcagcacaucgccaacauccgccccucccgccccuucaagcuccccaaguccuacgccgcccucaucgccgacuggcccgucgucguccucggcaugugcaccauguucaucgucgucugcgcccucgucggcguccucguccccgagcuccccgacuucuccgacccccuccucggcuucgagccccgcggcaccgccaucggccagcgccucgucaccuggaacaacauggucaagaacaccggcuacaaggccacccucgccaacuaccccuucaaguacgccgacgagcaggccaagucccaccgcgacgaccgcugguccgacgaccacuacgagcgcgagaagcgcgaggucgacuggaacuuccacaaggacuccuucuucugcgacguccccuccgaccgcuacucccgcgucgucuucaccuccuccggcggcgagacccucuggaaccuccccgccaucaaguccaugugcaacgucgacaacucccgcauccgcucccacccccaguucggcgaccucugccagcgcaccaccgccgccuccugcugccccuccuggacccucggcaacuacaucgccauccucaacaaccgcuccuccugccagaagaucgucgagcgcgacgucucccacacccucaagcuccuccgcaccugcgccaagcacuaccagaacggcacccucggccccgacugcugggacauggccgcccgccgcaaggaccagcucaagugcaccaacgucccccgcaagugcaccaaguacaacgccgucuaccagauccuccacuaccucgucgacaaggacuucaugacccccaagaccgccgacuacgccacccccgcccucaaguacuccaugcucuucucccccaccgagaagggcgaguccaugaugaacaucuaccucgacaacuucgagaacuggaacuccuccgacggcgucaccaccaucaccggcaucgaguucggcaucaagcacucccucuuccaggacuaccuccucauggacaccgucuaccccgccaucgccaucgucaucguccuccucgucaugugcgucuacaccaaguccauguucaucacccucaugaccauguucgccaucaucuccucccucaucgucuccuacuuccucuaccgcgucgucuuccacuucgaguucuuccccuucaugaaccucaccgcccucaucauccucgucggcaucggcgccgacgacgccuucguccucugcgacgucuggaacuacaccaaguucgacaagccccacgccgagaccuccgagaccgucuccaucacccuccagcacgccgcccucuccauguucgucaccuccuucaccaccgccgccgccuucuacgccaacuacgucuccaacaucaccgccauccgcugcuucggcgucuacgccggcaccgccauccucgucaacuacguccucauggucaccuggcuccccgccgucgucguccuccacgagcgcuaccuccucaacaucuucaccugcuucaagaagccccagcagcagaucuacgacaacaaguccugcuggaccgucgccugccagaagugccacaagguccucuucgccaucuccgaggccucccgcaucuucuucgagaagguccuccccugcaucgucaucaaguuccgcuaccucuggcucuucugguuccucgcccucaccgucggcggcgccuacaucgucugcaucaaccccaagaugaagcuccccucccucgagcucuccgaguuccaggucuuccgcuccucccaccccuucgagcgcuacgacgccgaguacaagaagcucuucauguucgagcgcguccaccacggcgaggagcuccacaugcccaucaccgucaucuggggcgucucccccgaggacaacggcaacccccucaaccccaaguccaagggcaagcucacccucgacuccuccuucaacaucgccucccccgccucccaggccuggauccuccacuucugccagaagcuccgcaaccagaccuucuucuaccagaccgacgagcaggacuucaccuccugcuucaucgagaccuucaagcaguggauggagaaccaggacugcgacgagcccgcccucuaccccugcugcucccacugguccuuccccuacaagcaggagaucuucgagcucugcaucaagcgcgccaucauggagcucgagcgcuccaccggcuaccaccucgacuccaagacccccggcccccgcuucgacaucaacgacaccauccgcgccgucguccucgaguuccaguccaccuaccucuucacccucgccuacgagaagaugcaccaguucuacaaggaggucgacuccuggaucuccuccgagcucuccuccgcccccgagggccucuccaacggcugguucgucuccaaccucgaguucuacgaccuccaggacucccucuccgacggcacccucaucgccaugggccucuccgucgccgucgccuucuccgucaugcuccucaccaccuggaacaucaucaucucccucuacgccaucaucuccaucgccggcaccaucuucgucaccgucggcucccucguccuccucggcugggagcucaacguccucgaguccgucaccaucuccgucgccgucggccucuccgucgacuucgccguccacuacggcgucgccuaccgccucgcccccgaccccgaccgcgagggcaaggucaucuucucccucucccgcgucggcuccgccauggccauggccgcccucaccaccuucgucgccggcgccaugaugaugcccuccaccguccucgccuacacccagcucggcaccuucaugaugcucaucaugugcaucuccugggccuucgccaccuucuucuuccagugcaugugccgcugccucggcccccagggcaccugcggccagaucccccuccccaagaagcuccagugcuccgccuucucccacgcccucuccaccucccccuccgacaagggccaguccaagacccacaccaucaacgccuaccaccucgacccccgcggccccaaguccgagcucgagcacgaguucuacgagcucgagccccucgccucccacuccugcaccgcccccgagaagaccaccuacgaggagacccacaucugcuccgaguucuucaacucccaggccaagaaccucggcaugcccguccacgccgccuacaacuccgagcucuccaaguccaccgaguccgacgccggcuccgcccuccuccagcccccccucgagcagcacaccgucugccacuucuucucccucaaccagcgcugcuccugccccgacgccuacaagcaccucaacuacggcccccacuccugccagcagaugggcgacugccucugccaccagugcucccccaccaccuccuccuucguccagauccagaacggcgucgccccccucaaggccacccaccaggccgucgagggcuucguccaccccaucacccacauccaccacugccccugccuccagggccgcgucaagcccgccggcaugcagaacucccucccccgcaacuucuuccuccaccccguccagcacauccaggcccaggagaagaucggcaagaccaacguccacucccuccagcgcuccaucgaggagcaccuccccaagauggccgagcccuccuccuucgucugccgcuccaccggcucccuccucaagaccugcugcgaccccgagaacaagcagcgcgagcucugcaagaaccgcgacgucuccaaccucgaguccuccggcggcaccgagaacaaggccggcggcaaggucgagcucucccucucccagaccgacgccuccgucaacuccgagcacuucaaccagaacgagcccaagguccucuucaaccaccucaugggcgaggccggcugccgcuccugccccaacaacucccaguccugcggccgcaucguccgcgucaagugcaacuccgucgacugccagaugcccaacauggaggccaacguccccgccguccucacccacuccgagcucuccggcgagucccuccucaucaagacccucuga

SEQ ID NO: 42256 - RNA, 2052 nt, Artificial Sequence
  derived and/or modified sequence opt2 from DIXDC1__Homo_sapiens__NP_001033043
augcucgccugccucacccgcggcaaccuccucgacguccuccaggagggcuucaacgagcagcagcuccaggccuacgucgccugggucaacgcccagcucaagaagcgccccgccgucaagcccguccaggaccuccgccaggaccuccgcgacggcgucauccucgccuaccucaucgagaucgucgccggcgagaagcucuccggcguccagcucucccccggcaaccagcaggagaugaagaacaacgucgagaagguccuccaguucgucgccuccaagaagauccgcaugcaccagaccuccgccaaggacaucgucgacggcaaccucaaguccaucaugcgccucguccucgcccucgccgcccacuucaagcccggcuccucccgcaccgucaaccagggccgcgacucccgcgccccccuccagucccaccgcccccacugcgccaccgccgucgcccagggcgccgccgccgcccucgccgacgucugccacgacaugucccgcuccggccgcgacgucuuccgcuaccgccagcgcaacuccuccauggacgaggagaucgagaaccccuacugguccguccgcgcccucguccagcaguacgagggccagcagcgcucccccuccgaguccuccugcuccucccucaccucccccucccccauccacuccgccaaguccgaguccaucaucacccaguccgaggagaaggccgacuucgucaucauccccgccgagggcaucgagaaccgcaccgagggcaccgacuccccccucucccgcgacuggcgccccggcucccccggcaccuaccucgagaccuccugggaggagcagcuccucgagcagcaggaguaccucgagaaggagauggaggaggccaagaagaugaucuccggccuccaggcccuccuccucaacggcucccuccccgaggacgagcaggagcgcccccucgcccucugcgagcccggcgucaaccccgaggagcagcucaucaucauccagucccgccucgaccaguccauggaggagaaccaggaccucaagaaggagcuccucaagugcaagcaggaggcccgcaaccuccagggcaucaaggacgcccuccagcagcgccucacccagcaggacaccuccguccuccagcucaagcaggagcuccuccgcgccaacauggacaaggacgagcuccacaaccagaacgucgaccuccagcgcaagcucgacgagcgcaaccgccuccucggcgaguacaagaaggagcucggccagaaggaccgccuccuccagcagcaccaggccaagcucgaggaggcccuccgcaagcucuccgacgucuccuaccaccaggucgaccucgagcgcgagcucgagcacaaggacguccuccucgcccacugcaugaagcgcgaggccgacgaggccaccaacuacaacucccacaacucccaguccaacggcuuccuccuccccaccgccggcaagggcgccaccuccgucuccaaccgcggcaccuccgaccuccagcucguccgcgacgcccuccgcucccuccgcaacuccuucuccggccacgacccccagcaccacaccaucgacucccucgagcagggcaucuccucccucauggagcgccuccacgucauggagacccagaagaagcaggagcgcaagguccgcgucaaguccccccgcacccaggucggcuccgaguaccgcgaguccuggccccccaacuccaagcucccccacucccaguccucccccaccgucuccuccaccugcaccaagguccucuacuucaccgaccgcucccucacccccuucauggucaacauccccaagcgccucgaggaggucacccucaaggacuucaaggccgccaucgaccgcgagggcaaccaccgcuaccacuucaaggcccucgaccccgaguucggcaccgucaaggaggagaucuuccacgacgacgacgccauccccggcugggagggcaagaucgucgccugggucgaggaggaccacggcgagaacuga

SEQ ID NO: 42257 - RNA, 1545 nt, Artificial Sequence
  derived and/or modified sequence opt2 from DKC1__Homo_sapiens__NP_001354
auggccgacgccgaggucaucauccuccccaagaagcacaagaagaagaaggagcgcaagucccuccccgaggaggacgucgccgagauccagcacgccgaggaguuccucaucaagcccgaguccaaggucgccaagcucgacaccucccaguggccccuccuccucaagaacuucgacaagcucaacguccgcaccacccacuacaccccccucgccugcggcuccaacccccucaagcgcgagaucggcgacuacauccgcaccggcuucaucaaccucgacaagcccuccaaccccuccucccacgaggucgucgccuggauccgccgcauccuccgcgucgagaagaccggccacuccggcacccucgaccccaaggucaccggcugccucaucgucugcaucgagcgcgccacccgccucgucaagucccagcaguccgccggcaaggaguacgucggcaucguccgccuccacaacgccaucgagggcggcacccagcucucccgcgcccucgagacccucaccggcgcccucuuccagcgccccccccucaucgccgccgucaagcgccagcuccgcguccgcaccaucuacgaguccaagaugaucgaguacgaccccgagcgccgccucggcaucuucugggucuccugcgaggccggcaccuacauccgcacccucugcguccaccucggccuccuccucggcgucggcggccagaugcaggagcuccgccgcguccgcuccggcgucauguccgagaaggaccacauggucaccaugcacgacguccucgacgcccaguggcucuacgacaaccacaaggacgaguccuaccuccgccgcgucgucuacccccucgagaagcuccucaccucccacaagcgccucgucaugaaggacuccgccgucaacgccaucugcuacggcgccaagaucaugcuccccggcguccuccgcuacgaggacggcaucgaggucaaccaggagaucgucgucaucaccaccaagggcgaggccaucugcauggccaucgcccucaugaccaccgccgucaucuccaccugcgaccacggcaucgucgccaagaucaagcgcgucaucauggagcgcgacaccuacccccgcaaguggggccucggccccaaggccucccagaagaagcucaugaucaagcagggccuccucgacaagcacggcaagcccaccgacuccacccccgccaccuggaagcaggaguacgucgacuacuccgaguccgccaagaaggaggucgucgccgaggucgucaaggccccccaggucgucgccgaggccgccaagaccgccaagcgcaagcgcgaguccgaguccgaguccgacgagaccccccccgccgccccccagcucaucaagaaggagaagaagaaguccaagaaggacaagaaggccaaggccggccucgaguccggcgccgagcccggcgacggcgacuccgacaccaccaagaagaagaagaagaagaagaaggccaaggaggucgagcucgucuccgaguga

SEQ ID NO: 42258 - RNA, 801 nt, Artificial Sequence
  derived and/or modified sequence opt2 from DKK1__Homo_sapiens__NP_036374
augauggcccucggcgccgccggcgccacccgcgucuucgucgccauggucgccgccgcccucggcggccacccccuccucggcgucuccgccacccucaacuccguccucaacuccaacgccaucaagaaccucccccccccccucggcggcgccgccggccaccccggcuccgccgucuccgccgcccccggcauccucuaccccggcggcaacaaguaccagaccaucgacaacuaccagcccuaccccugcgccgaggacgaggagugcggcaccgacgaguacugcgccucccccacccgcggcggcgacgccggcguccagaucugccucgccugccgcaagcgccgcaagcgcugcaugcgccacgccaugugcugccccggcaacuacugcaagaacggcaucugcgucuccuccgaccagaaccacuuccgcggcgagaucgaggagaccaucaccgaguccuucggcaacgaccacuccacccucgacggcuacucccgccgcaccacccucuccuccaagauguaccacaccaagggccaggagggcuccgucugccuccgcuccuccgacugcgccuccggccucugcugcgcccgccacuucugguccaagaucugcaagcccguccucaaggagggccaggucugcaccaagcaccgccgcaagggcucccacggccucgagaucuuccagcgcugcuacugcggcgagggccucuccugccgcauccagaaggaccaccaccaggccuccaacuccucccgccuccacaccugccagcgccacuga

SEQ ID NO: 42259 - RNA, 780 nt, Artificial Sequence
  derived and/or modified sequence opt2 from DKK2__Homo_sapiens__NP_055236
auggccgcccucaugcgcuccaaggacuccuccugcugccuccuccuccucgccgccguccucauggucgaguccucccagaucggcuccucccgcgccaagcucaacuccaucaaguccucccucggcggcgagacccccggccaggccgccaaccgcuccgccggcauguaccagggccucgccuucggcggcuccaagaagggcaagaaccucggccaggccuaccccugcuccuccgacaaggagugcgaggucggccgcuacugccacuccccccaccagggcuccuccgccugcauggucugccgccgcaagaagaagcgcugccaccgcgacggcaugugcugccccuccacccgcugcaacaacggcaucugcauccccgucaccgaguccauccucaccccccacauccccgcccucgacggcacccgccaccgcgaccgcaaccacggccacuacuccaaccacgaccucggcuggcagaaccucggccgcccccacaccaagaugucccacaucaagggccacgagggcgaccccugccuccgcuccuccgacugcaucgagggcuucugcugcgcccgccacuucuggaccaagaucugcaagcccguccuccaccagggcgaggucugcaccaagcagcgcaagaagggcucccacggccucgagaucuuccagcgcugcgacugcgccaagggccucuccugcaaggucuggaaggacgccaccuacuccuccaaggcccgccuccacgucugccagaagaucuga

SEQ ID NO: 42260 - RNA, 1053 nt, Artificial Sequence
  derived and/or modified sequence opt2 from DKK3__Homo_sapiens__XP_006718241
augcagcgccucggcgccacccuccucugccuccuccucgccgccgccguccccaccgcccccgcccccgcccccaccgccaccuccgcccccgucaagcccggccccgcccucuccuacccccaggaggaggccacccucaacgagauguuccgcgaggucgaggagcucauggaggacacccagcacaagcuccgcuccgccgucgaggagauggaggccgaggaggccgccgccaaggccuccuccgaggucaaccucgccaaccucccccccuccuaccacaacgagaccaacaccgacaccaaggucggcaacaacaccauccacguccaccgcgagauccacaagaucaccaacaaccagaccggccagauggucuucuccgagaccgucaucaccuccgucggcgacgaggagggccgccgcucccacgagugcaucaucgacgaggacugcggccccuccauguacugccaguucgccuccuuccaguacaccugccagcccugccgcggccagcgcaugcucugcacccgcgacuccgagugcugcggcgaccagcucugcgucuggggccacugcaccaagauggccacccgcggcuccaacggcaccaucugcgacaaccagcgcgacugccagcccggccucugcugcgccuuccagcgcggccuccucuuccccgucugcaccccccuccccgucgagggcgagcucugccacgaccccgccucccgccuccucgaccucaucaccugggagcucgagcccgacggcgcccucgaccgcugccccugcgccuccggccuccucugccagccccacucccacucccucgucuacgucugcaagcccaccuucgucggcucccgcgaccaggacggcgagauccuccucccccgcgagguccccgacgaguacgaggucggcuccuucauggaggagguccgccaggagcucgaggaccucgagcgcucccucaccgaggagauggcccuccgcgagcccgccgccgccgccgccgcccuccucggcggcgaggagaucuga

SEQ ID NO: 42261 - RNA, 675 nt, Artificial Sequence
  derived and/or modified sequence opt2 from DKK4__Homo_sapiens__XP_011542791
auggucgccgccguccuccucggccucuccuggcucugcuccccccucggcgcccucguccucgacuucaacaacauccgcuccuccgccgaccuccacggcgcccgcaagggcucccagugccucuccgacaccgacugcaacacccgcaaguucugccuccagccccgcgacgagaagcccuucugcgccaccugccgcggccuccgccgccgcugccagcgcgacgccaugugcugccccggcacccucugcgucaacgacgucugcaccaccauggaggacgccacccccauccucgagcgccagcucgacgagcaggacggcacccacgccgagggcaccaccggccaccccguccaggagaaccagcccaagcgcaagcccuccaucaagaagucccagggccgcaagggccaggagggcgaguccugccuccgcaccuucgacugcggccccggccucugcugcgcccgccacuucuggaccaagaucugcaagcccguccuccucgagggccaggucugcucccgccgcggccacaaggacaccgcccaggcccccgagaucuuccagcgcugcgacugcggccccggccuccucugccgcucccagcucaccuccaaccgccagcacgcccgccuccgcgucugccagaagaucgagaagcucuga

SEQ ID NO: 42262 - RNA, 636 nt, Artificial Sequence
  derived and/or modified sequence opt2 from DKKL1__Homo_sapiens__NP_001184230
augggcgaggccuccccccccgcccccgcccgccgccaccuccucguccuccuccuccuccucuccacccucgucauccccuccgccgccgcccccauccacgacgccgacgcccaggaguccucccucggccucaccggccuccagucccuccuccagggcuucucccgccucuuccucaagggcaaccuccuccgcggcaucgacucccucuucuccgcccccauggacuuccgcggccuccccggcaacuaccacaaggaggagaaccaggagcaccagcucggcaacaacacccucuccucccaccuccagaucgacaaggucccccgcauggaggagaaggaggcccucguccccauccagaaggccaccgacuccuuccacaccgagcuccacccccgcgucgccuucuggaucaucaagcucccccgccgccgcucccaccaggacgcccucgagggcggccacuggcucuccgagaagcgccaccgccuccaggccauccgcgacggccuccgcaagggcacccacaaggacguccucgaggagggcaccgaguccuccucccacucccgccucuccccccgcaagacccaccuccucuacauccuccgccccucccgccagcucuga

SEQ ID NO: 42263 - RNA, 1944 nt, Artificial Sequence
  derived and/or modified sequence opt2 from DLAT__Homo_sapiens__NP_001922
auguggcgcgucugcgcccgccgcgcccagaacgucgcccccugggccggccucgaggcccgcuggaccgcccuccaggagguccccggcaccccccgcgucaccucccgcuccggccccgcccccgcccgccgcaacuccgucaccaccggcuacggcggcguccgcgcccucugcggcuggacccccuccuccggcgccaccccccgcaaccgccuccuccuccagcuccucggcucccccggccgccgcuacuacucccuccccccccaccagaaggucccccuccccucccucucccccaccaugcaggccggcaccaucgcccgcugggagaagaaggagggcgacaagaucaacgagggcgaccucaucgccgaggucgagaccgacaaggccaccgucggcuucgagucccucgaggagugcuacauggccaagauccucgucgccgagggcacccgcgacguccccaucggcgccaucaucugcaucaccgucggcaagcccgaggacaucgaggccuucaagaacuacacccucgacuccuccgccgcccccaccccccaggccgcccccgcccccacccccgccgccaccgccuccccccccacccccuccgcccaggcccccggcuccuccuaccccccccacaugcagguccuccuccccgcccucucccccaccaugaccaugggcaccguccagcgcugggagaagaaggucggcgagaagcucuccgagggcgaccuccucgccgagaucgagaccgacaaggccaccaucggcuucgagguccaggaggagggcuaccucgccaagauccucguccccgagggcacccgcgacgucccccucggcaccccccucugcaucaucgucgagaaggaggccgacaucuccgccuucgccgacuaccgccccaccgaggucaccgaccucaagccccagguccccccccccacccccccccccgucgccgccgucccccccaccccccagccccucgcccccacccccuccgcccccugccccgccacccccgccggccccaagggccgcgucuucgucuccccccucgccaagaagcucgccgucgagaagggcaucgaccucacccaggucaagggcaccggccccgacggccgcaucaccaagaaggacaucgacuccuucguccccuccaaggucgcccccgcccccgccgccgucgucccccccaccggccccggcauggcccccguccccaccggcgucuucaccgacauccccaucuccaacauccgccgcgucaucgcccagcgccucaugcaguccaagcagaccaucccccacuacuaccucuccaucgacgucaacaugggcgagguccuccucguccgcaaggagcucaacaagauccucgagggccgcuccaagaucuccgucaacgacuucaucaucaaggccuccgcccucgccugccucaagguccccgaggccaacuccuccuggauggacaccgucauccgccagaaccacgucgucgacgucuccgucgccgucuccacccccgccggccucaucacccccaucgucuucaacgcccacaucaagggcgucgagaccaucgccaacgacgucgucucccucgccaccaaggcccgcgagggcaagcuccagccccacgaguuccagggcggcaccuucaccaucuccaaccucggcauguucggcaucaagaacuucuccgccaucaucaaccccccccaggccugcauccucgccaucggcgccuccgaggacaagcucguccccgccgacaacgagaagggcuucgacgucgccuccaugauguccgucacccucuccugcgaccaccgcgucgucgacggcgccgucggcgcccaguggcucgccgaguuccgcaaguaccucgagaagcccaucaccaugcuccucuga

SEQ ID NO: 42264 - RNA, 3276 nt, Artificial Sequence
  derived and/or modified sequence opt2 from DLC1__Homo_sapiens__NP_006085
augugccgcaagaagcccgacaccaugauccucacccagaucgaggccaaggaggccugcgacuggcuccgcgccaccggcuucccccaguacgcccagcucuacgaggacuuccucuuccccaucgacaucucccucgucaagcgcgagcacgacuuccucgaccgcgacgccaucgaggcccucugccgccgccucaacacccucaacaagugcgccgucaugaagcucgagaucuccccccaccgcaagcgcuccgacgacuccgacgaggacgagcccugcgccaucuccggcaaguggaccuuccagcgcgacuccaagcgcuggucccgccucgaggaguucgacgucuucucccccaagcaggaccucguccccggcucccccgacgacucccaccccaaggacggccccucccccggcggcacccucauggaccucuccgagcgccaggaggucuccuccguccgcucccucuccuccaccggcucccuccccucccacgccccccccuccgaggacgccgccaccccccgcaccaacuccgucaucuccgucugcuccuccuccaaccucgccggcaacgacgacuccuucggcucccuccccucccccaaggagcucuccuccuucuccuucuccaugaagggccacgagaagaccgccaaguccaagacccgcucccuccucaagcgcauggagucccucaagcucaaguccucccaccacuccaagcacaaggcccccuccaagcucggccucaucaucuccggccccauccuccaggagggcauggacgaggagaagcucaagcagcucaacugcgucgagaucuccgcccucaacggcaaccgcaucaacguccccaugguccgcaagcgcuccgucuccaacuccacccagaccuccuccuccuccucccaguccgagaccuccuccgccgucuccacccccucccccgucacccgcacccgcucccucuccgccugcaacaagcgcgucggcauguaccucgagggcuucgaccccuucaaccaguccaccuucaacaacgucgucgagcagaacuucaagaaccgcgaguccuaccccgaggacaccgucuucuacauccccgaggaccacaagcccggcaccuuccccaaggcccucaccaacggcuccuucucccccuccggcaacaacggcuccgucaacuggcgcaccggcuccuuccacggccccggccacaucucccuccgccgcgagaacuccuccgacucccccaaggagcucaagcgccgcaacuccuccuccuccauguccucccgccucuccaucuacgacaacguccccggcuccauccucuacuccuccuccggcgaccucgccgaccucgagaacgaggacaucuuccccgagcucgacgacauccucuaccacgucaagggcaugcagcgcaucgucaaccagugguccgagaaguucuccgacgagggcgacuccgacuccgcccucgacuccgucucccccugccccuccucccccaagcagauccaccucgacgucgacaacgaccgcaccacccccuccgaccucgacuccaccggcaacucccucaacgagcccgaggagcccuccgagauccccgagcgccgcgacuccggcgucggcgccucccucacccgcuccaaccgccaccgccuccgcuggcacuccuuccaguccucccaccgccccucccucaacuccgucucccuccagaucaacugccaguccgucgcccagaugaaccuccuccagaaguacucccuccucaagcucaccgcccuccucgagaaguacacccccuccaacaagcacggcuucuccugggccguccccaaguucaugaagcgcaucaagguccccgacuacaaggaccgcuccgucuucggcgucccccucaccgucaacguccagcgcaccggccagccccucccccaguccauccagcaggccaugcgcuaccuccgcaaccacugccucgaccaggucggccucuuccgcaaguccggcgucaagucccgcauccaggcccuccgccagaugaacgagggcgccaucgacugcgucaacuacgagggccaguccgccuacgacgucgccgacaugcucaagcaguacuuccgcgaccuccccgagccccucaugaccaacaagcucuccgagaccuuccuccagaucuaccaguacguccccaaggaccagcgccuccaggccaucaaggccgccaucaugcuccuccccgacgagaaccgcgagguccuccagacccuccucuacuuccucuccgacgucaccgccgccgucaaggagaaccagaugacccccaccaaccucgccgucugccucgcccccucccucuuccaccucaacacccucaagcgcgagaacuccuccccccgcgucaugcagcgcaagcagucccucggcaagcccgaccagaaggaccucaacgagaaccucgccgccacccagggccucgcccacaugaucgccgagugcaagaagcucuuccagguccccgaggagaugucccgcugccgcaacuccuacaccgagcaggagcucaagccccucacccucgaggcccucggccaccucggcaacgacgacuccgccgacuaccagcacuuccuccaggacugcgucgacggccucuucaaggaggucaaggagaaguucaagggcugggucuccuacuccaccuccgagcaggccgagcucuccuacaagaaggucuccgagggccccccccuccgccucuggcgcuccgucaucgagguccccgccguccccgaggagauccucaagcgccuccucaaggagcagcaccucugggacgucgaccuccucgacuccaaggucaucgagauccucgacucccagaccgagaucuaccaguacguccagaacuccauggccccccaccccgcccgcgacuacgucguccuccgcaccuggcgcaccaaccuccccaagggcgccugcgcccuccuccucaccuccgucgaccacgaccgcgcccccgucgucggcguccgcgucaacguccuccucucccgcuaccucaucgagcccugcggccccggcaaguccaagcucaccuacaugugccgcgucgaccuccgcggccacaugcccgagugguacaccaaguccuucggccaccucugcgccgccgaggucgucaagauccgcgacuccuucuccaaccagaacaccgagaccaaggacaccaagucccgcuga

SEQ ID NO: 42265 - RNA, 1530 nt, Artificial Sequence
  derived and/or modified sequence opt2 from DLD__Homo_sapiens__NP_000099
augcaguccuggucccgcgucuacugcucccucgccaagcgcggccacuucaaccgcaucucccacggccuccagggccucuccgccgucccccuccgcaccuacgccgaccagcccaucgacgccgacgucaccgucaucggcuccggccccggcggcuacgucgccgccaucaaggccgcccagcucggcuucaagaccgucugcaucgagaagaacgagacccucggcggcaccugccucaacgucggcugcauccccuccaaggcccuccucaacaacucccacuacuaccacauggcccacggcaaggacuucgccucccgcggcaucgagauguccgagguccgccucaaccucgacaagaugauggagcagaaguccaccgccgucaaggcccucaccggcggcaucgcccaccucuucaagcagaacaaggucguccacgucaacggcuacggcaagaucaccggcaagaaccaggucaccgccaccaaggccgacggcggcacccaggucaucgacaccaagaacauccucaucgccaccggcuccgaggucacccccuuccccggcaucaccaucgacgaggacaccaucgucuccuccaccggcgcccucucccucaagaagguccccgagaagauggucgucaucggcgccggcgucaucggcgucgagcucggcuccgucuggcagcgccucggcgccgacgucaccgccgucgaguuccucggccacgucggcggcgucggcaucgacauggagaucuccaagaacuuccagcgcauccuccagaagcagggcuucaaguucaagcucaacaccaaggucaccggcgccaccaagaaguccgacggcaagaucgacgucuccaucgaggccgccuccggcggcaaggccgaggucaucaccugcgacguccuccucgucugcaucggccgccgccccuucaccaagaaccucggccucgaggagcucggcaucgagcucgacccccgcggccgcauccccgucaacacccgcuuccagaccaagauccccaacaucuacgccaucggcgacgucgucgccggccccaugcucgcccacaaggccgaggacgagggcaucaucugcgucgagggcauggccggcggcgccguccacaucgacuacaacugcguccccuccgucaucuacacccaccccgaggucgccugggucggcaaguccgaggagcagcucaaggaggagggcaucgaguacaaggucggcaaguuccccuucgccgccaacucccgcgccaagaccaacgccgacaccgacggcauggucaagauccucggccagaaguccaccgaccgcguccucggcgcccacauccucggccccggcgccggcgagauggucaacgaggccgcccucgcccucgaguacggcgccuccugcgaggacaucgcccgcgucugccacgcccaccccacccucuccgaggccuuccgcgaggccaaccucgccgccuccuucggcaaguccaucaacuucuga

SEQ ID NO: 42266 - RNA, 5268 nt, Artificial Sequence
  derived and/or modified sequence opt2 from DLEC1__Homo_sapiens__NP_031361
auggagacccgcuccuccaagacccgccgcucccucgccucccgcaccaacgagugccagggcaccaugugggcccccaccuccccccccgccggcuccuccucccccucccagcccaccuggaaguccucccucuacuccucccucgccuacuccgaggccuuccacuacuccuucgccgcccgcccccgccgccucacccagcucgcccucgcccagcgccccgagccccagcuccuccgccuccgccccuccucccuccgcacccaggacaucucccaccuccucaccggcgucuuccgcaaccucuacuccgccgaggucaucggcgacgaggucuccgccucccucaucaaggcccgcggcuccgagaacgagcgccacgaggaguucgucgaccagcuccagcagauccgcgagcucuacaagcagcgccucgacgaguucgagaugcucgagcgccacaucacccaggcccaggcccgcgccaucgccgagaacgagcgcgucaugucccaggccggcguccaggaccucgagucccucguccgccucccccccgucaaguccgucucccgcuggugcaucgacuccgagcuccuccgcaagcaccaccucaucucccccgaggacuacuacaccgacaccguccccuuccacuccgcccccaagggcaucucccuccccggcugcuccaagcucaccuucuccugcgagaagcgcuccguccagaagaaggagcucaacaagaagcucgaggacuccugccgcaagaagcucgccgaguucgaggacgagcucgaccacaccgucgacucccucaccuggaaccucacccccaaggccaaggagcgcacccgcgagccccucaagaaggccucccagccccgcaacaagaacuggaugaaccaccuccgcgucccccagcgcgagcucgaccgccuccuccucgcccgcauggagucccgcaaccacuuccucaagaacccccgcuucuucccccccaacacccgcuacggcggcaagucccucgucuucccccccaagaagcccgcccccaucggcgaguuccaguccaccgagcccgagcaguccugcgccgacacccccgucuuccucgccaagccccccaucggcuucuucaccgacuacgagaucggccccgucuacgagauggucaucgcccuccagaacaccaccaccaccucccgcuaccuccgcguccucccccccuccacccccuacuucgcccucggccucggcauguuccccggcaagggcggcauggucgcccccggcaugaccugccaguacaucguccaguucuuccccgacugccucggcgacuucgacgacuucauccucgucgagacccaguccgcccacacccuccucaucccccuccaggcccgccgccccccccccguccucacccucucccccguccucgacugcggcuacugccucaucggcggcgucaagaugacccgcuucaucugcaagaacgucggcuucuccgucggccgcuucugcaucaugcccaagaccuccuggcccccccucuccuucaaggccaucgccaccgucggcuucgucgagcagccccccuucggcauccuccccuccgucuucgagcucgcccccggccacgccauccucgucgagguccucuucucccccaagucccucggcaaggccgagcagaccuucaucaucaugugcgacaacugccagaucaaggagcucgucaccaucggcaucggccagcucaucgcccucgaccucaucuacaucuccggcgagaagucccagcccgaccccggcgagcucaccgaccucaccgcccagcacuucauccgcuucgagcccgagaaccuccgcuccaccgcccgcaagcagcucaucauccgcaacgccacccacgucgagcucgccuucuacuggcagaucaugaagcccaaccuccagccccucaugcccggcgagaccuucuccauggacuccaucaagugcuaccccgacaaggagaccgccuucuccaucaugccccgcaagggcguccucuccccccacaccgaccacgaguucauccucuccuucuccccccacgagcuccgcgacuuccacuccguccuccagaugguccucgaggagguccccgagcccgucuccuccgaggccgagucccucggccacuccuccuacuccgucgacgacgucaucguccucgagaucgaggucaagggcuccgucgagcccuuccagguccuccucgagcccuacgcccucaucauccccggcgagaacuacaucggcaucaacgucaagaaggccuucaagauguggaacaacuccaagucccccauccgcuaccucuggggcaagaucuccgacugccacaucaucgaggucgagcccggcaccggcgucaucgagcccuccgaggucggcgacuucgagcucaacuucaccggcggcguccccggccccaccucccaggaccuccucugcgagaucgaggacucccccucccccgucguccuccacaucgaggccgucuucaagggccccgcccucaucaucaacgucuccgcccuccaguucggccuccuccgccucggccagaaggccaccaacuccauccagauccgcaacgucucccagcuccccgccaccuggcgcaugaaggagucccccgucucccuccaggagcgccccgaggacgucucccccuucgacaucgagcccuccuccggccagcuccacucccucggcgagugccgcgucgacaucacccucgaggcccuccacugccagcaccucgagaccguccucgagcucgaggucgagaacggcgccugguccuaccuccccgucuacgccgagguccagaagccccacgucuaccuccaguccucccaggucgagguccgcaaccucuaccucggcguccccaccaagaccaccaucacccucaucaacggcacccuccuccccacccaguuccacuggggcaagcuccucggccaccaggccgaguucugcauggucaccgucucccccaagcacggccuccucggccccuccgaggagugccagcucaagcucgagcucaccgcccacacccaggaggagcucacccaccucgcccuccccugccacgucuccggcaugaagaagccccucguccucggcaucuccggcaagccccagggccuccaggucgccaucaccaucuccaaggaguccuccgacugcuccaccgagcaguggcccggccaccccaaggagcuccgccucgacuucggcuccgccgucccccuccgcacccgcgucacccgccagcucauccucaccaaccgcucccccauccgcacccgcuucucccucaaguucgaguacuucggcuccccccagaacucccucuccaagaagaccucccuccccaacaugccccccgcccuccucaagaccguccgcaugcaggagcaccucgccaagcgcgagcagcucgacuucauggaguccaugcucucccacggcaagggcgccgccuucuucccccacuucucccagggcaugcucggccccuaccagcagcucugcaucgacaucaccggcugcgccaacauguggggcgaguacugggacaaccucaucugcaccgucggcgaccuccuccccgaggucauccccguccacauggccgccgucggcugccccaucuccucccuccgcaccaccuccuacaccaucgaccaggcccagaaggagcccgccaugcgcuucggcacccaggucuccggcggcgacaccgucacccgcacccuccgccucaacaacuccucccccugcgacauccgccucgacugggagaccuacguccccgaggacaaggaggaccgccucgucgagcuccucgucuucuacggcccccccuucccccuccgcgaccaggccggcaacgagcucgucugccccgacacccccgagggcggcugccuccucuggucccccggccccuccuccuccuccgaguucucccacgagaccgacuccuccgucgagggcuccuccuccgccuccaaccgcgucgcccagaagcucaucuccgucauccuccaggcccacgagggcguccccuccggccaccucuacugcaucucccccaagcaggucgucguccccgccggcggcuccuccaccaucuacaucuccuucacccccaugguccucucccccgagauccuccacaaggucgagugcaccggcuacgcccucggcuucaugucccucgacuccaaggucgagcgcgagauccccggcaagcgccaccgccuccaggacuucgccgucggcccccucaagcucgaccuccacuccuacguccgccccgcccagcucuccgucgagcucgacuacggcggcuccauggaguuccagugccaggccuccgaccucauccccgagcagcccugcuccggcguccucuccgagcucgucaccacccaccaccucaagcucaccaacaccaccgagaucccccacuacuuccgccucauggucucccgccccuucuccgucucccaggacggcgccucccaggaccaccgcgcccccggccccggccagaagcaggagugcgaggaggagaccgccuccgccgacaagcagcucguccuccaggcccaggagaacaugcucgucaacgucuccuucucccucucccucgagcuccucuccuaccagaagcuccccgccgaccagacccuccccggcgucgacauccagcaguccgccuccggcgagcgcgagauggucuucacccagaaccuccuccucgaguacaccaaccagaccacccaggucgucccccuccgcgccgucgucgccguccccgagcuccagcucuccaccuccugggucgacuucggcaccugcuucgucucccagcagcgcguccgcgaggucuaccucaugaaccucuccggcugccgcuccuacuggaccaugcucaugggccagcaggagcccgccaaggccgccgucgccuuccgcgucucccccaacuccggccuccucgaggcccgcuccgccaacgccccccccaccuccaucgcccuccaggucuucuucaccgcccgcuccuccgagcucuacgaguccaccauggucgucgagggcguccucggcgagaaguccugcacccuccgccuccgcggccagggcuccuacgacgagcgcuacaugcucccccaccagcccuga

SEQ ID NO: 42267 - RNA, 483 nt, Artificial Sequence
  derived and/or modified sequence opt2 from DLEU7__Homo_sapiens__NP_945340
auggccucccccgccccccucgucgccuccaucucccaccagauggucgcccuccagacccuccagcuccuccagcaggaguggggcuggggcgacggccccgucgcccccggcaacccccgcgaccccgaccacgucuccaccgcccccgcccgccgcuccggccccccccgcgcccgccccggccccggccgcgaggagcgcggcggcggcgucggcacccgcucccgccgcaccgccgcccgcgccaacucccccgaggaggaggucguccgcggcgccgagggcggcgccgagcuccuccccuucccccgcgaccgcggccccugcacccucgcccagauggccaugcgcuccgcccucgcccgcgucgucgacuccaccuccgagcucgucuccgucgagcagacccuccucggcccccuccagcaggagcgcuccuuccccauccaccucaagcuccagcuccucgccaacgaguga

SEQ ID NO: 42268 - RNA, 2679 nt, Artificial Sequence
  derived and/or modified sequence opt2 from DLG1__Homo_sapiens__NP_001191315
augcccguccgcaagcaggacacccagcgcgcccuccaccuccucgaggaguaccgcuccaagcucucccagaccgaggaccgccagcuccgcuccuccaucgagcgcgucaucaacaucuuccaguccaaccucuuccaggcccucaucgacauccaggaguucuacgaggucacccuccucgacaaccccaagugcaucgaccgcuccaagcccuccgagcccauccagcccgucaacaccugggagaucuccucccuccccuccuccaccgucaccuccgagacccuccccuccucccucucccccuccgucgagaaguaccgcuaccaggacgaggacacccccccccaggagcacaucuccccccagaucaccaacgaggucaucggccccgagcucguccacgucuccgagaagaaccucuccgagaucgagaacguccacggcuucgucucccacucccacaucucccccaucaaggccaaccccccccccguccucgucaacaccgacucccucgagacccccaccuacgucaacggcaccgacgccgacuacgaguacgaggagaucacccucgagcgcggcaacuccggccucggcuucuccaucgccggcggcaccgacaacccccacaucggcgacgacuccuccaucuucaucaccaagaucaucaccggcggcgccgccgcccaggacggccgccuccgcgucaacgacugcauccuccgcgucaacgaggucgacguccgcgacgucacccacuccaaggccgucgaggcccucaaggaggccggcuccaucguccgccucuacgucaagcgccgcaagcccgucuccgagaagaucauggagaucaagcucaucaagggccccaagggccucggcuucuccaucgccggcggcgucggcaaccagcacauccccggcgacaacuccaucuacgucaccaagaucaucgagggcggcgccgcccacaaggacggcaagcuccagaucggcgacaagcuccucgccgucaacaacgucugccucgaggaggucacccacgaggaggccgucaccgcccucaagaacaccuccgacuucgucuaccucaaggucgccaagcccaccuccauguacaugaacgacggcuacgccccccccgacaucaccaacuccuccucccagcccgucgacaaccacgucucccccuccuccuuccucggccagacccccgccucccccgcccgcuacucccccgucuccaaggccguccucggcgacgacgagaucacccgcgagccccgcaaggucguccuccaccgcggcuccaccggccucggcuucaacaucgucggcggcgaggacggcgagggcaucuucaucuccuucauccucgccggcggccccgccgaccucuccggcgagcuccgcaagggcgaccgcaucaucuccgucaacuccgucgaccuccgcgccgccucccacgagcaggccgccgccgcccucaagaacgccggccaggccgucaccaucgucgcccaguaccgccccgaggaguacucccgcuucgaggccaagauccacgaccuccgcgagcagaugaugaacuccuccaucuccuccggcuccggcucccuccgcaccucccagaagcgcucccucuacguccgcgcccucuucgacuacgacaagaccaaggacuccggccuccccucccagggccucaacuucaaguucggcgacauccuccacgucaucaacgccuccgacgacgagugguggcaggcccgccaggucacccccgacggcgaguccgacgaggucggcgucauccccuccaagcgccgcgucgagaagaaggagcgcgcccgccucaagaccgucaaguucaacuccaagacccgcgacaagggcuccuucaacgacaagcgcaagaagaaccucuucucccgcaaguuccccuucuacaagaacaaggaccaguccgagcaggagaccuccgacgccgaccagcacgucaccuccaacgccuccgacuccgaguccuccuaccgcggccaggaggaguacguccucuccuacgagcccgucaaccagcaggaggucaacuacacccgccccgucaucauccucggccccaugaaggaccgcaucaacgacgaccucaucuccgaguuccccgacaaguucggcuccugcgucccccacaccacccgccccaagcgcgacuacgaggucgacggccgcgacuaccacuucgucaccucccgcgagcagauggagaaggacauccaggagcacaaguucaucgaggccggccaguacaacaaccaccucuacggcaccuccguccaguccguccgcgaggucgccgagaagggcaagcacugcauccucgacgucuccggcaacgccaucaagcgccuccagaucgcccagcucuaccccaucuccaucuucaucaagcccaaguccauggagaacaucauggagaugaacaagcgccucaccgaggagcaggcccgcaagaccuucgagcgcgccaugaagcucgagcaggaguucaccgagcacuucaccgccaucguccagggcgacacccucgaggacaucuacaaccaggucaagcagaucaucgaggagcaguccggcuccuacaucuggguccccgccaaggagaagcucuga

SEQ ID NO: 42269 - RNA, 2250 nt, Artificial Sequence
  derived and/or modified sequence opt2 from DLG2__Homo_sapiens__NP_001136172
augcagcgccccuccgucucccgcgccgagaacuaccagcuccucugggacaccaucgccucccucaagcagugcgagcaggccaugcagcacgccuucauccccgucaacggcaccgagaucgaguacgaguucgaggagaucacccucgagcgcggcaacuccggccucggcuucuccaucgccggcggcaccgacaacccccacaucggcgacgaccccggcaucuucaucaccaagaucauccccggcggcgccgccgccgaggacggccgccuccgcgucaacgacugcauccuccgcgucaacgaggucgacgucuccgaggucucccacuccaaggccgucgaggcccucaaggaggccggcuccaucguccgccucuacguccgccgccgccgccccauccucgagaccgucgucgagaucaagcucuucaagggccccaagggccucggcuucuccaucgccggcggcgucggcaaccagcacauccccggcgacaacuccaucuacgucaccaagaucaucgacggcggcgccgcccagaaggacggccgccuccaggucggcgaccgccuccucauggucaacaacuacucccucgaggaggucacccacgaggaggccgucgccauccucaagaacaccuccgaggucgucuaccucaaggucggcaagcccaccaccaucuacaugaccgaccccuacggcccccccgacaucacccacuccuacuccccccccauggagaaccaccuccucuccggcaacaacggcacccucgaguacaagaccucccucccccccaucucccccggccgcuacucccccauccccaagcacaugcucgucgacgacgacuacaccucccacucccagcacuccaccgccacccgccagcccuccaugacccuccagcgcgccgucucccucgagggcgagccccgcaaggucguccuccacaagggcuccaccggccucggcuucaacaucgucggcggcgaggacggcgagggcaucuucgucuccuucauccucgccggcggccccgccgaccucuccggcgagcuccagcgcggcgaccagauccucuccgucaacggcaucgaccuccgcggcgccucccacgagcaggccgccgccgcccucaagggcgccggccagaccgucaccaucaucgcccaguaccagcccgaggacuacgcccgcuucgaggccaagauccacgaccuccgcgagcagaugaugaaccacuccauguccuccggcuccggcucccuccgcaccaaccagaagcgcucccucuacguccgcgccauguucgacuacgacaaguccaaggacuccggccuccccucccagggccucuccuucaaguacggcgacauccuccacgucaucaacgccuccgacgacgagugguggcaggcccgccgcgucaugcucgagggcgacuccgaggagaugggcgucauccccuccaagcgccgcgucgagcgcaaggagcgcgcccgccucaagaccgucaaguucaacgccaagcccggcgucaucgacuccaagggcgacauccccggccucggcgacgacggcuacggcaccaagacccuccgcggccaggaggaccucauccucuccuacgagcccgucacccgccaggagaucaacuacacccgccccgucaucauccucggccccaugaaggaccgcaucaacgacgaccucaucuccgaguuccccgacaaguucggcuccugcgucccccacaccacccgccccaagcgcgacuacgaggucgacggccgcgacuaccacuucgucaucucccgcgagcagauggagaaggacauccaggagcacaaguucaucgaggccggccaguacaacgacaaccucuacggcaccuccguccaguccguccgcuucgucgccgagcgcggcaagcacugcauccucgacgucuccggcaacgccaucaagcgccuccaggucgcccagcucuaccccaucgccaucuucaucaagccccgcucccucgagccccucauggagaugaacaagcgccucaccgaggagcaggccaagaagaccuacgaccgcgccaucaagcucgagcaggaguucggcgaguacuucaccgccaucguccagggcgacacccucgaggacaucuacaaccagugcaagcucgucaucgaggagcaguccggccccuucaucuggauccccuccaaggagaagcucuga

SEQ ID NO: 42270 - RNA, 1101 nt, Artificial Sequence
  derived and/or modified sequence opt2 from DLG3__Homo_sapiens__NP_001159750
augaugaacuccuccauguccuccggcuccggcucccuccgcaccuccgagaagcgcucccucuacguccgcgcccucuucgacuacgaccgcacccgcgacuccugccuccccucccagggccucuccuucuccuacggcgacauccuccacgucaucaacgccuccgacgacgagugguggcaggcccgccucgucaccccccacggcgaguccgagcagaucggcgucauccccuccaagaagcgcgucgagaagaaggagcgcgcccgccucaagaccgucaaguuccacgcccgcaccggcaugaucgaguccaaccgcuccaucaagaccaagcgcaagaaguccuuccgccucucccgcaaguuccccuucuacaaguccaaggagaacauggcccaggaguccuccauccaggagcagggcgucaccuccaacaccuccgacuccgaguccuccuccaagggccaggaggacgccauccucuccuacgagcccgucacccgccaggagauccacuacgcccgccccgucaucauccucggccccaugaaggaccgcgucaacgacgaccucaucuccgaguucccccacaaguucggcuccugcgucccccacaccacccgcccccgccgcgacaacgaggucgacggccaggacuaccacuucgucgucucccgcgagcagauggagaaggacauccaggacaacaaguucaucgaggccggccaguucaacgacaaccucuacggcaccuccauccaguccguccgcgccgucgccgagcgcggcaagcacugcauccucgacgucuccggcaacgccaucaagcgccuccagcaggcccagcucuaccccaucgccaucuucaucaagcccaaguccaucgaggcccucauggagaugaaccgccgccagaccuacgagcaggccaacaagaucuacgacaaggccaugaagcucgagcaggaguucggcgaguacuucaccgccaucguccagggcgacucccucgaggagaucuacaacaagaucaagcagaucaucgaggaccaguccggccacuacaucuggguccccucccccgagaagcucuga

SEQ ID NO: 42271 - RNA, 2166 nt, Artificial Sequence
  derived and/or modified sequence opt2 from DLG4__Homo_sapiens__NP_001122299
auggacugccucugcaucgucaccaccaagaaguaccgcuaccaggacgaggacacccccccccucgagcacucccccgcccaccuccccaaccaggccaacuccccccccgucaucgucaacaccgacacccucgaggcccccggcuacgucaacggcaccgagggcgagauggaguacgaggagaucacccucgagcgcggcaacuccggccucggcuucuccaucgccggcggcaccgacaacccccacaucggcgacgaccccuccaucuucaucaccaagaucauccccggcggcgccgccgcccaggacggccgccuccgcgucaacgacuccauccucuucgucaacgaggucgacguccgcgaggucacccacuccgccgccgucgaggcccucaaggaggccggcuccaucguccgccucuacgucaugcgccgcaagccccccgccgagaaggucauggagaucaagcucaucaagggccccaagggccucggcuucuccaucgccggcggcgucggcaaccagcacauccccggcgacaacuccaucuacgucaccaagaucaucgagggcggcgccgcccacaaggacggccgccuccagaucggcgacaagauccucgccgucaacuccgucggccucgaggacgucaugcacgaggacgccgucgccgcccucaagaacaccuacgacgucgucuaccucaaggucgccaagcccuccaacgccuaccucuccgacuccuacgccccccccgacaucaccaccuccuacucccagcaccucgacaacgagaucucccacuccuccuaccucggcaccgacuaccccaccgccaugacccccaccuccccccgccgcuacucccccgucgccaaggaccuccucggcgaggaggacaucccccgcgagccccgccgcaucgucauccaccgcggcuccaccggccucggcuucaacaucgucggcggcgaggacggcgagggcaucuucaucuccuucauccucgccggcggccccgccgaccucuccggcgagcuccgcaagggcgaccagauccucuccgucaacggcgucgaccuccgcaacgccucccacgagcaggccgccaucgcccucaagaacgccggccagaccgucaccaucaucgcccaguacaagcccgaggaguacucccgcuucgaggccaagauccacgaccuccgcgagcagcucaugaacuccucccucggcuccggcaccgccucccuccgcuccaaccccaagcgcggcuucuacauccgcgcccucuucgacuacgacaagaccaaggacugcggcuuccucucccaggcccucuccuuccgcuucggcgacguccuccacgucaucgacgccuccgacgaggagugguggcaggcccgccgcguccacuccgacuccgagaccgacgacaucggcuucauccccuccaagcgccgcgucgagcgccgcgaguggucccgccucaaggccaaggacuggggcuccuccuccggcucccagggccgcgaggacuccguccucuccuacgagaccgucacccagauggagguccacuacgcccgccccaucaucauccucggccccaccaaggaccgcgccaacgacgaccuccucuccgaguuccccgacaaguucggcuccugcgucccccacaccacccgccccaagcgcgaguacgagaucgacggccgcgacuaccacuucgucuccucccgcgagaagauggagaaggacauccaggcccacaaguucaucgaggccggccaguacaacucccaccucuacggcaccuccguccaguccguccgcgaggucgccgagcagggcaagcacugcauccucgacgucuccgccaacgccguccgccgccuccaggccgcccaccuccaccccaucgccaucuucauccgcccccgcucccucgagaacguccucgagaucaacaagcgcaucaccgaggagcaggcccgcaaggccuucgaccgcgccaccaagcucgagcaggaguucaccgagugcuucuccgccaucgucgagggcgacuccuucgaggagaucuaccacaaggucaagcgcgucaucgaggaccucuccggccccuacaucuggguccccgcccgcgagcgccucuga

SEQ ID NO: 42272 - RNA, 5760 nt, Artificial Sequence
  derived and/or modified sequence opt2 from DLG5__Homo_sapiens__NP_004738
auggagccccagcgccgcgagcuccucgcccagugccagcagucccucgcccaggccaugaccgaggucgaggccguccucggccuccucgaggccgccggcgcccucucccccggcgagcgccgccagcucgacgaggaggccggcggcgccaaggccgagcuccuccucaagcuccuccucgccaaggagcgcgaccacuuccaggaccuccgcgccgcccucgagaagacccagccccaccuccuccccauccucuaccucaacggcgucgucggccccccccagcccgccgagggcgccggcuccaccuacuccguccucuccaccaugcccuccgacuccgaguccuccuccucccucuccuccgucggcaccaccggcaaggcccccuccccccccccccuccucaccgaccagcaggucaacgagaaggucgagaaccucuccauccagcuccgccucaugacccgcgagcgcaacgagcuccgcaagcgccucgccuucgccacccacggcaccgccuucgacaagcgccccuaccaccgccucaaccccgacuacgagcgccucaagauccagugcguccgcgccauguccgaccuccagucccuccagaaccagcacaccaacgcccucaagcgcugcgaggaggucgccaaggagaccgacuucuaccacacccuccacucccgccuccucuccgaccagacccgccucaaggacgacgucgacaugcuccgccgcgagaacggccagcuccuccgcgagcgcaaccuccuccagcaguccugggaggacaugaagcgccuccacgaggaggaccagaaggagaucggcgaccuccgcgcccagcagcagcagguccucaagcacaacggcuccuccgagauccucaacaagcucuacgacaccgccauggacaagcucgaggucgucaagaaggacuacgacgcccuccgcaagcgcuacuccgagaaggucgccauccacaacgccgaccucucccgccucgagcagcucggcgaggagaaccagcgccuccucaagcagaccgagaugcucacccagcagcgcgacaccgccauccagcuccagcaccagugcgcccucucccuccgccgcuucgaggccauccaccacgagcucaacaaggccaccgcccagaacaaggaccuccagugggagauggagcuccuccaguccgagcucaccgagcuccgcaccacccaggucaagaccgccaaggaguccgagaaguaccgcgaggagcgcgacgccgucuacuccgaguacaagcucaucauguccgagcgcgaccaggucaucuccgagcucgacaagcuccagaccgaggucgagcucgccgaguccaagcucaaguccuccaccuccgagaagaaggccgccaacgaggagauggaggcccuccgccagaucaaggacaccgucaccauggacgccggccgcgccaacaaggaggucgagauccuccgcaagcagugcaaggcccucugccaggagcucaaggaggcccuccaggaggccgacgucgccaagugccgccgcgacugggccuuccaggagcgcgacaagaucgucgccgagcgcgacuccauccgcacccucugcgacaaccuccgccgcgagcgcgaccgcgccgucuccgagcucgccgaggcccuccgcucccucgacgacacccgcaagcagaagaacgacgucucccgcgagcucaaggagcucaaggagcagauggagucccagcucgagaaggaggcccgcuuccgccagcucauggcccacuccucccacgacuccgccaucgacaccgacuccauggagugggagaccgaggucgucgaguucgagcgcgagaccgaggacaucgaccucaaggcccucggcuucgacauggccgagggcgucaacgagcccugcuuccccggcgacugcggcaucuucgucaccaaggucgacaagggcuccaucgccgacggccgccuccgcgucaacgacuggcuccuccgcaucaacgacgucgaccucaucaacaaggacaagaagcaggccaucaaggcccuccucaacggcgagggcgccaucaacauggucguccgccgccgcaagucccucggcggcaaggucgucaccccccuccacaucaaccucuccggccagaaggacuccggcaucucccucgagaacggcgucuacgccgccgccguccuccccggcucccccgccgccaaggagggcucccucgccgucggcgaccgcaucgucgccaucaacggcaucgcccucgacaacaagucccucaacgagugcgagucccuccuccgcuccugccaggacucccucacccucucccuccucaaggucuucccccaguccuccuccugguccggccagaacaucuucgagaacaucaaggacuccgacaagaugcucuccuuccgcgcccacggccccgagguccaggcccacaacaagcgcaaccucauccagcacaacaacuccacccagaccgacaucuucuacaccgaccgccucgaggaccgcaaggagcccggcccccccggcggcuccuccuccuuccuccacaagcccuuccccggcggcccccuccaggucugcccccaggccugccccuccgccuccgagcgcucccucuccuccuuccgcuccgacgccuccggcgaccgcggcuucggccucgucgacguccgcggccgccgcccccuccuccccuucgagaccgaggucggccccugcggcgucggcgaggccucccucgacaaggccgacuccgagggcuccaacuccggcggcaccuggcccaaggccaugcucuccuccaccgccguccccgagaagcucuccgucuacaagaagcccaagcagcgcaaguccaucuucgaccccaacaccuucaagcgcccccagaccccccccaagaucgacuaccuccuccccggccccggccccgcccacuccccccagcccuccaagcgcgccggcccccucaccccccccaagcccccccgccgcuccgacuccaucaaguuccagcaccgccucgagaccuccuccgaguccgaggccacccucgucggcuccucccccuccaccuccccccccuccgcccucccccccgacgucgaccccggcgagcccaugcacgccucccccccccgcaaggcccgcguccgcaucgccuccuccuacuaccccgagggcgacggcgacuccucccaccuccccgccaagaaguccugcgacgaggaccucaccucccagaaggucgacgagcucggccagaagcgccgccgccccaaguccgcccccuccuuccgccccaagcucgcccccgucgucauccccgcccaguuccucgaggagcagaagugcguccccgccuccggcgagcucucccccgagcuccaggagugggcccccuacucccccggccacuccucccgccacuccaaccccccccucuaccccucccgccccuccgucggcaccgucccccgcucccucacccccuccaccaccgucuccuccauccuccgcaaccccaucuacaccguccgcucccaccgcgucggccccugcuccuccccccccgccgcccgcgacgccggcccccagggccuccaccccuccguccagcaccagggccgccucucccucgaccucucccaccgcaccugcuccgacuacuccgagaugcgcgccacccacggcuccaacucccuccccuccuccgcccgccucggcuccuccuccaaccuccaguucaaggccgagcgcaucaagauccccuccaccccccgcuacccccgcuccgucgucggcuccgagcgcggcuccgucucccacuccgagugcuccacccccccccaguccccccucaacaucgacacccucuccuccugcucccagucccagaccuccgccuccacccucccccgcaucgccgucaaccccgccucccucggcgagcgccgcaaggaccgccccuacgucgaggagccccgccacgucaagguccagaagggcuccgagccccucggcaucuccaucgucuccggcgagaagggcggcaucuacgucuccaaggucaccgucggcuccaucgcccaccaggccggccucgaguacggcgaccagcuccucgaguucaacggcaucaaccuccgcuccgccaccgagcagcaggcccgccucaucaucggccagcagugcgacaccaucaccauccucgcccaguacaacccccacguccaccagcucuccucccacucccgcuccuccucccaccucgaccccgccggcacccacuccacccuccagggcuccggcaccaccacccccgagcaccccuccgucaucgacccccucauggagcaggacgagggccccuccaccccccccgccaagcaguccuccucccgcaucgccggcgacgccaacaagaagacccucgagccccgcgucgucuucaucaagaagucccagcucgagcucggcguccaccucugcggcggcaaccuccacggcgucuucgucgccgaggucgaggacgacucccccgccaagggccccgacggccucguccccggcgaccucauccucgaguacggcucccucgacguccgcaacaagaccgucgaggaggucuacgucgagaugcucaagccccgcgacggcguccgccucaagguccaguaccgccccgaggaguucaccaaggccaagggccuccccggcgacuccuucuacauccgcgcccucuacgaccgccucgccgacgucgagcaggagcucuccuucaagaaggacgacauccucuacgucgacgacacccucccccagggcaccuucggcuccuggauggccuggcagcucgacgagaacgcccagaagauccagcgcggccagauccccuccaaguacgucauggaccaggaguucucccgccgccucuccauguccgaggucaaggacgacaacuccgccaccaagacccucuccgccgccgcccgccgcuccuucuuccgccgcaagcacaagcacaagcgcuccggcuccaaggacggcaaggaccuccucgcccucgacgccuucuccuccgacuccaucccccucuucgaggacuccgucucccucgccuaccagcgcguccagaaggucgacugcaccgcccuccgccccguccucauccucggcccccuccucgacgucgucaaggagaugcucgucaacgaggcccccggcaaguucugccgcugcccccucgaggucaugaaggccucccagcaggccaucgagcgcggcgucaaggacugccucuucgucgacuacaagcgccgcuccggccacuucgacgucaccaccgucgccuccaucaaggagaucaccgagaagaaccgccacugccuccucgacaucgccccccacgccaucgagcgccuccaccacaugcacaucuaccccaucgucaucuucauccacuacaaguccgccaagcacaucaaggagcagcgcgaccccaucuaccuccgcgacaaggucacccagcgccacuccaaggagcaguucgaggccgcccagaagcucgagcaggaguacucccgcuacuucaccggcgucauccagggcggcgcccucuccuccaucugcacccagauccucgccauggucaaccaggagcagaacaagguccucuggauccccgccugcccccucuga

SEQ ID NO: 42273 - RNA, 2028 nt, Artificial Sequence
  derived and/or modified sequence opt2 from DLGAP1__Homo_sapiens__NP_001003809
augaaccucaucuuccacaaggacauccucuucggcauccccgccaacaaggucccccaggacgaguggaccggcuacaccccccgcggcaaggacgacgagauccccugccgccgcaugcgcuccggcuccuacaucaaggccaugggcgacgaggacuccggcgacuccgacaccucccccaagcccucccccaaggucgccgcccgccgcgaguccuaccucaaggccacccagcccucccucaccgagcucaccacccucaagaucuccaacgagcacucccccaagcuccagauccgcucccacuccuaccuccgcgccgucuccgaggucuccaucaaccgcucccucgacucccucgaccccgccggccuccucaccucccccaaguuccgcucccgcaacgaguccuacaugcgcgccauguccaccaucucccaggucuccgagauggaggucaacggccaguucgaguccgucugcgaguccgucuucuccgagcucgagucccaggccgucgaggcccucgaccuccccaugcccggcugcuuccgcaugcgcucccacuccuacguccgcgccaucgagaagggcugcucccaggacgacgagugcgucucccuccgcuccuccucccccccccgcaccaccaccaccguccgcaccauccaguccuccaccgucuccuccugcaucaccaccuacaagaagacccccccccccguccccccccgcaccaccaccaagcccuucaucuccaucaccgcccaguccuccaccgaguccgcccaggacgccuacauggacggccagggccagcgcggcgacaucaucucccaguccggccucuccaacuccaccgagucccucgacuccaugaaggcccucaccgccgccaucgaggccgccaacgcccagauccacggccccgccucccagcacaugggcaacaacaccgccaccgucaccaccaccaccaccaucgccaccgucaccaccgaggaccgcaagaaggaccacuucaagaagaaccgcugccucuccaucggcauccaggucgacgacgccgaggagcccgacaagaccggcgagaacaaggcccccuccaaguuccaguccgucggcguccaggucgaggaggagaagugcuuccgccgcuucacccgcuccaacuccgucaccaccgccguccaggccgaccucgacuuccacgacaaccucgagaacucccucgaguccaucgaggacaacuccugccccggccccauggcccgccaguucucccgcgacgccuccaccuccaccgucuccauccagggcuccggcaaccacuaccacgccugcgccgccgacgacgacuucgacaccgacuucgaccccuccauccuccccccccccgaccccuggaucgacuccaucaccgaggacccccucgaggccguccagcgcuccgucugccaccgcgacggccacugguuccucaagcuccuccaggccgagcgcgaccgcauggagggcuggugccagcagauggagcgcgaggagcgcgagaacaaccuccccgaggacauccucggcaagauccgcaccgccgucggcuccgcccagcuccucauggcccagaaguucuaccaguuccgcgagcucugcgaggagaaccucaaccccaacgcccacccccgccccaccucccaggaccucgccggcuucugggacaugcuccagcucuccaucgagaacaucuccaugaaguucgacgagcuccaccagcucaaggccaacaacuggaagcagauggacccccucgacaagaaggagcgccgcgcccccccccccguccccaagaagcccgccaagggccccgccccccucauccgcgagcgcucccucgaguccucccagcgccaggaggcccgcaagcgccucauggccgccaagcgcgccgccuccguccgccagaacuccgccaccgaguccgccgaguccaucgagaucuacauccccgaggcccagacccgccucuga

SEQ ID NO: 42274 - RNA, 2928 nt, Artificial Sequence
  derived and/or modified sequence opt2 from DLGAP2__Homo_sapiens__XP_011533064
augaagggccucuccggcucccgcacccagcccccccucugcuccggccacaccugcggccucgccccccccgaggacugcgagcaccuccaccacggccccgacgcccgcccccccuaccuccucucccccgccgacuccugccccggcggccgccaccgcugcuccccccgcuccuccguccacuccgagugcgucaugaugcccgucguccucggcgaccacgucuccuccuccaccuucccccgcaugcacuacuccucccacuacgacacccgcgacgacugcgccgucgcccacgccggcgccaagaucaaccgcauccccgccaaccuccucgaccaguucgagaagcagcucccccuccaccgcgacggcuuccacacccuccaguaccagcgcaccuccgccgccgccgagcagcgcuccgagucccccggccgcauccgccaccucguccacuccguccagaagcucuucaccaagucccacucccucgagggcuccuccaaguccaacgccaacggcaccaaggccgacggccgcgccgacgaccaccaccacgcccaccacgccaagcacuccaagcgcuccaaguccaaggagcgcaagcccgagggcaagccccgccccggcauguccuccuggugguccuccgacgacaaccucgacuccgacuccaccuaccgcacccccuccguccucaaccgccaccaccucggccccgucgcccacugcuaccccgacgcccuccagucccccuucggcgaccucucccucaagaccuccaaguccaacaacgacgucaagugcuccgccugcgagggccucgcccucacccccgacgccaaguaccucaagcgcuccuccugguccacccucaccgucucccaggccaaggaggccuaccgcaaguccucccucaaccucgacaagccccuccuccaccaggacgccaagcccgcccuccgccccugccacuaccuccaggucccccaggacgaguggggcggcuaccccaccggcggcaaggacgaggagauccccugccgccgcaugcgcuccggcuccuacaucaaggccaugggcgacgaggaguccggcgaguccgacuccucccccaagaccucccccaaguccgccauccuccccgagccccuccucaaguccaucggccagcgcccccucggcgagcaccagacccagaccuaccuccaggccgccuccgacguccccgucggccacucccucgaccccgccgccaacuacaacucccccaaguuccgcucccgcaaccaguccuacaugcgcgccgucuccacccucucccaggccuccugcgucucccaggucuccgaggccgagaucaacggccaguucgaguccgucugcgaguccgucuucuccgaggucgagucccaggccauggacgcccucgaccuccccggcugcuuccgcacccgcucccacuccuaccuccgcgccauccaggccggcuacucccaggacgacgagugcauccccaugaugacccccuccgacaucaccuccaccauccgcuccaccgccgccgucuccuacaccaacuacaagaagacccccccccccguccccccccgcaccaccuccaagccccucaucuccgucaccgcccaguccuccaccgaguccacccaggacgccuaccaggacucccgcgcccagcgcaugucccccuggccccaggacucccgcggccucuacaacuccaccgacucccucgacuccaacaaggccaugaaccucgcccucgagaccgccgccgcccagcgccaccuccccgagucccaguccuccuccguccgcaccuccgacaaggccauccucgucuccaaggccgaggagcuccucaagucccgcugcuccuccaucggcauccaggacuccgaguuccccgagcaccagcccuacccccgcuccgacgucgagaccgccaccgacuccgacaccgagucccgcggccuccgcgaguaccacuccgucggcguccaggucgaggacgagaagcgccacggccgcuucaagcgcuccaacuccgucaccgccgccguccaggccgaccucgagcucgagggcuuccccggccacaucaccaccgaggacaagggccuccaguucggcuccuccuuccagcgccacuccgagcccuccacccccacccaguacuccgccguccgcaccguccgcacccagggccucuucuccuaccgcgaggacuaccgcacccaggucgacaccuccacccuccccccccccgaccccuggcucgagcccgccaucgacaccgucgagaccggccgcaugucccccugccgccgcgacggcuccugguuccucaagcuccuccacgccgagaccaagcgcauggagggcuggugcaaggagauggagcgcgaggccgaggagaacgaccucuccgaggagauccucggcaagauccgcuccgccgucggcuccgcccagcuccucaugucccagaaguuccagcaguucuacuggcucugccagcagaacauggaccccuccgccaugccccgccccaccucccaggaccucgccggcuacugggacaugcuccagcucuccaucgaggacgucuccaugaaguucgacgagcuccagcgccuccgccucaacgacuggaagaugauggagucccccgagcgcaaggaggagcgcaagguccccccccccauccccaagaagccccccaagggcaaguuccccaucacccgcgagaagucccucgaccuccccgaccgccagcgccaggaggcccgccgccgccucauggccgccaagcgcgccgccuccuuccgccagaacuccgccuccgagcgcgccgacuccaucgagaucuacauccccgaggcccagacccgccucuga

SEQ ID NO: 42275 - RNA, 2940 nt, Artificial Sequence
  derived and/or modified sequence opt2 from DLGAP3__Homo_sapiens__XP_011540181
augcgcggcuaccacggcgaccgcggcucccacccccgccccgcccgcuucgccgaccagcagcacauggacgucggccccgccgcccgcgcccccuaccuccucggcucccgcgaggccuucuccaccgagccccgcuucugcgccccccgcgccggccucggccacaucucccccgagggcccccucucccucuccgagggccccuccgucggccccgagggcggccccgccggcgccggcgucggcggcggcuccuccaccuucccccgcauguaccccggccagggccccuucgacaccugcgaggacugcgucggccacccccagggcaagggcgccccccgccucccccccacccuccucgaccaguucgagaagcagcuccccguccagcaggacggcuuccacacccuccccuaccagcgcggccccgccggcgccggccccggccccgcccccggcaccggcaccgcccccgagccccgcuccgagucccccucccgcauccgccaccucguccacuccguccagaagcucuucgccaagucccacucccucgaggcccccggcaagcgcgacuacaacggccccaaggccgagggccgcggcggcuccggcggcgacuccuaccccggccccggcuccggcggcccccacaccucccaccaccaccaccaccaccaccaccaccaccaccaccagucccgccacggcaagcgcuccaaguccaaggaccgcaagggcgacggccgccaccaggccaaguccaccggcuggugguccuccgacgacaaccucgacuccgacuccggcuuccucgccggcggccgcccccccggcgagcccggcggccccuucugccucgagggccccgacggcuccuaccgcgaccucuccuucaagggccgcuccggcggcuccgagggccgcugccucgccugcaccggcauguccaugucccucgacggccaguccgucaagcgcuccgccuggcacaccaugauggucucccagggccgcgacggcuaccccggcgccggccccggcaagggccuccucggccccgagaccaaggccaaggcccgcaccuaccacuaccuccaggucccccaggacgacuggggcggcuaccccaccggcggcaaggacggcgagauccccugccgccgcaugcgcuccggcuccuacaucaaggccaugggcgacgaggaguccggcgacuccgacggcucccccaagaccucccccaaggccgucgcccgccgcuucaccacccgccgcuccuccuccgucgaccaggcccgcaucaacugcugcguccccccccgcauccacccccgcuccuccauccccggcuacucccgcucccucaccaccggccagcucuccgacgagcucaaccagcagcucgaggccgucugcggcuccgucuucggcgagcucgagucccaggccgucgacgcccucgaccuccccggcugcuuccgcaugcgcucccacuccuaccuccgcgccauccaggccggcugcucccaggacgacgacugccucccccuccucgccacccccgccgccgucuccggccgccccggcuccuccuucaacuuccgcaaggcccccccccccaucccccccggcucccaggcccccccccgcaucuccaucaccgcccaguccuccaccgacuccgcccacgaguccuucaccgccgccgagggccccgcccgccgcugcuccuccgccgacggccucgacggccccgccaugggcgcccgcacccucgagcucgcccccguccccccccgcgccucccccaagccccccacccucaucaucaagaccauccccggccgcgaggagcuccgcucccucgcccgccagcgcaaguggcgccccuccaucggcguccaggucgagaccaucuccgacuccgacaccgagaaccgcucccgccgcgaguuccacuccaucggcguccaggucgaggaggacaagcgccgcgcccgcuucaagcgcuccaacuccgucaccgccggcguccaggccgaccucgagcucgagggccucgccggccucgccaccgucgccaccgaggacaaggcccuccaguucggccgcuccuuccagcgccacgccuccgagccccagcccggcccccgcgcccccaccuacuccgucuuccgcaccguccacacccagggccagugggccuaccgcgagggcuacccccuccccuacgagccccccgccaccgacggcucccccggccccgcccccgcccccacccccggccccggcgccggccgccgcgacuccuggaucgagcgcggcucccgcucccuccccgacuccggccgcgccucccccugcccccgcgacggcgagugguucaucaagaugcuccgcgccgaggucgagaagcucgagcacuggugccagcagauggagcgcgaggccgaggacuacgagcuccccgaggagauccucgagaagauccgcuccgccgucggcuccacccagcuccuccucucccagaagguccagcaguucuuccgccucugccagcaguccauggaccccaccgccuuccccguccccaccuuccaggaccucgccggcuucugggaccuccuccagcucuccaucgaggacgucacccucaaguuccucgagcuccagcagcucaaggccaacuccuggaagcuccucgagcccaaggaggagaagaagguccccccccccauccccaagaagccccuccgcggccgcggcguccccgucaaggagcgcucccucgacuccgucgaccgccagcgccaggaggcccgcaagcgccuccucgccgccaagcgcgccgccuccuuccgccacuccuccgccaccgaguccgccgacuccaucgagaucuacauccccgaggcccagacccgccucuga

SEQ ID NO: 42276 - RNA, 2529 nt, Artificial Sequence
  derived and/or modified sequence opt2 from DLGAP5__Homo_sapiens__NP_001139487
auguccuccucccacuucgccucccgccaccgcaaggacaucuccaccgagaugauccgcaccaagaucgcccaccgcaagucccucucccagaaggagaaccgccacaaggaguacgagcgcaaccgccacuucggccucaaggacgucaacauccccacccucgagggccgcauccucgucgagcucgacgagaccucccagggccucguccccgagaagaccaacgucaagccccgcgccaugaagaccauccucggcgaccagcgcaagcagaugcuccagaaguacaaggaggagaagcagcuccagaagcucaaggagcagcgcgagaaggccaagcgcggcaucuucaaggucggccgcuaccgccccgacaugcccugcuuccuccucuccaaccagaacgccgucaaggccgagcccaagaaggccauccccuccuccguccgcaucacccgcuccaaggccaaggaccagauggagcagaccaagaucgacaacgaguccgacguccgcgccauccgccccggcccccgccagaccuccgagaagaaggucuccgacaaggagaagaaggucguccagcccgucaugcccaccucccuccgcaugacccgcuccgccacccaggccgccaagcaggucccccgcaccgucuccuccaccaccgcccgcaagcccgucacccgcgccgccaacgagaacgagcccgagggcaagguccccuccaagggccgccccgccaagaacgucgagaccaagcccgacaagggcaucuccugcaaggucgacuccgaggagaacacccucaacucccagaccaacgccaccuccggcaugaaccccgacggcguccucuccaagauggagaaccuccccgagaucaacaccgccaagaucaagggcaagaacuccuucgcccccaaggacuucauguuccagccccucgacggccucaagaccuaccaggucacccccaugaccccccgcuccgccaacgccuuccucacccccuccuacaccuggaccccccucaagaccgaggucgacgagucccaggccaccaaggagauccucgcccagaagugcaagaccuacuccaccaagaccauccagcaggacuccaacaagcuccccugcccccucggcccccucaccgucuggcacgaggagcacguccucaacaagaacgaggccaccaccaagaaccucaacggccuccccaucaaggagguccccucccucgagcgcaacgagggccgcaucgcccagccccaccacggcguccccuacuuccgcaacauccuccaguccgagaccgagaagcucaccucccacugcuucgagugggaccgcaagcucgagcucgacauccccgacgacgccaaggaccucauccgcaccgccgucggccagacccgccuccucaugaaggagcgcuucaagcaguucgagggccucgucgacgacugcgaguacaagcgcggcaucaaggagaccaccugcaccgaccucgacggcuucugggacauggucuccuuccagaucgaggacgucauccacaaguucaacaaccucaucaagcucgaggaguccggcuggcaggucaacaacaacaugaaccacaacaugaacaagaacgucuuccgcaagaaggucgucuccggcaucgccuccaagcccaagcaggacgacgccggccgcaucgccgcccgcaaccgccucgccgccaucaagaacgccaugcgcgagcgcauccgccaggaggagugcgccgagaccgccgucuccgucauccccaaggaggucgacaagaucgucuucgacgccggcuucuuccgcgucgagucccccgucaagcucuucuccggccucuccgucuccuccgagggccccucccagcgccucggcacccccaaguccgucaacaaggccgucucccagucccgcaacgagaugggcaucccccagcagaccaccucccccgagaacgccggcccccagaacaccaaguccgagcacgucaagaagacccucuuccucuccauccccgagucccgcuccuccaucgaggacgcccagugccccggccuccccgaccucaucgaggagaaccacgucgucaacaagaccgaccucaaggucgacugccucuccuccgagcgcaugucccucccccuccucgccggcggcgucgccgacgacaucaacaccaacaagaaggagggcaucuccgacgucgucgagggcauggagcucaacuccuccaucaccucccaggacguccucauguccucccccgagaagaacaccgccucccagaacuccauccucgaggagggcgagaccaagaucucccaguccgagcucuucgacaacaagucccucaccaccgagugccaccuccucgacuccgucggcuccugcuacgucgcccgcgccggccucgagguccucggcuccuccgaccccaccaccuccgccucccgcgucgccggcaccaccgcccgcuccaagcuccaguga

SEQ ID NO: 42277 - RNA, 1152 nt, Artificial Sequence
  derived and/or modified sequence opt2 from DLK1__Homo_sapiens__NP_003827
augaccgccaccgaggcccuccuccgcguccuccuccuccuccucgccuucggccacuccaccuacggcgccgagugcuuccccgccugcaacccccagaacggcuucugcgaggacgacaacgucugccgcugccagcccggcuggcagggcccccucugcgaccagugcgucaccucccccggcugccuccacggccucugcggcgagcccggccagugcaucugcaccgacggcugggacggcgagcucugcgaccgcgacguccgcgccugcuccuccgcccccugcgccaacaacggcaccugcgucucccucgacgacggccucuacgagugcuccugcgcccccggcuacuccggcaaggacugccagaagaaggacggccccugcgucaucaacggcucccccugccagcacggcggcaccugcgucgacgacgagggccgcgccucccacgccuccugccucugcccccccggcuucuccggcaacuucugcgagaucgucgccaacuccugcacccccaaccccugcgagaacgacggcgucugcaccgacaucggcggcgacuuccgcugccgcugccccgccggcuucaucgacaagaccugcucccgccccgucaccaacugcgccuccucccccugccagaacggcggcaccugccuccagcacacccaggucuccuacgagugccucugcaagcccgaguucaccggccucaccugcgucaagaagcgcgcccucuccccccagcaggucacccgccuccccuccggcuacggccucgccuaccgccucacccccggcguccacgagcuccccguccagcagcccgagcaccgcauccucaaggucuccaugaaggagcucaacaagaagaccccccuccucaccgagggccaggccaucugcuucaccauccucggcguccucaccucccucgucguccucggcaccgucggcaucgucuuccucaacaagugcgagaccugggucuccaaccuccgcuacaaccacaugcuccgcaagaagaagaaccuccuccuccaguacaacuccggcgaggaccucgccgucaacaucaucuuccccgagaagaucgacaugaccaccuucuccaaggaggccggcgacgaggagaucuga

SEQ ID NO: 42278 - RNA, 2172 nt, Artificial Sequence
  derived and/or modified sequence opt2 from DLL1__Homo_sapiens__XP_011534060
augggcucccgcugcgcccucgcccucgccguccucuccgcccuccucugccaggucugguccuccggcgucuucgagcucaagcuccaggaguucgucaacaagaagggccuccucggcaaccgcaacugcugccgcggcggcgccggccccccccccugcgccugccgcaccuucuuccgcgucugccucaagcacuaccaggccuccgucucccccgagccccccugcaccuacggcuccgccgucacccccguccucggcgucgacuccuucucccuccccgacggcggcggcgccgacuccgccuucuccaaccccauccgcuuccccuucggcuucaccuggcccggcaccuucucccucaucaucgaggcccuccacaccgacucccccgacgaccucgccaccgagaaccccgagcgccucaucucccgccucgccacccagcgccaccucaccgucggcgaggaguggucccaggaccuccacuccuccggccgcaccgaccucaaguacuccuaccgcuucgucugcgacgagcacuacuacggcgagggcugcuccgucuucugccgcccccgcgacgacgccuucggccacuucaccugcggcgagcgcggcgagaaggucugcaaccccggcuggaagggccccuacugcaccgagcccaucugccuccccggcugcgacgagcagcacggcuucugcgacaagcccggcgagugcaagugccgcgucggcuggcagggccgcuacugcgacgagugcauccgcuaccccggcugccuccacggcaccugccagcagcccuggcagugcaacugccaggagggcuggggcggccucuucugcaaccaggaccucaacuacugcacccaccacaagcccugcaagaacggcgccaccugcaccaacaccggccagggcuccuacaccugcuccugccgccccggcuacaccggcgccaccugcgagcucggcaucgacgagugcgaccccucccccugcaagaacggcggcuccugcaccgaccucgagaacuccuacuccugcaccugcccccccggcuucuacggcaagaucugcgagcucuccgccaugaccugcgccgacggccccugcuucaacggcggccgcugcuccgacucccccgacggcggcuacuccugccgcugccccgucggcuacuccggcuucaacugcgagaagaagaucgacuacugcuccuccucccccugcuccaacggcgccaagugcgucgaccucggcgacgccuaccucugccgcugccaggccggcuucuccggccgccacugcgacgacaacgucgacgacugcgccuccucccccugcgccaacggcggcaccugccgcgacggcgucaacgacuucuccugcaccugcccccccggcuacaccggccgcaacugcuccgcccccgucucccgcugcgagcacgcccccugccacaacggcgccaccugccacgagcgcggccaccgcuacgucugcgagugcgcccgcggcuacggcggccccaacugccaguuccuccuccccgagcucccccccggccccgccgucgucgaccucaccgagaagcucgagggccagggcggccccuuccccugggucgccgucugcgccggcgucauccucguccucaugcuccuccucggcugcgccgccgucgucgucugcguccgccuccgccuccagaagcaccgcccccccgccgaccccugccgcggcgagaccgagaccaugaacaaccucgccaacugccagcgcgagaaggacaucuccgucuccaucaucggcgccacccagaucaagaacaccaacaagaaggccgacuuccacggcgaccacuccgccgacaagaacggcuucaaggcccgcuaccccgccgucgacuacaaccucguccaggaccucaagggcgacgacaccgccguccgcgacgcccacuccaagcgcgacaccaagugccagccccagggcuccuccggcgaggagaagggcacccccaccacccuccgcggcggcgaggccuccgagcgcaagcgccccgacuccggcugcuccaccuccaaggacaccaaguaccaguccgucuacgucaucuccgaggagaaggacgagugcgucaucgccaccgaggucuga

SEQ ID NO: 42279 - RNA, 1857 nt, Artificial Sequence
  derived and/or modified sequence opt2 from DLL3__Homo_sapiens__NP_058637
auggucuccccccgcauguccggccuccucucccagaccgucauccucgcccucaucuuccucccccagacccgccccgccggcgucuucgagcuccagauccacuccuucggccccggccccggccccggcgccccccgcucccccugcuccgcccgccuccccugccgccucuucuuccgcgucugccucaagcccggccucuccgaggaggccgccgagucccccugcgcccucggcgccgcccucuccgcccgcggccccgucuacaccgagcagcccggcgcccccgcccccgaccucccccuccccgacggccuccuccagguccccuuccgcgacgccuggcccggcaccuucuccuucaucaucgagaccuggcgcgaggagcucggcgaccagaucggcggccccgccuggucccuccucgcccgcgucgccggccgccgccgccucgccgccggcggccccugggcccgcgacauccagcgcgccggcgccugggagcuccgcuucuccuaccgcgcccgcugcgagccccccgccgucggcaccgccugcacccgccucugccgcccccgcuccgcccccucccgcugcggccccggccuccgccccugcgccccccucgaggacgagugcgaggccccccucgucugccgcgccggcugcucccccgagcacggcuucugcgagcagcccggcgagugccgcugccucgagggcuggaccggcccccucugcaccguccccgucuccaccuccuccugccucuccccccgcggccccuccuccgccaccaccggcugccucguccccggccccggccccugcgacggcaaccccugcgccaacggcggcuccugcuccgagaccccccgcuccuucgagugcaccugcccccgcggcuucuacggccuccgcugcgaggucuccggcgucaccugcgccgacggccccugcuucaacggcggccucugcgucggcggcgccgaccccgacuccgccuacaucugccacugcccccccggcuuccagggcuccaacugcgagaagcgcgucgaccgcugcucccuccagcccugccgcaacggcggccucugccucgaccucggccacgcccuccgcugccgcugccgcgccggcuucgccggcccccgcugcgagcacgaccucgacgacugcgccggccgcgccugcgccaacggcggcaccugcgucgagggcggcggcgcccaccgcugcuccugcgcccucggcuucggcggccgcgacugccgcgagcgcgccgaccccugcgccgcccgccccugcgcccacggcggccgcugcuacgcccacuucuccggccucgucugcgccugcgcccccggcuacaugggcgcccgcugcgaguuccccguccaccccgacggcgccuccgcccuccccgccgccccccccggccuccgccccggcgacccccagcgcuaccuccucccccccgcccucggccuccucgucgccgccggcgucgccggcgccgcccuccuccucguccacguccgccgccgcggccacucccaggacgccggcucccgccuccucgccggcacccccgagcccuccguccacgcccuccccgacgcccucaacaaccuccgcacccaggagggcuccggcgacggccccuccuccuccgucgacuggaaccgccccgaggacgucgacccccagggcaucuacgucaucuccgcccccuccaucuacgcccgcgaggucgccaccccccucuuccccccccuccacaccggccgcgccggccagcgccagcaccuccucuuccccuaccccuccuccauccucuccgucaaguga

SEQ ID NO: 42280 - RNA, 2058 nt, Artificial Sequence
  derived and/or modified sequence opt2 from DLL4__Homo_sapiens__NP_061947
auggccgccgccucccgcuccgccuccggcugggcccuccuccuccucgucgcccucuggcagcagcgcgccgccggcuccggcgucuuccagcuccagcuccaggaguucaucaacgagcgcggcguccucgccuccggccgccccugcgagcccggcugccgcaccuucuuccgcgucugccucaagcacuuccaggccgucgucucccccggccccugcaccuucggcaccgucuccacccccguccucggcaccaacuccuucgccguccgcgacgacuccuccggcggcggccgcaacccccuccagcuccccuucaacuucaccuggcccggcaccuucucccucaucaucgaggccuggcacgcccccggcgacgaccuccgccccgaggcccucccccccgacgcccucaucuccaagaucgccauccagggcucccucgccgucggccagaacuggcuccucgacgagcagaccuccacccucacccgccuccgcuacuccuaccgcgucaucugcuccgacaacuacuacggcgacaacugcucccgccucugcaagaagcgcaacgaccacuucggccacuacgucugccagcccgacggcaaccucuccugccuccccggcuggaccggcgaguacugccagcagcccaucugccucuccggcugccacgagcagaacggcuacugcuccaagcccgccgagugccucugccgccccggcuggcagggccgccucugcaacgagugcaucccccacaacggcugccgccacggcaccugcuccacccccuggcagugcaccugcgacgagggcuggggcggccucuucugcgaccaggaccucaacuacugcacccaccacucccccugcaagaacggcgccaccugcuccaacuccggccagcgcuccuacaccugcaccugccgccccggcuacaccggcgucgacugcgagcucgagcucuccgagugcgacuccaaccccugccgcaacggcggcuccugcaaggaccaggaggacggcuaccacugccucugcccccccggcuacuacggccuccacugcgagcacuccacccucuccugcgccgacucccccugcuucaacggcggcuccugccgcgagcgcaaccagggcgccaacuacgccugcgagugcccccccaacuucaccggcuccaacugcgagaagaaggucgaccgcugcaccuccaaccccugcgccaacggcggccagugccucaaccgcggccccucccgcaugugccgcugccgccccggcuucaccggcaccuacugcgagcuccacgucuccgacugcgcccgcaaccccugcgcccacggcggcaccugccacgaccucgagaacggccucaugugcaccugccccgccggcuucuccggccgccgcugcgagguccgcaccuccaucgacgccugcgccuccucccccugcuucaaccgcgccaccugcuacaccgaccucuccaccgacaccuucgucugcaacugccccuacggcuucgucggcucccgcugcgaguuccccgucggccucccccccuccuuccccugggucgccgucucccucggcgucggccucgccguccuccucguccuccucggcauggucgccgucgccguccgccagcuccgccuccgccgccccgacgacggcucccgcgaggccaugaacaaccucuccgacuuccagaaggacaaccucauccccgccgcccagcucaagaacaccaaccagaagaaggagcucgaggucgacugcggccucgacaaguccaacugcggcaagcagcagaaccacacccucgacuacaaccucgcccccggcccccucggccgcggcaccaugcccggcaaguucccccacuccgacaagucccucggcgagaaggccccccuccgccuccacuccgagaagcccgagugccgcaucuccgccaucugcuccccccgcgacuccauguaccaguccgucugccucaucuccgaggagcgcaacgagugcgucaucgccaccgaggucuga

SEQ ID NO: 42281 - RNA, 1362 nt, Artificial Sequence
  derived and/or modified sequence opt2 from DLST__Homo_sapiens__NP_001924
augcucucccgcucccgcugcgucucccgcgccuucucccgcucccucuccgccuuccagaagggcaacugcccccucggccgccgcucccuccccggcgucucccucugccagggccccggcuaccccaacucccgcaaggucgucaucaacaacuccgucuucuccguccgcuucuuccgcaccaccgccgucugcaaggacgaccucgucaccgucaagacccccgccuucgccgaguccgucaccgagggcgacguccgcugggagaaggccgucggcgacaccgucgccgaggacgaggucgucugcgagaucgagaccgacaagaccuccguccagguccccucccccgccaacggcgucaucgaggcccuccucguccccgacggcggcaaggucgagggcggcaccccccucuucacccuccgcaagaccggcgccgcccccgccaaggccaagcccgccgaggcccccgccgccgccgcccccaaggccgagcccaccgccgccgccguccccccccccgccgcccccauccccacccagaugccccccguccccucccccucccagccccccuccggcaagcccgucuccgccgucaagcccaccgucgcccccccccucgccgagcccggcgccggcaagggccuccgcuccgagcaccgcgagaagaugaaccgcaugcgccagcgcaucgcccagcgccucaaggaggcccagaacaccugcgccaugcucaccaccuucaacgagaucgacauguccaacauccaggagaugcgcgcccgccacaaggaggccuuccucaagaagcacaaccucaagcucggcuucauguccgccuucgucaaggccuccgccuucgcccuccaggagcagcccgucgucaacgccgucaucgacgacaccaccaaggaggucgucuaccgcgacuacaucgacaucuccgucgccgucgccaccccccgcggccucgucguccccgucauccgcaacgucgaggccaugaacuucgccgacaucgagcgcaccaucaccgagcucggcgagaaggcccgcaagaacgagcucgccaucgaggacauggacggcggcaccuucaccaucuccaacggcggcgucuucggcucccucuucggcacccccaucaucaaccccccccaguccgccauccucggcaugcacggcaucuucgaccgccccgucgccaucggcggcaaggucgagguccgccccaugauguacgucgcccucaccuacgaccaccgccucaucgacggccgcgaggccgucaccuuccuccgcaagaucaaggccgccgucgaggacccccgcguccuccuccucgaccucuga

SEQ ID NO: 42282 - RNA, 390 nt, Artificial Sequence
  derived and/or modified sequence opt2 from DLX1__Homo_sapiens__NP_001033582
augaccaugaccaccaugcccgagucccucaacucccccgucuccggcaaggccgucuucauggaguucggcccccccaaccagcagaugucccccucccccaugucccacggccacuacuccaugcacugccuccacuccgccggccacucccagcccgacggcgccuacuccuccgccuccuccuucucccgcccccucggcuaccccuacgucaacuccgucuccucccacgccuccucccccuacaucuccuccguccaguccuaccccggcuccgccucccucgcccagucccgccucgaggaccccggccaggaccucguccccaagcaggccauccagguccaggaggccgacgaggccggcuggggcggcuccggcggcuga

SEQ ID NO: 42283 - RNA, 987 nt, Artificial Sequence
  derived and/or modified sequence opt2 from DLX2__Homo_sapiens__NP_004396
augaccggcgucuucgacucccucgucgccgacaugcacuccacccagaucgccgccuccuccaccuaccaccagcaccagcagccccccuccggcggcggcgccggccccggcggcaacuccuccuccuccuccucccuccacaagccccaggagucccccacccuccccgucuccaccgccaccgacuccuccuacuacaccaaccagcagcaccccgccggcggcggcggcggcggcggcucccccuacgcccacaugggcuccuaccaguaccaggccuccggccucaacaacguccccuacuccgccaaguccuccuacgaccucggcuacaccgccgccuacaccuccuacgcccccuacggcaccuccuccucccccgccaacaacgagcccgagaaggaggaccucgagcccgagauccgcaucgucaacggcaagcccaagaagguccgcaagccccgcaccaucuacuccuccuuccagcucgccgcccuccagcgccgcuuccagaagacccaguaccucgcccuccccgagcgcgccgagcucgccgccucccucggccucacccagacccaggucaagaucugguuccagaaccgccgcuccaaguucaagaagauguggaaguccggcgagauccccuccgagcagcaccccggcgccuccgccuccccccccugcgccuccccccccgucuccgcccccgccuccugggacuucggcgucccccagcgcauggccggcggcggcggccccggcuccggcggcuccggcgccggcuccuccggcuccucccccuccuccgccgccuccgccuuccucggcaacuaccccugguaccaccagaccuccggcuccgccucccaccuccaggccaccgccccccuccuccaccccacccagaccccccagccccaccaccaccaccaccaccacggcggcggcggcgcccccgucuccgccggcaccaucuucuga

SEQ ID NO: 42284 - RNA, 864 nt, Artificial Sequence
  derived and/or modified sequence opt2 from DLX3__Homo_sapiens__NP_005211
auguccggcuccuucgaccgcaagcucuccuccauccucaccgacaucuccuccucccucuccugccacgccggcuccaaggacucccccacccuccccgaguccuccgucaccgaccucggcuacuacuccgccccccagcacgacuacuacuccggccagcccuacggccagaccgucaaccccuacaccuaccaccaccaguucaaccucaacggccucgccggcaccggcgccuacucccccaaguccgaguacaccuacggcgccuccuaccgccaguacggcgccuaccgcgagcagccccuccccgcccaggaccccgucuccgucaaggaggagcccgaggccgagguccgcauggucaacggcaagcccaagaagguccgcaagccccgcaccaucuacuccuccuaccagcucgccgcccuccagcgccgcuuccagaaggcccaguaccucgcccuccccgagcgcgccgagcucgccgcccagcucggccucacccagacccaggucaagaucugguuccagaaccgccgcuccaaguucaagaagcucuacaagaacggcgaggucccccucgagcacucccccaacaacuccgacuccauggccugcaacuccccccccucccccgcccucugggacaccuccucccacuccacccccgcccccgcccgcucccagcucccccccccccuccccuacuccgccucccccuccuaccucgacgaccccaccaacuccugguaccacgcccagaaccucuccggcccccaccuccagcagcagcccccccagcccgccacccuccaccacgccucccccggccccccccccaaccccggcgccgucuacuga

SEQ ID NO: 42285 - RNA, 723 nt, Artificial Sequence
  derived and/or modified sequence opt2 from DLX4__Homo_sapiens__NP_612138
augaccucccuccccugcccccuccccggccgcgacgccuccaaggccgucuuccccgaccucgcccccguccccuccgucgccgccgccuacccccucggccucucccccaccaccgccgccucccccaaccucuccuacucccgccccuacggccaccuccucuccuaccccuacaccgagcccgccaaccccggcgacuccuaccucuccugccagcagcccgccgcccucucccagccccucugcggccccgccgagcacccccaggagcucgaggccgacuccgagaagccccgccucucccccgagcccuccgagcgccgcccccaggcccccgccaagaagcuccgcaagccccgcaccaucuacuccucccuccagcuccagcaccucaaccagcgcuuccagcacacccaguaccucgcccuccccgagcgcgcccagcucgccgcccagcucggccucacccagacccaggucaagaucugguuccagaacaagcgcuccaaguacaagaagcuccucaagcagaacuccggcggccaggagggcgacuuccccggccgcaccuucuccgucucccccugcucccccccccuccccucccucugggaccuccccaaggccggcacccuccccaccuccggcuacggcaacuccuucggcgccugguaccagcaccacuccuccgacguccucgccuccccccagaugauguga

SEQ ID NO: 42286 - RNA, 870 nt, Artificial Sequence
  derived and/or modified sequence opt2 from DLX5__Homo_sapiens__NP_005212
augaccggcgucuucgaccgccgcguccccuccauccgcuccggcgacuuccaggcccccuuccagaccuccgccgccaugcaccaccccucccaggagucccccacccuccccgaguccuccgccaccgacuccgacuacuacucccccaccggcggcgccccccacggcuacugcucccccaccuccgccuccuacggcaaggcccucaaccccuaccaguaccaguaccacggcgucaacggcuccgccggcuccuaccccgccaaggccuacgccgacuacuccuacgccuccuccuaccaccaguacggcggcgccuacaaccgcguccccuccgccaccaaccagcccgagaaggaggucaccgagcccgagguccgcauggucaacggcaagcccaagaagguccgcaagccccgcaccaucuacuccuccuuccagcucgccgcccuccagcgccgcuuccagaagacccaguaccucgcccuccccgagcgcgccgagcucgccgccucccucggccucacccagacccaggucaagaucugguuccagaacaagcgcuccaagaucaagaagaucaugaagaacggcgagaugccccccgagcacucccccuccuccuccgaccccauggccugcaacuccccccagucccccgccgucugggagccccagggcuccucccgcucccucucccaccacccccacgcccacccccccaccuccaaccagucccccgccuccuccuaccucgagaacuccgccuccugguacaccuccgccgccuccuccaucaacucccaccuccccccccccggcucccuccagcacccccucgcccucgccuccggcacccucuacuga

SEQ ID NO: 42287 - RNA, 882 nt, Artificial Sequence
  derived and/or modified sequence opt2 from DLX6__Homo_sapiens__NP_005213
augaugaccaugaccaccauggccgacggccucgagggccaggacuccuccaaguccgccuucauggaguucggccagcagcagcagcagcagcagcagcagcagcagcagcagcagcagcagcagcagcagccccccccccccccccccccccccccccagccccacucccagcaguccucccccgccauggccggcgcccacuacccccuccacugccuccacuccgccgccgccgccgccgccgccggcucccaccaccaccaccaccaccagcaccaccaccacggcucccccuacgccuccggcggcggcaacuccuacaaccaccgcucccucgccgccuaccccuacaugucccacucccagcacucccccuaccuccaguccuaccacaacuccuccgccgccgcccagacccgcggcgacgacaccgaccagcagaagaccaccgucaucgagaacggcgagauccgcuucaacggcaagggcaagaagauccgcaagccccgcaccaucuacuccucccuccagcuccaggcccucaaccaccgcuuccagcagacccaguaccucgcccuccccgagcgcgccgagcucgccgccucccucggccucacccagacccaggucaagaucugguuccagaacaagcgcuccaaguucaagaagcuccucaagcagggcuccaacccccacgaguccgacccccuccagggcuccgccgcccucuccccccgcucccccgcccucccccccgucugggacgucuccgccuccgccaagggcgucuccaugccccccaacuccuacaugcccggcuacucccacugguacuccuccccccaccaggacaccaugcagcgcccccagaugauguga

SEQ ID NO: 42288 - RNA, 5358 nt, Artificial Sequence
  derived and/or modified sequence opt2 from DMBT1__Homo_sapiens__NP_004397
augggcaucuccaccgucauccucgagaugugccuccucuggggccagguccucuccaccggcggcuggaucccccgcaccaccgacuacgccucccucauccccuccgaggucccccucgaccccaccgucgccgagggcucccccuuccccuccgaguccacccucgaguccaccgucgccgagggcucccccaucucccucgaguccacccucgaguccaccgucgccgagggcucccucauccccuccgaguccacccucgaguccaccgucgccgagggcuccgacuccggccucgcccuccgccucgucaacggcgacggccgcugccagggccgcgucgagauccucuaccgcggcuccuggggcaccgucugcgacgacuccugggacaccaacgacgccaacgucgucugccgccagcucggcugcggcugggccauguccgcccccggcaacgccugguucggccagggcuccggccccaucgcccucgacgacguccgcugcuccggccacgaguccuaccucugguccugcccccacaacggcuggcucucccacaacugcggccacggcgaggacgccggcgucaucugcuccgccgcccagccccaguccacccuccgccccgaguccuggcccguccgcaucuccccccccguccccaccgagggcuccgaguccucccucgcccuccgccucgucaacggcggcgaccgcugccgcggccgcgucgagguccucuaccgcggcuccuggggcaccgucugcgacgacuacugggacaccaacgacgccaacgucgucugccgccagcucggcugcggcugggccauguccgcccccggcaacgcccaguucggccagggcuccggccccaucguccucgacgacguccgcugcuccggccacgaguccuaccucugguccugcccccacaacggcuggcucacccacaacugcggccacuccgaggacgccggcgucaucugcuccgccccccagucccgccccacccccucccccgacaccuggcccaccucccacgccuccaccgccggccccgaguccucccucgcccuccgccucgucaacggcggcgaccgcugccagggccgcgucgagguccucuaccgcggcuccuggggcaccgucugcgacgacuccugggacaccuccgacgccaacgucgucugccgccagcucggcugcggcugggccaccuccgcccccggcaacgcccgcuucggccagggcuccggccccaucguccucgacgacguccgcugcuccggcuacgaguccuaccucugguccugcccccacaacggcuggcucucccacaacugccagcacuccgaggacgccggcgucaucugcuccgccgcccacuccugguccacccccucccccgacacccuccccaccaucacccuccccgccuccaccgucggcuccgaguccucccucgcccuccgccucgucaacggcggcgaccgcugccagggccgcgucgagguccucuaccagggcuccuggggcaccgucugcgacgacuccugggacaccaacgacgccaacgucgucugccgccagcucggcugcggcugggccauguccgcccccggcaacgcccgcuucggccagggcuccggccccaucguccucgacgacguccgcugcuccggccacgaguccuaccucugguccugcccccacaacggcuggcucucccacaacugcggccacuccgaggacgccggcgucaucugcuccgccucccagucccgccccacccccucccccgacaccuggcccaccucccacgccuccaccgccggcuccgaguccucccucgcccuccgccucgucaacggcggcgaccgcugccagggccgcgucgagguccucuaccgcggcuccuggggcaccgucugcgacgacuacugggacaccaacgacgccaacgucgucugccgccagcucggcugcggcugggccauguccgcccccggcaacgcccgcuucggccagggcuccggccccaucguccucgacgacguccgcugcuccggccacgaguccuaccucugguccugcccccacaacggcuggcucucccacaacugcggccaccacgaggacgccggcgucaucugcuccgccucccagucccagcccacccccucccccgacaccuggcccaccucccacgccuccaccgccggcuccgaguccucccucgcccuccgccucgucaacggcggcgaccgcugccagggccgcgucgagguccucuaccgcggcuccuggggcaccgucugcgacgacuacugggacaccaacgacgccaacgucgucugccgccagcucggcugcggcugggccaccuccgcccccggcaacgcccgcuucggccagggcuccggccccaucguccucgacgacguccgcugcuccggccacgaguccuaccucugguccugcccccacaacggcuggcucucccacaacugcggccaccacgaggacgccggcgucaucugcuccgccucccagucccagcccacccccucccccgacaccuggcccaccucccgcgccuccaccgccggcuccgaguccacccucgcccuccgccucgucaacggcggcgaccgcugccgcggccgcgucgagguccucuaccagggcuccuggggcaccgucugcgacgacuacugggacaccaacgacgccaacgucgucugccgccagcucggcugcggcugggccauguccgcccccggcaacgcccaguucggccagggcuccggccccaucguccucgacgacguccgcugcuccggccacgaguccuaccucugguccugcccccacaacggcuggcucucccacaacugcggccaccacgaggacgccggcgucaucugcuccgccgcccagucccaguccaccccccgccccgacaccuggcucaccaccaaccuccccgcccucaccgucggcuccgaguccucccucgcccuccgccucgucaacggcggcgaccgcugccgcggccgcgucgagguccucuaccgcggcuccuggggcaccgucugcgacgacuccugggacaccaacgacgccaacgucgucugccgccagcucggcugcggcugggccauguccgcccccggcaacgcccgcuucggccagggcuccggccccaucguccucgacgacguccgcugcuccggcaacgaguccuaccucugguccugcccccacaagggcuggcucacccacaacugcggccaccacgaggacgccggcgucaucugcuccgccacccagaucaacuccaccaccaccgacugguggcaccccaccaccaccaccaccgcccgccccuccuccaacugcggcggcuuccucuucuacgccuccggcaccuucuccucccccuccuaccccgccuacuaccccaacaacgccaagugcgucugggagaucgaggucaacuccggcuaccgcaucaaccucggcuucuccaaccucaagcucgaggcccaccacaacugcuccuucgacuacgucgagaucuucgacggcucccucaacuccucccuccuccucggcaagaucugcaacgacacccgccagaucuucaccuccuccuacaaccgcaugaccauccacuuccgcuccgacaucuccuuccagaacaccggcuuccucgccugguacaacuccuuccccuccgacgccacccuccgccucgucaaccucaacuccuccuacggccucugcgccggccgcgucgagaucuaccacggcggcaccuggggcaccgucugcgacgacuccuggaccauccaggaggccgaggucgucugccgccagcucggcugcggccgcgccgucuccgcccucggcaacgccuacuucggcuccggcuccggccccaucacccucgacgacgucgagugcuccggcaccgaguccacccucuggcagugccgcaaccgcggcugguucucccacaacugcaaccaccgcgaggacgccggcgucaucugcuccggcaaccaccucuccacccccgcccccuuccucaacaucacccgccccaacaccgacuacuccugcggcggcuuccucucccagcccuccggcgacuucuccucccccuucuaccccggcaacuaccccaacaacgccaagugcgucugggacaucgagguccagaacaacuaccgcgucaccgucaucuuccgcgacguccagcucgagggcggcugcaacuacgacuacaucgaggucuucgacggccccuaccgcuccuccccccucaucgcccgcgucugcgacggcgcccgcggcuccuucaccuccuccuccaacuucauguccauccgcuucaucuccgaccacuccaucacccgccgcggcuuccgcgccgaguacuacuccucccccuccaacgacuccaccaaccuccucugccuccccaaccacaugcaggccuccgucucccgcuccuaccuccagucccucggcuucuccgccuccgaccucgucaucuccaccuggaacggcuacuacgagugccgcccccagaucacccccaaccucgucaucuucaccauccccuacuccggcugcggcaccuucaagcaggccgacaacgacaccaucgacuacuccaacuuccucaccgccgccgucuccggcggcaucaucaagcgccgcaccgaccuccgcauccacgucuccugccgcaugcuccagaacaccugggucgacaccauguacaucgccaacgacaccauccacgucgccaacaacaccauccaggucgaggagguccaguacggcaacuucgacgucaacaucuccuucuacaccuccuccuccuuccucuaccccgucaccucccgccccuacuacgucgaccucaaccaggaccucuacguccaggccgagauccuccacuccgacgccguccucacccucuucgucgacaccugcgucgccucccccuacuccaacgacuucaccucccucaccuacgaccucauccgcuccggcugcguccgcgacgacaccuacggccccuacuccucccccucccuccgcaucgcccgcuuccgcuuccgcgccuuccacuuccucaaccgcuuccccuccgucuaccuccgcugcaagauggucgucugccgcgccuacgaccccuccucccgcugcuaccgcggcugcguccuccgcuccaagcgcgacgucggcuccuaccaggagaaggucgacgucguccucggccccauccagcuccagacccccccccgccgcgaggaggagccccgcuga

SEQ ID NO: 42289 - RNA, 1023 nt, Artificial Sequence
  derived and/or modified sequence opt2 from DMC1__Homo_sapiens__NP_008999
augaaggaggaccaggucgucgccgaggagcccggcuuccaggacgaggaggagucccucuuccaggacaucgaccuccuccagaagcacggcaucaacgucgccgacaucaagaagcucaaguccgucggcaucugcaccaucaagggcauccagaugaccacccgccgcgcccucugcaacgucaagggccucuccgaggccaaggucgacaagaucaaggaggccgccaacaagcucaucgagcccggcuuccucaccgccuucgaguacuccgagaagcgcaagauggucuuccacaucaccaccggcucccaggaguucgacaagcuccucggcggcggcaucgaguccauggccaucaccgaggccuucggcgaguuccgcaccggcaagacccagcucucccacacccucugcgucaccgcccagcuccccggcgccggcggcuaccccggcggcaagaucaucuucaucgacaccgagaacaccuuccgccccgaccgccuccgcgacaucgccgaccgcuucaacgucgaccacgacgccguccucgacaacguccucuacgcccgcgccuacaccuccgagcaccagauggagcuccucgacuacgucgccgccaaguuccacgaggaggccggcaucuucaagcuccucaucaucgacuccaucauggcccucuuccgcgucgacuucuccggccgcggcgagcucgccgagcgccagcagaagcucgcccagaugcucucccgccuccagaagaucuccgaggaguacaacgucgccgucuucgucaccaaccagaugaccgccgaccccggcgccaccaugaccuuccaggccgaccccaagaagcccaucggcggccacauccucgcccacgccuccaccacccgcaucucccuccgcaagggccgcggcgagcuccgcaucgccaagaucuacgacucccccgagaugcccgagaacgaggccaccuucgccaucaccgccggcggcaucggcgacgccaaggaguga

SEQ ID NO: 42290 - RNA, 11034 nt, Artificial Sequence
  derived and/or modified sequence opt2 from DMD__Homo_sapiens__NP_000100
auggaggacgagcgcgaggacguccagaagaagaccuucaccaagugggucaacgcccaguucuccaaguucggcaagcagcacaucgagaaccucuucuccgaccuccaggacggccgccgccuccucgaccuccucgagggccucaccggccagaagcuccccaaggagaagggcuccacccgcguccacgcccucaacaacgucaacaaggcccuccgcguccuccagaacaacaacgucgaccucgucaacaucggcuccaccgacaucgucgacggcaaccacaagcucacccucggccucaucuggaacaucauccuccacuggcaggucaagaacgucaugaagaacaucauggccggccuccagcagaccaacuccgagaagauccuccucuccuggguccgccaguccacccgcaacuacccccaggucaacgucaucaacuucaccaccuccugguccgacggccucgcccucaacgcccucauccacucccaccgccccgaccucuucgacuggaacuccgucgucugccagcaguccgccacccagcgccucgagcacgccuucaacaucgcccgcuaccagcucggcaucgagaagcuccucgaccccgaggacgucgacaccaccuaccccgacaagaaguccauccucauguacaucaccucccucuuccagguccucccccagcaggucuccaucgaggccauccaggaggucgagaugcucccccgcccccccaaggucaccaaggaggagcacuuccagcuccaccaccagaugcacuacucccagcagaucaccgucucccucgcccagggcuacgagcgcaccuccucccccaagccccgcuucaaguccuacgccuacacccaggccgccuacgucaccaccuccgaccccacccgcucccccuuccccucccagcaccucgaggcccccgaggacaaguccuucggcuccucccucauggaguccgaggucaaccucgaccgcuaccagaccgcccucgaggagguccucuccuggcuccucuccgccgaggacacccuccaggcccagggcgagaucuccaacgacgucgaggucgucaaggaccaguuccacacccacgagggcuacaugauggaccucaccgcccaccagggccgcgucggcaacauccuccagcucggcuccaagcucaucggcaccggcaagcucuccgaggacgaggagaccgagguccaggagcagaugaaccuccucaacucccgcugggagugccuccgcgucgccuccauggagaagcaguccaaccuccaccgcguccucauggaccuccagaaccagaagcucaaggagcucaacgacuggcucaccaagaccgaggagcgcacccgcaagauggaggaggagccccucggccccgaccucgaggaccucaagcgccagguccagcagcacaagguccuccaggaggaccucgagcaggagcagguccgcgucaacucccucacccacauggucgucgucgucgacgaguccuccggcgaccacgccaccgccgcccucgaggagcagcucaagguccucggcgaccgcugggccaacaucugccgcuggaccgaggaccgcuggguccuccuccaggacauccuccucaaguggcagcgccucaccgaggagcagugccucuucuccgccuggcucuccgagaaggaggacgccgucaacaagauccacaccaccggcuucaaggaccagaacgagaugcucuccucccuccagaagcucgccguccucaaggccgaccucgagaagaagaagcaguccaugggcaagcucuacucccucaagcaggaccuccucuccacccucaagaacaaguccgucacccagaagaccgaggccuggcucgacaacuucgcccgcugcugggacaaccucguccagaagcucgagaaguccaccgcccagaucucccaggccgucaccaccacccagcccucccucacccagaccaccgucauggagaccgucaccaccgucaccacccgcgagcagauccucgucaagcacgcccaggaggagcucccccccccccccccccagaagaagcgccagaucaccgucgacuccgagauccgcaagcgccucgacgucgacaucaccgagcuccacuccuggaucacccgcuccgaggccguccuccagucccccgaguucgccaucuuccgcaaggagggcaacuucuccgaccucaaggagaaggucaacgccaucgagcgcgagaaggccgagaaguuccgcaagcuccaggacgccucccgcuccgcccaggcccucgucgagcagauggucaacgagggcgucaacgccgacuccaucaagcaggccuccgagcagcucaacucccgcuggaucgaguucugccagcuccucuccgagcgccucaacuggcucgaguaccagaacaacaucaucgccuucuacaaccagcuccagcagcucgagcagaugaccaccaccgccgagaacuggcucaagauccagcccaccacccccuccgagcccaccgccaucaagucccagcucaagaucugcaaggacgaggucaaccgccucuccggccuccagccccagaucgagcgccucaagauccaguccaucgcccucaaggagaagggccagggccccauguuccucgacgccgacuucgucgccuucaccaaccacuucaagcaggucuucuccgacguccaggcccgcgagaaggagcuccagaccaucuucgacacccucccccccaugcgcuaccaggagaccauguccgccauccgcaccuggguccagcaguccgagaccaagcucuccaucccccagcucuccgucaccgacuacgagaucauggagcagcgccucggcgagcuccaggcccuccaguccucccuccaggagcagcaguccggccucuacuaccucuccaccaccgucaaggagauguccaagaaggcccccuccgagaucucccgcaaguaccaguccgaguucgaggagaucgagggccgcuggaagaagcucuccucccagcucgucgagcacugccagaagcucgaggagcagaugaacaagcuccgcaagauccagaaccacauccagacccucaagaaguggauggccgaggucgacgucuuccucaaggaggaguggcccgcccucggcgacuccgagauccucaagaagcagcucaagcagugccgccuccucgucuccgacauccagaccauccagcccucccucaacuccgucaacgagggcggccagaagaucaagaacgaggccgagcccgaguucgccucccgccucgagaccgagcucaaggagcucaacacccagugggaccacaugugccagcaggucuacgcccgcaaggaggcccucaagggcggccucgagaagaccgucucccuccagaaggaccucuccgagaugcacgaguggaugacccaggccgaggaggaguaccucgagcgcgacuucgaguacaagacccccgacgagcuccagaaggccgucgaggagaugaagcgcgccaaggaggaggcccagcagaaggaggccaaggucaagcuccucaccgaguccgucaacuccgucaucgcccaggccccccccgucgcccaggaggcccucaagaaggagcucgagacccucaccaccaacuaccaguggcucugcacccgccucaacggcaagugcaagacccucgaggaggucugggccugcuggcacgagcuccucuccuaccucgagaaggccaacaaguggcucaacgaggucgaguucaagcucaagaccaccgagaacauccccggcggcgccgaggagaucuccgagguccucgacucccucgagaaccucaugcgccacuccgaggacaaccccaaccagauccgcauccucgcccagacccucaccgacggcggcgucauggacgagcucaucaacgaggagcucgagaccuucaacucccgcuggcgcgagcuccacgaggaggccguccgccgccagaagcuccucgagcaguccauccaguccgcccaggagaccgagaagucccuccaccucauccaggagucccucaccuucaucgacaagcagcucgccgccuacaucgccgacaaggucgacgccgcccagaugccccaggaggcccagaagauccaguccgaccucaccucccacgagaucucccucgaggagaugaagaagcacaaccagggcaaggaggccgcccagcgcguccucucccagaucgacgucgcccagaagaagcuccaggacgucuccaugaaguuccgccucuuccagaagcccgccaacuucgagcagcgccuccaggaguccaagaugauccucgacgaggucaagaugcaccuccccgcccucgagaccaaguccgucgagcaggaggucguccagucccagcucaaccacugcgucaaccucuacaagucccucuccgaggucaaguccgaggucgagauggucaucaagaccggccgccagaucguccagaagaagcagaccgagaaccccaaggagcucgacgagcgcgucaccgcccucaagcuccacuacaacgagcucggcgccaaggucaccgagcgcaagcagcagcucgagaagugccucaagcucucccgcaagaugcgcaaggagaugaacguccucaccgaguggcucgccgccaccgacauggagcucaccaagcgcuccgccgucgagggcaugcccuccaaccucgacuccgaggucgccuggggcaaggccacccagaaggagaucgagaagcagaagguccaccucaaguccaucaccgaggucggcgaggcccucaagaccguccucggcaagaaggagacccucgucgaggacaagcucucccuccucaacuccaacuggaucgccgucaccucccgcgccgaggaguggcucaaccuccuccucgaguaccagaagcacauggagaccuucgaccagaacgucgaccacaucaccaaguggaucauccaggccgacacccuccucgacgaguccgagaagaagaagccccagcagaaggaggacguccucaagcgccucaaggccgagcucaacgacauccgccccaaggucgacuccacccgcgaccaggccgccaaccucauggccaaccgcggcgaccacugccgcaagcucgucgagccccagaucuccgagcucaaccaccgcuucgccgccaucucccaccgcaucaagaccggcaaggccuccaucccccucaaggagcucgagcaguucaacuccgacauccagaagcuccucgagccccucgaggccgagauccagcagggcgucaaccucaaggaggaggacuucaacaaggacaugaacgaggacaacgagggcaccgucaaggagcuccuccagcgcggcgacaaccuccagcagcgcaucaccgacgagcgcaagcgcgaggagaucaagaucaagcagcagcuccuccagaccaagcacaacgcccucaaggaccuccgcucccagcgccgcaagaaggcccucgagaucucccaccagugguaccaguacaagcgccaggccgacgaccuccucaagugccucgacgacaucgagaagaagcucgccucccuccccgagccccgcgacgagcgcaagaucaaggagaucgaccgcgagcuccagaagaagaaggaggagcucaacgccguccgccgccaggccgagggccucuccgaggacggcgccgccauggccgucgagcccacccagauccagcucuccaagcgcuggcgcgagaucgaguccaaguucgcccaguuccgccgccucaacuucgcccagauccacaccguccgcgaggagaccaugauggucaugaccgaggacaugccccucgagaucuccuacguccccuccaccuaccucaccgagaucacccacgucucccaggcccuccucgaggucgagcagcuccucaacgcccccgaccucugcgccaaggacuucgaggaccucuucaagcaggaggagucccucaagaacaucaaggacucccuccagcaguccuccggccgcaucgacaucauccacuccaagaagaccgccgcccuccaguccgccacccccgucgagcgcgucaagcuccaggaggcccucucccagcucgacuuccagugggagaaggucaacaagauguacaaggaccgccagggccgcuucgaccgcuccgucgagaaguggcgccgcuuccacuacgacaucaagaucuucaaccaguggcucaccgaggccgagcaguuccuccgcaagacccagauccccgagaacugggagcacgccaaguacaagugguaccucaaggagcuccaggacggcaucggccagcgccagaccgucguccgcacccucaacgccaccggcgaggagaucauccagcaguccuccaagaccgacgccuccauccuccaggagaagcucggcucccucaaccuccgcuggcaggaggucugcaagcagcucuccgaccgcaagaagcgccucgaggagcagaagaacauccucuccgaguuccagcgcgaccucaacgaguucguccucuggcucgaggaggccgacaacaucgccuccaucccccucgagcccggcaaggagcagcagcucaaggagaagcucgagcaggucaagcuccucgucgaggagcucccccuccgccagggcauccucaagcagcucaacgagaccggcggccccguccucgucuccgcccccaucucccccgaggagcaggacaagcucgagaacaagcucaagcagaccaaccuccaguggaucaaggucucccgcgcccuccccgagaagcagggcgagaucgaggcccagaucaaggaccucggccagcucgagaagaagcucgaggaccucgaggagcagcucaaccaccuccuccucuggcucucccccauccgcaaccagcucgagaucuacaaccagcccaaccaggagggccccuucgacguccaggagaccgagaucgccguccaggccaagcagcccgacgucgaggagauccucuccaagggccagcaccucuacaaggagaagcccgccacccagcccgucaagcgcaagcucgaggaccucuccuccgaguggaaggccgucaaccgccuccuccaggagcuccgcgccaagcagcccgaccucgcccccggccucaccaccaucggcgccucccccacccagaccgucacccucgucacccagcccgucgucaccaaggagaccgccaucuccaagcucgagaugcccuccucccucaugcucgagguccccgcccucgccgacuucaaccgcgccuggaccgagcucaccgacuggcucucccuccucgaccaggucaucaagucccagcgcgucauggucggcgaccucgaggacaucaacgagaugaucaucaagcagaaggccaccaugcaggaccucgagcagcgccgcccccagcucgaggagcucaucaccgccgcccagaaccucaagaacaagaccuccaaccaggaggcccgcaccaucaucaccgaccgcaucgagcgcauccagaaccagugggacgagguccaggagcaccuccagaaccgccgccagcagcucaacgagaugcucaaggacuccacccaguggcucgaggccaaggaggaggccgagcagguccucggccaggcccgcgccaagcucgaguccuggaaggagggccccuacaccgucgacgccauccagaagaagaucaccgagaccaagcagcucgccaaggaccuccgccaguggcagaccaacgucgacgucgccaacgaccucgcccucaagcuccuccgcgacuacuccgccgacgacacccgcaagguccacaugaucaccgagaacaucaacgccuccuggcgcuccauccacaagcgcgucuccgagcgcgaggccgcccucgaggagacccaccgccuccuccagcaguucccccucgaccucgagaaguuccucgccuggcucaccgaggccgagaccaccgccaacguccuccaggacgccacccgcaaggagcgccuccucgaggacuccaagggcgucaaggagcucaugaagcaguggcaggaccuccagggcgagaucgaggcccacaccgacgucuaccacaaccucgacgagaacucccagaagauccuccgcucccucgagggcuccgacgacgccguccuccuccagcgccgccucgacaacaugaacuucaagugguccgagcuccgcaagaagucccucaacauccgcucccaccucgaggccuccuccgaccaguggaagcgccuccaccucucccuccaggagcuccucgucuggcuccagcucaaggacgacgagcucucccgccaggcccccaucggcggcgacuuccccgccguccagaagcagaacgacguccaccgcgccuucaagcgcgagcucaagaccaaggagcccgucaucauguccacccucgagaccguccgcaucuuccucaccgagcagccccucgagggccucgagaagcucuaccaggagccccgcgagcucccccccgaggagcgcgcccagaacgucacccgccuccuccgcaagcaggccgaggaggucaacaccgagugggagaagcucaaccuccacuccgccgacuggcagcgcaagaucgacgagacccucgagcgccuccaggagcuccaggaggccaccgacgagcucgaccucaagcuccgccaggccgaggucaucaagggcuccuggcagcccgucggcgaccuccucaucgacucccuccaggaccaccucgagaaggucaaggcccuccgcggcgagaucgccccccucaaggagaacgucucccacgucaacgaccucgcccgccagcucaccacccucggcauccagcucucccccuacaaccucuccacccucgaggaccucaacacccgcuggaagcuccuccaggucgccgucgaggaccgcguccgccagcuccacgaggcccaccgcgacuucggccccgccucccagcacuuccucuccaccuccguccagggccccugggagcgcgccaucucccccaacaagguccccuacuacaucaaccacgagacccagaccaccugcugggaccaccccaagaugaccgagcucuaccagucccucgccgaccucaacaacguccgcuucuccgccuaccgcaccgccaugaagcuccgccgccuccagaaggcccucugccucgaccuccucucccucuccgccgccugcgacgcccucgaccagcacaaccucaagcagaacgaccagcccauggacauccuccagaucaucaacugccucaccaccaucuacgaccgccucgagcaggagcacaacaaccucgucaacgucccccucugcgucgacaugugccucaacuggcuccucaacgucuacgacaccggccgcaccggccgcauccgcguccucuccuucaagaccggcaucaucucccucugcaaggcccaccucgaggacaaguaccgcuaccucuucaagcaggucgccuccuccaccggcuucugcgaccagcgccgccucggccuccuccuccacgacuccauccagaucccccgccagcucggcgaggucgccuccuucggcggcuccaacaucgagcccuccguccgcuccugcuuccaguucgccaacaacaagcccgagaucgaggccgcccucuuccucgacuggaugcgccucgagccccaguccauggucuggcuccccguccuccaccgcgucgccgccgccgagaccgccaagcaccaggccaagugcaacaucugcaaggagugccccaucaucggcuuccgcuaccgcucccucaagcacuucaacuacgacaucugccaguccugcuucuucuccggccgcgucgccaagggccacaagaugcacuaccccauggucgaguacugcacccccaccaccuccggcgaggacguccgcgacuucgccaagguccucaagaacaaguuccgcaccaagcgcuacuucgccaagcacccccgcaugggcuaccuccccguccagaccguccucgagggcgacaacauggagacccccgucacccucaucaacuucuggcccgucgacuccgcccccgccuccuccccccagcucucccacgacgacacccacucccgcaucgagcacuacgccucccgccucgccgagauggagaacuccaacggcuccuaccucaacgacuccaucucccccaacgaguccaucgacgacgagcaccuccucauccagcacuacugccagucccucaaccaggacuccccccucucccagccccgcucccccgcccagauccucaucucccucgaguccgaggagcgcggcgagcucgagcgcauccucgccgaccucgaggaggagaaccgcaaccuccaggccgaguacgaccgccucaagcagcagcacgagcacaagggccucuccccccuccccuccccccccgagaugaugcccaccuccccccaguccccccgcgacgccgagcucaucgccgaggccaagcuccuccgccagcacaagggccgccucgaggcccgcaugcagauccucgaggaccacaacaagcagcucgagucccagcuccaccgccuccgccagcuccucgagcagccccaggccgaggccaaggucaacggcaccaccgucuccucccccuccaccucccuccagcgcuccgacuccucccagcccaugcuccuccgcgucgucggcucccagaccuccgacuccaugggcgaggaggaccuccucucccccccccaggacaccuccaccggccucgaggaggucauggagcagcucaacaacuccuuccccuccucccgcggccgcaacacccccggcaagcccaugcgcgaggacaccauguga

SEQ ID NO: 42291 - RNA, 2601 nt, Artificial Sequence
  derived and/or modified sequence opt2 from DMGDH__Homo_sapiens__NP_037523
augcuccgccccggcgcccagcuccuccgcggccuccuccuccgcuccugcccccuccagggcucccccggccgcccccgcuccgucugcggccgcgagggcgaggagaagcccccccucuccgccgagacccaguggaaggaccgcgccgagaccgucaucaucggcggcggcugcgucggcgucucccucgccuaccaccucgccaaggccggcaugaaggacgucguccuccucgagaaguccgagcucaccgccggcuccaccuggcacgccgccggccucaccaccuacuuccaccccggcaucaaccucaagaagauccacuacgacuccaucaagcucuacgagaagcucgaggaggagaccggccaggucgucggcuuccaccagcccggcuccauccgccucgccaccacccccguccgcgucgacgaguucaaguaccagaugacccgcaccggcuggcacgccaccgagcaguaccucaucgagcccgagaagauccaggagauguucccccuccucaacaugaacaagguccucgccggccucuacaaccccggcgacggccacaucgaccccuacucccucaccauggcccucgccgccggcgcccgcaagugcggcgcccuccucaaguaccccgcccccgucaccucccucaaggcccgcuccgacggcaccugggacgucgagaccccccagggcuccaugcgcgccaaccgcaucgucaacgccgccggcuucugggcccgcgaggucggcaagaugaucggccucgagcacccccucauccccguccagcaccaguacgucgucaccuccaccaucuccgaggucaaggcccucaagcgcgagcuccccguccuccgcgaccucgagggcuccuacuaccuccgccaggagcgcgacggccuccucuucggccccuacgagucccaggagaagaugaagguccaggacuccugggucaccaacggcgucccccccggcuucggcaaggagcucuucgaguccgaccucgaccgcaucauggagcacaucaaggccgccauggagaugguccccguccucaagaaggccgacaucaucaacgucgucaacggccccaucaccuacucccccgacauccuccccauggucggcccccaccagggcguccgcaacuacugggucgccaucggcuucggcuacggcaucauccacgccggcggcgucggcaaguaccucuccgacuggauccuccacggcgagccccccuucgaccucaucgagcucgaccccaaccgcuacggcaaguggaccaccacccaguacaccgaggccaaggcccgcgaguccuacggcuucaacaacaucgucggcuaccccaaggaggagcgcuucgccggccgccccacccagcgcgucuccggccucuaccagcgccucgaguccaagugcuccaugggcuuccacgccggcugggagcagccccacugguucuacaagcccggccaggacacccaguaccgccccuccuuccgccgcaccaacugguucgagcccgucggcuccgaguacaagcaggucaugcagcgcgucgccgucaccgaccucucccccuucggcaaguucaacaucaagggccaggacuccauccgccuccucgaccaccucuucgccaacgucauccccaaggucggcuucaccaacaucucccacaugcucacccccaagggccgcgucuacgccgagcucaccgucucccaccagucccccggcgaguuccuccucaucaccggcuccggcuccgagcuccacgaccuccgcuggaucgaggaggaggccgucaagggcggcuacgacgucgagaucaagaacaucaccgacgagcucggcguccucggcgucgccggcccccaggcccgcaagguccuccagaagcucaccuccgaggaccucuccgacgacgucuucaaguuccuccagaccaagucccucaaggucuccaacauccccgucaccgccauccgcaucuccuacaccggcgagcucggcugggagcucuaccaccgccgcgaggacuccgucgcccucuacgacgccaucaugaacgccggccaggaggagggcaucgacaacuucggcaccuacgccaugaacgcccuccgccucgagaaggccuuccgcgccuggggccucgagaugaacugcgacaccaacccccucgaggccggccucgaguacuucgucaagcucaacaagcccgccgacuucaucggcaagcaggcccucaagcagaucaaggccaagggccucaagcgccgccucgucugccucacccucgccaccgacgacgucgaccccgagggcaacgaguccaucugguacaacggcaaggucgucggcaacaccaccuccggcuccuacuccuacuccauccagaagucccucgccuucgccuacguccccguccagcucuccgaggucggccagcaggucgaggucgagcuccucggcaagaacuaccccgccgucaucauccaggagccccucguccucaccgagcccacccgcaaccgccuccagaagaagggcggcaaggacaagaccuga

SEQ ID NO: 42292 - RNA, 273 nt, Artificial Sequence
  derived and/or modified sequence opt2 from DMKN__Homo_sapiens__NP_001030593
augaacaugaagcccgccaccgccuccgcccuccuccuccuccuccucggccucgccuggacccagggcucccacggcuggggcgccgacgccuccucccuccagaagcgcgccggccgcgccgaccagaacuacaacuacaaccagcacgccuaccccaccgccuacggcggcaaguacuccgucaagacccccgccaagggcggcgucucccccuccuccuccgccucccgcguccagcccggccuccuccagugggucaaguucugguga

SEQ ID NO: 42293 - RNA, 1494 nt, Artificial Sequence
  derived and/or modified sequence opt2 from DMP1__Homo_sapiens__NP_001073380
augaagaucuccauccuccucauguuccucuggggccucuccugcgcccuccccgucacccgcuaccagaacaacgaguccgaggacuccgaggaguggaagggccaccucgcccaggcccccacccccccccucgccaacgaggaccccuccgacuccacccaguccgaggagggccucggcuccgacgaccaccaguacaucuaccgccucgccggcggcuucucccgcuccaccggcaagggcggcgacgacaaggacgacgacgaggacgacuccggcgacgacaccuucggcgacgacgacuccggccccggccccaaggaccgccaggagggcggcaacucccgccucggcuccgacgaggacuccgacgacaccauccaggccuccgaggaguccgccccccagggccaggacuccgcccaggacaccaccuccgagucccgcgagcucgacaacgaggaccgcgucgacuccaagcccgagggcggcgacuccacccaggaguccgaguccgaggagcacugggucggcggcggcuccgacggcgaguccucccacggcgacggcuccgagcucgacgacgagggcaugcaguccgacgaccccgaguccauccgcuccgagcgcggcaacucccgcaugaacuccgccggcaugaaguccaaggaguccggcgagaacuccgagcaggccaacacccaggacuccggcggcucccagcuccucgagcaccccucccgcaagaucuuccgcaagucccgcaucuccgaggaggacgaccgcuccgagcucgacgacaacaacaccauggaggaggucaaguccgacuccaccgagaacuccaacucccgcgacaccggccucucccagccccgccgcgacuccaagggcgacucccaggaggacuccaaggagaaccucucccaggaggagucccagaacgucgacggccccuccuccgaguccucccaggaggccaaccucuccucccaggagaacuccuccgagucccaggaggaggucgucuccgagucccgcggcgacaaccccgaccccaccaccuccuacgucgaggaccaggaggacuccgacuccuccgaggaggacuccucccacacccucucccacuccaaguccgagucccgcgaggagcaggccgacuccgaguccuccgagucccucaacuucuccgaggagucccccgagucccccgaggacgagaacuccuccucccaggagggccuccagucccacuccuccuccgccgagucccaguccgaggagucccacuccgaggaggacgacuccgacucccaggacuccucccgcuccaaggaggacuccaacuccaccgaguccaaguccuccuccgaggaggacggccagcucaagaacaucgagaucgagucccgcaagcucaccgucgacgccuaccacaacaagcccaucggcgaccaggacgacaacgacugccaggacggcuacuga

SEQ ID NO: 42294 - RNA, 1875 nt, Artificial Sequence
  derived and/or modified sequence opt2 from DMPK__Homo_sapiens__NP_001075029
auguccgccgagguccgccuccgccgccuccagcagcucguccucgaccccggcuuccucggccucgagccccuccucgaccuccuccucggcguccaccaggagcucggcgccuccgagcucgcccaggacaaguacgucgccgacuuccuccagugggccgagcccaucgucguccgccucaaggagguccgccuccagcgcgacgacuucgagauccucaaggucaucggccgcggcgccuucuccgaggucgccgucgucaagaugaagcagaccggccaggucuacgccaugaagaucaugaacaagugggacaugcucaagcgcggcgaggucuccugcuuccgcgaggagcgcgacguccucgucaacggcgaccgccgcuggaucacccagcuccacuucgccuuccaggacgagaacuaccucuaccucgucauggaguacuacgucggcggcgaccuccucacccuccucuccaaguucggcgagcgcauccccgccgagauggcccgcuucuaccucgccgagaucgucauggccaucgacuccguccaccgccucggcuacguccaccgcgacaucaagcccgacaacauccuccucgaccgcugcggccacauccgccucgccgacuucggcuccugccucaagcuccgcgccgacggcaccguccgcucccucgucgccgucggcacccccgacuaccucucccccgagauccuccaggccgucggcggcggccccggcaccggcuccuacggccccgagugcgacuggugggcccucggcgucuucgccuacgagauguucuacggccagacccccuucuacgccgacuccaccgccgagaccuacggcaagaucguccacuacaaggagcaccucucccucccccucgucgacgagggcguccccgaggaggcccgcgacuucauccagcgccuccucugcccccccgagacccgccucggccgcggcggcgccggcgacuuccgcacccaccccuucuucuucggccucgacugggacggccuccgcgacuccgucccccccuucacccccgacuucgagggcgccaccgacaccugcaacuucgaccucgucgaggacggccucaccgccauggagacccucuccgacauccgcgagggcgccccccucggcguccaccuccccuucgucggcuacuccuacuccugcauggcccuccgcgacuccgagguccccggccccacccccauggagcucgaggccgagcagcuccucgagccccacguccaggcccccucccucgagcccuccgucuccccccaggacgagaccgccgaggucgccguccccgccgccguccccgccgccgaggccgaggccgaggucacccuccgcgagcuccaggaggcccucgaggaggagguccucacccgccagucccucucccgcgagauggaggccauccgcaccgacaaccagaacuucgccucccagcuccgcgaggccgaggcccgcaaccgcgaccucgaggcccacguccgccagcuccaggagcgcauggagcuccuccaggccgagggcgccaccgccgucaccggcguccccuccccccgcgccaccgacccccccucccaccucgacggcccccccgccgucgccgucggccagugcccccucgucggccccggccccaugcaccgccgccaccuccuccuccccgcccgcgucccccgccccggccucuccgaggcccucucccuccuccucuucgccgucguccucucccgcgccgccgcccucggcugcaucggccucgucgcccacgccggccagcucaccgccgucuggcgccgccccggcgccgcccgcgcccccuga

SEQ ID NO: 42295 - RNA, 1122 nt, Artificial Sequence
  derived and/or modified sequence opt2 from DMRT1__Homo_sapiens__NP_068770
augcccaacgacgaggccuucuccaagcccuccacccccuccgaggccccccacgcccccggcguccccccccagggccgcgccggcggcuucggcaaggccuccggcgcccucgucggcgccgccuccggcuccuccgccggcggcuccucccgcggcggcggcuccggcuccggcgccuccgaccucggcgccggcuccaagaaguccccccgccuccccaagugcgcccgcugccgcaaccacggcuacgccuccccccucaagggccacaagcgcuucugcauguggcgcgacugccagugcaagaagugcaaccucaucgccgagcgccagcgcgucauggccgcccaggucgcccuccgccgccagcaggcccaggaggaggagcucggcaucucccaccccaucccccuccccuccgccgccgagcuccucgucaagcgcgagaacaacggcuccaaccccugccucaugaccgagugcuccggcaccucccagcccccccccgccuccguccccaccaccgccgccuccgagggccgcauggucauccaggacauccccgccgucaccucccgcggccacgucgagaacacccccgaccucgucuccgacuccaccuacuacuccuccuucuaccagcccucccucuuccccuacuacaacaaccucuacaacugcccccaguacuccauggcccucgccgccgacuccgccuccggcgaggucggcaacccccucggcggcucccccgucaagaacucccuccgcggccuccccggccccuacguccccggccagaccggcaaccaguggcagaugaagaacauggagaaccgccacgccauguccucccaguaccgcaugcacuccuacuaccccccccccuccuaccucggccaguccgucccccaguucuucaccuucgaggacgcccccuccuaccccgaggcccgcgccuccgucuucuccccccccuccucccaggacuccggccucgucucccucuccuccuccucccccaucuccaacaaguccaccaaggccguccucgagugcgagcccgccuccgagcccuccuccuucaccgucacccccgucaucgaggaggacgaguga

SEQ ID NO: 42296 - RNA, 1164 nt, Artificial Sequence
  derived and/or modified sequence opt2 from DMRT2__Homo_sapiens__XP_006716781
auggacaagaagggccucuccggcaagcagaacaacuucgagcgcaaggccgucuaccagcgccagguccgcgcccccucccuccucgccaaguccauccucgagggcuaccgccccauccccgccgagaccuacgucggcggcaccuucccccuccccccccccgucuccgaccgcaugcgcaagcgccgcgccuucgccgacaaggagcucgagaacaucaugcucgagcgcgaguacaaggagcgcgagaugcucgagaccucccaggccgccgcccucuuccuccccaaccgcaugguccccggccccgacuacaacuccuacaaguccgccuacucccccucccccgucgagccccccuccaaggacuucugcaacuuccuccccaccugccucgaccucaccaugcaguacuccggcuccggcaacauggagcucaucuccuccaacgucuccgucgccaccaccuaccgccaguacccccucuccucccgcuuccucgucuggcccaagugcggccccaucuccgacacccuccucuaccagcagugccuccucaacgccaccaccuccguccaggcccucaagcccggcgccuccugggaccucaagggcgcccgcguccaggacggccucuccgccgagcaggacaugaugcccuccaagcucgagggcucccucguccucccccacacccccgagauccagaccacccgcuccgaccuccagggccaccaggccguccccgagcgcuccgccuucucccccccccgccgcaacuucucccccaucgucgacaccgacucccucgccgcccagggccacguccucaccaagaucuccaaggagaacacccgccacccccucccccuccgccacaaccccuuccacucccucuuccagcagacccucaccgacaaguccggccccgagcucaagacccccuucgucaaggaggccuucgaggagacccccaagaagcaccgcgagugccucgucaaggacaaccagaaguacaccuucaccaucgaccgcugcgccaaggaccucuucgucgccaagcaggucggcaccaagcucuccgucaacgagccccucuccuucuccgucgaguccauccucaagcgccccuccuccgccaucacccgcgucucccaguga

SEQ ID NO: 42297 - RNA, 1419 nt, Artificial Sequence
  derived and/or modified sequence opt2 from DMRT3__Homo_sapiens__NP_067063
augaacggcuacggcucccccuaccucuacaugggcggccccgucucccagcccccccgcgccccccuccagcgcacccccaagugcgcccgcugccgcaaccacggcguccucuccuggcucaagggccacaagcgcuacugccgcuucaaggacugcaccugcgagaagugcauccucaucaucgagcgccagcgcgucauggccgcccaggucgcccuccgccgccagcaggccaacgagucccucgagucccucauccccgacucccuccgcgcccuccccggcccccccccccccggcgacgccgucgccgccccccagcccccccccgccucccagcccucccagccccagcccccccgccccgccgccgagcucgccgccgccgccgcccuccgcuggaccgccgagccccagcccggcgcccuccaggcccagcucgccaagcccgaccucaccgaggagcgccucggcgacggcaaguccgccgacaacaccgaggucuucuccgacaaggacaccgaccagcgcuccucccccgacgucgccaaguccaagggcugcuucacccccgagucccccgagaucgucuccgucgaggagggcggcuacgccguccagaagaacggcggcaaccccgagucccgccccgacucccccaagugccacgccgagcagaaccaccuccucaucgagggccccuccggcaccgucucccuccccuucucccucaaggccaaccgccccccccucgagguccucaagaagaucuuccccaaccagaagcccaccguccucgagcucauccucaagggcugcggcggcgaccucgucuccgccgucgagguccuccucuccucccgcuccuccgucaccggcgccgagcgcaccuccgccgagcccgagucccucgcccuccccuccaacggccacaucuucgagcacacccucuccuccuaccccaucuccuccuccaagugguccgucggcuccgccuuccgcguccccgacacccuccgcuucuccgccgacuccuccaacgucguccccuccccccucgccggcccccuccagccccccuucccccagcccccccgcuacccccucaugcuccgcaacacccucgcccgcucccaguccucccccuuccuccccaacgacgucacccucuggaacaccaugacccuccagcagcaguaccagcuccgcucccaguacgucucccccuuccccuccaacuccaccuccgucuuccgcuccucccccguccuccccgcccgcgccaccgaggacccccgcaucuccauccccgacgacggcugccccuucgucuccaagcaguccaucuacaccgaggacgacuacgacgagcgcuccgacuccuccgacucccgcacccucaacaccuccuccuga

SEQ ID NO: 42298 - RNA, 1515 nt, Artificial Sequence
  derived and/or modified sequence opt2 from DMRTA1__Homo_sapiens__NP_071443
auggagcgcucccagugcggcucccgcgaccgcggcgucuccggccgcccccaccucgcccccggccucgucgucgccgccccccccccccccucccccgcccuccccguccccuccggcaugcaggucccccccgccuuccuccgcccccccucccucuuccuccgcgccgccgccgccgccgccgccgccgccgccgccaccuccggcuccggcggcugcccccccgcccccggccucgaguccggcgucggcgccgucggcugcggcuacccccgcacccccaagugcgcccgcugccgcaaccacggcgucgucuccgcccucaagggccacaagcgcuucugccgcuggcgcgacugcgccugcgccaagugcacccucaucgccgagcgccagcgcgucauggccgcccaggucgcccuccgccgccagcaggcccaggaggaguccgaggcccgcggccuccagcgccuccucugcuccggccucuccuggccccccggcggccgcgccuccggcggcggcggccgcgccgagaacccccaguccaccggcggccccgccgccggcgccgcccucggccucggcgcccuccgccaggccuccggcuccgccacccccgccuucgaggucuuccagcaggacuaccccgaggagaagcaggagcagaaggaguccaagugcgaguccugccagaacggccaggaggagcucaucuccaagucccaccagcucuaccucggcuccuccucccgcuccaacggcgucaucggcaagcaguccaucggcuccuccaucuccgaguacuccaacaagcccgacuccauccucuccccccaccccggcgagcaguccggcggcgaggaguccccccgcucccucuccuccuccgaccucgaguccggcaacgaguccgagugggucaaggaccucaccgccaccaaggccucccuccccaccgucuccucccgcccccgcgacccccucgacauccucaccaagaucuuccccaacuaccgccgcucccgccucgagggcauccuccgcuucugcaagggcgacgucguccaggccaucgagcagguccucaacggcaaggagcacaagcccgacaaccgcaaccucgccaacuccgaggagcucgagaacaccgccuuccagcgcgccuccuccuucucccucgccggcaucggcuucggcacccucggcaacaaguccgccuucuccccccuccagaccaccuccgccuccuacggcggcgacuccucccucuacggcgucaacccccgcgucggcaucuccccccuccgccucgccuacuccuccgccggccgcggccucuccggcuucaugucccccuaccucacccccggccucguccccacccuccccuuccgccccgcccucgacuacgccuucuccggcaugauccgcgacuccuccuaccucuccuccaaggacuccaucaccugcggccgccucuacuuccgccccaaccaggacaaccccuga

SEQ ID NO: 42299 - RNA, 2019 nt, Artificial Sequence
  derived and/or modified sequence opt2 from DMTF1__Homo_sapiens__NP_001135798
augaccgccaccaccgaggucgccgacgacgaggucaccgagggcaccgucacccagauccagauccuccagaacgagcagcucgacgagaucuccccccucggcaacgaggaggucuccgccgucucccaggccugguucaccaccaaggaggacaaggacucccucaccaacaagggccacaaguggaagcagggcaugugguccaaggaggagaucgacauccucaugaacaacaucgagcgcuaccucaaggcccgcggcaucaaggacgccaccgagaucaucuucgagauguccaaggacgagcgcaaggacuucuaccgcaccaucgccuggggccucaaccgcccccucuucgccgucuaccgccgcguccuccgcauguacgacgaccgcaaccacgucggcaaguacacccccgaggagaucgagaagcucaaggagcuccgcaucaagcacggcaacgacugggccaccaucggcgccgcccucggccgcuccgccuccuccgucaaggaccgcugccgccucaugaaggacaccugcaacaccggcaaguggaccgaggaggaggagaagcgccucgccgaggucguccacgagcucaccuccaccgagcccggcgacaucgucacccagggcgucuccugggccgccgucgccgagcgcgucggcacccgcuccgagaagcagugccgcuccaaguggcucaacuaccucaacuggaagcaguccggcggcaccgaguggaccaaggaggacgagaucaaccucauccuccgcaucgccgagcucgacgucgccgacgagaacgacaucaacugggaccuccucgccgagggcugguccuccguccgcuccccccaguggcuccgcuccaagugguggaccaucaagcgccagaucgccaaccacaaggacgucuccuuccccguccucaucaagggccucaagcagcuccacgagaaccagaagaacaaccccacccuccucgagaacaaguccggcuccggcguccccaacuccaacaccaacuccuccguccagcacguccagauccgcgucgcccgccucgaggacaacaccgccaucuccuccucccccauggccgcccuccagauccccguccagaucacccacgucuccuccgccgacucccccgccaccgucgacuccgagaccaucacccucaacuccggcacccuccagaccuucgagauccuccccuccuuccaccuccagcccaccggcacccccggcaccuaccuccuccagaccuccuccucccagggccucccccucacccucaccgccucccccaccgucacccucaccgccgccgcccccgccucccccgagcagaucaucguccacgcccucucccccgagcaccuccucaacaccuccgacaacgucaccguccagugccacaccccccgcgucaucauccagaccgucgccaccgaggacaucaccuccuccaucucccaggccgagcucaccgucgacuccgacauccaguccuccgacuuccccgagccccccgacgcccucgaggccgacaccuuccccgacgagauccaccaccccaagaugaccgucgagcccuccuucaacgacgcccacgucuccaaguucuccgaccagaacuccaccgagcucaugaacuccgucaugguccgcaccgaggaggagaucuccgacaccgaccucaagcaggaggagucccccuccgaccucgccuccgccuacgucaccgagggccucgagucccccaccaucgaggagcaggucgaccagaccaucgacgacgagaccauccucaucguccccuccccccacggcuucauccaggccuccgacgucaucgacaccgaguccguccucccccucaccacccucaccgaccccauccuccagcaccaccaggaggaguccaacaucaucggcuccucccucggcucccccgucuccgaggacuccaaggacgucgaggaccucgucaacugccacuga

SEQ ID NO: 42300 - RNA, 1077 nt, Artificial Sequence
  derived and/or modified sequence opt2 from DMTN__Homo_sapiens__NP_001107611
auggagcgccuccagaaggccaagauggacaaccagguccucggcuacaaggaccucgccgccauccccaaggacaaggccauccucgacaucgagcgccccgaccucaugaucuacgagccccacuucaccuacucccuccucgagcacgucgagcucccccgcucccgcgagcgcucccucucccccaaguccaccucccccccccccucccccgaggucugggccgacucccgcucccccggcaucaucucccaggccuccgccccccgcaccaccggcaccccccgcaccucccucccccacuuccaccaccccgagaccucccgccccgacuccaacaucuacaagaagccccccaucuacaagcagcgcgaguccgucggcggcuccccccagaccaagcaccucaucgaggaccucaucaucgaguccuccaaguuccccgccgcccagccccccgaccccaaccagcccgccaagaucgagaccgacuacuggcccugcccccccucccucgccgucgucgagaccgaguggcgcaagcgcaaggccucccgccgcggcgccgaggaggaggaggaggaggaggacgacgacuccggcgaggagaugaaggcccuccgcgagcgccagcgcgaggagcucuccaaggucaccuccaaccucggcaagaugauccucaaggaggagauggagaagucccuccccauccgccgcaagacccgcucccuccccgaccgcacccccuuccacaccucccuccaccagggcaccuccaaguccuccucccuccccgccuacggccgcaccacccucucccgccuccaguccaccgaguucucccccuccggcuccgagaccggcucccccggccuccagaucuaccccuacgagaugcucgucgucaccaacaagggccgcaccaagcucccccccggcgucgaccgcaugcgccucgagcgccaccucuccgccgaggacuucucccgcgucuucgccaugucccccgaggaguucggcaagcucgcccucuggaagcgcaacgagcucaagaagaaggccucccucuucuga

SEQ ID NO: 42301 - RNA, 2025 nt, Artificial Sequence
  derived and/or modified sequence opt2 from DMWD__Homo_sapiens__NP_004934
auggccgccggcggcgccgagggcggcuccggccccggcgccgccaugggcgacugcgccgagaucaagucccaguuccgcacccgcgagggcuucuacaagcuccuccccggcgacggcgccgcccgccgcuccggccccgccuccgcccagacccccguccccccccagcccccccagcccccccccggccccgccuccgccuccggccccggcgccgccggccccgccuccucccccccccccgccggccccggccccggccccgcccuccccgccguccgccucucccucguccgccucggcgagcccgacuccgccggcgccggcgagccccccgccacccccgccggccucggcuccggcggcgaccgcgucugcuucaaccucggccgcgagcucuacuucuaccccggcugcugccgccgcggcucccagcgcuccaucgaccucaacaagcccaucgacaagcgcaucuacaagggcacccagcccaccugccacgacuucaaccaguucaccgccgccaccgagaccaucucccuccucgucggcuucuccgccggccagguccaguaccucgaccucaucaagaaggacaccuccaagcucuucaacgaggagcgccucaucgacaagaccaaggucaccuaccucaaguggcuccccgaguccgagucccucuuccucgccucccacgccuccggccaccucuaccucuacaacgucucccaccccugcgccuccgcccccccccaguacucccuccucaagcagggcgagggcuucuccgucuacgccgccaaguccaaggccccccgcaacccccucgccaagugggccgucggcgagggcccccucaacgaguucgccuucucccccgacggccgccaccucgccugcgucucccaggacggcugccuccgcgucuuccacuucgacuccaugcuccuccgcggccucaugaaguccuacuucggcggccuccucugcgucugcuggucccccgacggccgcuacgucgucaccggcggcgaggacgaccucgucaccgucugguccuucaccgagggccgcgucgucgcccgcggccacggccacaaguccugggucaacgccgucgccuucgaccccuacaccacccgcgccgaggaggccgccaccgccgccggcgccgacggcgagcgcuccggcgaggaggaggaggaggagcccgaggccgccggcaccggcuccgccggcggcgccccccucuccccccuccccaaggccggcuccaucaccuaccgcuucggcuccgccggccaggacacccaguucugccucugggaccucaccgaggacguccucuacccccaccccccccucgcccgcacccgcacccuccccggcacccccggcaccaccccccccgccgccuccuccucccgcggcggcgagcccggccccggcccccucccccgcucccucucccgcuccaacucccucccccaccccgccggcggcggcaaggccggcggccccggcgucgccgccgagcccggcacccccuucuccaucggccgcuucgccacccucacccuccaggagcgccgcgaccgcggcgccgagaaggagcacaagcgcuaccacucccucggcaacaucucccgcggcggcuccggcggcuccggcuccggcggcgagaagcccuccggccccgucccccgcucccgccucgaccccgccaagguccucggcaccgcccucugcccccgcauccacgaggucccccuccucgagccccucgucugcaagaagaucgcccaggagcgccucaccguccuccucuuccucgaggacugcaucaucaccgccugccaggagggccucaucugcaccugggcccgccccggcaaggccuucaccgacgaggagaccgaggcccagaccggcgagggcuccuggccccgcucccccuccaaguccgucgucgagggcaucuccucccagcccggcaacucccccuccggcaccgucgucuga

SEQ ID NO: 42302 - RNA, 9147 nt, Artificial Sequence
  derived and/or modified sequence opt2 from DMXL1__Homo_sapiens__NP_001277250
augaaccuccaccagguccucaccggcgccgucaaccccggcgaccacugcuucuccgucggcuccaucggcgaccagcgcuucaccgccuacgccuccggcugcgacaucgucauccucggcuccgacuucgagcgccuccagaucauccccggcgccaagcacggcaacauccaggucggcugcgucgacugcuccaugcagcagggcaagaucgccgccuccuacggcaacgucaucuccaucuucgagcccgucaaccuccccaagcagaagaagaaccucgagcucuacucccaguggcagaaguccggccaguucuuccucgaguccaucgcccacaacaucaccugggaccccaccggcucccgccuccucaccggcuccuccuaccuccagcucugguccaacaccaaccucgagaagcccaccgaggacgagaaccucaacaagaccgaccucaacuucggcgacuggaagugcaucuggcacugcaagaccgccucccagguccaccucaugaaguucucccccgacggcgaguucuucgccaccgccggcaaggacgacugccuccucaaggucugguacaacgucgagaacuggcgcaccgccgucaccucccccgacggcuccuccgagaagcagucccagggcgagaucgacuucuccuucgucuaccucgcccacccccgcgccgucaacggcuucuccuggcgcaagaccuccaaguacaugccccgcgccuccgucugcaacguccuccucaccugcugcaaggacaacgucugccgccucugggucgagaccuuccuccccaacgacugccuccucuacggcggcgacugcucccacuggaccgaguccaucaaccucaccaacaacuucaagcgcaacgccuccuccaaggagcgcguccagaacgcccucgaggucaaccuccgccacuuccgccgcggccgccgccgcucccucgcccucgucgcccacaccggcuaccucccccaccagcaggacccccaccacguccaccgcaacaccccccuccacgccaacgcccucugccacuuccacaucgccgccuccaucaaccccgccaccgacaucccccuccuccccuccaucaccucccucucccucaacgagaacgaggagaagaccggccccuucgucguccacuggcucaacaacaaggagcuccacuucacccucuccauggaggucuuccuccagcagcuccgcaaguccuucgagcagcccuccuccgaggccuccgucgaggacuccaaccaggccgacgucaaguccgacgaggagaccgacgacggcgucgacgaccucaagaucaaccccgagaagaaggagcucggcugcgacaagaugguccccaacuccuccuucaccucccucuccuccgccgccaucgaccaccagaucgagguccuccucuccgagugguccaagaacgccgacaugcucuucuccauccaccccauggacggcucccuccucgucuggcacgucgacuggcucgacgaguaccagcccggcauguuccgccagguccaggucuccuucgucucccgcauccccgucgccuuccccaccggcgacgccaacucccucugcaaguccaucaugauguacgccugcaccaagaacgucgaccucgccauccagcagggcaagcagaagcccuccggccucacccgcuccaccuccaugcucaucuccuccggccacaacaaguccuccaacucccucaagcucuccaucuucacccccaacgucaugaugaucuccaagcacgccgacggcucccucaaccaguggcucgucuccuucgccgaggaguccgccuucuccaccguccucuccaucucccacaagucccgcuacugcggccaccgcuuccaccucaacgaccucgccugccacuccguccucccccuccuccucaccaccucccaccacaacgcccuccgcacccccgacgucgacaaccccgagcagcccuucgacgcccucaacaucgaggagugcucccucacccagcagaacaaguccaccgucgacgucgccuuccaggaccccuccgccgucuacuccgagcucauccucuggcgcgucgaccccgucggcccccucuccuucuccggcggcgucuccgagcucgcccgcaucaacucccuccacgucuccgccuucuccaacgucgccuggcuccccacccucauccccuccuacugccucggcgccuacugcaacucccccuccgccugcuucgucgccuccgacggccaguaccuccgccucuacgaggccgucaucgacgccaagaagcuccucuccgagcucuccaaccccgagaucuccaaguacgucggcgaggucuucaacaucgucucccagcaguccaccgcccgccccggcugcaucaucgcccucgaccccaucaccaagcuccacggccgcaagacccagcuccuccacgucuucgaggaggacuucauccucaacaaccucgagaagaagucccucggcaaggacuccauccucuccaacgccggcuccucccccaacggcuucuccgagaaguucuaccucaucgucaucgagugcacccaggacaaccgcucccuccuccacauguggaaccuccaccucaaguccauccccgucucccucgacgagaaggucgacaccaagcucuccgaggccgucuggcagcccgaggagcacuacuccuccucccccgagaagauccucucccccuucucccagaaguaccaggccugccgcgccaaccuccaguccaccucccgccucacccucuucuccgagauggucuacucccaggagcuccaccuccccgagggcgucgagaucaucuccaucaagcccuccgccggccaccucuccuccuccuccaucuaccccgccugcuccgcccccuaccuccucgccaccuccugcuccgacgagaagguccgcuucuggcgcugccgcgucaccgacggcgaguccgccaccuccaagaacggcaagaucgaccucgccuacaucugggaggaguggccccuccucaucgaggacggccuccaguccaacuccuccaucaccguccccggccgccccgucgaggucuccugcgcccacaccaaccgccucgccgucgccuacaagcagcccgccuccaacucccgcuccucccaggacuucgucaugcacgucuccaucuucgagugcgaguccaccggcggcuccugcuggguccucgagcagaccauccaccucgacgagcucuccaccguccucgacuccggcaucuccgucgacuccaaccucgucgccuacaacaagcaggacauguaccucuccuccaaggagaacaucaccuccaacaccaagcaccucguccaccucgacuggaugucccgcgaggacggcucccacauccucaccgucggcaucggcuccaagcucuucauguacggcccccucgccggcaagguccaggaccagaccggcaaggagacccucgccuucccccucugggaguccaccaaggucgucccccucuccaaguucguccuccuccgcuccgucgaccucgucuccuccgucgacggcuccccccccuuccccgucucccucuccuggguccgcgacggcauccucgucgucggcauggacugcgagaugcacgucuacugccaguggcagcccuccuccaagcaggagcccgucaucaccgacuccuacuccggcuccacccccuccaucaccucccucaucaagcaguccaacuccuccuccggccuccacccccccaagaagacccucacccgcuccaugaccucccucgcccagaagaucugcggcaagaagaccgccuucgaccccuccgucgacauggaggacuccggccucuucgaggccgcccacguccucucccccacccucccccaguaccacccccuccagcuccucgagcucauggaccucggcaagguccgccgcgccaaggccauccucucccaccucgucaagugcaucgccggcgaggucgucgcccucaacgaggccgaguccaaccacgagcgccgccuccgcucccucaccaucuccgccuccggcuccaccacccgcgacccccaggccuucaacaaggccgagaacaccgacuacaccgagaucgacuccguccccccccucccccucuacgcccuccucgccgccgacgacgacuccugcuacuccucccucgagaaguccuccaacgaguccacccucuccaaguccaaccagcucuccaaggaguccuacgacgagcucuuccagacccagcuccucaugaccgacacccacaugcucgagaccgacgaggagaacaccaagccccgcgucaucgaccucucccaguacucccccaccuacuucggccccgagcacgcccagguccucuccggccaccuccuccacuccucccuccccggccucucccgcauggagcagaugucccucauggcccucgccgacaccaucgccaccaccuccaccgacaucggcgagucccgcgaccgcucccagggcggcgagacccucgacgagugcggccucaaguuccuccucgccguccgccuccacaccuuccucaccaccucccuccccgccuaccgcgcccagcuccuccaccagggccucuccaccucccacuucgccugggccuuccacuccgucgccgaggaggagcuccucaacaugcuccccgccaugcagaaggacgaccccaccugguccgagcuccgcgccaugggcgucggcugguggguccgcaacacccgcauccuccgcaagugcaucgagaaggucgccaaggccgccuucuaccgcaagaacgacccccucgacgccgccaucuucuaccucgccaugaagaagaaggccgucaucuggggccucuaccgcgccgagaagaacacccgcaugacccaguucuucggccacaacuucgaggacgagcgcuggcgcaaggccgcccucaagaacgccuucucccuccucggcaagcagcgcuucgagcacuccgccgccuucuuccuccucgccggcugccuccgcgacgccaucgaggucugccucgagaagcucaacgacauccagcucgcccucgucaucgcccgccucuacgaguccgaguucgacaccuccgccgccuacaaguccauccuccgcaagaagguccucggcaucgacucccccgucuccgagcucugcucccucaacaucaacaugcaccacgaccccuuccuccgcuccauggccuacuggauccucgaggacuacuccggcgcccucgagacccucaucaagcagcccauccgcgagaacgacgaccagguccucuccgccuccaaccccaccgucuucaacuucuacaacuaccuccgcacccacccccuccuccuccgccgccacuucggcuccuccgacaccuucuccacccacaugucccucaccggcaaguccggccucgccggcaccaucaaccucuccgagcgccgccucuucuucaccaccgccuccgcccaccucaaggccggcugccccaugcucgcccucgagguccucuccaagaugcccaaggucaucaagaagacccgccccuucuaccgcgccuccuccuuccucgacaccuccaaggacugcucccccuccuccccccucaagcucgacgcccgcgaggacaaguccuccgccgucgacuggucccagucccucaucaacggcuucggcuccuccuccgagggcuccuccgagaagcaguccaacuccacccucuccuucgacuggucccagcccuccgucgucuuccaggacgacucccucgagcucaagugggacuccgacaacgacgaggagaacgaggacguccccaucuccaugaaggagcucaagccccuccagcgcaagaccgacaagaagcucgacgacaucuccuccaacuacaccgaguccuucuccacccucgacgagaacgaccuccucaaccccuccgaggacaucaucgccguccagcucaaguuccgcgccugccucaagauccucaccgucgagcuccgcacccucuccaccggcuacgagaucgacggcggcaagcuccgcuaccagcucuaccacuggcucgagaaggaggucaucgcccuccagcgcaccugcgacuucugcuccgacgccgaggagcuccaguccgccuucggccgcaacgaggacgaguucggccucaacgaggacgccgaggaccucccccaccagaccaaggucaagcagcuccgcgagaacuuccaggagaagcgccaguggcuccucaaguaccagucccuccuccgcauguuccucuccuacugcauccuccacggcucccacggcggcggccucgccuccguccgcauggagcucauccuccuccuccaggagucccagcaggagaccuccgagccccucuucuccuccccccucuccgagcagaccuccgucccccuccucuucgccugcaccgccaacgccaagaccgucgucgccaacccccuccuccaccucuccaaccucacccacgacauccuccacgccaucaucaacuucgacucccccccccaccccgacauccaguccaacaaggucuacgucaugcacacccucgccgccucccucuccgccugcaucuaccagugccucugcggcucccacaacuacuccuccuuccagaccaaccaguucaccggcauggucuaccagaccguccuccucccccaccgccccucccucaagaccggcucccucgacgaggcccucacccccaacaccucccccgcccaguggcccggcaucaccugccucauccgccuccucaacuccuccggcgaggaggcccaguccggccucaccguccuccucugcgagauccucaccgccgucuaccucucccucuucauccacggccucgccacccacuccuccaacgagcucuuccgcaucgucgcccacccccucaacgagaagaugugguccgccgucuucggcggcggcgcccacguccccuccaaggagcagacccacuccaagacccuccccgucuccucccucgucgaggagggcgagaagcagaacaagcgcuuccgccccuccaagauguccugccgcgaguccgccccccucacccccuccuccgcccccgucucccaggagucccucgccgucaaggagaaguucaucccccccgagcucuccaucugggacuacuucaucgccaagcccuuccuccccuccucccagucccgcgccgaguacgacuccgaggagucccucggcuccgacgacgacgacaacgacgacgacgacgacguccucgccuccgacuuccaccuccaggagcacuccaacuccaacuccuacuccuggucccucaugcgccucgccaugguccagcucguccucaacaaccucaagaccuucuaccccuucgccggccacgaccucgccgagcuccccgucuccuccccccucugccacgccguccucaagacccuccagugcugggagcagguccuccuccgccgccucgagauccacggcggccccccccagaacuacaucgccucccacaccgccgaggagucccucuccgccggccccgccauccuccgccacaaggcccuccucgagcccaccaacacccccuucaaguccaagcaccaccucgcccucuccgucaagcgccucuggcaguaccucgucaagcaggaggagauccaggagaccuucaucaagaacaucuucaccaagaagcgcugccucaacgagucccucgaggacaacuccgagaccaucaagaacuccaugauggaggagcccaacaucaacaagaucgaggccgaccucggcuaccccggcggcaaggcccgcaucauccacaaggaguccgacaucaucaccgccuucgccgucaacaaggccaaccgcaacugcaucgccaucgccuccucccacgacguccaggagcucgacgucuccggcauccucgccacccaggucuacaccugggucgacgacgacaucgaggucgagaccaagggcuccgaggacuuccucgucauccacgcccgcgacgaccucaccgccguccagggcaccacccccuacacccacuccaaccccggcacccccaucaacaugcccuggcucggcuccacccagaccggccgcggcgccuccgucaugaucaagaaggccaucaacaacguccgccgcaugaccucccaccccacccuccccuacuaccucaccggcgcccaggacggcuccguccgcauguucgaguggggccacucccagcagaucaccugcuuccgcuccggcggcaacucccgcgucacccgcaugcgcuucaacuaccagggcaacaaguucggcaucgucgacgccgacggcuaccucucccucuaccagaccaacuggaagugcugccccgucaccggcuccaugcccaagcccuaccucaccuggcagugccacaacaagaccgccaacgacuucgucuucgucuccuccuccucccucaucgccaccgccggccucuccaccgacaaccgcaacgucugccucugggacacccucgucgcccccgccaacucccucguccacgccuucaccugccacgacuccggcgccaccguccucgccuacgcccccaagcaccagcuccucaucuccggcggccgcaagggcuucaccuacgucuucgaccucugccagcgccagcagcgccagcucuuccagucccacgacucccccgucaaggccgucgccgucgaccccaccgaggaguacuucgucaccggcuccgccgagggcaacaucaagaucuggucccucuccaccuucggccuccuccacaccuucgucuccgagcacgcccgccaguccaucuuccgcaacaucggcaccggcgucaugcagaucgagaccggccccgccaaccacaucuucuccugcggcgccgacggcaccaugaagaugcgcauccuccccgaccaguucuccccccucaacgagguccucaagaacgacgucaaguucaugcucuga

SEQ ID NO: 42303 - RNA, 9114 nt, Artificial Sequence
  derived and/or modified sequence opt2 from DMXL2__Homo_sapiens__NP_001167587
augcaccuccaccagguccucaccggcgccgucaaccccggcgacaacugcuacuccgucggcuccgucggcgacguccccuucaccgccuacggcuccggcugcgacaucgucauccucgccaacgacuucgagugcguccagaucauccccggcgccaagcacggcaacauccaggucuccugcgucgagugcuccaaccagcagggccgcaucgccgccuccuacggcaacgccgucugcaucuucgagccccucggcaucaacucccacaagcgcaacugccagcucaagugccaguggcucaagaccggccaguucuuccucuccuccgucaccuacaaccucgccugggacccccaggacaaccgccuccucaccgccaccgacuccauccagcucugggccccccccggcgacgacauccucgaggaggaggaggagaucgacaacaccgucccccccguccucaacgacuggaagugcgucuggcagugcaagaccuccgucuccguccaccucauggaguggucccccgacggcgaguacuucgccaccgccggcaaggacgacugccuccucaaggucugguaccccaugaccggcuggaaguccuccaucaucccccaggaccaccacgaggucaagcgccgccaguccuccacccaguucuccuucgucuaccucgcccacccccgcgccgucaccggcuucuccuggcgcaagaccuccaaguacaugccccgcggcuccgucugcaacguccuccucaccuccugccacgacggcgucugccgccucugggccgagacccuccuccccgaggacugccuccucggcgagcagaucugcgagaccaccaccuccuccaucgccuccucccucucccacgccggccgccacaaggaccgcauccagcacgcccucgagaccauccaccaccucaagaaccuccgcaagggccagcgccgcuccuccguccucgucacccacgccgagcucaugcccgaccagaccgccaugcacgagguccagcgccacaucucccaccacgccaacgcccucugccacuuccacaucgccgccuccaucaaccccgccaccgacauccccaacguccucgucggcaccgccuucaacgucgacgacggcaacggcggcuucgucguccacuggcucaacaacaaggaguuccacuucaccuccuccaccgaggucuucaugcaccagcuccgcaagcucuccgacaagcaggucgaccacgagaacgacgacgccgaccgcgaggacgaggagcacucccaggaggaccgcgagcgcggccuccacaugaagcucgaccacgaccucucccucgaccgcgaguccgaggccggcaccggcuccuccgagcacgaggacggcgagcgcgagggcuccccccgcaccuacucccgccucuccguccccaugccccuccccaccguccuccucgaccgcaagaucgagacccuccucaccgaguggaacaagaaccccgacaugcucuucaccauccaccccgucgacggcaccuuccucgucuggcacgucaaguaccucgacgaguacaaccccggcaucuuccgccagguccaggucuccuucuccucccgcauccccgucgccuuccccuccggcgacgccuccucccucuccaagaacaucaugauguacgccugcaucaacgccaccaaggacucccaccacacccuccuccaccaggagggcauguccgucggcuccccccacggcucccagccccacucccgcucccacuccacccacaugaacauccucgcccccaccgucaugaugaucuccaagcacaucgacggcucccucaaccagugggccgucaccuucgccgacaaguccgccuucaccaccguccucaccgucucccacaaguuccgcuacugcggccaccgcuuccaccucaacgaccucgccugccacuccguccucccccuccuccucaccuccucccaccacaacgcccuccucacccccgagcucgacugccagugggacuccgacaacaagcucucccgccucauggaccccgucaagcacaucaagggcuccuccaagcagccccuccgcaacgccgccacccgcaccuuccacgaccccaacgccaucuacuccgagcucauccucuggcgcgucgaccccaucggcccccucuccuacaccggcggcgucuccgagcucgcccgcaucaacucccuccacaccuccgccuucuccaacgucgccuggcuccccacccucauccccuccuacugccucggcaccuacugcaacuccgccuccgccugcuucgucgccuccgacggcaagaaccuccgccucuaccaggccgucgucgacgcccgcaagcuccucgacgagcucuccgaccccgaguccuccaagcucaucggcgaggucuucaacaucgucucccagcaguccaccgcccgccccggcugcaucaucgagcucgacgccaucaccaaccagugcggcuccaacacccagcuccuccacgucuuccaggaggacuucaucaucggcuacaagccccacaaggaggacauggagaagaaggagaccgagaucuucuuccagcccucccagggcuaccgccccccccccuucuccgagaaguucuuccucgucgucaucgagaaggacuccaacaacaacuccauccuccacauguggcaccuccaccucaaguccguccaggccugccucgccaaggccuccgagggcgccuccuccgagucccuccucuccguccccggccagaagaacgucgacuccucccccgagaccucccccuccgucucccccaugccccacuccuccuccaucgccaaccuccagaccgccuccaagcucauccucuccucccgccucgucuacucccagccccucgaccuccccgaguccgucgaggucauccgcgccacccccuccgccggccaccucuccuccuccuccaucuaccccgucugccucgcccccuaccucgucgucaccaccugcuccgacaacaagguccgcuucuggaagugcugcauggaggccaaccccgagugcaacaaguccgacgagaaggagaucuaccacuggaagcgcuggccccucaugaacgacgagggcgaggacaacuccuccaccgucuccaucgucggccgccccgucgccgucuccugcuccuacaccggccgccucgccgucgccuacaagcagcccauccaccacaacggcuucgucuccaaggaguucuccaugcacgucugcaucuucgagugcgaguccaccggcggcuccgaguggguccucgagcagaccauccaccucgacgaccucgucaaggucggcuccguccucgacucccgcgucuccgucgacuccaaccucuucgucuacuccaaguccgacgcccuccucuccaaggaccgcuaccucauccccaacaucaagcaccucguccaccucgacugggucuccaaggaggacggcucccacauccucaccgucggcgucggcgccaacaucuucauguacggccgccucuccggcaucgucaccgagcagaccaacuccaaggacggcgucgccgucaucacccucccccucggcggcuccaucaagcagggcgucaagucccgcuggguccuccuccgcuccaucgaccucgucuccuccgucgacggcacccccucccuccccgucucccucuccuggguccgcgacggcauccucgucgucggcauggacugcgagaugcacgucuacgcccaguggaagcacgccgucaaguucggcgacaccgaggccgacuccuccaacgccgaggaggccgccaugcaggaccacuccaccuucaaguccaacaugcucgcccgcaaguccgucgucgagggcaccgccaucuccgacgacgucuucugcucccccaccgucauccaggacggcggccucuucgaggccgcccacguccucucccccacccucccccaguaccaccccacccagcuccucgagcucauggaccucggcaagguccgccgcgccaaggccauccucucccaccucgucaagugcaucgccggcgaggucgccaucguccgcgaccccgacgccggcgagggcaccaagcgccaccucucccgcaccaucuccgucuccggcuccaccgccaaggagaccgucaccgucggcaaggacggcacccgcgacuacaccgagaucgacuccauccccccccucccccucuacgcccuccucgccgccgaccaggacaccuccuaccgcaucuccgaggaguccaccaagaucccccaguccuacgaggaccagaccgucucccagcccgaggaccaguacuccgagcucuuccagauccaggacauccccaccgacgacaucgaccucgagcccgagaagcgcgagaacaaguccaaggucaucaaccucucccaguacggccccgccuacuucggccaggagcacgcccgcguccucuccucccaccucaugcacuccucccuccccggccucacccgccucgagcagauguuccucgucgcccucgccgacaccgucgccaccaccuccaccgagcucgacgagucccgcgacaaguccugcuccggccgcgacacccucgacgagugcggccuccgcuaccuccucgccaugcgccuccacaccugccuccucaccucccuccccccccucuaccgcguccagcuccuccaccagggcgucuccaccugccacuucgccugggccuuccacuccgaggccgaggaggagcucaucaacaugauccccgccauccagcgcggcgacccccagugguccgagcuccgcgccaugggcaucggcugguggguccgcaacaucaacacccuccgccgcugcaucgagaaggucgccaaggccuccuuccagcgcaacaacgacgcccucgacgccgcccucuucuaccucuccaugaagaagaaggccgucgucuggggccucuuccgcucccagcacgacgagaagaugaccaccuucuucucccacaacuucaacgaggaccgcuggcgcaaggccgcccucaagaacgccuucucccuccucggcaagcagcgcuucgagcaguccgccgccuucuuccuccucgccggcucccucaaggacgccaucgaggucugccucgagaagauggaggacauccagcucgccauggucaucgcccgccucuacgaguccgaguucgagaccuccuccaccuacaucuccauccucaaccagaagauccucggcugccagaaggacggcuccggcuucuccugcaagcgccuccaccccgaccccuuccuccgcucccucgccuacugggucaugaaggacuacacccgcgcccucgacacccuccucgagcagacccccaaggaggacgacgagcaccaggucaucaucaaguccugcaaccccgucgccuucuccuucuacaacuaccuccgcacccacccccuccucauccgccgcaaccucgccucccccgagggcacccucgccacccucggccucaagaccgagaagaacuucgucgacaagaucaaccucaucgagcgcaagcucuucuucaccaccgccaacgcccacuucaaggucggcugccccguccucgcccucgagguccucuccaagauccccaaggucaccaagaccuccgcccucuccgccaagaaggaccagcccgacuucaucucccaccgcauggacgacguccccucccacuccaaggcccucuccgacggcaacggcuccuccggcaucgagugguccaacgucaccuccucccaguacgacuggucccagcccaucgucaaggucgacgaggagccccucaaccucgacuggggcgaggaccacgacuccgcccucgacgaggaggaggacgacgccgucggccucgucaugaaguccaccgacgcccgcgagaaggacaagcaguccgaccagaaggccuccgaccccaacaugcuccucaccccccaggaggaggacgaccccgagggcgacaccgaggucgacgucaucgccgagcagcucaaguuccgcgccugccucaagauccucaugaccgagcuccgcacccucgccaccggcuacgaggucgacggcggcaagcuccgcuuccagcucuacaacuggcucgagaaggagaucgccgcccuccacgagaucugcaaccacgaguccgucaucaaggaguacuccuccaagaccuacuccaaggucgaguccgaccuccucgaccaggaggagauggucgacaagcccgacaucggcuccuacgagcgccaccagaucgagcgccgccgccuccaggccaagcgcgagcacgccgagcgccgcaaguccuggcuccagaagaaccaggaccuccuccgcgucuuccucuccuacugcucccuccacggcgcccagggcggcggccucgccuccguccgcauggagcucaaguuccuccuccaggagucccagcaggagaccaccgucaagcagcuccaguccccccucccccuccccaccacccucccccuccucuccgccuccaucgccuccaccaagaccgucaucgccaaccccguccucuaccucaacaaccacauccacgacauccucuacaccaucguccagaugaagacccccccccaccccuccaucgaggacgucaagguccacacccuccacucccucgccgccucccucuccgccuccaucuaccaggcccucugcgacucccacuccuacuccucccagaccgagggcaaccaguucaccggcauggccuaccagggccuccuccucuccgaccgccgccgccuccgcaccgaguccaucgaggagcacgccacccccaacuccucccccgcccaguggcccggcgucuccucccucaucaaccuccucuccuccgcccaggacgaggaccagcccaagcucaacauccuccucugcgaggccgucgucgccgucuaccucucccuccucauccacgcccucgccaccaacuccuccuccgagcucuuccgccucgccgcccacccccucaacaaccgcaugugggccgccgucuucggcggcggcgucaagcucgucgucaagccccgccgccaguccgagaacaucuccgccccccccguccucuccgaggacaucgacaagcaccgccgccgcuucaacaugcgcaugcucguccccggccgccccgucaaggacgccacccccccccccguccccgccgagcgccccuccuacaaggagaaguucaucccccccgagcucuccaugugggacuacuucgucgccaagcccuuccucccccucuccgacuccggcgucaucuacgacuccgacgaguccauccacuccgacgaggaggacgacgccuucuucuccgacacccagauccaggagcaccaggaccccaacuccuacuccugggcccuccuccaccucaccauggucaagcucgcccuccacaacgucaagaacuucuuccccaucgccggccucgaguucuccgagcuccccgucaccuccccccucggcaucgccgucaucaagaaccucgagaacugggagcagauccuccaggagaagauggaccaguucgagggccccccccccaacuacaucaacaccuaccccaccgaccucuccgucggcgccggccccgccauccuccgcaacaaggccaugcucgagcccgagaacacccccuucaagucccgcgacuccuccgccuuccccgucaagcgccucuggcacuuccucgucaagcaggagguccuccaggagaccuucauccgcuacaucuucaccaagaagcgcaagcaguccgaggucgaggccgaccucggcuaccccggcggcaaggccaaggucauccacaaggaguccgacaugaucauggccuucuccgucaacaaggccaacugcaacgagaucguccucgccuccacccacgacguccaggagcucgacgucaccucccuccucgccugccaguccuacaucuggaucggcgaggaguacgaccgcgaguccaaguccuccgacgacgucgacuaccgcggcuccaccaccacccucuaccagcccuccgccaccuccuacuccgccucccagguccacccccccuccucccuccccuggcucggcaccggccagaccuccaccggcgccuccguccucaugaagcgcaaccuccacaacgucaagcgcaugaccucccaccccguccaccaguacuaccucaccggcgcccaggacggcuccguccgcauguucgaguggacccgcccccagcagcucgucugcuuccgccaggccggcaacgcccgcgucacccgccucuacuucaacucccagggcaacaagugcggcgucgccgacggcgagggcuuccucuccaucuggcaggucaaccagaccgccuccaaccccaagcccuacauguccuggcagugccacuccaaggccaccuccgacuucgccuucaucaccuccuccucccucgucgccaccuccggccacuccaacgacaaccgcaacgucugccucugggacacccucaucucccccggcaacucccucauccacggcuucaccugccacgaccacggcgccaccguccuccaguacgcccccaagcagcagcuccucaucuccggcggccgcaagggccacgucugcaucuucgacauccgccagcgccagcucauccacaccuuccaggcccacgacuccgccaucaaggcccucgcccucgaccccuacgaggaguacuucaccaccggcuccgccgagggcaacaucaaggucuggcgccucaccggccacggccucauccacuccuucaaguccgagcacgccaagcaguccaucuuccgcaacaucggcgccggcgucaugcagaucgacaucauccagggcaaccgccucuucuccugcggcgccgacggcacccucaagacccgcguccuccccaacgccuucaacauccccaaccgcauccucgacauccucuga

SEQ ID NO: 42304 - RNA, 3183 nt, Artificial Sequence
  derived and/or modified sequence opt2 from DNA2__Homo_sapiens__NP_001073918
auggagcagcucaacgagcucgagcuccucauggagaaguccuucugggaggaggccgagcuccccgccgagcucuuccagaagaaggucgucgccuccuucccccgcaccguccucuccaccggcauggacaaccgcuaccucguccucgccgucaacaccguccagaacaaggagggcaacugcgagaagcgccucgucaucaccgccucccagucccucgagaacaaggagcucugcauccuccgcaacgacuggugcuccguccccgucgagcccggcgacaucauccaccucgagggcgacugcaccuccgacaccuggaucaucgacaaggacuucggcuaccucauccucuaccccgacaugcucaucuccggcaccuccaucgccuccuccauccgcugcaugcgccgcgccguccucuccgagaccuuccgcuccuccgaccccgccacccgccagaugcucaucggcaccguccuccacgaggucuuccagaaggccaucaacaacuccuucgcccccgagaagcuccaggagcucgccuuccagaccauccaggagauccgccaccucaaggagauguaccgccucaaccucucccaggacgagaucaagcaggaggucgaggacuaccuccccuccuucugcaagugggccggcgacuucaugcacaagaacaccuccaccgacuucccccagaugcagcucucccuccccuccgacaacuccaaggacaacuccaccugcaacaucgaggucgucaagcccauggacaucgaggaguccaucugguccccccgcuucggccucaagggcaagaucgacgucaccgucggcgucaagauccaccgcggcuacaagaccaaguacaagaucaugccccucgagcucaagaccggcaaggaguccaacuccaucgagcaccgcucccaggucguccucuacacccuccucucccaggagcgccgcgccgaccccgaggccggccuccuccucuaccucaagaccggccagauguaccccguccccgccaaccaccucgacaagcgcgagcuccucaagcuccgcaaccagauggccuucucccucuuccaccgcaucuccaaguccgccacccgccagaagacccagcucgccucccucccccagaucaucgaggaggagaagaccugcaaguacugcucccagaucggcaacugcgcccucuacucccgcgccgucgagcagcagauggacugcuccuccguccccaucgucaugcuccccaagaucgaggaggagacccagcaccucaagcagacccaccucgaguacuucucccucuggugccucaugcucacccucgagucccaguccaaggacaacaagaagaaccaccagaacaucuggcucaugcccgccuccgagauggagaaguccggcuccugcaucggcaaccucauccgcauggagcacgucaagaucgucugcgacggccaguaccuccacaacuuccagugcaagcacggcgccauccccgucaccaaccucauggccggcgaccgcgucaucgucuccggcgaggagcgcucccucuucgcccucucccgcggcuacgucaaggagaucaacaugaccaccgucaccugccuccucgaccgcaaccucuccguccuccccgaguccacccucuuccgccucgaccaggaggagaagaacugcgacaucgacaccccccucggcaaccucuccaagcucauggagaacaccuucgucuccaagaagcuccgcgaccucaucaucgacuuccgcgagccccaguucaucuccuaccucuccuccguccucccccacgacgccaaggacaccgucgccugcauccucaagggccucaacaagccccagcgccaggccaugaagaagguccuccucuccaaggacuacacccucaucgucggcaugcccggcaccggcaagaccaccaccaucugcacccucguccgcauccucuacgccugcggcuucuccguccuccucaccuccuacacccacuccgccgucgacaacauccuccucaagcucgccaaguucaagaucggcuuccuccgccucggccagauccagaagguccaccccgccauccagcaguucaccgagcaggagaucugccgcuccaaguccaucaagucccucgcccuccucgaggagcucuacaacucccagcucaucgucgccaccaccugcaugggcaucaaccaccccaucuucucccgcaagaucuucgacuucugcaucgucgacgaggccucccagaucucccagcccaucugccucggcccccucuucuucucccgccgcuucguccucgucggcgaccaccagcagcuccccccccucguccucaaccgcgaggcccgcgcccucggcauguccgagucccucuucaagcgccucgagcagaacaaguccgccgucguccagcucaccguccaguaccgcaugaacuccaagaucaugucccucuccaacaagcucaccuacgagggcaagcucgagugcggcuccgacaaggucgccaacgccgucaucaaccuccgccacuucaaggacgucaagcucgagcucgaguucuacgccgacuacuccgacaaccccuggcucaugggcgucuucgagcccaacaaccccgucugcuuccucaacaccgacaagguccccgcccccgagcaggucgagaagggcggcgucuccaacgucaccgaggccaagcucaucgucuuccucaccuccaucuucgucaaggccggcugcucccccuccgacaucggcaucaucgcccccuaccgccagcagcucaagaucaucaacgaccuccucgcccgcuccaucggcauggucgaggucaacaccgucgacaaguaccagggccgcgacaaguccaucguccucgucuccuucguccgcuccaacaaggacggcaccgucggcgagcuccucaaggacuggcgccgccucaacgucgccaucacccgcgccaagcacaagcucauccuccucggcugcguccccucccucaacugcuaccccccccucgagaagcuccucaaccaccucaacuccgagaagcucaucaucgaccuccccucccgcgagcacgagucccucugccacauccucggcgacuuccagcgcgaguga

SEQ ID NO: 42305 - RNA, 2178 nt, Artificial Sequence
  derived and/or modified sequence opt2 from DNAAF1__Homo_sapiens__NP_848547
augcaccccgagcccuccgagcccgccaccggcggcgccgccgagcucgacugcgcccaggagcccggcgucgaggaguccgccggcgaccacggcuccgccggccgcggcggcugcaaggaggagaucaacgaccccaaggagaucugcgucggcuccuccgacaccuccuaccacucccagcagaagcaguccggcgacaacggcuccggcggccacuucgcccacccccgcgaggaccgcgaggaccgcggcccccgcaugaccaaguccucccuccagaagcucugcaagcagcacaagcucuacaucacccccgcccucaacgacacccucuaccuccacuucaagggcuucgaccgcaucgagaaccucgaggaguacaccggccuccgcugccucuggcuccaguccaacggcauccagaagaucgagaaccucgaggcccagaccgagcuccgcugccucuuccuccagaugaaccuccuccgcaagaucgagaaccucgagccccuccagaagcucgacgcccucaaccucuccaacaacuacaucaagaccaucgagaaccucuccugccuccccguccucaacacccuccagauggcccacaaccaccucgagaccgucgaggacauccagcaccuccaggagugccuccgccucugcguccucgaccucucccacaacaagcucuccgaccccgagauccucuccauccucgaguccaugcccgaccuccgcguccucaaccucaugggcaaccccgucauccgccagauccccaacuaccgccgcaccgucaccguccgccucaagcaccucaccuaccucgacgaccgccccgucuuccccaaggaccgcgccugcgccgaggccugggcccgcggcggcuacgccgccgagaaggaggagcgccagcagugggagucccgcgagcgcaagaagaucaccgacuccaucgaggcccucgccaugaucaagcagcgcgccgaggagcgcaagcgccagcgcgagucccaggagcgcggcgagaugaccuccuccgacgacggcgagaacguccccgccuccgccgagggcaaggaggagccccccggcgaccgcgagacccgccagaagauggagcucuucgucaaggaguccuucgaggccaaggacgagcucugccccgagaagcccuccggcgaggagccccccgucgaggccaagcgcgaggacggcggccccgagcccgagggcacccuccccgccgagacccuccuccucuccucccccgucgaggucaagggcgaggacggcgacggcgagcccgagggcacccuccccgccgaggccccccccccccccccccccgucgaggucaagggcgaggacggcgaccaggagcccgagggcacccuccccgccgagacccuccuccucuccccccccgucaaggucaagggcgaggacggcgaccgcgagcccgagggcacccuccccgccgaggccccccccccccccccccucggcgccgcccgcgaggagcccaccccccaggccgucgccaccgagggcgucuucgucaccgagcucgacggcacccgcaccgaggaccucgagaccauccgccucgagaccaaggagaccuucugcaucgacgaccuccccgaccucgaggacgacgacgagaccggcaagucccucgaggaccagaacaugugcuuccccaagaucgaggucaucuccucccucuccgacgacuccgaccccgagcucgacuacaccucccuccccguccucgagaaccuccccaccgacacccucuccaacaucuucgccgucuccaaggacaccuccaaggccgcccgcguccccuucaccgacaucuucaagaaggaggccaagcgcgaccucgagauccgcaagcaggacaccaaguccccccgcccccucauccaggagcucuccgacgaggaccccuccggccagcuccucaugccccccaccugccagcgcgacgccgccccccucaccuccuccggcgaccgcgacuccgacuuccucgccgccuccucccccguccccaccgaguccgccgccaccccccccgagaccugcgucggcgucgcccagcccucccaggcccuccccaccugggaccucaccgccuuccccgcccccaaggccuccuga

SEQ ID NO: 42306 - RNA, 2370 nt, Artificial Sequence
  derived and/or modified sequence opt2 from DNAAF2__Homo_sapiens__NP_001077377
auggccaaggccgccgccuccuccucccucgaggaccucgaccucuccggcgaggagguccagcgccucaccuccgccuuccaggaccccgaguuccgccgcauguucucccaguacgccgaggagcucaccgaccccgagaaccgccgccgcuacgaggccgagaucaccgcccucgagcgcgagcgcggcgucgagguccgcuucguccaccccgagcccggccacguccuccgcaccucccucgacggcgcccgccgcugcuucgucaacgucugcuccaacgcccucgucggcgcccccuccucccgccccggcuccggcggcgaccgcggcgccgcccccggcucccacuggucccuccccuacucccucgcccccggccgcgaguacgccggccgcuccuccucccgcuacauggucuacgacgucgucuuccaccccgacgcccucgcccucgcccgccgccacgagggcuuccgccagaugcucgacgccaccgcccucgaggccgucgagaagcaguucggcgucaagcucgaccgccgcaacgccaagacccucaaggccaaguacaagggcacccccgaggccgccguccuccgcaccccccuccccggcgucauccccgcccgccccgacggcgagcccaagggcccccuccccgacuuccccuaccccuaccaguaccccgccgcccccggcccccgcgcccccuccccccccgaggccgcccuccagcccgcccccaccgagccccgcuacuccgucguccagcgccaccacgucgaccuccaggacuaccgcugcucccgcgacuccgcccccucccccgucccccacgagcucgucaucaccaucgagcucccccuccuccgcuccgccgagcaggccgcccucgaggucacccgcaagcuccucugccucgacucccgcaagcccgacuaccgccuccgccucucccuccccuaccccgucgacgacggccgcggcaaggcccaguucaacaaggcccgccgccagcucgucgucacccuccccgucguccuccccgccgcccgccgcgagcccgccgucgccgucgccgccgccgcccccgaggaguccgccgaccgcuccggcaccgacggccaggccugcgccuccgcccgcgagggcgaggccggccccgcccgcucccgcgccgaggacggcggccacgacaccugcgucgccggcgccgccggcuccggcgucaccacccucggcgaccccgaggucgcccccccccccgccgccgccggcgaggagcgcguccccaagcccggcgagcaggaccucucccgccacgccggcuccccccccggcuccgucgaggagcccucccccggcggcgagaacucccccggcggcggcggcucccccugccucuccucccgcucccucgccuggggcuccuccgccggccgcgaguccgcccgcggcgacuccuccgucgagacccgcgaggaguccgagggcaccggcggccagcgcuccgccugcgccaugggcggccccggcaccaaguccggcgagccccucugccccccccuccucugcaaccaggacaaggagacccucacccuccucauccaggucccccgcauccagccccagucccuccagggcgaccucaacccccucugguacaagcuccgcuucuccgcccaggaccucgucuacuccuucuuccuccaguucgcccccgagaacaagcucuccaccaccgagcccgucaucuccaucuccuccaacaacgccgucaucgagcucgccaagucccccgagucccacggccacuggcgcgagugguacuacggcgucaacaacgacucccucgagcuccaggagugcuccaacuccgaccagcuccagggcaaggaggagcgcgucaacgaggagucccaccucaccgagaaggaguacaucgagcacugcaacacccccaccaccgacuccgacuccuccaucgccgucaaggcccuccagaucgacuccuucggccucgucaccugcuuccagcaggagucccucgacgucucccagaugauccucggcaagucccagcagcccgaguccaagaugcaguccgaguucaucaaggagaaguccgccaccugcuccaacgaggagaaggacaaccucaacgaguccgucaucaccgaggagaaggagaccgacggcgaccaccucuccucccuccucaacaagaccaccguccacaacauccccggcuucgacuccaucaaggagaccaacaugcaggacggcuccguccaggucaucaaggaccacgucaccaacugcgccuucuccuuccagaacucccuccucuacgaccucgacuga

SEQ ID NO: 42307 - RNA, 1827 nt, Artificial Sequence
  derived and/or modified sequence opt2 from DNAAF3__Homo_sapiens__NP_001243643
augcucccccuccucgacuccuccaagcgcgccggcacccucggcuccggcugcggcgucccccgcguccacuccgccgcccucucccgcgaggagggcgccucccgcgacaucuggcgcaucaaggucugggcccgcgucaugaccacccccgccggcuccggcuccggcuucggcuccgucuccugguggggccucucccccgcccucgaccuccaggccgagcgcgacgccaccgucgacgcccuccccaccaccauggucccccagcccgccgucauccuccccggcccccccgucgaccccgacucccaggccgacaccguccacuccaaccccgagcucgacguccuccuccucggcuccgucgacggccgccaccuccuccgcacccucucccgcgccaaguucuggccccgccgccgcuucaacuucuucguccucgagaacaaccucgaggccgucgcccgccacaugcucaucuucucccucgcccucgaggagcccgagaagaugggccuccaggagcgcuccgagaccuuccucgaggucuggggcaacgcccuccuccgcccccccgucgccgccuucguccgcgcccaggccgaccuccucgcccaccucguccccgagcccgaccgccucgaggagcagcuccccuggcucucccuccgcgcccucaaguuccgcgagcgcgacgcccucgaggccgucuuccgcuucugggccggcggcgagaagggcccccaggccuuccccaugucccgccucugggacucccgccuccgccacuaccucggcucccgcuacgacgcccgccgcggcgucuccgacugggaccuccgcaugaagcuccacgaccgcggcgcccaggucauccacccccaggaguuccgccgcuggcgcgacaccggcgucgccuucgagcuccgcgacuccuccgccuaccacguccccaaccgcacccucgccuccggccgccuccucuccuaccgcggcgagcgcgucgccgcccgcggcuacuggggcgacaucgccaccggccccuucgucgccuucggcaucgaggccgacgacgagucccuccuccgcaccuccaacggccagcccgucaagaccgccggcgagaucacccagcacaacgucaccgagcuccuccgcgacgucgccgccuggggccgcgcccgcgccaccggcggcgaccucgaggagcagcagcacgccgagggcucccccgagcccggcacccccgcccccacccccgaguccuucaccguccacuuccucccccucaacuccgcccagacccuccaccacaaguccugcuacaacggccgcuuccagcuccucuacgucgccugcggcaugguccaccuccucauccccgagcucggcgccugcgucgcccccggcggcaaccucaucgucgagcucgcccgcuaccucgucgacguccgccaggagcagcuccagggcuucaacacccgcguccgcgagcucgcccaggccgccggcuucgccccccagaccggcgcccgccccuccgagaccuucgcccgcuucugcaagucccaggaguccgcccucggcaacaccguccccgccgucgagcccggcacccccccccucgacauccucgcccagccccucgaggccuccaaccccgcccucgagggccucacccagccccuccagggcggcaccccccacugcgagcccugccagcuccccuccgagucccccggcucccucuccgagguccucgcccagccccagggcgcccucgccccccccaacugcgaguccgacuccaagaccggcgucuga

SEQ ID NO: 42308 - RNA, 2568 nt, Artificial Sequence
  derived and/or modified sequence opt2 from DNAAF5__Homo_sapiens__NP_060272
auggccgcccucggcgucgccgaggccgucgccgccccccaccccgccgagggcgccgagaccgccgaggccgucgagcucucccgcgcccucucccgccuccuccccggccucgaggccgacuccaagcccggccgccgccgcgcccucgaggcccuccgccgcgcccucgaggagcccggccccgccgccgaccccaccgccuuccagggccccugggcccgccuccuccucccccgccuccuccgcugccucuccgaccccgccgagggcugccgcgcccucgccguccaccuccucgaccucggccuccgccgcgccgcccgcccccgcgacgcccucccccgccuccuccccgcccucgccgcccgccucgccggccccguccccgcccgccgcccccccgaggccugcgaggagcuccgccucgcccucguccagcuccucggccucgccgucgaccucugcggcgccgcccucgccccccaccucgacgacgcccuccgcgcccuccgcugcucccuccucgaccccuucgccgccguccgccgcgaguccugcuccugcgccgccgcccucgcccaggccacccccgaccacuuccacaugcaguccgagucccucaucggcccccucaugcagaccaucucccaccagcacuggaagguccgcgucgccgccaucgaggccaccggcgccgucauccacuucggcaacggcaaguccgucgacgacguccucucccacuucgcccagcgccucuucgacgacgucccccagguccgccgcgccgucgccuccgucgucggcggcuggcuccucugccuccgcgaccgcuacuccuucuuccacaagcucaucccccuccuccucuccucccucaacgacgagguccccgagguccgccagcucgccgccucccucugggaggacgucggccuccaguggcagaaggagaacgaggaggaccucaaggacaagcucgacuucgccccccccacccccccccacuaccccccccacgagcgccgccccguccucggcugccgcgagcucgucuuccgcaaccucuccaagauccuccccgcccucugccacgacaucaccgacugggucgucggcacccgcgucaaguccgcccagcuccuccccguccuccuccuccacgccgaggaccacgccacccagcaccucgaggucguccuccgcacccucuuccaggccugcaccgacgaggaggccgccgucguccaguccugcacccgcuccgccgagcucgucggcaccuucgucucccccgaggucuuccucaagcucauccucuccacccucaagaagacccccuccgccuccggccuccucguccucgccuccgccaugcgcggcugcccccgcgaggcccuccagccccaccucgccgccaucgccaccgagcucgcccaggcccacaucugccaggccuccgagaacgaccucuaccucgagcgccuccuccucugcguccaggcccucgucuccgucugccacgaggacugcggcgucgccucccuccagcuccucgacguccuccucaccaucgucgcccucgccggcgccaccggccuccgcgacaaggcccaggagaccauggacucccucgccauggucgagggcgucuccuccugccaggaccucuaccgcaagcacaucggcccccuccucgagcgcgucaccgccucccaccucgacuggaccgcccacucccccgagcuccuccaguucuccgucaucgucgcccaguccggccccgcccucggcgaggcccucccccacgucguccccacccuccgcgccugccuccagcccucccaggacccccagaugcgccucaagcucuucuccauccucuccaccguccuccuccgcgccaccgacaccaucaacucccagggccaguuccccuccuaccucgagaccgucaccaaggacauccucgcccccaaccuccaguggcacgccggccgcaccgccgccgccauccgcaccgccgccgucuccugccucugggcccucaccuccuccgagguccucuccgccgagcagauccgcgacguccaggagacccucaugccccagguccucaccacccucgaggaggacuccaagaugacccgccucaucuccugccgcaucaucaacaccuuccucaagaccuccggcggcaugaccgaccccgagaagcucauccgcaucuaccccgagcuccucaagcgccucgacgacgucuccaacgacguccgcauggccgccgccuccacccucgucaccuggcuccagugcgucaagggcgccaacgccaaguccuacuaccaguccuccguccaguaccucuaccgcgagcuccucguccaccucgacgaccccgagcgcgccauccaggacgccauccucgagguccucaaggagggcuccggccucuuccccgaccuccucguccgcgagaccgaggccgucauccacaagcaccgcuccgccaccuacugcgagcagcuccuccagcacguccaggccguccccgccacccaguga

SEQ ID NO: 42309 - RNA, 13551 nt, Artificial Sequence
  derived and/or modified sequence opt2 from DNAH11__Homo_sapiens__NP_001264044
auggccgcccaggucgccgcccgcgaggcccgcgacuuccgcgaggcccccacccuccgccucaccuccggcgccggccucgaggccgucggcgccgucgagcucgaggaggaggaggagaacgaggaggaggccgccgcccgccgcgcccgcuccuucgcccaggacgcccgcguccgcuuccucggcggccgccucgccaugaugcucggcuucaccgaggagaaguggucccaguaccucgaguccgaggacaaccgccagguccucggcgaguuccucgaguccaccucccccgccugccucgucuucuccuucgccgccuccggccgccucgccgccucccaggagaucccccgcgacgccaaccacaagcucgucuucaucuccaagaagaucaccgaguccaucggcgucaacgacuucucccaggucguccucuucggcgagcuccccgcccucucccucggccacgucuccgccuuccucgacgagauccucguccccguccucuccaacaagaacaaccacaaguccugguccugcuucaccucccaggacauggaguaccacaucgaggucaugaagaagaagauguacaucuuccgcggcaagaugucccgccgcacccuccuccccauccccaccgucgccggcaagauggaccucgaccagaacugcuccgagaacaagccccccuccaacgagcgcaucauccuccacgccaucgaguccgucgucaucgaguggucccaccagauccaggagaucaucgagcgcgacuccguccagcgccuccucaacggccuccaccucuccccccaggccgagcucgacuucuggaugaugcgccgcgagaaccucuccugcaucuacgaccagcuccaggcccccgucguccucaagauggucaagauccucaccaccaagcaguccuccuacuuccccacccucaaggacaucuuccucgccgucgagaacgcccuccucgaggcccaggacgucgagcucuaccuccgcccccuccgccgccacauccagugccuccaggagaccgaguucccccagacccgcauccucaucgccccccucuuccacaccaucugccucaucuggucccacuccaaguucuacaacacccccgcccgcgucaucguccuccuccaggaguucugcaaccucuucaucaaccaggccaccgccuaccucucccccgaggaccuccuccgcggcgagaucgaggagucccucgagaagguccaggucgccgucaacauccucaagaccuucaagaacuccuucuucaacuaccgcaagaagcucgccuccuacuucaugggccgcaagcuccgccccugggacuuccagucccaccucgucuucugccgcuucgacaaguuccucgaccgccucaucaagaucgaggacaucuucgccaccacccucgaguucgagaagcucgagcgccucgaguucggcggcaccaagggcgccauccucaacggccagguccacgagauguccgaggagcucauggagcucugcaagcucuucaagcaguccaccuacgaccccuccgacugcaccaacauggaguucgaguccgacuacgucgccuucaaguccaagacccucgaguucgaccgccgccucggcaccaucaucugcgaggccuucuucaacugcaacggccucgaggccgccuucaagcuccucaccaucuucggcaacuuccucgagaagcccgucgucauggagaucuucucccuccacuacuccacccucguccacauguucaacaccgagcucgacgucugcaagcagcucuacaacgagcacaugaagcagaucgagugcggccacgucguccucaacaagaacaugcccuucaccuccggcaacaugaagugggcccagcagguccuccagcgccuccagauguucugguccaacuucgccucccuccgcuaccucuuccucggcaaccccgaccacgcccucgucuaccagaaguacgucgagaugaccacccuccucgaccaguucgagucccgcaucuacaacgaguggaaguccaacgucgacgagaucugcgaguucaaccucaaccagccccucgucaaguucuccgccaucaacggccuccucugcgucaacuucgaccccaagcucgucgccguccuccgcgaggucaaguaccuccucaugcucaagaagcaggacauccccgacuccgcccucgccaucuucaagaagcgcaacaccauccucaaguacaucggcaaccucgaccuccucguccagggcuacaacaagcucaagcagacccuccucgaggucgaguacccccucaucgaggacgagcuccgcgccaucgacgagcagcucaccgccgccaccaccuggcucaccuggcaggacgacugcuggggcuacaucgagcgcguccgcgccgccaccuccgagcucgagcaccgcgucgagcgcacccagaagaacgucaaggucauccagcagaccaugcgcggcugggcccgcugcguccuccccccccgccgcgagcaccgccgcgaggccgccuucacccucgaggacaagggcgaccucuucaccaagaaguacaagcucauccagggcgacggcugcaagauccacaaccucgucgaggagaaccgcaagcucuucaaggccaaccccucccucgacaccuggaagaucuacgucgaguucaucgacgacaucgucgucgagggcuucuuccaggccaucaugcacgaccucgacuucuuccucaagaacaccgagaagcagcucaagcccgcccccuucuuccaggcccagaugauccuccucccccccgagaucgucuucaagcccucccucgaccgcgaggccggcgacggcuucuacgaccucgucgaggagaugcucugcaacuccuuccgcauguccgcccagaugaaccgcaucgccacccaccucgagaucaagaacuaccagaacgacauggacaacaugcucggccucgccgagguccgccaggagaucaugaaccgcgucgucaacgucaucaacaagguccucgacuuccgcaacacccucgagacccacaccuaccucugggucgacgaccgcgccgaguucaugaagcacuuccuccucuacggccacgccgucuccuccgacgagauggacgcccacgccaacgaggagauccccgagcagccccccacccucgagcaguucaaggagcagaucgacaucuacgaggcccucuacguccagauguccaaguucgaggacuuccgcgucuucgacuccugguucaaggucgacaugaagcccuucaaggucucccuccucaccaucaucaagaagugguccuggauguuccaggagcaccuccuccgcuucgucaucgacucccucaacgagcuccaggaguucaucaaggagaccgacuccggccuccagcgcgagcucaacgagggcgaccacgacggccucgucgacaucaugguccaccuccucgccguccgcucccgccagcgcgccaccgacgagcucuucgagccccucaaggagaccaucacccuccucgaguccuacggccagaagaugcccgagcaggucuacauccagcucgaggagcuccccgagcgcugggagaccaccaagaagaucgccgccaccguccgccacgaggucuccccccuccacaacgccgaggucacccucauccgcaagaagugcauccucuucgacgccaagcaggccgaguuccgcgagcgcuuccgccacuacgccccccucggcuucaacgccgagaaccccuacaccgcccucgacaaggccaacgaggagcucgaggcccucgaggaggagaugcuccagaugcaggaguccacccgccucuucgaggucgcccuccccgaguacaagcagaugaagcagugccgcaaggagaucaagcuccucaagggccucugggacgucaucaucuacguccgccgcuccaucgacaacuggaccaagacccaguggcgccagauccacgucgagcagauggacgucgagcuccgccgcuucgccaaggagaucuggucccucaacaaggagguccgcgucugggacgccuacaccggccucgagggcaccgucaaggacaugaccgccucccuccgcgccaucaccgagcuccagucccccgcccuccgcgaccgccacuggcaccagcucaugaaggccaucggcgucaaguuccucaucaacgaggccaccacccucgccgaccuccucgcccuccgccuccaccgcgucgaggacgacguccgccgcaucgucgacaaggccgucaaggagcucggcaccgagaaggucaucaccgagaucucccagaccugggccaccaugaaguucuccuacgagguccacuaccgcaccggcaucccccuccucaaguccgacgagcagcucuucgagacccucgagcacaaccagguccagcuccagacccuccuccaguccaaguacgucgaguacuucaucgagcagguccucuccuggcagaacaagcucaacaucgccgaccucgucaucuucaccuggauggagguccagcgcaccuggucccaccucgaguccaucuucgucugcuccgaggacauccgcauccagcucgucaaggacgcccgccgcuucgacggcgucgacgccgaguucaaggagcucauguucaagaccgccaaggucgagaacguccucgaggccaccugccgccccaaccucuacgagaagcucaaggaccuccagucccgccucucccucugcgagaaggcccucgccgaguaccucgagaccaagcgcaucgccuucccccgcuucuacuucgucuccuccgccgaccuccucgacauccucuccaagggcgcccagcccaagcaggucaccugccaccucgccaagcucuucgacuccaucgccgaccuccaguucgaggacaaccaggacgucuccgcccaccgcgccgucggcauguacuccaaggagaaggaguacguccccuuccaggccgagugcgagugcgucggccacgucgagaccuggcuccuccagcucgagcagaccaugcaggagaccguccgccacuccaucaccgaggccaucgucgccuacgaggagaagccccgcgagcucuggaucuucgacuuccccgcccaggucgcccucaccuccucccagaucugguggaccaccgacgucggcaucgccuucucccgccucgaggagggcuacgagaccgcccucaaggacuuccacaagaagcagaucucccagcucaacacccucaucacccuccuccucggcgagcucccccccggcgaccgccagaagaucaugaccaucugcaccaucgacguccacgcccgcgacgucgucgccaagcucaucucccagaaggucgucuccccccaggccuucaccuggcucucccagcuccgccaccgcugggaggacacccagaagcacugcuucgucaacaucugcgacgcccaguuccaguacuucuacgaguaccucggcaacuccccccgccucgucaucaccccccucaccgaccgcugcuacaucacccucacccagucccuccaccucaccauguccggcgcccccgccggccccgccggcaccggcaagaccgagaccaccaaggaccucggccgcgcccucggcaugauggucuacgucuucaacugcuccgagcagauggacuacaaguccaucggcaacaucuacaagggccucguccagaccggcgccuggggcugcuucgacgaguucaaccgcaucuccgucgagguccucuccgucgucgccguccaggucaagaugauccacgacgccauccgcaaccgcaagaagcgcuucgucuuccucggcgaggccaucacccucaagcccuccgucggcaucuucaucaccaugaaccccggcuacgccggccgcaccgagcuccccgagaaccucaaggcccucuuccgccccugcgccauggucgcccccgacaucgagcucaucugcgagauccuccucgucgccgagggcuucgucgacgcccgcgcccucgcccgcaaguucaucacccucuacacccucugcaaggagcuccucuccaagcaggaccacuacgacuggggccuccgcgccaucaaguccguccucgucgucgccggcucccucaagcgcggcgacaagaaccgccccgaggaccagguccucaugcgcgcccuccgcgacuucaacaugcccaagaucgucaccgacgacauccccgucuuccucggccucgucggcgaccucuuccccgcccucgacgucccccgccgccgcaagcuccacuucgagcagaugguccgccaguccacccucgagcuccgccuccagcccgaggaguccuucauccucaaggucguccagcucgaggagcuccucgccguccgccacuccgucuucgucgucggcaacgccggcaccggcaaguccaagauccuccgcacccucaaccgcaccuacgucaacaugaagcagaagcccgucuggaacgaccucaaccccaaggccgucaccaccgacgagcucuucggcuucauccaccacgccacccgcgaguggaaggacggcaagaucgucuacuccuacuucaucggccucuucuccuccauccuccgcgagcaggccaaccucaagcacgacggccccaaguggaucguccucgacggcgacaucgaccccauguggaucgagucccucaacaccgucauggacgacaacaagguccucacccucgccuccaacgagcgcaucgcccucacccccuucaugcgccuccucuucgagauccaccaccuccgcuccgccacccccgccaccgucucccgcgccggcauccucuacgucaacccccaggaccucggcuggaaccccuacgucgccuccuggaucgaccgccgccgccaccaguccgagaaggccaaccucaccauccucuucgacaaguacguccccgccugccucgacaagcuccgcaccuccuucaagaccaucaccuccauccccgaguccucccucguccagacccucugcguccuccucgagugccuccucacccccgagaacguccccuccgacucccccaaggaggucuacgaggucuacuucgucuucgccugcaucugggccuucggcggcacccuccuccaggaccagaucuccgacuaccaggccgacuucucccgcugguggcagaaggagaugaaggccgucaaguuccccucccagggcaccaucuucgacuacuacgucgaccacaagaccaagaagcuccuccccugggccgacaagaucgcccaguucaccauggaccccgacgucccccuccagaccguccucguccacaccaccgagaccgcccgccuccgcuacuucauggagcuccuccucgagaagggcaagccccucaugcucgucggcaacgccggcgucggcaagaccgucuucgucggcgacacccucgccucccucuccgaggacuacaucgucucccgcguccccuucaacuacuacaccaccuccaccgcccuccagaagauccucgagaagccccucgagaagaaggccggccacaacuacggccccggcggcaacaagaagcucaucuacuucaucgacgacaugaacaugcccgaggucgaccucuacggcaccguccagccccacacccucauccgccagcacaucgacuacggccacugguacgaccgccagaaggucaugcucaaggagauccacaacugccaguacgucgccugcaugaaccccauggucggcuccuucaccaucaacccccgccuccagcgccacuucaccgucuucgccuucaacuuccccucccucgacgcccucaacaccaucuacggccagaucuucuccuuccacuuccagcagcaggccuucgcccccuccauccuccgcuccggccccacccucauccaggccaccaucgccuuccaccagaccaugaugugcaacuuccuccccaccgccaucaaguuccacuacaucuucaaccuccgcgaccucuccaacgucuuccagggcauccucuucgccucccccgagugccucaagggcccccucgaccucauccaccucuggcuccacgaguccgcccgcgucuacggcgacaagcucaucgacaagaaggacugcgaccucuuccagcgccgcaugcucgagaccgccuacaaguacuucgagggcaucgacucccacaugcuccuccagcagccccucaucuacugccacuucgccgaccgcggcaaggacccccacuacaugcccgucaaggacugggagguccucaagaccauccucaccgagacccucgacaacuacaacgagcucaacgccgccaugcaccucguccucuucgaggacgccaugcagcacgucugccgcaucucccgcauccuccgcaccccccagggcugcgcccuccucgucggcgucggcggcuccggcaagcagucccucucccgccucgccgccuaccuccgcggccucgaggucuuccagaucacccucaccgagggcuacggcauccaggagcuccgcgucgaccucgccaaccucuacauccgcaccggcgccaagaacaugcccaccgucuuccuccucaccgacgcccagguccucgacgaguccuuccucguccucaucaacgaccuccucgccuccggcgagauccccgaccucuucuccgacgaggacgucgacaagaucaucuccggcauccacaacgagguccacgcccucggcauggucgacucccgcgagaacugcuggaaguucuucauggcccgcguccgccuccagcucaagaucauccucugcuucucccccgucggccgcacccuccgcguccgcgcccgcaaguuccccgccaucgucaacugcaccgccaucgacugguuccacgccuggccccaggaggcccucgucuccgucucccgccgcuucaucgaggagaccaagggcaucgagcccguccacaaggacuccaucucccucuucauggcccacguccacaccaccgucaacgagauguccacccgcuacuaccagaacgagcgccgccacaacuacaccacccccaaguccuuccucgagcagaucucccucuucaagaaccuccucaagaagaagcagaacgaggucuccgagaagaaggagcgccucgucaacggcauccagaagcucaagaccaccgccucccaggucggcgaccucaaggcccgccucgccucccaggaggccgagcuccagcuccgcaaccacgacgccgaggcccucaucaccaagaucggccuccagaccgagaaggucucccgcgagaagaccaucgccgacgccgaggagcgcaaggucaccgccauccagaccgaggucuuccagaagcagcgcgagugcgaggccgaccuccucaaggccgagcccgcccucgucgccgccaccgccgcccucaacacccucaaccgcgucaaccucuccgagcucaaggccuuccccaacccccccaucgccgucaccaacgucaccgccgccgucaugguccuccucgccccccgcggccgcguccccaaggaccgcuccuggaaggccgccaaggucuucaugggcaaggucgacgacuuccuccaggcccucaucaacuacgacaaggagcacauccccgagaacugccucaaggucgucaacgagcacuaccucaaggaccccgaguucaaccccaaccucauccgcaccaaguccuucgccgccgccggccucugcgccugggucaucaacaucaucaaguucuacgaggucuacugcgacgucgagcccaagcgccaggcccucgcccaggccaaccucgagcucgccgccgccaccgagaagcucgaggccauccgcaagaagcucgucgaccucgaccgcaaccucucccgccucaccgccuccuucgagaaggccaccgccgagaagguccgcugccaggaggaggucaaccagaccaacaagaccaucaagcucgccaaccgccucgucaaggagcucgaggccaagaagauccgcuggggccaguccaucaaguccuucgaggcccaggagaagacccucugcggcgacguccuccucaccgccgccuucgucuccuacgucggccccuucacccgccaguaccgccaggagcucguccacugcaaguggguccccuuccuccagcagaaggucuccaucccccucaccgagggccucgaccucaucuccaugcucaccgacgacgccaccaucgccgccuggaacaacgagggccuccccuccgaccgcauguccaccgagaacgccgccauccucacccacugcgagcgcuggccccucgucaucgacccccagcagcagggcaucaaguggaucaagaacaaguacggcauggaccucaaggucacccaccucggccagaagggcuuccucaacgccaucgagaccgcccucgccuucggcgacgucauccucaucgagaaccucgaggagaccaucgaccccguccucgacccccuccucggccgcaacaccaucaagaagggcaaguacauccgcaucggcgacaaggagugcgaguucaacaagaacuuccgccucauccuccacaccaagcucgccaacccccacuacaagcccgagcuccaggcccagaccacccuccucaacuucaccgucaccgaggacggccucgaggcccagcuccucgccgaggucgucuccaucgagcgccccgaccucgagaagcucaagcucguccucaccaagcaccagaacgacuucaagaucgagcucaaguaccucgaggacgaccuccuccuccgccucuccgccgccgagggcuccuuccucgacgacaccaagcucgucgagcgccucgaggccaccaagaccaccgucgccgagaucgagcacaaggucaucgaggccaaggagaacgagcgcaagaucaacgaggcccgcgagugcuaccgccccgucgccgcccgcgccucccuccucuacuucgucaucaacgaccuccagaagaucaacccccucuaccaguucucccucaaggccuucaacguccucuuccaccgcgccaucgagcaggccgacaaggucgaggacaugcagggccgcaucuccauccucauggaguccaucacccacgccgucuuccucuacaccucccaggcccucuucgagaaggacaagcucaccuuccucucccagauggccuuccagauccuccuccgcaagaaggagaucgacccccucgagcucgacuuccuccuccgcuucaccgucgagcacacccaccucucccccgucgacuuccucaccucccaguccugguccgccaucaaggccaucgccgucauggaggaguuccgcggcaucgaccgcgacgucgagggcuccgccaagcaguggcgcaagugggucgaguccgagugccccgagaaggagaagcucccccaggaguggaagaagaagucccucauccagaagcucauccuccuccgcgccaugcgccccgaccgcaugaccuacgcccuccgcaacuucgucgaggagaagcucggcgccaaguacgucgagcgcacccgccucgaccucgucaaggccuucgaggaguccucccccgccacccccaucuucuucauccucucccccggcgucgacgcccucaaggaccucgagauccucggcaagcgccucggcuucaccaucgacuccggcaaguuccacaacgucucccucggccagggccaggagaccgucgccgaggucgcccucgagaaggccuccaagggcggccacugggucauccuccagaacguccaccucgucgccaaguggcucggcacccucgagaagcuccucgagcgcuucucccagggcucccaccgcgacuaccgcgucuucauguccgccgaguccgcccccacccccgacgagcacaucaucccccagggccuccucgagaacuccaucaagaucaccaacgagccccccaccggcaugcucgccaaccuccacgccgcccucuacaacuucgaccaggacacccucgagaucugcuccaaggagcaggaguucaaguccauccucuucucccucugcuacuuccacgccugcgucgccggccgccuccgcuucggcccccagggcuggucccgcuccuaccccuucaaccccggcgaccucaccaucugcgccuccguccucuacaacuaccucgaggccaacuccaagguccccugggaggaccuccgcuaccucuucggcgagaucauguacggcggccacaucaccgacgacugggaccgcaagcucugccgcgucuaccucgaggaguucaugaaccccucccucaccgaggacgagcucaugcucgcccccggcuucgccgccccccccuaccucgacuacgccggcuaccaccaguacaucgaggagaugcucccccccgagucccccgcccucuacggccuccaccccaacgccgagaucgaguuccucaccgucaccuccaacacccucuuccgcacccuccucgagaugcagccccgcaacgcccucuccggcgacgagcucggccaguccaccgaggagaaggucaagaacguccucgacgacauccucgagaagcuccccgaggaguucaacauggccgagaucaugcagaagaacuccaaccgcucccccuacguccucgucugcuuccaggagugcgagcgcaugaacauccucauccgcgagauccgcaucucccucgagcagcucgaccucucccucaagggcgagcucgcccucucccccgccgucgaggcccagcaguucgcccucuccuacgacaccguccccgacaccugguccaagcucgccuaccccuccaccuacggccucgcccagugguucaacgaccuccuccuccgcugccgcgagcucgacaccuggacccaggaccucacccuccccgccgucgucuggcucuccggcuucuucaacccccaguccuuccucaccgccaucaugcagaccauggcccgcaagaacgaguggccccucgacaagacccgccucaccgccgacgucaccaagaagaccaaggaggacuacggccaccccccccgcgagggcgccuaccuccacggccucuucauggagggcgcccgcugggacacccaggccggcaccaucgucgaggcccgccucaaggagcucgccugccccaugcccgucaucuucgccaaggccacccccgucgaccgccaggagaccaagcagaccuacgagugccccgucuaccgcaccaagcuccgcggccccuccuacaucuggaccuuccgccucaaguccgaggagaagaccgccaaguggguccucgccggcgucgcccuccuccucgaggccuga

SEQ ID NO: 42310 - RNA, 11895 nt, Artificial Sequence
  derived and/or modified sequence opt2 from DNAH12__Homo_sapiens__NP_001278590
auguccgacgccaacaaggccgccaucgccgccgagaaggaggcccucaaccucaagcucccccccaucguccaccuccccgagaacaucggcgucgacacccccacccaguccaagcuccucaaguaccgccgcuccaaggagcagcagcagaagaucaaccagcucgucaucgacggcgccaagcgcaaccucgaccgcacccucggcaagcgcaccccccuccuccccccccccgacuacccccagaccaugaccuccgagaugaagaagaagggcuucaacuacaucuacaugaagcagugcgucgaguccuccccccucguccccauccagcaggaguggcucgaccacaugcuccgccucauccccgagucccucaaggagggcaaggagcgcgaggagcuccucgagucccucaucaacgaggucuccuccgacuucgagaacuccaugaagcgcuaccucguccaguccguccucgucaagccccccgucaagucccucgaggacgagggcggcccccuccccgagucccccgucggccucgacuacuccaaccccuggcacuccuccuacguccaggcccgcaaccagaucuucuccaaccuccacaucauccaccccaccaugaagaugcuccucgaccucggcuacaccaccuucgccgacaccguccuccucgacuucaccggcauccgcgccaagggccccaucgacugcgagucccucaagaccgaccucuccauccagacccgcaacgccgaggagaagaucaugaacaccugguaccccaaggucaucaaccucuucaccaagaaggaggcccucgagggcgucaagcccgagaagcucgacgccuucuacuccugcgucuccacccucauguccaaccagcucaaggaccuccuccgccgcaccgucgagggcuucgucaagcucuucgaccccaaggaccagcagcgccuccccaucuucaagaucgagcucaccuucgacgacgacaagauggaguucuaccccaccuuccaggaccucgaggacaacguccucucccucgucgagcgcaucgccgaggcccuccagaacguccagaccauccccuccuggcucuccggcaccuccacccccgucaaccucgacaccgagcuccccgagcacguccuccacugggccgucgacacccucaaggccgccguccaccgcaaccucgagggcgcccgcaagcacuacgagaccuacgucgagaaguacaacuggcuccucgacggcaccgccgucgagaacaucgagaccuuccagaccgaggaccacaccuucgacgaguacaccgaguucaucgagaaguuccucucccucgccuccgagaucaugcuccucccccaguggauccacuacaccaugguccgccucgacugcgaggaccucaagaccggccucaccaacaaggccaaggccuucgccaacauccuccucaacgacaucgccuccaaguaccgcaaggagaacgagugcaucugcuccgaguucgaggccaucaaggagcacgcccucaagguccccgagaccaccgaggagaugauggaccucaucuccuacgucgagaaggcccgcaccgucggcaucgaggagcucauccuccgcauccaggaguccaagcgccagauguccuacuuccucgacgucuuccucuucccccaggaggaccucgcccucaacgccaccguccucauguggccccgcaagaucaaccccaucuucgacgagaacgacgagcucaucgagaacgccaagcacaagaaggagaacgagcucauggccaagcgcgagaagcucauccucgagaucgagaaggagucccgccgcauggaggaguucaccgaguucgccgagcucgagcgcaugcagcaguacgucaccgacguccgccagcuccagaagcgcauccaggaguccgaggaggccguccaguucaucaacaaggaggaggagcucuucaagugggagcucaccaaguaccccgagcucgacaagcucaaggucaacaucgagcccuaccagaaguucuucaacuucguccucaaguggcagcgcuccgagaagcgcuggauggacggcggcuuccucgaccucaacggcgaguccauggaggccgacgucgaggaguucucccgcgagaucuucaagacccucaaguucuuccagaccaagcucaagaaggagcuccaggagaagcgcaaggccgcccgcaagcgcucccucgaggaggagaagaucgaggaggagcccaaggacaacgccaccaucaccaugugcuccaccgucauggagcagaucaaggccuucaaggaguacauccccaccgucuccauccucugcaaccccggcaugcgcgcccgccacuggaagcagaucuccgagaucgucggcuacgaccucacccccgacuccggcaccacccuccgcaagguccucaagcucaaccucacccccuaccucgagcaguucgaggucaucuccgccggcgccuccaaggaguucucccucgagaaggccaugaacaccaugaucggcaccugggaggacaucgccuuccacaucucccucuaccgcgacaccggcgucugcauccucuccuccgucgacgagauccaggccauccucgacgaccagaucaucaagacccagaccaugcgcggcucccccuucaucaagcccuucgagcacgagaucaaggccugggaggaccgccucauccgcauccaggagaccaucgacgaguggcucaagguccaggcccaguggcucuaccucgagcccaucuucugcuccgaggacaucaugcagcagaugcccgaggagggccgccaguuccagaccgucgaccgccacuggcgcgacaucaugaaguucugcgccaaggaccccaagguccucgccgccaccucccucaccggccuccucgagaagcuccagaacugcaacgagcuccucgagaagaucaugaagggccucaacgccuaccucgagaagaagcgccucuucuucccccgcuucuucuuccucuccaacgacgagaugcucgagauccucuccgagaccaaggacccccuccgcguccagccccaccucaagaagugcuucgagggcaucgccaagcucgaguuccuccccaaccucgacaucaaggccauguacuccuccgagggcgagcgcgucgagcucaucgcccucaucuccaccuccgccgcccgcggcgccgucgagaaguggcucauccaggucgaggaccucaugcuccgcuccguccacgacgucaucgccgccgcccgccucgccuaccccgaguccgcccgccgcgacuggguccgcgaguggcccggccaggucguccucugcaucucccagauguucuggaccuccgagacccaggaggucaucuccggcggcaccgagggccucaagaaguacuacaaggagcuccagaaccagcucaacgagaucgucgagcucguccgcggcaagcucuccaagcagacccgcaccacccucggcgcccucgucaccaucgacguccacgcccgcgacgucgucauggacaugaucaagaugggcgucucccacgacaccgacuuccucuggcucgcccagcuccgcuacuacugggagaacgagaacgcccgcguccgcaucaucaacugcaacgucaaguacgccuacgaguaccucggcaacuccccccgccucgucaucaccccccucaccgaccgcugcuaccgcacccucaucggcgccuucuaccucaaccucggcggcgcccccgagggccccgccggcaccggcaagaccgagaccaccaaggaccucgccaaggcccucgccguccagugcgucgucuucaacugcuccgacggccucgacuaccucgccaugggcaaguucuucaagggccucgccuccuccggcgccugggccugcuucgacgaguucaaccgcaucgagcucgagguccucuccgucgucgcccagcagauccucugcauccagcgcgccauccagcagaagcucgucgucuucgucuucgagggcaccgagcucaagcucaaccccaacugcuucgucgccaucaccaugaaccccggcuacgccggccgcuccgagcuccccgacaaccucaagguccucuuccgcaccgucgccaugaugguccccaacuacgcccucaucgccgagaucucccucuacuccuacggcuuccucaacgcccgcccccucuccgucaagaucgucaugaccuaccgccucugcuccgagcagcucuccucccaguuccacuacgacuacggcaugcgcgccgucaaggccguccucgucgccgccggcaaccucaagcucaaguaccccaacgagaacgaggacauccuccuccuccgcuccaucaaggacgucaacgagcccaaguuccucucccacgacaucccccucuucaacggcaucaccuccgaccucuuccccggcaucaagcuccccgaggccgacuaccacgaguuccucgagugcgcccacgaggccugcaacguccacaaccuccagcccgucaaguucuuccucgagaagaucauccagaccuacgagaugaugaucguccgccacggcuucaugcucgucggcgagcccuucgccgccaagaccaagguccuccacguccucgccgacacccucacccucaugaacgagcacggcuacggcgaggaggagaaggucaucuaccgcaccgucaaccccaaguccaucaccaugggccagcucuucggccaguucgaccccgucucccacgaguggaccgacggcaucgucgccaacaccuuccgcgaguucgcccucuccgagacccccgaccgcaagugggucgucuucgacggccccaucgacacccucuggaucgaguccaugaacaccguccucgacgacaacaagaagcucugccucauguccggcgagaucauccagauguccccccagaugucccucaucuucgagaccauggaccucucccaggccucccccgccaccgucucccgcugcggcaugaucuaccucgagcccucccagcucggcugggagccccucgucuccuccuggcucaacucccucaagggcccccucugcgagcccgaguaccaggcccuccuccgcggccucuucgccuggcucaucccccccucccucaaccagcgcgucgagcucuuccagcucaacuaccucuacaccaccaucgucuccaagauccucaagauccucaucaccuuccgcaucuccaacuacuucaaguacgucccccucaagacccagugcaccuucaucaaguucuuccuccaccagcaggccugcuucaucuucucccucaucugguccaucggcggcuccugcgacaccgacggccgccgcgucuucgacaccuucauccgccucaucauccucggcaaggacgacgagaaccccguccccgacuccgucggcaagugggagugccccuucgacgagaagggccucgucuacgacuacauguacgagcucaagaacaagggccgcuggguccacuggaacgagcucaucaagaacaccaaccucggcgacaagcagaucaagauccaggacaucaucguccccaccauggacaccauccgcuacaccuuccucauggaccucuccaucaccuacgccaagccccuccucuucgucggccccaccggcaccggcaaguccgucuacgucaaggacaagcucaugaaccaccucgagaaggaccaguacuuccccuucuacaucaaccucuccgcccgcaccuccgccaaccagguccagaacaucaucauggcccgccucgacaagcgccgcaagggcgucuucggcccccccaugggcaagaagugcaucaucuucaucgacgacaugaacaugcccgcccucgagaaguacggcgcccagccccccaucgagcuccuccgccaguucuucgacugcggccacugguacgaccucaaggacaccuccaagaucacccucgucgacaucgagcucaucgccgccaugggcccccccggcggcggccgcaaccccgucaccccccgcugcauccgccacuucaacaucugcuccaucaacuccuucuccgacgagaccaugguccgcaucuucuccuccaucgucgccuucuaccuccgcacccacgaguucccccccgaguacuucgucaucggcaaccagaucgucaacggcaccauggagaucuacaagcaguccgucgagaaccuccuccccacccccaccaagucccacuacaccuucaaccuccgcgacuucucccgcgucauccgcggcugccuccucaucgagcgcgacgccgucgccaacaagcacaccaugauccgccucuucguccacgagguccuccgcgucuucuacgaccgccucaucaacgacgacgaccgccgcuggcucuuccagcucaccaagaccgucaucaaggaccacuucaaggaguccuuccacuccaucuucucccaccuccgcaagcagaacgcccccgucaccgaggaggaccuccgcaaccucauguucggcgacuacaugaaccccgaccucgagggcgacgaccgcgucuacaucgagauccccaacauccaccacuucuccgacgucgucgaccagugccucgacgaguacaaccagacccacaagacccgcaugaaccucgucaucuuccgcuacguccucgagcaccucucccgcaucugccgcguccucaagcaguccggcggcaacgcccuccucgucggccucggcggcuccggccgccagucccucacccgccucgccaccuccauggccaagaugcacaucuuccagcccgagaucuccaaguccuacggcaugaacgaguggcgcgaggacaugaagggccuccuccgcaacgucggcaugaagggccagaagaccgucuuccucaucaccgacacccagaucaaggaggaggccuuccucgaggacaucgacuccguccucaacaccggcgagguccccaacaucuucgccgccgacgagaagcaggaggucauggagggcguccgccccgucgcccaggccggcaacaagcacgacgagcucuccccccucgcccucuucgccuucuucgucaaccgcugcaaggacaaccuccacgucgucgucgccuucucccccaucggcgacgccuuccgcaaccgccuccgccaguuccccucccucaucaacugcugcaccaucgacugguuccaguccuggcccgaggacgcccucgagcgcgucgccgucaaguuccucgagacccucgagcucaccgaggucgagcagcaggagaucguccccaucugcaagcacuuccacaccuccaucauggaccucuccgagcgcuuccuccacgagcucggccgccacaacuacgucaccgccaccuccuaccucgagcucaucggcuccuuccgccagcuccucacccagaagcgccaggccgucauggaggccaagcagcgcuacaugaacggccucgacaagcucgccuucgccgagucccaggucggcgagaugcagauggagcucgucgagcuccagcccaagcucgaggaggccaagaucgagaacgccaacaugaugcaggucaucgagaucgaguccguccaggucgaggccaagcgccaguucgucaagcucgacgaggagaucgccuccggcaaggccgaggaggcccaggcccucaagaacgagugcgaguccgaccucgccgaggccauccccgcccucgaggccgcccucuccgcccucgacacccucaagcccgccgacaucaccaucgucaaguccaugaagaacccccccuccggcgucaagcucgucauggccgccgucugcgucaugaaggacaucaagcccgagaagaucuccgaccccuccggcaccggcggcaagauccucgacuacuggggccccuccaagaagcuccucggcgacaugaacuuccuccgcgaccucaaggaguacgacaaggacaacauccccgucaccgucaugcagaagauccgcuccgaguaccucaugaaccccgaguucgacccccccaaggucgccaaggccuccuccgccgccgagggccucugcaaguggaucauggccauggaggucuacgaccgcgucgccaaggucgucgcccccaagaaggcccgccucuccgaggcccagaagucccucgccgagaccauggagcuccucaaccagaagcgcgccgagcucgccgaggucgagcaccaccucgagaaccuccagaugaccuuccucgagaagaccgaggagaaggccgcccucgaggaccaggucgagcucugcgccaagaagcucgagcgcgccucccagcucaucggcggccucggcggcgagaagucccgcugggcccaggccgccgacgaccuccagaucaccuacgagaaccucaccggcgacguccucgucuccgccggcgucaucgccuaccucggcgccuucaccuccggcuuccgccagaccugcaccaaggacugguccaugcucugcaagaagaagaagauccccugcuccgaggaguuccuccucuccaagacccucggcgaccccgucaagauccgcgccuggaacaucgccggccuccccaccgacaccuucuccaucgacaacggcgucaucgucaacaacugccgccgcuggccccucaugaucgacccccagggccaggccaacaaguggaucaagaacuccgagaaggagaaccagcucuccgucaucaagcucuccgacuccgacuacaugcgcacccucgagaacugcauccaguucggcaccccccuccuccucgagaacgucggcgaggagcucgaccccucccucgagccccuccuccuccgccagaccuucaagcagggcggcaucgacugcauccgccucggcgaggucaucaucgaguacuccuucgacuucaaguucuacaucaccaccaagcuccgcaacccccacuacaugcccgagcucgccaccaaggucucccuccucaacuucaugaucacccccgagggccucgaggaccagcuccucggcaucgucgucgccaaggagcgccccgagcucgaggaggagcgcaacgcccucauccuccaguccgccgccaacaagaagcagcucaaggacaucgagaagaagauccucgagacccucuccuccuccgagggcaacauccucgaggacgaguccgccaucaagguccucgacuccgccaagaugauguccaacgagaucaccaagaagcagcagaucgccgagaagaccgagcucaagaucgccgagucccgcgagggcuaccgccccaucgccaagcacuccuccguccucuucuucuccaucgccgaccucgccaacaucgaccccauguaccaguacucccucaccugguucgucaaccucuacaucaacuccauccacgacuccaacaaguccaagauccucgagaagcgccuccgcuaccucaacgaccacuucaccuacaaccucuacugcaacaucugccgcucccucuucgagaaggacaagcuccucuucuccuuccuccucugcgccaaccuccuccucgcccgcaaggagaucgaguaccaggagcucauguuccuccucaccggcggcgucucccucaaguccgccgagaagaaccccgaccccaccuggcuccaggacaaguccugggaggagaucugccgcgccuccgaguuccccgccuuccgcggccuccgccagcacuucugcgagcacaucuacgaguggcgcgagaucuacgacuccaaggagccccacaacgccaaguuccccgcccccauggacaagaaccucaacgagcuccagaagaucaucauccuccgcugccuccgccccgacaagaucacccccgccaucaccaacuacgucaccgacaagcucggcaagaaguucgucgagcccccccccuucgaccucaccaaguccuaccucgacuccaacugcaccaucccccucaucuucguccucucccccggcgccgaccccauggccucccuccucaaguucgccaacgacaaguccauguccggcaacaaguuccaggccaucucccucggccagggccagggccccaucgccgccaagaugaucaaggccgccaucgaggagggcaccugggucugccuccagaacugccaccucgccgucuccuggaugcccaugcucgagaagaucugcgaggacuucaccuccgagaccugcaacuccuccuuccgccucuggcucaccuccuaccccuccuccaaguuccccgucaccauccuccagaacggcgucaagaugaccaacgagccccccaccggccuccgccucaaccuccuccaguccuaccucaccgaccccgucuccgaccccgaguucuucaagggcugccgcggcaaggagcucgccugggagaagcuccucuucggcgucugcuucuuccacgcccucguccaggagcgcaagaaguucggcccccucggcuggaacauccccuacggcuucaacgaguccgaccuccgcaucuccauccgccagcuccagcucuucaucaacgaguacgacaccauccccuucgaggccaucuccuaccucaccggcgagugcaacuacggcggccgcgucaccgacgacugggaccgccgccuccuccucaccaugcucgccgacuucuacaaccucuacaucgucgagaacccccacuacaaguucucccccuccggcaacuacuucgccccccccaagggcaccuacgaggacuacaucgaguucaucaagaagcuccccuucacccagcaccccgagaucuucggccuccacgagaacgucgacaucuccaaggaccuccagcagaccaagacccucuucgagucccuccuccucacccagggcggcuccaagcagaccggcgccuccggcuccaccgaccagauccuccucgagaucaccaaggacauccucaacaagcuccccuccgacuucgacaucgagauggcccuccgcaaguaccccguccgcuacgaggaguccaugaacaccguccucguccaggagauggagcgcuucaacaaccucaucaucaccauccgcaacacccuccgcgaccucgagaaggccaucaagggcgucgucgucauggacuccgcccucgaggcccucuccggcucccuccucgucggcaagguccccgagaucugggccaagcgcuccuaccccucccucaagccccucggcuccuacaucaccgacuuccucgcccgccucaacuuccuccaggacugguacaacuccggcaagcccugcgucuucuggcucuccggcuucuucuucacccaggccuuccucaccggcgccaugcagaacuacgcccgcaaguacaccacccccaucgaccuccucggcuacgaguucgaggucauccccuccgacaccuccgacaccucccccgaggacggcgucuacauccacggccucuaccucgacggcgcccgcugggaccgcgaguccggccuccucgccgagcaguaccccaagcuccucuucgaccucaugcccaucaucuggaucaagcccacccagaagucccgcaucaucaaguccgacgccuacgucugcccccucuacaagaccuccgagcgcaagggcacccucuccaccaccggccacuccaccaacuucgucaucgccaugcuccucaagaccgaccagcccacccgccacuggaucaagcgcggcgucgcccuccucugccagcucgacgacuga

SEQ ID NO: 42311 - RNA, 13389 nt, Artificial Sequence
  derived and/or modified sequence opt2 from DNAH17__Homo_sapiens__NP_775899
augaccauggcccccgacguccgccucgaguaccucgaggaggucgccuccaucguccucaaguucaagcccgacaagugguccaagcucaucggcgccgaggagaacgucgcccucuucaccgaguucuucgagaagcccgacguccagguccucguccucacccucaacgccgccggcaugaucauccccugccucggcuucccccagucccucaaguccaagggcgucuacuucaucaagaccaaguccgagaacaucaacaaggacaacuaccgcgcccgccuccucuacggcgacaucucccccacccccgucgaccagcucaucgccgucgucgaggagguccucuccucccuccucaaccaguccgagaacauggccggcuggccccaggucgucuccgaggacaucgucaagcagguccaccgccucaagaacgagauguucgucauguccggcaagaucaagggcaagacccuccuccccauccccgagcaccucggcucccucgacggcacccucgaguccauggagcgcauccccuccucccucgacaaccuccuccuccacgccaucgagaccaccaucaucgacuggucccaccagauccgcgacguccucuccaaggacuccgcccaggcccuccucgacggccuccacccccucccccaggucgaguucgaguucugggacacccgccuccucaaccucaagugcauccacgagcagcucaaccgccccaaggucaacaagaucgucgagauccucgagaaggccaaguccugcuacuggcccgcccuccagaacgucuacaccaacgucaccgagggccucaaggaggccaacgacaucguccucuaccucaagccccuccgcauccuccucgaggagauggagcaggccgacuucaccaugcuccccaccuucaucgccaagguccucgacaccaucugcuucaucugggccaccuccgaguacuacaacacccccgcccgcaucaucgucauccuccaggaguucugcaaccagaucaucgagaugacccgcaccuuccucucccccgaggagguccucaagggccuccagggcgagaucgaggagguccucuccggcaucucccucgccgucaacguccucaaggagcucuaccagaccuacgacuucugcugcgucaacaugaagcucuucuucaaggacaaggagcccguccccugggaguuccccuccucccucgccuucucccgcaucaacuccuucuuccagcgcauccagaccaucgaggagcucuacaagaccgccaucgaguuccucaagcucgagaagaucgagcucggcggcguccgcggcaaccuccucggcucccucgucacccgcaucuacgacgaggucuucgagcucgucaaggucuucgccgacugcaaguacgacccccucgaccccggcgacuccaacuucgaccgcgacuacgccgacuucgagaucaagauccaggaccucgaccgccgccucgccaccaucuucugccagggcuucgacgacugcuccugcaucaaguccuccgccaagcuccucuacaugugcggcggccucauggagcgcccccucauccucgccgaggucgccccccgcuacuccgucaugcucgagcucuucgacgccgagcucgacaacgccaagauccucuacgacgcccagauggccgccuccgaggagggcaacaucccccucauccacaagaacaugccccccgucgccggccagcucaaguggucccucgagcuccaggagcgccucgaggucuccaugaagcaccucaagcacgucgagcaccccgucauguccggcgccgaggccaagcucaccuaccagaaguacgacgagaugauggagcuccuccgcugccaccgcgagaagaucuaccagcagugggucgccggcgucgaccaggacugccacuucaaccucggccagccccucauccuccgcgacgccgccuccaaccucauccacgucaacuucuccaaggcccucgucgccguccuccgcgaggucaaguaccucaacuuccagcagcagaaggagauccccgacuccgccgagucccucuucuccgagaacgagaccuuccgcaaguucgucggcaaccucgagcucaucgucggcugguacaacgagaucaagaccaucgucaaggccgucgaguuccuccucaucaaguccgagcucgaggccaucgacgucaagcuccucuccgccgagaccacccucuucuggaacggcgagggcgucuuccaguacauccaggagguccgcgagauccuccacaaccuccagaaccgcaugcagaaggccaagcagaacaucgagggcaucucccaggccaugaaggacugguccgccaacccccucuucgagcgcaaggacaacaagaaggaggcccuccucgaccucgacggccgcaucgccaaccucaacaagcgcuacgccgccguccgcgacgccggcgucaagauccaggccauggucgccgagaacgccgagcucuuccgcgccgacacccucucccuccccuggaaggacuacgucaucuacaucgacgacaugguccucgacgaguucgaccaguucauccgcaagucccucuccuuccucauggacaacauggucaucgacgaguccaucgccccccucuucgagauccgcauggagcucgacgaggacggccucaccuucaaccccacccucgaggucggcuccgaccgcggcuuccucgcccucaucgagggccucgucaacgacaucuacaacgucgcccgccucaucccccgccucgccaaggaccgcaugaacuacaagauggaccucgaggacaacaccgaccucaucgagaugcgcgaggaggucuccucccucgucaucaacgccaugaaggaggccgaggaguaccaggacuccuucgagcgcuacuccuaccucuggaccgacaaccuccaggaguucaugaagaacuuccucaucuacggcugcgccgucaccgccgaggaccucgacaccuggaccgacgacaccauccccaagaccccccccacccucgcccaguuccaggagcagaucgacuccuacgagaagcucuacgaggaggucuccaagugcgagaacaccaaggucuuccacggcuggcuccagugcgacugccgccccuucaagcaggcccuccucuccaccauccgccgcuggggcuucauguucaagcgccaccucuccaaccacgucaccaacucccucgccgaccucgaggccuucaugaaggucgcccgcaugggccucaccaagccccucaaggagggcgacuacgacggccucgucgaggucaugggccaccucaugaaggucaaggagcgccaggccgccaccgacaacauguucgagccccucaagcagaccaucgagcuccucaagaccuacggcgaggagaugcccgaggagauccaccucaagcuccaggagcuccccgagcacugggccaacaccaagaagcucgccauccaggucaagcucaccgucgccccccuccaggccaacgaggucuccauccuccgccgcaagugccagcaguucgagcucaagcagcacgaguuccgcgagcgcuuccgccgcgaggcccccuucuccuucuccgaccccaaccccuacaagucccucaacaagcagcagaaguccaucuccgccauggagggcaucauggaggcccucuccaaguccggcggccucuucgagguccccguccccgacuacaagcagcucaaggccugccaccgcgagguccgccuccucaaggagcucugggacauggucgucgucgucaacaccuccaucgaggacuggaagaccaccaaguggaaggacaucaacgucgagcagauggacaucgacugcaagaaguucgccaaggacaugcgcucccucgacaaggagaugaagaccugggacgccuucgucggccucgacaacaccgucaagaacgucaucaccucccuccgcgccgucuccgagcuccagaaccccgccauccgcgagcgccacuggcagcagcucaugcaggccacccaggucaaguucaagauguccgaggagaccacccucgccgaccuccuccagcucaaccuccacuccuacgaggacgagguccgcaacaucgucgacaaggccgucaaggaguccggcauggagaagguccucaaggcccucgacuccaccugguccaugauggaguuccagcacgagccccacccccgcaccggcaccaugaugcucaaguccuccgagguccucgucgagacccucgaggacaaccagguccagcuccagaaccucaugauguccaaguaccucgcccacuuccucaaggaggucaccuccuggcagcagaagcucuccaccgccgacuccgucaucuccaucugguucgagguccagcgcaccuggucccaccucgaguccaucuucaucggcuccgaggacauccgcacccagcuccccggcgacucccagcgcuucgacgacaucaaccaggaguucaaggcccucauggaggacgccgucaagacccccaacgucgucgaggccaccuccaagcccggccucuacaacaagcucgaggcccucaagaagucccucgccaucugcgagaaggcccucgccgaguaccucgagaccaagcgccucgccuucccccgcuucuacuucgucuccuccgccgaccuccucgacauccucuccaacggcaacgaccccgucgaggucucccgccaccucuccaagcucuucgacucccucugcaagcucaaguuccgccucgacgccuccgacaagccccucaaggucggccucggcauguacuccaaggaggacgaguacauggucuucgaccaggagugcgaccucuccggccaggucgaggucuggcucaaccgcguccucgaccgcaugugcuccacccuccgccacgagauccccgaggccgucgucaccuacgaggagaagccccgcgagcaguggauccucgacuaccccgcccaggucgcccucaccugcacccagaucugguggaccaccgaggucggccucgccuucgcccgccucgaggagggcuacgagaacgccauccgcgacuacaacaagaagcagaucucccagcucaacguccucaucacccuccucaugggcaaccucaacgccggcgaccgcaugaagaucaugaccaucugcaccaucgacguccacgcccgcgacgucgucgccaagaugaucgucgccaaggucgaguccucccaggccuucaccuggcaggcccagcuccgccaccgcugggacgaggagaagcgccacugcuucgccaacaucugcgacgcccagauccaguacuccuacgaguaccucggcaacaccccccgccucgucaucaccccccucaccgaccgcugcuacaucacccucacccagucccuccaccucaucaugggcggcgcccccgccggccccgccggcaccggcaagaccgagaccaccaaggaccucggccgcgcccucggcaccauggucuacgucuucaacugcuccgagcagauggacuacaaguccugcggcaacaucuacaagggccucgcccagaccggcgccuggggcugcuucgacgaguucaaccgcaucuccgucgagguccucuccgucaucgccguccaggucaagugcguccaggacgccauccgcgccaagaagaaggccuucaacuuccucggcgagaucaucggccucauccccaccgucggcaucuucaucaccaugaaccccggcuacgccggccgcgccgagcuccccgagaaccucaaggcccucuuccgccccugcgccauggucguccccgacuucgagcucaucugcgagaucaugcucauggccgagggcuuccucgaggcccgccuccucgcccgcaaguucaucacccucuacacccucugcaaggagcuccucuccaagcaggaccacuacgacuggggccuccgcgccaucaaguccguccucgucgucgccggcucccucaagcgcggcgaccccucccgcgccgaggaccagguccucaugcgcgcccuccgcgacuucaacauccccaagaucgucaccgacgaccuccccgucuucaugggccucaucggcgaccucuuccccgcccucgacgucccccgcaagcgcgaccucaacuucgagaagaucaucaagcaguccaucgucgagcucaagcuccaggccgaggacuccuucguccucaaggucguccagcucgaggagcuccuccagguccgccacuccgucuucaucgucggcaacgccggcuccggcaagucccagguccucaagucccucaacaagaccuaccagaaccucaagcgcaagcccgucgccgucgaccucgaccccaaggccgucaccugcgacgagcucuucggcaucaucaaccccgucacccgcgaguggaaggacggccucuucuccaccaucaugcgcgaccucgccaacaucacccacgacggccccaaguggaucauccucgacggcgacaucgaccccauguggaucgagucccucaacaccgucauggacgacaacaagguccucacccucgccuccaacgagcgcaucccccucaaccgcaccaugcgccucgucuucgagaucucccaccuccgcaccgccacccccgccaccgucucccgcgccggcauccucuacaucaaccccgccgaccucggcuggaaccccgucgucuccuccuggaucgagcgccgcaagguccaguccgagaaggccaaccucaugauccucuucgacaaguaccuccccaccugccucgacaagcuccgcuucggcuucaagaagaucacccccguccccgagaucaccgucauccagaccauccucuaccuccucgagugccuccucaccgagaagaccgucccccccgacuccccccgcgagcucuacgagcucuacuucgucuucaccugcuucugggccuucggcggcgccauguuccaggaccagcucgucgacuaccgcgucgaguucuccaagugguggaucaacgaguucaagaccaucaaguuccccucccagggcaccaucuucgacuacuacaucgaccccgacaccaagaaguuccuccccuggaccgacaagguccccuccuucgagcucgaccccgacgucccccuccaggccucccucguccacaccaccgagaccauccgcauccgcuacuucauggaccuccucauggagaaguccuggcccgucaugcucgucggcaacgccggcaccggcaaguccguccucaugggcgacaagcucgagucccucaacaccgacaacuaccucguccaggccguccccuucaacuucuacaccaccuccgccaugcuccagggcguccucgagaagccccucgagaagaaguccggccgcaacuacggcccccccggcaccaagaagcucgucuacuucaucgacgacaugaacaugcccgaggucgacaaguacggcaccgucgccccccacacccucauccgccagcacauggaccaccgccacugguacgaccgccacaagcucacccucaaggacauccacaacugccaguacgucgccugcaugaaccccaccuccggcuccuucaccaucgacucccgccuccagcgccacuucugcgucuucgccgucuccuuccccggccaggaggcccucaccaccaucuacaacaccauccucacccagcaccucgccuuccgcuccgucuccauggccauccagcgcaucuccucccagcucgucgccgccgcccucgcccuccaccagaagaucaccgccaccuuccuccccaccgccaucaaguuccacuacgucuucaaccuccgcgaccucuccaacaucuuccagggccuccucuucuccaccgccgagguccucaagaccccccucgaccucguccgccucuggcuccacgagaccgagcgcgucuacggcgacaagauggucgacgagaaggaccaggagacccuccaccgcgucaccauggccuccaccaagaaguucuucgacgaccucggcgacgagcuccucuucgccaagcccaacaucuucugccacuucgcccagggcaucggcgaccccaaguacguccccgucaccgacauggccccccucaacaagcuccucgucgacguccucgacuccuacaacgaggucaacgccgucaugaaccucguccucuucgaggacgccgucgcccacaucugccgcaucaaccgcauccucgaguccccccgcggcaacgcccuccucgucggcgucggcggcuccggcaagcagucccucucccgccucgccgccuacaucuccggccucgacgucuuccagaucacccucaagaagggcuacggcauccccgaccucaagaucgaccucgccgcccaguacaucaaggccgccgucaagaacguccccuccgucuuccucaugaccgacucccaggucgccgaggagcaguuccucguccucaucaacgaccuccucgccuccggcgagauccccggccucuucauggaggacgaggucgagaacaucaucuccuccaugcgcccccaggucaagucccucggcaugaacgacacccgcgagaccugcuggaaguucuucaucgagaagguccgccgccagcucaaggucauccucugcuucucccccgucggcuccguccuccgcguccgcgcccgcaaguuccccgccgucgucaacugcaccgccaucgacugguuccacgaguggcccgaggacgcccucgucuccgucuccgcccgcuuccucgaggagaccgagggcauccccugggaggucaaggccuccaucuccuucuucauguccuacguccacaccaccgucaacgagaugucccgcgucuaccucgccaccgagcgccgcuacaacuacaccacccccaagaccuuccucgagcagaucaagcucuaccagaaccuccucgccaagaagcgcaccgagcucgucgccaagaucgagcgccucgagaacggccucaugaagcuccaguccaccgccucccaggucgacgaccucaaggccaagcucgccauccaggaggccgagcucaagcagaagaacgaguccgccgaccagcucauccaggucgucggcaucgaggccgagaaggucuccaaggagaaggccaucgccgaccaggaggaggucaaggucgaggucaucaacaagaacgucaccgagaagcagaaggccugcgagaccgaccucgccaaggccgagcccgcccuccucgccgcccaggaggcccucgacacccucaacaagaacaaccucaccgagcucaaguccuucggcuccccccccgacgccgucgucaacgucaccgccgccgucaugauccucaccgcccccggcggcaagauccccaaggacaaguccuggaaggccgccaagaucaugaugggcaaggucgacaccuuccucgacucccucaagaaguucgacaaggagcacauccccgaggccugccucaaggccuucaagcccuaccagggcaaccccaccuucgaccccgaguucauccgcuccaaguccaccgccgccgccggccucugcuccuggugcaucaacaucguccgcuucuacgaggucuacugcgacgucgcccccaagcgccaggcccucgaggaggccaacgccgagcucgccgaggcccaggagaagcucucccgcaucaagaacaagaucgccgagcucaacgccaaccucuccaaccucaccuccgccuucgagaaggccaccgccgagaagaucaagugccagcaggaggccgacgccaccaaccgcgucauccuccucgccaaccgccucgucggcggccucgccuccgagaacauccgcugggccgaguccgucgagaacuuccgcucccagggcgucacccucugcggcgacguccuccucaucuccgccuucgucuccuacgucggcuacuucaccaagaaguaccgcaacgagcucauggagaaguucuggauccccuacauccacaaccucaagguccccauccccaucaccaacggccucgacccccucucccuccucaccgacgacgccgacgucgccaccuggaacaaccagggccuccccuccgaccgcauguccaccgagaacgccaccauccucggcaacaccgagcgcuggccccucaucgucgacgcccagcuccagggcaucaaguggaucaagaacaaguaccgcuccgagcucaaggccauccgccucggccagaaguccuaccucgacgucaucgagcaggccaucuccgagggcgacacccuccucaucgagaacaucggcgagaccgucgaccccguccucgacccccuccucggccgcaacaccaucaagaagggcaaguacaucaagaucggcgacaaggaggucgaguaccaccccaaguuccgccucauccuccacaccaaguacuucaacccccacuacaagcccgagaugcaggcccagugcacccucaucaacuuccucgucacccgcgacggccucgaggaccagcuccucgccgccgucgucgccaaggagcgccccgaccucgagcagcucaaggccaaccucaccaagucccagaacgaguucaagaucguccucaaggagcucgaggacucccuccucgcccgccucuccgccgccuccggcaacuuccucggcgacaccgcccucgucgagaaccucgagaccaccaagcacaccgccuccgagaucgaggagaaggucgucgaggccaagaucaccgaggucaagaucaacgaggcccgcgagaacuaccgccccgccgccgagcgcgccucccuccucuacuucauccucaacgaccucaacaagaucaaccccgucuaccaguucucccucaaggccuucaacgucgucuucgagaaggccauccagcgcaccacccccgccaacgaggucaagcagcgcgucaucaaccucaccgacgagaucaccuacuccgucuacauguacaccgcccgcggccucuucgagcgcgacaagcucaucuuccucgcccaggucaccuuccagguccucuccaugaagaaggagcucaaccccgucgagcucgacuuccuccuccgcuuccccuucaaggccggcgucgucucccccgucgacuuccuccagcaccagggcuggggcggcaucaaggcccucuccgagauggacgaguucaagaaccucgacuccgacaucgagggcuccgccaagcgcuggaagaagcucgucgaguccgaggcccccgagaaggagaucuuccccaaggaguggaagaacaagaccgcccuccagaagcucugcaugguccgcugccuccgccccgaccgcaugaccuacgccaucaagaacuucgucgaggagaagaugggcuccaaguucgucgagggccgcuccgucgaguucuccaaguccuacgaggaguccucccccuccaccuccaucuucuucauccucucccccggcgucgacccccucaaggacgucgaggcccucggcaagaagcucggcuucaccaucgacaacggcaagcuccacaacgucucccucggccagggccaggaggucgucgccgagaacgcccucgacgucgccgccgagaagggccacugggucauccuccagaacauccaccucgucgcccgcuggcucggcacccucgacaagaagcucgagcacuacuccaccggcucccacgaggacuaccgcgucuucaucuccgccgagcccgcccccucccccgagacccacaucaucccccagggcauccucgagaacgccaucaagaucaccaacgagccccccaccggcaugcacgccaaccuccacaaggcccucgaccucuucacccaggacacccucgagaugugcaccaaggagauggaguucaagugcaugcucuucgcccucugcuacuuccacgccgucgucgccgagcgccgcaaguucggcgcccagggcuggaaccgcuccuaccccuucaacaacggcgaccucaccaucuccaucaacguccucuacaacuaccucgaggccaaccccaagguccccugggacgaccuccgcuaccucuucggcgagaucauguacggcggccacaucaccgacgacugggaccgccgccucugccgcaccuaccucgccgaguacauccgcaccgagaugcucgagggcgacguccuccucgcccccggcuuccagaucccccccaaccucgacuacaagggcuaccacgaguacaucgacgagaaccucccccccgagucccccuaccucuacggccuccaccccaacgccgagaucggcuuccucaccgucaccuccgagaagcucuuccgcaccguccucgagaugcagcccaaggagaccgacuccggcgccggcaccggcgucucccgcgaggagaaggucaaggccguccucgacgacauccucgagaagauccccgagaccuucaacauggccgagaucauggccaaggccgccgagaagacccccuacgucgucgucgccuuccaggagugcgagcgcaugaacauccucaccaacgagaugcgccgcucccucaaggagcucaaccucggccucaagggcgagcucaccaucaccaccgacgucgaggaccucuccaccgcccucuucuacgacaccguccccgacaccugggucgcccgcgccuaccccuccaugaugggccucgccgccugguacgccgaccuccuccuccgcauccgcgagcucgaggccuggaccaccgacuucgcccuccccaccaccgucuggcucgccggcuucuucaacccccaguccuuccucaccgccaucaugcaguccauggcccgcaagaacgaguggccccucgacaagaugugccucuccgucgaggucaccaagaagaaccgcgaggacaugaccgcccccccccgcgagggcuccuacgucuacggccucuucauggagggcgcccgcugggacacccagaccggcgucaucgccgaggcccgccucaaggagcucacccccgccaugcccgucaucuucaucaaggccauccccgucgaccgcauggagaccaagaacaucuacgagugccccgucuacaagacccgcauccgcggccccaccuacgucuggaccuucaaccucaagaccaaggagaaggccgccaaguggauccucgccgccgucgcccuccuccuccaggucuga

SEQ ID NO: 42312 - RNA, 12798 nt, Artificial Sequence
  derived and/or modified sequence opt2 from DNAH1__Homo_sapiens__NP_056327
auggagcagcccaacuccaagggcuacucccucggccgcaccccccagggccccgagugcuccuccgcccccgccguccaggucggcacccaccgcggccucgaguacaaccccggcaagauccuccccggcuccgacuacggccucggcaacccccccgcccucgaccccaagcucccccaccucccccucccccccgccccccccacccucuccgaccucggccagccccgcaaguccccccucaccggcaccgacaagaaguacccccucaugaagcagcgcggcuucuacuccgacauccucucccccggcacccucgaccagcucggcgaggucugccgcggcccccgcaugucccagaaccuccuccgccaggccgaccucgacaaguucaccccccgcgucggcuccuucgagguccccgaggacuuccaggagcgcauggagcagcagugcaucggcuccaccacccgccuccucgcccagaccgacuucccccuccaggccuacgagcccaagaugcagguccccuuccagguccuccccggccagcacccccgcaagaucgagaucgagcgccgcaagcagcaguaccucucccucgacaucgagcagcuccucuucucccagggcaucgacuccaacaagcucaugccccgccaccucgaccaccagcacccccagaccaucgagcagggccacgaccccaucuuccccaucuaccucccccucaaggucuucgacaacgaggacuucgacugccgcaccccccgcgaguggaucaacaugggccucgagcccggcucccucgaccgcaagcccguccccggcaaggcccuccuccccaccgacgacuuccucggccacgaggaccccaagucccagaagcucaaguacaaguggugcgaggucggcguccucgacuacgacgaggagaagaagcucuaccucguccacaagaccgacgagaagggccucguccgcgacgagaugggccgccccauccucaacgccggcgucaccaccgagggccgccccccccuccaggucugccaguacugggucccccgcauccagcuccucuucugcgccgaggaccccugcauguucgcccagcgcgucguccaggccaacgcccuccgcaagaacaccgaggcccuccuccucuacaaccucuacgucgacugcaugcccuccgacggccagcacgucaucuccgagcagucccucuccaagaucaagcagugggcccucuccaccccccgcaugcgcaagggccccuccguccucgagcaccucuccucccucgcccgcgaggucucccucgacuacgagcgcuccaugaacaagaucaacuucgaccacgucgucuccuccaagcccgagaccuucuccuacgucacccuccccaagaaggaggaggagcagguccccgagcgcggccucgucuccguccccaaguaccacuucugggagcagaaggaggacuucaccuucgucucccuccucacccgccccgaggucaucaccgcccucuccaagguccgcgccgagugcaacaaggucaccgccaugucccucuuccacuccucccucuccaaguacucccaccucgaggaguucgagcagauccagucccagaccuucucccagguccagauguuccucaaggacuccuggaucuccucccucaaggucgccaugcgcuccucccuccgcgacauguccaagggcugguacaaccucuacgagaccaacugggaggucuaccucauguccaagcuccgcaagcucauggagcucgucaaguacaugcuccaggacacccuccgcuuccucguccaggacucccucgccuccuucucccaguucaucuccgacaccugcugcuccguccucaacugcaccgacgacauggucuggggcgacgaccucaucaacucccccuaccgcccccgcaagaacccccucuucaucauggaccucguccucgacuccuccggcguccacuacuccaccccccucgagcaguucgaggccucccuccucaaccucuucgacaagggcauccucgccacccacgccgucccccagcucgagaagcucgucauggaggacaucuucaucuccggcgacccccuccucgaguccgucggccuccacgagccccucgucgaggagcuccgcgccaccaucgccuccgccgucuccaaggccaugaucccccuccaggccuacgccaaggaguaccgcaaguaccucgagcucaacaacaacgacaucgccuccuuccucaagaccuaccagacccagggccuccucgcccaggagguccgcgaggucguccucacccaccuccgcgagaaggagauccucgacuccucccuccccuccuccaucaucaucggccccuucuacaucaacaccgacaacgucaagcagucccucuccaagaagcgcaaggcccucgccaccuccguccucgacauccucgccaagaaccuccacaaggaggucgacuccaucugcgaggaguuccgcuccaucucccgcaagaucuacgagaagcccaacuccaucgaggagcucgccgagcuccgcgaguggaugaagggcauccccgagcgccucgucggccucgaggagcgcaucgucaaggucauggacgacuaccaggucauggacgaguuccucuacaaccucuccuccgacgacuucaacgacaaguggaucgccuccaacuggcccuccaagauccucggccagaucgagcucguccagcagcagcacgucgaggacgaggagaaguuccgcaagauccagaucauggaccagaacaacuuccaggagaagcucgagggccuccagcucgucgucgccggcuucuccauccacgucgagaucucccgcgcccacgagaucgccaacgagguccgccgcgucaagaagcagcucaaggacugccagcagcucgccaugcucuacaacaaccgcgagcgcaucuucucccuccccaucaccaacuacgacaagcucucccgcauggucaaggaguuccagcccuaccucgaccucuggaccaccgccuccgacuggcuccgcugguccgaguccuggaugaacgacccccucuccgccaucgacgccgagcagcucgagaagaacgucgucgaggccuucaagaccaugcacaagugcgucaagcaguucaaggacaugcccgccugccaggaggucgcccucgacauccgcgcccgcaucgaggaguucaagcccuacaucccccucauccagggccuccgcaaccccggcaugcgcauccgccacugggagacccucuccaaccagaucaacaucaacguccgccccaaggccaaccucaccuucgcccgcugccucgagaugaaccuccaggaccacaucgaguccaucuccaaggucgccgaggucgccggcaaggaguacgccaucgagcaggcccucgacaagauggagaaggagugguccaccauccucuucaacguccuccccuacaaggccaccgacaccuacauccucaagucccccgacgaggccucccagcuccucgacgaccacaucgucaugacccagaacauguccuucucccccuacaagaagcccuucgagcagcgcaucaacuccugggagaacaagcucaagcucacccaggagguccucgaggaguggcucaacugccagcgcuccuggcucuaccucgagcccaucuucuccuccgaggacaucaaccagcagcuccccgucgaguccaagcgcuaccagaccauggagcgcaucuggaagaagaucaugaagaacgccuacgagaaccgcgaggucaucaacgucugcuccgaccuccgcaugcucgacucccuccgcgacugcaacaagauccucgaccucguccagaagggccucuccgaguaccucgagaccaagcgcuccgccuucccccgcuucuacuuccucuccgacgacgagcuccucgagauccucucccagaccaaggaccccaccgccguccagccccaccuccgcaagugcuucgagaacaucgcccgccuccucuuccaggaggaccucgagaucacccacauguacuccgccgagggcgaggagguccagcucugcuucuccaucuaccccuccuccaacgucgaggacuggcuccgcgaggucgagcgcuccaugaaggccuccguccacgacaucaucgagaaggccauccgcgccuaccccaccaugccccgcacccaguggguccucaacuggcccggccaggucaccaucgccggcugccagaccuacuggaccauggaggucgccgaggcccucgaggccggcaaccuccgcucccagcucuucccccagcucugccagcagcucuccgaccucgucgcccucguccgcggcaagcucucccgcaugcagcgcgccguccucuccgcccucaucgucaucgagguccacgccaaggacgucgucuccaagcucauccaggagaacgucgucuccgucaacgacuuccaguggaucucccagcuccgcuacuacuggaccaacaacgaccucuacauccgcgccgucaacgccgaguucaucuacggcuacgaguaccucggcaacuccggccgccucgucaucaccccccucaccgaccgcugcuaccucacccucaccggcgcccuccaccucaaguucggcggcgcccccgccggccccgccggcaccggcaagaccgagaccaccaaggaccucggcaaggcccucgccauccagaccgucgucuucaacugcuccgaccagcucgacuucauggccaugggcaaguucuucaagggccucgccuccgccggcgccugggccugcuucgacgaguucaaccgcaucgacaucgagguccucuccgucgucgcccagcagaucaccaccauccagaaggcccagcagcagcgcgucgagcgcuucauguucgagggcgucgagaucccccucguccccuccugcgccgucuucaucaccaugaaccccggcuacgccggccgcaccgagcuccccgacaaccucaaggcccucuuccgccccgucgccaugaugguccccgacuacgccaugaucaccgagaucucccucuacuccuucggcuucaacgaggccuccguccucgccaagaagaucaccaccaccuucaagcucuccuccgagcagcucuccucccaggaccacuacgacuucggcaugcgcgccgucaagaccgucaucuccgccgccggcaaccucaagcgcgagaaccccuccaugaacgaggagcucaucugccuccgcgccauccgcgacgucaacguccccaaguuccuccaggaggaccucaagcucuucuccggcaucgucuccgaccucuuccccaccaucaaggaggaggacaccgacuacggcauccucgacgaggccauccgcgaggccugccgcaacuccaaccucaaggacgucgagggcuuccucaccaagugcauccagcucuacgagaccaccgucguccgccacggccucaugcucgucggccccaccggcuccggcaaguccaccugcuaccgcguccucgccgccgccaugaccucccucaagggccagcccuccaucuccggcggcauguacgaggccgucaacuacuacguccucaaccccaaguccaucaccaugggccagcucuacggcgaguucgaccuccucacccacgaguggaccgacggcaucuucuccuccuucauccgcgccggcgccaucaccuccgacaccaacaagaagugguacauguucgacggccccgucgacgccaucuggaucgagaacaugaacaccguccucgacgacaacaagaagcucugccucuccuccggcgagaucaucaagcucaccgaggccaugaccaugauguucgagguccaggaccucgccgucgccucccccgccaccgucucccgcugcggcauggucuaccucgagcccuccauccucggccucaugcccuucaucgagugcuggcuccgcaagcuccccccccuccucaagcccuacgaggagcacuucaaggcccucuucgucuccuuccucgaggaguccaucuccuucguccgcuccuccgucaaggaggucaucgccuccaccaacugcaaccucaccaugucccuccucaagcuccucgacugcuucuucaagcccuuccucccccgcgagggccucaagaagauccccuccgagaagcucucccgcaucgucgagcucaucgagcccugguucaucuucucccucaucugguccgucggcgccaccggcgacuccuccggccgcaccuccuucucccacuggcuccgccucaagauggagaacgagcagcucacccuccucuuccccgaggagggccucgucuucgacuaccgccucgaggacgccggcaucuccggcaccaacgacuccgaggacgaggaggaggaguacaagcaggucgccugggucaaguggauggacuccuccgcccccuucaccaugguccccgacaccaacuacugcaacaucaucguccccaccauggacaccguccagaugucccaccuccucgacaugcuccucaccaacaagaagcccguccucugcaucggccccaccggcaccggcaagacccucaccaucuccgacaagcuccucaagaaccucgcccucgacuacaucucccacuuccucaccuucuccgcccgcaccuccgccaaccagacccaggacuucaucgacuccaagcucgacaagcgccgcaagggcgucuucggccccccccucggccgcaacuucaucuucuucaucgacgaccucaacaugcccgcccucgagaccuacggcgcccagccccccaucgagcuccuccgccaguggauggaccacggcggcugguacgaccgcaagaucaucggcgccuucaagaaccucgucgacaucaacuucgucugcgccaugggcccccccggcggcggccgcaacaccgucaccccccgccucaugcgccacuucaacuaccucuccuucgccgagauggacgaggucuccaagaagcgcaucuucuccaccauccucggcaacuggcucgacggccuccucggcgagaaguccuaccgcgagcgcguccccggcgccccccacaucgcccacuucaccgagccccucgucgaggccaccaucauggucuacgccaccaucaccucccagcuccuccccacccccgccaagucccacuacaccuucaaccuccgcgaccucuccaaggucuuccagggcaugcucauggccgaccccgccaaggucgaggaccagguccagcuccuccgccucugguaccacgagaacugccgcgucuuccgcgaccgccucgucaacgaggaggaccgcuccugguucgaccagcuccucaagcgcugcauggagcagugggaggucaccuucaacaaggucugccccuuccagcccauccucuacggcgacuucaugucccccggcuccgacgucaaguccuacgagcucaucaccuccgaguccaagaugaugcaggucaucgaggaguacaucgaggacuacaaccagaucaacaccgccaagcucaagcucguccucuucauggacgccaugucccacaucugccgcaucucccgcacccuccgccaggcccucggcaacgcccuccuccucggcgucggcggcuccggccgcuccucccucacccgccucgccucccacauggccgaguacgagugcuuccagaucgagcucuccaagaacuacggcauguccgaguggcgcgacgacgucaagaagguccuccucaaggccggccuccagaaccuccccaucaccuuccucuucuccgacacccagaucaagaacgaguccuuccucgaggacaucaacaacguccucaacuccggcgacauccccaaccucuacaccgccgacgagcaggaccagaucgucuccaccaugcgccccuacauccaggagcagggccuccagcccaccaaggccaaccucauggccgccuacaccggccgcguccgcuccaacauccacaugguccucugcaugucccccaucggcgaggucuuccgcgcccgccuccgccaguuccccucccucgucaacugcugcaccaucgacugguucaacgaguggcccgccgaggcccucaaguccgucgccaccgucuuccucaacgagauccccgagcucgaguccucccaggaggagauccagggccucauccaggucugcgucuacauccaccaguccgucuccaagaagugcaucgaguaccucgccgagcucacccgccacaacuacgucacccccaaguccuaccucgagcuccuccacaucuucuccauccucaucggccagaagaagcucgagcucaagaccgccaagaaccgcaugaaguccggccucgacaagcuccuccgcaccuccgaggacgucgccaagaugcaggaggaccucgaguccaugcacccccuccucgaggaggccgccaaggacaccaugcucaccauggagcagaucaaggucgacaccgccaucgccgaggagacccgcaacuccguccagaccgaggagaucaaggccaacgagaaggccaagaaggcccaggccaucgccgacgacgcccagaaggaccucgacgaggcccuccccgcccucgacgccgcccucgccucccuccgcaaccucaacaagaacgacgucaccgagguccgcgccaugcagcgccccccccccggcgucaagcucgucaucgaggccgucugcaucaugaagggcaucaagcccaagaagguccccggcgagaagcccggcaccaaggucgacgacuacugggagcccggcaagggccuccuccaggaccccggccacuuccucgagucccucuucaaguucgacaaggacaacaucggcgacgucgucaucaaggccauccagcccuacaucgacaacgaggaguuccagcccgccaccaucgccaaggucuccaaggccugcaccuccaucugccaguggguccgcgccaugcacaaguaccacuucgucgccaaggccgucgagcccaagcgccaggcccuccucgaggcccaggacgaccucggcgucacccagcgcauccucgacgaggccaagcagcgccuccgcgaggucgaggacggcaucgccaccaugcaggccaaguaccgcgagugcaucaccaagaaggaggagcucgagcucaagugcgagcagugcgagcagcgccucggccgcgccggcaagcucaucaacggccucuccgacgagaagguccgcuggcaggagaccgucgagaaccuccaguacaugcucaacaacaucuccggcgacguccucgucgccgccggcuucgucgccuaccucggccccuucaccggccaguaccgcaccguccucuacgacuccugggucaagcagcuccgcucccacaacgucccccacaccuccgagcccacccucaucggcacccucggcaaccccgucaagauccgcuccuggcagaucgccggccuccccaacgacacccucuccgucgagaacggcgucaucaaccaguucucccagcgcuggacccacuucaucgacccccagucccaggccaacaaguggaucaagaacauggagaaggacaacggccucgacgucuucaagcucuccgaccgcgacuuccuccgcuccauggagaacgccauccgcuucggcaagcccugccuccucgagaacgucggcgaggagcucgaccccgcccucgagcccguccuccucaagcagaccuacaagcagcagggcaacaccguccucaagcucggcgacaccgucauccccuaccacgaggacuuccgcauguacaucaccaccaagcuccccaacccccacuacacccccgagaucuccaccaagcucacccucaucaacuucacccucucccccuccggccucgaggaccagcuccucggccaggucgucgccgaggagcgccccgaccucgaggaggccaagaaccagcucaucaucuccaacgccaagaugcgccaggagcucaaggacaucgaggaccagauccucuaccgccucuccuccuccgagggcaaccccgucgacgacauggagcucaucaagguccucgaggccuccaagaugaaggccgccgagauccaggccaagguccgcaucgccgagcagaccgagaaggacaucgaccucacccgcauggaguacauccccgucgccauccgcacccagauccucuucuucugcgucuccgaccucgccaacgucgaccccauguaccaguacucccucgagugguuccucaacaucuuccucuccggcaucgccaacuccgagcgcgccgacaaccucaagaagcgcaucuccaacaucaaccgcuaccucaccuacucccucuacuccaacgucugccgcucccucuucgagaagcacaagcucauguucgccuuccuccucugcguccgcaucaugaugaacgagggcaagaucaaccaguccgaguggcgcuaccuccucuccggcggcuccaucuccaucaugaccgagaaccccgcccccgacuggcucuccgaccgcgccuggcgcgacauccucgcccucuccaaccuccccaccuucuccuccuucuccuccgacuucgucaagcaccucuccgaguuccgcgucaucuucgacucccucgagccccaccgcgagccccuccccggcaucugggaccaguaccucgaccaguuccagaagcuccucguccuccgcugccuccgcggcgacaaggucaccaacgccaugcaggacuucgucgccaccaaccucgagccccgcuucaucgagccccagaccgccaaccucuccgucgucuucaaggacuccaacuccaccaccccccucaucuucguccucucccccggcaccgaccccgccgccgaccucuacaaguucgccgaggagaugaaguucuccaagaagcucuccgccaucucccucggccagggccagggcccccgcgccgaggccaugaugcgcuccuccaucgagcgcggcaagugggucuucuuccagaacugccaccucgcccccuccuggaugcccgcccucgagcgccucaucgagcacaucaaccccgacaagguccaccgcgacuuccgccucuggcucaccucccuccccuccaacaaguuccccgucuccauccuccagaacggcuccaagaugaccaucgagcccccccgcggcguccgcgccaaccuccucaaguccuacuccucccucggcgaggacuuccucaacuccugccacaaggucauggaguucaagucccuccuccucucccucugccucuuccacggcaacgcccucgagcgccgcaaguucggcccccucggcuucaacauccccuacgaguucaccgacggcgaccuccgcaucugcaucucccagcucaagauguuccucgacgaguacgacgacauccccuacaagguccucaaguacaccgccggcgagaucaacuacggcggccgcgucaccgacgacugggaccgccgcugcaucaugaacauccucgaggacuucuacaaccccgacguccucucccccgagcacuccuacuccgccuccggcaucuaccaccagaucccccccaccuacgaccuccacggcuaccucuccuacaucaagucccucccccucaacgacaugcccgagaucuucggccuccacgacaacgccaacaucaccuucgcccagaacgagaccuucgcccuccucggcaccaucauccagcuccagcccaaguccuccuccgccggcucccagggccgcgaggagaucgucgaggacgucacccagaacauccuccucaagguccccgagcccaucaaccuccagugggucauggccaaguaccccguccucuacgaggaguccaugaacaccguccucguccaggaggucauccgcuacaaccgccuccuccaggucaucacccagacccuccaggaccuccucaaggcccucaagggccucgucgucauguccucccagcucgagcucauggccgccucccucuacaacaacaccguccccgagcucugguccgccaaggccuaccccucccucaagccccucuccuccugggucauggaccuccuccagcgccucgacuuccuccaggccuggauccaggacggcauccccgccgucuucuggaucuccggcuucuucuucccccaggccuuccucaccggcacccuccagaacuucgcccgcaaguucgucaucuccaucgacaccaucuccuucgacuucaaggucauguucgaggcccccuccgagcucacccagcgcccccaggucggcugcuacauccacggccucuuccucgagggcgcccgcugggaccccgaggccuuccagcucgccgagucccagcccaaggagcucuacaccgagauggccgucaucuggcuccuccccacccccaaccgcaaggcccaggaccaggacuucuaccucugccccaucuacaagacccucacccgcgccggcacccucuccaccaccggccacuccaccaacuacgucaucgccgucgagauccccacccaccagccccagcgccacuggaucaagcgcggcgucgcccucaucugcgcccucgacuacuga

SEQ ID NO: 42313 - RNA, 2619 nt, Artificial Sequence
  derived and/or modified sequence opt2 from DNAH2__Homo_sapiens__NP_001290199
auguccuccaaggccgagaagaagcagcgccucuccggccgcggcuccucccaggccuccugguccggccgcgccacccgcgccgccgucgccacccaggagcagggcaacgcccccgccgucuccgagcccgagcuccaggccgagcuccccaaggaggagcccgagccccgccucgagggcccccaggcccaguccgaggaguccgucgagcccgaggccgacgucaagccccucuuccucucccgcgccgcccucaccggccucgccgacgccgucuggacccaggagcacgacgccauccucgagcacuucgcccaggaccccaccgaguccauccucaccaucuucaucgaccccugcuucggccucaagcucgagcucggcaugcccguccagacccagaaccagcucgucuacuucauccgccaggcccccguccccaucaccugggagaacuucgaggccaccguccaguucggcaccguccgcggccccuacauccccgcccuccuccgccuccucggcggcgucuucgccccccagaucuucgccaacaccggcuggcccgaguccauccgcaaccacuucgccucccaccuccacaaguuccucgccugccucaccgacacccgcuacaagcucgagggccacaccguccucuacauccccgccgaggccaugaacaugaagcccgagauggucaucaaggacaaggagcucguccagcgccucgagaccuccaugauccacuggacccgccagaucaaggagaugcucuccgcccaggagaccgucgagaccggcgagaaccucggcccccucgaggagaucgaguucuggcgcaaccgcugcauggaccucuccggcaucuccaagcagcucgucaagaagggcgucaagcacgucgaguccauccuccaccucgccaaguccuccuaccucgcccccuucaugaagcucgcccagcagauccaggacggcucccgccaggcccaguccaaccucaccuuccucuccauccucaaggagcccuaccaggagcucgccuucaugaagcccaaggacaucuccuccaagcuccccaagcucaucucccucauccgcaucaucugggucaacuccccccacuacaacacccgcgagcgccucaccucccucuuccgcaagauguccaacgagaucauccgccucugcugccacgccaucucccucgaccgcaucuucgagggcuacgucuccuccuccaaggaggaccuccagggcugcauccucugcugccacgccuggaaggaccacuacguccaggccguccagaugcacauccaguucuccucccgcggcuggguccucgaccagaccuccaucuucgcccaggucgacgccuucguccagcgcugcaaggaccucaucgaggucugcgacugccaguaccacuucgcccgcugggaggacggcaagcagggcccccuccccugcuucuucggcgcccagggcccccagaucacccgcaaccuccucgagaucgaggacaucuuccacaagaaccuccacacccuccgcgccguccgcggcggcauccucgacgucaagaacaccugcuggcacgaggacuacaacaaguuccgcgccggcaucaaggaccucgaggucaugacccagaaccucaucaccuccgccuucgagcucguccgcgacgucccccacggcguccuccuccucgacaccuuccaccgccucgccucccgcgaggccaucaagcgcaccuacgacaagaaggccgucgaccucuacaugcucuucaacuccgagcucgcccucgucaaccgcgagcgcaacaagaaguggcccgaccucgagcccuacgucgcccaguacuccggcaaggcccgcuggguccacauccuccgccgccgcaucgaccgcgucaugaccugccucgccggcgcccacuuccucccccgcaucggcaccggcaaggaguccguccacaccuaccagcagaugguccaggccaucgacgagcucguccgcaagaccuuccaggaguggaccuccucccucgacaaggacugcauccgccgccucgacaccccccuccuccgcaucucccaggagaaggccggcaugcucgacgucaacuucgacaaguaccgcucccaccucgcccccuuccccuacaccccccuccuccagcucucccaggaguuccacucccaccuccucaccccccucuucaucauccucucccucucccacaccaucugccuccucuccuccuucuacuucuucuucuccuccuucaucuucgucuccccccaccucccccccugcuaccagcacuucaacuucaccaccuaccucaagacccagcagaacaagaccaugaucggccaggcccgcuggcucacccccgucauccccgcccucugggaggccgaggucggcgccucccucgagccccgcucccuccgcaccgccugggccaccuggcagaaccccgucuccgccaagaacaccaagaucuccugggccugguggcacaagcccgucgucuccgccaccugggagggcgaggucggcggcucccccgagcccggccgccagcgccuccaguga

SEQ ID NO: 42314 - RNA, 12351 nt, Artificial Sequence
  derived and/or modified sequence opt2 from DNAH3__Homo_sapiens__NP_060009
augggcgccaccggccgccucgagcucacccucgccgcccccccccaccccggccccgccuuccagcgcuccaaggcccgcgagacccagggcgaggaggagggcuccgagaugcagaucgccaaguccgacuccauccaccacaugucccacucccagggccagcccgagcuccccccccuccccgccuccgccaacgaggagcccuccggccucuaccagaccgucaugucccacuccuucuaccccccccucaugcagcgcaccuccuggacccucgccgcccccuucaaggagcagcaccaccaccgcggccccuccgacuccaucgccaacaacuacucccucauggcccaggaccucaagcucaaggaccuccucaaggucuaccagcccgccaccaucuccgucccccgcgaccgcaccggccagggccuccccuccuccggcaaccgcuccuccuccgagcccaugcgcaagaagaccaaguucuccucccgcaacaaggaggacuccacccgcaucaagcucgccuucaagaccuccaucuucucccccaugaagaaggaggucaagaccucccucaccuuccccggcucccgccccaugucccccgagcagcagcucgacgucaugcuccagcaggagauggagauggaguccaaggagaagaagcccuccgaguccgaccucgagcgcuacuacuacuaccucaccaacggcauccgcaaggacaugaucgcccccgaggagggcgaggucaugguccgcaucuccaagcucaucuccaacacccuccucaccucccccuuccucgagccccucauggucguccucguccaggagaaggagaacgacuacuacugcucccucaugaaguccaucgucgacuacauccucauggaccccauggagcgcaagcgccucuucaucgaguccaucccccgccucuucccccagcgcgucauccgcgcccccguccccuggcacuccgucuaccgcuccgccaagaaguggaacgaggagcaccuccacaccgucaaccccaugaugcuccgccucaaggagcucugguucgccgaguuccgcgaccuccgcuucguccgcaccgccgagauccucgccggcaagcucccccuccagccccaggaguucugggacgucauccagaagcacugccucgaggcccaccagacccuccucaacaaguggauccccaccugcgcccagcucuucaccucccgcaaggagcacuggauccacuucgcccccaaguccaacuacgacuccucccgcaacaucgaggaguacuucgccuccgucgccuccuucaugucccuccagcuccgcgagcucgucaucaagucccucgaggaccucgucucccucuucaugauccacaaggacggcaacgacuucaaggagcccuaccaggagaugaaguucuucaucccccagcucaucaugaucaagcucgaggucuccgagcccaucaucgucuucaaccccuccuucgacggcugcugggagcucauccgcgacuccuuccucgagaucaucaagaacuccaacggcauccccaagcucaaguacaucccccucaaguucuccuucaccgccgccgccgccgaccgccagugcgucaaggccgccgagcccggcgagcccuccaugcacgccgccgccaccgccauggccgagcucaagggcuacaaccuccuccucggcaccgucaacgccgaggagaagcucgucuccgacuuccucauccagaccuucaaggucuuccagaagaaccaggucggccccugcaaguaccucaacgucuacaagaaguacgucgaccuccucgacaacaccgccgagcagaacaucgccgccuuccucaaggagaaccacgacaucgacgacuucgucaccaagaucaacgccaucaagaagcgccgcaacgagaucgccuccaugaacaucaccgucccccucgccauguucugccucgacgccaccgcccucaaccacgaccucugcgagcgcgcccagaaccucaaggaccaccucauccaguuccaggucgacgucaaccgcgacaccaacaccuccaucugcaaccaguacucccacaucgccgacaaggucuccgagguccccgccaacaccaaggagcucgucucccucaucgaguuccucaagaaguccuccgccgucaccgucuucaagcuccgccgccagcuccgcgacgccuccgagcgccucgaguuccucauggacuacgccgaccuccccuaccagaucgaggacaucuucgacaacucccgcaaccuccuccuccacaagcgcgaccaggccgagauggaccucaucaagcgcugcuccgaguucgagcuccgccucgagggcuaccaccgcgagcucgaguccuuccgcaagcgcgaggucaugaccaccgaggagaugaagcacaacgucgagaagcucaacgagcucuccaagaaccucaaccgcgccuucgccgaguucgagcucaucaacaaggaggaggagcuccucgagaaggagaaguccaccuacccccuccuccaggccaugcucaagaacaagguccccuacgagcagcucugguccaccgccuacgaguucuccaucaaguccgaggaguggaugaacggcccccucuuccuccucaacgccgagcagaucgccgaggagaucggcaacauguggcgcaccaccuacaagcucaucaagacccucuccgacguccccgccccccgccgccucgccgagaacgucaagaucaagaucgacaaguucaagcaguacauccccauccucuccaucuccugcaaccccggcaugaaggaccgccacuggcagcagaucuccgagaucgucggcuacgagaucaagcccaccgagaccaccugccucuccaacaugcucgaguucggcuucggcaaguucgucgagaagcucgagcccaucggcgccgccgccuccaaggaguacucccucgagaagaaccucgaccgcaugaagcucgacugggucaacgucaccuucuccuucgucaaguaccgcgacaccgacaccaacauccucugcgccaucgacgacauccagaugcuccucgacgaccacgucaucaagacccagaccaugugcggcucccccuucaucaagcccaucgaggccgagugccgcaagugggaggagaagcucauccgcauccaggacaaccucgacgccuggcucaagugccaggccaccuggcucuaccucgagcccaucuucuccuccgaggacaucaucgcccagaugcccgaggagggccgcaaguucggcaucgucgacuccuacuggaagucccucaugucccaggccgucaaggacaaccgcauccucgucgccgccgaccagccccgcauggccgagaagcuccaggaggccaacuuccuccucgaggacauccagaagggccucaacgacuaccucgagaagaagcgccucuucuucccccgcuucuucuuccucuccaacgacgagcuccucgagauccucuccgagaccaaggacccccuccgcguccagccccaccucaagaagugcuucgagggcaucgccaagcucgaguucaccgacaaccucgagaucgucggcaugaucuccuccgagaaggagaccguccccuucauccagaagaucuaccccgccaacgccaagggcauggucgagaaguggcuccagcaggucgagcagaugaugcucgccuccaugcgcgaggucaucggccucggcaucgaggccuacgucaaggucccccgcaaccacuggguccuccaguggcccggccaggucgucaucugcgucuccuccaucuucuggacccaggaggucucccaggcccucgccgagaacacccuccucgacuuccucaagaaguccaacgaccagaucgcccagaucguccagcucguccgcggcaagcucuccuccggcgcccgccucacccucggcgcccucaccgucaucgacguccacgcccgcgacgucgucgccaagcucuccgaggaccgcgucuccgaccucaacgacuuccaguggaucucccagcuccgcuacuacugggucgccaaggacguccagguccagaucaucaccaccgaggcccucuacggcuacgaguaccucggcaacuccccccgccucgucaucaccccccucaccgaccgcugcuaccgcacccucaugggcgcccucaagcucaaccucggcggcgcccccgagggccccgccggcaccggcaagaccgagaccaccaaggaccucgccaaggcccucgccaagcagugcgucgucuucaacugcuccgacggccucgacuacaaggccaugggcaaguucuucaagggccucgcccaggccggcgccugggccugcuucgacgaguucaaccgcaucgaggucgagguccucuccgucgucgcccagcagauccucuccauccagcaggccaucauccgcaagcucaagaccuucaucuucgagggcaccgagcucucccucaaccccaccugcgccgucuucaucaccaugaaccccggcuacgccggccgcgccgagcuccccgacaaccucaaggcccucuuccgcaccgucgccaugaugguccccgacuacgcccucaucggcgagaucucccucuacuccaugggcuuccucgacucccgcucccucgcccagaagaucgucgccaccuaccgccucugcuccgagcagcucuccucccagcaccacuacgacuacggcaugcgcgccgucaaguccguccucaccgccgccggcaaccucaagcucaaguaccccgaggagaacgaguccguccuccuccuccgcgcccuccucgacgucaaccucgccaaguuccucgcccaggacgucccccucuuccagggcaucaucuccgaccucuuccccggcgucguccuccccaagcccgacuacgaggucuuccucaagguccucaacgacaacaucaagaagaugaagcuccagcccguccccugguucaucggcaagaucauccagaucuacgagaugaugcucguccgccacggcuacaugaucgucggcgaccccaugggcggcaagaccuccgccuacaagguccucgccgccgcccucggcgaccuccacgccgccaaccagauggaggaguucgccgucgaguacaagaucaucaaccccaaggccaucaccaugggccagcucuacggcugcuucgaccaggucucccacgaguggauggacggcguccucgccaacgccuuccgcgagcaggccuccucccucuccgacgaccgcaaguggaucaucuucgacggccccgucgacgccaucuggaucgagaacaugaacaccguccucgacgacaacaagaagcucugccucauguccggcgagaucauccagaugaacuccaagaugucccucaucuucgagcccgccgaccucgagcaggccucccccgccaccgucucccgcugcggcaugaucuacauggagccccaccagcucggcuggaagccccucaaggacuccuacauggacacccuccccuccucccucaccaaggagcacaaggagcucgucaacgacauguucauguggcucguccagcccugccucgaguucggccgccuccacugcaaguucgucguccagaccucccccauccaccucgccuucuccaugaugcgccucuacuccucccuccucgacgagauccgcgccgucgaggaggaggagauggagcucggcgagggccucuccucccagcagaucuuccucuggcuccagggccucuuccucuucucccucgucuggaccgucgccggcaccaucaacgccgacucccgcaagaaguucgacgucuucuuccgcaaccucaucaugggcauggacgacaaccacccccgccccaaguccgucaagcucaccaagaacaacaucuuccccgagcgcggcuccaucuacgacuucuacuucaucaagcaggccuccggccacugggagaccuggacccaguacaucaccaaggaggaggagaagguccccgccggcgccaaggucuccgagcucaucauccccaccauggagaccgcccgccaguccuucuuccucaagaccuaccucgaccacgagauccccaugcucuucgucggccccaccggcaccggcaaguccgccaucaccaacaacuuccuccuccaccuccccaagaacaccuaccuccccaacugcaucaacuucuccgcccgcaccuccgccaaccagacccaggacaucaucauguccaagcucgaccgccgccgcaagggccucuucggcccccccaucggcaagaaggccgucgucuucgucgacgaccucaacaugcccgccaaggaggucuacggcgcccagccccccaucgagcuccuccgccaguggaucgaccacggcuacugguucgacaagaaggacaccacccgccucgacaucgucgacaugcuccucgucaccgccaugggcccccccggcggcggccgcaacgacaucaccggccgcuucacccgccaccucaacaucaucuccaucaacgccuucgaggacgacauccucaccaagaucuucuccuccaucgucgacuggcacuucggcaagggcuucgacgucauguuccuccgcuacggcaagaugcucguccaggccaccaagaccaucuaccgcgacgccgucgagaacuuccuccccacccccuccaagucccacuacgucuucaaccuccgcgacuucucccgcgucauccagggcguccuccucugcccccacacccaccuccaggacgucgagaagugcauccgccucuggauccacgaggucuaccgcgucuucuacgaccgccucaucgacaaggaggaccgccaggucuucuucaacauggucaaggagaccaccuccaacugcuucaagcagaccaucgagaagguccucauccaccucucccccaccggcaagaucgucgacgacaacauccgcucccucuucuucggcgacuacuucaagcccgaguccgaccagaagaucuacgacgagaucaccgaccucaagcagcucaccgucgucauggagcacuaccucgaggaguucaacaacaucuccaaggcccccaugucccucgucauguuccgcuucgccaucgagcacaucucccgcaucugccgcguccucaagcaggacaagggccaccuccuccucgucggcaucggcggcuccggccgccaguccgccgccaagcucuccaccuucaugaacgccuacgagcucuaccagaucgagaucaccaagaacuacgccggcaacgacuggcgcgaggaccucaagaagaucauccuccaggucggcgucgccaccaaguccaccgucuuccucuucgccgacaaccagaucaaggacgaguccuucgucgaggacaucaacaugcuccucaacaccggcgacguccccaacaucuuccccgccgacgagaaggccgacaucgucgagaagaugcagaccgccgcccgcacccagggcgagaaggucgaggucaccccccucuccauguacaacuucuucaucgagcgcgucaucaacaagaucuccuucucccucgccaugucccccaucggcgacgccuuccgcaaccgccuccgcauguuccccucccucaucaacugcugcaccaucgacugguuccaguccuggcccaccgacgcccucgagcucgucgccaacaaguuccucgaggacgucgagcucgacgacaacauccgcgucgaggucgucuccaugugcaaguacuuccaggaguccgucaagaagcucucccucgacuacuacaacaagcuccgccgccacaacuacgucacccccaccuccuaccucgagcucauccucaccuucaagacccuccucaacuccaagcgccaggaggucgccaugaugcgcaaccgcuaccucaccggccuccagaagcucgacuucgccgccucccaggucgccgucaugcagcgcgagcucaccgcccuccagccccagcucauccucaccuccgaggagaccgccaagaugauggucaagaucgaggccgagacccgcgaggccgacggcaagaagcuccucguccaggccgacgagaaggaggccaacgucgccgccgccaucgcccagggcaucaagaacgagugcgagggcgaccucgccgaggccaugcccgcccucgaggccgcccucgccgcccucgacacccucaaccccgccgacaucucccucgucaaguccaugcagaacccccccggccccgucaagcucgucauggaguccaucugcaucaugaagggcaugaagcccgagcgcaagcccgaccccuccggcuccggcaagaugaucgaggacuacuggggcgucuccaagaagauccucggcgaccucaaguuccucgagucccucaagaccuacgacaaggacaacauccccccccucaccaugaagcgcauccgcgagcgcuucaucaaccaccccgaguuccagcccgccgucaucaagaacgucuccuccgccugcgagggccucugcaaguggguccgcgccauggaggucuacgaccgcgucgccaaggucgucgcccccaagcgcgagcgccuccgcgaggccgagggcaagcucgccgcccagaugcagaagcucaaccagaagcgcgccgagcucaagcucgucgucgaccgccuccaggcccucaacgacgacuucgaggagaugaacaccaagaagaaggaccucgaggagaacaucgagaucugcucccagaagcucguccgcgccgagaagcucaucuccggccucggcggcgagaaggaccgcuggaccgaggccgcccgccagcucggcauccgcuacaccaaccucaccggcgacguccuccucuccuccggcaccgucgccuaccucggcgccuucaccgucgacuaccgcguccagugccagaaccaguggcucgccgagugcaaggacaaggucauccccggcuucuccgacuucucccucucccacacccucggcgaccccaucaagauccgcgccuggcagaucgccggccuccccgucgacuccuucuccaucgacaacggcaucaucgucuccaacucccgccgcugggcccucaugaucgacccccacggccaggccaacaaguggaucaagaacauggagaaggccaacaagcucgccgucaucaaguucuccgacuccaacuacaugcgcaugcucgagaacgcccuccagcucggcacccccguccucaucgagaacaucggcgaggagcucgacgccuccaucgagcccauccuccucaaggccaccuucaagcagcagggcgucgaguacaugcgccucggcgagaacaucaucgaguacucccgcgacuucaagcucuacaucaccacccgccuccgcaacccccacuaccuccccgaggucgccgucaaggucugccuccucaacuucaugaucaccccccucggccuccaggaccagcuccucggcaucgucgccgccaaggagaagcccgagcucgaggagaagaagaaccagcucaucgucgaguccgccaagaacaagaagcaccucaaggagaucgaggacaagauccucgagguccucuccauguccaagggcaacauccucgaggacgagaccgccaucaagguccucuccuccuccaagguccucuccgaggagaucuccgagaagcagaaggucgccuccaugaccgagacccagaucgacgagacccgcaugggcuacaagcccgucgccguccacuccgccaccaucuucuucugcaucuccgaccucgccaacaucgagcccauguaccaguacucccucaccugguucaucaaccucuacaugcacucccucacccacuccaccaaguccgaggagcucaaccuccgcaucaaguacaucaucgaccacuucacccucuccaucuacaacaacgucugccgcucccucuucgagaaggacaagcuccucuucucccuccuccucaccaucggcaucaugaagcagaagaaggagaucaccgaggaggucugguacuuccuccucaccggcggcaucgcccucgacaaccccuaccccaaccccgccccccaguggcucuccgagaaggccugggccgagaucguccgcgccuccgcccuccccaagcuccacggccucauggagcaccucgagcagaaccucggcgaguggaagcucaucuacgacuccgccuggccccacgaggagcagcuccccggcuccuggaaguucucccagggccucgagaagauggucauccuccgcugccuccgccccgacaagaugguccccgccguccgcgaguucaucgccgagcacaugggcaagcucuacaucgaggcccccaccuucgaccuccagggcuccuacaacgacuccuccugcugcgccccccucaucuucguccucucccccuccgccgaccccauggccggccuccucaaguucgccgacgaccucggcaugggcggcacccgcacccagaccaucucccucggccagggccagggccccaucgccgccaagaugaucaacaacgccaucaaggacggcaccugggucguccuccagaacugccaccucgccgccuccuggaugcccacccucgagaagaucugcgaggaggucaucguccccgaguccaccaacgcccgcuuccgccucuggcucaccuccuaccccuccgagaaguuccccgucuccauccuccagaacggcaucaagaugaccaacgagccccccaagggccuccgcgccaaccuccuccgcuccuaccucaacgaccccaucuccgaccccgucuucuuccaguccugcgccaaggccgucauguggcagaagaugcucuucggccucugcuucuuccacgccgucguccaggagcgccgcaacuucggcccccucggcuggaacauccccuacgaguucaacgaguccgaccuccgcaucuccauguggcagauccagauguuccucaacgacuacaaggagguccccuucgacgcccucaccuaccucaccggcgagugcaacuacggcggccgcgucaccgacgacaaggaccgccgccuccuccucucccuccucuccauguucuacugcaaggagaucgaggaggacuacuacucccucgcccccggcgacaccuacuacauccccccccacggcuccuaccaguccuacaucgacuaccuccgcaaccuccccaucaccgcccaccccgaggucuucggccuccacgagaacgccgacaucaccaaggacaaccaggagaccaaccagcucuucgagggcguccuccucacccucccccgccaguccggcggcuccggcaaguccccccaggaggucgucgaggagcucgcccaggacauccucuccaagcucccccgcgacuucgaccucgaggaggucaugaagcucuaccccgucgucuacgaggaguccaugaacaccguccuccgccaggagcucauccgcuucaaccgccucaccaaggucguccgccgcucccucaucaaccucggccgcgccaucaagggccagguccucauguccuccgagcucgaggaggucuucaacuccaugcucgucggcaagguccccgccaugugggccgccaaguccuaccccucccucaagccccucggcggcuacgucgccgaccuccucgcccgccucaccuucuuccaggaguggaucgacaagggcccccccgucgucuucuggaucuccggcuucuacuucacccaguccuuccucaccggcgucucccagaacuacgcccgcaaguacaccauccccaucgaccacaucggcuucgaguucgaggucaccccccaggagaccgucauggagaacaaccccgaggacggcgccuacaucaagggccucuuccucgagggcgcccgcugggaccgcaagaccaugcagaucggcgagucccuccccaagauccucuacgacccccuccccaucaucuggcucaagcccggcgaguccgccauguuccuccaccaggacaucuacgucugccccgucuacaagaccuccgcccgccgcggcacccucuccaccaccggccacuccaccaacuacguccucuccaucgagcuccccaccgacaugccccagaagcacuggaucaaccgcggcgucgccucccucugccagcucgacaacuga

SEQ ID NO: 42315 - RNA, 13875 nt, Artificial Sequence
  derived and/or modified sequence opt2 from DNAH5__Homo_sapiens__NP_001360
auguuccgcaucggccgccgccagcucuggaagcacuccgucacccgcguccucacccagcgccucaagggcgagaaggaggccaagcgcgcccuccucgacgcccgccacaacuaccucuucgccaucgucgccuccugccucgaccucaacaagaccgaggucgaggacgccauccucgagggcaaccagaucgagcgcaucgaccagcucuucgccgucggcggccuccgccaccucauguucuacuaccaggacgucgaggaggccgagaccggccagcucggcucccucggcggcgucaaccucgucuccggcaagaucaagaagcccaaggucuucgucaccgagggcaacgacgucgcccucaccggcgucugcgucuucuucauccgcaccgaccccuccaaggccaucacccccgacaacauccaccaggaggucuccuucaacaugcucgacgccgccgacggcggccuccucaacuccguccgccgccuccucuccgacaucuucauccccgcccuccgcgccaccucccacggcuggggcgagcucgagggccuccaggacgccgccaacauccgccaggaguuccucuccucccucgagggcuucgucaacguccucuccggcgcccaggagucccucaaggagaaggucaaccuccgcaagugcgacauccucgagcucaagacccucaaggagcccaccgacuaccucacccucgccaacaaccccgagacccucggcaagaucgaggacugcaugaaggucuggaucaagcagaccgagcagguccucgccgagaacaaccagcuccucaaggaggccgacgacgucggcccccgcgccgagcucgagcacuggaagaagcgccucuccaaguucaacuaccuccucgagcagcucaagucccccgacgucaaggccguccucgccguccucgccgccgccaaguccaagcuccucaagaccuggcgcgagauggacauccgcaucaccgacgccaccaacgaggccaaggacaacgucaaguaccucuacacccucgagaagugcugcgacccccucuacuccuccgacccccucuccaugauggacgccauccccacccucaucaacgccaucaagaugaucuacuccaucucccacuacuacaacaccuccgagaagaucaccucccucuucgucaaggucaccaaccagaucaucuccgccugcaaggccuacaucaccaacaacggcaccgccuccaucuggaaccagccccaggacgucgucgaggagaagauccucuccgccaucaagcucaagcaggaguaccagcucugcuuccacaagaccaagcagaagcucaagcagaaccccaacgccaagcaguucgacuucuccgagauguacaucuucggcaaguucgagaccuuccaccgccgccucgccaagaucaucgacaucuucaccacccucaagaccuacuccguccuccaggacuccaccaucgagggccucgaggacauggccaccaaguaccagggcaucgucgccaccaucaagaagaaggaguacaacuuccucgaccagcgcaagauggacuucgaccaggacuacgaggaguucugcaagcagaccaacgaccuccacaacgagcuccgcaaguucauggacgucaccuucgccaagauccagaacaccaaccaggcccuccgcaugcucaagaaguucgagcgccucaacauccccaaccucggcaucgacgacaaguaccagcucauccucgagaacuacggcgccgacaucgacaugaucuccaagcucuacaccaagcagaaguacgaccccccccucgcccgcaaccagccccccaucgccggcaagauccucugggcccgccagcucuuccaccgcauccagcagcccaugcagcucuuccagcagcaccccgccguccucuccaccgccgaggccaagcccaucauccgcuccuacaaccgcauggccaagguccuccucgaguucgagguccucuuccaccgcgccuggcuccgccagaucgaggagauccacgucggccucgaggccucccuccucgucaaggcccccggcaccggcgagcucuucgucaacuucgacccccagauccucauccucuuccgcgagaccgagugcauggcccagaugggccucgaggucuccccccucgccaccucccucuuccagaagcgcgaccgcuacaagcgcaacuucuccaacaugaagaugaugcucgccgaguaccagcgcgucaaguccaagauccccgccgccaucgagcagcucaucgucccccaccucgccaaggucgacgaggcccuccagcccggccucgccgcccucaccuggaccucccucaacaucgaggccuaccucgagaacaccuucgccaagaucaaggaccucgagcuccuccucgaccgcgucaacgaccucaucgaguuccgcaucgacgccauccucgaggagauguccuccaccccccucugccagcucccccaggaggagccccucaccugcgaggaguuccuccagaugaccaaggaccucugcgucaacggcgcccagauccuccacuucaaguccucccucgucgaggaggccgucaacgagcucgucaacaugcuccucgacgucgagguccucuccgaggaggaguccgagaagaucuccaacgagaacuccgucaacuacaagaacgaguccuccgccaagcgcgaggagggcaacuucgacacccucaccuccuccaucaacgcccgcgccaacgcccuccuccucaccaccgucacccgcaagaagaaggagaccgagaugcucggcgaggaggcccgcgagcuccucucccacuucaaccaccagaacauggacgcccuccucaaggucacccgcaacacccucgaggccauccgcaagcgcauccacuccucccacaccaucaacuuccgcgacuccaacuccgccuccaacaugaagcagaacucccuccccaucuuccgcgccuccgucacccucgccauccccaacaucgucauggcccccgcccucgaggacguccagcagacccucaacaaggccgucgagugcaucaucuccguccccaagggcguccgccagugguccuccgagcuccucuccaagaagaagauccaggagcgcaagauggccgcccuccaguccaacgaggacuccgacuccgacgucgagaugggcgagaacgagcuccaggacacccucgagaucgccuccgucaaccuccccauccccguccagaccaagaacuacuacaagaacgucuccgagaacaaggagaucgucaagcucgucuccguccucuccaccaucaucaacuccaccaagaaggaggucaucaccuccauggacugcuucaagcgcuacaaccacaucuggcagaagggcaaggaggaggccaucaagaccuucaucacccaguccccccuccucuccgaguucgagucccagauccucuacuuccagaaccucgagcaggagaucaacgccgagcccgaguacgucugcgucggcuccaucgcccucuacaccgccgaccucaaguucgcccucaccgccgagaccaaggccuggauggucgucaucggccgccacugcaacaagaaguaccgcuccgagauggagaacaucuucaugcucaucgaggaguucaacaagaagcucaaccgccccaucaaggaccucgacgacauccgcaucgccauggccgcccucaaggagauccgcgaggagcagaucuccaucgacuuccaggucggccccaucgaggaguccuacgcccuccucaaccgcuacggccuccucaucgcccgcgaggagaucgacaaggucgacacccuccacuacgccugggagaagcuccucgcccgcgccggcgagguccagaacaagcucgucucccuccagcccuccuucaagaaggagcucaucuccgccgucgaggucuuccuccaggacugccaccaguucuaccucgacuacgaccucaacggccccauggccuccggccucaagccccaggaggccuccgaccgccucaucauguuccagaaccaguucgacaacaucuaccgcaaguacaucaccuacaccggcggcgaggagcucuucggccuccccgccacccaguacccccagcuccucgagaucaagaagcagcucaaccuccuccagaagaucuacacccucuacaacuccgucaucgagaccgucaacuccuacuacgacauccucugguccgaggucaacaucgagaagaucaacaacgagcuccucgaguuccagaaccgcugccgcaagcucccccgcgcccucaaggacuggcaggccuuccucgaccucaagaagaucaucgacgacuucuccgagugcugcccccuccucgaguacauggccuccaaggccaugauggagcgccacugggagcgcaucaccacccucaccggccacucccucgacgucggcaacgaguccuucaagcuccgcaacaucauggaggccccccuccucaaguacaaggaggagaucgaggacaucugcaucuccgccgucaaggagcgcgacaucgagcagaagcucaagcaggucaucaacgagugggacaacaagaccuucaccuucggcuccuucaagacccgcggcgagcuccuccuccgcggcgacuccaccuccgagaucaucgccaacauggaggacucccucaugcuccucggcucccuccucuccaaccgcuacaacaugcccuucaaggcccagauccagaaguggguccaguaccucuccaacuccaccgacaucaucgaguccuggaugaccguccagaaccucuggaucuaccucgaggccgucuucgucggcggcgacaucgccaagcagcuccccaaggaggccaagcgcuucuccaacaucgacaaguccugggucaagaucaugacccgcgcccacgagguccccuccgucguccagugcugcgucggcgacgagacccucggccagcuccucccccaccuccucgaccagcucgagaucugccagaagucccucaccggcuaccucgagaagaagcgccucugcuucccccgcuucuucuucgucuccgaccccgcccuccucgagauccucggccaggccuccgacucccacaccauccaggcccaccuccucaacgucuucgacaacaucaaguccgucaaguuccacgagaagaucuacgaccgcauccucuccaucuccucccaggagggcgagaccaucgagcucgacaagcccgucauggccgagggcaacgucgaggucuggcucaacucccuccucgaggagucccaguccucccuccaccucgucauccgccaggccgccgccaacauccaggagaccggcuuccagcucaccgaguuccucuccuccuuccccgcccaggucggccuccucggcauccagaugaucuggacccgcgacuccgaggaggcccuccgcaacgccaaguucgacaagaagaucaugcagaagaccaaccaggccuuccucgagcuccucaacacccucaucgacgucaccacccgcgaccucuccuccaccgagcgcgucaaguacgagacccucaucaccauccacguccaccagcgcgacaucuucgacgaccucugccacaugcacaucaagucccccauggacuucgaguggcucaagcagugccgcuucuacuucaacgaggacuccgacaagaugaugauccacaucaccgacgucgccuucaucuaccagaacgaguuccucggcugcaccgaccgccucgucaucaccccccucaccgaccgcugcuacaucacccucgcccaggcccucggcauguccaugggcggcgcccccgccggccccgccggcaccggcaagaccgagaccaccaaggacaugggccgcugccucggcaaguacgucgucgucuucaacugcuccgaccagauggacuuccgcggccucggccgcaucuucaagggccucgcccaguccggcuccuggggcugcuucgacgaguucaaccgcaucgaccuccccguccucuccgucgccgcccagcagaucuccaucauccucaccugcaagaaggagcacaagaaguccuucaucuucaccgacggcgacaacgucaccaugaaccccgaguucggccucuuccucaccaugaaccccggcuacgccggccgccaggagcuccccgagaaccucaagaucaacuuccgcuccgucgccaugaugguccccgaccgccagaucaucauccgcgucaagcucgccuccugcggcuucaucgacaacgucguccucgcccgcaaguucuucacccucuacaagcucugcgaggagcagcucuccaagcagguccacuacgacuucggccuccgcaacauccucuccguccuccgcacccucggcgccgccaagcgcgccaaccccauggacaccgaguccaccaucgucaugcgcguccuccgcgacaugaaccucuccaagcucaucgacgaggacgagccccucuuccucucccucaucgaggaccucuuccccaacauccuccucgacaaggccggcuaccccgagcucgaggccgccaucucccgccaggucgaggaggccggccucaucaaccacccccccuggaagcucaaggucauccagcucuucgagacccagcgcguccgccacggcaugaugacccucggccccuccggcgccggcaagaccaccugcauccacacccucaugcgcgccaugaccgacugcggcaagccccaccgcgagaugcgcaugaaccccaaggccaucaccgccccccagauguucggccgccucgacgucgccaccaacgacuggaccgacggcaucuucuccacccucuggcgcaagacccuccgcgccaagaagggcgagcacaucuggaucauccucgacggccccgucgacgccaucuggaucgagaaccucaacuccguccucgacgacaacaagacccucacccucgccaacggcgaccgcauccccauggcccccaacugcaagaucaucuucgagccccacaacaucgacaacgccucccccgccaccgucucccgcaacggcauggucuucauguccuccuccauccucgacuggucccccauccucgagggcuuccucaagaagcgcuccccccaggaggccgagauccuccgccagcucuacaccgaguccuuccccgaccucuaccgcuucugcauccagaaccucgaguacaagauggagguccucgaggccuucgucaucacccaguccaucaacaugcuccagggccucaucccccucaaggagcagggcggcgaggucucccaggcccaccucggccgccucuucgucuucgcccuccucugguccgccggcgccgcccucgagcucgacggccgccgccgccucgagcucuggcuccgcucccgccccaccggcacccucgagcuccccccccccgccggccccggcgacaccgccuucgacuacuacgucgcccccgacggcaccuggacccacuggaacacccgcacccaggaguaccucuaccccuccgacaccacccccgaguacggcuccauccucguccccaacgucgacaacguccgcaccgacuuccucauccagaccaucgccaagcagggcaaggccguccuccucaucggcgagcagggcaccgccaagaccgucaucaucaagggcuucauguccaaguacgaccccgagugccacaugaucaagucccucaacuucuccuccgccaccaccccccucauguuccagcgcaccaucgaguccuacgucgacaagcgcaugggcaccaccuacggcccccccgccggcaagaagaugaccgucuucaucgacgacgucaacaugcccaucaucaacgaguggggcgaccaggucaccaacgagaucguccgccagcucauggagcagaacggcuucuacaaccucgagaagcccggcgaguucaccuccaucgucgacauccaguuccucgccgccaugauccaccccggcggcggccgcaacgacaucccccagcgccucaagcgccaguucuccaucuucaacugcacccuccccuccgaggccuccgucgacaagaucuucggcgucaucggcgucggccacuacugcacccagcgcggcuucuccgaggagguccgcgacuccgucaccaagcucgucccccucacccgccgccucuggcagaugaccaagaucaagaugcuccccacccccgccaaguuccacuacgucuucaaccuccgcgaccucucccgcgucuggcagggcaugcucaacaccaccuccgaggucaucaaggagcccaacgaccuccucaagcucuggaagcacgagugcaagcgcgucaucgccgaccgcuucaccgucuccuccgacgucaccugguucgacaaggcccucgucucccucgucgaggaggaguucggcgaggagaagaagcuccucgucgacugcggcaucgacaccuacuucgucgacuuccuccgcgacgcccccgaggccgccggcgagaccuccgaggaggccgacgccgagacccccaagaucuacgagcccaucgaguccuucucccaccucaaggagcgccucaacauguuccuccagcucuacaacgaguccauccgcggcgccggcauggacauggucuucuucgccgacgccaugguccaccucgucaagaucucccgcgucauccgcaccccccagggcaacgcccuccucgucggcgucggcggcuccggcaagcagucccucacccgccucgccuccuucaucgccggcuacgucuccuuccagaucacccucacccgcuccuacaacaccuccaaccucauggaggaccucaagguccucuaccgcaccgccggccagcagggcaagggcaucaccuucaucuucaccgacaacgagaucaaggacgaguccuuccucgaguacaugaacaacguccucuccuccggcgaggucuccaaccucuucgcccgcgacgagaucgacgagaucaacuccgaccucgccuccgucaugaagaaggaguucccccgcugccuccccaccaacgagaaccuccacgacuacuucaugucccgcguccgccagaaccuccacaucguccucugcuucucccccgucggcgagaaguuccgcaaccgcgcccucaaguuccccgcccucaucuccggcugcaccaucgacugguucucccgcuggcccaaggacgcccucgucgccgucuccgagcacuuccucaccuccuacgacaucgacugcucccucgagaucaagaaggaggucguccagugcaugggcuccuuccaggacggcgucgccgagaagugcgucgacuacuuccagcgcuuccgccgcuccacccacgucacccccaaguccuaccucuccuucauccagggcuacaaguucaucuacggcgagaagcacgucgagguccgcacccucgccaaccgcaugaacaccggccucgagaagcucaaggaggccuccgaguccgucgccgcccucuccaaggagcucgaggccaaggagaaggagcuccaggucgccaacgacaaggccgacaugguccucaaggaggucaccaugaaggcccaggccgccgagaaggucaaggccgagguccagaaggucaaggaccgcgcccaggccaucgucgacuccaucuccaaggacaaggccaucgccgaggagaagcucgaggccgccaagcccgcccucgaggaggccgaggccgcccuccagaccauccgccccuccgacaucgccaccguccgcacccucggccgccccccccaccucaucaugcgcaucauggacugcguccuccuccucuuccagcgcaaggucuccgccgucaagaucgaccucgagaaguccugcaccaugcccuccuggcaggagucccucaagcucaugaccgccggcaacuuccuccagaaccuccagcaguuccccaaggacaccaucaacgaggaggucaucgaguuccucucccccuacuucgagaugcccgacuacaacaucgagaccgccaagcgcgucugcggcaacgucgccggccucugcuccuggaccaaggccauggccuccuucuucuccaucaacaaggagguccucccccucaaggccaaccucgucguccaggagaaccgccaccuccucgccaugcaggaccuccagaaggcccaggccgagcucgacgacaagcaggccgagcucgacgucguccaggccgaguacgagcaggccaugaccgagaagcagacccuccucgaggacgccgagcgcugccgccacaagaugcagaccgccuccacccucaucuccggccucgccggcgagaaggagcgcuggaccgagcagucccaggaguucgccgcccagaccaagcgccucgucggcgacguccuccucgccaccgccuuccucuccuacuccggccccuucaaccaggaguuccgcgaccuccuccucaacgacuggcgcaaggagaugaaggcccgcaagauccccuucggcaagaaccucaaccucuccgagaugcucaucgacgcccccaccaucuccgaguggaaccuccagggccuccccaacgacgaccucuccauccagaacggcaucaucgucaccaaggccucccgcuacccccuccucaucgacccccagacccagggcaagaucuggaucaagaacaaggagucccgcaacgagcuccagaucaccucccucaaccacaaguacuuccgcaaccaccucgaggacucccucucccucggccgcccccuccucaucgaggacgucggcgaggagcucgaccccgcccucgacaacguccucgagcgcaacuucaucaagaccggcuccaccuucaaggucaaggucggcgacaaggaggucgacguccucgacggcuuccgccucuacaucaccaccaagcuccccaaccccgccuacacccccgagaucuccgcccgcaccuccaucaucgacuucaccgucaccaugaagggccucgaggaccagcuccucggccgcgucauccucaccgagaagcaggagcucgagaaggagcgcacccaccucauggaggacgucaccgccaacaagcgccgcaugaaggagcucgaggacaaccuccucuaccgccucaccuccacccagggcucccucgucgaggacgagucccucaucgucguccucuccaacaccaagcgcaccgccgaggaggucacccagaagcucgagaucuccgccgagaccgagguccagaucaacuccgcccgcgaggaguaccgccccgucgccacccgcggcuccauccucuacuuccucaucaccgagaugcgccucgucaacgagauguaccagaccucccuccgccaguuccucggccucuucgaccucucccucgcccgcuccgucaagucccccaucaccuccaagcgcaucgccaacaucaucgagcacaugaccuacgaggucuacaaguacgccgcccgcggccucuacgaggagcacaaguuccucuucacccuccuccucacccucaagaucgacauccagcgcaaccgcgucaagcacgaggaguuccucacccucaucaagggcggcgccucccucgaccucaaggccugcccccccaagcccuccaaguggauccucgacaucaccuggcucaaccucgucgagcucuccaagcuccgccaguucuccgacguccucgaccagaucucccgcaacgagaagauguggaagaucugguucgacaaggagaaccccgaggaggagccccuccccaacgccuacgacaagucccucgacugcuuccgccgccuccuccucauccgcuccuggugccccgaccgcaccaucgcccaggcccgcaaguacaucgucgacuccaugggcgagaaguacgccgagggcgucauccucgaccucgagaagaccugggaggaguccgacccccgcaccccccucaucugccuccucuccaugggcuccgaccccaccgacuccaucaucgcccucggcaagcgccucaagaucgagacccgcuacgucuccaugggccagggccaggagguccacgcccgcaagcuccuccagcagaccauggccaacggcggcugggcccuccuccagaacugccaccucggccucgacuucauggacgagcucauggacaucaucaucgagaccgagcucguccacgacgccuuccgccucuggaugaccaccgaggcccacaagcaguuccccaucacccuccuccagauguccaucaaguucgccaacgaccccccccagggccuccgcgccggccucaagcgcaccuacuccggcgucucccaggaccuccucgacgucuccuccggcucccaguggaagcccaugcucuacgccgucgccuuccuccacuccaccguccaggagcgccgcaaguucggcgcccucggcuggaacauccccuacgaguucaaccaggccgacuucaacgccaccguccaguucauccagaaccaccucgacgacauggacgucaagaagggcgucuccuggaccaccauccgcuacaugaucggcgagauccaguacggcggccgcgucaccgacgacuacgacaagcgccuccucaacaccuucgccaaggucugguucuccgagaacauguucggccccgacuucuccuucuaccagggcuacaacauccccaagugcuccaccgucgacaacuaccuccaguacauccagucccuccccgccuacgacucccccgaggucuucggccuccaccccaacgccgacaucaccuaccaguccaagcucgccaaggacguccucgacaccauccucggcauccagcccaaggacaccuccggcggcggcgacgagacccgcgaggccgucgucgcccgccucgccgacgacaugcucgagaagcucccccccgacuacguccccuucgaggucaaggagcgccuccagaagaugggccccuuccagcccaugaacaucuuccuccgccaggagaucgaccgcaugcagcgcguccucucccucguccgcuccacccucaccgagcucaagcucgccaucgacggcaccaucaucauguccgagaaccuccgcgacgcccucgacugcauguucgacgcccgcauccccgccugguggaagaaggccuccuggaucuccuccacccucggcuucugguucaccgagcucaucgagcgcaacucccaguucaccuccugggucuucaacggccgcccccacugcuucuggaugaccggcuucuucaacccccagggcuuccucaccgccaugcgccaggagaucacccgcgccaacaagggcugggcccucgacaacaugguccucugcaacgaggucaccaaguggaugaaggacgacaucuccgccccccccaccgagggcgucuacgucuacggccucuaccucgagggcgccggcugggacaagcgcaacaugaagcucaucgaguccaagcccaagguccucuucgagcucaugcccgucauccgcaucuacgccgagaacaacacccuccgcgacccccgcuucuacuccugccccaucuacaagaagcccguccgcaccgaccucaacuacaucgccgccgucgaccuccgcaccgcccagacccccgagcacuggguccuccgcggcgucgcccuccucugcgacgucaaguga

SEQ ID NO: 42316 - RNA, 12477 nt, Artificial Sequence
  derived and/or modified sequence opt2 from DNAH6__Homo_sapiens__NP_001361
augaccuuccgcgccaccgacuccgaguucgaccucaccaacaucgaggaguacgccgagaacuccgcccucucccgccucaacaacaucaaggccaagcagcgcgucuccuacgucaccuccaccgagaacgaguccgacacccagauccucaccuuccgccacaucaccaaggcccaggagaagacccgcaagcgccagcagcccaucaagcucgagccccuccccguccucaaggucuaccaggaccacaagcagcccgaguacauccacgagcagaaccgcuuccagcucaugaccgccggcaucaucaagcgccccgucuccaucgccaagaaguccuucgccaccuccuccacccaguuccucgagcaccaggacgccgucaagaagaugcagauccaccgccccuacgucgaggucuucucccccuccccccccaagcucccccacaccggcaucggcaagcgcggccucuucggcacccgcuccuccgccuaccccaaguacaccuuccacgaccgcgaggaggucgucaaggccaacauccgcgacccccuccagaucaucaagaucauccgcgagaacgagcaccucggcuuccucuacaugauccccgccgucccccgcuccuccaucgaguacgacaccuacaaccucaaggucgucuccuacgagaacaucaacaagaacgacuacuacaccaucucccagcgcgccgucacccacaucuacaacgaggacaucgaguucaucgagaucgaccgcugggagcaggaguaccucuaccaccgcgagcucaccaagauccccaucuucucccucuuccgcaaguggaaggccuucuccgucuggcgcaagaacguccgcuccaagaagaucaccggcugccagaagucccuccagaagaaccucuucaucgucaacccccaccuccgccccgcccuccucaagaucaacgagcucugcuaccaccucuccuucaugggccucugcuacaucgagaagugccacaccuacacccuccaggaguucaaggccgcccaggucauccgccucgccgaggucaccgagcgccucggcgaguuccgcaacgaggccaaguacgucguccgccgcgccugccgcuucgcccuccgcgccgccggcuucguccccgacgacugcgccuucggccccuucgaggacuaccacaagguccaguccuccggcuccuucaucaacaccccccacgagcuccccaccuacggcgacuccgagaagaugaccuacaccgagcaggccuccaagcgccacuacugcaugcgccucaccugcuucauccgccucaacgacuaccucaucgagaacaccaugcacauccucaccgucaacgccgucaacucccuccucaaccaccucaccgacaagcucaagcgcacccccuccgccgacgucauccagaaguggaucaccgaggagaagcccgagguccccgacaagaagggcacccucauggucgagaagcaggaggaggacgagucccucauccccauguuccucaccgagcucaugcucaccguccagucccuccucuucgagcccucccucgaggacuuccucgacggcauccucggcgccgucaaccacugccagaacaccguccucuccguccccaaccucguccccgacuccuacuucgacgccuucaccucccccuacaucaacaacaagcucgagggcaagaccugcggcaccggccccucccucgccgccgucuucgaggacgacaagaacuuccacaccaucaucucccagaucaaggagaccauccaggccgccuucgaguccgcccgcaucuacgccgccaccuucgagaaguuccagaucuucuucaaggagaacgagucccucgaccuccaggcccucaagcuccaggagcccgacaucaacuucuucuccgagcagcucgagaaguaccacaagcagcacaaggacgccgucgcccuccgccccacccgcaacgucggccuccuccucaucgacacccgccuccuccgcgagaagcucauccccuccccccuccgcugccucgagguccucaacuucaugcucccccgccaguccaagaagaaggucgacgccaucaucuucgaggcccaggacgccgaguacaagcucgaguucguccccaccaccaccaccgaguacguccacucccuccucuuccucgacgagauccaggagcgcaucgagucccucgaggacgagggcaacaucgucacccagauguacaagcucauggagcaguaccagguccccaccccccccgaggacuucgccgucuucgccaccaugaagcccuccaucgucgccguccgcaacgccaucgacaaguccgucggcgaccgcgaguccuccaucaagcaguucugcguccaccucggcuccgaccucgaggagcucaacaacgaggucaacgaggucaagcuccaggcccaggacccccagauccucgacaucuccgccgaccaggacaagauccgccucauccucaacaaccuccaguccguccucgccgaccuccagaagcgcgccuuccaguacaaguccuaccagaagaacuucaaggucgaggucuccaaguucgaggcccucgaggaggucuccgccgagcucaagcucaagcagcuccucugggacuccuucuccgagugggacaagcuccagcaggaguggcucaaguccaaguucgacugccucgaccccgagguccucaacggccaggucuccaaguacgccaaguucgucacccagcucgagaagggccucccccccaacuccgucgucccccagcucaaguacaaggucgagaagaugaaggagaagcuccccgucaucaucgaccuccgcaaccccacccucaaggcccgccacugggccgccaucgagcagaccgucgacgccacccucgucgacgccgagaucccccucacccucgagcgccucucccagcuccacgucuucgacuucggccaggagauccaggacaucuccggccaggccuccggcgaggccgcccucgaggccauccucaagaaggucgaggacuccuggaagaccaccgaguucgucauccucccccaccgcgacuccaaggacgucuucauccucggcggcaccgacgacauccagguccuccucgacgacuccaccaucaacgucgccacccucgccuccucccgcuaccucggcccccucaagacccgcgucgacgaguggcagaagcagcucgcccucuucaaccagacccucgaggaguggcucaccugccagcgcaacuggcucuaccucgaguccaucuucaacgcccccgacauccagcgccagcuccccgccgaggccaagauguuccuccaggucgacaaguccuggaaggagaucaugcgcaaggucaaccgccuccccaacgcccuccgcgccgccacccagcccggccuccucgagaccuuccagaacaacaacgcccuccucgaccagauccagaagugccucgaggccuaccucgaguccaagcgcgucaucuucccccgcuucuacuuccucuccaacgacgagcuccucgagauccucgcccagacccgcaacccccaggccguccagccccaccuccgcaagugcuucgacuccaucuccaagcucgaguucgcccucaugccccccgccgagggcaagauccccggcaucgacggcgagcccgagaaggucuacaccaacgacauccucgccaugcucucccccgagggcgagcgcgucucccucggcaagggccucaaggcccgcggcaacgucgaggaguggcucggcaaggucgaggaggccauguucaccucccuccgccgccucugcaaggccgccaucgccgacuaccagggcaagcuccgcaccgacugggucgucgccggccaccccucccaggucauccucaccgucucccagaucauguggugccgcgaccucaccgagugccucgagaccgagcacuccaaccacauccaggcccucaagaacuucgagaaggucaacuucgagcgccucaacgcccucgccgccaucguccagggcucccuccccaagcuccaccgcaacauccucaccgcccucaucaccaucgacguccacgcccgcgacaucgucaccgagcucguccaguccaaggucgagaccgucgaguccuucgacuggcagcgccagcuccgcuacuacugggacaucgaccucgacaacugcgucgcccgcauggcccucucccaguacaccuacggcuacgaguaccucggcgccugcccccgccucgucaucaccccccucaccgaccgcugcuaccucugccucaugggcgcccuccagcucgaccucggcggcgcccccgccggccccgccggcaccggcaagaccgagaccaccaaggaccucgccaaggcccucgccauccagugcgucgucuucaacugcuccgacggccucgacuacaagaugaugggccgcuucuucuccggccucgcccaguccggcgccuggugcugcuucgacgaguucaaccgcaucgacaucgagguccucuccgucaucgcccagcagcucaucaccauccgcaacgccaaggccgccaagcucucccgcuucauguucgagggccgcgagaucaagcucgucaugaccugcgccgccuucaucaccaugaaccccggcuacgccggccgcaccgagcuccccgacaaccucaaggcccucuuccgccccuucgccaugaugguccccaacuacgcccucaucgccgaggucauccucuacuccgagggcuucgaguccuccaagauccucgcccgcaagaugacccagauguacaagcucugcuccgagcagcucucccagcaggaccacuacgacuucggcaugcgcgccgucaaguccguccucgucauggccggcucccucaagcgcgagaaccccgaccucaacgaggacgucguccucauccgcgcccuccaggacuccaaccuccccaaguuccucaccgacgacgcccuccucuucuccggcaucaucuccgaccucuuccccggcguccagauccccgagcacgacuacggcauccuccaguccaccaucgucgacgucaugaaccgccagaaccuccagcccgagaugugcaugguccgcaaggucauccaguucuacgagaccaugcucguccgccacggcgucaugcucgucggccccaccggcggcggcaagaccaccgucuaccgcauccucgccgagacccucggcaaccuccagaagcucggcaucgagaacuccuucuaccaggccgucaagaccuacguccucaaccccaaguccaucaccaugggcgagcucuacggcgaggucaacaaccucacccucgaguggaaggacggccucauggcccucuccguccgcgccgccgucaacgacaccuccgaggaccacaaguggaucaucuccgacggccccgucgacgcccucuggaucgagaacaugaacaccguccucgacgacaacaagaugcucugccucgccaacuccgagcgcaucaagcucaccccccagauccacaugcucuucgagguccaggaccuccgcgucgccucccccgccaccgucucccgcugcggcauggucuucgucgaccccgaggagcucaaguggaugcccuacgucaagaccuggaugaagggcaucuccaagaagcucaccgaggagacccaggaguacauccucaaccucuuccagcgcuacgucgacgagggccuccacuucaucaacaagaagugcucccaggccaucccccaggucgacaucuccaaggucaccacccucugcugccuccucgagucccucauccucggcaaggacggcgucaaccucgccauggagcagaccaagcucaacaccauccucugccagaccuucgucuucugcuaccucuggucccucggcggcaaccucaccgagaacuacuacgacuccuucgacaccuucauccgcacccaguucgacgacaaccccgacgcccgccuccccaacuccggcgaccucugguccauccacauggacuucgacaccaagcgccucgaccccugggagcgcaucauccccaccuucaaguacaaccgcgacguccccuucuucgagaugcucguccccaccaccgacaccguccgcuacggcuaccucauggagaagcuccucgccgucaagcacuccguccucuucaccggcaucaccggcgucggcaaguccgucaucgccaagggccuccucaacaagauccaggaguccgccggcuacguccccgucuaccucaacuucuccgcccagaccuccuccgcccgcacccaggagaucaucgaguccaagcucgagcgcaagcgcaagaacauccucggcgcccccggcaacaagcgcaucgucaucuucgucgacgaccucaacaugccccgccucgaccgcuacggcucccagccccccaucgagcuccuccgccaguaccaggacuucggcggcuucuacgaccgcaacaagcucuucuggaaggagauccaggacgucaccaucaucuccgccugcgccccccccggcggcggccgcaaccccgucaccccccgcuucauccgccacuucuccaugcucugccuccccaugcccuccgagcacucccucaagcagaucuuccaggccauccucaacggcuuccucuccgacuucccccccgccgucaagcagaccgccuccuccaucgucgaggccuccgucgagaucuacaacaagauguccgucgaccuccuccccacccccgccaagucccacuacgucuucaaccuccgcgaccucuccaagugcguccagggcauccuccagugcgaccccggcaccauccgcgaggagauccagaucuuccgccucuucugccacgagugccagcgcgucuuccacgaccgccucaucaacaacgaggacaagcacuacuuccacgucauccucaccgagauggccaacaagcacuucggcaucgccaucgaccucgaguacuuccucaacaagcccaucaucuucggcgacuucaucaaguucggcgccgacaaggccgaccgcaucuacgacgacaugcccgacaucgagaagaccgccaacguccuccaggacuaccucgacgacuacaaccucaccaaccccaaggaggucaagcucgucuucuuccaggacgccaucgagcacgucucccgcaucgcccgcaugauccgccaggagcgcggcaacgcccuccucgucggcgucggcggcaccggcaagcagucccucacccgccucgccgcccacaucugcggcuacaagugccuccagaucgagcucucccgcggcuacaacuacgacuccuuccacgaggaccuccgcaagcucuacaagauggccggcgucgaggacaagaacauggucuuccucuucaccgacacccagaucgucgucgaggaguuccucgaggacaucaacaacauccucaacuccggcgagguccccaaccucuucgagaaggacgagcucgagcagguccucgccgccacccgcccccgcgccaaggaggucggcaucuccgagggcaaccgcgacgaggucuuccaguacuucaucuccaagguccgccagaagcuccacaucguccucugcaugucccccgucggcgaggccuuccgcucccgcugccgcauguuccccucccucgucaacugcugcaccaucgacugguucguccaguggccccgcgaggcccuccucuccgucuccaagaccuucuucucccaggucgacgccggcaacgaggagcucaaggagaagcucccccucaugugcgucaacguccaccucuccgucuccuccauggccgagcgcuacuacaacgagcuccgccgccgcuacuacaccacccccaccuccuaccucgagcucaucaaccucuaccucuccaugcucuccgagaagcgcaagcagaucaucuccgcccgcgaccgcgucaagaacggccucaccaagcuccucgagaccaacauccucgucgacaagaugaagcucgaccucuccgcccucgagcccguccuccucgccaaguccgaggacgucgaggcccucauggagaagcucgccgucgaccaggaguccgccgaccagguccgcaacaccguccaggaggacgaggccaccgccaaggucaaggccgaggagacccaggccaucgccgacgacgcccagcgcgaccucgacgaggcccuccccgcccucgacgccgccaacaaggcccucgacucccucgacaaggccgacaucuccgagauccgcgucuucaccaagccccccgaccucgucaugaccgucauggaggccaucuccauccuccucaacgccaagcccgacuggcccuccgccaagcagcuccucggcgacuccaacuuccucaagcgccuccucgaguacgacaaggagaacaucaagccccagauccucgccaagcuccagaaguacaucaacaaccccgacuucguccccgagaaggucgagaaggucuccaaggccugcaaguccaugugcauguggguccgcgccauggaccucuacucccgcgucgucaaggucgucgagcccaagcgccagaagcuccgcgccgcccaggccgagcucgacaucaccauggccacccuccgcgagaagcaggcccuccuccgccaggucgaggaccagauccaggcccuccaggacgaguacgacaagggcgucaacgagaaggagucccucgccaagaccauggcccucaccaaggcccgccucguccgcgccggcaagcucaccgccgcccucgaggacgagcagguccgcugggaggaguccauccagaaguucgaggaggagaucuccaacaucaccggcaacgucuucaucgccgccgccugcgucgccuacuacggcgccuucaccgcccaguaccgccagucccucaucgagugcuggauccaggacugccagucccucgagauccccaucgaccccuccuucucccucaucaacauccucggcgaccccuacgagauccgccaguggaacaccgacggccucccccgcgaccucaucuccaccgagaacggcauccucgucacccagggccgccgcuggccccucaugaucgacccccaggaccaggccaaccgcuggauccgcaacaaggaguccaaguccggccucaagaucaucaagcucaccgacuccaacuuccuccgcauccucgagaacuccauccgccucggccuccccguccuccucgaggagcucaaggagacccucgaccccgcccucgagcccauccuccucaagcagaucuucaucuccggcggccgccuccucauccgccucggcgacuccgacaucgacuacgacaagaacuuccgcuucuacaugaccaccaagaugcccaacccccacuaccuccccgaggucugcaucaaggucaccaucaucaacuucaccgucaccaaguccggccucgaggaccagcuccucuccgacgucguccgccucgagaagccccgccucgaggagcagcgcaucaagcucaucguccgcaucaacaccgacaagaaccagcucaagaccaucgaggagaagauccuccgcaugcucuucaccuccgagggcaacauccucgacaacgaggagcucaucgacacccuccaggacuccaagaucaccuccggcgccaucaagacccgccucgaggaggccgaguccaccgagcagaugaucaacgucgcccgcgagaaguaccgccccgucgccacccagggcuccgucauguacuucgucaucgccucccucuccgagaucgaccccauguaccaguacucccucaaguacuucaagcagcucuucaacaccaccaucgagaccuccgucaagaccgagaaccuccagcagcgccucgacguccuccucgagcagacccuccucaccgccuacgucaacgucucccgcggccucuucgagcagcacaagcucaucuacuccuucaugcucugcgucgagaugaugcgccagcagggcacccucuccgacgccgaguggaacuucuuccuccgcggcuccgccggccucgagaaggagcgcccccccaagcccgaggcccccuggcuccccaccgccaccugguucgccugcugcgaccucgaggaguccuuccccgucuuccacggccucacccagaacauccucucccaccccaucuccauccgccucggcuccuucgagaccuacaucaacccccagaagugggagggcuacuccaagaugaagcacgaggacaagcacaugcgccaggagaaggaggccgcccaccaggaccccugguccgccggccucuccuccuuccacaagcucauccucaucaagugcugcaaggaggagaaggucgucuucgcccucaccgacuucgucaucgagaaccucggcaagcaguucaucgagaccccccccgucgaccuccccacccucuaccaggacauguccugcaacaccccccucgucuucauccucuccaccggcuccgaccccaugggcgccuuccagcgcuucgcccgcgaguccggcuacuccgagcgcguccaguccaucucccucggccagggccagggccccaucgccgagaagauggucaaggacgccaugaaguccggcaacugggucuuccuccagaacugccaccucgccgucuccuggaugcucgccauggaggagcucaucaagaccuucaccgaccccgacuccgccaucaaggacaccuuccgccucuuccucuccuccaugcccuccaacaccuuccccgucaccguccuccagaacuccgucaaggucaccaacgagccccccaagggccuccgcgccaacauccgccgcgccuucaccgagaugacccccuccuucuucgaggagaacauccucggcaagaaguggcgccagaucaucuucggcaucugcuucuuccacgccaucauccaggagcgcaagaaguucggcccccucggcuggaacaucugcuacgaguucaacgacuccgaccgcgagugcgcccuccucaaccucaagcucuacugcaaggagggcaagauccccugggacgcccucaucuacaucaccggcgagaucaccuacggcggccgcgucaccgacuccugggaccagcgcugccuccgcaccauccucaagcgcuucuucucccccgagacccucgaggaggacuacaaguacuccgaguccggcaucuacuucgcccccauggccgacucccuccaggaguucaaggacuacaucgagaaccucccccucaucgacgaccccgagaucuucggcaugcacgagaacgccaaccucgucuuccaguacaaggagaccuccacccucaucaacaccauccucgagguccagccccgcuccuccaccggcggcgagggcaaguccaacgacgagaucguccaggagcucgucgccuccguccagacccgcguccccgagaagcucgagauggagggcgccuccgagucccucuucgucaaggaccuccagggccgccucaacucccucaccaccguccucggccaggaggucgaccgcuucaacaaccuccucaagcucauccacaccucccucgagacccucaacaaggccaucgccggcuucgucgucauguccgaggagauggagaaggucuacaacuccuuccucaacaaccagguccccgcccucugguccaacaccgccuaccccucccucaagccccucggcuccugggucaaggaccucauccuccgcaccuccuucgucgaccucuggcucaagcgcggccagcccaaguccuacuggaucuccggcuucuucuucccccagggcuuccucaccggcacccuccagaaccacgcccgcaaguacaaccuccccaucgacgagcucuccuucaaguacuccgucauccccaccuaccgcgaccaggccgccgucaucgaggccgccaagaccguccaguucggccaggagcuccccauggacauggagcuccccucccccgaggacggcguccucguccacggcauguucauggacgccucccgcugggacgacaaggagauggucaucgaggacgcccuccccggccagaugaaccccguccuccccgucguccacuucgagccccagcagaacuacaagcccucccccacccucuaccacugcccccucuacaagaccggcgcccgcgccggcacccucuccaccaccggccacuccaccaacuucgucgucaccguccuccuccccuccaagcgcuccaaggacuacuggaucgccaagggcuccgcccuccucugccagcucuccgaguga

SEQ ID NO: 42317 - RNA, 12075 nt, Artificial Sequence
  derived and/or modified sequence opt2 from DNAH7__Homo_sapiens__NP_061720
auguccuccgagcaggacaaguccgccuccaaggagaaguccaagaagcccguccgcuuccucccccagcucuccauggagaagcucgccuccaaggagaaguucaaggcccccgcccgcgcccucccccagcucuccauggucuccaccaagccccacuggcagcaggccgcccccuccuuccaccucuccgucaagcaggacgacgagucccccgagcccuucuccgucaagaacgagcagucccacgccgaguacauggagcgcuucggcaagaagggcaagcucccccaccaggucgacgacuccuacgucggccccuccaccuccaaguccaagggcaaguccccccacaaggagcgcgagaacuuccgcuccacccucgucaacgucaucaugcagcaggacgccgaccucgacuccgccguccccgacggcuccaccauccccaagcccaccgccuccgccaucgagaaggacauccuccgcuacuacuacuacauccaccacggcaucgacaccgaccacgucgcccccauggaggacuccuggcucgagcacguccucgaccucgucccccagcaccucaaggucuucaccgacuccaucgucacccucuccgacgagaugcgcgaggacuaccuccucuccguccgcaaguccaucgucgacuucguccucaaggacccccgcgagaagggcgacgacaagaagaccgacgagcuccccgcccaccgcgccgagauggagauccuccccaagcccuggcgcaaguccuuccucgccgccuccuccuacauccgcgaccaccucaacgccaugaaccccaccaugcucgccguccucgaccucuggcacaccaacuucaagaagcuccgccucgucgacaucaaggaguuccacaacugccaggacgcccucgagcucuccuccuuccagaacaucaucaugcgccacauggacuccgccaaggagacccuccucaagaugugguuccccgagguccagaacaucuacuaccagggcaacaagaagaagcagcuccccaccggcgacuccuccgccaagcucgaguccuucuucaacugcgccgccgcccucaugacccuccagcuccaggaccucacccucgucuccaugcaggacuucaccgaccucaucgcccagccccccgacuccguccgcgccuucgagcaccccggcuucaucaugcgccucauccucgacaacgacaccaucaaguucgagcccgagcucuccgacuacaucgacaucuuccucaacgucuacgacgucaugaucaaggccgucuccuucgucccccgcgucgagaccaagcucuacuccaagugggaguccaaguccaagcccaccacccucaagcccaucauccucaacgagaucgucgacgcccacaaggagaagaucaaggaggucaucaugaaggaguccgucgcccccaccgagcaccuccgccucuacgacaaguacgacuuccucaucacccgcaaggccgagcgcgacgucgacaacuuccucgccgagaaccacuccuacgagaagaucaucgacgagaucugcaaguaccagaagcucaucgaggagauccaguacaccuccaucaagaccauccgccucggcauguucgagaugcacugcgaggagcucauccgcgcccucgucaagcgcgccgacaucaucugcggcaagcuccucgccaagauguuccgcgaccaccaggaggucaacacccgccucugcgacgaguucgagcgcaucgccgagaaggcccucuccaccccccccaacaccgccgagcucauggagaugaaggccuacauccagaaggucgaggucaccgacaugaucgagcucgagcagcgccucgucgacuccaagaacugccucgccuuccucaucgaguacgucaacuucucccccgccgacaugcgccucaacaacuccgucuuccagugguacggccgcaugggcgagaucuucgaggagcaccgcaagaucaucaaggagaagaucgagcaguaccaggagggccucaagcuccgcugcgagcgcuucgucgaggagcucgaguccuacgccaagcaguccgaggaguucuacuccuucggcgaccuccaggacguccagcgcuaccucaagaaggcccagauccucaacggcaagcucgaccucgccgccgacaagaucgagcaguucaacgccgaggaggaggccuucggcuggcuccccuccgucuacccccagcgcaagaagauccaggacggccucaaccccuaccuccgccucuacgagaccgccgucgaguucuccuccaacuaccgcgccuggaccgagggccccuaccacaaggucaaccccgaccaggucgaggccgacaucggcaacuacuggcgcggccucuacaagcucgagaagaccuuccacgacucccccuacgcccucgccaugaccaagaagguccgcuccaaggucgaggacuucaagcagcacaucccccucauccaggucaucugcaaccccggccuccgcccccgccacugggaggccauguccgccaucgucggcuacccccuccagcccuccgacgacuccaccgucuccuccuuccucgacaugaaccucgagcccuacaucgaccgcuucgagggcaucuccgaggccgccuccaaggaguacucccucgagaaggccauggagaagaugaucaccgagugggacgccgucgaguucgucauccacuccuaccgcgagaccggcaccuucauccucgccuccgucgacgagauccagaugcuccucgacgaccacaucaucaagacccagaccaugcgcggcucccccuucaucaagcccuacgagaagcagaugcgcgagugggagggcaagcuccuccuccuccaggagauccucgacgaguggcucaagguccaggccaccuggcucuaccucgagcccaucuucuccucccccgacaucaugucccagaugcccgaggagggccgccgcuucaccgccgucgacaagaccuggcgcgacaucaugcgcuccgucaugcaggacaagcacguccucaccgucgucaccaucgaccgcaugcucgagcgccucaagaaguccaacgagcuccucgagcucauccucaagggccucaacgaguaccucgagaagaagcgccucuucuucccccgcuucuucuuccucuccaacgacgagcuccucgagauccucuccgagaccaaggaccccacccgcguccagccccaccucaagaagugcuucgagggcaucgccaaggucgaguucaccgagacccucgacaucacccacaugaaguccuccgagggcgaggucgucgagcucaucgagaucaucuccaccgccaaggcccgcggccaggucgagaaguggcucgucgagcucgagcgcgucaugaucaacuccauccacaaggucaccggcgacgccaccuucgccuacaccaaguacgagcgcaucaacuggguccgcgacuggcccggccagaccguccucugcgucucccagaucuucuggaccaaggagguccagaccgccauccccaugggcaucaaggcccucgagcaguaccucaagaccugcaaccgccagaucgacgacaucgucacccucguccgcggcaagcucuccaugcagaaccgcgucacccucggcgcccucgucguccucgacguccacgcccgcgacguccucuccucccucgucaagaagaacaucuccgacgacuccgacuucgaguggcucucccagcuccgcuacuacuggcaggagaaccaccucgagaccaagaugaucaacgccggccuccgcuacggcuacgaguaccucggcaacuccccccgccucgucaucaccccccucaccgaccgcugcuaccgcacccucuucggcgcccuccaccuccaccucggcggcgcccccgagggccccgccggcaccggcaagaccgagaccaccaaggaccucgccaaggccgucgccaagcagugcgucgucuucaacugcuccgacggccucgacuaccucgcccucggcaaguucuucaagggccuccucuccugcggcgccugggccugcuucgacgaguucaaccgcaucgaccucgagguccucuccgucgucgcccagcagauccucaccauccagcgcggcaucaacgccggcgccgacauccucauguucgagggcaccgagcucaagcucgaccccaccugcgccgucuucaucaccaugaaccccggcuacgccggccgcuccgagcuccccgacaaccucaaggcccucuuccgcaccgucgccaugaugguccccgacuacgccaugaucgccgagaucguccucuacuccugcggcuucgucaccgcccgcccccucuccgucaagaucgucgccaccuaccgccucugcuccgagcagcucuccucccagcaccacuacgacuacggcaugcgcgccgucaaguccguccucaccgccgccggcaaccucaagcucaaguaccccaacgagaacgaggagauccuccuccuccgcuccaucaucgacgucaaccuccccaaguuccucucccacgaccucccccucuucgagggcaucaccuccgaccucuuccccggcgucaagcuccccaagcccgacuacaacgaccuccucgccgccaucaaggacaacugcgccuccaugaaccuccagaugaccgccuucuucuccgagaagauccuccaggucuacgagaugaugaucguccgccacggcuucaugaucgucggcgagcccuucggcggcaagaccuccgccuaccgcguccucgccggcgcccucaacgacaucugcgagaagggccucauggaggagaacaagguccagaucaccguccucaaccccaaguccgucaccaugggccagcucuacggccaguucgacuccgucucccacgagugguccgacggcguccucgccgucuccuuccgcgccuucgccuccuccgucacccccgaccgcaaguggcucaucuucgacggccccgucgacgccgucuggaucgagaacaugaacaccguccucgacgacaacaagaagcucugccucauguccggcgagaucauccagauguccccccagaugaaccucaucuucgagcccauggaccucgaggucgccucccccgccaccgucucccgcugcggcaugaucuacauggagccccacaugcucggcuggcgcccccucaugcucuccugggucaaccuccuccccgccuccgucuccgucauccagaaggaguucaucaugggccucuucgaccgcaugguccccgucuccgucgaguucauccgcaagcacaccaaggagcucucccccaccuccgacaccaaccucguccgcucccucaugaaccucaucgacugcuucauggacgacuucgccgacgaggucaagcucaaggagcgcaacgaccgcgagaccuacucccuccucgagggcaucuuccucuucucccucaucugguccgucggcgccuccugcaccgacgacgaccgccucaaguucaacaagauccuccgcgagcucauggagucccccaucuccgaccgcacccgcaacaccuucaagcuccaguccggcaccgagcagaccuccuccaaggcccucaccguccccuuccccgagaagggcaccaucuacgacuaccaguucgucaccgagggcaucggcaagugggagcccuggaucaagaagcucaaggaggccccccccauccccaaggacgucauguucaacgagaucaucguccccacccucgacaccauccgcuacuccgcccucauggagcuccucaccacccaccagaagcccuccaucuucgucggccccaccggcaccggcaaguccgucuacaucaccaacuuccuccucaaccagcucaacaaggagaucuacaagccccuccucaucaacuucuccgcccagaccaccgccgcccagacccagaacaucgucauguccaagcucgacaagcgccgcaagggcgucuucggccccccccucggcaagcgcauggucgucuucgucgacgacgucaacaugcccgcccgcgaggucuacggcgcccagccccccaucgagcuccuccgccaguggcucgaccacuggaacugguacgaccucaaggacugcuccaugaucaagcucgucgacauccagaucaugugcgccaugggcccccccggcggcggccgcaaccccgucaccccccgcuacaugcgccacuucaacaucaucaccaucaacgaguucuccgacaaguccauguacaccaucuucucccgcauccucaccuggcaccucgagaucugcuacaaguuccccgacgaguuccucgaccucaccacccagaucgucaacggcaccaugacccucuacaaggaggccaugaagaaccuccuccccacccccgccaagucccacuaccucuucaaccuccgcgacuucucccgcgucauccagggcgucugccucucccgccccgagaccaccgagaccaccgaggucaucaagcgccucuggguccacgagguccuccgcgucuacuacgaccgccuccucgacaacaccgaccgcuccuggcucaucaacuacauccaggagauccuccgcaacuacauguacgaggacuuccacgagcucuuccagcgccucgacuucgacaacgacggcauggucgaggccgacgaccuccgcucccucauguucugcgacuuccacgaccccaagcgcgaggacaccaacuaccgcgagaucgccgacgucgacaaccuccgcaugaucgucgagauccaccucgaggaguacaacaacaucuccaagaagcccaugaaccucguccucuuccgcuucgccaucgagcacaucucccgcaucucccgcauccucaagcagccccgcucccacgcccuccucgucggcgucggcggcuccggccgccaguccgucacccgccucgccgcccacauggccgacuacuccgucuuccaggucgagaucuccaagggcuacgacaccaccgaguggcacgaggaccucaaggucauccuccgcaagugcgccgagggcgagaugcagggcgucuuccucuucaccgacacccagaucaaggaggaguccuuccucgaggacgucuccaaccuccucaacgccggcgagauccccaaccucuucgcccucgacgagaagcaggagaucugcgacaagaugcgccagcucgaccgccagcgcgacaagaccaagcagaccgacggcucccccaucgcccucuucaacauguucaucgaccacugccgcucccagcuccacgucguccucgccaugucccccaucggcgacgccuuccgcaaccgccuccgcaaguuccccgcccucgucaacugcugcaccaucgacugguuccaguccuggcccgaggacgcccuccaggccgucgccucccgcuuccucgaggagaucgagauguccgaggagauccgcgacggcugcaucgacaugugcaaguccuuccacaccuccaccaucgaccucuccaaguccuucuucgucgagcuccagcgcuacaacuacgucacccccaccuccuaccucgagcucaucuccaccuucaagcuccuccucgagaagaagcgcuccgaggucaugaagaugaagaagcgcuacgaggucggccucgagaagcucgacuccgccuccucccaggucgccaccaugcagauggagcucgaggcccuccacccccagcucaaggucgccuccaaggaggucgacgagaugaugaucaugaucgagaaggaguccgucgaggucgccaagaccgagaagaucgucaaggccgacgagaccaucgccaacgagcaggccauggccuccaaggccaucaaggacgagugcgacgccgaccucgccggcgcccuccccauccucgaguccgcccucgccgcccucgacacccucaccgcccaggacaucaccgucgucaaguccaugaaguccccccccgccggcgucaagcucgucauggaggccaucugcauccucaagggcaucaaggccgacaagauccccgaccccaccggcuccggcaagaagaucgaggacuucuggggccccgccaagcgccuccucggcgacaugcgcuuccuccagucccuccacgaguacgacaaggacaacaucccccccgccuacaugaacaucauccgcaagaacuacauccccaaccccgacuucguccccgagaagauccgcaacgccuccaccgccgccgagggccucugcaagugggucaucgccauggacuccuacgacaaggucgccaagaucgucgcccccaagaagaucaagcucgccgccgccgagggcgagcucaagaucgccauggacggccuccgcaagaagcaggccgcccucaaggagguccaggacaagcucgcccgccuccaggacacccucgagcucaacaagcagaagaaggccgaccucgagaaccaggucgaccucugcuccaagaagcucgagcgcgccgagcagcucaucggcggccucggcggcgagaagacccgcuggucccacaccgcccucgagcucggccagcucuacaucaaccucaccggcgacauccucaucuccuccggcgucgucgccuaccucggcgccuucaccuccaccuaccgccagaaccagaccaaggaguggaccacccucugcaagggccgcgacauccccugcuccgacgacugcucccucaugggcacccucggcgaggccgucaccauccgcaccuggaacaucgccggccuccccuccgacuccuucuccaucgacaacggcaucaucaucaugaacgcccgccgcuggccccucaugaucgacccccagucccaggccaacaaguggaucaagaacauggagaaggccaacucccucuacgucaucaagcucuccgagcccgacuacguccgcacccucgagaacugcauccaguucggcacccccguccuccucgagaacgucggcgaggagcucgaccccauccucgagccccuccuccucaagcagaccuucaagcagggcggcuccaccugcauccgccucggcgacuccaccaucgaguacgcccccgacuuccgcuucuacaucaccaccaagcuccgcaacccccacuaccuccccgagaccuccgucaaggucacccuccucaacuucaugaucacccccgagggcaugcaggaccagcuccucggcaucgucgucgcccaggagcgccccgaccucgaggaggagaagcaggcccucauccuccagggcgccgagaacaagcgccagcucaaggagaucgaggacaagauccucgagguccucuccuccuccgagggcaacauccucgaggacgagaccgccaucaagauccucuccuccuccaaggcccucgccaacgagaucucccagaagcaggaggucgccgaggagaccgagaagaagaucgacaccacccgcaugggcuaccgccccaucgccauccacuccuccauccucuucuucucccucgccgaccucgccaacaucgagcccauguaccaguacucccucaccugguucaucaaccucuucauccucuccaucgagaacuccgagaaguccgagauccucgccaagcgccuccagauccucaaggaccacuucaccuacucccucuacgucaacgucugccgcucccucuucgagaaggacaagcuccucuucuccuucugccucaccaucaaccuccuccuccacgagcgcgccaucaacaaggccgaguggcgcuuccuccucaccggcggcaucggccucgacaaccccuacgccaaccucugcaccuggcucccccagaaguccugggacgagaucugccgccucgacgaccuccccgccuucaagaccauccgccgcgaguucaugcgccucaaggacggcuggaagaaggucuacgacucccucgagccccaccacgaggucuuccccgaggagugggaggacaaggccaacgaguuccagcgcaugcucaucauccgcugccuccgccccgacaaggucauccccaugcuccaggaguucaucaucaaccgccucggccgcgccuucaucgagcccccccccuucgaccucgccaaggccuucggcgacuccaacugcugcgccccccucaucuucguccucucccccggcgccgaccccauggccgcccuccucaaguucgccgacgaccagggcuacggcggcuccaagcucuccucccucucccucggccagggccagggccccaucgccaugaagaugcucgagaaggccgucaaggagggcaccugggucguccuccagaacugccaccucgccaccuccuggaugcccacccucgagaaggucugcgaggagcucucccccgaguccacccaccccgacuuccgcauguggcucaccuccuaccccucccccaacuuccccgucuccguccuccagaacggcgucaagaugaccaacgaggcccccaagggccuccgcgccaacaucauccgcuccuaccucauggaccccaucuccgaccccgaguucuucggcuccugcaagaagcccgaggaguucaagaagcuccucuacggccucugcuucuuccacgcccucguccaggagcgccgcaaguucggcccccucggcuggaacauccccuacgaguucaacgagaccgaccuccgcaucuccguccagcagcuccacauguuccucaaccaguacgaggagcuccccuacgaggcccuccgcuacaugaccggcgagugcaacuacggcggccgcgucaccgacgacugggaccgccgcacccuccgcuccauccucaacaaguucuucaaccccgagcucgucgagaacuccgacuacaaguucgacuccuccggcaucuacuucgucccccccuccggcgaccacaaguccuacaucgaguacaccaagacccucccccucacccccgcccccgagaucuucggcaugaacgccaacgccgacaucaccaaggaccaguccgagacccagcuccucuucgacaacauccuccucacccagucccgcuccgccggcgccggcgccaaguccuccgacgaggucgucaacgaggucgccuccgacauccucggcaagcuccccaacaacuucgacaucgaggccgccaugcgccgcuaccccaccaccuacacccaguccaugaacaccguccucguccaggagaugggccgcuucaacaagcuccucaagaccauccgcgacuccugcgucaacauccagaaggccaucaagggccucgccgucauguccaccgaccucgaggaggucgucuccuccauccucaacgucaagauccccgagauguggaugggcaaguccuaccccucccucaagccccucggcuccuacgucaacgacuuccucgcccgccucaaguuccuccagcagugguacgaggucggccccccccccgucuucuggcucuccggcuucuucuucacccaggccuuccucaccggcgcccagcagaacuacgcccgcaaguacaccauccccaucgaccuccucggcuucgacuacgaggucauggaggacaaggaguacaagcacccccccgaggacggcgucuucauccacggccucuuccucgacggcgccuccuggaaccgcaagaucaagaagcucgccgagucccaccccaagauccucuacgacaccguccccgucauguggcucaagcccugcaagcgcgccgacauccccaagcgccccuccuacgucgccccccucuacaagaccuccgagcgccgcggcguccucuccaccaccggccacuccaccaacuucgucaucgccaugacccuccccuccgaccagcccaaggagcacuggaucggccgcggcgucgcccuccucugccagcucaacuccuga

SEQ ID NO: 42318 - RNA, 14124 nt, Artificial Sequence
  derived and/or modified sequence opt2 from DNAH8__Homo_sapiens__NP_001193856
auggagaaggacgccgaggacggcgcccccuccgagggcgccgaggccccccccuccaccgaggaggccgcccccccccgcuccgaggaggaggaggccccccgcccccccaccgucgaggcccccgccgaggacggcuucucccccuccgccgaggacgccgucuccuccgucgucgacuaccgcgaccucauccccuccgaggagggcaucguccuccccgacgaccacgaggccgaccucaaccgcguccgccagcgccucgccccccgccccguccaguccgucaucuccgagguccucucccuccccuccucccgccgcuccucccgcuaccgccgcuccauguccggccuccccaaccuccaggagacccucaaggagcgccaggcccgcuuccgcgaggcccgcgagucccgccgccucaagaucgaccccuccuacaaguacaucuucgagauccucgccgagaaccucggccucgacaucgucaccgucgaggagcucauccucgacugccccucccucgaggccuucaccaacuucuucgccaaggacggcugcaagacccucaaguuccucuaccaggagggcgacguccccggcaucgagugcggccgcaccaucgccggcgccaccaagggcgccaagaugaugaagcucuacaucgacaacgccgcccccgacaagcucaagggccucugcaucuucuucguccgcugccgcaacgacgucgccaucaacgucaagaccauccaggaggaggcccucuucaccguccucgacgccuccaagggccuccucaacggcauccgcgacaugcucgccaacaucuuccuccccgccguccucgccaccaacaacuggggcgcccucaaccaguccaagcagggcgaguccgagaagcacaucuucaccgagaccaucaaccgcuaccucuccuuccucgacggcgcccgcaucuccaucgagggcaccgucaagcucaagaccaucgacaacgucaacuucuccaagcuccacaccuucgaggaggucaccgccgccgccuccaacuccgagaccguccaccagcucgaggagguccucauggucugguacaagcagaucgagcagguccucaucgaguccgagcagaugcgcaaggaggccggcgacuccggcccccucaccgagcucgagcacuggaagcgcauguccgccaaguucaacuacaucaucgagcagaucaagggccccuccugcaaggccgucaucaacguccucaacgucgcccacuccaagcuccucaagaacuggcgcgaccucgacgcccgcaucaccgacaccgccaacgaguccaaggacaacguccgcuaccucuacacccucgagaaggucugccagccccucuacaaccacgaccucgucuccauggcccacggcauccagaaccucaucaacgccauccgcaugauccacggcgucucccgcuacuacaacaccuccgagcgcaugaccucccucuucaucaaggucaccaaccagauggucaccgccugcaaggccuacaucaccgacggcggccucaaccacgucugggaccaggagacccccgucguccucaagaagauccaggacugcaucuuccucuucaaggaguaccaggccuccuuccacaagacccgcaagcucaucuccgaguccuccggcgagaaguccuucgaggucuccgagauguacaucuucggcaaguucgaggccuucugcaagcgccucgagaagaucaccgagaugaucaccgucguccagaccuacuccacccucuccaacuccaccaucgagggcaucgacaucauggccaucaaguuccgcaacaucuaccagggcgucaagaagaagcaguacgacauccucgacccccgccgcaccgaguucgacaccgacuuccucgacuucaugaccaagaucaacggccucgagguccagauccaggccuucaugaacuccuccuucggcaagauccucuccucccagcaggcccuccagcuccuccagcgcuuccagaagcucaacauccccugccucggccucgagaucaaccacaccaucgagcgcauccuccaguacuacgucgccgagcucgacgccaccaagaagcucuaccacucccagaaggacgaccccccccucgcccgcaacaugccccccaucgccggcaagauccucuggguccgccagcucuaccgccgcaucuccgagcccaucaacuacuucuucaagaacuccgacauccucuccucccccgacggcaaggccgucauccgccaguacaacaagaucuccuacguccucgucgaguucgaggucgucuaccacaccgccuggauccgcgagaucucccagcuccacuacgcccuccaggccacccucuucguccgccaccccgagaccggcaagcuccucgucaacuucgaccccaagauccucgaggucguccgcgagaccaagugcaugaucaagaugaagcucgacguccccgagcaggccaagcgccuccucaagcucgaguccaagcucaaggccgacaagcucuaccuccagggccuccuccaguacuacgacgagcucugccaggagguccccuccgucuucgucaaccucaugacccccaagaugaagaaggucgaguccguccuccgccagggccucaccguccucaccugguccucccucacccucgaguccuucuuccaggaggucgagcucguccucgacauguucaaccagcuccucaagaagaucuccgaccucugcgagaugcacaucgacaccguccucaaggagaucgccaagaccguccucaucucccuccccgaguccggcgccaccaaggucgaggacaugcucacccucaacgagaccuacaccaaggagugggccgacauccucaaccacaaguccaagcacgucgaggaggccguccgcgagcucaucuccaucuucgagcagaucuacgaggucaaguacaccggcaaggucggcaagcaguccgagcagcgcaagcacgucgucuucggcuccgagaccggcgagggcgagaacaacgacuacgaggccaacaucgucaacgaguucgacacccacgacaaggaggacgaguucaagaaggagugcaaggaggucuucgccuucuucucccaccagcuccucgacucccuccagaaggccacccgccucucccucgacaccaugaagcgccgcaucuucgucgccucccucuacggccgcaagcaguccgaggacaucaucuccuucaucaaguccgagguccaccucgccauccccaacgucgucaugauccccucccucgacgacauccagcaggccaucaaccgcaugauccagcucacccucgaggucucccgcggcgucgcccacuggggccagcagcagauccgccccaucaaguccgucauccccucccccaccaccaccgacgucacccaccagaacaccggcaagcuccucaagaaggaggagcgcuccuucgaggaggccauccccgcccgcaagcucaagaacuucuaccccggcgucgccgagcacaaggacaucuccaagcucguccuccuccucuccuccuccgucaacucccuccgcaaggccgcccacgaggcccuccaggacuuccagaaguacaagacccucuggaccgaggaccgcgacgucaaggucaaggaguuccucgccaacaaccccucccucaccgagauccgcuccgagauccuccacuacgccaccuucgagcaggagaucgacgagcucaagcccaucaucgucgucggcgcccucgagcuccacaccgagcccaugaagcucgcccucuccaucgaggccaaggccuggaagaugcuccucugccgcuaccucaacgaggaguacaagaagaagauguccuacaugaucgccuucaucaacgaguaccucaagaagcucucccgccccauccgcgaccucgacgacguccgcuucgccauggaggcccucuccugcauccgcgacaacgagauccagauggacaugacccucggccccaucgaggaggccuacgccauccucaaccgcuucgaggucgaggucaccaaggaggaguccgaggccgucgacacccuccgcuacuccuucaacaagcuccaguccaaggccgucuccguccaggaggaccucguccagguccagcccaaguucaaguccaaccuccucgaguccgucgaggucuuccgcgaggacgucaucaacuucgccgaggccuacgagcucgagggccccaugguccccaacauccccccccaggaggccuccaaccgccuccagaucuuccaggccuccuucgacgaccucuggcgcaaguucgucaccuacuccuccggcgagcagcucuucggccuccccgucaccgacuacgagguccuccacaagacccgcaaggagcucaaccuccuccagaagcucuacggccucuacgacaccgucauguccuccaucuccggcuacuacgagauccucuggggcgacgucgacaucgagaagaucaacgccgagcuccucgaguuccagaaccgcugccgcaagcuccccaagggccucaaggacuggcaggccuuccucgaccucaagaagcgcaucgacgacuucuccgaguccugcccccuccucgagaugaugaccaacaaggccaugaagcagcgccacugggaccgcaucuccgagcucaccggcacccccuucgacgucgaguccgacuccuucugccuccgcaacaucauggaggccccccuccucaagcacaaggacgacaucgaggacaucugcaucuccgccaucaaggagaaggacaucgaggccaagcucacccaggucaucgagaacuggaccaaccagaaccucuccuucgccgccuucaagggcaagggcgagcuccuccucaagggcaccgaguccggcgagaucaucacccucauggaggacucccucaugguccucggcucccuccucuccaaccgcuacaacgcccccuucaagaagaacauccagaacugggucuacaagcucuccaccuccuccgacaucaucgaggaguggcucgucguccagaaccucugggucuaccucgaggccgucuucgucggcggcgacaucgccaagcagcucccccaggaggccaagcgcuuccagaacaucgacaaguccuggaucaagaucaugcagcgcgcccacgagaaccccaacgucaucaacugcugcgucggcgacgagaccaugggccagcuccucccccaccuccacgagcagcucgaggucugccagaagucccucaccggcuaccucgagaagaagcgccuccucuucccccgcuucuucuucgucuccgaccccguccuccucgagauccucggccaggccuccgacucccacaccauccagccccaccuccccgccgucuccgacaacaucaacgaggucaccuuccacgccaaggacuacgaccgcaucauggccgucaucucccgcgagggcgagaagaucguccucgacaacuccgucauggccaagggccccgucgagaucuggcuccucgaccuccucaagaugcagauguccucccuccacaacaucauccgcuccgccuucuaccagaucuccgacuccggcuuccagcuccuccccuuccucucccacuuccccgcccaggucggccuccucggcauccagaugcucuggacccacgacuccgaggaggcccuccgcaacgccaaggacgaccgcaagaucaugcaggucaccaaccagaaguuccucgacauccucaacacccucaucucccagaccacccacgaccucuccaaguucgaccgcgucaaguucgagacccucaucaccauccacguccaccagcgcgacaucuucgacgaccucgucaagaugcacaucaagucccccaccgacuucgaguggcucaagcagucccgcuucuacuucaaggaggaccucgaccagaccgucgucuccaucaccgacgucgacuucaucuaccagaacgaguuccucggcugcaccgaccgccucgucaucaccccccucaccgaccgcugcuacaucacccucgcccaggcccucggcaugaacaugggcggcgcccccgccggccccgccggcaccggcaagaccgagaccaccaaggacaugggccgcugccucggcaaguacgucgucgucuucaacugcuccgaccagauggacuuccgcggccucggccgcaucuucaagggccucgcccaguccggcuccuggggcugcuucgacgaguucaaccgcaucgagcuccccguccucuccgucgccgcccagcagaucuacaucguccucaccgcccgcaaggagcgcaagaagcaguucaucuucuccgacggcgacugcgucgaccucaaccccgaguucggcaucuuccucaccaugaaccccggcuacgccggccgccaggagcuccccgagaaccucaagauccaguuccgcaccgucgccaugaugguccccgaccgccagaucaucaugcgcgucaagcucgccuccugcggcuuccucgagaacgucauccucgcccagaaguucuacguccucuacaagcucugcgaggagcagcucaccaagcagguccacuacgacuucggccuccgcaacauccucuccguccuccgcacccucggcucccagaagcgcgcccgccccgaggacuccgagcucuccaucgucaugcgcggccuccgcgacaugaaccucuccaagcucgucgacgaggacgagccccucuuccucucccucaucaacgaccucuuccccggccuccagcucgacuccaacaccuacgccgagcuccagaacgccgucgcccaccagguccagaucgagggccucaucaaccacccccccuggaaccucaagcucguccagcucuacgagaccucccucguccgccacggccucaugacccucggccccuccggcuccggcaagaccaccgucaucaccauccucaugaaggcccagaccgagugcggccgcccccaccgcgagaugcgcaugaaccccaaggccaucaccgccccccagauguucggccgccucgacaccgccaccaacgacuggaccgacggcaucuucuccacccucuggcgcaagacccucaaggccaagaagggcgagaacaucuuccucauccucgacggccccgucgacgccaucuggaucgagaaccucaacuccguccucgacgacaacaagacccucacccucgccaacggcgaccgcauccccauggcccccuccugcaagcuccucuucgagguccacaacaucgagaacgccucccccgccaccgucucccgcaugggcauggucuacaucuccuccuccgcccucuccuggcgccccauccuccaggccuggcucaagaagcgcaccgcccaggaggccgccgucuuccucacccucuacgagaaggucuucgaggacaccuacaccuacaugaagcucaaccucaaccccaagaugcagcuccucgagugcaacuacaucguccagucccucaaccuccucgagggccucauccccuccaaggaggagggcggcgucuccugcgucgagcaccuccacaagcucuucgucuucggccucauguggucccucggcgcccuccucgagcucgagucccgcgagaagcucgaggccuuccuccgccagcacgaguccaagcucgaccuccccgagauccccaagggcuccaaccagaccauguacgaguucuacgucaccgacuacggcgacugggagcacuggaacaagaagcuccagcccuacuacuaccccaccgacuccauccccgaguacuccuccauccucguccccaacgucgacaacauccgcaccaacuuccucaucgacaccaucgccaagcagcacaaggccguccuccucaccggcgagcagggcaccgccaagaccgucauggucaaggccuaccucaagaaguacgaccccgagguccagcucuccaagucccucaacuucuccuccgccaccgagcccaugauguuccagcgcaccaucgaguccuacgucgacaagcgcaucggcuccaccuacggcccccccggcggccgcaagaugaccgucuucaucgacgacaucaacaugcccgucaucaacgaguggggcgaccagaucaccaacgagaucguccgccagaugauggagauggagggcauguacucccucgacaagcccggcgacuucaccaccaucgucgacguccagcucaucgccgccaugauccaccccggcggcggccgcaacgacaucccccagcgccucaagcgccaguucaccgucuucaacugcacccuccccuccaacgccuccaucgacaagaucuucggcaucaucggcugcggcuacuucgaccccugccgcuccuucaagccccagaucugcgagaugaucgucaaccucgucuccgucggccgcguccucuggcaguggaccaaggucaagaugcuccccacccccuccaaguuccacuacaucuucaaccuccgcgaccucucccgcaucuggcagggcaugcucaccaucaaggccgaggagugcgccuccauccccacccuccucucccucuucaagcacgagugcucccgcgucaucgccgaccgcuucaucacccccgaggacgagcagugguucaacgcccaccucacccgcgccgucgaggagaacaucggcuccgacgccgccuccugcauccuccccgagcccuacuucgucgacuuccuccgcgagaugcccgagcccaccggcgacgagcccgaggacuccgucuucgagguccccaagaucuacgagcucaugcccuccuucgacuuccucgccgagaagcuccaguucuaccagcgccaguucaacgagaucauccgcggcaccucccucgaccucgucuucuucaaggacgccaugacccaccucaucaagaucucccgcaucauccgcaccuccugcggcaacgcccuccucgucggcgucggcggcuccggcaagcagucccucucccgccucgccuccuucaucgccggcuaccagaucuuccagaucacccucacccgcuccuacaacgucaccaaccucaccgacgaccucaaggcccucuacaaggucgccggcgccgacggcaagggcaucaccuucaucuucaccgacuccgagaucaaggacgaggccuuccucgaguaccucaacaaccuccucuccuccggcgagaucuccaaccucuucgcccgcgacgagauggacgagaucacccagggccucaucuccgucaugaagcgcgagcucccccgccacccccccaccuucgacaaccucuacgaguacuucaucucccgcucccgcaagaaccuccacgucguccucugcuucucccccgucggcgagaaguuccgcgcccgcucccucaaguuccccggccucaucuccggcugcaccauggacugguucucccgcuggccccgcgaggcccucaucgccgucgccuccuacuuccucuccgacuacaacaucgucugcuccuccgagaucaagcgccaggucgucgagaccaugggccucuuccacgacauggucuccgaguccugcgaguccuacuuccagcgcuaccgccgccgcgcccacgucacccccaaguccuaccucuccuucaucaacggcuacaagaacaucuacgccgagaaggucaaguucaucaacgagcaggccgagcgcaugaacaucggccucgacaagcucauggaggccuccgaguccgucgccaagcucucccaggaccucgccgucaaggagaaggagcucgccgucgccuccaucaaggccgacgagguccucgccgaggucaccgucuccgcccaggccuccgccaagaucaagaacgagguccaggaggucaaggacaaggcccagaagaucgucgacgagaucgacuccgagaaggucaaggccgaguccaagcucgaggccgccaagcccgcccucgaggaggccgaggccgcccucaacaccaucaagcccaacgacaucgccaccguccgcaagcucgccaagcccccccaccucaucaugcgcaucauggacugcguccuccuccucuuccagaagaagaucgaccccgucaccauggaccccgagaaguccugcugcaagcccuccuggggcgagucccucaagcucauguccgccaccggcuuccucuggucccuccagcaguuccccaaggacaccaucaacgaggagaccgucgagcuccuccagcccuacuucaacauggacgacuacaccuucgaguccgccaagaaggucugcggcaacgucgccggccuccucuccuggacccucgccauggccaucuucuacggcaucaaccgcgagguccucccccucaaggccaaccucgccaagcaggagggccgccucgccgucgccaacgccgagcucggcaaggcccaggcccuccucgacgagaagcaggccgagcucgacaagguccaggccaaguucgacgccgccaugaacgagaagauggaccuccucaacgacgccgacaccugccgcaagaagaugcaggccgccuccacccucaucgacggccucuccggcgagaagauccgcuggacccagcaguccaaggaguucaaggcccagaucaaccgccucgucggcgacauccuccucugcaccggcuuccucuccuaccucggccccuucaaccagaucuuccgcaacuaccuccucaaggaccagugggagauggagcuccgcgcccgcaagauccccuucaccgagaaccucaaccucaucuccaugcucgucgacccccccaccaucggcgaguggggccuccagggccuccccggcgacgaccucuccauccagaacggcaucaucgucaccaaggccacccgcuacccccuccucaucgacccccagacccagggcaagaccuggaucaaguccaaggagaaggagaacgaccuccaggucaccucccucaaccacaaguacuuccgcacccaccucgaggacucccucucccucggccgcccccuccucaucgaggacauccacgaggagcucgaccccgcccucgacaacguccucgagaagaacuucaucaaguccggcaccaccuucaaggucaaggucggcgacaaggagugcgacaucauggacaccuucaagcucuacaucaccaccaagcuccccaaccccgccuucacccccgagaucaacgccaagaccuccgucaucgacuucaccgucaccaugaagggccucgagaaccagcuccuccgccgcgucauccucaccgagaagcaggagcucgaggccgagcgcgucaagcuccucgaggacgucaccuucaacaagcgcaagaugaaggagcucgaggacaaccuccucuacaagcucuccgccaccaagggcucccucgucgacgacgagucccucaucggcguccuccgcaccaccaagcagaccgccgccgaggucuccgagaagcuccacgucgccgccgagaccgagaucaagaucaacgccgcccaggaggaguuccgccccgccgccacccgcggcuccauccucuacuuccucaucaccgagauguccauggucaacaucauguaccagaccucccucgcccaguuccucaagcucuucgaccaguccauggcccgcuccgagaaguccccccucccccagaagcgcaucaccaacaucaucgaguaccucaccuacgaggucuucaccuacuccguccgcggccucuacgagaaccacaaguuccucuucguccuccucaugacccucaagaucgaccuccagcgcggcaccgucaagcaccgcgaguuccaggcccucaucaagggcggcgccgcccucgaccucaaggccugcccccccaagcccuaccgcuggauccucgacaugaccuggcucaaccucgucgagcucuccaagcucccccaguucgccgagaucaugaaccagaucucccgcaacgagaagggcuggaaguccugguucgacaaggacgcccccgaggaggagaucauccccgacggcuacaacgacucccucgacaccugccacaagcuccuccucauccgcuccuggugccccgaccgcaccgucuuccaggcccgcaaguacaucgccgacucccucgaggagaaguacaccgagcccgucauccucaaccucgagaagaccugggaggaguccgacacccgcaccccccucaucugcuuccucuccaugggcuccgaccccaccaaccagaucgacgcccucgccaagaagcucaagcucgagugccgcaccaucuccaugggccagggccaggagguccacgcccgcaagcucauccagauguccaugcagcagggcggcuggguccuccuccagaacugccaccucggccucgaguucauggaggagcuccucgagacccucaucaccaccgaggccuccgacgacuccuuccgcgucuggaucaccaccgagccccacgaccgcuuccccaucacccuccuccagaccucccucaaguucaccaacgagcccccccagggcguccgcgccggccucaagcgcaccuucgccggcaucaaccaggaccuccucgacaucuccaaccuccccauguggaagcccaugcucuacaccgucgccuuccuccacuccaccguccaggagcgccgcaaguucggcccccucggcuggaacauccccuacgaguucaacuccgccgacuucuccgccuccguccaguucauccagaaccaccucgacgagugcgacaucaagaagggcgucuccuggaacaccguccgcuacaugaucggcgagguccaguacggcggccgcgucaccgacgacuucgacaagcgccuccucaacugcuucgcccgcgucugguucuccgagaagauguucgagcccuccuucugcuucuacaccggcuacaagaucccccucugcaagacccucgaccaguacuucgaguacauccagucccuccccucccucgacaaccccgaggucuucggccuccaccccaacgccgacaucaccuaccaguccaacaccgccuccgccguccucgagaccaucaccaacauccagcccaaggaguccggcggcggcgucggcgagacccgcgaggccaucgucuaccgccucuccgaggacaugcucuccaagcucccccccgacuacaucccccacgaggucaagucccgccucaucaagaugggccaccucaacuccaugaacaucuuccuccgccaggagaucgaccgcaugcagcgcgucaucuccauccuccgcuccucccucuccgaccucaagcucgccaucgagggcaccaucaucauguccgagaaccuccgcgacgcccucgacaacauguacgacgcccgcaucccccagcucuggaagcgcgucuccugggacuccuccacccucggcuucugguucaccgagcuccucgagcgcaacgcccaguucuccaccuggaucuucgagggccgccccaacgucuucuggaugaccggcuucuucaacccccagggcuuccucaccgccaugcgccaggaggucacccgcgcccacaagggcugggcccucgacaccgucaccauccacaacgagguccuccgccagaccaaggaggagaucaccuccccccccggcgagggcgucuacaucuacggccucuacauggacggcgccgccugggaccgccgcaacggcaagcucauggaguccacccccaagguccucuucacccagcuccccguccuccacaucuucgccaucaacuccaccgcccccaaggaccccaagcucuacgucugccccaucuacaagaagccccgccgcaccgaccucaccuucaucaccgucgucuaccuccgcaccguccucucccccgaccacuggauccuccgcggcgucgcccuccucugcgacaucaaguga

SEQ ID NO: 42319 - RNA, 13461 nt, Artificial Sequence
  derived and/or modified sequence opt2 from DNAH9__Homo_sapiens__NP_001363
augcgccucgccgaggagcgcgccgcccucgccgccgagaacgccgacggcgagcccggcgccgaccgccgccuccgccuccucggcaccuacgucgccaugucccuccgccccgccgccggcgccugggagcgcugcgccggcuccgccgaggccgagcagcuccuccaggccuuccucggccgcgacgccgccgagggcccccgcccccuccucgucguccgccccggcccccgcggccucgccauccgccccggccucgaggucggccccgaguccggccucgccggcgccaaggcccucuucuuccuccgcaccggccccgagccccccggccccgacuccuuccgcggcgccgucgucugcggcgaccuccccgccgccccccucgagcaccucgccgcccucuucuccgaggucguccuccccguccucgccaacgagaagaaccgccucaacuggccccacaugaucugcgaggacguccgccgccacgcccacucccuccagugcgaccucuccgucauccucgagcaggucaagggcaagacccuccucccccuccccgccggcuccgagaagauggaguucgccgacuccaaguccgagaccguccucgacuccaucgacaaguccgucaucuacgccaucgaguccgccgucaucaagugguccuaccagguccaggucguccucaagcgcgaguccucccagccccuccuccagggcgagaaccccacccccaaggucgagcucgaguucuggaagucccgcuacgaggaccucaaguacaucuacaaccagcuccgcaccaucaccguccgcggcauggccaagcuccucgacaagcuccaguccuccuacuuccccgccuucaaggccauguaccgcgacgucgucgccgcccucgccgaggcccaggacauccacguccaccucaucccccuccagcgccaccucgaggcccucgagaacgccgaguuccccgaggucaagccccagcuccgcccccuccuccacgucgucugccucaucugggccaccugcaaguccuaccgcucccccggccgccucaccguccuccuccaggagaucugcaaccuccucauccagcaggccuccaacuaccucucccccgaggaccuccuccgcuccgaggucgaggagucccagcgcaagcuccaggucgucuccgacacccucuccuucuucaagcaggaguuccaggaccgccgcgagaaccuccacaccuacuucaaggagaaccaggaggucaaggagugggacuuccaguccucccucgucuucguccgccucgacggcuuccucggccagcuccacgucgucgagggccuccucaagaccgcccucgacuuccacaagcucggcaaggucgaguucuccggcguccgcggcaacgcccucucccagcagguccagcagaugcacgaggaguuccaggagauguaccgccuccucuccggcuccuccuccgacugccucuaccuccaguccaccgacuucgagaacgacgucuccgaguucaaccagaaggucgaggaccucgaccgccgccucggcaccaucuucauccaggccuucgacgacgcccccggccucgagcacgccuucaagcuccucgacaucgccggcaaccuccucgagcgcccccucgucgcccgcgacaccuccgacaaguaccucguccucauccagauguucaacaaggaccucgacgccguccgcaugaucuacucccagcacguccaggaggaggccgagcucggcuucucccccguccacaagaacaugcccaccgucgccggcggccuccgcugggcccaggagcuccgccagcgcauccagggccccuucuccaacuucggccgcaucacccaccccugcauggaguccgccgagggcaagcgcaugcagcagaaguacgaggacaugcucucccuccucgagaaguacgagacccgccucuacgaggacuggugccgcaccgucuccgagaagucccaguacaaccucucccagccccuccucaagcgcgaccccgagaccaaggagaucaccaucaacuucaacccccagcucaucuccguccucaaggagauguccuaccucgagccccgcgagaugaagcacaugcccgagaccgccgccgccauguucuccucccgcgacuucuaccgccagcucgucgccaaccucgagcucauggccaacugguacaacaaggucaugaagacccuccucgaggucgaguucccccucgucgaggaggagcuccagaacaucgaccuccgccuccgcgccgccgaggagacccucaacuggaagaccgagggcaucugcgacuacgucaccgagaucaccuccuccauccacgaccucgagcagcgcauccagaagaccaaggacaacgucgaggagauccagaacaucaugaagaccugggucacccccaucuucaagaccaaggacggcaagcgcgagucccuccucucccucgacgaccgccacgaccgcauggagaaguacuacaaccucaucaaggaguccggccucaagauccacgcccucguccaggagaaccucggccucuucuccgccgaccccaccuccaacaucuggaagaccuacgucaacuccaucgacaaccuccuccucaacggcuucuuccucgccaucgagugcucccucaaguaccuccucgagaacaccgagugcaaggccggccucacccccaucuucgaggcccagcucucccucgccauccccgagcucgucuucuaccccucccucgaguccggcgucaagggcggcuucugcgacaucgucgagggccucaucaccuccaucuuccgcauccccucccucgucccccgccucuccccccagaacggcuccccccacuaccaggucgaccucgacggcauccccgaccucgccaacaugcgccgcacccucauggagcgcguccagcgcaugaugggccucugcugcggcuaccaguccaccuucucccaguacuccuaccucuacgucgaggaccgcaaggagguccucggccaguuccuccucuacggccacauccucacccccgaggagaucgaggaccacgucgaggacggcauccccgagaaccccccccuccucucccaguucaagguccagaucgacuccuacgagacccucuacgaggaggucugccgccucgagcccaucaaggucuucgacggcuggaugaagaucgacauccgccccuucaaggccucccuccucaacaucaucaagcgcuggucccuccucuucaagcagcaccucgucgaccacgucacccacucccucgccaaccucgacgccuucaucaagaaguccgaguccggccuccucaagaaggucgagaagggcgacuuccagggccucgucgagaucaugggccaccucauggccgucaaggagcgccaguccaacaccgacgagauguucgagccccucaagcagaccaucgagcuccucaagaccuacgagcaggagcuccccgagaccgucuucaagcagcucgaggagcuccccgagaaguggaacaacaucaagaaggucgccaucaccgucaagcagcaggucgccccccuccaggccaacgaggucacccuccuccgccagcgcugcaccgccuucgacgccgagcagcagcaguucugggagcaguuccacaaggaggcccccuuccgcuucgacuccauccacccccaccagaugcucgacgcccgccacaucgagauccagcagauggaguccaccauggccuccaucuccgaguccgccucccucuucgaggucaacguccccgacuacaagcagcuccgccagugccgcaaggaggucugccagcucaaggagcucugggacaccaucggcauggucaccuccuccauccacgccugggagaccacccccuggcgcaacaucaacgucgaggccauggagcucgagugcaagcaguucgcccgccacauccgcaaccucgacaaggagguccgcgccugggacgccuucaccggccucgaguccaccgucuggaacacccucuccucccuccgcgccgucgccgagcuccagaaccccgccauccgcgagcgccacuggcgccagcucaugcaggccaccggcgucuccuucaccauggaccaggacaccacccucgcccaccuccuccagcuccagcuccaccacuacgaggacgagguccgcggcaucgucgacaaggccgccaaggagaugggcauggagaagacccucaaggagcuccagaccaccugggccggcauggaguuccaguacgagccccacccccgcaccaacgucccccuccucugcuccgacgaggaccucaucgagguccucgaggacaaccagguccagcuccagaaccucgucauguccaaguacgucgccuucuuccucgaggaggucuccggcuggcagaagaagcucuccaccgucgacgccgucaucuccaucugguucgagguccagcgcaccuggacccaccucgaguccaucuucaccggcuccgaggacauccgcgcccagcucccccaggacuccaagcgcuucgagggcaucgacaucgacuucaaggagcucgccuacgacgcccagaagauccccaacgucguccagaccaccaacaagcccggccucuacgagaagcucgaggacauccagggccgccucugccucugcgagaaggcccucgccgaguaccucgacaccaagcgccucgccuucccccgcuucuacuuccucuccuccuccgaccuccucgacauccucuccaacggcaccgccccccagcagguccagcgccaccucuccaagcucuucgacaacauggccaagaugcgcuuccagcucgacgccuccggcgagcccaccaagaccucccucggcauguacuccaaggaggaggaguacgucgccuucuccgagcccugcgacugcuccggccaggucgagaucuggcucaaccacguccucggccacaugaaggccaccguccgccacgagaugaccgagggcgucaccgccuacgaggagaagccccgcgagcaguggcucuucgaccaccccgcccaggucgcccucaccugcacccagaucugguggaccaccgaggucggcauggccuucgcccgccucgaggagggcuacgaguccgccaugaaggacuacuacaagaagcaggucgcccagcucaagacccucaucaccaugcucaucggccagcucuccaagggcgaccgccagaagaucaugaccaucugcaccaucgacguccacgcccgcgacgucgucgccaagaugaucgcccagaaggucgacaacgcccaggccuuccucuggcucucccagcuccgccaccgcugggacgacgaggucaagcacugcuucgccaacaucugcgacgcccaguuccucuacuccuacgaguaccucggcaacaccccccgccucgucaucaccccccucaccgaccgcugcuacaucacccucacccagucccuccaccucaccauguccggcgcccccgccggccccgccggcaccggcaagaccgagaccaccaaggaccucggccgcgcccucggcauccucgucuacgucuucaacugcuccgagcagauggacuacaaguccugcggcaacaucuacaagggccucgcccagaccggcgccuggggcugcuucgacgaguucaaccgcaucuccgucgagguccucuccgucgucgccguccaggucaaguccauccaggacgccauccgcgacaagaagcagugguucuccuuccucggcgaggagaucucccucaaccccuccgucggcaucuucaucaccaugaaccccggcuacgccggccgcaccgagcuccccgagaaccucaagucccucuuccgccccugcgccauggucguccccgacuucgagcucaucugcgagaucaugcucgucgccgagggcuucaucgaggcccagucccucgcccgcaaguucaucacccucuaccagcucugcaaggagcuccucuccaagcaggaccacuacgacuggggccuccgcgccaucaaguccguccucgucgucgccggcucccucaagcgcggcgaccccgaccgccccgaggaccagguccucaugcgcucccuccgcgacuucaacauccccaagaucgucaccgacgacaugcccaucuucaugggccucaucggcgaccucuuccccgcccucgacgucccccgccgccgcgaccccaacuucgaggcccucguccgcaaggccaucgucgaccucaagcuccaggccgaggacaacuucguccucaaggucguccagcucgaggagcuccucgccguccgccacuccgucuucgucgucggcggcgccggcaccggcaagucccagguccuccgcucccuccacaagaccuaccagaucaugaagcgccgccccgucuggaccgaccucaaccccaaggccgucaccaacgacgagcucuucggcaucaucaaccccgccaccggcgaguggaaggacggccucuucuccuccaucaugcgcgagcucgccaacaucacccacgacggccccaaguggauccuccucgacggcgacaucgaccccauguggaucgagucccucaacaccgucauggacgacaacaagguccucacccucgccuccaacgagcgcaucccccucaaccccaccaugaagcuccucuucgagaucucccaccuccgcaccgccacccccgccaccgucucccgcgccggcauccucuacaucaaccccgccgaccucggcuggaacccccccgucuccuccuggaucgagaagcgcgagauccagaccgagcgcgccaaccucaccauccucuucgacaaguaccuccccaccugccucgacacccuccgcacccgcuucaagaagaucauccccauccccgagcaguccaugguccagauggucugccaccuccucgagugccuccucaccaccgaggacauccccgccgacugccccaaggagaucuacgagcacuacuucgucuucgccgccaucugggccuucggcggcgccaugguccaggaccagcucgucgacuaccgcgccgaguucuccaagugguggcucaccgaguucaagaccgucaaguuccccucccagggcaccaucuucgacuacuacaucgaccccgagaccaagaaguucgagcccugguccaagcucgucccccaguucgaguucgaccccgagaugccccuccaggccugccucguccacaccuccgagaccauccgcgucugcuacuucauggagcgccucauggcccgccagcgccccgucaugcucgucggcaccgccggcaccggcaaguccguccucgucggcgccaagcucgccucccucgaccccgaggccuaccucgucaagaacguccccuucaacuacuacaccaccuccgccaugcuccaggccguccucgagaagccccucgagaagaaggccggccgcaacuacggcccccccggcaacaagaagcucaucuacuucaucgacgacaugaacaugcccgaggucgacgccuacggcaccguccagccccacaccaucauccgccagcaccucgacuacggccacugguacgaccgcuccaagcucucccucaaggagaucaccaacguccaguacgucuccugcaugaaccccaccgccggcuccuucaccaucaacccccgccuccagcgccacuucuccgucuucguccucuccuuccccggcgccgacgcccucuccuccaucuacuccaucauccucacccagcaccucaagcucggcaacuuccccgccucccuccagaaguccauccccccccucaucgaccucgcccucgccuuccaccagaagaucgccaccaccuuccuccccaccggcaucaaguuccacuacaucuucaaccuccgcgacuucgccaacaucuuccagggcauccucuucuccuccgucgagugcgucaaguccaccugggaccucauccgccucuaccuccacgaguccaaccgcgucuaccgcgacaagauggucgaggagaaggacuucgaccucuucgacaagauccagaccgagguccucaagaagaccuucgacgacaucgaggaccccgucgagcagacccagucccccaaccucuacugccacuucgccaacggcaucggcgagcccaaguacaugcccguccaguccugggagcuccucacccagacccucgucgaggcccucgagaaccacaacgaggucaacaccgucauggaccucguccucuucgaggacgccaugcgccacgucugccacaucaaccgcauccucgaguccccccgcggcaacgcccuccucgucggcgucggcggcuccggcaagcagucccucacccgccucgccgccuucaucuccuccauggacgucuuccagaucacccuccgcaagggcuaccagauccaggacuucaagauggaccucgccucccucugccucaaggccggcgucaagaaccucaacaccgucuuccucaugaccgacgcccaggucgccgacgagcgcuuccucguccucaucaacgaccuccucgccuccggcgagauccccgaccucuacuccgacgacgaggucgagaacaucaucuccaacguccgcaacgaggucaagucccagggccucgucgacaaccgcgagaacugcuggaaguucuucaucgaccgcauccgccgccagcucaaggucacccucugcuucucccccgucggcaacaagcuccgcguccgcucccgcaaguuccccgccaucgucaacugcaccgccauccacugguuccacgaguggccccagcaggcccucgaguccgucucccuccgcuuccuccagaacaccgagggcaucgagcccaccgucaagcaguccaucuccaaguucauggccuucguccacaccuccgucaaccagaccucccaguccuaccucuccaacgagcagcgcuacaacuacaccacccccaaguccuuccucgaguucauccgccucuaccagucccuccuccaccgccaccgcaaggagcucaagugcaagaccgagcgccucgagaacggccuccucaagcuccacuccaccuccgcccaggucgacgaccucaaggccaagcucgccgcccaggaggucgagcucaagcagaagaacgaggacgccgacaagcucauccaggucgucggcgucgagaccgacaaggucucccgcgagaaggccauggccgacgaggaggagcagaaggucgccgucaucaugcucgaggucaagcagaagcagaaggacugcgaggaggaccucgccaaggccgagcccgcccucaccgccgcccaggccgcccucaacacccucaacaagaccaaccucaccgagcucaaguccuucggcucccccccccucgccgucuccaacgucuccgccgccgucaugguccucauggccccccgcggccgcguccccaaggaccgcuccuggaaggccgccaaggucaccauggccaaggucgacggcuuccucgacucccucaucaacuucaacaaggagaacauccacgagaacugccucaaggccauccgccccuaccuccaggaccccgaguucaaccccgaguucgucgccaccaaguccuacgccgccgccggccucugcuccugggucaucaacaucguccgcuucuacgaggucuucugcgacgucgagcccaagcgccaggcccucaacaaggccaccgccgaccucaccgccgcccaggagaagcucgccgccaucaaggccaagaucgcccaccucaacgagaaccucgccaagcucaccgcccgcuucgagaaggccaccgccgacaagcucaagugccagcaggaggccgaggucaccgccgucaccaucucccucgccaaccgccucgucggcggccucgccuccgagaacguccgcugggccgacgccguccagaacuucaagcagcaggagcgcacccucugcggcgacauccuccucaucaccgccuucaucuccuaccucggcuucuucaccaagaaguaccgccagucccuccucgaccgcaccuggcgccccuaccucucccagcucaagacccccauccccgucacccccgcccucgacccccuccgcaugcucauggacgacgccgacgucgccgccuggcagaacgagggccuccccgccgaccgcauguccgucgagaacgccaccauccucaucaacugcgagcgcuggccccucauggucgacccccagcuccagggcaucaaguggaucaagaacaaguacggcgaggaccuccgcgucacccagaucggccagaagggcuaccuccagaucaucgagcaggcccucgaggccggcgccgucguccucaucgagaaccucgaggaguccaucgaccccguccucggcccccuccucggccgcgaggucaucaagaagggccgcuucaucaagaucggcgacaaggagugcgaguacaaccccaaguuccgccucauccuccacaccaagcucgccaacccccacuaccagcccgagcuccaggcccaggccacccucaucaacuucaccgucacccgcgacggccucgaggaccagcuccucgccgccgucgucuccauggagcgccccgaccucgagcagcucaaguccgaccucaccaagcagcagaacggcuucaagaucacccucaagacccucgaggacucccuccucucccgccucuccuccgccuccggcaacuuccucggcgagaccguccucgucgagaaccucgagaucaccaagcagaccgccgccgaggucgagaagaagguccaggaggccaaggucaccgaggucaagaucaacgaggcccgcgagcacuaccgccccgccgccgcccgcgccucccuccucuacuucaucaugaacgaccucuccaagauccaccccauguaccaguucucccucaaggccuucuccaucgucuuccagaaggccgucgagcgcgccgcccccgacgagucccuccgcgagcgcgucgccaaccucaucgacuccaucaccuucuccgucuaccaguacaccauccgcggccucuucgagugcgacaagcucaccuaccucgcccagcucaccuuccagauccuccucaugaaccgcgaggucaacgccgucgagcucgacuuccuccuccgcucccccguccagaccggcaccgccucccccgucgaguuccucucccaccaggccuggggcgccgucaagguccucuccuccauggaggaguucuccaaccucgaccgcgacaucgagggcuccgccaaguccuggaagaaguucgucgaguccgagugccccgagaaggagaagcucccccaggaguggaagaacaagaccgcccuccagcgccucugcaugcuccgcgccaugcgccccgaccgcaugaccuacgcccuccgcgacuucgucgaggagaagcucggcuccaaguacgucgucggccgcgcccucgacuucgccaccuccuucgaggaguccggccccgccacccccauguucuucauccucucccccggcgucgacccccucaaggacgucgagucccagggccgcaagcucggcuacaccuucaacaaccagaacuuccacaacgucucccucggccagggccaggaggucgucgccgaggccgcccucgaccucgccgccaagaagggccacugggucauccuccagaacauccaccucgucgccaaguggcucuccacccucgagaagaagcucgaggagcacuccgagaacucccaccccgaguuccgcgucuucauguccgccgagcccgcccccucccccgagggccacaucaucccccagggcauccucgagaacuccaucaagaucaccaacgagccccccaccggcaugcacgccaaccuccacaaggcccucgacaacuucacccaggacacccucgagaugugcucccgcgagaccgaguucaaguccauccucuucgcccucugcuacuuccacgccgucgucgccgagcgccgcaaguucggcccccagggcuggaaccgcuccuaccccuucaacaccggcgaccucaccaucuccgucaacguccucuacaacuuccucgaggccaacgccaagguccccuacgacgaccuccgcuaccucuucggcgagaucauguacggcggccacaucaccgacgacugggaccgccgccucugccgcaccuaccucggcgaguucauccgccccgagaugcucgagggcgagcucucccucgcccccggcuucccccuccccggcaacauggacuacaacggcuaccaccaguacaucgacgccgagcucccccccgagucccccuaccucuacggccuccaccccaacgccgagaucggcuuccucacccagaccuccgagaagcucuuccgcaccguccucgagcuccagccccgcgacucccaggcccgcgacggcgccggcgccacccgcgaggagaaggucaaggcccuccucgaggagauccucgagcgcgucaccgacgaguucaacauccccgagcucauggccaaggucgaggagcgcacccccuacaucgucgucgccuuccaggagugcggccgcaugaacauccucacccgcgagauccagcgcucccuccgcgagcucgagcucggccucaagggcgagcucaccaugaccucccacauggagaaccuccagaacgcccucuacuucgacaugguccccgaguccugggcccgccgcgccuaccccuccaccgccggccucgccgccugguuccccgaccuccucaaccgcaucaaggagcucgaggccuggaccggcgacuucaccaugcccuccaccgucuggcucaccggcuucuucaacccccaguccuuccucaccgccaucaugcaguccaccgcccgcaagaacgaguggccccucgaccagauggcccuccagugcgacaugaccaagaagaaccgcgaggaguuccgcucccccccccgcgagggcgccuacauccacggccucuucauggagggcgccugcugggacacccaggccggcaucaucaccgaggccaagcucaaggaccucaccccccccaugcccgucauguucaucaaggccauccccgccgacaagcaggacugccgcuccgucuacuccugccccgucuacaagaccucccagcgcggccccaccuacgucuggaccuucaaccucaagaccaaggagaaccccuccaaguggguccucgccggcgucgcccuccuccuccagaucuga

SEQ ID NO: 42320 - RNA, 2100 nt, Artificial Sequence
  derived and/or modified sequence opt2 from DNAI1__Homo_sapiens__NP_036276
augauccccgccuccgccaaggccccccacaagcagccccacaagcaguccaucuccaucggccgcggcacccgcaagcgcgacgaggacuccggcaccgaggucggcgagggcaccgacgagugggcccaguccaaggccaccguccgcccccccgaccagcucgagcucaccgacgccgagcucaaggaggaguucacccgcauccucaccgccaacaacccccacgccccccagaacaucguccgcuacuccuucaaggagggcaccuacaagcccaucggcuucgucaaccagcucgccguccacuacacccaggucggcaaccucauccccaaggacuccgacgagggccgccgccagcacuaccgcgacgagcucgucgccggcucccaggaguccgucaaggucaucuccgagaccggcaaccucgaggaggacgaggagcccaaggagcucgagaccgagcccggcucccagaccgacguccccgccgccggcgccgccgagaaggucaccgaggaggagcucaugacccccaagcagcccaaggagcgcaagcucaccaaccaguucaacuucuccgagcgcgccucccagaccuacaacaaccccguccgcgaccgcgagugccagaccgagccccccccccgcaccaacuucuccgccaccgccaaccagugggagaucuacgacgccuacgucgaggagcucgagaagcaggagaagaccaaggagaaggagaaggccaagacccccgucgccaagaaguccggcaagauggccaugcgcaagcucaccuccauggagucccagaccgacgaccucaucaagcucucccaggccgccaagaucauggagcgcauggucaaccagaacaccuacgacgacaucgcccaggacuucaaguacuacgacgacgccgccgacgaguaccgcgaccaggucggcacccuccucccccucuggaaguuccagaacgacaaggccaagcgccucuccgucaccgcccucugcuggaaccccaaguaccgcgaccucuucgccgucggcuacggcuccuacgacuucaugaagcagucccgcggcaugcuccuccucuacucccucaagaaccccuccuuccccgaguacauguucuccuccaacuccggcgucaugugccucgacauccacgucgaccaccccuaccucgucgccgucggccacuacgacggcaacgucgccaucuacaaccucaagaagccccacucccagcccuccuucugcuccuccgccaaguccggcaagcacuccgaccccgucuggcaggucaaguggcagaaggacgacauggaccagaaccucaacuucuucuccgucuccuccgacggccgcaucgucuccuggacccucgucaagcgcaagcucguccacaucgacgucaucaagcucaaggucgagggcuccaccaccgagguccccgagggccuccagcuccaccccgucggcugcggcaccgccuucgacuuccacaaggagaucgacuacauguuccucgucggcaccgaggagggcaagaucuacaagugcuccaaguccuacuccucccaguuccucgacaccuacgacgcccacaacauguccgucgacaccgucuccuggaaccccuaccacaccaaggucuucauguccugcuccuccgacuggaccgucaagaucugggaccacaccaucaagacccccauguucaucuacgaccucaacuccgccgucggcgacgucgccugggcccccuacuccuccaccgucuucgccgccgucaccaccgacggcaaggcccacaucuucgaccucgccaucaacaaguacgaggccaucugcaaccagcccgucgccgccaagaagaaccgccucacccacguccaguucaaccucauccaccccaucaucaucgucggcgacgaccgcggccacaucaucucccucaagcucucccccaaccuccgcaagaugcccaaggagaagaagggccaggagguccagaagggccccgccgucgagaucgccaagcucgacaagcuccucaaccucguccgcgaggucaagaucaagaccuga

SEQ ID NO: 42321 - RNA, 1782 nt, Artificial Sequence
  derived and/or modified sequence opt2 from DNAI2__Homo_sapiens__NP_001166281
auggagaucgucuacgucuacgucaagaagcgcuccgaguucggcaagcagugcaacuucuccgaccgccaggccgagcucaacaucgacaucaugcccaaccccgagcucgccgagcaguucgucgagcgcaaccccgucgacaccggcauccagugcuccaucuccauguccgagcacgaggccaacuccgagcgcuucgagauggagacccgcggcgucaaccacgucgagggcggcuggcccaaggacgucaacccccucgagcucgagcagaccauccgcuuccgcaagaaggucgagaaggacgagaacuacgucaacgccaucaugcagcucggcuccaucauggagcacugcaucaagcagaacaacgccaucgacaucuacgaggaguacuucaacgacgaggaggccauggaggucauggaggaggaccccuccgccaagaccaucaacgucuuccgcgacccccaggagaucaagcgcgccgccacccaccucuccuggcaccccgacggcaaccgcaagcucgccgucgccuacuccugccucgacuuccagcgcgcccccgucggcauguccuccgacuccuacaucugggaccucgagaaccccaacaagcccgagcucgcccucaagcccuccuccccccucgucacccucgaguucaaccccaaggacucccacguccuccucggcggcugcuacaacggccagaucgccugcugggacacccgcaagggcucccucgucgccgagcucuccaccaucgaguccucccaccgcgaccccgucuacggcaccaucuggcuccaguccaagaccggcaccgagugcuucuccgccuccaccgacggccaggucauguggugggacauccgcaagauguccgagcccaccgaggucgucauccucgacaucaccaagaaggagcagcucgagaacgcccucggcgccaucucccucgaguucgaguccacccuccccaccaaguucauggucggcaccgagcagggcaucgucaucuccugcaaccgcaaggccaagaccuccgccgagaagaucgucugcaccuuccccggccaccacggccccaucuacgcccuccagcgcaaccccuucuaccccaagaacuuccucaccgucggcgacuggaccgcccgcaucugguccgaggacucccgcgaguccuccaucauguggaccaaguaccacauggccuaccucaccgacgccgccuggucccccguccgccccaccgucuucuucaccacccgcauggacggcacccucgacaucugggacuucauguucgagcagugcgaccccacccucucccucaaggacaacggcugccucaucgccugcggcucccagcucggcaccaccacccuccucgaggucucccccggccucuccacccuccagcgcaacgagaagaacgucgccuccuccauguucgagcgcgagacccgccgcgagaagauccucgaggcccgccaccgcgagaugcgccucaaggagaagggcaaggccgagggccgcgacgaggagcagaccgacgaggagcucgccgucgaccucgaggcccucgucuccaaggccgaggaggaguucuucgacaucaucuucgccgagcucaagaagaaggaggccgacgccaucaagcucacccccgucccccagcagcccucccccgaggaggaccaggucgucgaggagggcgaggaggccgccggcgaggagggcgacgaggaggucgaggaggaccucgccuga

SEQ ID NO: 42322 - RNA, 1194 nt, Artificial Sequence
  derived and/or modified sequence opt2 from DNAJA1__Homo_sapiens__NP_001530
auggucaaggagaccaccuacuacgacguccucggcgucaagcccaacgccacccaggaggagcucaagaaggccuaccgcaagcucgcccucaaguaccaccccgacaagaaccccaacgagggcgagaaguucaagcagaucucccaggccuacgagguccucuccgacgccaagaagcgcgagcucuacgacaagggcggcgagcaggccaucaaggagggcggcgccggcggcggcuucggcucccccauggacaucuucgacauguucuucggcggcggcggccgcaugcagcgcgagcgccgcggcaagaacgucguccaccagcucuccgucacccucgaggaccucuacaacggcgccacccgcaagcucgcccuccagaagaacgucaucugcgacaagugcgagggccgcggcggcaagaagggcgccgucgagugcugccccaacugccgcggcaccggcaugcagauccgcauccaccagaucggccccggcaugguccagcagauccaguccgucugcauggagugccagggccacggcgagcgcaucucccccaaggaccgcugcaaguccugcaacggccgcaagaucguccgcgagaagaagauccucgagguccacaucgacaagggcaugaaggacggccagaagaucaccuuccacggcgagggcgaccaggagcccggccucgagcccggcgacaucaucaucguccucgaccagaaggaccacgccgucuucacccgccgcggcgaggaccucuucaugugcauggacauccagcucgucgaggcccucugcggcuuccagaagcccaucuccacccucgacaaccgcaccaucgucaucaccucccaccccggccagaucgucaagcacggcgacaucaagugcguccucaacgagggcaugcccaucuaccgccgccccuacgagaagggccgccucaucaucgaguucaaggucaacuuccccgagaacggcuuccucucccccgacaagcucucccuccucgagaagcuccuccccgagcgcaaggaggucgaggagaccgacgagauggaccaggucgagcucgucgacuucgaccccaaccaggagcgccgccgccacuacaacggcgaggccuacgaggacgacgagcaccacccccgcggcggcguccagugccagaccuccuga

SEQ ID NO: 42323 - RNA, 1239 nt, Artificial Sequence
  derived and/or modified sequence opt2 from DNAJA2__Homo_sapiens__NP_005871
auggccaacgucgccgacaccaagcucuacgacauccucggcgucccccccggcgccuccgagaacgagcucaagaaggccuaccgcaagcucgccaaggaguaccaccccgacaagaaccccaacgccggcgacaaguucaaggagaucuccuucgccuacgagguccucuccaaccccgagaagcgcgagcucuacgaccgcuacggcgagcagggccuccgcgagggcuccggcggcggcggcggcauggacgacaucuucucccacaucuucggcggcggccucuucggcuucaugggcaaccagucccgcucccgcaacggccgccgccgcggcgaggacaugaugcacccccucaaggucucccucgaggaccucuacaacggcaagaccaccaagcuccagcucuccaagaacguccucugcuccgccugcuccggccagggcggcaaguccggcgccguccagaagugcuccgccugccgcggccgcggcguccgcaucaugauccgccagcucgcccccggcaugguccagcagaugcaguccgucugcuccgacugcaacggcgagggcgaggucaucaacgagaaggaccgcugcaagaagugcgagggcaagaaggucaucaaggaggucaagauccucgagguccacgucgacaagggcaugaagcacggccagcgcaucaccuucaccggcgaggccgaccaggcccccggcgucgagcccggcgacaucguccuccuccuccaggagaaggagcacgaggucuuccagcgcgacggcaacgaccuccacaugaccuacaagaucggccucgucgaggcccucugcggcuuccaguucaccuucaagcaccucgacggccgccagaucgucgucaaguacccccccggcaaggucaucgagcccggcugcguccgcgucguccgcggcgagggcaugccccaguaccgcaaccccuucgagaagggcgaccucuacaucaaguucgacguccaguuccccgagaacaacuggaucaaccccgacaagcucuccgagcucgaggaccuccuccccucccgccccgagguccccaacaucaucggcgagaccgaggaggucgagcuccaggaguucgacuccacccgcggcuccggcggcggccagcgccgcgaggccuacaacgacuccuccgacgaggaguccuccucccaccacggccccggcguccagugcgcccaccaguga

SEQ ID NO: 42324 - RNA, 1362 nt, Artificial Sequence
  derived and/or modified sequence opt2 from DNAJA3__Homo_sapiens__NP_001128582
auggccgcccgcugcuccacccgcuggcuccucgucgucgucggcaccccccgccuccccgccaucuccggccgcggcgcccgccccccccgcgagggcgucgucggcgccuggcucucccgcaagcucuccguccccgccuucgccuccucccucaccuccugcggcccccgcgcccuccucacccuccgccccggcgucucccucaccggcaccaagcacaaccccuucaucugcaccgccuccuuccacaccuccgccccccucgccaaggaggacuacuaccagauccucggcgucccccgcaacgccucccagaaggagaucaagaaggccuacuaccagcucgccaagaaguaccaccccgacaccaacaaggacgaccccaaggccaaggagaaguucucccagcucgccgaggccuacgagguccucuccgacgaggucaagcgcaagcaguacgacgccuacggcuccgccggcuucgaccccggcgccuccggcucccagcacuccuacuggaagggcggccccaccgucgaccccgaggagcucuuccgcaagaucuucggcgaguucuccuccuccuccuucggcgacuuccagaccgucuucgaccagccccaggaguacuucauggagcucaccuucaaccaggccgccaagggcgucaacaaggaguucaccgucaacaucauggacaccugcgagcgcugcaacggcaagggcaacgagcccggcaccaagguccagcacugccacuacugcggcggcuccggcauggagaccaucaacaccggccccuucgucaugcgcuccaccugccgccgcugcggcggccgcggcuccaucaucaucucccccugcgucgucugccgcggcgccggccaggccaagcagaagaagcgcgucaugauccccguccccgccggcgucgaggacggccagaccguccgcaugcccgucggcaagcgcgagaucuucaucaccuuccgcguccagaagucccccgucuuccgccgcgacggcgccgacauccacuccgaccucuucaucuccaucgcccaggcccuccucggcggcaccgcccgcgcccagggccucuacgagaccaucaacgucaccaucccccccggcacccagaccgaccagaagauccgcaugggcggcaagggcaucccccgcaucaacuccuacggcuacggcgaccacuacauccacaucaagauccgcguccccaagcgccucaccucccgccagcagucccucauccucuccuacgccgaggacgagaccgacgucgagggcaccgucaacggcgucacccucaccuccuccggcaagcgcuccaccggcaacuga

SEQ ID NO: 42325 - RNA, 1077 nt, Artificial Sequence
  derived and/or modified sequence opt2 from DNAJB11__Homo_sapiens__NP_057390
auggccccccagaaccucuccaccuucugccuccuccuccucuaccucaucggcgccgucaucgccggccgcgacuucuacaagauccucggcgucccccgcuccgccuccaucaaggacaucaagaaggccuaccgcaagcucgcccuccagcuccaccccgaccgcaaccccgacgacccccaggcccaggagaaguuccaggaccucggcgccgccuacgagguccucuccgacuccgagaagcgcaagcaguacgacaccuacggcgaggagggccucaaggacggccaccaguccucccacggcgacaucuucucccacuucuucggcgacuucggcuucauguucggcggcaccccccgccagcaggaccgcaacaucccccgcggcuccgacaucaucgucgaccucgaggucacccucgaggaggucuacgccggcaacuucgucgaggucguccgcaacaagcccgucgcccgccaggcccccggcaagcgcaagugcaacugccgccaggagaugcgcaccacccagcucggccccggccgcuuccagaugacccaggaggucgucugcgacgagugccccaacgucaagcucgucaacgaggagcgcacccucgaggucgagaucgagcccggcguccgcgacggcauggaguaccccuucaucggcgagggcgagccccacgucgacggcgagcccggcgaccuccgcuuccgcaucaaggucgucaagcaccccaucuucgagcgccgcggcgacgaccucuacaccaacgucaccaucucccucgucgagucccucgucggcuucgagauggacaucacccaccucgacggccacaagguccacaucucccgcgacaagaucacccgccccggcgccaagcucuggaagaagggcgagggccuccccaacuucgacaacaacaacaucaagggcucccucaucaucaccuucgacgucgacuuccccaaggagcagcucaccgaggaggcccgcgagggcaucaagcagcuccucaagcagggcuccguccagaaggucuacaacggccuccagggcuacuga

SEQ ID NO: 42326 - RNA, 951 nt, Artificial Sequence
  derived and/or modified sequence opt2 from DNAJB13__Homo_sapiens__NP_705842
augggccaggacuacuacuccguccucggcaucacccgcaacuccgaggacgcccagaucaagcaggccuaccgccgccucgcccucaagcaccacccccucaaguccaacgagcccuccuccgccgagaucuuccgccagaucgccgaggccuacgacguccucuccgaccccaugaagcgcggcaucuacgacaaguucggcgaggagggccucaagggcggcaucccccucgaguucggcucccagacccccuggaccaccggcuacgucuuccacggcaagcccgagaaggucuuccacgaguucuucggcggcaacaaccccuucuccgaguucuucgacgccgagggcuccgaggucgaccucaacuucggcggccuccagggccgcggcgucaagaagcaggacccccaggucgagcgcgaccucuaccucucccucgaggaccucuucuucggcugcaccaagaagaucaagaucucccgccgcguccucaacgaggacggcuacuccuccaccaucaaggacaagauccucaccaucgacgucaagcccggcuggcgccagggcacccgcaucaccuucgagaaggagggcgaccagggccccaacaucauccccgccgacaucaucuucaucgucaaggagaagcuccacccccgcuuccgccgcgagaacgacaaccucuucuucgucaaccccaucccccucggcaaggcccucaccugcugcaccgucgagguccgcacccucgacgaccgccuccucaacauccccaucaacgacaucauccaccccaaguacuucaagaagguccccggcgagggcaugccccuccccgaggaccccaccaagaagggcgaccucuucaucuucuucgacauccaguuccccacccgccucaccccccagaagaagcagaugcuccgccaggcccuccucaccuga

SEQ ID NO: 42327 - RNA, 723 nt, Artificial Sequence
  derived and/or modified sequence opt2 from DNAJB1__Homo_sapiens__NP_001287843
auguucgccgaguucuucggcggccgcaaccccuucgacaccuucuucggccagcgcaacggcgaggagggcauggacaucgacgaccccuucuccggcuuccccaugggcaugggcggcuucaccaacgucaacuucggccgcucccgcuccgcccaggagcccgcccgcaagaagcaggacccccccgucacccacgaccuccgcgucucccucgaggagaucuacuccggcugcaccaagaagaugaagaucucccacaagcgccucaaccccgacggcaaguccauccgcaacgaggacaagauccucaccaucgaggucaagaagggcuggaaggagggcaccaagaucaccuuccccaaggagggcgaccagaccuccaacaacauccccgccgacaucgucuucguccucaaggacaagccccacaacaucuucaagcgcgacggcuccgacgucaucuaccccgcccgcaucucccuccgcgaggcccucugcggcugcaccgucaacguccccacccucgacggccgcaccauccccgucgucuucaaggacgucauccgccccggcaugcgccgcaagguccccggcgagggccucccccuccccaagacccccgagaagcgcggcgaccucaucaucgaguucgaggucaucuuccccgagcgcaucccccagaccucccgcaccguccucgagcagguccuccccaucuga

SEQ ID NO: 42328 - RNA, 834 nt, Artificial Sequence
  derived and/or modified sequence opt2 from DNAJB2__Homo_sapiens__NP_001034639
auggccuccuacuacgagauccucgacgucccccgcuccgccuccgccgacgacaucaagaaggccuaccgccgcaaggcccuccaguggcaccccgacaagaaccccgacaacaaggaguucgccgagaagaaguucaaggaggucgccgaggccuacgagguccucuccgacaagcacaagcgcgagaucuacgaccgcuacggccgcgagggccucaccggcaccggcaccggccccucccgcgccgaggccggcuccggcggccccggcuucaccuucaccuuccgcucccccgaggaggucuuccgcgaguucuucggcuccggcgaccccuucgccgagcucuucgacgaccucggccccuucuccgagcuccagaaccgcggcucccgccacuccggccccuucuucaccuucuccuccuccuuccccggccacuccgacuucuccuccuccuccuucuccuucucccccggcgccggcgccuuccgcuccgucuccaccuccaccaccuucguccagggccgccgcaucaccacccgccgcaucauggagaacggccaggagcgcgucgaggucgaggaggacggccagcucaaguccgucaccaucaacggcguccccgacgaccucgcccucggccucgagcucucccgccgcgagcagcagcccuccgucaccucccgcuccggcggcacccagguccagcagacccccgccuccugcccccucgacuccgaccucuccgaggacgaggaccuccagcucgccauggccuacucccucuccgagauggaggccgccggcaagaagcccgccgacgucuucuga

SEQ ID NO: 42329 - RNA, 1389 nt, Artificial Sequence
  derived and/or modified sequence opt2 from DNAJB5__Homo_sapiens__NP_001128476
augggcggcgccgaggccgagcccuggggccgcgcccccggccccgccaucggcggccgccgcgccggcgacuccugccccggcuggcgccgccgcucccgcucccgcggccgcggccagcgccucucccacggcccccgccgccgcccccagcuccucaccgccgcccccccccuccaggcccgcggcgccuuccgcuccuucccccacuccuggggcgaggacuuccucgccucccucauguucaagauccagcucgagccccucaagcuccgcgccuggacccucaacggcuucgucaaguuccgcaacaaggagaccuccgccggccccgucgccgucaugggcaaggacuacuacaagauccucggcauccccuccggcgccaacgaggacgagaucaagaaggccuaccgcaagauggcccucaaguaccaccccgacaagaacaaggagcccaacgccgaggagaaguucaaggagaucgccgaggccuacgacguccucuccgaccccaagaagcgcggccucuacgaccaguacggcgaggagggccucaagaccggcggcggcaccuccggcggcuccuccggcuccuuccacuacaccuuccacggcgacccccacgccaccuucgccuccuucuucggcggcuccaaccccuucgacaucuucuucgccuccucccgcuccacccgccccuucuccggcuucgaccccgacgacauggacgucgacgaggacgaggaccccuucggcgccuucggccgcuucggcuucaacggccucucccgcggcccccgccgcgcccccgagccccucuacccccgccgcaagguccaggacccccccgucguccacgagcuccgcgucucccucgaggagaucuaccacggcuccaccaagcgcaugaagaucacccgccgccgccucaaccccgacggccgcaccguccgcaccgaggacaagauccuccacaucgucaucaagcgcggcuggaaggagggcaccaagaucaccuuccccaaggagggcgacgccacccccgacaacauccccgccgacaucgucuucguccucaaggacaagccccacgcccacuuccgccgcgacggcaccaacguccucuacuccgcccucaucucccucaaggaggcccucugcggcugcaccgucaacauccccaccaucgacggccgcgucaucccccuccccugcaacgacgucaucaagcccggcaccgucaagcgccuccgcggcgagggccuccccuuccccaagguccccacccagcgcggcgaccucaucgucgaguucaagguccgcuuccccgaccgccucaccccccagacccgccagauccucaagcagcaccuccccugcuccuga

SEQ ID NO: 42330 - RNA, 726 nt, Artificial Sequence
  derived and/or modified sequence opt2 from DNAJB6__Homo_sapiens__NP_005485
auggucgacuacuacgagguccucggcguccagcgccacgccucccccgaggacaucaagaaggccuaccgcaagcucgcccucaaguggcaccccgacaagaaccccgagaacaaggaggaggccgagcgcaaguucaagcaggucgccgaggccuacgagguccucuccgacgccaagaagcgcgacaucuacgacaaguacggcaaggagggccucaacggcggcggcggcggcggcucccacuucgacucccccuucgaguucggcuucaccuuccgcaaccccgacgacgucuuccgcgaguucuucggcggccgcgaccccuucuccuucgacuucuucgaggaccccuucgaggacuucuucggcaaccgccgcggcccccgcggcucccgcucccgcggcaccggcuccuucuucuccgccuucuccggcuuccccuccuucggcuccggcuucuccuccuucgacaccggcuucaccuccuucggcucccucggccacggcggccucaccuccuucuccuccaccuccuucggcggcuccggcaugggcaacuucaaguccaucuccaccuccaccaagauggucaacggccgcaagaucaccaccaagcgcaucgucgagaacggccaggagcgcgucgaggucgaggaggacggccagcucaagucccucaccaucaacggcaaggagcagcuccuccgccucgacaacaaguga

SEQ ID NO: 42331 - RNA, 930 nt, Artificial Sequence
  derived and/or modified sequence opt2 from DNAJB7__Homo_sapiens__NP_660157
auggucgacuacuacgagguccucggccuccagcgcuacgccucccccgaggacaucaagaaggccuaccacaaggucgcccucaaguggcaccccgacaagaaccccgagaacaaggaggaggccgagcgcaaguucaaggaggucgccgaggccuacgagguccucuccaacgacgagaagcgcgacaucuacgacaaguacggcaccgagggccucaacggcggcggcucccacuucgacgacgagugcgaguacggcuucaccuuccacaagcccgacgacgucuucaaggagaucuuccacgagcgcgaccccuucuccuuccacuucuucgaggacucccucgaggaccuccucaaccgccccggcuccuccuacggcaaccgcaaccgcgacgccggcuacuucuucuccaccgccuccgaguaccccaucuucgagaaguucuccuccuacgacaccggcuacaccucccagggcucccucggccacgagggccucaccuccuucuccucccucgccuucgacaacuccggcauggacaacuacaucuccgucaccaccuccgacaagaucgucaacggccgcaacaucaacaccaagaagaucaucgaguccgaccaggagcgcgaggccgaggacaacggcgagcucaccuucuuccucgucaacuccgucgccaacgaggagggcuucgccaaggagugcuccuggcgcacccaguccuucaacaacuacucccccaacucccacuccuccaagcacgucucccaguacaccuucgucgacaacgacgagggcggcaucuccugggucaccuccaaccgcgacccccccaucuucuccgccggcgucaaggagggcggcaagcgcaagaagaagaagcgcaaggagguccagaagaaguccaccaagcgcaacugcuga

SEQ ID NO: 42332 - RNA, 699 nt, Artificial Sequence
  derived and/or modified sequence opt2 from DNAJB8__Homo_sapiens__NP_699161
auggccaacuacuacgagguccucggcguccaggccuccgccucccccgaggacaucaagaaggccuaccgcaagcucgcccuccgcuggcaccccgacaagaaccccgacaacaaggaggaggccgagaagaaguucaagcucgucuccgaggccuacgagguccucuccgacuccaagaagcgcucccucuacgaccgcgccggcugcgacuccuggcgcgccggcggcggcgccuccacccccuaccacucccccuucgacaccggcuacaccuuccgcaaccccgaggacaucuuccgcgaguucuucggcggccucgaccccuucuccuucgaguucugggacucccccuucaacuccgaccgcggcggccgcggccacggccuccgcggcgccuucuccgccggcuucggcgaguuccccgccuucauggaggccuucuccuccuucaacaugcucggcugcuccggcggcucccacaccaccuucuccuccaccuccuucggcggcuccuccuccggcuccuccggcuucaaguccgucauguccuccaccgagaugaucaacggccacaaggucaccaccaagcgcaucgucgagaacggccaggagcgcgucgaggucgaggaggacggccagcucaaguccgucaccgucaacggcaaggagcagcucaaguggauggacuccaaguga

SEQ ID NO: 42333 - RNA, 672 nt, Artificial Sequence
  derived and/or modified sequence opt2 from DNAJB9__Homo_sapiens__NP_036460
auggccaccccccaguccaucuucaucuucgccaucugcauccucaugaucaccgagcucauccucgccuccaaguccuacuacgacauccucggcguccccaaguccgccuccgagcgccagaucaagaaggccuuccacaagcucgccaugaaguaccaccccgacaagaacaagucccccgacgccgaggccaaguuccgcgagaucgccgaggccuacgagacccucuccgacgccaaccgccgcaaggaguacgacacccucggccacuccgccuucaccuccggcaagggccagcgcggcuccggcuccuccuucgagcaguccuucaacuucaacuucgacgaccucuucaaggacuucggcuucuucggccagaaccagaacaccggcuccaagaagcgcuucgagaaccacuuccagacccgccaggacggcggcuccucccgccagcgccaccacuuccaggaguucuccuucggcggcggccucuucgacgacauguucgaggacauggagaagauguucuccuucuccggcuucgacuccaccaaccagcacaccguccagaccgagaaccgcuuccacggcuccuccaagcacugccgcaccgucacccagcgccgcggcaacauggucaccaccuacaccgacugcuccggccaguga

SEQ ID NO: 42334 - RNA, 2244 nt, Artificial Sequence
  derived and/or modified sequence opt2 from DNAJC10__Homo_sapiens__NP_001258510
augggcgucuggcucaacaaggacgacuacauccgcgaccucaagcgcaucauccucugcuuccucaucgucuacauggccauccucgucggcaccgaccaggacuucuacucccuccucggcgucuccaagaccgccuccucccgcgagauccgccaggccuucaagaagcucgcccucaagcuccaccccgacaagaaccccaacaaccccaacgcccacggcgacuuccucaagaucaaccgcgccuacgagguccucaaggacgaggaccuccgcaagaaguacgacaaguacggcgagaagggccucgaggacaaccagggcggccaguacgaguccuggaacuacuaccgcuacgacuucggcaucuacgacgacgaccccgagaucaucacccucgagcgccgcgaguucgacgccgccgucaacuccggcgagcucugguucgucaacuucuacucccccggcugcucccacugccacgaccucgcccccaccuggcgcgacuucgccaaggaggucgacggccuccuccgcaucggcgccgucaacugcggcgacgaccgcaugcucugccgcaugaagggcgucaacuccuaccccucccucuucaucuuccgcuccggcauggcccccgucaaguaccacggcgaccgcuccaaggagucccucgucuccuucgccaugcagcacguccgcuccaccgucaccgagcucuggaccggcaacuucgucaacuccauccagaccgccuucgccgccggcaucggcuggcucaucaccuucugcuccaagggcggcgacugccucaccucccagacccgccuccgccucuccggcaugcucuuccucaacucccucgacgccaaggagaucuaccucgaggucauccacaaccuccccgacuucgagcuccucuccgccaacacccucgaggaccgccucgcccaccaccgcuggcuccucuucuuccacuucggcaagaacgagaacuccaacgaccccgagcucaagaagcucaagacccuccucaagaacgaccacauccaggucggccgcuucgacugcuccuccgcccccgacaucugcuccaaccucuacgucuuccagcccucccucgccgucuucaagggccagggcaccaaggaguacgagauccaccacggcaagaagauccucuacgacauccucgccuucgccaaggaguccgucaacucccacgucaccacccucggcccccagaacuuccccgccaacgacaaggagcccuggcucgucgacuucuucgcccccuggugcccccccugccgcgcccuccuccccgagcuccgccgcgccuccaaccuccucuacggccagcucaaguucggcacccucgacugcaccguccacgagggccucugcaacauguacaacauccaggccuaccccaccaccgucgucuucaaccaguccaacauccacgaguacgagggccaccacuccgccgagcagauccucgaguucaucgaggaccucaugaaccccuccgucgucucccucacccccaccaccuucaacgagcucgucacccagcgcaagcacaacgaggucuggauggucgacuucuacucccccuggugccaccccugccagguccucaugcccgaguggaagcgcauggcccgcacccucaccggccucaucaacgucggcuccaucgacugccagcaguaccacuccuucugcgcccaggagaacguccagcgcuaccccgagauccgcuucuucccccccaaguccaacaaggccuaccacuaccacuccuacaacggcuggaaccgcgacgccuacucccuccgcaucuggggccucggcuuccucccccaggucuccaccgaccucaccccccagaccuucuccgagaagguccuccagggcaagaaccacugggucaucgacuucuacgcccccuggugcggccccugccagaacuucgcccccgaguucgagcuccucgcccgcaugaucaagggcaaggucaaggccggcaaggucgacugccaggccuacgcccagaccugccagaaggccggcauccgcgccuaccccaccgucaaguucuacuucuacgagcgcgccaagcgcaacuuccaggaggagcagaucaacacccgcgacgccaaggccaucgccgcccucaucuccgagaagcucgagacccuccgcaaccagggcaagcgcaacaaggacgagcucuga

SEQ ID NO: 42335 - RNA, 597 nt, Artificial Sequence
  derived and/or modified sequence opt2 from DNAJC12__Homo_sapiens__NP_068572
auggacgccauccucaacuaccgcuccgaggacaccgaggacuacuacacccuccucggcugcgacgagcucuccuccgucgagcagauccucgccgaguucaagguccgcgcccucgagugccaccccgacaagcaccccgagaaccccaaggccgucgagaccuuccagaagcuccagaaggccaaggagauccucaccaacgaggagucccgcgcccgcuacgaccacuggcgccgcucccagauguccaugcccuuccagcagugggaggcccucaacgacuccgucaagaccuccaugcacugggucguccgcggcaagaaggaccucaugcucgaggaguccgacaagacccacaccaccaagauggagaacgaggagugcaacgagcagcgcgagcgcaagaaggaggagcucgccuccaccgccgagaagaccgagcagaaggagcccaagccccucgagaaguccgucuccccccagaacuccgacuccuccggcuucgccgacgucaacggcuggcaccuccgcuuccgcugguccaaggacgcccccuccgagcuccuccgcaaguuccgcaacuacgagaucuga

SEQ ID NO: 42336 - RNA, 6732 nt, Artificial Sequence
  derived and/or modified sequence opt2 from DNAJC13__Homo_sapiens__NP_056083
augaacaucauccgcgagaacaaggaccucgccugcuucuacaccaccaagcacuccuggcgcggcaaguacaagcgcgucuucuccgucggcacccacgccaucaccaccuacaaccccaacacccucgaggucaccaaccaguggcccuacggcgacaucugcuccaucucccccgucggcaagggccagggcaccgaguucaaccucaccuuccgcaagggcuccggcaagaaguccgagacccucaaguucuccaccgagcaccgcaccgagcuccucaccgaggcccuccgcuuccgcaccgacuucuccgagggcaagaucaccggccgccgcuacaacugcuacaagcaccacugguccgacucccgcaagcccgucauccucgaggucacccccggcggcuucgaccagaucaaccccgccaccaaccgcguccucugcuccuacgacuaccgcaacaucgagggcuucgucgaccucuccgacuaccagggcggcuucugcauccucuacggcggcuucucccgccuccaccucuucgccuccgagcagcgcgaggagaucaucaaguccgccaucgaccacgccggcaacuacaucggcaucucccuccgcauccgcaaggagccccucgaguucgagcaguaccucaaccuccgcuucggcaaguacuccaccgacgaguccaucaccucccucgccgaguucgucguccagaagaucuccccccgccacuccgagcccgucaagcgcguccucgcccucaccgagaccugccucgucgagcgcgaccccgccaccuacaacaucgccacccucaagccccucggcgaggucuucgcccucgucugcgacuccgagaacccccagcucuucaccaucgaguucaucaagggccagguccgcaaguacuccuccaccgagcgcgacucccuccucgccucccuccucgacggcguccgcgccuccggcaaccgcgacgucugcgucaagaugacccccacccacaagggccagcgcuggggccuccucuccaugcccgucgacgaggaggucgagucccuccaccuccgcuuccucgccaccccccccaacggcaacuucgccgacgccgucuuccgcuucaacgccaacaucuccuacuccggcguccuccacgccgucacccaggacggccucuucuccgagaacaaggagaagcucaucaacaacgccaucaccgcccuccucucccaggagggcgacgucgucgccuccaacgccgagcucgagucccaguuccaggccguccgccgccucgucgccuccaaggccggcuuccucgccuucacccagcuccccaaguuccgcgagcgccucggcgucaaggucgucaaggcccucaagcgcuccaacaacggcaucauccacgccgccgucgacaugcucugcgcccucaugugccccaugcacgacgacuacgaccuccgccaggagcagcucaacaaggccucccuccucuccuccaagaaguuccucgagaaccuccucgagaaguucaacucccacgucgaccacggcaccggcgcccucgucaucuccucccuccucgacuuccucaccuucgcccucugcgcccccuacuccgagaccaccgagggccagcaguucgacaugcuccucgagauggucgccuccaacggccgcacccucuucaagcucuuccagcaccccuccauggccaucaucaagggcgccggccucgucaugaaggccaucaucgaggagggcgacaaggagaucgccaccaagaugcaggagcucgcccucuccgagggcgcccucccccgccaccuccacaccgccauguucaccaucuccuccgaccagcgcaugcucaccaaccgccagcucucccgccaccucgucggccucuggaccgccgacaacgccaccgccaccaaccuccucaagcgcauccucccccccggccuccucgccuaccucgaguccuccgaccucguccccgagaaggacgccgaccgcaugcacguccgcgacaacgucaagaucgccauggaccaguacggcaaguucaacaagguccccgaguggcagcgccucgccggcaaggccgccaaggaggucgagaaguucgccaaggagaaggucgaccucguccucaugcacuggcgcgaccgcaugggcaucgcccagaaggagaacaucaaccagaagcccgucguccuccgcaagcgccgccagcgcaucaagaucgaggccaacugggaccucuucuacuaccgcuucggccaggaccacgcccgcuccaaccucaucuggaacuucaagacccgcgaggagcucaaggacacccucgaguccgagaugcgcgccuucaacaucgaccgcgagcucggcuccgccaacgucaucuccuggaaccaccacgaguucgaggucaaguacgagugccucgccgaggagaucaagaucggcgacuacuaccuccgccuccuccucgaggaggacgagaacgaggaguccggcuccaucaagcgcuccuacgaguucuucaacgagcucuaccaccgcuuccuccucacccccaaggucaacaugaagugccucugccuccaggcccucgccaucgucuacggccgcugccacgaggagaucggccccuucaccgacacccgcuacaucaucggcaugcucgagcgcugcaccgacaagcucgagcgcgaccgccucauccucuuccucaacaagcucauccucaacaagaagaacgucaaggaccucauggacuccaacggcauccgcauccucgucgaccuccucacccucgcccaccuccacgucucccgcgccaccgucccccuccaguccaacgucaucgaggccgcccccgacaugaagcgcgaguccgagaaggagugguacuucggcaacgccgacaaggagcgcuccggccccuacggcuuccacgagaugcaggagcucuggaccaagggcaugcucaacgccaagacccgcugcugggcccagggcauggacggcuggcgcccccuccaguccaucccccagcucaaguggugccuccucgccuccggccaggccguccucaacgagaccgaccucgccacccucauccucaacaugcucaucaccaugugcggcuacuuccccucccgcgaccaggacaacgccaucauccgcccccuccccaaggucaagcgccuccucuccgacuccaccugccucccccacaucauccagcuccuccucaccuucgaccccauccucgucgagaaggucgccauccuccucuaccacaucaugcaggacaacccccagcucccccgccucuaccucuccggcgucuucuucuucaucaugauguacaccggcuccaacguccuccccgucgcccgcuuccucaaguacacccacaccaagcaggccuucaaguccgaggagaccaagggccaggacaucuuccagcgcuccauccucggccacauccuccccgaggccauggucugcuaccucgagaacuacgagcccgagaaguucuccgagaucuuccucggcgaguucgacacccccgaggccaucugguccuccgagaugcgccgccucaugaucgagaagaucgccgcccaccucgccgacuucaccccccgccuccaguccaacacccgcgcccucuaccaguacugccccauccccaucaucaacuacccccagcucgagaacgagcucuucugcaacaucuacuaccucaagcagcucugcgacacccuccgcuuccccgacuggcccaucaaggaccccgucaagcuccucaaggacacccucgacgccuggaagaaggaggucgagaagaagccccccaugauguccaucgacgacgccuacgagguccucaaccucccccagggccagggcccccacgacgaguccaagauccgcaaggccuacuuccgccucgcccagaaguaccaccccgacaagaaccccgagggccgcgacauguucgagaaggucaacaaggccuacgaguuccucugcaccaaguccgccaagaucgucgacggccccgaccccgagaacaucauccucauccucaagacccaguccauccucuucaaccgccacaaggaggaccuccagcccuacaaguacgccggcuaccccaugcucauccgcaccaucaccauggagaccuccgacgaccuccucuucuccaaggaguccccccuccuccccgccgccaccgagcucgccuuccacaccgucaacugcuccgcccucaacgccgaggagcuccgccgcgagaacggccucgagguccuccaggaggccuucucccgcugcgucgccguccucacccgcgccuccaagcccuccgacauguccguccaggucugcggcuacaucuccaagugcuacuccgucgccgcccaguucgaggagugccgcgagaagaucaccgagaugcccuccaucaucaaggaccucugccgcguccucuacuucggcaaguccaucccccgcgucgccgcccucggcgucgagugcgucuccuccuucgccgucgacuucuggcuccagacccaccucuuccaggccggcauccucugguaccuccucggcuuccucuucaacuacgacuacacccucgaggaguccggcauccagaaguccgaggagaccaaccagcaggaggucgccaacucccucgccaagcucuccguccacgcccucucccgccucggcggcuaccucgccgaggagcaggccacccccgagaaccccaccauccgcaagucccucgccggcaugcucacccccuacgucgcccgcaagcucgccgucgccuccgucaccgagauccucaagaugcucaacuccaacaccgagucccccuaccucaucuggaacaacuccacccgcgccgagcuccucgaguuccucgagucccagcaggagaacaugaucaagaagggcgacugcgacaagaccuacggcuccgaguucgucuacuccgaccacgccaaggagcucaucgucggcgagaucuucguccgcgucuacaacgagguccccaccuuccagcucgagguccccaaggccuucgccgccucccuccucgacuacaucggcucccaggcccaguaccuccacaccuucauggccaucacccacgccgccaaggucgaguccgagcagcacggcgaccgccucccccgcgucgagauggcccucgaggcccuccgcaacgucaucaaguacaaccccggcuccgaguccgagugcaucggccacuucaagcucaucuucucccuccuccgcguccacggcgccggccagguccagcagcucgcccucgaggucgucaacaucgucaccuccaaccaggacugcgucaacaacaucgccgaguccaugguccucuccucccuccucgcccuccuccacucccuccccuccucccgccagcucguccucgagacccucuacgcccucaccuccuccaccaagaucaucaaggaggccauggccaagggcgcccucaucuaccuccucgacauguucugcaacuccacccacccccagguccgcgcccagaccgccgagcucuucgccaagaugaccgccgacaagcucaucggccccaagguccgcaucacccucaugaaguuccuccccuccgucuucauggacgccaugcgcgacaaccccgaggccgccguccacaucuucgagggcacccacgagaaccccgagcucaucuggaacgacaacucccgcgacaaggucuccaccaccguccgcgagaugaugcucgagcacuucaagaaccagcaggacaaccccgaggccaacuggaagcuccccgaggacuucgccgucgucuucggcgaggccgagggcgagcucgccgucggcggcgucuuccuccgcaucuucaucgcccagcccgccuggguccuccgcaagccccgcgaguuccucaucgcccuccucgagaagcucaccgagcuccucgagaagaacaacccccacggcgagacccucgagacccucaccauggccaccgucugccucuucuccgcccagccccagcucgccgaccagguccccccccucggccaccuccccaaggucauccaggccaugaaccaccgcaacaacgccauccccaaguccgccauccgcgucauccacgcccucuccgagaacgagcucugcguccgcgccauggccucccucgagaccaucggcccccucaugaacggcaugaagaagcgcgccgacaccgucggccucgccugcgaggccaucaaccgcauguuccagaaggagcaguccgagcucgucgcccaggcccucaaggccgaccucguccccuaccuccucaagcuccucgagggcaucggccucgagaaccucgacucccccgccgccaccaaggcccagaucgucaaggcccucaaggccaugacccgcucccuccaguacggcgagcaggucaacgagauccucugccgcuccuccgucugguccgccuucaaggaccagaagcacgaccucuucaucuccgagucccagaccgccggcuaccucaccggccccggcgucgccggcuaccucaccgccggcaccuccaccuccgucauguccaaccuccccccccccgucgaccacgaggccggcgaccucggcuaccagaccuga

SEQ ID NO: 42337 - RNA, 2109 nt, Artificial Sequence
  derived and/or modified sequence opt2 from DNAJC14__Homo_sapiens__NP_115740
auggcccagaagcaccccggcgagcgcggccucuacggcgcccaccacuccggcggcgccucccuccgcacccucggccccuccgucgaccccgagauccccuccuucuccggccuccgcgacuccgccggcaccgcccccaacggcacccgcugccucaccgagcacuccggccccaagcacacccagcaccccaaccccgcccacuggcucgaccccucccacggcccccccggcggccccggccccccccgcgacgccgaggaccccgaccaguccgagaccuccuccgaggaggaguccggcgucgaccaggagcucuccaaggagaacgagaccggcaaccagaaggacggcaacuccuuccucuccauccccuccgccugcaacugccagggcacccccggcauccccgagggccccuacuccgagggcggcaacggcuccuccuccaacuucugccaccacugcaccucccccgcccucggcgaggacgagcucgaggaggaguacgacgacgaggagucccucaaguuccccuccgacuucucccgcgucuccuccggcaagaagccccccucccgccgccagcgccaccgcuuccccaccaaggaggacacccgcgagggcggccgccgcgacccccgcucccccggccgccaccgccucggccgcaagcgcucccaggccgacaagcgcaagggccucggccucuggggcgccgaggagcucugccagcucggccaggccggcuucugguggcucaucgagcuccucguccucgucggcgaguacgucgagaccugcggccaccucaucuacgccugccgccagcucaaguccuccgaccucgaccucuuccgcgucuggaugggcgucuggaccggccgccucggcggcugggcccaggucauguuccaguuccucucccagggcuucuacugcggcgucggccucuucacccgcuuccucaagcuccucggcgcccuccuccuccucgcccucgcccucuuccucggcuuccuccagcucggcuggcgcuuccucgucggccucggcgaccgccucggcuggcgcgacaaggccaccuggcucuucuccuggcucgacucccccgcccuccagcgcugccucacccuccuccgcgacucccgccccuggcagcgccucguccgcaucguccaguggggcuggcucgagcuccccugggucaagcagaacaucaaccgccagggcaacgcccccgucgccuccggccgcuacugccagcccgaggaggaggucgcccgccuccucaccauggccggcguccccgaggacgagcucaaccccuuccacguccucggcgucgaggccaccgccuccgacgucgagcucaagaaggccuaccgccagcucgccgucaugguccaccccgacaagaaccaccacccccgcgccgaggaggccuucaagguccuccgcgccgccugggacaucgucuccaacgccgagaagcgcaaggaguacgagaugaagcgcauggccgagaacgagcucucccgcuccgucaacgaguuccucuccaagcuccaggacgaccucaaggaggccaugaacaccaugaugugcucccgcugccagggcaagcaccgccgcuucgagauggaccgcgagcccaaguccgcccgcuacugcgccgagugcaaccgccuccaccccgccgaggagggcgacuucugggccgaguccuccaugcucggccucaagaucaccuacuucgcccucauggacggcaaggucuacgacaucaccgagugggccggcugccagcgcgucggcaucucccccgacacccaccgcguccccuaccacaucuccuucggcucccgcauccccggcacccgcggccgccagcgcgccacccccgacgccccccccgccgaccuccaggacuuccucucccgcaucuuccaggucccccccggccagaugcccaacggcaacuucuucgccgccccccagcccgcccccggcgccgccgccgccuccaagcccaacuccaccguccccaagggcgaggccaagcccaagcgccgcaagaagguccgccgccccuuccagcgcuga

SEQ ID NO: 42338 - RNA, 453 nt, Artificial Sequence
  derived and/or modified sequence opt2 from DNAJC15__Homo_sapiens__NP_037370
auggccgcccgcggcgucaucgcccccgucggcgagucccuccgcuacgccgaguaccuccagcccuccgccaagcgccccgacgccgacgucgaccagcagcgccucguccgcucccucaucgccgucggccucggcgucgccgcccucgccuucgccggccgcuacgccuuccgcaucuggaagccccucgagcaggucaucaccgagaccgccaagaagaucuccacccccuccuucuccuccuacuacaagggcggcuucgagcagaagaugucccgccgcgaggccggccucauccucggcgucucccccuccgccggcaaggccaagauccgcaccgcccaccgccgcgucaugauccucaaccaccccgacaagggcggcucccccuacgucgccgccaagaucaacgaggccaaggaccuccucgagaccaccaccaagcacuga

SEQ ID NO: 42339 - RNA, 1077 nt, Artificial Sequence
  derived and/or modified sequence opt2 from DNAJC18__Homo_sapiens__NP_689899
auggccgccacccucggcuccggcgagcgcuggaccgaggccuacaucgacgccguccgccgcaacaaguaccccgaggacaccccccccgagucccacgaccccugcggcugcugcaacugcaugaaggcccagaaggagaagaaguccgagaacgaguggacccagacccgccagggcgagggcaacuccaccuacuccgaggagcagcuccucggcguccagcgcaucaagaagugccgcaacuacuacgagauccucggcgucucccgcgacgccuccgacgaggagcucaagaaggccuaccgcaagcucgcccucaaguuccaccccgacaagaacugcgcccccggcgccaccgacgccuucaaggccaucggcaacgccuucgccguccucuccaaccccgacaagcgccuccgcuacgacgaguacggcgacgagcaggucaccuucaccgccccccgcgcccgccccuacaacuacuaccgcgacuucgaggccgacaucacccccgaggagcucuucaacgucuucuucggcggccacuuccccaccggcaacauccacauguucuccaacgucaccgacgacaccuacuacuaccgccgccgccaccgccacgagcgcacccagacccagaaggaggaggaggaggagaagccccagaccaccuacuccgccuucauccagcuccuccccguccucgucaucgucaucaucuccgucaucacccagcuccucgccaccaacccccccuacucccucuucuacaaguccacccucggcuacaccaucucccgcgagacccagaaccuccagguccccuacuucgucgacaagaacuucgacaaggccuaccgcggcgccucccuccacgaccucgagaagaccaucgagaaggacuacaucgacuacauccagaccuccugcuggaaggagaagcagcagaaguccgagcucaccaaccucgccggccucuaccgcgacgagcgccucaagcagaaggccgagucccucaagcucgagaacugcgagaagcucuccaagcucaucggccuccgccgcggcggcuga

SEQ ID NO: 42340 - RNA, 351 nt, Artificial Sequence
  derived and/or modified sequence opt2 from DNAJC19__Homo_sapiens__NP_660304
auggccuccaccgucgucgccgucggccucaccaucgccgccgccggcuucgccggccgcuacguccuccaggccaugaagcacauggagccccaggucaagcaggucuuccagucccuccccaaguccgccuucuccggcggcuacuaccgcggcggcuucgagcccaagaugaccaagcgcgaggccgcccucauccucggcgucucccccaccgccaacaagggcaagauccgcgacgcccaccgccgcaucaugcuccucaaccaccccgacaagggcggcucccccuacaucgccgccaagaucaacgaggccaaggaccuccucgagggccaggccaagaaguga

SEQ ID NO: 42341 - RNA, 1665 nt, Artificial Sequence
  derived and/or modified sequence opt2 from DNAJC1__Homo_sapiens__NP_071760
augaccgcccccugcucccagcccgcccagcuccccggccgccgccagcucggccucguccccuucccccccccccccccccgcaccccccuccucuggcuccuccuccuccuccucgccgccgucgcccccgcccgcggcugggaguccggcgaccucgagcucuucgaccucgucgaggagguccagcucaacuucuaccaguuccucggcguccagcaggacgccuccuccgccgacauccgcaaggccuaccgcaagcucucccucacccuccaccccgacaagaacaaggacgagaacgccgagacccaguuccgccagcucgucgccaucuacgagguccucaaggacgacgagcgccgccagcgcuacgacgacauccucaucaacggccuccccgacuggcgccagcccgucuucuacuaccgccgcguccgcaagauguccaacgccgagcucgcccuccuccucuucaucauccucaccgucggccacuacgccgucgucugguccaucuaccucgagaagcagcucgacgagcuccucucccgcaagaagcgcgagaagaagaagaagaccggcuccaaguccgucgacgucuccaagcucggcgccuccgagaagaacgagcgccuccucaugaagccccaguggcacgaccuccuccccugcaagcucggcaucugguucugccucacccucaaggcccucccccaccucauccaggacgccggccaguucuacgccaaguacaaggagacccgccucaaggagaaggaggacgcccucacccgcaccgagcucgagacccuccagaagcagaagaaggucaagaagcccaagcccgaguuccccgucuacaccccccucgagaccaccuacauccaguccuacgaccacggcaccuccaucgaggagaucgaggagcagauggacgacuggcucgagaaccgcaaccgcacccagaagaagcaggcccccgaguggaccgaggaggaccucucccagcucacccgcuccauggucaaguuccccggcggcacccccggccgcugggagaagaucgcccacgagcucggccgcuccgucaccgacgucaccaccaaggccaagcagcucaaggacuccgucaccugcucccccggcaugguccgccucuccgagcucaaguccaccguccagaacucccgccccaucaagaccgccaccacccuccccgacgacaugaucacccagcgcgaggacgccgagggcgucgccgccgaggaggagcaggagggcgacuccggcgagcaggagaccggcgccaccgacgcccgcccccgccgccgcaagcccgcccgccuccucgaggccaccgccaagcccgagcccgaggagaagucccgcgccaagcgccagaaggacuucgacaucgccgagcagaacgaguccuccgacgaggagucccuccgcaaggagcgcgcccgcuccgccgaggagcccuggacccagaaccagcagaagcuccucgagcucgcccuccagcaguacccccgcggcuccuccgaccgcugggacaagaucgcccgcugcguccccuccaaguccaaggaggacugcaucgcccgcuacaagcuccucgucgagcucguccagaagaagaagcaggccaaguccuga

SEQ ID NO: 42342 - RNA, 822 nt, Artificial Sequence
  derived and/or modified sequence opt2 from DNAJC27__Homo_sapiens__NP_057628
auggaggccaacaugcccaagcgcaaggagcccggccgcucccuccgcaucaaggucaucuccaugggcaacgccgaggucggcaaguccugcaucaucaagcgcuacugcgagaagcgcuucgucuccaaguaccucgccaccaucggcaucgacuacggcgucaccaagguccacguccgcgaccgcgagaucaaggucaacaucuucgacauggccggccaccccuucuucuacgagguccgcaacgaguucuacaaggacacccagggcgucauccucgucuacgacgucggccagaaggacuccuucgacgcccucgacgccuggcucgccgagaugaagcaggagcucggcccccacggcaacauggagaacaucaucuucgucgucugcgccaacaagaucgacugcaccaagcaccgcugcgucgacgaguccgagggccgccucugggccgaguccaagggcuuccucuacuucgagaccuccgcccagaccggcgagggcaucaacgagauguuccagaccuucuacaucuccaucgucgaccucugcgagaacggcggcaagcgccccaccaccaacuccuccgccuccuucaccaaggagcaggccgacgccauccgccgcauccgcaacuccaaggacuccugggacaugcucggcgucaagcccggcgccucccgcgacgaggucaacaaggccuaccgcaagcucgccguccuccuccaccccgacaagugcgucgcccccggcuccgaggacgccuucaaggccgucgucaacgcccgcaccgcccuccucaagaacaucaaguga

SEQ ID NO: 42343 - RNA, 1167 nt, Artificial Sequence
  derived and/or modified sequence opt2 from DNAJC28__Homo_sapiens__NP_060303
augaacaccauguacgucaugauggcccagauccuccgcucccaccucaucaaggccaccgucauccccaaccgcgucaagaugcuccccuacuucggcaucauccgcaaccgcaugauguccacccacaaguccaagaagaagauccgcgaguacuaccgccuccucaacgucgaggagggcugcuccgccgacgagguccgcgaguccuuccacaagcucgccaagcaguaccaccccgacuccggcuccaacaccgccgacuccgccaccuucauccgcaucgagaaggccuaccgcaagguccucucccacgucaucgagcagaccaacgccucccaguccaagggcgaggaggaggaggacgucgagaaguucaaguacaagaccccccagcaccgccacuaccucuccuucgagggcaucggcuucggcacccccacccagcgcgagaagcacuaccgccaguuccgcgccgaccgcgccgccgagcaggucauggaguaccagaagcagaagcuccagucccaguacuuccccgacuccgucaucgucaagaacauccgccaguccaagcagcagaagaucacccaggccaucgagcgccucgucgaggaccucauccaggaguccauggccaagggcgacuucgacaaccucuccggcaagggcaagccccucaagaaguucuccgacugcuccuacaucgaccccaugacccacaaccucaaccgcauccucaucgacaacggcuaccagcccgaguggauccucaagcagaaggagaucuccgacaccaucgagcagcuccgcgaggccauccucgucucccgcaagaagcucggcaaccccaugacccccaccgagaagaagcaguggaaccacgucugcgagcaguuccaggagaacauccgcaagcucaacaagcgcaucaacgacuucaaccucaucguccccauccucacccgccagaagguccacuucgacgcccagaaggagaucguccgcgcccagaagaucuacgagacccucaucaagaccaaggaggucaccgaccgcaaccccaacaaccucgaccagggcgagggcgagaagacccccgagaucaagaagggcuuccucaacuggaugaaccucuggaaguucaucaagauccgcuccuucuga

SEQ ID NO: 42344 - RNA, 1707 nt, Artificial Sequence
  derived and/or modified sequence opt2 from DNAJC2__Homo_sapiens__NP_001123359
augcuccuccuccccuccgccgccgacggccgcggcaccgccaucacccacgcccucaccuccgccuccacccucugccaggucgagcccgucggccgcugguucgaggccuucgucaagcgccgcaaccgcaacgccuccgccuccuuccaggagcucgaggacaagaaggagcucuccgaggaguccgaggacgaggagcuccagcucgaggaguuccccaugcucaagacccucgaccccaaggacuggaagaaccaggaccacuacgccguccucggccucggccacguccgcuacaaggccacccagcgccagaucaaggccgcccacaaggccaugguccucaagcaccaccccgacaagcgcaaggccgccggcgagcccaucaaggagggcgacaacgacuacuucaccugcaucaccaaggccuacgagaugcucuccgaccccgucaagcgccgcgccuucaacuccgucgaccccaccuucgacaacuccguccccuccaaguccgaggccaaggacaacuucuucgaggucuucacccccgucuucgagcgcaacucccgcugguccaacaagaagaacguccccaagcucggcgacaugaacuccuccuucgaggacgucgacaucuucuacuccuucugguacaacuucgacuccuggcgcgaguucuccuaccucgacgaggaggagaaggagaaggccgagugccgcgacgagcgccgcuggaucgagaagcagaaccgcgccacccgcgcccagcgcaagaaggaggagaugaaccgcauccgcacccucgucgacaacgccuacuccugcgacccccgcaucaagaaguucaaggaggaggagaaggccaagaaggaggccgagaagaaggccaaggccgaggccaagcgcaaggagcaggaggccaaggagaagcagcgccaggccgagcucgaggccgcccgccucgccaaggagaaggaggaggaggagguccgccagcaggcccuccucgccaagaaggagaaggacauccagaagaaggccaucaagaaggagcgccagaagcuccgcaacuccugcaagaucgaggagaucaacgagcagauccgcaaggagaaggaggaggccgaggcccgcaugcgccaggccuccaagaacaccgagaaguccaccggcggcggcggcaacggcuccaagaacugguccgaggacgaccuccagcuccucaucaaggccgucaaccucuuccccgccggcaccaacucccgcugggaggucaucgccaacuacaugaacauccacuccuccuccggcgucaagcgcaccgccaaggacgucaucggcaaggccaagucccuccagaagcucgacccccaccagaaggacgacaucaacaagaaggccuucgacaaguucaagaaggagcacggcgucgucccccaggccgacaacgccacccccuccgagcgcuucgagggccccuacaccgacuucacccccuggaccaccgaggagcagaagcuccucgagcaggcccucaagaccuaccccgucaacacccccgagcgcugggagaagaucgccgaggccguccccggccgcaccaagaaggacugcaugaagcgcuacaaggagcucgucgagauggucaaggccaagaaggccgcccaggagcagguccucaacgccucccgcgccaagaaguga

SEQ ID NO: 42345 - RNA, 1515 nt, Artificial Sequence
  derived and/or modified sequence opt2 from DNAJC3__Homo_sapiens__NP_006251
auggucgcccccggcuccgucaccucccgccucggcuccgucuuccccuuccuccucguccucgucgaccuccaguacgagggcgccgagugcggcgucaacgccgacgucgagaagcaccucgagcucggcaagaagcuccucgccgccggccagcucgccgacgcccucucccaguuccacgccgccgucgacggcgaccccgacaacuacaucgccuacuaccgccgcgccaccgucuuccucgccaugggcaaguccaaggccgcccuccccgaccucaccaaggucauccagcucaagauggacuucaccgccgcccgccuccagcgcggccaccuccuccucaagcagggcaagcucgacgaggccgaggacgacuucaagaagguccucaaguccaaccccuccgagaacgaggagaaggaggcccagucccagcucaucaaguccgacgagaugcagcgccuccgcucccaggcccucaacgccuucggcuccggcgacuacaccgccgccaucgccuuccucgacaagauccucgaggucugcgucugggacgccgagcuccgcgagcuccgcgccgagugcuucaucaaggagggcgagccccgcaaggccaucuccgaccucaaggccgccuccaagcucaagaacgacaacaccgaggccuucuacaagaucuccacccucuacuaccagcucggcgaccacgagcucucccucuccgagguccgcgagugccucaagcucgaccaggaccacaagcgcugcuucgcccacuacaagcaggucaagaagcucaacaagcucaucgaguccgccgaggagcucauccgcgacggccgcuacaccgacgccaccuccaaguacgaguccgucaugaagaccgagcccuccaucgccgaguacaccguccgcuccaaggagcgcaucugccacugcuucuccaaggacgagaagcccgucgaggccauccgcgucugcuccgagguccuccagauggagcccgacaacgucaacgcccucaaggaccgcgccgaggccuaccucaucgaggagauguacgacgaggccauccaggacuacgagaccgcccaggagcacaacgagaacgaccagcagauccgcgagggccucgagaaggcccagcgccuccucaagcagucccagaagcgcgacuacuacaagauccucggcgucaagcgcaacgccaagaagcaggagaucaucaaggccuaccgcaagcucgcccuccaguggcaccccgacaacuuccagaacgaggaggagaagaagaaggccgagaagaaguucaucgacaucgccgccgccaaggagguccucuccgaccccgagaugcgcaagaaguucgacgacggcgaggacccccucgacgccgagucccagcagggcggcggcggcaaccccuuccaccgcuccuggaacuccuggcagggcuucaaccccuucuccuccggcggccccuuccgcuucaaguuccacuucaacuga

SEQ ID NO: 42346 - RNA, 597 nt, Artificial Sequence
  derived and/or modified sequence opt2 from DNAJC5__Homo_sapiens__NP_079495
auggccgaccagcgccagcgcucccucuccaccuccggcgagucccucuaccacguccucggccucgacaagaacgccaccuccgacgacaucaagaaguccuaccgcaagcucgcccucaaguaccaccccgacaagaaccccgacaaccccgaggccgccgacaaguucaaggagaucaacaacgcccacgccauccucaccgacgccaccaagcgcaacaucuacgacaaguacggcucccucggccucuacgucgccgagcaguucggcgaggagaacgucaacaccuacuucguccucuccuccuggugggccaaggcccucuucgucuucugcggccuccucaccugcugcuacugcugcugcugccucugcugcugcuucaacugcugcugcggcaagugcaagcccaaggcccccgagggcgaggagaccgaguucuacgucucccccgaggaccucgaggcccagcuccaguccgacgagcgcgaggccaccgacacccccaucgucauccagcccgccuccgccaccgagaccacccagcucaccgccgacucccaccccuccuaccacaccgacggcuucaacuga

SEQ ID NO: 42347 - RNA, 1317 nt, Artificial Sequence
  derived and/or modified sequence opt2 from DNAJC7__Homo_sapiens__NP_001138238
augugccccaagaacgccuccuacuacggcaaccgcgccgccacccucaugaugcucggccgcuuccgcgaggcccucggcgacgcccagcaguccguccgccucgacgacuccuucguccgcggccaccuccgcgagggcaagugccaccucucccucggcaacgccauggccgccugccgcuccuuccagcgcgcccucgagcucgaccacaagaacgcccaggcccagcaggaguucaagaacgccaacgccgucauggaguacgagaagaucgccgagaccgacuucgagaagcgcgacuuccgcaaggucgucuucugcauggaccgcgcccucgaguucgcccccgccugccaccgcuucaagauccucaaggccgagugccucgccaugcucggccgcuaccccgaggcccaguccgucgccuccgacauccuccgcauggacuccaccaacgccgacgcccucuacguccgcggccucugccucuacuacgaggacugcaucgagaaggccguccaguucuucguccaggcccuccgcauggcccccgaccacgagaaggccugcaucgccugccgcaacgccaaggcccucaaggccaagaaggaggacggcaacaaggccuucaaggagggcaacuacaagcucgccuacgagcucuacaccgaggcccucggcaucgaccccaacaacaucaagaccaacgccaagcucuacugcaaccgcggcaccgucaacuccaagcuccgcaagcucgacgacgccaucgaggacugcaccaacgccgucaagcucgacgacaccuacaucaaggccuaccuccgccgcgcccagugcuacauggacaccgagcaguacgaggaggccguccgcgacuacgagaaggucuaccagaccgagaagaccaaggagcacaagcagcuccucaagaacgcccagcucgagcucaagaaguccaagcgcaaggacuacuacaagauccucggcgucgacaagaacgccuccgaggacgagaucaagaaggccuaccgcaagcgcgcccucaugcaccaccccgaccgccacuccggcgccuccgccgagguccagaaggaggaggagaagaaguucaaggaggucggcgaggccuucaccauccucuccgaccccaagaagaagacccgcuacgacuccggccaggaccucgacgaggagggcaugaacaugggcgacuucgaccccaacaacaucuucaaggccuucuucggcggccccggcggcuucuccuucgaggccuccggccccggcaacuucuucuuccaguucggcuga

SEQ ID NO: 42348 - RNA, 573 nt, Artificial Sequence
  derived and/or modified sequence opt2 from DNAL1__Homo_sapiens__NP_113615
auggccaaggccaccaccaucaaggaggcccucgcccgcugggaggagaagaccggccagcgccccuccgaggccaaggagaucaagcucuacgcccagaucccccccaucgagaagauggacgccucccucuccaugcucgccaacugcgagaagcucucccucuccaccaacugcaucgagaagaucgccaaccucaacggccucaagaaccuccgcauccucucccucggccgcaacaacaucaagaaccucaacggccucgaggccgucggcgacacccucgaggagcucuggaucuccuacaacuucaucgagaagcucaagggcauccacaucaugaagaagcucaagauccucuacauguccaacaaccucgucaaggacugggccgaguucgucaagcucgccgagcuccccugccucgaggaccucgucuucgucggcaacccccucgaggagaagcacuccgccgagaacaacuggaucgaggaggccaccaagcgcguccccaagcucaagaagcucgacggcacccccgucaucaagggcgacgaggaggaggacaacuga

SEQ ID NO: 42349 - RNA, 849 nt, Artificial Sequence
  derived and/or modified sequence opt2 from DNASE1__Homo_sapiens__XP_011520696
augcgcggcaugaagcuccucggcgcccuccucgcccucgccgcccuccuccagggcgccgucucccucaagaucgccgccuucaacauccagaccuucggcgagaccaagauguccaacgccacccucgucuccuacaucguccagauccucucccgcuacgacaucgcccucguccaggagguccgcgacucccaccucaccgccgucggcaagcuccucgacaaccucaaccaggacgcccccgacaccuaccacuacgucgucuccgagccccucggccgcaacuccuacaaggagcgcuaccucuucgucuaccgccccgaccaggucuccgccgucgacuccuacuacuacgacgacggcugcgagcccugcggcaacgacaccuucaaccgcgagcccgccaucguccgcuucuucucccgcuucaccgagguccgcgaguucgccaucgucccccuccacgccgcccccggcgacgccgucgccgagaucgacgcccucuacgacgucuaccucgacguccaggagaaguggggccucgaggacgucaugcucaugggcgacuucaacgccggcugcuccuacguccgccccucccagugguccuccauccgccucuggaccucccccaccuuccaguggcucauccccgacuccgccgacaccaccgccacccccacccacugcgccuacgaccgcaucgucgucgccggcaugcuccuccgcggcgccgucguccccgacuccgcccuccccuucaacuuccaggccgccuacggccucuccgaccagcucgcccaggccaucuccgaccacuaccccgucgaggucaugcucaaguga

SEQ ID NO: 42350 - RNA, 900 nt, Artificial Sequence
  derived and/or modified sequence opt2 from DNASE1L2__Homo_sapiens__NP_001288609
augggcggcccccgcgcccuccucgccgcccucugggcccucgaggccgccggcaccgccgcccuccgcaucggcgccuucaacauccaguccuucggcgacuccaaggucuccgaccccgccugcggcuccaucaucgccaagauccucgccggcuacgaccucgcccucguccaggagguccgcgaccccgaccucuccgccgucuccgcccucauggagcagaucaacuccgucuccgagcacgaguacuccuucgucuccucccagccccucggccgcgaccaguacaaggagauguaccucuucgucuaccgcaaggacgccgucuccgucgucgacaccuaccucuaccccgaccccgaggacgucuucucccgcgagcccuucgucgucaaguucuccgcccccggcaccggcgagcgcgcccccccccuccccucccgccgcgcccucaccccccccccccuccccgccgccgcccagaaccucguccucaucccccuccacgccgccccccaccaggccgucgccgagaucgacgcccucuacgacgucuaccucgacgucaucgacaaguggggcaccgacgacaugcucuuccucggcgacuucaacgccgacugcuccuacguccgcgcccaggacugggccgccauccgccuccgcuccuccgaggucuucaaguggcucauccccgacuccgccgacaccaccgucggcaacuccgacugcgccuacgaccgcaucgucgccugcggcgcccgccuccgccgcucccucaagccccaguccgccaccguccacgacuuccaggaggaguucggccucgaccagacccaggcccucgccaucuccgaccacuuccccgucgaggucacccucaaguuccaccgcuga

SEQ ID NO: 42351 - RNA, 828 nt, Artificial Sequence
  derived and/or modified sequence opt2 from DNASE1L3__Homo_sapiens__NP_001243489
augucccgcgagcucgccccccuccuccuccuccuccucuccauccacuccgcccucgccaugcgcaucugcuccuucaacguccgcuccuucggcgaguccaagcaggaggacaagaacgccauggacgucaucgucaaggucaucaagcgcugcgacaucauccucgucauggagaucaaggacuccaacaaccgcaucugccccauccucauggagaagcucaaccgcgagaagcucgucuccgucaagcgcuccuaccacuaccacgacuaccaggacggcgacgccgacgucuucucccgcgagcccuucgucgucugguuccaguccccccacaccgccgucaaggacuucgucaucaucccccuccacaccacccccgagaccuccgucaaggagaucgacgagcucgucgaggucuacaccgacgucaagcaccgcuggaaggccgagaacuucaucuucaugggcgacuucaacgccggcugcuccuacguccccaagaaggccuggaagaacauccgccuccgcaccgacccccgcuucgucuggcucaucggcgaccaggaggacaccaccgucaagaaguccaccaacugcgccuacgaccgcaucguccuccgcggccaggagaucgucuccuccgucguccccaaguccaacuccgucuucgacuuccagaaggccuacaagcucaccgaggaggaggcccucgacgucuccgaccacuuccccgucgaguucaagcuccaguccucccgcgccuucaccaacuccaagaaguccgucacccuccgcaagaagaccaaguccaagcgcuccuga

SEQ ID NO: 42352 - RNA, 462 nt, Artificial Sequence
  derived and/or modified sequence opt2 from DNASE2B__Homo_sapiens__XP_011540180
augccccagcucugcacccgcgccuccuccuccgagauccccggccgccuccucaccacccuccaguccgcccagggccagaaguuccuccacuucgccaaguccgacuccuuccucgacgacaucuucgccgccuggauggcccagcgccucaagacccaccuccucaccgagaccuggcagcgcaagcgccaggagcuccccuccaacugcucccuccccuaccacgucuacaacaucaaggccaucaagcucucccgccacuccuacuucuccuccuaccaggaccacgccaaguggugcaucucccagaagggcaccaagaaccgcuggaccugcaucggcgaccucaaccgcuccccccaccaggccuuccgcuccggcggcuucaucugcacccagaacuggcagaucuaccaggccuuccagggccucguccucuacuacgaguccugcaaguga

SEQ ID NO: 42353 - RNA, 1083 nt, Artificial Sequence
  derived and/or modified sequence opt2 from DNASE2__Homo_sapiens__NP_001366
augaucccccuccuccucgccgcccuccucugcguccccgccggcgcccucaccugcuacggcgacuccggccagcccgucgacugguucgucgucuacaagcuccccgcccuccgcggcuccggcgaggccgcccagcgcggccuccaguacaaguaccucgacgaguccuccggcggcuggcgcgacggccgcgcccucaucaacucccccgagggcgccgucggccgcucccuccagccccucuaccgcuccaacaccucccagcucgccuuccuccucuacaacgaccagcccccccagcccuccaaggcccaggacuccuccaugcgcggccacaccaagggcguccuccuccucgaccacgacggcggcuucuggcucguccacuccguccccaacuuccccccccccgccuccuccgccgccuacuccuggccccacuccgccugcaccuacggccagacccuccucugcgucuccuuccccuucgcccaguucuccaagaugggcaagcagcucaccuacaccuaccccugggucuacaacuaccagcucgagggcaucuucgcccaggaguuccccgaccucgagaacgucgucaagggccaccacgucucccaggagcccuggaacuccuccaucacccucaccucccaggccggcgccgucuuccaguccuucgccaaguucuccaaguucggcgacgaccucuacuccggcuggcucgccgccgcccucggcaccaaccuccagguccaguucuggcacaagaccgucggcauccuccccuccaacugcuccgacaucuggcagguccucaacgucaaccagaucgccuuccccggccccgccggccccuccuucaacuccaccgaggaccacuccaaguggugcgucucccccaagggccccuggaccugcgucggcgacaugaaccgcaaccagggcgaggagcagcgcggcggcggcacccucugcgcccagcuccccgcccucuggaaggccuuccagccccucgucaagaacuaccagcccugcaacggcauggcccgcaagcccucccgcgccuacaagaucuga

SEQ ID NO: 42354 - RNA, 1062 nt, Artificial Sequence
  derived and/or modified sequence opt2 from DND1__Homo_sapiens__NP_919225
augcaguccaagcgcgacugcgagcucuggugcgagcgcgucaaccccgagaacaaggccgcccucgaggccuggguccgcgagaccggcauccgccucguccaggucaacggccagcgcaaguacggcggccccccccccggcugggucggcucccccccccccgccggcuccgaggucuucaucggccgccucccccaggacgucuacgagcaccagcucaucccccucuuccagcgcgucggccgccucuacgaguuccgccucaugaugaccuucuccggccucaaccgcggcuucgccuacgcccgcuacuccucccgccgcggcgcccaggccgccaucgccacccuccacaaccacccccuccgccccuccugcccccuccucgucugccgcuccaccgagaagugcgagcucuccgucgacggccucccccccaaccucacccgcuccgcccuccuccucgcccuccagccccucggccccggccuccaggaggcccgccuccuccccucccccggccccgcccccggccagaucgcccuccucaaguucuccucccaccgcgccgccgccauggccaagaaggcccucgucgagggccagucccaccucugcggcgagcaggucgccgucgaguggcucaagcccgaccucaagcagcgccuccgccagcagcucgucggccccuuccuccgcuccccccagcccgagggcucccagcucgcccucgcccgcgacaagcucggcuuccagggcgcccgcgccacccuccagcuccucugccagcgcaugaagcucggcucccccgucuuccucaccaagugccucggcaucggccccgccggcuggcaccgcuucugguaccaggucgucauccccggccaccccguccccuucuccggccucaucugggucguccucacccucgacggccgcgacggccacgaggucgccaaggacgccgucuccguccgccuccuccaggcccucuccgaguccggcgccaaccuccucugguccgccggcgccgaggccggcaccauggucaagcaguga

SEQ ID NO: 42355 - RNA, 2214 nt, Artificial Sequence
  derived and/or modified sequence opt2 from DNER__Homo_sapiens__NP_620711
augcagccccgccgcgcccaggcccccggcgcccagcuccuccccgcccucgcccuccuccuccuccuccucggcgccggcccccgcggcuccucccucgccaaccccguccccgccgccccccucuccgcccccggccccugcgccgcccagcccugccgcaacggcggcgucugcaccucccgccccgagcccgacccccagcaccccgcccccgccggcgagcccggcuacuccugcaccugccccgccggcaucuccggcgccaacugccagcucgucgccgaccccugcgccuccaaccccugccaccacggcaacugcuccuccuccuccuccuccuccuccgacggcuaccucugcaucugcaacgagggcuacgagggccccaacugcgagcaggcccuccccucccuccccgccaccggcuggaccgaguccauggccccccgccagcuccagcccguccccgccacccaggagcccgacaagauccucccccgcucccaggccaccgucacccuccccaccuggcagcccaagaccggccagaaggucgucgagaugaagugggaccaggucgaggucauccccgacaucgccugcggcaacgccuccuccaacuccuccgccggcggccgccucgucuccuucgaggucccccagaacaccuccgucaagauccgccaggacgccaccgccucccucauccuccucuggaaggucaccgccaccggcuuccagcagugcucccucaucgacggccgcuccgucaccccccuccaggccuccggcggccucguccuccucgaggagaugcucgcccucggcaacaaccacuucaucggcuucgucaacgacuccgucaccaaguccaucgucgcccuccgccucacccucgucgucaaggucuccaccugcguccccggcgagucccacgccaacgaccucgagugcuccggcaagggcaagugcaccaccaagcccuccgaggccaccuucuccugcaccugcgaggagcaguacgucggcaccuucugcgaggaguacgacgccugccagcgcaagcccugccagaacaacgccuccugcaucgacgccaacgagaagcaggacggcuccaacuucaccugcgucugccuccccggcuacaccggcgagcucugccaguccaagaucgacuacugcauccucgaccccugccgcaacggcgccaccugcaucuccucccucuccggcuucaccugccagugccccgagggcuacuucggcuccgccugcgaggagaaggucgaccccugcgccuccucccccugccagaacaacggcaccugcuacgucgacggcguccacuucaccugcaacugcucccccggcuucaccggccccaccugcgcccagcucaucgacuucugcgcccucucccccugcgcccacggcaccugccgcuccgucggcaccuccuacaagugccucugcgaccccggcuaccacggccucuacugcgaggaggaguacaacgagugccucuccgcccccugccucaacgccgccaccugccgcgaccucgucaacggcuacgagugcgucugccucgccgaguacaagggcacccacugcgagcucuacaaggaccccugcgccaacgucuccugccucaacggcgccaccugcgacuccgacggccucaacggcaccugcaucugcgcccccggcuucaccggcgaggagugcgacaucgacaucaacgagugcgacuccaaccccugccaccacggcggcuccugccucgaccagcccaacggcuacaacugccacugcccccacggcugggucggcgccaacugcgagauccaccuccaguggaaguccggccacauggccgagucccucaccaacaugccccgccacucccucuacaucaucaucggcgcccucugcgucgccuucauccucaugcucaucauccucaucgucggcaucugccgcaucucccgcaucgaguaccagggcuccucccgccccgccuacgaggaguucuacaacugccgcuccaucgacuccgaguucuccaacgccaucgccuccauccgccacgcccgcuucggcaagaagucccgccccgccauguacgacgucucccccaucgccuacgaggacuacucccccgacgacaagccccucgucacccucaucaagaccaaggaccucuga

SEQ ID NO: 42356 - RNA, 14262 nt, Artificial Sequence
  derived and/or modified sequence opt2 from DNHD1__Homo_sapiens__NP_653267
augguccccgaggagcgccgcgucggccucuccuccgacgagaccuccuccgacucccucaaguccuggcacuccaucugcguccucgacuccaaggagcagccccucgccugccagcagaagcagcgccaguucgucaagcccgucaccgaguccgagcagcccaccguccucgagcuccuccucgccgagcuccgcacccucuucuccgccguccuccaggacuccucccccgccgccuggcgcuaccuccacgccguccucggccuccucccccccuaccgcgagcuccucgucggccaccucgaccuccuccccuuccucgagcagcucuacugcugggcccccuggguccagacccaccuccaccucgaccuccucggcgccaucguccaggccuucccccccgacuccucccuccucgacuccgccucccacgccgacugcugcccccagaagcgccgccuccaccaccgcccccccugccccgccugccccuucguccaggcccaguggucccgccagcaggucaaggaggagcucgccaccuggcuccgcccccucacccuccccgagcuccagcgcugccucggcaucgucggcgcccaggucgcccucgaggaggccgucuggcucgacggccucucccuccucccccucgcccucgccgccgacauccccguccgcuacgaguccuccgacaccgacaacgccgaggucgagcccgucggccgcaaggagacccgcucccagcucgacuacgaggucccccgcgagaaggccuuccagaaguccuccaccggcuucucccccgagaccuccuuccucgacucccaggucaugaccgcccucaagauggagcgcuaccucaagaagauccacuuccucuaccucaacgucgcccccucccgcuacuuccgccccuacucccucauggucgucccccccgacaaggucaaccccgagcacuacaucuucucccccuucggcauccuccacguccaccccgucgagggcuccgagaccaugacccucggcaccuggcaccaccacugcguccucuggcagcagcuccaguucauccccuucuucaaguacugccuccuccgcaaguccuucaccugcuggaagaagaacguccgccuccagggccuccaccgccuccagaaguuccucgagaaccaccuccuccucgccgucccccacuucggcgccggccuccuccacaucucccgccuccuccaggagcuccacuccgucuccuggcucccccaggagcucgaccgcugcuacgagcuccucgaccuccagaccgcccucgccgaggagaagcacaaggcccuccgccuccuccaccgcugccucaaccucugcaccuccauccuccgccucguccacgaggacaccuaccacaugcagcagugccuccaggagcgcguccagaacugcgaccgcauccgcaccggccagggcuccaucuaccuccagcgcguccagcacaagcagcucgagcagaagcucaagcaggccgaggccugguggcuccagcucggcaaguucgcccgccucgucgacuacaugaucugccagucccucaucuccguccucgaggagcagaucaccuccuucgucgccaacauccuccaggccccccgccagaagcccuuccucuccucccagcucgucuucgacgaccacggccagcucucccacguccccugcgucgagaacaugauccagacccucaccggcggccuccaguccgucaagaccuccgcccuccaggucguccaguccgccgaccucaagaccuccuccgacucccucuacuccgaggaggaggacgaggaggaggacuccaaggacgaguuccucaugcccaaguuccagggccagcccuccgacgccgucuccaucuucugcggccccaacgucggccucgucuggcccuggaagucccaccccaucgccggcauccucgagguccgcggcugccgccuccgcggccaguacuucccccacaacuacaagcagcucgaggaggaccucgacaacaaccccaagauccagcaggcccucaacauccagcagguccuccucgagggcguccucugcaagguccaggaguucugccgcgagcaccacuggaucaccggcaucuacgaguuccuccaguccuggggcccccagaagcucgaggacaugcgcggcggccccaucaagaacuacgucacccucgucucccgccucaacgucuggcaggcccgcgucuccuccaugcccaucgagcuccucaccaagggcggccuccuccuccucuccugccacgacguccaggccgagauggaguccaagcucaacuccauccgcaaggacauccucgcccacguccagaacgagugcuggaaccucucccagcagcucaugaccgagcucaccgacuucaugcacaucuuccgcaccaucaacuccgacauccacgccaucgcccagugcacccagaagcucaacgaggccaacgagcaguacgucgagcucgaggagcgcauggaguacguccgcgcccuccacgagcucauccgcaaccacuucucccucuucuccgccgagaacgaggcccucgacaucuccguccgccgccaguucggcgagucccccaucccccccugccccccccccccccagccccaccuccuccacugcccccuccucgccccccagcuccucgacaugugggaggccuuccaguucgagaagucccaggccuccgaguuccuccucuccaagcgccacgccaucaugcccaagcuccagcagcucauggccgccgcccucgccgagcucgagggccuccucgccaaggcccucuccggccccuucauggaccccacccaggaccagcgcuccaccgagcaccagcucgucucccucgagcgccaguuccagaacaccgucuccgaccucuccgagcuccaccacgccuacgccaucuucaccgaggacgagacccccgucccccuccccaucugcggcacccgccccaucguccagcagcagcgcaucuggcaccucuaccgcgucaucuccgagaacaucuccgaguggaagugcauggccuucgccaaguucucccccgccauggcccaggagaagaccgagggcuggcucaccgaggccgcccgcauguccaccacccucgagcuccacucccccguccuccagcacugcaugcgcauccucggcgaguuccgcuccuaccucccccuccucaccaagcucggcucccuccacccccagucccucaacugccagugccuccuccgcgcccucggccucggcucccuccagaccaucgagcuccucacccucggccagcuccucaccuacccccuccucgaguucgccgaccgcaucaaccaggucuggcagaacgagaacgagcgcauccacgcccaggagaccauccgccgccuccagcgcuacugggaggcccgccagcuccgccuccucaacuucauccuccacguccccuacgagccccccgccuccgagcgcuccaagcgccagguccuccgcuccccccagugggaggucgucgacaaggacuccggcaccuucauccucuccgacuacuccaaccuccaggacuccauccaggagucccuccagguccucuccaagauccucgccaucgagaaguccggcgaccucaacaagaucgcccucgagugggucgccaucaugcacggccucggcgcccuccucgaggucuggcucaccuuccagcagaaguggaucuuccucaacaagguccuccacgagaugaagauccaguuccccaacgccgaccucaacucccgcuucaaggucauggacgaccaguaccgcacccucaugcgcaucuccgucgccgaccccaugguccucucccucgucguccccuccgccgagcgcucccccuacuuccagggccagcagcuccagcagcuccuccaggccggcuccgucgagcucgagggcaucaucaugucccucgaguccguccucuacggcgucugcgcccacuucccccgccucuucuuccucuccgacuccgagcucgucgcccuccucgccgcccgccucgaguccugcgaggcccagcucuggguccgccgcugcuucccccacguccacgccgucuccuuccgcuccugccccaccggcgagaagaacaccgacgacugggaguccucccccaacacccagacccaggucgaggcccucgccguccucggcgccggcggcgaggaggucaagcuccagggcccccucccccuccaccccgaccuccccaaguggcucgccucccucgagaagugccuccgccucgcccucguccacaugcuccagggcugcgucgccgcccgccucgcccgcggccccucccucggcgaggcccucaagcagcuccccaagcagaacaagcucuaccuccagcucuacguccagcacuggaucgaccucguccaggccuuccccuggcagugcguccucgucgccgaggaggucgucuggcgcgccgagauggaggaggcccuccucgaguggggcacccucgccauggucuccaugcacaugcgcaagcucgagguccucgucaacuucaugcgcgcccagcgcgccucccagggcggccagucccuccccuccguccgccagaccucccuccucuccgcccuccucgucauggccgucacccaccgcgacaucgcccagcuccucgagcagcaccaggucuccgaccucaccgacuuccacuggguccgccagcucaaguaccaccucggcuccccccacaucauccccaaguccccccuccagucccucaagaccaucgccuccuccgagcccucccucucccccgccgccugcuggaucgacguccucggccgcuccuuccucuacaacuacgaguaccucggcccccgccucggcccccuccccucccuccuccccgagcgccccgcccucguccuccuccucgcccucgaggaggucgccugcggcaccguccucggccccaacggcgucggcaagcgcgccaucgucaacucccucgcccaggcccucggccgccagcucgucaugcuccccugcuccccccagaucgaggcccagugccucuccaacuaccucaacggcgcccuccagggcggcgccuggcuccuccucgagaagguccaccagcucccccccggccuccucuccgcccucggccagcgccucggcgagcuccaccaccucuacgccccccucuaccaggaggccucccgcaacaccuccaccaucgaccccacccagccccagcuccucggcuccuccuucuucgagaagcaccacgucuccguccgccucggcuacggcugccuccucguccuccgcgcccucuccuccgccguccccgccaaccuccaccuccuccuccgccccgucgcccucgcccuccccgaccuccgccaggucgccgagcucacccuccucggcgccggcaugcgcgacgccuuccagauggccacccgccucuccaaguucuucucccucgagcgcgagcucgucuccggcccccuccccugccgccucccccuccucaagcagauccucgaggacaccauccgcacccucaacgucaccaaggaggagcccaagugccagaagccccgcucccucgccgccaucgaggaggccgcccuccuccgcuccccccucuucuccauccucaacggccuccaccuccacaaccuccgcggccuccucugcgcccucuuccccuccgccucccagguccucgccgagcccaugaccuacaagcucaugaagccccucgucgucgaggagcuccagcaggucggccucgaccccucccccgacauccucggcucccucgagcagcucucccaggcccucucccgcgccuccggcauccuccuccucggccccgccggcuccggcaagaccaccugcuggcacucccucuucaagauccagaaccgccucgccgccauggaggacaccuccacccagggcugccagcccgucgagaucacccaccucuaccccuccggccucuccccccaggaguuccucggcuggcucgagggcuccugcuggcaccacggcaucuuccccaagguccuccgcgccgccggccagugcaacaacaugggccagaagcgccagaccgaggaguccaucggcauccagcacuggaucaucugcgacggcgccuccaacggcgccuggcucgacuccaucaccugccuccucuccgagcucccccagcucucccuccccuccggccagcagaucgcccgcccccccggcaccuuccuccucauggaggucgccgacaccaccggcaucucccccaccgucgucggcugcugcgcccucgucuggugcggcggcgagcagaccuggcagugcauccucuccgcccucauggccucccuccccuacgaguaccgccuccagcaccgcaccgucgccgagcucaaccacauggccgagguccucguccccgccacccuccgcuuccucaccugccagggcgucuccucccuccuccagguccacggccagcaggccgucugcgccggcgucgccgaggucaccuccauggcccgcauccuccacucccuccucgaccuccaccuccgccucaaggaggagaaggcccccggccccgaggaccucuccuacuccgaccccgucgcccaguccuuccgcuccuccaaguccuccuuccucaaccgcucccaggucgacuccgacgacguccccgacaagugccgcgagcaccuccucgccgucuccuccuuccucuucgcccucaucuggggcuucggcgcccaccuccccucccgcuucuggcccaucuucgacaccuucauccgcgacuccaucucccgccucuccaacuaccccgagcccccccccuccgcccucgucuucgaccuccacgucucccccgaggacggcacccucguccccuucaccggccaguaccucuccucccacaucaagggcacccucggcaccuuccaccccuccauccagaccgagcgccuccucuacgucgucgaccuccuccucuccggcggccagcccguccuccucgccggcgaggccgccaccggcaaguccgccuucgucgagguccucgucgagccccaccaccccuacaucuacucccccauccaccccgccuucuccuccucccaccuccgccuccuccucucccgcggcauccagggccagacccaggccuccccccagcccggccaccaccaggacuccaagcccucccuccucuuccuccucgaggaccuccaccucgccaccuccgaccccgagaaguccugccagcccguccucgagacccuccgccaggccauggacggcaccgucuacgcccacuccacccucgagcuccagacccuccagcccaccgucaacuuccucgccaccgucaccguccccggcuacugcgagcgcccccucugcccccgccucuuccgccucuucaccguccucgcccucgaguccaugacccaggccacccuccucgagcgccacguccccaucauccaggccuggcucgagcgcuuccccuccgucgagcgcgagcgcgcccucgcccgcggccucguccgcgccuccgucgaggccugggaggccgucugcaacugcuucaugcccuccccccuccacccccacuaccacuucucccuccacuccgucucccaccuccucuccucccuccagcuccuccccaaccgcaccggcucccgcggcuucgucgacuaccccaaccaccaggagcaccuccgccgcgucuccggccuccgcggcaccugccucaccgucaugauggccacccgcaacgucguccgccucuggcuccacgaggcccagcgcaccuucugcgaccgccucgacuccccccgcgagcgcuccuacugcgccaagcuccuccucgucgucgcccaguccgucuucugcugcggccccggcccccagcaccucggcaaggaccaccaggaguccgaggaggaggaggaggaggagcgcguccccgaggucgaguccgagggcgagcucgcccagugggaggacuucuccaacuccaacuccgagaccgaggaggaggaggagcccuacggccuccaggucgcccgcgucuccaacucccgcgaccccucccucacccccuccaucggccccgucucccgcggcaugaaggaguccaucucccacaagauccgccaggagaagggcacccgcgccuccaacuaccgccuccagguccgccgcuccuucaagaccugguggcagaagaagccccagauggaccucaucuccccccuccuccuccccguccuccuccuccacccccaggagaagcccuccgaccucgucuucucccaggagcucauccucggccccaacuccgagacccccaaccucuaccucgagcgccagugggagaagcucgaggagcagcucgccaccuccgccgcccagcucaagcucuccccccaccucgcccgcugccacuccauggcccagcacgucgcccgccucguccgcguccucgcccgcccccgccagcacggccuccuccucuccggcgcccucggcaccggccgccacaccgccaucacccucgccuccuccaucugccaggcccacuucuuccaccuccccuccggcuccgaggaggccauccuccagugccuccgcgacgccuccuggcacgccggcaugcucucccagcccgucgcccuccucguccccuccggcgucgaccucaccacccuccaccgccuccucgcccucgccaccuccggcuccuuccccggccaguacaccgaggccgaccucgaccgcaucggcgagcaccucccccgcgagaaccucggcgucaagcagaacaucaagaaggagaugguccuccagcgcuuccaccagcaggucugcucccaccuccaccucuucuuccucaucggcgacaagcaggcccacaagcagcuccccuccacccucuuccuccgccuccuccagcucgccaccgccuccaucgaccgcuacgagcccugggaccaggccgcccucgccaaggucgcccagcaccaccucgagggcgcccaguccgucccccucgacgacggcuccuggaaguaccccgaccuccaggccuccauccccuccgucgccaaggccauggcccucauccaccucuccgccacccacuaccacgagcaccucugccccgcccucccccucgucacccccaagaccuuccucgacuuccucgacaccuuccucaugcuccagcagcagaccauccucaagaucaagaacaaggcccagcgcguccagaacgcccucgagaaccuccgcaugcucaucaaggagcacggcacccacgccaaccucaucuucgaccucgagcagcagcucaaggacuccggcaagucccucuccauguuccagcagcagcucgagcaguccaagcuccucuacaagcagcagcucgaggagugccgccaccaggagaaccucaucgagaaccucgcccgccagcgcgacgcccuccaggcccagcgcgaggccuuccucgagcagauguccaaggccuuccucgagccccucucccagcuccaggucgccgacuucgaggagauccgcuccuaccgcgccccccccgaguccgucguccgcgucaccgacgccaugugcgaccucuuccaccacgagaccggcugggccuccgccaagcagcuccucugcaccgaggacuucuaccaggagcucgucuucuuccccaaggagaagaucaccgacuccgagcucaucaagcuccaccucauccucaaggcccccggcauggacgacgccgcccuccgcgccgucucccgccccgccgccucccucgccgccuggcucugggccguccuccacuacggccucgcccacugccgcggccuccccaccgaccuccuccuccagcaggucgaggccacccucacccgcgagcaggcccgccucggcuacuaccaguuccaggcccaggagacccucgagcacaaccucgcccucgccaagauggucgaggacgcccaggccucccacaacugcgucgccaagacccucucccaggcccagugcggccaguaccacaaguggcccaugaaggccgcccuccucacccccaugcgcgccuggaccacccagcuccagaagcucaagggccgcugcaugaccgucuucggcgacacccuccucugcuccgccgccaucaucuaccucggccccuuccccccccuccgccgccaggagcuccucgacgaguggcucgcccucugccgcggcuuccaggaggcccucggccccgacgacgucgcccaggcccucaagcgcaagcagaaguccgucuccaucccccccaagaacccccuccucgccacccacucccccuucuccauccucucccuccucuccuccgaguccgagcaguaccagugggacggcaaccucaagccccaggccaaguccgcccaccucgccggccuccuccuccgcucccccacccacuacuccuccugccgcuggccccuccuccucgaccccuccaacgaggcccucaucuggcucgacccccucccccucgaggagaaccgcuccuucgcccccgcccucaccgagggccgcggcaagggccucaugcgcaaccagaagcgcgaguccaagaccgacaugaaggaggaggacgacgaguccgaggaguccaacgaggccgaggaccagaccaaggagcagaaggccgaggagcgcaagaacgagcaggagaaggagcaggaggagaacgaggagaaggaggaggagaagaccgagucccagggcuccaagcccgccuacgagacccagcuccccucccuccccuaccucuccguccucuccggcgccgaccccgagcucggcucccagcuccaggaggccgccgccugcggccuccccguccuccucaccaacgucgagcucggccucggcugcgaggagcuccaguggcuccuccagcgcgagcagcucucccccccccagguccagcccggcuucugccucuaccucuccaccacccucucccucugcgccauggagaagguccucggcugcgagcuccucaagggccucaacguccucgaccucggccucaacauggagauccucgaggagcagaugcuccacgagauccucugccgcgaguaccccgagcucgagacccgcuggcaggaccucaagauccgcgcccucgacaccugcaaggccgucgaggccgccgaggagcgccuccucaccaugcuccucuuccagaaccccaagcgccagaagcccgccaaguuccuccgcaacaucguccgcgcccagggcaagcucugccagcuccgcgcccacugcgaggagcucgagggccagaagcuccaggagaugguccucugggcccccuaccgccccgucgucuggcacggcauggccauggucaaggcccucucccagcuccagaaccuccucccccucuucugcaugucccccgagaacuggcucgccgucaccaagcaggcccucgacuccaugaagccccgcgagaucaaccacggcgaggaccucgccucccaccuccuccagcuccgcgcccaccucacccgccagcuccucggcuccaccgucaccgcccucggccucacccaggucccccucgucggcgcccucggcgcccucgcccuccuccaggccaccggcaaggccuccgagcucgagcgccucgcccucuggcccggccucgccgccucccccuccaccguccacuccaagcccgucuccgacgucgcccgccccgccuggcucggccccaaggccuggcacgagugcgagaugcucgagcuccucccccccuucgucggccucugcgccucccucgccggccacuccuccgccuggcaggccuaccucucccucuccuccaccguccucggccccgcccccggccccggccccgagccccucucccuccuccagaagcucauccucuggcgcguccuccgccccgagugccucgccggcgcccucgccgacuucaccaccucccuccucggccgcccccucgacgagaacaccuacgcccccaccaugcccuucaagcacucccaggccacccagcccaugcucauccuccuccccccccccggccaccccuccgccacccuccacccccucaccgucauccagaagcucgccgccaaguaccagcagggccagaagcagcuccaggucaucgcccucggcuccgaggccugggaccccgucuccgucgucgucuccacccucucccaggccauguacgagggccacuggcucguccucgacaacugccaccucaugccccacuggcccaaggagcuccuccagcuccuccucgagcuccucggccgcgccaaggucgucgccgaccucgaguccgagcagcuccucgaccagcccgagucccgcaacgucuccaccguccaccgcgacuuccgccucuggcucaucguccccgccgaguccuccgccucccuccccgccguccucacccagcacuccaugcccgucuucuggaaccagucccucgagcucggccacguccucaucgacuccgucgagcucgcccagcagguccucuacaugcagccccccacccaggcccucccccuccuccuccuccacggccuccuccuccaccgccagcucuacggcacccgccuccaggcccaccgcggccgcuggucccaggucacccucacccagguccuccagacccaggaccagcucugggccucccucuccaacccccgcgccgccaugcaggagcucgccgccuccgucuucuacggcggcccccucggcgacaccgaggaccgcgaggcccucaucucccucacccaggccugccucucccccuccuccggcuccuggguccagccccacaccccccagucccuccucgccacccucaugccccuccccgagcuccgcgagcucgacgccauggccgagugcaaggcccagaugcaccuccuccccuccccccccgagccccgccucugcggccucuccgagggcccccaggccuggcuccuccgccgccagucccgcgcccuccucuccgcccuccagcgcuccucccccgucuggguccccgagucccgccgcggcgcccagcucgccgagcgccgccuccgccagcgccucguccaggucaaccgccgccucgagucccuccaggaccuccucacccacgucauccgccaggacgaguccgacgcccccugguccguccucggccccaacgcccgccgcccccucgagggcguccucgagaccgaggcccucgagcucucccagcucgucggcacccuccagcgcgaccucgacugccuccuccagcagcucaagggcgccccccccugccccucccgccgcugcgccgccgucgcccacgcccucuggaccggccgccucccccuccccuggcgcccccacgcccccgccggcccccagccccccuggcacuggcuccgccagcucucccgccgcggccagcuccucguccgcuaccucggcgucggcgccgacgccuccuccgacguccccgagcgcgucuuccaccucuccgccuuccgccacccccgccgccuccuccucgcccuccgcggcgaggccgcccucgaccagaacguccccuccuccaacuuccccggcucccgcggcuccgucuccucccagcuccaguacaagcgccucgagaugaacuccaacccccuccacuuccgcgucgagaacggccccaaccccaccguccccgagcgcggccuccuccucaucggccuccagguccuccacgccgagugggaccccaucgccggcgcccuccaggacucccccuccucccagcccuccccccucccccccgucuccaucuccacccaggcccccggcaccuccgaccuccccgcccccgccgaccucaccgucuacuccugccccgucuacaugggcggcccccucggcaccgccaagcuccagucccgcaacaucgucaugcaccucccccuccccaccaagcucacccccaacaccugcguccagcgccgcguccacgucugcucccccccccucuccuga

SEQ ID NO: 42357 - RNA, 537 nt, Artificial Sequence
  derived and/or modified sequence opt2 from DNLZ__Homo_sapiens__NP_001074318
augcuccgcaccgcccuccgcggcgccccccgccuccucucccgcguccagccccgcgcccccugccuccgccgccucuggggccgcggcgcccgccccgaggucgccggccgccgccgcgccugggccuggggcuggcgccgcuccuccuccgagcagggccccggccccgccgccgcccucggccgcgucgaggccgcccacuaccagcucgucuacaccugcaaggucugcggcacccgcuccuccaagcgcaucuccaagcucgccuaccaccagggcgucgucaucgucaccugccccggcugccagaaccaccacaucaucgccgacaaccucggcugguucuccgaccucaacggcaagcgcaacaucgaggagauccucaccgcccgcggcgagcagguccaccgcgucgccggcgagggcgcccucgagcucguccucgaggccgccggcgcccccaccuccaccgccgcccccgaggccggcgaggacgagggcccccccucccccggcaagaccgagcccuccuga

SEQ ID NO: 42358 - RNA, 2556 nt, Artificial Sequence
  derived and/or modified sequence opt2 from DNM1__Homo_sapiens__NP_001005336
augggcaaccgcggcauggaggaccucaucccccucgucaaccgccuccaggacgccuucuccgccaucggccagaacgccgaccucgaccucccccagaucgccgucgucggcggccaguccgccggcaaguccuccguccucgagaacuucgucggccgcgacuuccucccccgcggcuccggcaucgucacccgccgcccccucguccuccagcucgucaacgccaccaccgaguacgccgaguuccuccacugcaagggcaagaaguucaccgacuucgaggagguccgccucgagaucgaggccgagaccgaccgcgucaccggcaccaacaagggcaucucccccguccccaucaaccuccgcgucuacuccccccacguccucaaccucacccucgucgaccuccccggcaugaccaagguccccgucggcgaccagccccccgacaucgaguuccagauccgcgacaugcucaugcaguucgucaccaaggagaacugccucauccucgccgucucccccgccaacuccgaccucgccaacuccgacgcccucaaggucgccaaggaggucgacccccagggccagcgcaccaucggcgucaucaccaagcucgaccucauggacgagggcaccgacgcccgcgacguccucgagaacaagcuccucccccuccgccgcggcuacaucggcgucgucaaccgcucccagaaggacaucgacggcaagaaggacaucaccgccgcccucgccgccgagcgcaaguucuuccucucccaccccuccuaccgccaccucgccgaccgcaugggcacccccuaccuccagaagguccucaaccagcagcucaccaaccacauccgcgacacccuccccggccuccgcaacaagcuccagucccagcuccucuccaucgagaaggaggucgaggaguacaagaacuuccgccccgacgaccccgcccgcaagaccaaggcccuccuccagaugguccagcaguucgccgucgacuucgagaagcgcaucgagggcuccggcgaccagaucgacaccuacgagcucuccggcggcgcccgcaucaaccgcaucuuccacgagcgcuuccccuucgagcucgucaagauggaguucgacgagaaggagcuccgccgcgagaucuccuacgccaucaagaacauccacggcauccgcaccggccucuucacccccgacauggccuucgagaccaucgucaagaagcaggucaagaagauccgcgagcccugccucaagugcgucgacauggucaucuccgagcucaucuccaccguccgccagugcaccaagaagcuccagcaguacccccgccuccgcgaggagauggagcgcaucgucaccacccacauccgcgagcgcgagggccgcaccaaggagcaggucaugcuccucaucgacaucgagcucgccuacaugaacaccaaccacgaggacuucaucggcuucgccaacgcccagcagcgcuccaaccagaugaacaagaagaagaccuccggcaaccaggacgagauccucgucauccgcaagggcuggcucaccaucaacaacaucggcaucaugaagggcggcuccaaggaguacugguucguccucaccgccgagaaccucuccugguacaaggacgacgaggagaaggagaagaaguacaugcucuccgucgacaaccucaagcuccgcgacgucgagaagggcuucauguccuccaagcacaucuucgcccucuucaacaccgagcagcgcaacgucuacaaggacuaccgccagcucgagcucgccugcgagacccaggaggaggucgacuccuggaaggccuccuuccuccgcgccggcgucuaccccgagcgcgucggcgacaaggagaaggccuccgagaccgaggagaacggcuccgacuccuucaugcacuccauggacccccagcucgagcgccaggucgagaccauccgcaaccucgucgacuccuacauggccaucgucaacaagaccguccgcgaccucaugcccaagaccaucaugcaccucaugaucaacaacaccaaggaguucaucuucuccgagcuccucgccaaccucuacuccugcggcgaccagaacacccucauggaggaguccgccgagcaggcccagcgccgcgacgagaugcuccgcauguaccacgcccucaaggaggcccucuccaucaucggcgacaucaacaccaccaccgucuccacccccaugcccccccccgucgacgacuccuggcuccagguccaguccguccccgccggccgccgcucccccaccuccucccccaccccccagcgccgcgcccccgccgucccccccgcccgccccggcucccgcggccccgcccccggccccccccccgccggcuccgcccucggcggcgccccccccguccccucccgccccggcgccucccccgaccccuucggcccccccccccagguccccucccgccccaaccgcgccccccccggcgucccccgcaucaccaucuccgaccccuga

SEQ ID NO: 42359 - RNA, 2178 nt, Artificial Sequence
  derived and/or modified sequence opt2 from DNM1L__Homo_sapiens__NP_001265392
auggaggcccucauccccgucaucaacaagcuccaggacgucuucaacaccgucggcgccgacaucauccagcucccccagaucgucgucgucggcacccaguccuccggcaaguccuccguccucgagucccucgucggccgcgaccuccucccccgcggcaccggcaucgucacccgccgcccccucauccuccagcucguccacgucucccaggaggacaagcgcaagaccaccggcgaggagaacggcgucgaggccgaggaguggggcaaguuccuccacaccaagaacaagcucuacaccgacuucgacgagauccgccaggagaucgagaacgagaccgagcgcaucuccggcaacaacaagggcgucucccccgagcccauccaccucaagaucuucucccccaacgucgucaaccucacccucgucgaccuccccggcaugaccaagguccccgucggcgaccagcccaaggacaucgagcuccagauccgcgagcucauccuccgcuucaucuccaaccccaacuccaucauccucgccgucaccgccgccaacaccgacauggccaccuccgaggcccucaagaucucccgcgaggucgaccccgacggccgccgcacccucgccgucaucaccaagcucgaccucauggacgccggcaccgacgccauggacguccucaugggccgcgucauccccgucaagcucggcaucaucggcgucgucaaccgcucccagcucgacaucaacaacaagaaguccgucaccgacuccauccgcgacgaguacgccuuccuccagaagaaguaccccucccucgccaaccgcaacggcaccaaguaccucgcccgcacccucaaccgccuccucaugcaccacauccgcgacugccuccccgagcucaagacccgcaucaacguccucgccgcccaguaccagucccuccucaacuccuacggcgagcccgucgacgacaaguccgccacccuccuccagcucaucaccaaguucgccaccgaguacugcaacaccaucgagggcaccgccaaguacaucgagaccuccgagcucugcggcggcgcccgcaucugcuacaucuuccacgagaccuucggccgcacccucgaguccgucgacccccucggcggccucaacaccaucgacauccucaccgccauccgcaacgccaccggcccccgccccgcccucuucguccccgaggucuccuucgagcuccucgucaagcgccagaucaagcgccucgaggagcccucccuccgcugcgucgagcucguccacgaggagaugcagcgcaucauccagcacugcuccaacuacuccacccaggagcuccuccgcuuccccaagcuccacgacgccaucgucgaggucgucaccugccuccuccgcaagcgccuccccgucaccaacgagaugguccacaaccucgucgccaucgagcucgccuacaucaacaccaagcaccccgacuucgccgacgccugcggccucaugaacaacaacaucgaggagcagcgccgcaaccgccucgcccgcgagcuccccuccgccgucucccgcgacaaguccuccaagguccccuccgcccucgcccccgccucccaggagcccucccccgccgccuccgccgaggccgacggcaaggucgccuccggcggcggcggcgucggcgacggcguccaggagcccaccaccggcaacuggcgcggcaugcucaagaccuccaaggccgaggagcuccucgccgaggagaaguccaagcccauccccaucaugcccgccuccccccagaagggccacgccgucaaccuccucgacguccccguccccgucgcccgcaagcucuccgcccgcgagcagcgcgacugcgaggucaucgagcgccucaucaaguccuacuuccucaucguccgcaagaacauccaggacuccguccccaaggccgucaugcacuuccucgucaaccacgucaaggacacccuccaguccgagcucgucggccagcucuacaaguccucccuccucgacgaccuccucaccgaguccgaggacauggcccagcgccgcaaggaggccgccgacaugcucaaggcccuccagggcgccucccagaucaucgccgagauccgcgagacccaccucugguga

SEQ ID NO: 42360 - RNA, 2613 nt, Artificial Sequence
  derived and/or modified sequence opt2 from DNM2__Homo_sapiens__NP_001005360
augggcaaccgcggcauggaggagcucaucccccucgucaacaagcuccaggacgccuucuccuccaucggccaguccugccaccucgaccucccccagaucgccgucgucggcggccaguccgccggcaaguccuccguccucgagaacuucgucggccgcgacuuccucccccgcggcuccggcaucgucacccgccgcccccucauccuccagcucaucuucuccaagaccgagcacgccgaguuccuccacugcaaguccaagaaguucaccgacuucgacgagguccgccaggagaucgaggccgagaccgaccgcgucaccggcaccaacaagggcaucucccccguccccaucaaccuccgcgucuacuccccccacguccucaaccucacccucaucgaccuccccggcaucaccaagguccccgucggcgaccagccccccgacaucgaguaccagaucaaggacaugauccuccaguucaucucccgcgaguccucccucauccucgccgucacccccgccaacauggaccucgccaacuccgacgcccucaagcucgccaaggaggucgacccccagggccuccgcaccaucggcgucaucaccaagcucgaccucauggacgagggcaccgacgcccgcgacguccucgagaacaagcuccucccccuccgccgcggcuacaucggcgucgucaaccgcucccagaaggacaucgagggcaagaaggacauccgcgccgcccucgccgccgagcgcaaguucuuccucucccaccccgccuaccgccacauggccgaccgcaugggcaccccccaccuccagaagacccucaaccagcagcucaccaaccacauccgcgagucccuccccgcccuccgcuccaagcuccagucccagcuccucucccucgagaaggaggucgaggaguacaagaacuuccgccccgacgaccccacccgcaagaccaaggcccuccuccagaugguccagcaguucggcgucgacuucgagaagcgcaucgagggcuccggcgaccaggucgacacccucgagcucuccggcggcgcccgcaucaaccgcaucuuccacgagcgcuuccccuucgagcucgucaagauggaguucgacgagaaggaccuccgccgcgagaucuccuacgccaucaagaacauccacggcguccgcaccggccucuucacccccgaccucgccuucgaggccaucgucaagaagcaggucgucaagcucaaggagcccugccucaagugcgucgaccucgucauccaggagcucaucaacaccguccgccagugcaccuccaagcucuccuccuacccccgccuccgcgaggagaccgagcgcaucgucaccaccuacauccgcgagcgcgagggccgcaccaaggaccagauccuccuccucaucgacaucgagcaguccuacaucaacaccaaccacgaggacuucaucggcuucgccaacgcccagcagcgcuccacccagcucaacaagaagcgcgccauccccaaccagggcgagauccucgucauccgccgcggcuggcucaccaucaacaacaucucccucaugaagggcggcuccaaggaguacugguucguccucaccgccgagucccucuccugguacaaggacgaggaggagaaggagaagaaguacaugcucccccucgacaaccucaagauccgcgacgucgagaagggcuucauguccaacaagcacgucuucgccaucuucaacaccgagcagcgcaacgucuacaaggaccuccgccagaucgagcucgccugcgacucccaggaggacgucgacuccuggaaggccuccuuccuccgcgccggcgucuaccccgagaaggaccaggccgagaacgaggacggcgcccaggagaacaccuucuccauggacccccagcucgagcgccaggucgagaccauccgcaaccucgucgacuccuacgucgccaucaucaacaaguccauccgcgaccucaugcccaagaccaucaugcaccucaugaucaacaacaccaaggccuucauccaccacgagcuccucgccuaccucuacuccuccgccgaccaguccucccucauggaggaguccgccgaccaggcccagcgccgcgacgacaugcuccgcauguaccacgcccucaaggaggcccucaacaucaucggcgacaucuccaccuccaccgucuccacccccguccccccccccgucgacgacaccuggcuccaguccgccuccucccacucccccaccccccagcgccgccccgucuccuccauccacccccccggccgcccccccgccguccgcggccccacccccggccccccccucauccccguccccgucggcgccgccgccuccuucuccgccccccccauccccucccgccccggcccccaguccgucuucgccaacuccgaccucuuccccgcccccccccagauccccucccgccccguccgcaucccccccggcaucccccccggcguccccucccgccgcccccccgccgcccccucccgccccaccaucauccgccccgccgagcccucccuccucgacuga

SEQ ID NO: 42361 - RNA, 2580 nt, Artificial Sequence
  derived and/or modified sequence opt2 from DNM3__Homo_sapiens__NP_001129599
augggcaaccgcgagauggaggagcucaucccccucgucaaccgccuccaggacgccuucuccgcccucggccaguccugccuccucgagcucccccagaucgccgucgucggcggccaguccgccggcaaguccuccguccucgagaacuucgucggccgcgacuuccucccccgcggcuccggcaucgucacccgccgcccccucguccuccagcucgucaccuccaaggccgaguacgccgaguuccuccacugcaagggcaagaaguucaccgacuucgacgagguccgccucgagaucgaggccgagaccgaccgcgucaccggcaugaacaagggcaucuccuccauccccaucaaccuccgcgucuacuccccccacguccucaaccucacccucaucgaccuccccggcaucaccaagguccccgucggcgaccagccccccgacaucgaguaccagauccgcgagaugaucaugcaguucaucacccgcgagaacugccucauccucgccgucacccccgccaacaccgaccucgccaacuccgacgcccucaagcucgccaaggaggucgacccccagggccuccgcaccaucggcgucaucaccaagcucgaccucauggacgagggcaccgacgcccgcgacguccucgagaacaagcuccucccccuccgccgcggcuacgucggcgucgucaaccgcucccagaaggacaucgacggcaagaaggacaucaaggccgccaugcucgccgagcgcaaguucuuccucucccaccccgccuaccgccacaucgccgaccgcaugggcaccccccaccuccagaagguccucaaccagcagcucaccaaccacauccgcgacacccuccccaacuuccgcaacaagcuccagggccagcuccucuccaucgagcacgaggucgaggccuacaagaacuucaagcccgaggaccccacccgcaagaccaaggcccuccuccagaugguccagcaguucgccgucgacuucgagaagcgcaucgagggcuccggcgaccaggucgacacccucgagcucuccggcggcgccaagaucaaccgcaucuuccacgagcgcuuccccuucgagaucgucaagauggaguucaacgagaaggagcuccgccgcgagaucuccuacgccaucaagaacauccacggcauccgcaccggccucuucacccccgacauggccuucgaggccaucgucaagaagcagaucgucaagcucaagggccccucccucaaguccgucgaccucgucauccaggagcucaucaacaccgucaagaagugcaccaagaagcucgccaacuucccccgccucugcgaggagaccgagcgcaucgucgccaaccacauccgcgagcgcgagggcaagaccaaggaccagguccuccuccucaucgacauccaggucuccuacaucaacaccaaccacgaggacuucaucggcuucgccaacgcccagcagcgcuccucccagguccacaagaagaccaccgucggcaaccaggucauccgcaagggcuggcucaccaucuccaacaucggcaucaugaagggcggcuccaagggcuacugguucguccucaccgccgagucccucuccugguacaaggacgacgaggagaaggagaagaaguacaugcucccccucgacaaccucaagguccgcgacgucgagaaguccuucauguccuccaagcacaucuucgcccucuucaacaccgagcagcgcaacgucuacaaggacuaccgcuuccucgagcucgccugcgacucccaggaggacgucgacuccuggaaggccucccuccuccgcgccggcgucuaccccgacaaguccgucgccgagaacgacgagaacggccaggccgagaacuucuccauggacccccagcucgagcgccaggucgagaccauccgcaaccucgucgacuccuacauguccaucaucaacaagugcauccgcgaccucauccccaagaccaucaugcaccucaugaucaacaacgucaaggacuucaucaacuccgagcuccucgcccagcucuacuccuccgaggaccagaacacccucauggaggaguccgccgagcaggcccagcgccgcgacgagaugcuccgcauguaccaggcccucaaggaggcccucggcaucaucggcgacaucuccaccgccaccgucuccacccccgcccccccccccgucgacgacuccuggauccagcacucccgccgcucccccccccccucccccaccacccagcgccgccccacccucuccgccccccucgcccgccccaccuccggccgcggccccgcccccgccauccccucccccggcccccacuccggcgccccccccguccccuuccgccccggcccccucccccccuuccccuccuccuccgacuccuucggcgcccccccccagguccccucccgccccacccgcgccccccccuccguccccucccgccgccccccccccucccccacccgccccaccaucauccgcccccucgaguccucccuccucgacuga

SEQ ID NO: 42362 - RNA, 4734 nt, Artificial Sequence
  derived and/or modified sequence opt2 from DNMBP__Homo_sapiens__NP_056036
auggaggccggcuccgucguccgcgccaucuucgacuucugccccuccgucuccgaggagcucccccucuucgucggcgacaucaucgagguccucgccgucgucgacgaguucuggcuccucggcaagaaggaggacgucaccggccaguuccccuccuccuucgucgagaucgucaccauccccucccucaaggagggcgagcgccucuucgucugcaucugcgaguucaccucccaggagcucgacaaccucccccuccaccgcggcgaccucgucauccucgacggcauccccaccgccggcuggcuccagggccgcuccugcuggggcgcccgcggcuucuuccccuccuccugcguccgcgagcucugccucuccucccagucccgccaguggcacucccaguccgcccucuuccagauccccgaguacuccaugggccaggcccgcgcccucaugggccucuccgcccagcucgacgaggagcucgacuuccgcgagggcgacgucaucaccaucaucggcguccccgagcccggcugguucgagggcgagcucgagggccgccgcggcaucuuccccgagggcuucgucgagcuccucggcccccuccgcaccgucgacgaguccgucuccuccggcaaccaggacgacugcaucgucaacggcgaggucgacacccccgucggcgaggaggagaucggccccgacgaggacgaggaggagcccggcaccuacggcgucgcccucuaccgcuuccaggcccucgagcccaacgagcucgacuucgaggucggcgacaagauccgcauccucgccacccucgaggacggcuggcucgagggcucccucaagggccgcaccggcaucuuccccuaccgcuucgucaagcucugccccgacacccgcgucgaggagaccauggcccucccccaggagggcucccucgcccgcauccccgagaccucccucgacugccucgagaacacccucggcgucgaggagcagcgccacgagaccuccgaccacgaggccgaggagcccgacugcaucaucuccgaggcccccaccuccccccucggccaccucaccuccgaguacgacaccgaccgcaacuccuaccaggacgaggacaccgccggcggccccccccgcucccccggcgucgagugggagaugccccucgccaccgacucccccaccuccgaccccaccgaggucgucaacggcaucuccucccagccccagguccccuuccaccccaaccuccagaagucccaguacuacuccaccgucggcggcucccacccccacuccgagcaguaccccgaccuccucccccucgaggcccgcacccgcgacuacgccucccucccccccaagcgcauguacucccagcucaagacccuccagaagcccguccucccccucuaccgcggcuccuccgucuccgccucccgcgucgucaagccccgccaguccuccccccagcuccacaaccucgccuccuacaccaagaagcaccacaccuccuccgucuacuccaucuccgagcgccucgagaugaagcccggcccccaggcccagggccucgucauggaggccgccacccacucccagggcgacggcuccaccgaccucgacuccaagcucacccagcagcucaucgaguucgagaagucccucgccggccccggcaccgagcccgacaagauccuccgccacuucuccaucauggacuucaacuccgagaaggacaucguccgcggcuccuccaagcucaucaccgagcaggagcuccccgagcgccgcaaggcccuccgccccccccccccccgccccugcacccccgucuccaccuccccccaccuccucgucgaccagaaccucaagcccgcccccccccucgucguccgccccucccgccccgccccccucccccccuccgcccagcagcgcaccaacgccgucucccccaagcuccucucccgccaccgccccaccugcgagacccucgagaaggagggccccggccacaugggccgcucccucgaccagaccucccccugcccccucguccucguccgcaucgaggagauggagcgcgaccucgacauguacucccgcgcccaggaggagcucaaccucaugcucgaggagaagcaggacgaguccucccgcgccgagacccucgaggaccucaaguucugcgaguccaacaucgagucccucaacauggagcuccagcagcuccgcgagaugacccuccucuccucccaguccuccucccucgucgcccccuccggcuccgucuccgccgagaaccccgagcagcgcaugcucgagaagcgcgccaaggucaucgaggagcuccuccagaccgagcgcgacuacauccgcgaccucgagaugugcaucgagcgcaucaugguccccaugcagcaggcccagguccccaacaucgacuucgagggccucuucggcaacaugcagauggucaucaaggucuccaagcagcuccucgccgcccucgagaucuccgacgccgucggccccgucuuccucggccaccgcgacgagcucgagggcaccuacaagaucuacugccagaaccacgacgaggccaucgcccuccucgagaucuacgagaaggacgagaagauccagaagcaccuccaggacucccucgccgaccucaagucccucuacaacgaguggggcugcaccaacuacaucaaccucggcuccuuccucaucaagcccguccagcgcgucaugcgcuacccccuccuccucauggagcuccucaacuccacccccgagucccaccccgacaaggucccccucaccaacgccguccucgccgucaaggagaucaacgucaacaucaacgaguacaagcgccgcaaggaccucguccucaaguaccgcaagggcgacgaggacucccucauggagaagaucuccaagcucaacauccacuccaucaucaagaaguccaaccgcgucuccucccaccucaagcaccucaccggcuucgccccccagaucaaggacgaggucuucgaggagaccgagaagaacuuccgcaugcaggagcgccucaucaaguccuucauccgcgaccucucccucuaccuccagcacauccgcgaguccgccugcgucaaggucgucgccgccgucuccaugugggacgucugcauggagcgcggccaccgcgaccucgagcaguucgagcgcguccaccgcuacaucuccgaccagcucuucaccaacuucaaggagcgcaccgagcgccucgucaucuccccccucaaccagcuccucuccauguucaccggcccccacaagcucguccagaagcgcuucgacaagcuccucgacuucuacaacugcaccgagcgcgccgagaagcucaaggacaagaagacccucgaggagcuccaguccgcccgcaacaacuacgaggcccucaacgcccagcuccucgacgagcuccccaaguuccaccaguacgcccagggccucuucaccaacugcguccacggcuacgccgaggcccacugcgacuucguccaccaggcccucgagcagcucaagccccuccucucccuccucaaggucgccggccgcgagggcaaccucaucgccaucuuccacgaggagcacucccgcguccuccagcagcuccaggucuucaccuucuuccccgagucccuccccgccaccaagaagcccuucgagcgcaagaccaucgaccgccaguccgcccgcaagccccuccucggccuccccuccuacaugcuccaguccgaggagcuccgcgccucccuccucgcccgcuacccccccgagaagcucuuccaggccgagcgcaacuucaacgccgcccaggaccucgacgucucccuccucgagggcgaccucgucggcgucaucaagaagaaggaccccaugggcucccagaaccgcuggcucaucgacaacggcgucaccaagggcuucgucuacuccuccuuccucaagcccuacaacccccgccgcucccacuccgacgccuccgucggcucccacuccuccaccgaguccgagcacggcuccuccuccccccgcuucccccgccagaacuccggcuccacccucaccuucaaccccuccuccauggccgucuccuucaccuccggcuccugccagaagcagccccaggacgccucccccccccccaaggagugcgaccagggcacccucuccgccucccucaaccccuccaacuccgaguccucccccucccgcugccccuccgaccccgacuccaccucccagccccgcuccggcgacuccgccgacgucgcccgcgacgucaagcagcccaccgccaccccccgcuccuaccgcaacuuccgccaccccgagaucgucggcuacuccguccccggccgcaacggccagucccaggaccucgucaagggcugcgcccgcaccgcccaggcccccgaggaccgcuccaccgagcccgacggcuccgaggccgagggcaaccaggucuacuucgccgucuacaccuucaaggcccgcaaccccaacgagcucuccgucuccgccaaccagaagcucaagauccucgaguucaaggacgucaccggcaacaccgagugguggcucgccgaggucaacggcaagaagggcuacguccccuccaacuacauccgcaagaccgaguacaccuga

SEQ ID NO: 42363 - RNA, 4899 nt, Artificial Sequence
  derived and/or modified sequence opt2 from DNMT1__Homo_sapiens__NP_001124295
augcccgcccgcaccgcccccgcccgcguccccacccucgccguccccgccaucucccuccccgacgacguccgccgccgccucaaggaccucgagcgcgacucccucaccgagaaggagugcgucaaggagaagcucaaccuccuccacgaguuccuccagaccgagaucaagaaccagcucugcgaccucgagaccaagcuccgcaaggaggagcucuccgaggagggcuaccucgccaaggucaagucccuccucaacaaggaccucucccucgagaacggcgcccacgccuacaaccgcgaggucaacggccgccucgagaacggcaaccaggcccgcuccgaggcccgccgcgucggcauggccgacgccaacuccccccccaagccccucuccaagccccgcaccccccgccgcuccaaguccgacggcgaggccaagcgcucccgcgacccccccgccuccgccucccaggucaccggcauccgcgccgagcccucccccuccccccgcaucacccgcaaguccacccgccagaccaccaucaccucccacuucgccaagggccccgccaagcgcaagccccaggaggaguccgagcgcgccaaguccgacgaguccaucaaggaggaggacaaggaccaggacgagaagcgccgccgcgucaccucccgcgagcgcgucgcccgcccccuccccgccgaggagcccgagcgcgccaaguccggcacccgcaccgagaaggaggaggagcgcgacgagaaggaggagaagcgccuccgcucccagaccaaggagcccacccccaagcagaagcucaaggaggagcccgaccgcgaggcccgcgccggcguccaggccgacgaggacgaggacggcgacgagaaggacgagaagaagcaccgcucccagcccaaggaccucgccgccaagcgccgccccgaggagaaggagcccgagaaggucaacccccagaucuccgacgagaaggacgaggacgagaaggaggagaagcgccgcaagaccacccccaaggagcccaccgagaagaagauggcccgcgccaagaccgucaugaacuccaagacccacccccccaagugcauccagugcggccaguaccucgacgaccccgaccucaaguacggccagcacccccccgacgccgucgacgagccccagaugcucaccaacgagaagcucuccaucuucgacgccaacgaguccggcuucgaguccuacgaggcccucccccagcacaagcucaccugcuucuccgucuacugcaagcacggccaccucugccccaucgacaccggccucaucgagaagaacaucgagcucuucuucuccggcuccgccaagcccaucuacgacgacgaccccucccucgagggcggcgucaacggcaagaaccucggccccaucaacgagugguggaucaccggcuucgacggcggcgagaaggcccucaucggcuucuccaccuccuucgccgaguacauccucauggaccccucccccgaguacgcccccaucuucggccucaugcaggagaagaucuacaucuccaagaucgucgucgaguuccuccaguccaacuccgacuccaccuacgaggaccucaucaacaagaucgagaccaccgucccccccuccggccucaaccucaaccgcuucaccgaggacucccuccuccgccacgcccaguucgucgucgagcaggucgaguccuacgacgaggccggcgacuccgacgagcagcccaucuuccucacccccugcaugcgcgaccucaucaagcucgccggcgucacccucggccagcgccgcgcccaggcccgccgccagaccauccgccacuccacccgcgagaaggaccgcggccccaccaaggccaccaccaccaagcucgucuaccagaucuucgacaccuucuucgccgagcagaucgagaaggacgaccgcgaggacaaggagaacgccuucaagcgccgccgcugcggcgucugcgaggucugccagcagcccgagugcggcaagugcaaggccugcaaggacauggucaaguucggcggcuccggccgcuccaagcaggccugccaggagcgccgcugccccaacauggccaugaaggaggccgacgacgacgaggaggucgacgacaacauccccgagaugcccucccccaagaagaugcaccagggcaagaagaagaagcagaacaagaaccgcaucuccugggucggcgaggccgucaagaccgacggcaagaaguccuacuacaagaaggucugcaucgacgccgagacccucgaggucggcgacugcgucuccgucauccccgacgacuccuccaagccccucuaccucgcccgcgucaccgcccucugggaggacuccuccaacggccagauguuccacgcccacugguucugcgccggcaccgacaccguccucggcgccaccuccgacccccucgagcucuuccucgucgacgagugcgaggacaugcagcucuccuacauccacuccaaggucaaggucaucuacaaggcccccuccgagaacugggccauggagggcggcauggaccccgagucccuccucgagggcgacgacggcaagaccuacuucuaccagcucugguacgaccaggacuacgcccgcuucgaguccccccccaagacccagcccaccgaggacaacaaguucaaguucugcgucuccugcgcccgccucgccgagaugcgccagaaggagaucccccgcguccucgagcagcucgaggaccucgacucccgcguccucuacuacuccgccaccaagaacggcauccucuaccgcgucggcgacggcgucuaccucccccccgaggccuucaccuucaacaucaagcucuccucccccgucaagcgcccccgcaaggagcccgucgacgaggaccucuaccccgagcacuaccgcaaguacuccgacuacaucaagggcuccaaccucgacgcccccgagcccuaccgcaucggccgcaucaaggagaucuucugccccaagaaguccaacggccgccccaacgagaccgacaucaagauccgcgucaacaaguucuaccgccccgagaacacccacaaguccacccccgccuccuaccacgccgacaucaaccuccucuacugguccgacgaggaggccgucgucgacuucaaggccguccagggccgcugcaccgucgaguacggcgaggaccuccccgagugcguccaggucuacuccaugggcggccccaaccgcuucuacuuccucgaggccuacaacgccaaguccaaguccuucgaggacccccccaaccacgcccgcucccccggcaacaagggcaagggcaagggcaagggcaagggcaagcccaagucccaggccugcgagcccuccgagcccgagaucgagaucaagcuccccaagcuccgcacccucgacgucuucuccggcugcggcggccucuccgagggcuuccaccaggccggcaucuccgacacccucugggccaucgagaugugggaccccgccgcccaggccuuccgccucaacaaccccggcuccaccgucuucaccgaggacugcaacauccuccucaagcucgucauggccggcgagaccaccaacucccgcggccagcgccucccccagaagggcgacgucgagaugcucugcggcggcccccccugccagggcuucuccggcaugaaccgcuucaacucccgcaccuacuccaaguucaagaacucccucgucgucuccuuccucuccuacugcgacuacuaccgcccccgcuucuuccuccucgagaacguccgcaacuucgucuccuucaagcgcuccaugguccucaagcucacccuccgcugccucguccgcaugggcuaccagugcaccuucggcguccuccaggccggccaguacggcgucgcccagacccgccgccgcgccaucauccucgccgccgcccccggcgagaagcucccccucuuccccgagccccuccacgucuucgccccccgcgccugccagcucuccgucgucgucgacgacaagaaguucgucuccaacaucacccgccucuccuccggccccuuccgcaccaucaccguccgcgacaccauguccgaccuccccgagguccgcaacggcgccuccgcccucgagaucuccuacaacggcgagccccaguccugguuccagcgccagcuccgcggcgcccaguaccagcccauccuccgcgaccacaucugcaaggacauguccgcccucgucgccgcccgcaugcgccacaucccccucgcccccggcuccgacuggcgcgaccuccccaacaucgagguccgccucuccgacggcaccauggcccgcaagcuccgcuacacccaccacgaccgcaagaacggccgcuccuccuccggcgcccuccgcggcgucugcuccugcgucgaggccggcaaggccugcgaccccgccgcccgccaguucaacacccucauccccuggugccucccccacaccggcaaccgccacaaccacugggccggccucuacggccgccucgagugggacggcuucuucuccaccaccgucaccaaccccgagcccaugggcaagcagggccgcguccuccaccccgagcagcaccgcgucgucuccguccgcgagugcgcccgcucccagggcuuccccgacaccuaccgccucuucggcaacauccucgacaagcaccgccaggucggcaacgccgucccccccccccucgccaaggccaucggccucgagaucaagcucugcaugcucgccaaggcccgcgaguccgccuccgccaagaucaaggaggaggaggccgccaaggacuga

SEQ ID NO: 42364 - RNA, 2172 nt, Artificial Sequence
  derived and/or modified sequence opt2 from DNMT3A__Homo_sapiens__NP_715640
augggcauccucgagcgcgucguccgccgcaacggccgcgucgaccgcucccucaaggacgagugcgacaccgccgagaagaaggccaaggucaucgccggcaugaacgccgucgaggagaaccagggccccggcgagucccagaaggucgaggaggccuccccccccgccguccagcagcccaccgaccccgccucccccaccgucgccaccacccccgagcccgucggcuccgacgccggcgacaagaacgccaccaaggccggcgacgacgagcccgaguacgaggacggccgcggcuucggcaucggcgagcucgucuggggcaagcuccgcggcuucuccugguggcccggccgcaucgucuccugguggaugaccggccgcucccgcgccgccgagggcacccgcugggucaugugguucggcgacggcaaguucuccgucgucugcgucgagaagcucaugccccucuccuccuucugcuccgccuuccaccaggccaccuacaacaagcagcccauguaccgcaaggccaucuacgagguccuccaggucgccuccucccgcgccggcaagcucuuccccgucugccacgacuccgacgaguccgacaccgccaaggccgucgagguccagaacaagcccaugaucgagugggcccucggcggcuuccagcccuccggccccaagggccucgagccccccgaggaggagaagaaccccuacaaggaggucuacaccgacaugugggucgagcccgaggccgccgccuacgccccccccccccccgccaagaagccccgcaaguccaccgccgagaagcccaaggucaaggagaucaucgacgagcgcacccgcgagcgccucgucuacgagguccgccagaagugccgcaacaucgaggacaucugcaucuccugcggcucccucaacgucacccucgagcacccccucuucgucggcggcaugugccagaacugcaagaacugcuuccucgagugcgccuaccaguacgacgacgacggcuaccaguccuacugcaccaucugcugcggcggccgcgagguccucaugugcggcaacaacaacugcugccgcugcuucugcgucgagugcgucgaccuccucgucggccccggcgccgcccaggccgccaucaaggaggaccccuggaacugcuacaugugcggccacaagggcaccuacggccuccuccgccgccgcgaggacuggcccucccgccuccagauguucuucgccaacaaccacgaccaggaguucgacccccccaaggucuacccccccguccccgccgagaagcgcaagcccauccgcguccucucccucuucgacggcaucgccaccggccuccucguccucaaggaccucggcauccaggucgaccgcuacaucgccuccgaggucugcgaggacuccaucaccgucggcaugguccgccaccagggcaagaucauguacgucggcgacguccgcuccgucacccagaagcacauccaggaguggggccccuucgaccucgucaucggcggcucccccugcaacgaccucuccaucgucaaccccgcccgcaagggccucuacgagggcaccggccgccucuucuucgaguucuaccgccuccuccacgacgcccgccccaaggagggcgacgaccgccccuucuucuggcucuucgagaacgucgucgccaugggcgucuccgacaagcgcgacaucucccgcuuccucgaguccaaccccgucaugaucgacgccaaggaggucuccgccgcccaccgcgcccgcuacuucuggggcaaccuccccggcaugaaccgcccccucgccuccaccgucaacgacaagcucgagcuccaggagugccucgagcacggccgcaucgccaaguucuccaagguccgcaccaucaccacccgcuccaacuccaucaagcagggcaaggaccagcacuuccccgucuucaugaacgagaaggaggacauccucuggugcaccgagauggagcgcgucuucggcuuccccguccacuacaccgacgucuccaacaugucccgccucgcccgccagcgccuccucggccgcuccugguccguccccgucauccgccaccucuucgccccccucaaggaguacuucgccugcgucuga

SEQ ID NO: 42365 - RNA, 2187 nt, Artificial Sequence
  derived and/or modified sequence opt2 from DNMT3B__Homo_sapiens__NP_001193984
augaagggcgacacccgccaccucaacggcgaggaggacgccggcggccgcgaggacuccauccucgucaacggcgccugcuccgaccaguccuccgacuccccccccauccucgaggccauccgcacccccgagauccgcggccgccgcuccuccucccgccucuccaagcgcgaggucuccucccuccucuccuacacccaggaccucaccggcgacggcgacggcgaggacggcgacggcuccgacacccccgucaugcccaagcucuuccgcgagacccgcacccgcuccgagucccccgccucccuccgccgccgcgccaccgccuccgccggcacccccuggcccuccccccccuccuccuaccucaccaucgaccucaccgacgacaccgaggacacccacggcaccccccaguccuccuccacccccuacgcccgccucgcccaggacucccagcagggcggcauggaguccccccaggucgaggccgacuccggcgacggcgacuccuccgaguaccaggacggcaaggaguucggcaucggcgaccucgucuggggcaagaucaagggcuucuccugguggcccgccauggucgucuccuggaaggccaccuccaagcgccaggccauguccggcaugcgcuggguccagugguucggcgacggcaaguucuccgaggucuccgccgacaagcucgucgcccucggccucuucucccagcacuucaaccucgccaccuucaacaagcucgucuccuaccgcaaggccauguaccacgcccucgagaaggcccgcguccgcgccggcaagaccuuccccuccucccccggcgacucccucgaggaccagcucaagcccaugcucgagugggcccacggcggcuucaagcccaccggcaucgagggccucaagcccaacaacacccagcccgagaacaagacccgccgccgcaccgccgacgacuccgccaccuccgacuacugccccgcccccaagcgccucaagaccaacugcuacaacaacggcaaggaccgcggcgacgaggaccagucccgcgagcagauggccuccgacgucgccaacaacaaguccucccucgaggacggcugccucuccugcggccgcaagaaccccgucuccuuccacccccucuucgagggcggccucugccagaccugccgcgaccgcuuccucgagcucuucuacauguacgacgacgacggcuaccaguccuacugcaccgucugcugcgagggccgcgagcuccuccucugcuccaacaccuccugcugccgcugcuucugcgucgagugccucgagguccucgucggcaccggcaccgccgccgaggccaagcuccaggagcccugguccugcuacaugugccucccccagcgcugccacggcguccuccgccgccgcaaggacuggaacguccgccuccaggccuucuucaccuccgacaccggccucgaguacgaggcccccaagcucuaccccgccauccccgccgcccgccgccgccccauccgcguccucucccucuucgacggcaucgccaccggcuaccucguccucaaggagcucggcaucaaggucggcaaguacgucgccuccgaggucugcgaggaguccaucgccgucggcaccgucaagcacgagggcaacaucaaguacgucaacgacguccgcaacaucaccaagaagaacaucgaggaguggggccccuucgaccucgucaucggcggcucccccugcaacgaccucuccaacgucaaccccgcccgcaagggccucuacgagggcaccggccgccucuucuucgaguucuaccaccuccucaacuacucccgccccaaggagggcgacgaccgccccuucuucuggauguucgagaacgucgucgccaugaaggucggcgacaagcgcgacaucucccgcuuccucgagugcaaccccgucaugaucgacgccaucaaggucuccgccgcccaccgcgcccgcuacuucuggggcaaccuccccggcaugaaccgcaucuucggcuuccccguccacuacaccgacgucuccaacaugggccgcggcgcccgccagaagcuccucggccgcuccugguccguccccgucauccgccaccucuucgccccccucaaggacuacuucgccugcgaguga

SEQ ID NO: 42366 - RNA, 1161 nt, Artificial Sequence
  derived and/or modified sequence opt2 from DNMT3L__Homo_sapiens__NP_787063
auggccgccauccccgcccucgaccccgaggccgagcccuccauggacgucauccucgucggcuccuccgagcucuccuccuccgucucccccggcaccggccgcgaccucaucgccuacgaggucaaggccaaccagcgcaacaucgaggacaucugcaucugcugcggcucccuccagguccacacccagcacccccucuucgagggcggcaucugcgcccccugcaaggacaaguuccucgacgcccucuuccucuacgacgacgacggcuaccaguccuacugcuccaucugcugcuccggcgagacccuccucaucugcggcaaccccgacugcacccgcugcuacugcuucgagugcgucgacucccucgucggccccggcaccuccggcaagguccacgccauguccaacugggucugcuaccucugccuccccuccucccgcuccggccuccuccagcgccgccgcaaguggcgcucccagcucaaggccuucuacgaccgcgaguccgagaacccccucgagauguucgagaccguccccgucuggcgccgccagcccguccgcguccucucccucuucgaggacaucaagaaggagcucaccucccucggcuuccucgaguccggcuccgaccccggccagcucaagcacgucgucgacgucaccgacaccguccgcaaggacgucgaggaguggggccccuucgaccucgucuacggcgccacccccccccucggccacaccugcgaccgcccccccuccugguaccucuuccaguuccaccgccuccuccaguacgcccgccccaagcccggcuccccccgccccuucuucuggauguucgucgacaaccucguccucaacaaggaggaccucgacgucgccucccgcuuccucgagauggagcccgucaccauccccgacguccacggcggcucccuccagaacgccguccgcgucugguccaacauccccgccauccgcucccgccacugggcccucgucuccgaggaggagcucucccuccucgcccagaacaagcaguccuccaagcucgccgccaaguggcccaccaagcucgucaagaacugcuuccucccccuccgcgaguacuucaaguacuucuccaccgagcucaccuccucccucuga

SEQ ID NO: 42367 - RNA, 1458 nt, Artificial Sequence
  derived and/or modified sequence opt2 from DNPEP__Homo_sapiens__NP_036232
auguccggccacucccccacccgcggcgccaugcaggucgccaugaacggcaaggcccgcaaggaggccguccagaccgccgccaaggagcuccucaaguucgucaaccgcucccccucccccuuccacgccgucgccgagugccgcaaccgccuccuccaggccggcuucuccgagcucaaggagaccgagaaguggaacaucaagcccgaguccaaguacuucaugacccgcaacuccuccaccaucaucgccuucgccgucggcggccaguacguccccggcaacggcuucucccucaucggcgcccacaccgacucccccugccuccgcgucaagcgccgcucccgccgcucccaggucggcuuccagcaggucggcgucgagaccuacggcggcggcaucugguccaccugguucgaccgcgaccucacccucgccggccgcgucaucgucaagugccccaccuccggccgccucgagcagcagcucguccacgucgagcgccccauccuccgcaucccccaccucgccauccaccuccagcgcaacaucaacgagaacuucggccccaacaccgagaugcaccucguccccauccucgccaccgccauccaggaggagcucgagaagggcacccccgagcccggcccccucaacgccgucgacgagcgccaccacuccguccucaugucccuccucugcgcccaccucggccucucccccaaggacaucgucgagauggagcucugccucgccgacacccagcccgccguccucggcggcgccuacgacgaguucaucuucgccccccgccucgacaaccuccacuccugcuucugcgcccuccaggcccucaucgacuccugcgccggccccggcucccucgccaccgagccccacguccgcauggucacccucuacgacaacgaggaggucggcuccgaguccgcccagggcgcccagucccuccucaccgagcucguccuccgccgcaucuccgccuccugccagcaccccaccgccuucgaggaggccauccccaaguccuucaugaucuccgccgacauggcccacgccguccaccccaacuaccucgacaagcacgaggagaaccaccgcccccucuuccacaagggccccgucaucaaggucaacuccaagcagcgcuacgccuccaacgccgucuccgaggcccucauccgcgaggucgccaacaaggucaaggucccccuccaggaccucaugguccgcaacgacacccccugcggcaccaccaucggccccauccucgccucccgccucggccuccgcguccucgaccucggcuccccccagcucgccaugcacuccauccgcgagauggccugcaccaccggcguccuccagacccucacccucuucaagggcuucuucgagcucuuccccucccucucccacaaccuccucgucgacuga

SEQ ID NO: 42368 - RNA, 1527 nt, Artificial Sequence
  derived and/or modified sequence opt2 from DNTT__Homo_sapiens__NP_001017520
auggaccccccccgcgccucccaccucuccccccgcaagaagcgcccccgccagaccggcgcccucauggccuccuccccccaggacaucaaguuccaggaccucgucgucuucauccucgagaagaagaugggcaccacccgccgcgccuuccucauggagcucgcccgccgcaagggcuuccgcgucgagaacgagcucuccgacuccgucacccacaucgucgccgagaacaacuccggcuccgacguccucgaguggcuccaggcccagaagguccaggucuccucccagcccgagcuccucgacgucuccuggcucaucgagugcauccgcgccggcaagcccgucgagaugaccggcaagcaccagcucgucguccgccgcgacuacuccgacuccaccaaccccggcccccccaagaccccccccaucgccguccagaagaucucccaguacgccugccagcgccgcaccacccucaacaacugcaaccagaucuucaccgacgccuucgacauccucgccgagaacugcgaguuccgcgagaacgaggacuccugcgucaccuucaugcgcgccgccuccguccucaagucccuccccuucaccaucaucuccaugaaggacaccgagggcauccccugccucggcuccaaggucaagggcaucaucgaggagaucaucgaggacggcgaguccuccgaggucaaggccguccucaacgacgagcgcuaccaguccuucaagcucuucaccuccgucuucggcgucggccucaagaccuccgagaagugguuccgcaugggcuuccgcacccucuccaagguccgcuccgacaagucccucaaguucacccgcaugcagaaggccggcuuccucuacuacgaggaccucgucuccugcgucacccgcgccgaggccgaggccgucuccguccucgucaaggaggccgucugggccuuccuccccgacgccuucgucaccaugaccggcggcuuccgccgcggcaagaagaugggccacgacgucgacuuccucaucaccucccccggcuccaccgaggacgaggagcagcuccuccagaaggucaugaaccucugggagaagaagggccuccuccucuacuacgaccucgucgaguccaccuucgagaagcuccgccuccccucccgcaaggucgacgcccucgaccacuuccagaagugcuuccucaucuucaagcucccccgccagcgcgucgacuccgaccaguccuccuggcaggagggcaagaccuggaaggccauccgcgucgaccucguccucugccccuacgagcgccgcgccuucgcccuccucggcuggaccggcucccgcuucgagcgcgaccuccgccgcuacgccacccacgagcgcaagaugauccucgacaaccacgcccucuacgacaagaccaagcgcaucuuccucaaggccgaguccgaggaggagaucuucgcccaccucggccucgacuacaucgagcccugggagcgcaacgccuga

SEQ ID NO: 42369 - RNA, 1203 nt, Artificial Sequence
  derived and/or modified sequence opt2 from DOC2A__Homo_sapiens__XP_011544277
augcgcggccgccgcggcgaccgcaugaccaucaacauccaggagcacauggccaucaacgucugccccggccccauccgccccauccgccagaucuccgacuacuucccccgcggccccggccccgagggcggcggcggcggcggcggcgaggcccccgcccaccucgucccccucgcccucgccccccccgccgcccuccucggcgccaccacccccgaggacggcgccgaggucgacuccuacgacuccgacgacgccaccgcccucggcacccucgaguucgaccuccucuacgaccgcgccuccugcacccuccacugcuccauccuccgcgccaagggccucaagcccauggacuucaacggccucgccgaccccuacgucaagcuccaccuccuccccggcgccugcaaggccaacaagcucaagaccaagacccagcgcaacacccucaaccccgucuggaacgaggaccucaccuacuccggcaucaccgacgacgacaucacccacaagguccuccgcaucgccgucugcgacgaggacaagcucucccacaacgaguucaucggcgagauccgcgucccccuccgccgccucaagcccucccagaagaagcacuucaacaucugccucgagcgccaggucccccucgccucccccuccuccauguccgccgcccuccgcggcaucuccugcuaccucaaggagcucgagcaggccgagcagggccagggccuccucgaggagcgcggccgcauccuccucucccucuccuacuccucccgccgccgcggccuccucgucggcauccuccgcugcgcccaccucgccgccauggacgucaacggcuacuccgaccccuacgucaagaccuaccuccgccccgacgucgacaagaaguccaagcacaagaccugcgucaagaagaagacccucaaccccgaguucaacgaggaguucuucuacgagaucgagcucuccacccucgccaccaagacccucgaggucaccgucugggacuacgacaucggcaaguccaacgacuucaucggcggcgucucccucggccccggcgcccgcggcgaggcccgcaagcacugguccgacugccuccagcagcccgacgccgcccucgagcgcuggcacacccucaccuccgagcucccccccgccgccggcgcccucuccuccgccuga

SEQ ID NO: 42370 - RNA, 1239 nt, Artificial Sequence
  derived and/or modified sequence opt2 from DOC2B__Homo_sapiens__NP_003576
augacccuccgccgccgcggcgagaaggccaccaucuccauccaggagcacauggccaucgacgucugccccggccccauccgccccaucaagcagaucuccgacuacuucccccgcuucccccgcggccucccccccgacgccggcccccgcgccgccgccccccccgacgcccccgcccgccccgccgucgccggcgccggccgccgcucccccuccgacggcgcccgcgaggacgacgaggacgucgaccagcucuucggcgccuacggcuccucccccggccccucccccggccccucccccgcccgcccccccgccaagccccccgaggacgagcccgacgccgacggcuacgaguccgacgacugcaccgcccucggcacccucgacuucucccuccucuacgaccaggagaacaacgcccuccacugcaccaucaccaaggccaagggccucaagcccauggaccacaacggccucgccgaccccuacgucaagcuccaccuccuccccggcgccuccaaggccaacaagcuccgcaccaagacccuccgcaacacccucaaccccaccuggaacgagacccucaccuacuacggcaucaccgacgaggacaugauccgcaagacccuccgcaucuccgucugcgacgaggacaaguuccgccacaacgaguucaucggcgagacccgcgucccccucaagaagcucaagcccaaccacaccaagaccuucuccaucugccucgagaagcagcuccccgucgacaagaccgaggacaagucccucgaggagcgcggccgcauccucaucucccucaaguacuccucccagaagcagggccuccucgucggcaucguccgcugcgcccaccucgccgccauggacgccaacggcuacuccgaccccuacgucaagaccuaccuccgccccgacgucgacaagaaguccaagcacaagaccgccgucaagaagaagacccucaaccccgaguucaacgaggaguucugcuacgagaucaagcacggcgaccucgccaagaagucccucgaggucaccgucugggacuacgacaucggcaaguccaacgacuucaucggcggcgucguccucggcauccacgccaagggcgagcgccucaagcacugguucgacugccucaagaacaaggacaagcgcaucgagcgcuggcacacccucaccuccgagcuccccggcgccguccucuccgacuga

SEQ ID NO: 42371 - RNA, 6543 nt, Artificial Sequence
  derived and/or modified sequence opt2 from DOCK10__Homo_sapiens__NP_001277192
auguccuuccgcggcaaggucuucaagcgcgagcccuccgaguucuggaagaagcgccgcaccguccgccgcgucaaccaggaggagauccaccgcuucuccucccaggagaagccccgccuccucgagccccucgacuacgagaccgucaucgaggagcucgagaagaccuaccgcaacgacccccuccaggaccuccucuucuuccccuccgacgacuucuccgccgccaccgucuccugggacauccgcacccucuacuccaccguccccgaggacgccgagcacaaggccgagaaccuccucgucaaggaggccugcaaguucuacuccucccaguggcacgucgucaacuacaaguacgagcaguacuccggcgacauccgccagcucccccgcgccgaguacaagcccgagaagcuccccucccacuccuucgagaucgaccacgaggacgccgacaaggacgaggacaccaccucccacuccuccuccaagggcggcggcggcgccggcggcaccggcgucuucaaguccggcuggcucuacaagggcaacuucaacuccaccgucaacaacaccgucaccguccgcuccuucaagaagcgcuacuuccagcucacccagcuccccgacaacuccuacaucaugaacuucuacaaggacgagaagaucuccaaggagcccaagggcugcaucuuccucgacuccugcaccggcgucguccagaacaaccgccuccgcaaguacgccuucgagcucaagaugaacgaccucaccuacuucguccucgccgccgagaccgaguccgacauggacgaguggauccacacccucaaccgcauccuccagaucucccccgagggcccccuccagggccgccgcuccaccgagcucaccgaccucggccucgacucccucgacaacuccgucaccugcgagugcacccccgaggagaccgacuccuccgagaacaaccuccacgccgacuucgccaaguaccucaccgagaccgaggacaccgucaagaccacccgcaacauggagcgccucaaccucuucucccucgaccccgacaucgacacccucaagcuccagaagaaggaccuccucgagcccgaguccgucaucaagcccuucgaggagaaggccgccaagcgcaucaugaucaucugcaaggcccucaacuccaaccuccagggcugcgucaccgagaacgagaacgaccccaucaccaacaucgagcccuucuucgucuccgucgcccucuacgaccuccgcgacucccgcaagaucuccgccgacuuccacgucgaccucaaccacgccgccguccgccagaugcuccucggcgccuccgucgcccucgagaacggcaacaucgacaccaucaccccccgccaguccgaggagccccacaucaagggccuccccgaggaguggcucaaguuccccaagcaggccgucuucuccgucuccaacccccacuccgagaucguccucgucgccaagaucgagaagguccucaugggcaacaucgccuccggcgccgagcccuacaucaagaaccccgacuccaacaaguacgcccagaagauccucaaguccaaccgccaguucugcuccaagcucggcaaguaccgcaugcccuucgccugggccguccgcuccgucuucaaggacaaccagggcaacgucgaccgcgacucccgcuucuccccccucuuccgccaggaguccuccaagaucuccaccgaggaccucgucaagcucgucuccgacuaccgccgcgccgaccgcaucuccaagaugcagaccauccccggcucccucgacaucgccgucgacaacgucccccucgagcaccccaacugcgucaccuccuccuucauccccgucaagcccuucaacaugauggcccagaccgagcccaccgucgaggucgaggaguucgucuacgacuccaccaaguacugccgccccuaccgcgucuacaagaaccagaucuacaucuaccccaagcaccucaaguacgacucccagaagugcuucaacaaggcccgcaacaucaccgucugcaucgaguucaagaacuccgacgaggaguccgccaagccccucaagugcaucuacggcaagcccggcggcccccucuucaccuccgccgccuacaccgccguccuccaccacucccagaaccccgacuucuccgacgaggucaagaucgagcuccccacccagcuccacgagaagcaccacauccucuucuccuucuaccacgucaccugcgacaucaacgccaaggccaacgccaagaagaaggaggcccucgagaccuccgucggcuacgccuggcucccccucaugaagcacgaccagaucgccucccaggaguacaacauccccaucgccaccucccucccccccaacuaccucuccuuccaggacuccgccuccggcaagcacggcggcuccgacaucaagugggucgacggcggcaagccccucuucaaggucuccaccuucgucgucuccaccgucaacacccaggacccccacgucaacgccuucuuccaggagugccagaagcgcgagaaggacaugucccagucccccaccuccaacuucauccgcuccugcaagaaccuccucaacgucgagaagauccacgccaucauguccuuccuccccaucauccucaaccagcucuucaagguccucguccagaacgaggaggacgagaucaccaccaccgucacccgcguccucaccgacaucgucgccaagugccacgaggagcagcucgaccacuccguccaguccuacaucaaguucgucuucaagacccgcgccugcaaggagcgcaccguccacgaggagcucgccaagaacgucaccggccuccucaaguccaacgacuccaccaccgucaagcacguccucaagcacuccugguucuucuucgccaucauccucaaguccauggcccagcaccucaucgacaccaacaagauccagcucccccgcccccagcgcuuccccgaguccuaccagaacgagcucgacaaccucgucaugguccucuccgaccacgucaucuggaaguacaaggacgcccucgaggagacccgccgcgccaaccacuccgucgcccgcuuccucaagcgcugcuucaccuucauggaccgcggcuacgucuucaagauggucaacaacuacaucuccauguucuccuccggcgaccucaagacccucugccaguacaaguucgacuuccuccaggaggucugccagcacgagcacuucaucccccucugccuccccauccgcuccgccaacauccccgacccccucacccccuccgaguccacccaggagcuccacgccuccgacaugcccgaguacuccgucaccaacgaguucugccgcaagcacuuccucaucggcauccuccuccgcgaggucggcuucgcccuccaggaggaccaggacguccgccaccucgcccucgccguccucaagaaccucauggccaagcacuccuucgacgaccgcuaccgcgagccccgcaagcaggcccagaucgccucccucuacaugccccucuacggcaugcuccucgacaacaugccccgcaucuaccucaaggaccucuaccccuucaccgucaacaccuccaaccagggcucccgcgacgaccucuccaccaacggcggcuuccagucccagaccgccaucaagcacgccaacuccgucgacaccuccuucuccaaggacguccucaacuccaucgccgccuucuccuccaucgccaucuccaccgucaaccacgccgacucccgcgccucccucgccucccucgacuccaaccccuccaccaacgagaaguccuccgagaagaccgacaacugcgagaagaucccccgcccccucucccucaucggcuccacccuccgcuucgacaagcucgaccaggccgagacccgcucccuccucaugugcuuccuccacaucaugaagaccaucuccuacgagacccucaucgccuacuggcagcgcgcccccucccccgaggucuccgacuucuucuccauccucgacgucugccuccagaacuuccgcuaccucggcaagcgcaacaucauccgcaagaucgccgccgccuucaaguucguccaguccacccagaacaacggcacccucaagggcuccaaccccuccugccagaccuccggccuccucucccaguggaugcacuccaccuccucccacgagggccacaagcagcaccgcucccagacccuccccaucauccgcggcaagaacgcccucuccaaccccaagcuccuccagaugcucgacaacaccaugaccuccaacuccaacgagaucgacaucguccaccacgucgacaccgaggccaacaucgccaccgaggucugccucaccauccucgaccuccucucccucuucacccagacccaccagcgccagcuccagcagugcgacugccagaacucccucaugaagcgcgucuucgacaccuacaugcucuucuuccaggucaaccaguccgccaccgcccucaagcacgucuucgccucccuccgccucuucgucugcaaguuccccuccgccuucuuccagggccccgccgaccucugcggcuccuucugcuacgagguccucaagugcugcaaccaccgcucccgcuccacccagaccgaggccuccgcccuccucuacuucuucaugcgcaagaacuucgaguucaacaagcagaaguccaucguccgcucccaccuccagcucaucaaggccgucucccagcucaucgccgacgccggcaucggcggcucccgcuuccagcacucccucgccaucaccaacaacuucgccaacggcgacaagcagaugaagaacuccaacuuccccgccgaggucaaggaccucaccaagcgcauccgcaccguccucauggccaccgcccagaugaaggagcacgagaaggaccccgagaugcucgucgaccuccaguacucccucgccaacuccuacgccuccacccccgagcuccgccgcaccuggcucgaguccauggccaagauccacgcccgcaacggcgaccucuccgaggccgccaugugcuacauccacaucgccgcccucaucgccgaguaccucaagcgcaagggcuacuggaaggucgagaagaucugcaccgccucccuccucuccgaggacacccaccccugcgacuccaacucccuccucaccacccccuccggcggcuccauguucuccaugggcuggcccgccuuccucuccaucacccccaacaucaaggaggagggcgccaugaaggaggacuccggcaugcaggacacccccuacaacgagaacauccucgucgagcagcucuacaugugcgucgaguuccucuggaaguccgagcgcuacgagcucaucgccgacgucaacaagcccaucaucgccgucuucgagaagcagcgcgacuucaagaagcucuccgaccucuacuacgacauccaccgcuccuaccucaaggucgccgaggucgucaacuccgagaagcgccucuucggccgcuacuaccgcgucgccuucuacggccagggcuucuucgaggaggaggagggcaaggaguacaucuacaaggagcccaagcucaccggccucuccgagaucucccagcgccuccucaagcucuacgccgacaaguucggcgccgacaacgucaagaucauccaggacuccaacaaggucaaccccaaggaccucgaccccaaguacgccuacauccaggucaccuacgucacccccuucuucgaggagaaggagaucgaggaccgcaagaccgacuucgagaugcaccacaacaucaaccgcuucgucuucgagacccccuucacccucuccggcaagaagcacggcggcgucgccgagcagugcaagcgccgcaccauccucaccaccucccaccucuuccccuacgucaagaagcgcauccaggucaucucccaguccuccaccgagcucaaccccaucgaggucgccaucgacgagauguccaagaaggucuccgagcucaaccagcucugcaccauggaggaggucgacaugauccgccuccagcucaagcuccagggcuccgucuccgucaaggucaacgccggccccauggccuacgcccgcgccuuccucgaggagaccaacgccaagaaguaccccgacaaccaggucaagcuccucaaggagaucuuccgccaguucgccgacgccugcggccaggcccucgacgucaacgagcgccucaucaaggaggaccagcucgaguaccaggaggagcuccgcucccacuacaaggacaugcucuccgagcucuccaccgucaugaacgagcagaucaccggccgcgacgaccucuccaagcgcggcgucgaccagaccugcacccgcgucaucuccaaggccacccccgcccuccccaccgucuccaucuccuccuccgccgaggucuga

SEQ ID NO: 42372 - RNA, 6222 nt, Artificial Sequence
  derived and/or modified sequence opt2 from DOCK11__Homo_sapiens__NP_653259
auggccgagguccgcaaguucaccaagcgccucuccaagcccggcaccgccgccgagcuccgccaguccgucuccgaggccguccgcggcuccgucguccucgagaaggccaaggucgucgagccccucgacuacgagaacgucaucgcccagcgcaagacccagaucuacuccgacccccuccgcgaccuccucauguuccccauggaggacaucuccaucuccgucaucggccgccagcgccgcaccguccaguccaccguccccgaggacgccgagaagcgcgcccagucccucuucgucaaggagugcaucaagaccuacuccaccgacuggcacgucgucaacuacaaguacgaggacuucuccggcgacuuccgcaugcuccccugcaagucccuccgccccgagaagauccccaaccacgucuucgagaucgacgaggacugcgagaaggacgaggacuccuccucccucugcucccagaagggcggcgucaucaagcagggcuggcuccacaaggccaacgucaacuccaccaucaccgucaccaugaaggucuucaagcgccgcuacuucuaccucacccagcuccccgacggcuccuacauccucaacuccuacaaggacgagaagaacuccaaggaguccaagggcugcaucuaccucgacgccugcaucgacgucguccagugccccaagaugcgccgccacgccuucgagcucaagaugcucgacaaguacucccacuaccucgccgccgagaccgagcaggagauggaggaguggcucaucacccucaagaagaucauccagaucaacaccgacucccucguccaggagaagaaggagaccgucgagaccgcccaggacgacgagaccuccucccagggcaaggccgagaacaucauggccucccucgagcgcuccaugcaccccgagcucaugaaguacggccgcgagaccgagcagcucaacaagcucucccgcggcgacggccgccagaaccucuucuccuucgacuccgagguccagcgccucgacuucuccggcaucgagcccgacaucaagcccuucgaggagaagugcaacaagcgcuuccucgucaacugccacgaccucaccuucaacauccucggccagaucggcgacaacgccaagggcccccccaccaacgucgagcccuucuucaucaaccucgcccucuucgacgucaagaacaacugcaagaucuccgccgacuuccacgucgaccucaacccccccuccguccgcgagaugcucuggggcuccuccacccagcucgccuccgacggcucccccaagggcuccucccccgaguccuacauccacggcaucgccgagucccagcuccgcuacauccagcagggcaucuucuccgucaccaacccccaccccgagaucuuccucgucgcccgcaucgagaagguccuccagggcaacaucacccacugcgccgagcccuacaucaagaacuccgaccccgucaagaccgcccagaagguccaccgcaccgccaagcaggucugcucccgccucggccaguaccgcaugcccuucgccugggccgcccgccccaucuucaaggacacccagggcucccucgaccucgacggccgcuucuccccccucuacaagcaggacuccuccaagcucuccuccgaggacauccucaagcuccucuccgaguacaagaagcccgagaagaccaagcuccagaucauccccggccagcucaacaucaccgucgagugcguccccgucgaccucuccaacugcaucaccuccuccuacgucccccucaagcccuucgagaagaacugccagaacaucaccgucgaggucgaggaguucguccccgagaugaccaaguacugcuaccccuucaccaucuacaagaaccaccucuacgucuacccccuccagcucaaguacgacucccagaagaccuucgccaaggcccgcaacaucgccgucugcgucgaguuccgcgacuccgacgaguccgacgccuccgcccucaagugcaucuacggcaagcccgccggcuccgucuucaccaccaacgccuacgccgucgucucccaccacaaccagaaccccgaguucuacgacgagaucaagaucgagcuccccauccaccuccaccagaagcaccaccuccucuucaccuucuaccacgucuccugcgagaucaacaccaagggcaccaccaagaagcaggacaccgucgagacccccgucggcuucgccugggucccccuccucaaggacggccgcaucaucaccuucgagcagcagcuccccgucuccgccaaccucccccccggcuaccucaaccucaacgacgccgagucccgccgccagugcaacgucgacaucaagugggucgacggcgccaagccccuccucaagaucaagucccaccucgaguccaccaucuacacccaggaccuccacguccacaaguucuuccaccacugccagcucauccaguccggcuccaaggagguccccggcgagcucaucaaguaccucaagugccuccacgccauggagauccaggucaugauccaguuccuccccgucauccucaugcagcucuuccgcguccucaccaacaugacccacgaggacgacguccccaucaacugcaccaugguccuccuccacaucgucuccaagugccacgaggagggccucgacuccuaccuccgcuccuucaucaaguacuccuuccgccccgagaagcccuccgccccccaggcccagcucauccacgagacccucgccaccaccaugaucgccauccucaagcaguccgccgacuuccucuccaucaacaagcuccucaaguacuccugguucuucuucgagaucaucgccaaguccauggccaccuaccuccucgaggagaacaagaucaagcucccccgcggccagcgcuuccccgagaccuaccaccacguccuccacucccuccuccucgccaucaucccccacgucaccauccgcuacgccgagauccccgacgagucccgcaacgucaacuacucccucgccuccuuccucaagcgcugccucacccucauggaccgcggcuucaucuucaaccucaucaacgacuacaucuccggcuucucccccaaggaccccaagguccucgccgaguacaaguucgaguuccuccagaccaucugcaaccacgagcacuacaucccccucaaccuccccauggccuucgccaagcccaagcuccagcgcguccaggacuccaaccucgaguacucccucuccgacgaguacugcaagcaccacuuccucgucggccuccuccuccgcgagaccuccaucgcccuccaggacaacuacgagauccgcuacaccgccaucuccgucaucaagaaccuccucaucaagcacgccuucgacacccgcuaccagcacaagaaccagcaggccaagaucgcccagcucuaccuccccuucgucggccuccuccucgagaacauccagcgccucgccggccgcgacacccucuacuccugcgccgccaugcccaacuccgccucccgcgacgaguuccccugcggcuucaccucccccgccaaccgcggcucccucuccaccgacaaggacaccgccuacggcuccuuccagaacggccacggcaucaagcgcgaggacucccgcggcucccucauccccgagggcgccaccggcuuccccgaccagggcaacaccggcgagaacacccgccaguccuccacccgcuccuccgucucccaguacaaccgccucgaccaguacgagauccgcucccuccucaugugcuaccucuacaucgucaagaugaucuccgaggacacccuccucaccuacuggaacaaggucuccccccaggagcucaucaacauccucauccuccucgaggucugccucuuccacuuccgcuacaugggcaagcgcaacaucgcccgcguccacgacgccuggcucuccaagcacuucggcaucgaccgcaagucccagaccaugcccgcccuccgcaaccgcuccggcgucaugcaggcccgccuccagcaccucuccucccucgaguccuccuucacccucaaccacuccuccaccaccaccgaggccgacaucuuccaccaggcccuccucgagggcaacaccgccaccgaggucucccucaccguccucgacaccaucuccuucuucacccagugcuucaagacccagcuccucaacaacgacggccacaacccccucaugaagaaggucuucgacauccaccucgccuuccucaagaacggccaguccgaggucucccucaagcacgucuucgccucccuccgcgccuucaucuccaaguuccccuccgccuucuucaagggccgcgucaacaugugcgccgccuucugcuacgagguccucaagugcugcaccuccaagaucuccuccacccgcaacgaggccuccgcccuccucuaccuccucaugcgcaacaacuucgaguacaccaagcgcaagaccuuccuccgcacccaccuccagaucaucaucgccgucucccagcucaucgccgacgucgcccucuccggcggcucccgcuuccaggagucccucuucaucaucaacaacuucgccaacuccgaccgccccaugaaggccaccgccuuccccgccgaggucaaggaccucaccaagcgcauccgcaccguccucauggccaccgcccagaugaaggagcacgagaaggaccccgagaugcucaucgaccuccaguacucccucgccaaguccuacgccuccacccccgagcuccgcaagaccuggcucgacuccauggccaagauccacgucaagaacggcgacuucuccgaggccgccaugugcuacguccacgucgccgcccucgucgccgaguuccuccaccgcaagaagcucuuccccaacggcugcuccgccuucaagaagaucacccccaacaucgacgaggagggcgccaugaaggaggacgccggcaugauggacguccacuacuccgaggagguccuccucgagcuccucgagcagugcgucgacggccucuggaaggccgagcgcuacgagaucaucuccgagaucuccaagcucaucguccccaucuacgagaagcgccgcgaguucgagaagcucacccaggucuaccgcacccuccacggcgccuacaccaagauccucgaggucaugcacaccaagaagcgccuccucggcaccuucuuccgcgucgccuucuacggccaguccuucuucgaggaggaggacggcaaggaguacaucuacaaggagcccaagcucaccggccucuccgagaucucccuccgccucgucaagcucuacggcgagaaguucggcaccgagaacgucaagaucauccaggacuccgacaaggucaacgccaaggagcucgaccccaaguacgcccacauccaggucaccuacgucaagcccuacuucgacgacaaggagcucaccgagcgcaagaccgaguucgagcgcaaccacaacaucucccgcuucgucuucgaggcccccuacacccucuccggcaagaagcagggcugcaucgaggagcagugcaagcgccgcaccauccucaccaccuccaacuccuuccccuacgucaagaagcgcauccccaucaacugcgagcagcagaucaaccucaagcccaucgacgucgccaccgacgagaucaaggacaagaccgccgagcuccagaagcucugcuccuccaccgacgucgacaugauccagcuccagcucaagcuccagggcugcgucuccguccaggucaacgccggcccccucgccuacgcccgcgccuuccucaacgacucccaggccuccaaguacccccccaagaaggucuccgagcucaaggacauguuccgcaaguucauccaggccugcuccaucgcccucgagcucaacgagcgccucaucaaggaggaccaggucgaguaccacgagggccucaaguccaacuuccgcgacauggucaaggagcucuccgacaucauccacgagcagauccuccaggaggacaccaugcacucccccuggauguccaacacccuccacgucuucugcgccaucuccggcaccuccuccgaccgcggcuacggcuccccccgcuacgccgaggucuga

SEQ ID NO: 42373 - RNA, 5598 nt, Artificial Sequence
  derived and/or modified sequence opt2 from DOCK1__Homo_sapiens__NP_001371
augacccgcuggguccccaccaagcgcgaggagaaguacggcgucgccuucuacaacuacgacgcccgcggcgccgacgagcucucccuccagaucggcgacaccguccacauccucgagaccuacgagggcugguaccgcggcuacacccuccgcaagaaguccaagaagggcaucuuccccgccuccuacauccaccucaaggaggccaucgucgagggcaagggccagcacgagaccgucauccccggcgaccucccccucauccaggaggucaccaccacccuccgcgagugguccaccaucuggcgccagcucuacguccaggacaaccgcgagauguuccgcuccguccgccacaugaucuacgaccucaucgaguggcgcucccagauccucuccggcacccucccccaggacgagcucaaggagcucaagaagaaggucaccgccaagaucgacuacggcaaccgcauccucgaccucgaccucgucguccgcgacgaggacggcaacauccucgaccccgagcucaccuccaccaucucccucuuccgcgcccacgagaucgccuccaagcaggucgaggagcgccuccaggaggagaagucccagaagcagaacaucgacaucaaccgccaggccaaguucgccgccacccccucccucgcccucuucgucaaccucaagaacgucgucugcaagaucggcgaggacgccgagguccucaugucccucuacgaccccgucgaguccaaguucaucuccgagaacuaccucguccgcugguccuccuccggccuccccaaggacaucgaccgccuccacaaccuccgcgccgucuucaccgaccucggcuccaaggaccucaagcgcgagaagaucuccuucgucugccagaucguccgcgucggccgcauggagcuccgcgacaacaacacccgcaagcucaccuccggccuccgccgccccuucggcgucgccgucauggacgucaccgacaucaucaacggcaaggucgacgacgaggacaagcagcacuucauccccuuccagcccgucgccggcgagaacgacuuccuccagaccgucaucaacaaggucaucgccgccaaggaggucaaccacaagggccagggccucugggucacccucaagcuccuccccggcgacauccaccagauccgcaaggaguucccccaccucgucgaccgcaccaccgccgucgcccgcaagaccggcuuccccgagaucaucaugcccggcgacguccgcaacgacaucuacgucacccucguccagggcgacuucgacaagggcuccaagaccaccgccaagaacgucgaggucaccgucuccgucuacgacgaggacggcaagcgccucgagcacgucaucuuccccggcgccggcgacgaggccaucuccgaguacaaguccgucaucuacuaccaggucaagcagccccgcugguucgagaccgucaaggucgccauccccaucgaggacgucaaccgcucccaccuccgcuucaccuuccgccaccgcuccucccaggacuccaaggacaaguccgagaagaucuucgcccucgccuucgucaagcucaugcgcuacgacggcaccacccuccgcgacggcgagcacgaccucaucgucuacaaggccgaggccaagaagcucgaggacgccgccaccuaccucucccuccccuccaccaaggccgagcucgaggagaagggccacuccgccaccggcaaguccaugcagucccucggcuccugcaccaucuccaaggacuccuuccagaucuccacccucgucugcuccaccaagcucacccagaacgucgaccuccucggccuccucaaguggcgcuccaacaccucccuccuccagcagaaccuccgccagcucaugaaggucgacggcggcgaggucgucaaguuccuccaggacacccucgacgcccucuucaacaucaugauggagaacuccgaguccgagaccuucgacacccucgucuucgacgcccucgucuucaucaucggccucaucgccgaccgcaaguuccagcacuucaaccccguccucgagaccuacaucaagaagcacuucuccgccacccucgccuacaccaagcucaccaagguccucaagaacuacgucgacggcgccgagaagcccggcgucaacgagcagcucuacaaggccaugaaggcccucgaguccaucuucaaguucaucguccgcucccgcauccucuucaaccagcucuacgagaacaagggcgaggccgacuucgucgagucccuccuccagcucuuccgcuccaucaacgacaugauguccuccauguccgaccagaccguccgcgucaagggcgccgcccucaaguaccuccccaccaucgucaacgacgucaagcucgucuucgaccccaaggagcucuccaagauguucaccgaguucauccucaacguccccaugggccuccucaccauccagaagcucuacugccucaucgagaucguccacuccgaccucuucacccagcacgacugccgcgagauccuccuccccaugaugaccgaccagcucaaguaccaccucgagcgccaggaggaccucgaggccugcugccagcuccucucccacauccucgagguccucuaccgcaaggacgucggccccacccagcgccacguccagaucaucauggagaagcuccuccgcaccgucaaccgcaccgucaucuccaugggccgcgacuccgagcucaucggcaacuucgucgccugcaugaccgccauccuccgccagauggaggacuaccacuacgcccaccucaucaagaccuucggcaagaugcgcaccgacgucgucgacuuccucauggagaccuucaucauguucaagaaccucaucggcaagaacgucuaccccuucgacugggucaucaugaacaugguccagaacaaggucuuccuccgcgccaucaaccaguacgccgacaugcucaacaagaaguuccucgaccaggccaacuucgagcuccagcucuggaacaacuacuuccaccucgccgucgccuuccucacccaggagucccuccagcucgagaacuucuccuccgccaagcgcgccaagauccucaacaaguacggcgacaugcgccgccagaucggcuucgagauccgcgacaugugguacaaccucggccagcacaagaucaaguucauccccgagauggucggccccauccucgagaugacccucauccccgagaccgagcuccgcaaggccaccauccccaucuucuucgacaugaugcagugcgaguuccacuccacccgcuccuuccagauguucgagaacgagaucaucaccaagcucgaccacgaggucgagggcggccgcggcgacgagcaguacaagguccucuucgacaagauccuccucgagcacugccgcaagcacaaguaccucgccaagaccggcgagaccuucgucaagcucgucguccgccucauggagcgccuccucgacuaccgcaccaucaugcacgacgagaacaaggagaaccgcauguccugcaccgucaacguccucaacuucuacaaggagaucgagcgcgaggagauguacauccgcuaccucuacaagcucugcgaccuccacaaggagugcgacaacuacaccgaggccgccuacacccuccuccuccacgccaagcuccucaagugguccgaggacgucugcgucgcccaccucacccagcgcgacggcuaccaggccaccacccagggccagcucaaggagcagcucuaccaggagaucauccacuacuucgacaagggcaagaugugggaggaggccaucgcccucggcaaggagcucgccgagcaguacgagaacgagauguucgacuacgagcagcucuccgagcuccucaagaagcaggcccaguucuacgagaacaucgucaaggucauccgccccaagcccgacuacuucgccgucggcuacuacggccagggcuuccccaccuuccuccgcggcaaggucuucaucuaccgcggcaaggaguacgagcgccgcgaggacuucgaggcccgccuccucacccaguuccccaacgccgagaagaugaagaccaccuccccccccggcgacgacaucaagaacucccccggccaguacauccagugcuucaccgucaagcccaagcucgaccucccccccaaguuccaccgccccgucuccgagcagaucgucuccuucuaccgcgucaacgagguccagcgcuucgaguacucccgccccauccgcaagggcgagaagaaccccgacaacgaguucgccaacauguggaucgagcgcaccaucuacaccaccgccuacaagcuccccggcauccuccgcugguucgaggucaaguccgucuucauggucgagaucuccccccucgagaacgccaucgagaccaugcagcucaccaacgacaagaucaacuccaugguccagcagcaccucgacgaccccucccuccccaucaacccccucuccaugcuccucaacggcaucgucgaccccgccgucaugggcggcuucgccaacuacgagaaggccuucuucaccgaccgcuaccuccaggagcaccccgaggcccacgagaagaucgagaagcucaaggaccucaucgccuggcagauccccuuccucgccgagggcauccgcauccacggcgacaaggucaccgaggcccuccgccccuuccacgagcgcauggaggccugcuucaagcagcucaaggagaaggucgagaaggaguacggcguccgcaucaugcccuccucccucgacgaccgccgcggcucccgcccccgcuccaugguccgcuccuucaccaugcccuccuccucccgcccccucuccgucgccuccgucuccucccucuccuccgacuccacccccucccgccccggcuccgacggcuucgcccucgagccccuccuccccaagaagaugcacucccgcucccaggacaagcucgacaaggacgaccucgagaaggagaagaaggacaagaagaaggagaagcgcaacuccaagcaccaggagaucuucgagaaggaguucaagcccaccgacaucucccuccagcaguccgaggccgucauccucuccgagaccaucuccccccuccgcccccagcgccccaagucccaggucaugaacgucaucggcuccgagcgccgcuucuccgucucccccuccucccccuccucccagcagacccccccccccgucaccccccgcgccaagcucuccuucuccaugcaguccucccucgagcucaacggcaugaccggcgccgacgucgccgacgucccccccccccucccccucaagggcuccgucgccgacuacggcaaccucauggagaaccaggaccuccucggcucccccacccccccccccccccccccccaccagcgccaccucccccccccccuccccuccaagaccccccccccccccccccccaagaccacccgcaagcagaccuccgucgacuccggcaucguccaguga

SEQ ID NO: 42374 - RNA, 5493 nt, Artificial Sequence
  derived and/or modified sequence opt2 from DOCK2__Homo_sapiens__NP_004937
auggcccccuggcgcaaggccgacaaggagcgccacggcgucgccaucuacaacuuccagggcuccggcgccccccagcucucccuccagaucggcgacgucguccgcauccaggagaccugcggcgacugguaccgcggcuaccucaucaagcacaagaugcuccagggcaucuuccccaaguccuucauccacaucaaggaggucaccgucgagaagcgccgcaacaccgagaacaucauccccgccgagaucccccucgcccaggaggucaccaccacccucugggaguggggcuccaucuggaagcagcucuacgucgccuccaagaaggagcgcuuccuccagguccaguccaugauguacgaccucauggaguggcgcucccagcuccucuccggcacccuccccaaggacgagcucaaggagcucaagcagaaggucaccuccaagaucgacuacggcaacaagauccucgagcucgaccucaucguccgcgacgaggacggcaacauccucgaccccgacaacaccuccgucaucucccucuuccacgcccacgaggaggccaccgacaagaucaccgagcgcaucaaggaggagauguccaaggaccagcccgacuacgccauguacucccgcaucuccuccucccccacccacucccucuacgucuucguccgcaacuucgucugccgcaucggcgaggacgccgagcucuucaugucccucuacgaccccaacaagcagaccgucaucuccgagaacuaccucguccgcuggggcucccgcggcuuccccaaggagaucgagaugcucaacaaccucaaggucgucuucaccgaccucggcaacaaggaccucaaccgcgacaagaucuaccucaucugccagaucguccgcgucggcaagauggaccucaaggacaccggcgccaagaagugcacccagggccuccgccgccccuucggcgucgccgucauggacaucaccgacaucaucaagggcaaggccgaguccgacgaggagaagcagcacuucauccccuuccaccccgucaccgccgagaacgacuuccuccacucccuccucggcaaggucaucgccuccaagggcgacuccggcggccagggccucugggucaccaugaagaugcucgucggcgacaucauccagauccgcaaggacuacccccaccucgucgaccgcaccaccgucgucgcccgcaagcucggcuuccccgagaucaucaugcccggcgacguccgcaacgacaucuacaucacccuccuccagggcgacuucgacaaguacaacaagaccacccagcgcaacgucgaggucaucaugugcgucugcgccgaggacggcaagacccuccccaacgccaucugcgucggcgccggcgacaagcccaugaacgaguaccgcuccgucgucuacuaccaggucaagcagccccgcuggauggagaccgucaaggucgccguccccaucgaggacaugcagcgcauccaccuccgcuucauguuccgccaccgcuccucccucgaguccaaggacaagggcgagaagaacuucgccauguccuacgucaagcucaugaaggaggacggcaccacccuccacgacggcuuccacgaccucgucguccucaagggcgacuccaagaagauggaggacgccuccgccuaccucacccuccccuccuaccgccaccacgucgagaacaagggcgccacccucucccgcuccuccuccuccgucggcggccucuccgucuccucccgcgacgucuucuccaucuccacccucgucugcuccaccaagcucacccagaacgucggccuccucggccuccucaaguggcgcaugaagccccagcuccuccaggagaaccucgagaagcucaagaucgucgacggcgaggaggucgucaaguuccuccaggacacccucgacgcccucuucaacaucaugauggagcacucccaguccgacgaguacgacauccucgucuucgacgcccucaucuacaucaucggccucaucgccgaccgcaaguuccagcacuucaacaccguccucgaggccuacauccagcagcacuucuccgccacccucgccuacaagaagcucaugaccguccucaagaccuaccucgacaccuccucccgcggcgagcagugcgagcccauccuccgcacccucaaggcccucgaguacgucuucaaguucaucguccgcucccgcacccucuucucccagcucuacgagggcaaggagcagauggaguucgaggaguccaugcgccgccucuucgaguccaucaacaaccucaugaagucccaguacaagaccaccauccuccuccaggucgccgcccucaaguacauccccuccguccuccacgacgucgagauggucuucgacgccaagcuccucucccagcuccucuacgaguucuacaccugcaucccccccgucaagcuccagaagcagaagguccaguccaugaacgagaucguccaguccaaccucuucaagaagcaggagugccgcgacauccuccuccccgucaucaccaaggagcucaaggagcuccucgagcagaaggacgacaugcagcaccagguccucgagcgcaaguacugcgucgagcuccucaacuccauccucgagguccucuccuaccaggacgccgccuucaccuaccaccacauccaggagaucaugguccagcuccuccgcaccgucaaccgcaccgucaucaccaugggccgcgaccacauccucaucucccacuucgucgccugcaugaccgccauccucaaccagaugggcgaccagcacuacuccuucuacaucgagaccuuccagaccuccuccgagcucgucgacuuccucauggagaccuucaucauguucaaggaccucaucggcaagaacgucuaccccggcgacuggauggccauguccaugguccagaaccgcgucuuccuccgcgccaucaacaaguucgccgagaccaugaaccagaaguuccucgagcacaccaacuucgaguuccagcucuggaacaacuacuuccaccucgccgucgccuucaucacccaggacucccuccagcucgagcaguucucccacgccaaguacaacaagauccucaacaaguacggcgacaugcgccgccucaucggcuucuccauccgcgacaugugguacaagcucggccagaacaagaucugcuucauccccggcauggucggccccauccucgagaugacccucauccccgaggccgagcuccgcaaggccaccauccccaucuucuucgacaugaugcucugcgaguaccagcgcuccggcgacuucaagaaguucgagaacgagaucauccucaagcucgaccacgaggucgagggcggccgcggcgacgagcaguacaugcagcuccucgaguccauccucauggagugcgccgccgagcaccccaccaucgccaaguccgucgagaacuucgucaaccucgucaagggccuccucgagaagcuccucgacuaccgcggcgucaugaccgacgaguccaaggacaaccgcauguccugcaccgucaaccuccucaacuucuacaaggacaacaaccgcgaggagauguacauccgcuaccucuacaagcuccgcgaccuccaccucgacugcgacaacuacaccgaggccgccuacacccuccuccuccacaccuggcuccucaagugguccgacgagcagugcgccucccaggucaugcagaccggccagcagcacccccagacccaccgccagcucaaggagacccucuacgagaccaucaucggcuacuucgacaagggcaagaugugggaggaggccaucucccucugcaaggagcucgccgagcaguacgagauggagaucuucgacuacgagcuccucucccagaaccucauccagcaggccaaguucuacgaguccaucaugaagauccuccgccccaagcccgacuacuucgccgucggcuacuacggccagggcuuccccuccuuccuccgcaacaaggucuucaucuaccgcggcaaggaguacgagcgccgcgaggacuuccagaugcagcucaugacccaguuccccaacgccgagaagaugaacaccaccuccgcccccggcgacgacgucaagaacgcccccggccaguacauccagugcuucaccguccagcccguccucgacgagcacccccgcuucaagaacaagcccguccccgaccagaucaucaacuucuacaaguccaacuacguccagcgcuuccacuacucccgccccguccgccgcggcaccgucgaccccgagaacgaguucgccuccauguggaucgagcgcaccuccuucgucaccgccuacaagcuccccggcauccuccgcugguucgaggucguccacaugucccagaccaccaucuccccccucgagaacgccaucgagaccauguccaccgccaacgagaagauccucaugaugaucaaccaguaccaguccgacgagacccuccccaucaacccccucuccaugcuccucaacggcaucgucgaccccgccgucaugggcggcuucgccaaguacgagaaggccuucuucaccgaggaguacguccgcgaccaccccgaggaccaggacaagcucacccaccucaaggaccucaucgccuggcagauccccuuccucggcgccggcaucaagauccacgagaagcgcgucuccgacaaccuccgccccuuccacgaccgcauggaggagugcuucaagaaccucaagaugaaggucgagaaggaguacggcguccgcgagaugcccgacuucgacgaccgccgcgucggccgcccccgcuccaugcuccgcuccuaccgccagauguccaucaucucccucgccuccaugaacuccgacugcuccacccccuccaagcccaccuccgaguccuucgaccucgagcucgccucccccaagaccccccgcgucgagcaggaggagcccaucucccccggcuccacccuccccgaggucaagcuccgccgcuccaagaagcgcaccaagcgcuccuccgucgucuucgccgacgagaaggccgccgccgaguccgaccucaagcgccucucccgcaagcacgaguucauguccgacaccaaccucuccgagcacgccgccaucccccucaaggccuccguccucucccagauguccuucgccucccaguccaugcccaccauccccgcccucgcccucuccgucgccggcauccccggccucgacgaggccaacaccuccccccgccucucccagaccuuccuccagcucuccgacggcgacaagaagacccucacccgcaagaaggucaaccaguucuucaagaccaugcucgccuccaaguccgccgaggagggcaagcagauccccgacucccucuccaccgaccucuga

SEQ ID NO: 42375 - RNA, 6093 nt, Artificial Sequence
  derived and/or modified sequence opt2 from DOCK3__Homo_sapiens__NP_004938
auguggacccccaccgaggaggagaaguacggcgucgucaucugcuccuuccgcggcuccgucccccagggccucguccucgagaucggcgagaccguccagauccucgagaagugcgagggcugguaccgcggcgucuccaccaagaagcccaacgucaagggcaucuuccccgccaacuacauccaccucaagaaggccaucgucuccaaccgcggccaguacgagaccgucgucccccucgaggacuccaucgucaccgaggucaccgccacccuccaggagugggccucccucuggaagcagcucuacgucaagcacaaggucgaccucuucuacaagcuccgccacgucaugaacgagcucaucgaccuccgccgccagcuccucuccggccaccucacccaggaccagguccgcgaggucaagcgccacaucaccguccgccucgacuggggcaacgagcaccucggccucgaccucgucccccgcaaggacuucgaggucgucgacuccgaccagaucuccgucuccgaccucuacaagaugcaccucuccucccgccaguccguccagcaguccaccucccaggucgacaccaugcgcccccgccacggcgagaccugccgcaugcccgucccccaccacuucuuccucucccucaaguccuucaccuacaacaccaucggcgaggacaccgacgucuucuucucccucuacgacaugcgcgagggcaagcagaucuccgagcgcuuccucguccgccucaacaagaacggcggcccccgcaaccccgagaagaucgagcgcaugugcgcccucuucaccgaccucuccuccaaggacaugaagcgcgaccucuacaucgucgcccacgucauccgcaucggccgcaugcuccucaacgacuccaagaagggccccccccaccuccacuaccgccgccccuacggcugcgccguccucuccauccucgacguccuccagucccucaccgaggucaaggaggagaaggacuucguccucaaggucuacaccugcaacaacgaguccgaguggucccagauccacgagaacaucauccgcaaguccuccgccaaguacuccgcccccuccgccucccacggccucaucaucucccuccagcuccuccgcggcgacauggagcagauccgccgcgagaaccccaugaucuucaaccgcggccucgccaucacccgcaagcucggcuuccccgacgucaucaugcccggcgacauccgcaacgaccucuaccucacccucgagaagggcgacuucgagcgcggcggcaaguccguccagaagaacaucgaggucaccauguacguccucuacgccgacggcgagauccucaaggacugcaucucccucggcuccggcgagcccaaccgcuccuccuaccacuccuucguccucuaccacuccaacuccccccgcuggggcgagaucaucaagcuccccauccccaucgaccgcuuccgcggcucccaccuccgcuucgaguuccgccacugcuccaccaaggacaagggcgagaagaagcucuucggcuucgccuucuccacccucaugcgcgacgacggcaccacccucuccgacgacauccacgagcucuacgucuacaagugcgacgagaacuccaccuucaacaaccacgcccucuaccucggccuccccugcugcaaggaggacuacaacggcugccccaacauccccuccucccucaucuuccagcgcuccaccaaggaguccuucuucaucuccacccagcucuccuccaccaagcucacccagaacgucgaccuccucgcccuccucaaguggaaggccuuccccgaccgcaucauggacguccucggccgccuccgccacgucuccggcgaggagaucgucaaguuccuccaggacauccucgacacccucuucgucauccucgacgacaacaccgagaaguacggccuccucgucuuccagucccucgucuucaucaucaaccuccuccgcgacaucaaguacuuccacuuccgccccgucauggacaccuacauccagaagcacuucgccggcgcccucgccuacaaggagcucauccgcugccucaagugguacauggacugcuccgccgagcucauccgccaggaccacauccaggaggccaugcgcgcccucgaguaccucuucaaguucaucguccagucccgcauccucuacucccgcgccaccugcggcauggaggaggagcaguuccgcuccuccauccaggagcucuuccaguccauccgcuucguccucucccucgacucccgcaacuccgagacccuccucuucacccaggccgcccuccucaacuccuuccccaccaucuucgacgagcuccuccagauguucaccguccaggaggucgccgaguucguccgcggcacccucggcuccaugcccuccaccguccacaucggccaguccauggacgucgucaagcuccaguccaucgcccgcaccgucgacucccgccucuucuccuucuccgagucccgccgcauccuccuccccgucguccuccaccacauccaccuccaccuccgccagcagaaggagcuccucaucugcuccggcauccucggcuccaucuucuccaucgucaagaccuccucccucgaggccgacgucauggaggaggucgagaugauggucgagucccuccucgacguccuccuccagacccuccucaccaucauguccaagucccacgcccaggaggccguccgcggccagcgcugcccccagugcaccgccgagaucaccggcgaguacgucuccugccuccucucccuccuccgccagaugugcgacacccacuuccagcaccuccucgacaacuuccaguccaaggacgagcucaaggaguuccuccucaagaucuucugcgucuuccgcaaccucaugaagauguccgucuucccccgcgacuggauggucaugcgccuccucaccuccaacaucaucgucaccaccguccaguaccucuccuccgcccuccacaagaacuucaccgagaccgacuucgacuucaaggucuggaacuccuacuucucccucgccguccucuucaucaaccagcccucccuccagcucgagaucaucaccuccgccaagcgcaagaagauccucgacaaguacggcgacaugcgcgucaugauggccuacgagcucuucuccauguggcagaaccucggcgagcacaagauccacuucauccccggcaugaucggccccuuccucggcgucacccucgucccccagcccgagguccgcaacaucaugauccccaucuuccacgacaugauggacugggagcagcgcaagaacggcaacuucaagcaggucgaggccgagcucaucgacaagcucgacuccauggucuccgagggcaagggcgacgaguccuaccgcgagcucuucucccuccucacccagcucuucggccccuaccccucccuccucgagaaggucgagcaggagaccuggcgcgagaccggcaucuccuucgucaccuccgucacccgccucauggagcgccuccucgacuaccgcgacugcaugaagggcgaggagaccgagaacaagaagaucggcugcaccgucaaccucaugaacuucuacaaguccgagaucaacaaggaggagauguacauccgcuacauccacaagcucugcgacaugcaccuccaggccgagaacuacaccgaggccgccuucacccuccuccucuacugcgagcuccuccagugggaggaccgcccccuccgcgaguuccuccacuaccccucccagaccgaguggcagcgcaaggagggccucugccgcaagaucauccacuacuucaacaagggcaaguccugggaguucggcaucccccucugccgcgagcucgccugccaguacgagucccucuacgacuaccagucccucuccuggauccgcaagauggaggccuccuacuacgacaacaucauggagcagcagcgccucgagcccgaguucuuccgcgucggcuucuacggccgcaaguuccccuucuuccuccgcaacaaggaguacgucugccgcggccacgacuacgagcgccucgaggccuuccagcagcgcaugcucuccgaguucccccaggccgucgccaugcagcaccccaaccaccccgacgacgccauccuccagugcgacgcccaguaccuccagaucuacgccgucacccccauccccgacuacgucgacguccuccagauggaccgcguccccgaccgcgucaaguccuucuaccgcgucaacaacguccgcaaguuccgcuacgaccgccccuuccacaagggccccaaggacaaggagaacgaguucaagucccucuggaucgagcgcaccacccucacccucacccacucccuccccggcaucucccgcugguucgaggucgagcgccgcgagcucgucgaggucuccccccucgagaacgccauccaggucgucgagaacaagaaccaggagcuccgcucccucaucucccaguaccagcacaagcagguccacggcaacaucaaccuccucuccaugugccucaacggcgucaucgacgccgccgucaacggcggcaucgcccgcuaccaggaggccuucuucgacaaggacuacaucaacaagcaccccggcgacgccgagaagaucacccagcucaaggagcucaugcaggagcagguccacguccucggcgucggccucgccguccacgagaaguucguccaccccgagaugcgcccccuccacaagaagcucaucgaccaguuccagaugaugcgcgccucccucuaccacgaguuccccggccucgacaagcucucccccgccugcuccggcaccuccaccccccgcggcaacguccucgccucccacucccccaugucccccgaguccaucaagaugacccaccgccacucccccaugaaccucaugggcaccggccgccacuccuccuccucccucuccucccacgccuccuccgaggccggcaacauggucaugcucggcgacggcuccaugggcgacgcccccgaggaccucuaccaccacaugcagcucgccuaccccaacccccgcuaccagggcuccgucaccaacgucuccguccucuccuccucccaggccucccccuccuccuccucccucuccuccacccacuccgcccccucccagaugaucaccuccgcccccuccuccgcccgcggcucccccucccuccccgacaaguaccgccacgcccgcgagaugaugcuccuccuccccaccuaccgcgaccgccccuccuccgccauguaccccgccgccauccucgagaacggccagccccccaacuuccagcgcgcccucuuccagcaggucgucggcgccugcaagcccugcuccgaccccaaccucuccgucgccgagaagggccacuacucccuccacuucgacgccuuccaccacccccucggcgacaccccccccgcccuccccgcccgcacccuccgcaaguccccccuccaccccauccccgccucccccaccuccccccaguccggccucgacggcuccaacuccacccucuccggcuccgccuccuccggcgucuccucccucuccgaguccaacuucggccacuccuccgaggcccccccccgcaccgacaccauggacuccaugcccucccaggccuggaacgccgacgaggaccucgagccccccuaccuccccguccacuacucccucuccgaguccgccguccucgacuccaucaaggcccagcccugccgcucccacuccgcccccggcugcgucaucccccaggaccccauggacccccccgcccucccccccaagcccuaccacccccgccuccccgcccucgagcacgacgagggcguccuccuccgcgaggagaccgagcgcccccgcggccuccaccgcaaggccccccucccccccggcuccgccaaggaggagcaggcccgcauggccugggagcacggccgcggcgagcaguga

SEQ ID NO: 42376 - RNA, 5901 nt, Artificial Sequence
  derived and/or modified sequence opt2 from DOCK4__Homo_sapiens__NP_055520
auguggauccccaccgagcacgagaaguacggcgucgucaucgccuccuuccgcggcaccguccccuacggccucucccucgagaucggcgacaccguccagauccucgagaagugcgacggcugguaccgcggcuucgcccucaagaaccccaacaucaagggcaucuuccccuccuccuacguccaccucaagaacgccugcgucaagaacaagggccaguucgagauggucauccccaccgaggacuccgucaucaccgagaugaccuccacccuccgcgacuggggcaccauguggaagcagcucuacguccgcaacgagggcgaccucuuccaccgccucuggcacaucaugaacgagauccucgaccuccgccgccagguccucgucggccaccucacccacgaccgcaugaaggacgucaagcgccacaucaccgcccgccucgacuggggcaacgagcagcucggccucgaccucgucccccgcaaggaguacgccauggucgaccccgaggacaucuccaucaccgagcucuaccgccucauggagcaccgccaccgcaagaaggacacccccguccaggccuccucccaccaccucuucguccagaugaagucccucaugugcuccaaccucggcgaggagcucgaggucaucuucucccucuucgacuccaaggagaaccgccccaucuccgagcgcuucuuccuccgccucaaccgcaacggccuccccaaggcccccgacaagcccgagcgccacugcucccucuucgucgaccucggcuccuccgagcuccgcaaggacaucuacaucaccguccacaucauccgcaucggccgcaugggcgccggcgagaagaagaacgccugcuccguccaguaccgccgccccuucggcugcgccguccucuccaucgccgaccuccucaccggcgagaccaaggacgaccucauccucaaggucuacaugugcaacaccgaguccgagugguaccagauccacgagaacaucaucaagaagcucaacgcccgcuacaaccucaccggcuccaacgccggccucgccgucucccuccagcuccuccacggcgacaucgagcagauccgccgcgaguacuccuccgucuucucccacggcgucuccaucacccgcaagcucggcuucuccaacaucaucaugcccggcgagaugcgcaacgaccucuacaucaccaucgagcgcggcgaguucgagaagggcggcaaguccgucgcccgcaacgucgaggucaccauguucaucgucgacuccuccggccagacccucaaggacuucaucuccuucggcuccggcgagccccccgccuccgaguaccacuccuucguccucuaccacaacaacuccccccgcugguccgagcuccucaagcuccccauccccgucgacaaguuccgcggcgcccacauccgcuucgaguuccgccacugcuccaccaaggagaagggcgagaagaagcucuucggcuucuccuucgucccccucaugcaggaggacggccgcacccuccccgacggcacccacgagcucaucguccacaagugcgaggagaacaccaaccuccaggacaccacccgcuaccucaagcuccccuucuccaagggcaucuuccucggcaacaacaaccaggccaugaaggccaccaaggaguccuucugcaucaccuccuuccucugcuccaccaagcucacccagaacggcgacaugcucgaccuccucaaguggcgcacccaccccgacaagaucaccggcugccucuccaagcucaaggagaucgacggcuccgagaucgucaaguuccuccaggacacccucgacacccucuucggcauccucgacgagaacucccagaaguacggcuccaaggucuucgacucccucguccacaucaucaaccuccuccaggacuccaaguuccaccacuucaagcccgucauggacaccuacaucgagucccacuucgccggcgcccucgccuaccgcgaccucaucaagguccucaagugguacgucgaccgcaucaccgaggccgagcgccaggagcacauccaggagguccucaaggcccaggaguacaucuucaaguacaucguccagucccgccgccucuucucccucgccaccggcggccagaacgaggaggaguuccgcugcugcauccaggagcuccucauguccguccgcuucuuccucucccaggaguccaagggcuccggcgcccucucccagucccaggccgucuuccucuccuccuuccccgccgucuacuccgagcuccucaagcucuucgacguccgcgaggucgccaaccucguccaggacacccucggcucccuccccaccauccuccacgucgacgacucccuccaggccaucaagcuccagugcaucggcaagaccgucgagucccagcucuacaccaaccccgacucccgcuacauccuccuccccgucguccuccaccaccuccacauccaccuccaggagcagaaggaccucaucaugugcgcccgcauccucuccaacgucuucugccucaucaagaagaacuccuccgagaaguccguccucgaggagaucgacgucaucgucgccucccuccucgacauccuccuccgcaccauccucgagaucaccucccgcccccagcccuccuccuccgccaugcgcuuccaguuccaggacgucaccggcgaguucgucgccugccuccucucccuccuccgccagaugaccgaccgccacuaccagcagcuccucgacuccuucaacaccaaggaggagcuccgcgacuuccuccuccagaucuucaccgucuuccgcauccucauccgccccgagauguuccccaaggacuggaccgucaugcgccucgucgccaacaacgucaucaucaccaccguccucuaccucuccgacgcccuccgcaagaacuuccucaacgagaacuucgacuacaagaucugggacuccuacuucuaccucgccgucaucuucaucaaccagcucugccuccagcucgagauguucacccccuccaagaagaagaagguccucgagaaguacggcgacaugcgcgucaccaugggcugcgagaucuucuccauguggcagaaccucggcgagcacaagcuccacuucauccccgcccucaucggccccuuccucgaggucacccucaucccccagcccgaccuccgcaacgucaugauccccaucuuccacgacaugauggacugggagcagcgccgcuccggcaacuucaagcaggucgaggccaagcucaucgacaagcucgacucccucauguccgagggcaagggcgacgagaccuaccgcgagcucuucaacuccauccuccucaagaagaucgagcgcgagaccuggcgcgaguccggcgucucccucaucgccaccgucacccgccucauggagcgccuccucgacuaccgcgacugcaugaagaugggcgaggucgacggcaagaagaucggcugcaccgucucccuccucaacuucuacaagaccgagcucaacaaggaggagauguacauccgcuacauccacaagcucuacgaccuccaccucaaggcccagaacuucaccgaggccgccuacacccuccuccucuacgacgagcuccucgagugguccgaccgcccccuccgcgaguuccucaccuaccccaugcagaccgaguggcagcgcaaggagcaccuccaccucaccaucauccagaacuucgaccgcggcaagugcugggagaacggcaucauccucugccgcaagaucgccgagcaguacgaguccuacuacgacuaccgcaaccucuccaagaugcgcaugauggaggccucccucuacgacaagaucauggaccagcagcgccucgagcccgaguucuuccgcgucggcuucuacggcaagaaguuccccuucuuccuccgcaacaaggaguucgucugccgcggccacgacuacgagcgccucgaggccuuccagcagcgcaugcucaacgaguucccccacgccaucgccaugcagcacgccaaccagcccgacgagaccaucuuccaggccgaggcccaguaccuccagaucuacgccgucacccccauccccgagucccaggagguccuccagcgcgagggcguccccgacaacaucaaguccuucuacaaggucaaccacaucuggaaguuccgcuacgaccgccccuuccacaagggcaccaaggacaaggagaacgaguucaagucccucugggucgagcgcaccucccucuaccucguccagucccuccccggcaucucccgcugguucgaggucgagaagcgcgaggucgucgagauguccccccucgagaacgccaucgagguccucgagaacaagaaccagcagcucaagacccucaucucccagugccagacccgccagaugcagaacaucaacccccucaccaugugccucaacggcgucaucgacgccgccgucaacggcggcgucucccgcuaccaggaggccuucuucgucaaggaguacauccucucccaccccgaggacggcgagaagaucgcccgccuccgcgagcucaugcucgagcaggcccagauccucgaguucggccucgccguccacgagaaguucgucccccaggacaugcgcccccuccacaagaagcucgucgaccaguucuucgucaugaaguccucccucggcauccaggaguucuccgccugcaugcaggccucccccguccacuuccccaacggcuccccccgcgucugccgcaacuccgcccccgccuccgucucccccgacggcacccgcgucaucccccgccgcuccccccucuccuaccccgccgucaaccgcuacuccuccuccucccucuccucccaggccuccgccgaggucuccaacaucaccggccaguccgaguccuccgacgaggucuucaacaugcagcccucccccuccaccuccucccucuccuccacccacuccgccucccccaacgucaccuccuccgcccccuccuccgcccgcgccuccccccuccucuccgacaagcacaagcacucccgcgagaacuccugccucuccccccgcgagcgccccugcuccgccaucuaccccacccccgucgagcccucccagcgcaugcucuucaaccacaucggcgacggcgcccucccccgcuccgaccccaaccucuccgcccccgagaaggccgucaaccccacccccuccuccuggucccucgacuccggcaaggaggccaagaacauguccgacuccggcaagcucaucuccccccccguccccccccgccccacccagaccgccucccccgcccgccacaccaccuccgucucccccucccccgccggccgcuccccccucaagggcuccguccaguccuucacccccucccccgucgaguaccacucccccggccucaucuccaacucccccguccucuccggcuccuacuccuccggcaucuccucccucucccgcugcuccaccuccgagaccuccggcuucgagaaccaggucaacgagcaguccgccccccuccccguccccguccccguccccguccccuccuacggcggcgaggagcccguccgcaaggaguccaagacccccccccccuacuccgucuacgagcgcacccuccgccgccccgucccccucccccacucccucuccauccccgucaccuccgagccccccgcccucccccccaagccccucgccgcccgcuccucccaccucgagaacggcgcccgccgcaccgaccccggcccccgcccccgcccccucccccgcaaggucucccagcucuga

SEQ ID NO: 42377 - RNA, 5613 nt, Artificial Sequence
  derived and/or modified sequence opt2 from DOCK5__Homo_sapiens__NP_079216
auggcccgcuggauccccaccaagcgccagaaguacggcgucgccaucuacaacuacaacgccucccaggacgucgagcucucccuccagaucggcgacaccguccacauccucgagauguacgagggcugguaccgcggcuacacccuccagaacaaguccaagaagggcaucuuccccgagaccuacauccaccucaaggaggccaccgucgaggaccucggccagcacgagaccgucauccccggcgagcucccccucguccaggagcucaccuccacccuccgcgagugggccgucaucuggcgcaagcucuacgucaacaacaagcucacccucuuccgccagcuccagcagaugaccuacucccucaucgaguggcgcucccagauccucuccggcacccuccccaaggacgagcucgccgagcucaagaagaaggucaccgccaagaucgaccacggcaaccgcaugcucggccucgaccucgucguccgcgacgacaacggcaacauccucgaccccgacgagaccuccaccaucgcccucuucaaggcccacgaggucgccuccaagcgcaucgaggagaagauccaggaggagaaguccauccuccagaaccucgaccuccgcggccaguccaucuucuccaccauccacaccuacggccucuacgucaacuucaagaacuucgucugcaacaucggcgaggacgccgagcucuucauggcccucuacgaccccgaccaguccaccuucaucuccgagaacuaccucauccgcuggggcuccaacggcaugcccaaggagaucgagaagcucaacaaccuccaggccgucuucaccgaccucuccuccauggaccucauccgcccccgcgucucccucgucugccagaucguccgcgucggccacauggagcucaaggagggcaagaagcacaccugcggccuccgccgccccuucggcgucgccgucauggacaucaccgacaucauccacggcaaggucgacgacgaggagaagcagcacuucauccccuuccagcagaucgccauggagaccuacauccgccagcgccagcucaucauguccccccucaucaccucccacgucaucggcgagaacgagccccucaccuccguccucaacaaggucaucgccgccaaggaggucaaccacaagggccagggccucugggucucccucaagcuccuccccggcgaccucacccagguccagaagaacuucucccaccucgucgaccgcuccaccgccaucgcccgcaagaugggcuuccccgagaucauccuccccggcgacguccgcaacgacaucuacgucacccucauccacggcgaguucgacaagggcaagaagaagacccccaagaacgucgaggucaccauguccguccacgacgaggagggcaagcuccucgagaaggccauccaccccggcgccggcuacgagggcaucuccgaguacaaguccgucgucuacuaccaggucaagcagcccugcugguacgagaccgucaaggucuccaucgccaucgaggaggucacccgcugccacauccgcuucaccuuccgccaccgcuccucccaggagacccgcgacaaguccgagcgcgccuucggcgucgccuucgucaagcucaugaaccccgacggcaccacccuccaggacggccgccacgaccucgucgucuacaagggcgacaacaagaagauggaggacgccaaguucuaccucacccuccccggcaccaagauggagauggaggagaaggagcuccaggccuccaagaaccucgucaccuucacccccuccaaggacuccaccaaggacuccuuccagaucgccacccucaucugcuccaccaagcucacccagaacgucgaccuccucggccuccucaacuggcgcuccaacucccagaacaucaagcacaaccucaagaagcucauggaggucgacggcggcgagaucgucaaguuccuccaggacacccucgacgcccucuucaacaucaugauggagauguccgacuccgagaccuacgacuuccucgucuucgacgcccucgucuucaucaucucccucaucggcgacaucaaguuccagcacuucaaccccguccucgagaccuacaucuacaagcacuucuccgccacccucgccuacgucaagcucuccaagguccucaacuucuacgucgccaacgccgacgacuccuccaagaccgagcuccucuucgccgcccucaaggcccucaaguaccucuuccgcuucaucauccagucccgcguccucuaccuccgcuucuacggccaguccaaggacggcgacgaguucaacaacuccauccgccagcucuuccucgccuucaacaugcucauggaccgcccccucgaggaggccgucaagaucaagggcgccgcccucaaguaccuccccuccaucaucaacgacgucaagcucgucuucgaccccgucgagcucuccguccucuucugcaaguucauccaguccauccccgacaaccagcucguccgccagaagcucaacugcaugaccaagaucgucgaguccacccucuuccgccaguccgagugccgcgagguccuccucccccuccucaccgaccagcucuccggccagcucgacgacaacuccaacaagcccgaccacgaggccuccucccagcuccucuccaacauccucgagguccucgaccgcaaggacgucggcgccaccgccguccacauccagcucaucauggagcgccuccuccgccgcaucaaccgcaccgucaucggcaugaaccgccaguccccccacaucggcuccuucgucgccugcaugaucgcccuccuccagcagauggacgacucccacuacucccacuacaucuccaccuucaagacccgccaggacaucaucgacuuccucauggagaccuucaucauguucaaggaccucaucggcaagaacgucuacgccaaggacuggauggucaugaacaugacccagaaccgcgucuuccuccgcgccaucaaccaguucgccgagguccucacccgcuucuucauggaccaggccuccuucgagcuccagcucuggaacaacuacuuccaccucgccgucgccuuccucacccacgagucccuccagcucgagaccuucucccaggccaagcgcaacaagaucgucaagaaguacggcgacaugcgcaaggagaucggcuuccgcauccgcgacaugugguacaaccucggcccccacaagaucaaguucauccccuccauggucggccccauccucgaggucacccucacccccgaggucgagcuccgcaaggccaccauccccaucuucuucgacaugaugcagugcgaguucaacuucuccggcaacggcaacuuccacauguucgagaacgagcucaucaccaagcucgaccaggaggucgagggcggccgcggcgacgagcaguacaagguccuccucgagaagcuccuccucgagcacugccgcaagcacaaguaccucuccuccuccggcgaggucuucgcccuccucgucuccucccuccucgagaaccuccucgacuaccgcaccaucaucaugcaggacgaguccaaggagaaccgcauguccugcaccgucaacguccucaacuucuacaaggagaagaagcgcgaggacaucuacauccgcuaccucuacaagcuccgcgaccuccaccgcgacugcgagaacuacaccgaggccgccuacacccuccuccuccacgccgagcuccuccagugguccgacaagcccugcgucccccaccuccuccagaaggacuccuacuacgucuacacccagcaggagcucaaggagaagcucuaccaggagaucaucuccuacuucgacaagggcaagaugugggagaaggccaucaagcucuccaaggagcucgccgagaccuacgaguccaaggucuucgacuacgagggccucggcaaccuccucaagaagcgcgccuccuucuacgagaacaucaucaaggccaugcgcccccagcccgaguacuucgccgucggcuacuacggccagggcuuccccuccuuccuccgcaacaagaucuucaucuaccgcggcaaggaguacgagcgccgcgaggacuucucccuccgccuccucacccaguuccccaacgccgagaagaugaccuccaccaccccccccggcgaggacaucaaguccucccccaagcaguacaugcagugcuucaccgucaagcccgucaugucccucccccccuccuacaaggacaagcccguccccgagcagauccucaacuacuaccgcgccaacgagguccagcaguuccgcuacucccgccccuuccgcaagggcgagaaggaccccgacaacgaguucgccaccauguggaucgagcgcaccaccuacaccaccgccuacaccuuccccggcauccucaagugguucgaggucaagcagaucuccaccgaggagaucuccccccucgagaacgccaucgagaccauggagcucaccaacgagcgcaucuccaacugcguccagcagcacgccugggaccgcucccucuccguccacccccucuccaugcuccucuccggcaucgucgaccccgccgucaugggcggcuucuccaacuacgagaaggccuucuucaccgagaaguaccuccaggagcaccccgaggaccaggagaaggucgagcuccucaagcgccucaucgcccuccagaugccccuccucaccgagggcauccgcauccacggcgagaagcucaccgagcagcucaagccccuccacgagcgccucuccuccugcuuccgcgagcucaaggagaaggucgagaagcacuacggcgucaucacccucccccccaaccucaccgagcgcaagcagucccgcaccggcuccaucguccuccccuacaucauguccuccacccuccgccgccucuccaucaccuccgucaccuccuccgucgucuccaccuccuccaacuccuccgacaacgcccccucccgccccggcuccgacggcuccauccucgagccccuccucgagcgccgcgccuccuccggcgcccgcgucgaggaccucucccuccgcgaggagaacuccgagaaccgcaucuccaaguucaagcgcaaggacuggucccucuccaagucccaggucaucgccgagaaggcccccgagcccgaccucaugucccccacccgcaaggcccagcgccccaagucccuccagcucauggacaaccgccucucccccuuccacggcuccucccccccccaguccaccccccucuccccccccccccucacccccaaggccacccgcacccucuccucccccucccuccagaccgacggcaucgccgccacccccgucccccccccccccccccccaaguccaagcccuacgagggcucccagcgcaacuccaccgagcucgcccccccccuccccguccgccgcgaggccaaggccccccccccccccccccccaaggcccgcaaguccggcauccccaccuccgagcccggcucccaguga

SEQ ID NO: 42378 - RNA, 6144 nt, Artificial Sequence
  derived and/or modified sequence opt2 from DOCK6__Homo_sapiens__NP_065863
auggccgccuccgagcgccgcgccuucgcccacaagaucaaccgcaccgucgccgccgagguccgcaagcaggucucccgcgagcgcuccggcuccccccacuccucccgccgcugcuccuccucccucggcgucccccucaccgaggucgucgagccccucgacuucgaggacguccuccucucccgcccccccgacgccgagcccggcccccuccgcgaccucgucgaguuccccgccgacgaccucgagcuccuccuccagccccgcgagugccgcaccaccgagcccggcauccccaaggacgagaagcucgacgcccagguccgcgccgccgucgagauguacaucgaggacugggucaucguccaccgccgcuaccaguaccucuccgccgccuacucccccgucaccaccgacacccagcgcgagcgccagaagggccucccccgccaggucuucgagcaggacgccuccggcgacgagcgcuccggccccgaggacuccaacgacucccgccgcggcuccggcucccccgaggacaccccccgcuccuccggcgccuccuccaucuucgaccuccgcaaccucgccgccgacucccuccuccccucccuccucgagcgcgccgcccccgaggacgucgaccgccgcaacgagacccuccgccgccagcaccgcccccccgcccuccucacccucuaccccgcccccgacgaggacgaggccgucgagcgcugcucccgccccgagcccccccgcgagcacuucggccagcgcauccucgucaagugccucucccucaaguucgagaucgagaucgagcccaucuucggcauccucgcccucuacgacguccgcgagaagaagaagaucuccgagaacuucuacuucgaccucaacuccgacuccaugaagggccuccuccgcgcccacggcacccaccccgccaucuccacccucgcccgcuccgccaucuucuccgucaccuaccccucccccgacaucuuccucgucaucaagcucgagaagguccuccagcagggcgacaucuccgagugcugcgagcccuacaugguccucaaggaggucgacaccgccaagaacaaggagaagcucgagaagcuccgccucgccgccgagcaguucugcacccgccucggccgcuaccgcaugcccuucgccuggaccgccguccaccucgccaacaucgucuccuccgccggccagcucgaccgcgacuccgacuccgagggcgagcgccgccccgccuggaccgaccgccgccgccgcggcccccaggaccgcgccuccuccggcgacgacgccugcuccuucuccggcuuccgccccgccacccucaccgucaccaacuucuucaagcaggaggccgagcgccucuccgacgaggaccucuucaaguuccucgccgacaugcgccgccccuccucccuccuccgccgccuccgccccgucaccgcccagcucaagaucgacaucucccccgcccccgagaacccccacuucugccucucccccgagcuccuccacaucaagcccuaccccgacccccgcggccgccccaccaaggagauccucgaguuccccgcccgcgaggucuacgccccccacaccuccuaccgcaaccuccucuacgucuacccccacucccucaacuucuccucccgccagggcuccguccgcaaccucgccguccgcguccaguacaugaccggcgaggaccccucccaggcccuccccgucaucuucggcaaguccuccugcuccgaguucacccgcgaggccuucacccccgucgucuaccacaacaagucccccgaguucuacgaggaguucaagcuccaccuccccgccugcgucaccgagaaccaccaccuccucuucaccuucuaccacgucuccugccagccccgccccggcaccgcccucgagacccccgucggcuucaccuggaucccccuccuccagcacggccgccuccgcaccggccccuucugccuccccgucuccgucgaccagcccccccccuccuacuccguccucacccccgacgucgcccuccccggcaugcgcugggucgacggccacaagggcgucuucuccgucgagcucaccgccgucuccuccguccacccccaggaccccuaccucgacaaguucuucacccucguccacguccucgaggagggcgccuuccccuuccgccucaaggacaccguccucuccgagggcaacgucgagcaggagcuccgcgccucccucgccgcccuccgccucgccucccccgagccccucgucgccuucucccaccacguccucgacaagcucguccgccucgucauccgcccccccaucaucuccggccagaucgucaaccucggccgcggcgccuucgaggccauggcccacgucgucucccucguccaccgcucccucgaggccgcccaggacgcccgcggccacugcccccagcucgccgccuacguccacuacgccuuccgccuccccggcaccgagcccucccuccccgacggcgccccccccgucaccguccaggccgccacccucgcccgcggcuccggccgccccgccucccucuaccucgcccgcuccaaguccaucuccuccuccaaccccgaccucgccgucgcccccggcuccgucgacgacgaggucucccgcauccucgccuccaagcuccuccacgaggagcucgcccuccagugggucgucuccuccuccgccguccgcgaggccauccuccagcacgccugguucuucuuccagcucauggucaaguccauggcccuccaccuccuccucggccagcgccucgacaccccccgcaagcuccgcuuccccggccgcuuccucgacgacaucaccgcccucgucggcuccgucggccucgaggucaucacccgcguccacaaggacgucgagcucgccgagcaccucaacgccucccucgccuucuuccucuccgaccuccucucccucgucgaccgcggcuucgucuucucccucguccgcgcccacuacaagcaggucgccacccgccuccaguccucccccaaccccgccgcccuccucacccuccgcauggaguucacccgcauccucugcucccacgagcacuacgucacccucaaccuccccugcugcccccucuccccccccgccucccccucccccuccgucuccuccaccaccucccaguccuccaccuucuccucccaggcccccgaccccaaggucaccuccauguucgagcucuccggccccuuccgccagcagcacuuccucgccggccuccuccucaccgagcucgcccucgcccucgagcccgaggccgagggcgccuuccuccuccacaagaaggccaucuccgccguccacucccuccucugcggccacgacaccgacccccgcuacgccgaggccaccgucaaggcccgcgucgccgagcucuaccucccccuccucuccaucgcccgcgacacccucccccgccuccacgacuucgccgagggccccggccagcgcucccgccucgccuccaugcucgacuccgacaccgagggcgagggcgacaucgccggcaccaucaaccccuccgucgccauggccaucgccggcggcccccucgcccccggcucccgcgccuccaucucccagggcccccccaccgccucccgcgccggcugcgcccucuccgccgaguccucccgcacccuccucgccugcguccucuggguccucaagaacaccgagcccgcccuccuccagcgcugggccaccgaccucacccucccccagcucggccgccuccucgaccuccucuaccucugccucgccgccuucgaguacaagggcaagaaggccuucgagcgcaucaacucccucaccuucaagaagucccucgacaugaaggcccgccucgaggaggccauccucggcaccaucggcgcccgccaggagaugguccgccgcucccgcgagcgcucccccuucggcaaccccgagaacguccgcuggcgcaaguccgucacccacuggaagcagaccuccgaccgcgucgacaagaccaaggacgagauggagcacgaggcccucgucgagggcaaccucgccaccgaggccucccucgucguccucgacacccucgagaucaucguccagaccgucaugcucuccgaggcccgcgaguccguccucggcgccguccucaaggucguccucuacucccucggcuccgcccaguccgcccucuuccuccagcacggccucgccacccagcgcgcccucgucuccaaguuccccgagcuccucuucgaggaggacaccgagcucugcgccgaccucugccuccgccuccuccgccacugcggcucccgcaucuccaccauccgcacccacgccuccgccucccucuaccuccucaugcgccagaacuucgagaucggccacaacuucgcccgcgucaagaugcaggucaccaugucccucuccucccucgucggcaccacccagaacuucuccgaggagcaccuccgccgcucccucaagaccauccucaccuacgccgaggaggacaugggccuccgcgacuccaccuucgccgagcagguccaggaccucauguucaaccuccacaugauccucaccgacaccgucaagaugaaggagcaccaggaggaccccgagaugcucaucgaccucauguaccgcaucgcccgcggcuaccagggcucccccgaccuccgccucaccuggcuccagaacauggccggcaagcacgccgagcucggcaaccacgccgaggccgcccagugcaugguccacgccgccgcccucgucgccgaguaccucgcccuccucgaggaccaccgccaccuccccgucggcugcgucuccuuccagaacaucuccuccaacguccucgaggaguccgccaucuccgacgacauccucucccccgacgaggagggcuucugcuccggcaagcacuucaccgagcucggccucgucggccuccucgagcaggccgccggcuacuucaccaugggcggccucuacgaggccgucaacgaggucuacaagaaccucauccccauccucgaggcccaccgcgacuacaagaagcucgccgccguccacggcaagcuccaggaggccuucaccaagaucaugcaccaguccuccggcugggagcgcgucuucggcaccuacuuccgcgucggcuucuacggcgcccacuucggcgaccucgacgagcaggaguucgucuacaaggagcccuccaucaccaagcucgccgagaucucccaccgccucgaggaguucuacaccgagcgcuucggcgacgacgucgucgagaucaucaaggacuccaaccccgucgacaaguccaagcucgacucccagaaggccuacauccagaucaccuacgucgagcccuacuucgacaccuacgagcucaaggaccgcgucaccuacuucgaccgcaacuacggccuccgcaccuuccucuucugcacccccuucacccccgacggccgcgcccacggcgagcuccccgagcagcacaagcgcaagacccuccucuccaccgaccacgccuuccccuacaucaagacccgcauccgcgucugccaccgcgaggagaccguccucacccccgucgaggucgccaucgaggacaugcagaagaagacccgcgagcucgccuucgccaccgagcaggacccccccgacgccaagaugcuccagaugguccuccagggcuccgucggccccaccgucaaccagggcccccucgaggucgcccaggucuuccucgccgagauccccgaggaccccaagcucuuccgccaccacaacaagcuccgccucugcuucaaggacuucugcaagaagugcgaggacgcccuccgcaagaacaaggcccucaucggccccgaccagaaggaguaccaccgcgagcucgagcgcaacuacugccgccuccgcgaggcccuccagccccuccucacccagcgccucccccagcucauggcccccaccccccccggccuccgcaacucccucaaccgcgccuccuuccgcaaggccgaccucuga

SEQ ID NO: 42379 - RNA, 6423 nt, Artificial Sequence
  derived and/or modified sequence opt2 from DOCK7__Homo_sapiens__XP_011540628
auggccgagcgccgcgccuucgcccagaagaucucccgcaccgucgccgccgagguccgcaagcagaucuccggccaguacuccggcuccccccagcuccucaagaaccucaacaucgucggcaacaucucccaccacaccaccgucccccucaccgaggccgucgaccccgucgaccucgaggacuaccucaucacccacccccucgccgucgacuccggcccccuccgcgaccucaucgaguucccccccgacgacaucgaggucgucuacuccccccgcgacugccgcacccucgucuccgccguccccgaggaguccgagauggacccccacguccgcgacugcauccgcuccuacaccgaggacugggccaucgucauccgcaaguaccacaagcucggcaccggcuucaaccccaacacccucgacaagcagaaggagcgccagaagggccuccccaagcaggucuucgaguccgacgaggcccccgacggcaacuccuaccaggacgaccaggacgaccucaagcgccgcuccauguccaucgacgacaccccccgcggcuccugggccugcuccaucuucgaccucaagaacucccuccccgacgcccuccuccccaaccuccucgaccgcacccccaacgaggagaucgaccgccagaacgacgaccagcgcaaguccaaccgccacaaggagcucuucgcccuccaccccucccccgacgaggaggagcccaucgagcgccucuccguccccgacauccccaaggagcacuucggccagcgccuccucgucaagugccucucccucaaguucgagaucgagaucgagcccaucuucgccucccucgcccucuacgacgucaaggagaagaagaagaucuccgagaacuucuacuucgaccucaacuccgagcagaugaagggccuccuccgcccccacgucccccccgccgccaucaccacccucgcccgcuccgccaucuucuccaucaccuaccccucccaggacgucuuccucgucaucaagcucgagaagguccuccagcagggcgacaucggcgagugcgccgagcccuacaugaucuucaaggaggccgacgccaccaagaacaaggagaagcucgagaagcucaagucccaggccgaccaguucugccagcgccucggcaaguaccgcaugcccuucgccuggaccgccauccaccucaugaacaucgucuccuccgccggcucccucgagcgcgacuccaccgaggucgagaucuccaccggcgagcgcaagggcuccugguccgagcgccgcaacuccuccaucgucggccgccgcucccucgagcgcaccaccuccggcgacgacgccugcaaccucaccuccuuccgccccgccacccucaccgucaccaacuucuucaagcaggagggcgaccgccucuccgacgaggaccucuacaaguuccucgccgacaugcgccgccccuccuccguccuccgccgccuccgccccaucaccgcccagcucaagaucgacaucucccccgcccccgagaacccccacuacugccucacccccgagcuccuccaggucaagcucuaccccgacucccgcguccgccccacccgcgagauccucgaguuccccgcccgcgacgucuacguccccaacaccaccuaccgcaaccuccucuacaucuacccccagucccucaacuucgccaaccgccagggcuccgcccgcaacaucaccgucaagguccaguucauguacggcgaggaccccuccaacgccaugcccgucaucuucggcaaguccuccugcuccgaguucuccaaggaggccuacaccgccgucgucuaccacaaccgcucccccgacuuccacgaggagaucaaggucaagcuccccgccacccucaccgaccaccaccaccuccucuucaccuucuaccacgucuccugccagcagaagcagaacaccccccucgagacccccgucggcuacaccuggauccccaugcuccagaacggccgccucaagaccggccaguucugccuccccgucucccucgagaagcccccccaggccuacuccguccucucccccgaggucccccuccccggcaugaagugggucgacaaccacaagggcgucuucaacgucgaggucgucgccgucuccuccauccacacccaggaccccuaccucgacaaguucuucgcccucgucaacgcccucgacgagcaccucuuccccguccgcaucggcgacaugcgcaucauggagaacaaccucgagaacgagcucaaguccuccaucuccgcccucaacuccucccagcucgagcccgucguccgcuuccuccaccuccuccucgacaagcucauccuccucgucauccgcccccccgucaucgccggccagaucgucaaccucggccaggccuccuucgaggccauggccuccaucaucaaccgccuccacaagaaccucgagggcaaccacgaccagcacggccgcaacucccuccucgccuccuacauccacuacgucuuccgccuccccaacaccuaccccaacuccuccucccccggccccggcggccucggcggcuccguccacuacgccaccauggcccgcuccgccguccgccccgccucccucaaccucaaccgcucccgcucccucuccaacuccaaccccgacaucuccggcacccccaccucccccgacgacgagguccgcuccaucaucggcuccaagggccucgaccgcuccaacuccugggucaacaccggcggccccaaggccgcccccuggggcuccaaccccucccccuccgccgaguccacccaggccauggaccgcuccugcaaccgcauguccucccacaccgagaccuccuccuuccuccagacccucaccggccgccuccccaccaagaagcucuuccacgaggagcucgcccuccagugggucgucugcuccggcuccguccgcgaguccgcccuccagcaggccugguucuucuucgagcucauggucaaguccaugguccaccaccucuacuucaacgacaagcucgaggccccccgcaagucccgcuuccccgagcgcuucauggacgacaucgccgcccucgucuccaccaucgccuccgacaucgucucccgcuuccagaaggacaccgagauggucgagcgccucaacaccucccucgccuucuuccucaacgaccuccucuccgucauggaccgcggcuucgucuucucccucaucaaguccugcuacaagcaggucuccuccaagcucuacucccuccccaaccccuccguccucgucucccuccgccucgacuuccuccgcaucaucugcucccacgagcacuacgucacccucaaccuccccugcucccuccucaccccccccgccucccccucccccuccgucuccuccgccaccucccaguccuccggcuucuccaccaacguccaggaccagaagaucgccaacauguucgagcucuccguccccuuccgccagcagcacuaccucgccggccucguccucaccgagcucgccgucauccucgaccccgacgccgagggccucuucggccuccacaagaaggucaucaacaugguccacaaccuccucuccucccacgacuccgacccccgcuacuccgacccccagaucaaggcccgcgucgccaugcucuaccucccccucaucggcaucaucauggagaccgucccccagcucuacgacuucaccgagacccacaaccagcgcggccgccccaucugcaucgccaccgacgacuacgaguccgaguccggcuccaugaucucccagaccgucgccauggccaucgccggcaccuccgucccccagcucacccgccccggcuccuuccuccucaccuccaccuccggccgccagcacaccaccuucuccgccgaguccucccgcucccuccucaucugccuccucuggguccucaagaacgccgacgagaccguccuccagaagugguucaccgaccucuccguccuccagcucaaccgccuccucgaccuccucuaccucugcgucuccugcuucgaguacaagggcaagaaggucuucgagcgcaugaacucccucaccuucaagaaguccaaggacaugcgcgccaagcucgaggaggccauccucggcuccaucggcgcccgccaggagaugguccgccgcucccgcggccagcucggcaccuacaccaucgccuccccccccgagcgcucccccuccggcuccgccuucggcucccaggagaaccuccgcuggcgcaaggacaugacccacuggcgccagaacaccgagaagcucgacaagucccgcgccgagaucgagcacgaggcccucaucgacggcaaccucgccaccgaggccaaccucaucauccucgacacccucgagaucgucguccagaccgucuccgucaccgaguccaaggaguccauccucggcggcguccucaagguccuccuccacuccauggccugcaaccaguccgccgucuaccuccagcacugcuucgccacccagcgcgcccucgucuccaaguuccccgagcuccucuucgaggaggagaccgagcagugcgccgaccucugccuccgccuccuccgccacugcuccuccuccaucggcaccauccgcucccacgccuccgccucccucuaccuccucaugcgccagaacuucgagaucggcaacaacuucgcccgcgucaagaugcaggucaccaugucccucuccucccucgucggcaccucccagaacuucaacgaggaguuccuccgccgcucccucaagaccauccucaccuacgccgaggaggaccucgagcuccgcgagaccaccuuccccgaccagguccaggaccucgucuucaaccuccacaugauccucuccgacaccgucaagaugaaggagcaccaggaggaccccgagaugcucaucgaccucauguaccgcaucgccaagggcuaccagaccucccccgaccuccgccucaccuggcuccagaacauggccggcaagcacuccgagcgcuccaaccacgccgaggccgcccagugccucguccacuccgccgcccucgucgccgaguaccucuccaugcucgaggaccgcaaguaccuccccgucggcugcgucaccuuccagaacaucuccuccaacguccucgaggaguccgccgucuccgacgacgucgucucccccgacgaggagggcaucugcuccggcaaguacuucaccgaguccggccucgucggccuccucgagcaggccgccgccuccuucuccauggccggcauguacgaggccgucaacgaggucuacaagguccucauccccauccacgaggccaaccgcgacgccaagaagcucuccaccauccacggcaagcuccaggaggccuucuccaagaucguccaccaguccaccggcugggagcgcauguucggcaccuacuuccgcgucggcuucuacggcaccaaguucggcgaccucgacgagcaggaguucgucuacaaggagcccgccaucaccaagcucgccgagaucucccaccgccucgagggcuucuacggcgagcgcuucggcgaggacgucgucgaggucaucaaggacuccaaccccgucgacaagugcaagcucgaccccaacaaggccuacauccagaucaccuacgucgagcccuacuucgacaccuacgagaugaaggaccgcaucaccuacuucgacaagaacuacaaccuccgccgcuucauguacugcacccccuucacccucgacggccgcgcccacggcgagcuccacgagcaguucaagcgcaagaccauccucaccaccucccacgccuuccccuacaucaagacccgcgucaacgucacccacaaggaggagaucauccucacccccaucgaggucgccaucgaggacaugcagaagaagacccaggagcucgccuucgccacccaccaggaccccgccgaccccaagaugcuccagaugguccuccagggcuccgucggcaccaccgucaaccagggcccccucgaggucgcccaggucuuccucuccgagauccccuccgaccccaagcucuuccgccaccacaacaagcuccgccucugcuucaaggacuucaccaagcgcugcgaggacgcccuccgcaagaacaagucccucaucggccccgaccagaaggaguaccagcgcgagcucgagcgcaacuaccaccgccucaaggaggcccuccagccccucaucaaccgcaagaucccccagcucuacaaggccguccuccccgucaccugccaccgcgacuccuucucccgcaugucccuccgcaagauggaccucuga

SEQ ID NO: 42380 - RNA, 6300 nt, Artificial Sequence
  derived and/or modified sequence opt2 from DOCK8__Homo_sapiens__NP_982272
auggccacccuccccuccgccgagcgccgcgccuucgcccucaagaucaaccgcuacuccuccgccgagauccgcaagcaguucacccucccccccaaccucggccaguaccaccgccaguccaucuccaccuccggcuuccccucccuccagcucccccaguucuacgaccccgucgagcccgucgacuucgagggccuccucaugacccaccucaacucccucgacguccagcucgcccaggagcucggcgacuucaccgacgacgaccucgacgucgucuucacccccaaggagugccgcacccuccagcccucccuccccgaggagggcgucgagcucgacccccacguccgcgacugcguccagaccuacauccgcgaguggcucaucgucaaccgcaagaaccagggcucccccgagaucugcggcuucaagaagaccggcucccgcaaggacuuccacaagacccuccccaagcagaccuucgaguccgagacccucgagugcuccgagcccgccgcccaggccggcccccgccaccucaacguccucugcgacgucuccggcaagggccccgucaccgccugcgacuucgaccuccgcucccuccagcccgacaagcgccucgagaaccuccuccagcaggucuccgccgaggacuucgagaagcagaacgaggaggcccgccgcaccaaccgccaggccgagcucuucgcccucuaccccuccgucgacgaggaggacgccgucgagauccgccccguccccgagugccccaaggagcaccucggcaaccgcauccucgucaagcuccucacccucaaguucgagaucgagaucgagccccucuucgccuccaucgcccucuacgacgucaaggagcgcaagaagaucuccgagaacuuccacugcgaccucaacuccgaccaguucaagggcuuccuccgcgcccacacccccuccgucgccgccuccucccaggcccgcuccgccgucuucuccgucaccuaccccuccuccgacaucuaccucgucgucaagaucgagaagguccuccagcagggcgagaucggcgacugcgccgagcccuacaccgucaucaaggaguccgacggcggcaaguccaaggagaagaucgagaagcucaagcuccaggccgaguccuucugccagcgccucggcaaguaccgcaugcccuucgccugggcccccaucucccucuccuccuucuucaacgucuccacccucgagcgcgaggucaccgacgucgacuccgucgucggccgcuccuccgucggcgagcgccgcacccucgcccagucccgccgccucuccgagcgcgcccucucccucgaggagaacggcgucggcuccaacuucaagaccuccacccucuccgucuccuccuucuucaagcaggagggcgaccgccucuccgacgaggaccucuucaaguuccucgccgacuacaagcgcuccuccucccuccagcgccgcgucaaguccauccccggccuccuccgccucgagaucuccaccgcccccgagaucaucaacugcugccucacccccgagaugcuccccgucaagcccuuccccgagaaccgcacccgcccccacaaggagauccucgaguuccccacccgcgaggucuacgucccccacaccgucuaccgcaaccuccucuacgucuacccccagcgccucaacuucgucaacaagcucgccuccgcccgcaacaucaccaucaagauccaguucaugugcggcgaggacgccuccaacgccaugcccgucaucuucggcaaguccuccggccccgaguuccuccaggaggucuacaccgccgucaccuaccacaacaagucccccgacuucuacgaggaggucaagaucaagcuccccgccaagcucaccgucaaccaccaccuccucuucaccuucuaccacaucuccugccagcagaagcagggcgccuccgucgagacccuccucggcuacuccuggcuccccauccuccucaacgagcgccuccagaccggcuccuacugccuccccgucgcccucgagaagcucccccccaacuacuccaugcacuccgccgagaaggucccccuccagaacccccccaucaagugggccgagggccacaagggcgucuucaacaucgagguccaggccgucuccuccguccacacccaggacaaccaccucgagaaguucuucacccucugccacucccucgagucccaggucaccuuccccauccgcguccucgaccagaagaucuccgagauggcccucgagcacgagcucaagcucuccaucaucugccucaacuccucccgccucgagccccucguccucuuccuccaccucguccucgacaagcucuuccagcucuccguccagcccauggucaucgccggccagaccgccaacuucucccaguucgccuucgaguccgucgucgccaucgccaacucccuccacaacuccaaggaccucuccaaggaccagcacggccgcaacugccuccucgccuccuacguccacuacgucuuccgccuccccgagguccagcgcgacguccccaaguccggcgcccccaccgcccuccucgacccccgcuccuaccacaccuacggccgcaccuccgccgccgccgucuccuccaagcuccuccaggcccgcgucauguccuccuccaaccccgaccucgccggcacccacuccgccgccgacgaggaggucaagaacaucauguccuccaagaucgccgaccgcaacugcucccgcauguccuacuacugcuccggcuccuccgacgcccccuccucccccgccgccccccgccccgccuccaagaagcacuuccacgaggagcucgcccuccagauggucgucuccaccggcaugguccgcgagaccgucuucaaguacgccugguucuucuucgagcuccucgucaaguccauggcccagcacguccacaacauggacaagcgcgacuccuuccgccgcacccgcuucuccgaccgcuucauggacgacaucaccaccaucgucaacgucgucaccuccgagaucgccgcccuccucgucaagccccagaaggagaacgagcaggccgagaagaugaacaucucccucgccuucuuccucuacgaccuccucucccucauggaccgcggcuucgucuucaaccucauccgccacuacugcucccagcucuccgccaagcucuccaaccuccccacccucaucuccaugcgccucgaguuccuccgcauccucugcucccacgagcacuaccucaaccucaaccucuucuucaugaacgccgacaccgcccccaccucccccugccccuccaucuccucccagaacuccuccuccugcuccuccuuccaggaccagaagaucgccuccauguucgaccucaccuccgaguaccgccagcagcacuuccucaccggccuccucuucaccgagcucgccgccgcccucgacgccgagggcgagggcaucuccaagguccagcgcaaggccgucuccgccauccacucccuccucuccucccacgaccucgacccccgcugcgucaagcccgaggucaaggucaagaucgccgcccucuaccucccccucgucggcaucauccucgacgcccucccccagcucugcgacuucaccgucgccgacacccgccgcuaccgcaccuccggcuccgacgaggagcaggagggcgccggcgccaucaaccagaacgucgcccucgccaucgccggcaacaacuucaaccucaagaccuccggcaucguccucuccucccuccccuacaagcaguacaacaugcucaacgccgacaccacccgcaaccucaugaucugcuuccucuggaucaugaagaacgccgaccagucccucauccgcaaguggaucgccgaccuccccuccacccagcucaaccgcauccucgaccuccucuucaucugcguccucugcuucgaguacaagggcaagcaguccuccgacaaggucuccacccagguccuccagaagucccgcgacgucaaggcccgccucgaggaggcccuccuccgcggcgagggcgcccgcggcgagaugaugcgccgccgcgcccccggcaacgaccgcuuccccggccucaacgagaaccuccgcuggaagaaggagcagacccacuggcgccaggccaacgagaagcucgacaagaccaaggccgagcucgaccaggaggcccucaucuccggcaaccucgccaccgaggcccaccucaucauccucgacaugcaggagaacaucauccaggccuccuccgcccucgacugcaaggacucccuccucggcggcguccuccgcguccucgucaacucccucaacugcgaccaguccaccaccuaccucacccacugcuucgccacccuccgcgcccucaucgccaaguucggcgaccuccucuucgaggaggaggucgagcagugcuucgaccucugccaccagguccuccaccacugcuccuccuccauggacgucacccgcucccaggccugcgccacccucuaccuccucaugcgcuucuccuucggcgccaccuccaacuucgcccgcgucaagaugcaggucaccaugucccucgccucccucgucggccgcgcccccgacuucaacgaggagcaccuccgccgcucccuccgcaccauccucgccuacuccgaggaggacaccgccaugcagaugacccccuuccccacccaggucgaggagcuccucugcaaccucaacuccauccucuacgacaccgucaagaugcgcgaguuccaggaggaccccgagaugcucauggaccucauguaccgcaucgccaaguccuaccaggccucccccgaccuccgccucaccuggcuccagaacauggccgagaagcacaccaagaagaagugcuacaccgaggccgccaugugccucguccacgccgccgcccucgucgccgaguaccucuccaugcucgaggaccacuccuaccuccccgucggcuccgucuccuuccagaacaucuccuccaacguccucgaggaguccgucgucuccgaggacacccucucccccgacgaggacggcgucugcgccggccaguacuucaccgaguccggccucgucggccuccucgagcaggccgccgagcucuucuccaccggcggccucuacgagaccgucaacgaggucuacaagcucgucauccccauccucgaggcccaccgcgaguuccgcaagcucacccucacccacuccaagcuccagcgcgccuucgacuccaucgucaacaaggaccacaagcgcauguucggcaccuacuuccgcgucggcuucuucggcuccaaguucggcgaccucgacgagcaggaguucgucuacaaggagcccgccaucaccaagcuccccgagaucucccaccgccucgaggccuucuacggccagugcuucggcgccgaguucgucgaggucaucaaggacuccacccccgucgacaagaccaagcucgaccccaacaaggccuacauccagaucaccuucgucgagcccuacuucgacgaguacgagaugaaggaccgcgucaccuacuucgagaagaacuucaaccuccgccgcuucauguacaccacccccuucacccucgagggccgcccccgcggcgagcuccacgagcaguaccgccgcaacaccguccucaccaccaugcacgccuuccccuacaucaagacccgcaucuccgucauccagaaggaggaguucguccucacccccaucgaggucgccaucgaggacaugaagaagaagacccuccagcucgccgucgccaucaaccaggagccccccgacgccaagaugcuccagaugguccuccagggcuccgucggcgccaccgucaaccagggcccccucgaggucgcccaggucuuccucgccgagauccccgccgaccccaagcucuaccgccaccacaacaagcuccgccucugcuucaaggaguucaucaugcgcugcggcgaggccgucgagaagaacaagcgccucaucaccgccgaccagcgcgaguaccagcaggagcucaagaagaacuacaacaagcucaaggagaaccuccgccccaugaucgagcgcaagauccccgagcucuacaagcccaucuuccgcgucgagucccagaagcgcgacuccuuccaccgcuccuccuuccgcaagugcgagacccagcucucccagggcuccuga

SEQ ID NO: 42381 - RNA, 6207 nt, Artificial Sequence
  derived and/or modified sequence opt2 from DOCK9__Homo_sapiens__NP_001123520
augcaggccgacaagugccgcaccuccucccgcuccgucaagaaggagcucgucaucgaguccccccuccaguacaaggacgccgcccagggcgaggucgaggccgagucccccggccccguccccgccaagcccaagcucaucgagccccucgacuacgagaacgucaucguccagaagaagacccagauccucaacgacugccuccgcgagaugcuccucuuccccuacgacgacuuccagaccgccauccuccgccgccagggccgcuacaucugcuccaccguccccgccaaggccgaggaggaggcccagucccucuucgucaccgagugcaucaagaccuacaacuccgacuggcaccucgucaacuacaaguacgaggacuacuccggcgaguuccgccagcuccccaacaaggucgucaagcucgacaagcuccccguccacgucuacgaggucgacgaggaggucgacaaggacgaggacgccgccucccucggcucccagaagggcggcaucaccaagcacggcuggcucuacaagggcaacaugaacuccgccaucuccgucaccaugcgcuccuucaagcgccgcuucuuccaccucauccagcucggcgacggcuccuacaaccucaacuucuacaaggacgagaagaucuccaaggagcccaagggcuccaucuuccucgacuccugcaugggcgucguccagaacaacaagguccgccgcuucgccuucgagcucaagaugcaggacaaguccuccuaccuccucgccgccgacuccgaggucgagauggaggaguggaucaccauccucaacaagauccuccagcucaacuucgaggccgccaugcaggagaagcgcaacggcgacucccacgaggacgacgagcaguccaagcucgagggcuccggcuccggccucgacuccuaccuccccgagcucgccaaguccgcccgcgaggccgagaucaagcucaaguccgagucccgcgucaagcucuucuaccucgaccccgacgcccagaagcucgacuucuccuccgccgagcccgaggucaaguccuucgaggagaaguucggcaagcgcauccucgucaagugcaacgaccucuccuucaaccuccagugcugcgucgccgagaacgaggagggccccaccaccaacgucgagcccuucuucgucacccucucccucuucgacaucaaguacaaccgcaagaucuccgccgacuuccacgucgaccucaaccacuucuccguccgccagaugcucgccaccaccucccccgcccucaugaacggcuccggccagucccccuccguccucaagggcauccuccacgaggccgccaugcaguaccccaagcagggcaucuucuccgucaccugcccccaccccgacaucuuccucgucgcccgcaucgagaagguccuccagggcuccaucacccacugcgccgagcccuacaugaaguccuccgacuccuccaaggucgcccagaagguccucaagaacgccaagcaggccugccagcgccucggccaguaccgcaugcccuucgccugggccgcccgcacccucuucaaggacgccuccggcaaccucgacaagaacgcccgcuucuccgccaucuaccgccaggacuccaacaagcucuccaacgacgacaugcucaagcuccucgccgacuuccgcaagcccgagaagauggccaagcuccccgucauccucggcaaccucgacaucaccaucgacaacgucuccuccgacuuccccaacuacgucaacuccuccuacauccccaccaagcaguucgagaccugcuccaagacccccaucaccuucgaggucgaggaguucguccccugcauccccaagcacacccagcccuacaccaucuacaccaaccaccucuacgucuaccccaaguaccucaaguacgacucccagaaguccuucgccaaggcccgcaacaucgccaucugcaucgaguucaaggacuccgacgaggaggacucccagccccucaagugcaucuacggccgccccggcggccccgucuucacccgcuccgccuucgccgccguccuccaccaccaccagaaccccgaguucuacgacgagaucaagaucgagcuccccacccagcuccacgagaagcaccaccuccuccucaccuucuuccacgucuccugcgacaacuccuccaagggcuccaccaagaagcgcgacgucgucgagacccaggucggcuacuccuggcucccccuccucaaggacggccgcgucgucaccuccgagcagcacauccccgucuccgccaaccuccccuccggcuaccucggcuaccaggagcucggcaugggccgccacuacggccccgagaucaagugggucgacggcggcaagccccuccucaagaucuccacccaccucgucuccaccgucuacacccaggaccagcaccuccacaacuucuuccaguacugccagaagaccgaguccggcgcccaggcccucggcaacgagcucgucaaguaccucaagucccuccacgccauggagggccacgucaugaucgccuuccuccccaccauccucaaccagcucuuccgcguccucacccgcgccacccaggaggaggucgccgucaacgucacccgcgucaucauccacgucgucgcccagugccacgaggagggccucgagucccaccuccgcuccuacgucaaguacgccuacaaggccgagcccuacgucgccuccgaguacaagaccguccacgaggagcucaccaaguccaugaccaccauccucaagcccuccgccgacuuccucaccuccaacaagcuccucaaguacuccugguucuucuucgacguccucaucaaguccauggcccagcaccucaucgagaacuccaaggucaagcuccuccgcaaccagcgcuuccccgccuccuaccaccacgccgucgagaccgucgucaacaugcucaugccccacaucacccagaaguuccgcgacaaccccgaggccuccaagaacgccaaccacucccucgccgucuucaucaagcgcugcuucaccuucauggaccgcggcuucgucuucaagcagaucaacaacuacaucuccugcuucgcccccggcgaccccaagacccucuucgaguacaaguucgaguuccuccgcgucgucugcaaccacgagcacuacaucccccucaaccuccccaugcccuucggcaagggccgcauccagcgcuaccaggaccuccagcucgacuacucccucaccgacgaguucugccgcaaccacuuccucgucggccuccuccuccgcgaggucggcaccgcccuccaggaguuccgcgagguccgccucaucgccaucuccguccucaagaaccuccucaucaagcacuccuucgacgaccgcuacgccucccgcucccaccaggcccgcaucgccacccucuaccucccccucuucggccuccucaucgagaacguccagcgcaucaacguccgcgacgucucccccuuccccgucaacgccggcaugaccgucaaggacgagucccucgcccuccccgccgucaacccccucgucaccccccagaagggcuccacccucgacaacucccuccacaaggaccuccucggcgccaucuccggcaucgccucccccuacaccaccuccacccccaacaucaacuccguccgcaacgccgacucccgcggcucccucaucuccaccgacuccggcaacucccuccccgagcgcaacuccgagaaguccaacucccucgacaagcaccagcaguccuccacccucggcaacuccgucguccgcugcgacaagcucgaccaguccgagaucaagucccuccucaugugcuuccucuacauccucaaguccauguccgacgacgcccucuucaccuacuggaacaaggccuccaccuccgagcucauggacuucuucaccaucuccgaggucugccuccaccaguuccaguacaugggcaagcgcuacaucgcccgcaccggcaugaugcacgcccgccuccagcagcucggcucccucgacaacucccucaccuucaaccacuccuacggccacuccgacgccgacguccuccaccagucccuccucgaggccaacaucgccaccgaggucugccucaccgcccucgacacccucucccucuucacccucgccuucaagaaccagcuccucgccgaccacggccacaacccccucaugaagaaggucuucgacgucuaccucugcuuccuccagaagcaccaguccgagaccgcccucaagaacgucuucaccgcccuccgcucccucaucuacaaguuccccuccaccuucuacgagggccgcgccgacaugugcgccgcccucugcuacgagauccucaagugcugcaacuccaagcucuccuccauccgcaccgaggccucccagcuccucuacuuccucaugcgcaacaacuucgacuacaccggcaagaaguccuucguccgcacccaccuccaggucaucaucuccgucucccagcucaucgccgacgucgucggcaucggcggcacccgcuuccagcagucccucuccaucaucaacaacugcgccaacuccgaccgccucaucaagcacaccuccuucuccuccgacgucaaggaccucaccaagcgcauccgcaccguccucauggccaccgcccagaugaaggagcacgagaacgaccccgagaugcucgucgaccuccaguacucccucgccaaguccuacgccuccacccccgagcuccgcaagaccuggcucgacuccauggcccgcauccacgucaagaacggcgaccucuccgaggccgccaugugcuacguccacgucaccgcccucgucgccgaguaccucacccgcaaggaggccguccagugggagcccccccuccucccccacucccacuccgccugccuccgccgcucccgcggcggcgucuuccgccagggcugcaccgccuuccgcgucaucacccccaacaucgacgaggaggccuccaugauggaggacgucggcaugcaggacguccacuucaacgaggacguccucauggagcuccucgagcagugcgccgacggccucuggaaggccgagcgcuacgagcucaucgccgacaucuacaagcucaucauccccaucuacgagaagcgccgcgacuucgagcgccucgcccaccucuacgacacccuccaccgcgccuacuccaaggucaccgaggucaugcacuccggccgccgccuccucggcaccuacuuccgcgucgccuucuucggccaggccgcccaguaccaguucaccgacuccgagaccgacgucgagggcuucuucgaggacgaggacggcaaggaguacaucuacaaggagcccaagcucaccccccucuccgagaucucccagcgccuccucaagcucuacuccgacaaguucggcuccgagaacgucaagaugauccaggacuccggcaaggucaaccccaaggaccucgacuccaaguacgccuacauccaggucacccacgucauccccuucuucgacgagaaggagcuccaggagcgcaagaccgaguucgagcgcucccacaacauccgccgcuucauguucgagaugcccuucacccagaccggcaagcgccagggcggcgucgaggagcagugcaagcgccgcaccauccucaccgccauccacugcuuccccuacgucaagaagcgcauccccgucauguaccagcaccacaccgaccucaaccccaucgaggucgccaucgacgagauguccaagaaggucgccgagcuccgccagcucugcuccuccgccgaggucgacaugaucaagcuccagcucaagcuccagggcuccgucuccguccaggucaacgccggcccccucgccuacgcccgcgccuuccucgacgacaccaacaccaagcgcuaccccgacaacaaggucaagcuccucaaggaggucuuccgccaguucgucgaggccugcggccaggcccucgccgucaacgagcgccucaucaaggaggaccagcucgaguaccaggaggagaugaaggccaacuaccgcgagauggccaaggagcucuccgagaucaugcacgagcagcucggcuga

SEQ ID NO: 42382 - RNA, 909 nt, Artificial Sequence
  derived and/or modified sequence opt2 from DOHH__Homo_sapiens__XP_011526642
auggucaccgagcaggaggucgacgccaucggccagacccucgucgaccccaagcagccccuccaggcccgcuuccgcgcccucuucacccuccgcggccucggcggccccggcgccaucgccuggaucucccaggccuucgacgacgacuccgcccuccucaagcacgagcucgccuacugccucggccagaugcaggacgcccgcgccauccccaugcucgucgacguccuccaggacacccgccaggagcccaugguccgccacgaggccggcgaggcccucggcgccaucggcgaccccgagguccucgagauccucaagcaguacuccuccgaccccgucaucgaggucgccgagaccugccagcucgccguccgccgccucgaguggcuccagcagcacggcggcgagcccgccgccggccccuaccucuccgucgaccccgccccccccgccgaggagcgcgacgucggccgccuccgcgaggcccuccucgacgagucccgcccccucuucgagcgcuaccgcgccauguucgcccuccgcaacgccggcggcgaggaggccgcccucgcccucgccgagggccuccacugcggcuccgcccucuuccgccacgaggucggcuacguccucggccagcuccagcacgaggccgccgucccccagcucgccgccgcccucgcccgcugcaccgagaaccccaugguccgccacgagugcgccgaggcccucggcgccaucgcccgccccgccugccucgccgcccuccaggcccacgccgacgaccccgagcgcgucguccgcgaguccugcgaggucgcccucgacauguacgagcacgagaccggccgcgccuuccaguacgccgacggccucgagcagcuccgcggcgcccccuccuga

SEQ ID NO: 42383 - RNA, 1029 nt, Artificial Sequence
  derived and/or modified sequence opt2 from DOK1__Homo_sapiens__NP_001184189
augcucgagaacucccucuacucccccaccugggagggcucccaguucugggucaccguccagcgcaccgaggccgccgagcgcugcggccuccacggcuccuacguccuccgcgucgaggccgagcgccucacccuccucaccgucggcgcccagucccagauccucgagccccuccucuccuggcccuacacccuccuccgccgcuacggccgcgacaaggucauguucuccuucgaggccggccgccgcugccccuccggccccggcaccuucaccuuccagaccgcccagggcaacgacaucuuccaggccgucgagaccgccauccaccgccagaaggcccagggcaaggccggccagggccacgacguccuccgcgccgacucccacgagggcgaggucgccgagggcaagcuccccuccccccccggcccccaggagcuccucgacuccccccccgcccucuacgccgagccccucgacucccuccgcaucgcccccugccccucccaggacucccucuacuccgacccccucgacuccaccuccgcccaggccggcgagggcguccagcgcaagaagccccucuacugggaccucuacgagcacgcccagcagcagcuccucaaggccaagcucaccgaccccaaggaggaccccaucuacgacgagcccgagggccucgcccccguccccccccagggccucuacgaccucccccgcgagcccaaggacgccugguggugccaggcccgcgucaaggaggagggcuacgagcuccccuacaaccccgccaccgacgacuacgccgucccccccccccgcuccaccaagccccuccucgcccccaagccccagggccccgccuuccccgagcccggcaccgccaccggcuccggcaucaagucccacaacuccgcccucuacucccagguccagaaguccggcgccuccggcuccugggacugcggccucucccgcgucggcaccgacaagaccggcgucaaguccgagggcuccaccuga

SEQ ID NO: 42384 - RNA, 1239 nt, Artificial Sequence
  derived and/or modified sequence opt2 from DOK2__Homo_sapiens__NP_003965
augggcgacggcgccgucaagcagggcuuccucuaccuccagcagcagcagaccuucggcaagaaguggcgccgcuucggcgccucccucuacggcggcuccgacugcgcccucgcccgccucgagcuccaggagggccccgagaagccccgccgcugcgaggccgcccgcaaggucauccgccucuccgacugccuccgcgucgccgaggccggcggcgaggccuccuccccccgcgacaccuccgccuucuuccucgagaccaaggagcgccucuaccuccucgccgcccccgccgccgagcgcggcgacuggguccaggccaucugccuccucgccuuccccggccagcgcaaggagcucuccggccccgagggcaagcagucccgccccugcauggaggagaacgagcucuacuccuccgccgucaccgucggcccccacaaggaguucgccgucaccaugcgccccaccgaggccuccgagcgcugccaccuccgcggcuccuacacccuccgcgccggcgaguccgcccucgagcucuggggcggccccgagcccggcacccagcucuacgacuggcccuaccgcuuccuccgccgcuucggccgcgacaaggucaccuucuccuucgaggccggccgccgcugcgucuccggcgagggcaacuucgaguucgagacccgccagggcaacgagaucuuccucgcccucgaggaggccaucuccgcccagaagaacgccgcccccgccaccccccagccccagcccgccaccauccccgccucccucccccgccccgacucccccuacucccgcccccacgacucccuccccccccccucccccaccacccccguccccgccccccgcccccgcggccaggagggcgaguacgccguccccuucgacgccgucgcccgcucccucggcaagaacuuccgcggcauccucgccguccccccccagcuccucgccgacccccucuacgacuccaucgaggagacccuccccccccgccccgaccacaucuacgacgagcccgagggcgucgccgcccucucccucuacgacuccccccaggagccccgcggcgaggccuggcgccgccaggccaccgccgaccgcgaccccgccggccuccagcacguccagcccgccggccaggacuucuccgccuccggcuggcagcccggcaccgaguacgacaacgucguccucaagaagggccccaaguga

SEQ ID NO: 42385 - RNA, 993 nt, Artificial Sequence
  derived and/or modified sequence opt2 from DOK3__Homo_sapiens__NP_001138347
auggacccccucgagacccccaucaaggacggcauccucuaccagcagcacgucaaguucggcaagaagugcuggcgcaaggucugggcccuccucuacgccggcggccccuccggcgucgcccgccucgaguccugggagguccgcgacggcggccucggcgccgccggcgaccgcuccgccggccccggccgccgcggcgagcgccgcgucauccgccucgccgacugcgucuccguccuccccgccgacggcgaguccugcccccgcgacaccggcgccuuccuccucaccaccaccgagcgcucccaccuccucgccgcccagcaccgccaggccuggaugggccccaucugccagcucgccuuccccggcaccggcgaggccuccuccggcuccaccgacgcccagucccccaagcgcggccucguccccauggaggagaacuccaucuacuccuccuggcaggaggucggcgaguuccccgucgucguccagcgcaccgaggccgccacccgcugccagcucaagggccccgcccuccucguccucggccccgacgccauccagcuccgcgaggccaagggcacccaggcccucuacuccuggcccuaccacuuccuccgcaaguucggcuccgacaagauccuccucggcacccccggcgucucccuccucaucugcaagggcgagcgcaccgacgacgucuccggcaucauccucgacgagucccuccuccgcgccuacuccguccccggcgccggcggccacucccgcguccaggacucccucggccccguccuccgcgagcccaccuuccagggcgagcgcuccuuccucaagaccuccaugcuccgcucccuccucugcuccugcuccuggcgccacccccgcucccagccccgcacccaggccuccugccuccagggcuccgacugccccgccccccaccgcaacuccaccuccgccgcccacacccucggcaccuccuga

SEQ ID NO: 42386 - RNA, 981 nt, Artificial Sequence
  derived and/or modified sequence opt2 from DOK4__Homo_sapiens__NP_060580
auggccaccaacuucuccgacaucgucaagcagggcuacgucaagaugaagucccgcaagcucggcaucuaccgccgcugcuggcucgucuuccgcaaguccuccuccaagggcccccagcgccucgagaaguaccccgacgagaaguccgucugccuccgcggcugccccaaggucaccgagaucuccaacgucaagugcgucacccgccuccccaaggagaccaagcgccaggccgucgccaucaucuucaccgacgacuccgcccgcaccuucaccugcgacuccgagcucgaggccgaggagugguacaagacccucuccgucgagugccucggcucccgccucaacgacaucucccucggcgagcccgaccuccucgcccccggcguccagugcgagcagaccgaccgcuucaacgucuuccuccuccccugccccaaccucgacgucuacggcgagugcaagcuccagaucacccacgagaacaucuaccucugggacauccacaacccccgcgucaagcucgucuccuggccccucugcucccuccgccgcuacggccgcgacgccacccgcuucaccuucgaggccggccgcaugugcgacgccggcgagggccucuacaccuuccagacccaggagggcgagcagaucuaccagcgcguccacuccgccacccucgccaucgccgagcagcacaagcgcguccuccucgagauggagaagaacguccgccuccucaacaagggcaccgagcacuacuccuaccccugcacccccaccaccaugcucccccgcuccgccuacuggcaccacaucaccggcucccagaacaucgccgaggccuccuccuacgccggcgagggcuacggcgccgcccaggccuccuccgagaccgaccuccucaaccgcuucauccuccucaagcccaagcccucccagggcgacuccuccgaggccaagacccccucccaguga

SEQ ID NO: 42387 - RNA, 921 nt, Artificial Sequence
  derived and/or modified sequence opt2 from DOK5__Homo_sapiens__NP_060901
auggccuccaacuucaacgacaucgucaagcagggcuacguccgcauccgcucccgccgccucggcaucuaccagcgcugcuggcucgucuucaagaaggccuccuccaagggccccaagcgccucgagaaguucuccgacgagcgcgccgccuacuuccgcugcuaccacaaggucaccgagcucaacaacgucaagaacgucgcccgccuccccaaguccaccaagaagcacgccaucggcaucuacuucaacgacgacaccuccaagaccuucgccugcgaguccgaccucgaggccgacgaguggugcaagguccuccagauggagugcgucggcacccgcaucaacgacaucucccucggcgagcccgaccuccucgccaccggcgucgagcgcgagcaguccgagcgcuucaacgucuaccucaugcccucccccaaccucgacguccacggcgagugcgcccuccagaucaccuacgaguacaucugccucugggacguccagaacccccgcgucaagcucaucuccuggccccucuccgcccuccgccgcuacggccgcgacaccaccugguucaccuucgaggccggccgcaugugcgagaccggcgagggccucuucaucuuccagacccgcgacggcgaggccaucuaccagaagguccacuccgccgcccucgccaucgccgagcagcacgagcgccuccuccaguccgucaagaacuccaugcuccagaugaagauguccgagcgcgccgccucccucuccaccauggucccccucccccgcuccgccuacuggcagcacaucacccgccagcacuccaccggccagcucuaccgccuccaggacgucuccuccccccucaagcuccaccgcaccgagaccuuccccgccuaccgcuccgagcacuga

SEQ ID NO: 42388 - RNA, 996 nt, Artificial Sequence
  derived and/or modified sequence opt2 from DOK6__Homo_sapiens__NP_689934
auggccuccaacuucaacgacaucgucaagcagggcuacgucaagauccgcucccgcaagcucggcaucuuccgccgcugcuggcucgucuucaagaaggccuccuccaagggcccccgccgccucgagaaguuccccgacgagaaggccgccuacuuccgcaacuuccacaaggucaccgagcuccacaacaucaagaacaucacccgccucccccgcgagaccaagaagcacgccgucgccaucaucuuccacgacgagaccuccaagaccuucgccugcgaguccgagcucgaggccgaggaguggugcaagcaccucugcauggagugccucggcacccgccucaacgacaucucccucggcgagcccgaccuccucgccgccggcguccagcgcgagcagaacgagcgcuucaacgucuaccucaugcccacccccaaccucgacaucuacggcgagugcaccaugcagaucacccacgagaacaucuaccucugggacauccacaacgccaaggucaagcucgucauguggccccucuccucccuccgccgcuacggccgcgacuccaccugguucaccuucgaguccggccgcaugugcgacaccggcgagggccucuucaccuuccagacccgcgagggcgagaugaucuaccagaagguccacuccgccacccucgccaucgccgagcagcacgagcgccucaugcucgagauggagcagaaggcccgccuccagaccucccucaccgagcccaugacccucuccaaguccaucucccucccccgcuccgccuacuggcaccacaucacccgccagaacuccgucggcgagaucuacucccuccagggccacggcuucggcuccuccaagaugucccgcgcccagaccuuccccuccuacgcccccgagcaguccgaggaggcccagcagccccucucccgcuccuccuccuacggcuucuccuacuccuccucccucauccaguga

SEQ ID NO: 42389 - RNA, 768 nt, Artificial Sequence
  derived and/or modified sequence opt2 from DOK7__Homo_sapiens__NP_001158145
augaccgaggccgcccucgucgagggccaggucaagcuccgcgacggcaagaaguggaagucccgcuggcucguccuccgcaagcccucccccgucgccgacugccuccucaugcucgucuacaaggacaaguccgagcgcaucaagggccuccgcgagcgcuccucccucacccucgaggacaucugcggccucgagcccggccuccccuacgagggccucguccacacccucgccaucgucugccucucccaggccaucaugcucggcuucgacucccacgaggccaugugcgccugggacgcccgcauccgcuacgcccucggcgagguccaccgcuuccacgucaccgucgcccccggcaccaagcucgaguccggccccgccacccuccaccucugcaacgacguccucguccucgcccgcgacaucccccccgccgucaccggccaguggaagcucuccgaccuccgccgcuacggcgccguccccuccggcuucaucuucgagggcggcacccgcggcuggcgccuccuccccguccucggccgcggcggcgccgaccagcuccccguccgccuccaccgcccccgccaccucccccaccagggcccccucugggccgccgccggcuccacccgccccaagucccccggcacccucgacugcggcggcgccugcggccccggcucccccggcaaccccaccgccggcgaggccgccgagcccccccucaccugcggccaggccggccaguggcgcggcuga

SEQ ID NO: 42390 - RNA, 1617 nt, Artificial Sequence
  derived and/or modified sequence opt2 from DOLK__Homo_sapiens__NP_055723
augacccgcgagugccccucccccgcccccggccccggcgccccccucuccggcuccguccucgccgaggccgccgucgucuucgccgucguccucuccauccacgccaccgucugggaccgcuacuccuggugcgccgucgcccucgccguccaggccuucuacguccaguacaagugggaccgccuccuccagcagggcuccgccgucuuccaguuccgcauguccgccaacuccggccuccuccccgccuccauggucaugccccuccucggccucgucaugaaggagcgcugccagaccgccggcaaccccuucuucgagcgcuucggcaucgucgucgccgccaccggcauggccgucgcccucuucuccuccguccucgcccucggcaucacccgccccguccccaccaacaccugcgucauccucggccucgccggcggcgucaucaucuacaucaugaagcacucccucuccgucggcgaggucaucgagguccucgagguccuccucaucuucgucuaccucaacaugauccuccucuaccuccucccccgcugcuucacccccggcgaggcccuccucguccucggcggcaucuccuucguccucaaccagcucaucaagcgcucccucacccucgucgagucccagggcgaccccgucgacuucuuccuccucgucgucgucgucggcaugguccucaugggcaucuucuucuccacccucuucgucuucauggacuccggcaccugggccuccuccaucuucuuccaccucaugaccugcguccucucccucggcgucguccuccccuggcuccaccgccucauccgccgcaacccccuccucuggcuccuccaguuccucuuccagaccgacacccgcaucuaccuccucgccuacuggucccuccucgccacccucgccugccucgucguccucuaccagaacgccaagcgcuccuccuccgaguccaagaagcaccaggcccccaccaucgcccgcaaguacuuccaccucaucgucgucgccaccuacauccccggcaucaucuucgaccgcccccuccucuacgucgccgccaccgucugccucgccgucuucaucuuccucgaguacguccgcuacuuccgcaucaagccccucggccacacccuccgcuccuuccucucccucuuccucgacgagcgcgacuccggcccccucauccucacccacaucuaccuccuccucggcaugucccuccccaucuggcucaucccccgccccugcacccagaagggcucccucggcggcgcccgcgcccucguccccuacgccggcguccucgccgucggcgucggcgacaccgucgccuccaucuucggcuccaccaugggcgagauccgcuggcccggcaccaagaagaccuucgagggcaccaugaccuccaucuucgcccagaucaucuccgucgcccucauccucaucuucgacuccggcgucgaccucaacuacuccuacgccuggauccucggcuccaucuccaccgucucccuccucgaggccuacaccacccagaucgacaaccuccuccucccccucuaccuccucauccuccucauggccuga

SEQ ID NO: 42391 - RNA, 1701 nt, Artificial Sequence
  derived and/or modified sequence opt2 from DONSON__Homo_sapiens__NP_060083
auggcccucuccguccccggcuacucccccggcuuccgcaagccccccgaggucguccgccuccgccgcaagcgcgcccgcucccgcggcgccgccgccucccccccccgcgagcucaccgagcccgccgcccgccgcgccgcccucgucgccggccucccccuccgccccuuccccgccgccggcggccgcggcggcggcuccggcggcggccccgccgccgcccgccgcaaccccuucgcccgccucgacaaccgcccccgcgucgccgccgagccccccgacggccccgcccgcgagcagcccgaggcccccguccccuuccucgacuccaaccaggagaacgaccuccucugggaggagaaguuccccgagcgcaccaccgucaccgagcucccccagaccucccacgucuccuucuccgagcccgacauccccuccuccaaguccaccgagcuccccgucgacugguccaucaagacccgccuccucuucaccuccucccagcccuucaccugggccgaccaccucaaggcccaggaggaggcccagggccucguccagcacugccgcgccaccgaggucacccuccccaaguccauccaggaccccaagcucuccuccgagcuccgcugcaccuuccagcagucccucaucuacuggcuccaccccgcccucuccuggcucccccucuucccccgcaucggcgccgaccgcaagauggccggcaagaccucccccugguccaacgacgccacccuccagcacguccucauguccgacugguccgucuccuucaccucccucuacaaccuccucaagaccaagcucugccccuacuucuacgucugcaccuaccaguucaccguccucuuccgcgccgccggccucgccggcuccgaccucaucaccgcccucaucucccccaccacccgcggccuccgcgaggccaugcgcaacgagggcaucgaguucucccucccccucaucaaggaguccggccacaagaaggagaccgccuccggcaccucccucggcuacggcgaggagcaggccaucuccgacgaggacgaggaggaguccuucuccuggcucgaggagaugggcguccaggacaagaucaagaagcccgacauccucuccaucaagcuccgcaaggagaagcacgagguccagauggaccaccgccccgaguccgucguccucgucaagggcaucaacaccuucacccuccucaacuuccucaucaacuccaagucccucgucgccaccuccggcccccaggccggccucccccccacccuccucucccccgucgccuuccgcggcgccaccaugcagaugcucaaggcccgcuccgucaacgucaagacccaggcccucuccggcuaccgcgaccaguucucccucgagaucaccggccccaucaugccccacucccuccacucccucaccaugcuccucaaguccucccaguccggcuccuucuccgccguccucuacccccacgagcccaccgccgucuucaacaucugccuccagauggacaagguccucgacauggaggucguccacaaggagcucaccaacugcggccuccaccccaacacccucgagcagcucucccagaucccccuccucggcaaguccucccuccgcaacgucguccuccgcgacuacaucuacaacuggcgcuccuga

SEQ ID NO: 42392 - RNA, 6897 nt, Artificial Sequence
  derived and/or modified sequence opt2 from DOPEY2__Homo_sapiens__NP_001307643
auggaccccgaggagcaggagcuccucaacgacuaccgcuaccgcuccuacuccuccgucaucgagaaggcccuccgcaacuucgaguccuccuccgagugggccgaccucaucuccucccucggcaagcucaacaaggcccuccaguccaaccuccgcuacucccuccucccccgccgccuccucaucuccaagcgccucgcccagugccuccaccccgcccuccccuccggcguccaccucaaggcccucgagaccuacgagaucaucuucaagaucgucggcaccaaguggcucgccaaggaccucuuccucuacuccugcggccucuucccccuccucgcccacgccgccgucuccguccgccccguccuccucacccucuacgagaaguacuuccucccccuccagaagcuccuccuccccucccuccaggccuucaucgucggccuccuccccggccucgaggagggcuccgagaucuccgaccgcaccgacgcccuccuccuccgccucucccucgucgucggcaaggaggucuucuacaccgcccucuggggcuccguccucgccucccccuccauccgccuccccgccuccgucuucgucgucggccacaucaaccgcgacgcccccggccgcgagcagaaguacaugcucggcaccaaccaccagcucaccgucaagucccuccgcgccucccuccucgacuccaacguccucguccagcgcaacaaccucgagaucguccucuucuucuuccccuucuacaccugccucgacuccaacgagcgcgccaucccccuccuccgcuccgacaucguccgcauccucuccgccgccacccagacccuccuccgccgcgacaugucccucaaccgccgccucuacgccuggcuccucggcuccgacaucaagggcaacaccgucguccccgaguccgagaucuccaacuccuacgaggaccaguccuccuacuucuucgagaaguacuccaaggaccuccucgucgagggccucgccgagauccuccaccagaaguucaucgacgccgacgucgaggagcgccaccacgccuaccucaagcccuuccgcguccucaucucccuccucgacaagcccgagaucggcccccaggucgucggcaaccucuuccucgaggucauccgcgccuucuacuccuacugccgcgacgcccucggcuccgaccucaagcucuccuacacccaguccggcaacucccucaucuccgccaucaaggagaaccgcaacgccuccgagaucgucaagaccgucaaccuccucaucaccucccucuccaccgacuuccucugggacuacaugacccgcugcuucgaggagugcuuccgccccgucaagcagcgcuacuccguccgcaacuccgucucccccccccccaccgucuccgagcucugcgcccuccucgucuuccuccucgacgucaucccccucgagcucuacuccgagguccagacccaguaccucccccagguccucggcugccucguccagccccucgccgaggacauggaggcccucucccuccccgagcucacccacgcccucaagaccugcuucaagguccucuccaagguccagaugccccccuccuaccucgacaccgaguccaccuccggcaccuccucccccgucaagggcgagaacggcaagaucauccucgagaccaaggccgucauccccggcgacgaggacgccuccuuccccccccucaaguccgaggacuccggcaucggccucuccgccuccucccccgagcucuccgagcaccuccgcgucccccgcgucucccucgagcgcgacgacgucuggaagaagggcggcuccaugcagcgcaccuuccucugcauccaggagcucaucgccaacuucgccuccaagaacaucuucggcguccagcucaccgccuccggcgaggaguccaaguccgaggagcccgccggcaagcgcgaccgcgacggcacccagucccucgccgccaacgacuccucccgcaagaacuccugggagcccaagcccaucaccgucccccaguucaagcagaugcucuccgaccucuucaccgcccgcggcucccccuucaagaccaaguccuccgagucccccuccuccucccccuccucccccgcccgcaagaacggcggcgagugggacgucgagaaggucgucaucgaccucggcggcucccgcgaggagcgccgcgaggccuucgccgccgccugccaccuccuccucgacugcgccaccuuccccgucuaccucuccgaggaggagaccgagcagcucugcgccacccucuuccagcuccccggcgccggcgacuccuccuuccccuccuggcucaagucccucaugaccaucugcugcugcgucaccgacugcuaccuccagaacgucgccaucuccacccuccucgaggucaucaaccacucccagucccucgcccucgucaucgaggacaagaugaagcgcuacaaguccuccggccacaaccccuucuucggcaagcuccagauggucaccgucccccccaucgcccccggcauccucaaggucaucgccgagaagaccgacuucuaccagcgcgucgcccgcguccucuggaaccagcucaacaaggagacccgcgagcaccacgucaccugcgucgagcucuucuaccgccuccacugccucgcccccaccgccaacaucugcgaggacaucaucugccacgcccuccucgaccccgacaagggcacccgccucgaggcccucuuccgcuucuccgucaucuggcaccucacccgcgagauccagggcucccgcgucaccucccacaaccgcuccuucgaccgcucccucuucgucguccucgacucccucgccugcaccgacggcgccaucggcgccgccgcccagggcuggcucguccgcgcccucucccucggcgacgucgcccgcauccucgagcccguccuccuccuccuccuccagcccaagacccagcgcaccuccauccacugccucaagcaggagaacuccgccgacgaccuccaccgcugguucaaccgcaagaagaccuccuuccgcgaggccugcgccguccccgagccccaggaguccggcuccgaggagcaccucccccucucccaguucaccaccgucgaccgcgaggccaucugggccgaggucgagaaggagcccgagaaguacccccuccgcggcgagcucuccgaggaggagcuccccuacuacgucgagcuccccgaccgcaccgcccacggcgcccccgacuccuccgagcacaccgaguccgccgacaccuccuccugccacaccgacuccgagaacaccuccuccuucuccucccccucccacgaccuccaggagcucuccaacgaggagaacugcugcgcccccauccccaugggcggccgcgccuaccccaagcgcuccgcccuccucgccgccuuccaguccgaguccuucaaggccggcgccaagcucucccucguccgcgucgacuccgacaagacccaggccuccgaguccuucuccuccgacgaggaggccgaccucgagcuccaggcccucaccaccucccgccuccucaagcagcagcgcgagcgccaggaggccgucgaggcccucuucaagcacauccuccucuaccuccagcccuacgacucccgccgcguccucuacgccuucuccguccucgaggccguccucaagaccaaccccaaggaguucaucgaggccgucucccgcaccuccauggacaccuccuccaccgcccaccucaaccucaucuccaaccuccucgcccgccaccaggaggcccucaucggccaguccuucuacggcaagcuccagacccagguccccaacgucugcccccacucccuccuccucgagcuccucaccuaccucugccucuccuuccuccgcuccuacuaccccugcuaccucaaggucucccaccgcgacauccucggcaaccgcgacguccaggucaaguccgucgagguccucauccgcaucaugaugcagcucgucuccgucgccaaguccuccgagggcaagaacgucgaguucauccacucccuccuccagcgcugcaagguccaggaguucguccuccucucccucuccgccuccauguacaccucccagaagcgcuacggccucgccaccgcccaccacggccgcgcccuccccgaggacucccucuucgaggagucccucaucaaccucggccaggaccagaucugguccgagcacccccuccagaucgagcuccucaagcuccuccagguccucaucguccucgagcaccaccucggccgcgcccacgaggaggccgagaaccagcccgaccucucccgcgaguggcagcgcgcccucaacuuccagcaggccaucuccgcccuccaguacguccagccccacccccucaccucccagggccuccucgucuccgccgucguccgcggccuccagcccgccuacggcuacggcaugcaccccgccugggucucccucgucacccacucccuccccuacuucggcaagucccucggcuggaccgucacccccuucgucguccagaucugcaagaaccucgacgaccucgucaagcaguacgaguccgaguccgucaagcucuccgucuccaccaccuccaagcgcgagaacaucucccccgacuacccccucacccuccucgagggccucaccaccaucucccacuucugccuccucgagcaggccaaccagaacaagaagaccauggccgccggcgaccccgccaaccuccgcaacgcccgcaacgccauccucgaggagcucccccgcaccgucaacaccauggcccuccucuggaacguccuccgcaaggaggagacccagaagcgccccgucgaccuccucggcgccaccaagggcuccuccuccgucuacuucaagaccaccaagaccauccgccagaagauccucgacuuccucaacccccucaccgcccaccucggcguccagcucaccgccgccgucgccgccgucuggucccgcaagaaggcccagcgccacuccaagaugaagaucauccccaccgccuccgccucccagcucacccucgucgaccucgucugcgcccucuccacccuccagaccgacacccuccuccaccucgucaaggaggucgucaagcgccccccccaggucaagggcggcgacgagaaguccccccucgucgacauccccguccuccaguucugcuacgccuuccuccagcgccuccccguccccgcccuccaggagaacuucuccucccuccucggcguccucaaggaguccguccagcucaaccucgccccccccggcuacuuccuccuccucuccaugcucaacgacuucgucacccgcacccccaaccucgagaacaagaaggaccagaaggaccuccaggagaucacccagaagauccucgaggccgucggcaacaucgccggcuccucccucgagcagaccuccuggcucucccgcaaccucgaggucaaggcccagccccaggccucccucgaggaguccgacgccgaggaggaccucuacgacgccgccgccgccuccgccauggucuccuccuccgcccccuccgucuacuccguccaggcccucucccuccucgccgagguccucgccucccuccucgacauggucuaccgcuccgacgagaaggagaaggccgucccccucaucucccgccuccucuacuacgucuuccccuaccuccgcaaccacuccgccuacaacgcccccuccuuccgcgccggcgcccagcuccucuccucccucuccggcuacgccuacaccaagcgcgccuggcgcaaggagguccucgagcucuuccucgaccccgccuucuuccagauggacaccuccugcguccacuggaaguccaucaucgaccaccuccucacccacgagaagaccauguucaaggaccucaugaacaugcaguccuccucccucaagcucuucuccuccuucgagcagaaggccaugcuccucaagcgccaggccuucgccgucuucuccggcgagcucgaccaguaccaccucuaccucccccucauccaggagcgccucaccgacaaccuccgcgucggccagaccuccaucgucgccgcccagauguuccucuucuuccgcguccuccuccuccgcaucuccccccagcaccucaccucccucuggcccaucauggucuccgagcucauccagaccuucacccagcucgaggaggaccucaaggacgaggacgagucccuccgcuccaccaacaaggucaaccgcaccaaggucuccguccccgacgccaacggccccuccgucggcgagaucccccaguccgagcucauccucuaccucuccgccugcaaguuccucgacaccgcccucuccuucccccccgacaagaugccccucuuccagaucuaccgcugggccuucauccccgaggucgacaccgagggccccgccuuccucuccgacgucgaggagaaccaccaggagugcaagccccacaccguccgcauccucgagcuccucaagcucaaguucggcgagaucuccuccuccgacgagaucaccaugaaguccgaguucccccuccuccgccagcacuccgucuccuccauccgccagcucaugcccuucuucaugacccucaacggcgccuucaagacccagcgccagcuccccgccgacucccccggcacccccuuccucgacuuccccgucaccgacuccccccgcauccucaagcagcucgaggagugcaucgaguacgacuuccucgagcaccccgagugcuga

SEQ ID NO: 42393 - RNA, 4614 nt, Artificial Sequence
  derived and/or modified sequence opt2 from DOT1L__Homo_sapiens__NP_115871
augggcgagaagcucgagcuccgccucaagucccccgucggcgccgagcccgccgucuaccccuggccccuccccgucuacgacaagcaccacgacgccgcccacgagaucaucgagaccauccgcugggucugcgaggagauccccgaccucaagcucgccauggagaacuacguccucaucgacuacgacaccaaguccuucgaguccaugcagcgccucugcgacaaguacaaccgcgccaucgacuccauccaccagcucuggaagggcaccacccagcccaugaagcucaacacccgccccuccaccggccuccuccgccacauccuccagcaggucuacaaccacuccgucaccgaccccgagaagcucaacaacuacgagcccuucucccccgaggucuacggcgagaccuccuucgaccucgucgcccagaugaucgacgagaucaagaugaccgacgacgaccucuucgucgaccucggcuccggcgucggccaggucguccuccaggucgccgccgccaccaacugcaagcaccacuacggcgucgagaaggccgacauccccgccaaguacgccgagaccauggaccgcgaguuccgcaaguggaugaagugguacggcaagaagcacgccgaguacacccucgagcgcggcgacuuccucuccgaggaguggcgcgagcgcaucgccaacaccuccgucaucuucgucaacaacuucgccuucggccccgaggucgaccaccagcucaaggagcgcuucgccaacaugaaggagggcggccgcaucgucuccuccaagcccuucgccccccucaacuuccgcaucaacucccgcaaccucuccgacaucggcaccaucaugcgcgucgucgagcucuccccccucaagggcuccgucuccuggaccggcaagcccgucuccuacuaccuccacaccaucgaccgcaccauccucgagaacuacuucuccucccucaagaaccccaagcuccgcgaggagcaggaggccgcccgccgccgccagcagcgcgaguccaaguccaacgccgccacccccaccaagggccccgagggcaaggucgccggccccgccgacgcccccauggacuccggcgccgaggaggagaaggccggcgccgccaccgucaagaagcccucccccuccaaggcccgcaagaagaagcucaacaagaagggccgcaagauggccggccgcaagcgcggccgccccaagaagaugaacaccgccaaccccgagcgcaagcccaagaagaaccagaccgcccucgacgcccuccacgcccagaccgucucccagaccgccgccuccuccccccaggacgccuaccgcuccccccacucccccuucuaccagcucccccccuccguccagcgccacucccccaacccccuccucgucgcccccaccccccccgcccuccagaagcuccucgaguccuucaagauccaguaccuccaguuccucgccuacaccaagaccccccaguacaaggccucccuccaggagcuccucggccaggagaaggagaagaacgcccagcuccucggcgccgcccagcagcuccucucccacugccaggcccagaaggaggagauccgccgccucuuccagcagaagcucgacgagcucggcgucaaggcccucaccuacaacgaccucauccaggcccagaaggagaucuccgcccacaaccagcagcuccgcgagcaguccgagcagcucgagcaggacaaccgcgcccuccgcggccagucccuccagcuccucaaggcccgcugcgaggagcuccagcucgacugggccacccucucccucgagaagcuccucaaggagaagcaggcccucaagucccagaucuccgagaagcagcgccacugccucgagcuccagaucuccaucgucgagcucgagaagucccagcgccagcaggagcuccuccagcucaaguccugcgucccccccgacgacgcccucucccuccaccuccgcggcaagggcgcccucggccgcgagcucgagcccgacgccucccgccuccaccucgagcucgacugcaccaaguucucccucccccaccucuccuccaugucccccgagcucuccaugaacggccaggccgccggcuacgagcucugcggcguccucucccgccccuccuccaagcagaacaccccccaguaccucgccuccccccucgaccaggaggucguccccugcacccccucccacgucggccgcccccgccucgagaagcucuccggccucgccgcccccgacuacacccgccucucccccgccaagaucguccuccgccgccaccucucccaggaccacaccguccccggccgccccgccgccuccgagcuccacucccgcgccgagcacaccaaggagaacggccuccccuaccagucccccuccguccccggcuccaugaagcucuccccccaggacccccgcccccucucccccggcgcccuccagcucgccggcgagaaguccuccgagaagggccuccgcgagcgcgccuacggcuccuccggcgagcucaucaccucccuccccaucuccaucccccucuccaccguccagcccaacaagcuccccgucuccaucccccucgccuccgucguccuccccucccgcgccgagcgcgcccgcuccacccccucccccguccuccagccccgcgaccccuccuccacccucgagaagcagaucggcgccaacgcccacggcgccggcucccgcucccucgcccucgcccccgccggcuucuccuacgccggcuccgucgccaucuccggcgcccucgccggcucccccgccucccucacccccggcgccgagcccgccacccucgacgaguccuccuccuccggcucccucuucgccaccgucggcucccgcuccuccaccccccagcacccccuccuccucgcccagccccgcaacucccuccccgccucccccgcccaccagcucuccuccuccccccgccucggcggcgccgcccagggcccccuccccgaggccuccaagggcgaccuccccuccgacuccggcuucuccgaccccgaguccgaggccaagcgccgcaucgucuucaccaucaccaccggcgccggcuccgccaagcagucccccuccuccaagcacuccccccucaccgccuccgcccgcggcgacugcguccccucccacggccaggacucccgccgccgcggccgccgcaagcgcgccuccgccggcacccccucccucuccgccggcgucucccccaagcgccgcgcccuccccuccgucgccggccucuucacccagcccuccggcuccccccucaaccucaacuccauggucuccaacaucaaccagccccucgagaucaccgccaucuccucccccgagaccucccucaaguccucccccguccccuaccaggaccacgaccagccccccguccucaagaaggagcgcccccucucccagaccaacggcgcccacuacuccccccucaccuccgacgaggagcccggcuccgaggacgagcccuccuccgcccgcaucgagcgcaagaucgccaccaucucccucgaguccaaguccccccccaagacccucgagaacggcggcggccucgccggccgcaagcccgcccccgccggcgagcccgucaacuccuccaaguggaaguccaccuucucccccaucuccgacaucggccucgccaaguccgccgacuccccccuccaggccuccuccgcccucucccagaacucccucuucaccuuccgccccgcccucgaggagcccuccgccgacgccaagcucgccgcccacccccgcaagggcuuccccggcucccucuccggcgccgacggccucucccccggcaccaaccccgccaacggcugcaccuucggcggcggccucgccgccgaccucucccuccacuccuucuccgacggcgccucccucccccacaagggccccgaggccgccggccucuccuccccccucuccuuccccucccagcgcggcaaggagggcuccgacgccaaccccuuccucuccaagcgccagcucgacggccucgccggccucaagggcgagggcucccgcggcaaggaggccggcgagggcggccucccccucugcggccccaccgacaagaccccccuccucuccggcaaggccgccaaggcccgcgaccgcgaggucgaccucaagaacggccacaaccucuucaucuccgccgccgccgucccccccggcucccuccucuccggccccggccucgcccccgccgccuccuccgccggcggcgccgccuccuccgcccagacccaccgcuccuuccucggccccuucccccccggcccccaguucgcccucggccccaugucccuccaggccaaccucggcuccgucgccggcuccuccguccuccagucccucuucuccuccguccccgccgccgccggccucguccacgucuccuccgccgccacccgccucaccaacucccacgccaugggcuccuucuccggcgucgccggcggcaccgucggcggcaacuga

SEQ ID NO: 42394 - RNA, 1227 nt, Artificial Sequence
  derived and/or modified sequence opt2 from DPAGT1__Homo_sapiens__NP_001373
augugggccuucuccgagcuccccaugccccuccucaucaaccucaucgucucccuccucggcuucgucgccaccgucacccucauccccgccuuccgcggccacuucaucgccgcccgccucugcggccaggaccucaacaagaccucccgccagcagauccccgagucccagggcgucaucuccggcgccgucuuccucaucauccucuucugcuucauccccuuccccuuccucaacugcuucgucaaggagcagugcaaggccuucccccaccacgaguucgucgcccucaucggcgcccuccucgccaucugcugcaugaucuuccucggcuucgccgacgacguccucaaccuccgcuggcgccacaagcuccuccuccccaccgccgccucccucccccuccucauggucuacuucaccaacuucggcaacaccaccaucgucguccccaagcccuuccgccccauccucggccuccaccucgaccucggcauccucuacuacgucuacaugggccuccucgccgucuucugcaccaacgccaucaacauccucgccggcaucaacggccucgaggccggccagucccucgucaucuccgccuccaucaucgucuucaaccucgucgagcucgagggcgacugccgcgacgaccacgucuucucccucuacuucaugauccccuucuucuucaccacccucggccuccucuaccacaacugguaccccucccgcgucuucgucggcgacaccuucugcuacuucgccggcaugaccuucgccgucgucggcauccucggccacuucuccaagaccaugcuccucuucuucaugccccaggucuucaacuuccucuacucccucccccagcuccuccacaucauccccugcccccgccaccgcaucccccgccucaacaucaagaccggcaagcucgagauguccuacuccaaguucaagaccaagucccucuccuuccucggcaccuucauccucaaggucgccgagucccuccagcucgucaccguccaccaguccgagaccgaggacggcgaguucaccgagugcaacaacaugacccucaucaaccuccuccucaagguccucggccccauccacgagcgcaaccucacccuccuccuccuccuccuccagauccucggcuccgccaucaccuucuccauccgcuaccagcucguccgccucuucuacgacgucuga

SEQ ID NO: 42395 - RNA, 612 nt, Artificial Sequence
  derived and/or modified sequence opt2 from DPCD__Homo_sapiens__NP_056263
auggccgucaccggcuggcucgagucccuccgcaccgcccagaagaccgcccuccuccaggacggccgccgcaagguccacuaccucuuccccgacggcaaggagauggccgaggaguacgacgagaagaccuccgagcuccucguccgcaaguggcgcgucaaguccgcccucggcgccaugggccaguggcagcucgaggucggcgaccccgccccccucggcgccggcaaccucggccccgagcucaucaaggaguccaacgccaaccccaucuucaugcgcaaggacaccaagauguccuuccaguggcgcauccgcaaccuccccuaccccaaggacgucuacuccgucuccgucgaccagaaggagcgcugcaucaucguccgcaccaccaacaagaaguacuacaagaaguucuccauccccgaccucgaccgccaccagcucccccucgacgacgcccuccucuccuucgcccacgccaacugcacccucaucaucuccuaccagaagcccaaggaggucgucgucgccgaguccgagcuccagaaggagcucaagaaggucaagaccgcccacuccaacgacggcgacugcaagacccaguga

SEQ ID NO: 42396 - RNA, 4182 nt, Artificial Sequence
  derived and/or modified sequence opt2 from DPCR1__Homo_sapiens__NP_543146
auggcccagcccguccacucccucugcuccgccuucggccuccagugcugccuccucuuccuccucgccuccuggggcgccggcgccaccaccuuccaggaguaccagaagaccggcgagcucuccaccuccgaccacaucuucccccucacccccggccucgucuacuccauccccuucgaccacaucguccuccacuccggccagcgcccccccgagcuccccaaguccaccgagauccacgagcagaagcgccacugcaacaccacccgccacuccaagcccaccgacaagcccaccggcaacuccaagaccaucgaccacaaguccuccaccgacaaccacgaggccccccccaccuccgaggagaacuccuccaaccagggcaaggaccccaugauccgcaaccagcgcuccgucgaccccgccgacuccaccaccacccacaaggaguccgccggcaagaagcacaucacccccgcccccaaguccaagaucaacugccgcaaguccaccaccggcaaguccaccgucacccgcaaguccgacaagaccggccgcccccucgagaaguccauguccacccucgacaagaccuccaccuccucccacaagaccaccaccuccuuccacaacuccggcaacucccagaccaagcagaaguccaccuccuuccccgagaagaucaccgccgccuccaagaccaccuacaagaccaccggcacccccgaggaguccgagaagaccgaggacucccgcaccaccgucgccuccgacaagcuccucaccaagaccaccaagaacauccaggagaccaucuccgccaacgagcucacccagucccucgccgagcccaccgagcacggcggccgcaccgccaacgagaacaacacccccucccccgccgagcccaccgagaaccgcgagcgcaccgccaacgagaacaccacccucucccccgccgagcccaucgagaaccgcgagcgcaccgccaacgagaacaccgcccccuuccccgccggccccaccgagaaccgcgagaugaccgccaacgagaacaccacccucuuccccgccgagcccaccgagcacggcgagcgcaccgccaacgagaacaccacccccucccccgccgagcccaccgagcacggcgagcgcaccgccaacgagaacaccacccccucccccgccgagcccaccgagcacggcgagcgcacccccuucgccaacgacaagaccaccuccuccuccgccgaguccaccgagcacggcgagcgcaccccccucgccaacgagaacaccacccccucccccgccgagcccaccgagaaccgcgagcgcaccgccaacgagaacaccacccccucccccgccggccccaccgagaaccgcgagaccaccgccaacgagaagaccacccucucccccgucgagcccaccgagaaccgcgagaccaccgccaacgagaagaccacccccucccccgccgagcccaccgagaacggccagcgcacccccuucgccaacgagaagaccaccuccuccuccgccgagcccaccgagcacggcgagcgcaccccccucgccaacgagaacaccacccccucccccgccgagcccaccgagaaccgcgagcgcaccgccaacgagaagaccacccccucccccgccgagcccaccgagaacggcgaccgcaccccccucgccaacgagaagaccacccccucccucgccgagcccaccgagaacggccagcgcacccccuucgccaacgagaagaccaccuccuccuccgccgagcccaccgagcacgaggagcgcaccccccucgccaacgagaacaccacccccucccccgccgagcccaccgagaaccgcgagcgcaccgccaacgagaacaccacccccucccccgccggccccaccgagaaccgcgagaugaccgccaacgagaagaccacccucuuccccgccgagcccaccgagaaccgcgagcgcaccgccaacgagaagaccaccuccucccccgccgagcccaccgagaacggccagcgcacccccuucgccaacgagaagaccaccuccuccuccgccgagcccaccgagcacggcgagcgcaccccccucgccaacgagaacaccacccucucccccgccgagcccaccgagaaccgcgagcgcaccgccaacgagaagaccacccccuuccccgccgagcccaccgagaaccgcgagcgcaccgccaacgagaacaccacccccucccccgcccagcccaccgagaacggcgaccgcaccccccucgccaacgagaagaccacccccucccucgccgagcccaccgagaacggcaagcgcacccccuucgccaacgagaagaccaccuccuccuccgccgagcccaccgagcacgccgagcgcaccccccucgccaacgagaacaccaccuccucccccgccgagcccaccgagaaccgcgagcgcaccgccaacgagaagaccacccaguuccccgccgagcccaccgagaaccgcgaguccaccgccaacgagaagaccacccccuuccccgccgagcccaccgagaaccgcgaguggaccgccaacgagaacaccacccucucccccgccgagcccaccgagcacgaggagaugaccccccucgccaacgagaagaccacccucucccccgccgagcccaccgagaacggcgagcgcacccccuucaccaacgagaagaccacccccuccuccgccgagcccaccgagcacggcgagcgcaccccccucgccaacgagaucaccacccccucccgcgccgagcccaccgagcacggcgagcgcaucgccaacgagaaggccacccccucccccgccaagcccaccgagcacggcgagaccaccgucaacgaggacaccacccccuccuccgccgagcccaccgagaacggcgagcgcaccccccucgccaacgagaacaccaccaccucccccaccgaguccaccgagcacggcgagcgcaccgccaacgagaagaccacccccucccccgccgagcccaccgagcacggcgagcgcacccccuccgccaacgagaagaccauccccucccccgccaagcccaccgagcacgaggagaugacccccuccgccaacgagaacaccacccccucccccgucaagcccaccgagcacggcgagaagaccacccucgccaacgagaagaucacccucucccccgagggccccaccgagcacggcgccaagaccaccuccgccaacgagaagaucacccccucccucgccaagcccaccgagcacggcgagcgcaccaccucccccaacgacaagaucaccuccuccgccgccgaguccaccgagcaccgcgaccgcgccaccuccgccaacgucaucacccccgcccccgccgagcccaucaagcacgccaagcgcaccacccucgcccacgagaagaugacccaggucaccgagaaguccaccgagcaccccgagaagaccaccuccaccaccgagaagaccacccgcacccccgagaagcccacccucuacuccgagaagaccaucugcaccaagggcaagaacacccccguccccgagaagcccaccgagaaccucggcaacaccacccucaccaccgagaccaucaaggcccccgucaaguccaccgagaaccccgagaagaccgccgccgucaccaagaccaucaagcccuccgucaaggucaccggcgacaagucccucaccaccaccuccucccaccucaacaagaccgaggucacccaccagguccccaccggcuccuucacccucaucaccucccgcaccaagcucuccuccaucaccuccgaggccaccggcaacgagucccaccccuaccucaacaaggacggcucccagaagggcauccacgccggccagaugggcgagaacgacuccuuccccgccugggccaucgucaucgucguccucgucgccgucauccuccuccucgucuuccucggccucaucuuccucgucuccuacaugaugcgcacccgccgcacccucacccagaacacccaguacaacgacgccgaggacgagggcggccccaacuccuaccccgucuaccucauggagcagcagaaccucggcaugggccagauccccuccccccgcuga

SEQ ID NO: 42397 - RNA, 1236 nt, Artificial Sequence
  derived and/or modified sequence opt2 from DPEP1__Homo_sapiens__NP_001121613
augugguccggcugguggcucuggccccucgucgccgucugcaccgccgacuucuuccgcgacgaggccgagcgcaucaugcgcgacucccccgucaucgacggccacaacgaccuccccuggcagcuccucgacauguucaacaaccgccuccaggacgagcgcgccaaccucaccacccucgccggcacccacaccaacauccccaagcuccgcgccggcuucgucggcggccaguucugguccgucuacacccccugcgacacccagaacaaggacgccguccgccgcacccucgagcagauggacgucguccaccgcaugugccgcauguaccccgagaccuuccucuacgucaccuccuccgccggcauccgccaggccuuccgcgagggcaaggucgccucccucaucggcgucgagggcggccacuccaucgacuccucccucggcguccuccgcgcccucuaccagcucggcaugcgcuaccucacccucacccacuccugcaacacccccugggccgacaacuggcucgucgacaccggcgacuccgagccccagucccagggccucucccccuucggccagcgcgucgucaaggagcucaaccgccucggcguccucaucgaccucgcccacgucuccgucgccaccaugaaggccacccuccagcucucccgcgcccccgucaucuucucccacuccuccgccuacuccgucugcgccucccgccgcaacguccccgacgacguccuccgccucgucaagcagaccgacucccucgucauggucaacuucuacaacaacuacaucuccugcaccaacaaggccaaccucucccaggucgccgaccaccucgaccacaucaaggaggucgccggcgcccgcgccgucggcuucggcggcgacuucgacggcgucccccgcguccccgagggccucgaggacgucuccaaguaccccgaccucaucgccgagcuccuccgccgcaacuggaccgaggccgaggucaagggcgcccucgccgacaaccuccuccgcgucuucgaggccgucgagcaggccuccaaccucacccaggcccccgaggaggagcccaucccccucgaccagcucggcggcuccugccgcacccacuacggcuacuccuccggcgccuccucccuccaccgccacuggggccuccuccucgccucccucgccccccucguccucugccucucccuccucuga

SEQ ID NO: 42398 - RNA, 1461 nt, Artificial Sequence
  derived and/or modified sequence opt2 from DPEP2__Homo_sapiens__NP_071750
augcagcccuccggccucgagggccccggcaccuucggccgcuggccccuccucucccuccuccuccuccuccuccuccuccagcccgucaccugcgccuacaccacccccggccccccccgcgcccucaccacccucggcgccccccgcgcccacaccaugcccggcaccuacgcccccuccaccacccucuccucccccuccacccagggccuccaggagcaggcccgcgcccucaugcgcgacuucccccucgucgacggccacaacgaccucccccucguccuccgccaggucuaccagaagggccuccaggacgucaaccuccgcaacuucuccuacggccagaccucccucgaccgccuccgcgacggccucgucggcgcccaguucugguccgccuacguccccugccagacccaggaccgcgacgcccuccgccucacccucgagcagaucgaccucauccgccgcaugugcgccuccuacuccgagcucgagcucgucaccuccgccaaggcccucaacgacacccagaagcucgccugccucaucggcgucgagggcggccacucccucgacaacucccucuccauccuccgcaccuucuacaugcucggcguccgcuaccucacccucacccacaccugcaacacccccugggccgaguccuccgccaagggcguccacuccuucuacaacaacaucuccggccucaccgacuucggcgagaaggucgucgccgagaugaaccgccucggcaugauggucgaccucucccacgucuccgacgccgucgcccgccgcgcccucgaggucucccaggcccccgucaucuucucccacuccgccgcccgcggcgucugcaacuccgcccgcaacguccccgacgacauccuccagcuccucaagaagaacggcggcgucgucauggucucccucuccaugggcgucauccagugcaaccccuccgccaacgucuccaccgucgccgaccacuucgaccacaucaaggccgucaucggcuccaaguucaucggcaucggcggcgacuacgacggcgccggcaaguucccccagggccucgaggacgucuccaccuaccccguccucaucgaggagcuccucucccgcggcugguccgaggaggagcuccagggcguccuccgcggcaaccuccuccgcgucuuccgccaggucgagaagguccaggaggagaacaaguggcaguccccccucgaggacaaguuccccgacgagcagcucuccuccuccugccacuccgaccucucccgccuccgccagcgccagucccucaccuccggccaggagcucaccgagauccccauccacuggaccgccaagcuccccgccaagugguccgucuccgaguccuccccccacauggcccccguccucgccgucgucgccaccuuccccguccucauccucuggcucuga

SEQ ID NO: 42399 - RNA, 1542 nt, Artificial Sequence
  derived and/or modified sequence opt2 from DPEP3__Homo_sapiens__NP_071752
augauccgcaccccccucuccgccuccgcccaccgccuccuccuccccggcucccgcggccgccccccccgcaacaugcagcccaccggccgcgagggcucccgcgcccucucccgccgcuaccuccgccgccuccuccuccuccuccuccuccuccuccuccgccagcccgucacccgcgccgagaccacccccggcgccccccgcgcccucuccacccucggcucccccucccucuucaccacccccggcguccccuccgcccucaccacccccggccucaccacccccggcacccccaagacccucgaccuccgcggccgcgcccaggcccucaugcgcuccuucccccucgucgacggccacaacgaccucccccagguccuccgccagcgcuacaagaacguccuccaggacgucaaccuccgcaacuucucccacggccagaccucccucgaccgccuccgcgacggccucgucggcgcccaguucugguccgccuccgucuccugccagucccaggaccagaccgccguccgccucgcccucgagcagaucgaccucauccaccgcaugugcgccuccuacuccgagcucgagcucgucaccuccgccgagggccucaacuccucccagaagcucgccugccucaucggcgucgagggcggccacucccucgacuccucccucuccguccuccgcuccuucuacguccucggcguccgcuaccucacccucaccuucaccugcuccacccccugggccgaguccuccaccaaguuccgccaccacauguacaccaacgucuccggccucaccuccuucggcgagaaggucgucgaggagcucaaccgccucggcaugaugaucgaccucuccuacgccuccgacacccucauccgccgcguccucgaggucucccaggcccccgucaucuucucccacuccgccgcccgcgccgucugcgacaaccuccucaacguccccgacgacauccuccagcuccucaagaagaacggcggcaucgucauggucacccucuccaugggcguccuccagugcaaccuccucgccaacgucuccaccgucgccgaccacuucgaccacauccgcgccgucaucggcuccgaguucaucggcaucggcggcaacuacgacggcaccggccgcuucccccagggccucgaggacgucuccaccuaccccguccucaucgaggagcuccucucccgcuccugguccgaggaggagcuccagggcguccuccgcggcaaccuccuccgcgucuuccgccaggucgagaagguccgcgaggagucccgcgcccagucccccgucgaggccgaguuccccuacggccagcucuccaccuccugccacucccaccucgucccccagaacggccaccaggccacccaccucgaggucaccaagcagcccaccaaccgcguccccuggcgcuccuccaacgccucccccuaccucguccccggccucgucgccgccgccaccauccccaccuucacccaguggcucugcuga

SEQ ID NO: 42400 - RNA, 1245 nt, Artificial Sequence
  derived and/or modified sequence opt2 from DPF1__Homo_sapiens__NP_001128627
augggcggccucuccgcccgccccaccgccggccgcaccgaccccgccggcaccugcuggggccaggaccccggcuccaagauggccaccgucauccccggcccccucucccucggcgaggacuucuaccgcgaggccaucgagcacugccgcuccuacaacgcccgccucugcgccgagcgcucccuccgccuccccuuccucgacucccagaccggcgucgcccagaacaacugcuacaucuggauggagaagacccaccgcggccccggccucgcccccggccagaucuacaccuaccccgcccgcugcuggcgcaagaagcgccgccucaacauccucgaggacccccgccuccgccccugcgaguacaagaucgacugcgaggccccccucaagaaggagggcggccuccccgagggccccguccucgaggcccuccucugcgccgagaccggcgagaagaagaucgagcucaaggaggaggagaccaucauggacugccagaagcagcagcuccucgaguucccccacgaccucgaggucgaggaccucgaggacgacaucccccgccgcaagaaccgcgccaagggcaaggccuacggcaucggcggccuccgcaagcgccaggacaccgccucccucgaggaccgcgacaagcccuacgucugcgacaucugcggcaagcgcuacaagaaccgccccggccucuccuaccacuacacccacacccaccucgccgaggaggagggcgaggagaacgccgagcgccacgcccuccccuuccaccgcaagaacaaccacaagcaguucuacaaggagcucgccuggguccccgaggcccagcgcaagcacaccgccaagaaggcccccgacggcaccgucauccccaacggcuacugcgacuucugccucggcggcuccaagaagaccggcugccccgaggaccucaucuccugcgccgacugcggccgcuccggccaccccuccugccuccaguucaccgucaacaugaccgccgccguccgcaccuaccgcuggcagugcaucgagugcaaguccugcucccucugcggcaccuccgagaacgacgaccagcuccucuucugcgacgacugcgaccgcggcuaccacauguacugccucuccccccccauggccgagccccccgagggcuccugguccugccaccucugccuccgccaccucaaggagaaggccuccgccuacaucacccucaccuga

SEQ ID NO: 42401 - RNA, 1137 nt, Artificial Sequence
  derived and/or modified sequence opt2 from DPF3__Homo_sapiens__NP_001267471
auggccaccgucauccacaacccccucaaggcccucggcgaccaguucuacaaggaggccaucgagcacugccgcuccuacaacucccgccucugcgccgagcgcuccguccgccuccccuuccucgacucccagaccggcgucgcccagaacaacugcuacaucuggauggagaagcgccaccgcggccccggccucgcccccggccagcucuacaccuaccccgcccgcugcuggcgcaagaagcgccgccuccacccccccgaggaccccaagcuccgccuccucgagaucaagcccgaggucgagcucccccucaagaaggacggcuucaccuccgaguccaccacccucgaggcccuccuccgcggcgagggcgucgagaagaaggucgacgcccgcgaggaggaguccauccaggagauccagcgcguccucgagaacgacgagaacgucgaggagggcaacgaggaggaggaccucgaggaggacauccccaagcgcaagaaccgcacccgcggccgcgcccgcggcuccgccggcggccgccgccgccacgacgccgccucccaggaggaccacgacaagcccuacgucugcgacaucugcggcaagcgcuacaagaaccgccccggccucuccuaccacuacgcccacacccaccucgccuccgaggagggcgacgaggcccaggaccaggagacccgcuccccccccaaccaccgcaacgagaaccaccgcccccagaagggccccgacggcaccgucauccccaacaacuacugcgacuucugccucggcggcuccaacaugaacaagaaguccggccgccccgaggagcucgucuccugcgccgacugcggccgcuccggccaccccaccugccuccaguucacccucaacaugaccgaggccgucaagaccuacaaguggcagugcaucgagugcaaguccugcauccucugcggcaccuccgagaacgacgaccagcuccucuucugcgacgacugcgaccgcggcuaccacauguacugccucaacccccccgucgccgagccccccgagggcuccugguccugccaccucugcugggagcuccucaaggagaaggccuccgccuucggcugccaggccuga

SEQ ID NO: 42402 - RNA, 1332 nt, Artificial Sequence
  derived and/or modified sequence opt2 from DPH1__Homo_sapiens__NP_001374
augcgccgccaggucauggccgcccucgucgucuccggcgccgccgagcagggcggccgcgacggccccggccgcggccgcgccccccgcggccgcgucgccaaccagaucccccccgagauccucaagaacccccagcuccaggccgccauccgcguccuccccuccaacuacaacuucgagauccccaagaccaucuggcgcauccagcaggcccaggccaagaaggucgcccuccagaugcccgagggccuccuccucuucgccugcaccaucgucgacauccucgagcgcuucaccgaggccgaggucauggucaugggcgacgucaccuacggcgccugcugcgucgacgacuucaccgcccgcgcccucggcgccgacuuccucguccacuacggccacuccugccucauccccauggacaccuccgcccaggacuuccgcguccucuacgucuucgucgacauccgcaucgacaccacccaccuccucgacucccuccgccucaccuucccccccgccaccgcccucgcccucgucuccaccauccaguucgucuccacccuccaggccgccgcccaggagcucaaggccgaguaccgcgucuccgucccccagugcaagccccucucccccggcgagauccucggcugcaccuccccccgccucuccaaggaggucgaggccgucgucuaccucggcgacggccgcuuccaccucgaguccgucaugaucgccaaccccaacguccccgccuaccgcuacgaccccuacuccaagguccucucccgcgagcacuacgaccaccagcgcaugcaggccgcccgccaggaggccaucgccaccgcccgcuccgccaaguccuggggccucauccucggcacccucggccgccagggcucccccaagauccucgagcaccucgagucccgccuccgcgcccucggccucuccuucguccgccuccuccucuccgagaucuuccccuccaagcucucccuccuccccgaggucgacgucuggguccaggucgccugcccccgccucuccaucgacuggggcaccgccuuccccaagccccuccucacccccuacgaggccgccgucgcccuccgcgacaucuccuggcagcagcccuaccccauggacuucuacgccggcuccucccucggccccuggaccgucaaccacggccaggaccgccgcccccacgcccccggccgccccgcccgcggcaagguccaggagggcuccgcccgcccccccuccgccgucgccugcgaggacugcuccugccgcgacgagaaggucgccccccucgcccccuga

SEQ ID NO: 42403 - RNA, 174 nt, Artificial Sequence
  derived and/or modified sequence opt2 from DPH3__Homo_sapiens__NP_001040899
auggccgucuuccacgacgaggucgagaucgaggacuuccaguacgacgaggacuccgagaccuacuucuaccccugccccugcggcgacaacuucuccaucaccaaggaccaguucgucugcggcgagaccguccccgcccccuccgccaacaaggagcucgucaagugcuga

SEQ ID NO: 42404 - RNA, 498 nt, Artificial Sequence
  derived and/or modified sequence opt2 from DPH6__Homo_sapiens__NP_001135444
augcgcgucgccgcccucaucuccggcggcaaggacuccugcuacaacaugaugcagugcaucgccgccggccaccagaucgucgcccucgccaaccuccgccccgccgagaaccaggucggcuccgacgagcucgacuccuacauguaccagaccgucggccaccacgccaucgaccucuacgccgaggccauggcccucccccucuaccgccgcaccauccgcggccgcucccucgacacccgccaggucuacaccaagugcgagggcgacgaggucgaggaccucuacgagcuccucaagcucgucaagggcaucacccgcaugacccuccucgccgaguacgacgcccucaaccuccaggacuuccacaugcaccucaaggucggcucccaggccaucgucuaccgcacccccaacgagcucugcacccacuccaaguucgacaagcacaccuucccccccuucaucuccgagaucgccaagugcgaggucuga

SEQ ID NO: 42405 - RNA, 1359 nt, Artificial Sequence
  derived and/or modified sequence opt2 from DPH7__Homo_sapiens__NP_620133
augaugggcugcuucgcccuccagaccgucgacaccgagcucaccgccgacuccgucgaguggugcccccuccagggcugccgccaccuccucgccugcggcaccuaccagcuccgccgccccgaggaccgccccgccggcccccagaacaagggcggcauggaggucaaggagccccagguccgccucggccgccucuuccucuacuccuucaacgacaacaacuccauccacccccucgucgagguccagcgcaaggacaccuccgccauccucgacaugaaguggugccacauccccgucgccggccacgcccuccucggccucgccgacgccuccggcuccauccagcuccuccgccucgucgaguccgagaagucccacguccucgagccccucuccucccucgcccucgaggagcagugccucgcccucucccucgacugguccaccggcaagaccggccgcgccggcgaccagccccucaagaucaucuccuccgacuccaccggccagcuccaccuccucauggucaacgagacccgcccccgccuccagaaggucgccuccuggcaggcccaccaguucgaggccuggaucgccgccuucaacuacuggcaccccgagaucgucuacuccggcggcgacgacggccuccuccgcggcugggacacccgcguccccggcaaguuccucuucaccuccaagcgccacaccaugggcgucugcuccauccaguccuccccccaccgcgagcacauccucgccaccggcuccuacgacgagcacauccuccucugggacacccgcaacaugaagcagccccucgccgacacccccguccagggcggcgucuggcgcaucaaguggcaccccuuccaccaccaccuccuccucgccgccugcaugcacuccggcuucaagauccucaacugccagaaggccauggaggagcgccaggaggccaccguccucaccucccacacccuccccgacucccucgucuacggcgccgacugguccuggcuccucuuccgcucccuccagcgcgcccccuccugguccuuccccuccaaccucggcaccaagaccgccgaccucaagggcgccuccgagcuccccacccccugccacgagugccgcgaggacaacgacggcgagggccacgcccgcccccaguccggcaugaagccccucaccgagggcaugcgcaagaacggcaccuggcuccaggccaccgccgccaccacccgcgacugcggcgucaaccccgaggaggccgacuccgccuucucccuccucgccaccugcuccuucuacgaccacgcccuccaccucugggagugggagggcaacuga

SEQ ID NO: 42406 - RNA, 783 nt, Artificial Sequence
  derived and/or modified sequence opt2 from DPM1__Homo_sapiens__NP_003850
auggccucccucgaggucucccgcuccccccgccgcucccgccgcgagcucgagguccgcuccccccgccagaacaaguacuccguccuccuccccaccuacaacgagcgcgagaaccucccccucaucgucuggcuccucgucaaguccuucuccgaguccggcaucaacuacgagaucaucaucaucgacgacggcucccccgacggcacccgcgacgucgccgagcagcucgagaagaucuacggcuccgaccgcauccuccuccgcccccgcgagaagaagcucggccucggcaccgccuacauccacggcaugaagcacgccaccggcaacuacaucaucaucauggacgccgaccucucccaccaccccaaguucauccccgaguucauccgcaagcagaaggagggcaacuucgacaucgucuccggcacccgcuacaagggcaacggcggcgucuacggcugggaccucaagcgcaagaucaucucccgcggcgccaacuuccucacccagauccuccuccgccccggcgccuccgaccucaccggcuccuuccgccucuaccgcaaggagguccucgagaagcucaucgagaagugcgucuccaagggcuacgucuuccagauggagaugaucguccgcgcccgccagcucaacuacaccaucggcgagguccccaucuccuucgucgaccgcgucuacggcgaguccaagcucggcggcaacgagaucgucuccuuccucaagggccuccucacccucuucgccaccaccuga

SEQ ID NO: 42407 - RNA, 255 nt, Artificial Sequence
  derived and/or modified sequence opt2 from DPM2__Homo_sapiens__NP_003854
auggccaccggcaccgaccaggucgucggccucggccucgucgccgucucccucaucaucuucaccuacuacaccgccugggucauccuccuccccuucaucgacucccagcacgucauccacaaguacuuccucccccgcgccuacgccgucgccaucccccucgccgccggccuccuccuccuccucuucgucggccucuucaucuccuacgucaugcucaagaccaagcgcgucaccaagaaggcccaguga

SEQ ID NO: 42408 - RNA, 369 nt, Artificial Sequence
  derived and/or modified sequence opt2 from DPM3__Homo_sapiens__NP_061846
augcucuccgucggcggccuccgccucucccucguccgcuucuccuuccuccuccuccgcggcgcccuccuccccucccucgccgucaccaugaccaagcucgcccaguggcucuggggccucgccauccucggcuccaccugggucgcccucaccaccggcgcccucggccucgagcucccccucuccugccaggagguccucuggccccuccccgccuaccuccucgucuccgccggcugcuacgcccucggcaccgucggcuaccgcgucgccaccuuccacgacugcgaggacgccgcccgcgagcuccagucccagauccaggaggcccgcgccgaccucgcccgccgcggccuccgcuucuga

SEQ ID NO: 42409 - RNA, 2403 nt, Artificial Sequence
  derived and/or modified sequence opt2 from DPP10__Homo_sapiens__NP_001171505
augaccgccgccaagcaggagccccagcccacccccggcgcccgcgccucccaggcccagcccgccgaccaggagcucggcuccaacucccccccccagcgcaacuggaagggcaucgccaucgcccuccucgucauccucgucgucugcucccucaucaccauguccgucauccuccucacccccgacgagcucaccaacuccuccgagacccgccucucccucgaggaccucuuccgcaaggacuucguccuccacgaccccgaggcccgcuggaucaacgacaccgacgucgucuacaaguccgagaacggccacgucaucaagcucaacaucgagaccaacgccaccacccuccuccucgagaacaccaccuucgucaccuucaaggccucccgccacuccgucucccccgaccucaaguacguccuccucgccuacgacgucaagcagaucuuccacuacuccuacaccgccuccuacgucaucuacaacauccacacccgcgaggucugggagcucaacccccccgaggucgaggacuccguccuccaguacgccgccuggggcguccagggccagcagcucaucuacaucuucgagaacaacaucuacuaccagcccgacaucaaguccuccucccuccgccucaccuccuccggcaaggaggagaucaucuucaacggcaucgccgacuggcucuacgaggaggagcuccuccacucccacaucgcccacugguggucccccgacggcgagcgccucgccuuccucaugaucaacgacucccucguccccaccauggucaucccccgcuucaccggcgcccucuaccccaagggcaagcaguaccccuaccccaaggccggccaggucaaccccaccaucaagcucuacgucgucaaccucuacggccccacccacacccucgagcucaugccccccgacuccuucaagucccgcgaguacuacaucaccauggucaagugggucuccaacaccaagaccgucguccgcuggcucaaccgcgcccagaacaucuccauccucaccgucugcgagaccaccaccggcgccugcuccaagaaguacgagaugaccuccgacaccuggcucucccagcagaacgaggagcccgucuucucccgcgacggcuccaaguucuucaugaccguccccgucaagcagggcggccgcggcgaguuccaccacaucgccauguuccucauccaguccaaguccgagcagaucaccguccgccaccucaccuccggcaacugggaggucaucaagauccucgccuacgacgagaccacccagaagaucuacuuccucuccaccgaguccuccccccgcggccgccagcucuacuccgccuccaccgagggccuccucaaccgccagugcaucuccugcaacuucaugaaggagcagugcaccuacuucgacgccuccuucucccccaugaaccagcacuuccuccucuucugcgagggcccccgcguccccgucgucucccuccacuccaccgacaaccccgccaaguacuucauccucgaguccaacuccaugcucaaggaggccauccucaagaagaagaucggcaagcccgagaucaagauccuccacaucgacgacuacgagcucccccuccagcucucccuccccaaggacuucauggaccgcaaccaguacgcccuccuccucaucauggacgaggagcccggcggccagcucgucaccgacaaguuccacaucgacugggacuccguccucaucgacauggacaacgucaucgucgcccgcuucgacggccgcggcuccggcuuccagggccucaagauccuccaggagauccaccgccgccucggcuccgucgaggucaaggaccagaucaccgccgucaaguuccuccucaagcuccccuacaucgacuccaagcgccucuccaucuucggcaagggcuacggcggcuacaucgccuccaugauccucaaguccgacgagaagcucuucaagugcggcuccgucgucgcccccaucaccgaccucaagcucuacgccuccgccuucuccgagcgcuaccucggcaugcccuccaaggaggaguccaccuaccaggccgccuccguccuccacaacguccacggccucaaggaggagaacauccucaucauccacggcaccgccgacaccaagguccacuuccagcacuccgccgagcucaucaagcaccucaucaaggccggcgucaacuacaccaugcaggucuaccccgacgagggccacaacgucuccgagaaguccaaguaccaccucuacuccaccauccucaaguucuucuccgacugccucaaggaggagaucuccguccucccccaggagcccgaggaggacgaguga

SEQ ID NO: 42410 - RNA, 2124 nt, Artificial Sequence
  derived and/or modified sequence opt2 from DPP3__Homo_sapiens__NP_001243599
auggccgacacccaguacauccuccccaacgacaucggcgucuccucccucgacugccgcgaggccuuccgccuccucucccccaccgagcgccucuacgccuaccaccucucccgcgccgccugguacggcggccucgccguccuccuccagaccucccccgaggcccccuacaucuacgcccuccucucccgccucuuccgcgcccaggaccccgaccagcuccgccagcacgcccucgccgagggccucaccgaggaggaguaccaggagaagcucgagcgcgucauccucggcuccgaggccgcccagcagcaccccgaggagguccgcggccucuggcagaccugcggcgagcucauguucucccucgagccccgccuccgccaccucggccucggcaaggagggcaucaccaccuacuucuccggcaacugcaccauggaggacgccaagcucgcccaggacuuccucgacucccagaaccucuccgccuacaacacccgccucuucaaggaggucgacggcgagggcaagcccuacuacgagguccgccucgccuccguccucggcuccgagcccucccucgacuccgaggucaccuccaagcucaaguccuacgaguuccgcggcucccccuuccaggucacccgcggcgacuacgcccccauccuccagaaggucgucgagcagcucgagaaggccaaggccuacgccgccaacucccaccagggccagaugcucgcccaguacaucgaguccuucacccagggcuccaucgaggcccacaagcgcggcucccgcuucuggauccaggacaagggccccaucgucgaguccuacaucggcuucaucgaguccuaccgcgaccccuucggcucccgcggcgaguucgagggcuucgucgccgucgucaacaaggccauguccgccaaguucgagcgccucgucgccuccgccgagcagcuccucaaggagcuccccuggccccccaccuucgagaaggacaaguuccucacccccgacuucaccucccucgacguccucaccuucgccggcuccggcauccccgccggcaucaacauccccaacuacgacgaccuccgccagaccgagggcuucaagaacgucucccucggcaacguccucgccgucgccuacgccacccagcgcgagaagcucaccuuccucgaggaggacgacaaggaccucuacauccucuggaagggccccuccuucgacguccaggucggccuccacgagcuccucggccacggcuccggcaagcucuucguccaggacgagaagggcgccuucaacuucgaccaggagaccgucaucaaccccgagaccggcgagcagauccaguccugguaccgcuccggcgagaccugggacuccaaguucuccaccaucgccuccuccuacgaggagugccgcgccgaguccgucggccucuaccucugccuccacccccagguccucgagaucuucggcuucgagggcgccgacgccgaggacgucaucuacgucaacuggcucaacaugguccgcgccggccuccucgcccucgaguucuacacccccgaggccuucaacuggcgccaggcccacaugcaggcccgcuucgucauccuccgcguccuccucgaggccggcgagggccucgucaccaucacccccaccaccggcuccgacggccgccccgacgcccgcguccgccucgaccgcuccaagauccgcuccgucggcaagcccgcccucgagcgcuuccuccgccgccuccagguccucaaguccaccggcgacgucgccggcggccgcgcccucuacgagggcuacgccaccgucaccgacgccccccccgagugcuuccucacccuccgcgacaccguccuccuccgcaaggagucccgcaagcucaucguccagcccaacacccgccucgagggcuccgacguccagcuccucgaguacgaggccuccgccgccggccucauccgcuccuucuccgagcgcuuccccgaggacggccccgagcucgaggagauccucacccagcucgccaccgccgacgcccgcuucuggaagggccccuccgaggcccccuccggccaggccuga

SEQ ID NO: 42411 - RNA, 2301 nt, Artificial Sequence
  derived and/or modified sequence opt2 from DPP4__Homo_sapiens__NP_001926
augaagacccccuggaagguccuccucggccuccucggcgccgccgcccucgucaccaucaucaccguccccgucguccuccucaacaagggcaccgacgacgccaccgccgacucccgcaagaccuacacccucaccgacuaccucaagaacaccuaccgccucaagcucuacucccuccgcuggaucuccgaccacgaguaccucuacaagcaggagaacaacauccucgucuucaacgccgaguacggcaacuccuccgucuuccucgagaacuccaccuucgacgaguucggccacuccaucaacgacuacuccaucucccccgacggccaguucauccuccucgaguacaacuacgucaagcaguggcgccacuccuacaccgccuccuacgacaucuacgaccucaacaagcgccagcucaucaccgaggagcgcauccccaacaacacccagugggucaccuggucccccgucggccacaagcucgccuacgucuggaacaacgacaucuacgucaagaucgagcccaaccuccccuccuaccgcaucaccuggaccggcaaggaggacaucaucuacaacggcaucaccgacugggucuacgaggaggaggucuucuccgccuacuccgcccucugguggucccccaacggcaccuuccucgccuacgcccaguucaacgacaccgaggucccccucaucgaguacuccuucuacuccgacgagucccuccaguaccccaagaccguccgcguccccuaccccaaggccggcgccgucaaccccaccgucaaguucuucgucgucaacaccgacucccucuccuccgucaccaacgccaccuccauccagaucaccgcccccgccuccaugcucaucggcgaccacuaccucugcgacgucaccugggccacccaggagcgcaucucccuccaguggcuccgccgcauccagaacuacuccgucauggacaucugcgacuacgacgaguccuccggccgcuggaacugccucgucgcccgccagcacaucgagauguccaccaccggcugggucggccgcuuccgccccuccgagccccacuucacccucgacggcaacuccuucuacaagaucaucuccaacgaggagggcuaccgccacaucugcuacuuccagaucgacaagaaggacugcaccuucaucaccaagggcaccugggaggucaucggcaucgaggcccucaccuccgacuaccucuacuacaucuccaacgaguacaagggcaugcccggcggccgcaaccucuacaagauccagcucuccgacuacaccaaggucaccugccucuccugcgagcucaaccccgagcgcugccaguacuacuccgucuccuucuccaaggaggccaaguacuaccagcuccgcugcuccggccccggccucccccucuacacccuccacuccuccgucaacgacaagggccuccgcguccucgaggacaacuccgcccucgacaagaugcuccagaacguccagaugcccuccaagaagcucgacuucaucauccucaacgagaccaaguucugguaccagaugauccuccccccccacuucgacaaguccaagaaguacccccuccuccucgacgucuacgccggccccugcucccagaaggccgacaccgucuuccgccucaacugggccaccuaccucgccuccaccgagaacaucaucgucgccuccuucgacggccgcggcuccggcuaccagggcgacaagaucaugcacgccaucaaccgccgccucggcaccuucgaggucgaggaccagaucgaggccgcccgccaguucuccaagaugggcuucgucgacaacaagcgcaucgccaucuggggcugguccuacggcggcuacgucaccuccaugguccucggcuccggcuccggcgucuucaagugcggcaucgccgucgcccccgucucccgcugggaguacuacgacuccgucuacaccgagcgcuacaugggccuccccacccccgaggacaaccucgaccacuaccgcaacuccaccgucaugucccgcgccgagaacuucaagcaggucgaguaccuccucauccacggcaccgccgacgacaacguccacuuccagcaguccgcccagaucuccaaggcccucgucgacgucggcgucgacuuccaggccaugugguacaccgacgaggaccacggcaucgccuccuccaccgcccaccagcacaucuacacccacaugucccacuucaucaagcagugcuucucccuccccuga

SEQ ID NO: 42412 - RNA, 2406 nt, Artificial Sequence
  derived and/or modified sequence opt2 from DPP6__Homo_sapiens__NP_001034439
augaaggagaaggccaugaucaagaccgccaagaugcagggcaacgucauggagcucgucggcuccaaccccccccagcgcaacuggaagggcaucgccaucgcccuccucgucauccucgucaucugcucccucaucgucaccuccgucauccuccucacccccgccgaggacaacucccucucccagaagaagaaggucaccgucgaggaccucuucuccgaggacuucaagauccacgaccccgaggccaaguggaucuccgacaccgaguucaucuaccgcgagcagaagggcaccguccgccucuggaacgucgagaccaacaccuccaccguccucaucgagggcaagaagaucgagucccuccgcgccauccgcuacgagaucucccccgaccgcgaguacgcccucuucuccuacaacgucgagcccaucuaccagcacuccuacaccggcuacuacguccucuccaagaucccccacggcgacccccagucccucgacccccccgaggucuccaacgccaagcuccaguacgccggcuggggccccaagggccagcagcucaucuucaucuucgagaacaacaucuacuacugcgcccacgucggcaagcaggccauccgcgucgucuccaccggcaaggagggcgucaucuacaacggccucuccgacuggcucuacgaggaggagauccucaagacccacaucgcccacugguggucccccgacggcacccgccucgccuacgccgccaucaacgacucccgcguccccaucauggagcuccccaccuacaccggcuccaucuaccccaccgucaagcccuaccacuaccccaaggccggcuccgagaaccccuccaucucccuccacgucaucggccucaacggccccacccacgaccucgagaugaugccccccgacgacccccgcaugcgcgaguacuacaucaccauggucaagugggccaccuccaccaaggucgccgucaccuggcucaaccgcgcccagaacgucuccauccucacccucugcgacgccaccaccggcgucugcaccaagaagcacgaggacgaguccgaggccuggcuccaccgccagaacgaggagcccgucuucuccaaggacggccgcaaguucuucuucauccgcgccaucccccagggcggccgcggcaaguucuaccacaucaccgucuccuccucccagcccaacuccuccaacgacaacauccaguccaucaccuccggcgacugggacgucaccaagauccucgccuacgacgagaagggcaacaagaucuacuuccucuccaccgaggaccucccccgccgccgccagcucuacuccgccaacaccgucggcaacuucaaccgccagugccucuccugcgaccucgucgagaacugcaccuacuucuccgccuccuucucccacuccauggacuucuuccuccucaagugcgagggccccggcguccccauggucaccguccacaacaccaccgacaagaagaagauguucgaccucgagaccaacgagcacgucaagaaggccaucaacgaccgccagaugcccaaggucgaguaccgcgacaucgagaucgacgacuacaaccuccccaugcagauccucaagcccgccaccuucaccgacaccacccacuacccccuccuccucgucgucgacggcacccccggcucccaguccgucgccgagaaguucgaggucuccugggagaccgucauggucuccucccacggcgccgucgucgucaagugcgacggccgcggcuccggcuuccagggcaccaagcuccuccacgagguccgccgccgccucggccuccucgaggagaaggaccagauggaggccguccgcaccaugcucaaggagcaguacaucgaccgcacccgcgucgccgucuucggcaaggacuacggcggcuaccucuccaccuacauccuccccgccaagggcgagaaccagggccagaccuucaccugcggcuccgcccucucccccaucaccgacuucaagcucuacgccuccgccuucuccgagcgcuaccucggccuccacggccucgacaaccgcgccuacgagaugaccaaggucgcccaccgcgucuccgcccucgaggagcagcaguuccucaucauccaccccaccgccgacgagaagauccacuuccagcacaccgccgagcucaucacccagcucauccgcggcaaggccaacuacucccuccagaucuaccccgacgagucccacuacuucaccuccuccucccucaagcagcaccucuaccgcuccaucaucaacuucuucgucgagugcuuccgcauccaggacaagcuccucaccgucaccgccaaggaggacgaggaggaggacuga

SEQ ID NO: 42413 - RNA, 1479 nt, Artificial Sequence
  derived and/or modified sequence opt2 from DPP7__Homo_sapiens__NP_037511
augggcuccgcccccugggcccccguccuccuccucgcccucggccuccgcggccuccaggccggcgcccgccgcgcccccgaccccggcuuccaggagcgcuucuuccagcagcgccucgaccacuucaacuucgagcgcuucggcaacaagaccuucccccagcgcuuccucgucuccgaccgcuucuggguccgcggcgagggccccaucuucuucuacaccggcaacgagggcgacgucugggccuucgccaacaacuccgccuucgucgccgagcucgccgccgagcgcggcgcccuccucgucuucgccgagcaccgcuacuacggcaagucccuccccuucggcgcccaguccacccagcgcggccacaccgagcuccucaccgucgagcaggcccucgccgacuucgccgagcuccuccgcgcccuccgccgcgaccucggcgcccaggacgcccccgccaucgccuucggcggcuccuacggcggcaugcucuccgccuaccuccgcaugaaguacccccaccucgucgccggcgcccucgccgccuccgcccccguccucgccgucgccggccucggcgacuccaaccaguucuuccgcgacgucaccgccgacuucgagggccagucccccaagugcacccagggcguccgcgaggccuuccgccagaucaaggaccucuuccuccagggcgccuacgacaccguccgcugggaguucggcaccugccagccccucuccgacgagaaggaccucacccagcucuucauguucgcccgcaacgccuucaccguccucgccaugauggacuaccccuaccccaccgacuuccucggcccccuccccgccaaccccgucaaggucggcugcgaccgccuccucuccgaggcccagcgcaucaccggccuccgcgcccucgccggccucgucuacaacgccuccggcuccgagcacugcuacgacaucuaccgccucuaccacuccugcgccgaccccaccggcugcggcaccggccccgacgcccgcgccugggacuaccaggccugcaccgagaucaaccucaccuucgccuccaacaacgucaccgacauguuccccgaccuccccuucaccgacgagcuccgccagcgcuacugccucgacaccuggggcgucuggccccgccccgacuggcuccucaccuccuucuggggcggcgaccuccgcgccgccuccaacaucaucuucuccaacggcaaccucgaccccugggccggcggcggcauccgccgcaaccucuccgccuccgucaucgccgucaccauccagggcggcgcccaccaccucgaccuccgcgccucccaccccgaggaccccgccuccgucgucgaggcccgcaagcucgaggccaccaucaucggcgagugggucaaggccgcccgccgcgagcagcagcccgcccuccgcggcggcccccgccucucccucuga

SEQ ID NO: 42414 - RNA, 2349 nt, Artificial Sequence
  derived and/or modified sequence opt2 from DPP8__Homo_sapiens__NP_060213
auggccgccgccauggagaccgagcagcucggcgucgagaucuucgagaccgccgacugcgaggagaacaucgagucccaggaccgccccaagcucgagcccuucuacgucgagcgcuacuccuggucccagcucaagaagcuccucgccgacacccgcaaguaccacggcuacaugauggccaaggccccccacgacuucauguucgucaagcgcaacgaccccgacggcccccacuccgaccgcaucuacuaccucgccauguccggcgagaaccgcgagaacacccucuucuacuccgagauccccaagaccaucaaccgcgccgccguccucaugcucuccuggaagccccuccucgaccucuuccaggccacccucgacuacggcauguacucccgcgaggaggagcuccuccgcgagcgcaagcgcaucggcaccgucggcaucgccuccuacgacuaccaccagggcuccggcaccuuccucuuccaggccggcuccggcaucuaccacgucaaggacggcggcccccagggcuucacccagcagccccuccgccccaaccucgucgagaccuccugccccaacauccgcauggaccccaagcucugccccgccgaccccgacuggaucgccuucauccacuccaacgacaucuggaucuccaacaucgucacccgcgaggagcgccgccucaccuacguccacaacgagcucgccaacauggaggaggacgcccgcuccgccggcgucgccaccuucguccuccaggaggaguucgaccgcuacuccggcuacugguggugccccaaggccgagaccacccccuccggcggcaagauccuccgcauccucuacgaggagaacgacgaguccgaggucgagaucauccacgucaccucccccaugcucgagacccgccgcgccgacuccuuccgcuaccccaagaccggcaccgccaaccccaaggucaccuucaagauguccgagaucaugaucgacgccgagggccgcaucaucgacgucaucgacaaggagcucauccagcccuucgagauccucuucgagggcgucgaguacaucgcccgcgccggcuggacccccgagggcaaguacgccugguccauccuccucgaccgcucccagacccgccuccagaucguccucaucucccccgagcucuucauccccgucgaggacgacgucauggagcgccagcgccucaucgaguccguccccgacuccgucaccccccucaucaucuacgaggagaccaccgacaucuggaucaacauccacgacaucuuccacgucuucccccagucccacgaggaggagaucgaguucaucuucgccuccgagugcaagaccggcuuccgccaccucuacaagaucaccuccauccucaaggaguccaaguacaagcgcuccuccggcggccuccccgcccccuccgacuucaagugccccaucaaggaggagaucgccaucaccuccggcgagugggagguccucggccgccacggcuccaacauccaggucgacgagguccgccgccucgucuacuucgagggcaccaaggacuccccccucgagcaccaccucuacgucgucuccuacgucaaccccggcgaggucacccgccucaccgaccgcggcuacucccacuccugcugcaucucccagcacugcgacuucuucaucuccaaguacuccaaccagaagaacccccacugcgucucccucuacaagcucuccucccccgaggacgaccccaccugcaagaccaaggaguucugggccaccauccucgacuccgccggcccccuccccgacuacaccccccccgagaucuucuccuucgaguccaccaccggcuucacccucuacggcaugcucuacaagccccacgaccuccagcccggcaagaaguaccccaccguccucuucaucuacggcggcccccaggucgccaucgccggcgcccccgucacccucuggaucuucuacgacaccggcuacaccgagcgcuacaugggccaccccgaccagaacgagcagggcuacuaccucggcuccgucgccaugcaggccgagaaguuccccuccgagcccaaccgccuccuccuccuccacggcuuccucgacgagaacguccacuucgcccacaccuccauccuccucuccuuccucguccgcgccggcaagcccuacgaccuccagaucuacccccaggagcgccacuccauccgcguccccgaguccggcgagcacuacgagcuccaccuccuccacuaccuccaggagaaccucggcucccgcaucgccgcccucaaggucaucuga

SEQ ID NO: 42415 - RNA, 2679 nt, Artificial Sequence
  derived and/or modified sequence opt2 from DPP9__Homo_sapiens__XP_005259730
augcgcaaggucaagaagcuccgccucgacaaggagaacaccggcuccuggcgcuccuucucccucaacuccgagggcgccgagcgcauggccaccaccggcacccccaccgccgaccgcggcgacgccgccgccaccgacgaccccgccgcccgcuuccagguccagaagcacuccugggacggccuccgcuccaucauccacggcucccgcaaguacuccggccucaucgucaacaaggccccccacgacuuccaguucguccagaagaccgacgaguccggcccccacucccaccgccucuacuaccucggcaugcccuacggcucccgcgagaacucccuccucuacuccgagauccccaagaagguccgcaaggaggcccuccuccuccucuccuggaagcagaugcucgaccacuuccaggccaccccccaccacggcgucuacucccgcgaggaggagcuccuccgcgagcgcaagcgccucggcgucuucggcaucaccuccuacgacuuccacuccgaguccggccucuuccucuuccaggccuccaacucccucuuccacugccgcgacggcggcaagaacggcuucauggucucccccaugaagccccucgagaucaagacccagugcuccggcccccgcauggaccccaagaucugccccgccgaccccgccuucuucuccuucaucaacaacuccgaccucugggucgccaacaucgagaccggcgaggagcgccgccucaccuucugccaccagggccucuccaacguccucgacgaccccaaguccgccggcgucgccaccuucgucauccaggaggaguucgaccgcuucaccggcuacugguggugccccaccgccuccugggagggcuccgagggccucaagacccuccgcauccucuacgaggaggucgacgaguccgaggucgaggucauccacguccccucccccgcccucgaggagcgcaagaccgacuccuaccgcuacccccgcaccggcuccaagaaccccaagaucgcccucaagcucgccgaguuccagaccgacucccagggcaagaucgucuccacccaggagaaggagcucguccagcccuucuccucccucuuccccaaggucgaguacaucgcccgcgccggcuggacccgcgacggcaaguacgccugggccauguuccucgaccgcccccagcaguggcuccagcucguccuccucccccccgcccucuucauccccuccaccgagaacgaggagcagcgccucgccuccgcccgcgccgucccccgcaacguccagcccuacgucgucuacgaggaggucaccaacgucuggaucaacguccacgacaucuucuaccccuucccccaguccgagggcgaggacgagcucugcuuccuccgcgccaacgagugcaagaccggcuucugccaccucuacaaggucaccgccguccucaagucccagggcuacgacugguccgagcccuucucccccggcgaggacgaguucaagugccccaucaaggaggagaucgcccucaccuccggcgagugggagguccucgcccgccacggcuccaagaucugggucaacgaggagaccaagcucgucuacuuccagggcaccaaggacaccccccucgagcaccaccucuacgucgucuccuacgaggccgccggcgagaucguccgccucaccacccccggcuucucccacuccugcuccaugucccagaacuucgacauguucgucucccacuacuccuccgucuccaccccccccugcguccacgucuacaagcucuccggccccgacgacgacccccuccacaagcagccccgcuucugggccuccaugauggaggccgccuccugcccccccgacuacgucccccccgagaucuuccacuuccacacccgcuccgacguccgccucuacggcaugaucuacaagccccacgcccuccagcccggcaagaagcaccccaccguccucuucgucuacggcggcccccagguccagcucgucaacaacuccuucaagggcaucaaguaccuccgccucaacacccucgccucccucggcuacgccgucgucgucaucgacggccgcggcuccugccagcgcggccuccgcuucgagggcgcccucaagaaccagaugggccaggucgagaucgaggaccaggucgagggccuccaguucgucgccgagaaguacggcuucaucgaccucucccgcgucgccauccacggcugguccuacggcggcuuccucucccucaugggccucauccacaagccccaggucuucaaggucgccaucgccggcgcccccgucaccgucuggauggccuacgacaccggcuacaccgagcgcuacauggacguccccgagaacaaccagcacggcuacgaggccggcuccgucgcccuccacgucgagaagcuccccaacgagcccaaccgccuccucauccuccacggcuuccucgacgagaacguccacuucuuccacaccaacuuccucgucucccagcucauccgcgccggcaagcccuaccagcuccagaucuaccccaacgagcgccacuccauccgcugccccgaguccggcgagcacuacgaggucacccuccuccacuuccuccaggaguaccucuga

SEQ ID NO: 42416 - RNA, 897 nt, Artificial Sequence
  derived and/or modified sequence opt2 from DPPA2__Homo_sapiens__NP_620170
auguccgacgccaaccucgacuccuccaagaagaacuuccucgagggcgaggucgacgacgaggaguccgucauccucacccucguccccgucaaggacgacgccaacauggagcagauggagcccuccgucuccuccaccuccgacgucaagcucgagaagcccaagaaguacaaccccggccaccuccuccagaccaacgagcaguucaccgccccccagaaggcccgcugcaagauccccgcccucccccuccccaccauccucccccccaucaacaaggucugccgcgacacccuccgcgacuggugccagcagcucggccucuccaccaacggcaagaagaucgaggucuaccuccgccuccaccgccacgccuaccccgagcagcgccaggacaugcccgagaugucccaggagacccgccuccagcgcugcucccgcaagcgcaaggccgucaccaagcgcgcccgccuccagcgcuccuacgagaugaacgagcgcgccgaggagaccaacaccgucgaggucaucaccuccgcccccggcgccaugcucgccuccugggcccgcaucgccgcccgcgccguccagcccaaggcccucaacuccugcuccauccccgucuccgucgaggccuuccucaugcaggccuccggcguccgcuggugcgucguccacggccgccuccucuccgccgacaccaagggcuggguccgccuccaguuccacgccggccaggccuggguccccaccacccaccgccgcaugaucucccucuuccuccuccccgccugcaucuuccccucccccggcaucgaggacaacaugcucugccccgacugcgccaagcgcaacaagaagaugaugaagcgccucaugaccgucgagaaguga

SEQ ID NO: 42417 - RNA, 480 nt, Artificial Sequence
  derived and/or modified sequence opt2 from DPPA3__Homo_sapiens__NP_954980
auggaccccucccaguucaaccccaccuacauccccggcuccccccagaugcucaccgaggagaacucccgcgacgacuccggcgccucccagaucuccuccgagacccucaucaagaaccucuccaaccucaccaucaacgccuccuccgaguccgucuccccccucuccgaggcccuccuccgccgcgaguccgucggcgccgccguccuccgcgagaucgaggacgaguggcucuacucccgccgcggcguccgcacccuccucuccguccagcgcgagaagauggcccgccuccgcuacaugcuccucggcggcguccgcacccacgagcgccgccccaccaacaaggagcccaagggcgucaagaaggagucccgccccuucaagugccccugcuccuucugcgucuccaacggcugggaccccuccgagaacgcccgcaucggcaaccaggacaccaagccccuccagcccuga

SEQ ID NO: 42418 - RNA, 915 nt, Artificial Sequence
  derived and/or modified sequence opt2 from DPPA4__Homo_sapiens__NP_060659
augcuccgcggcuccgccuccuccaccuccauggagaaggccaagggcaaggaguggaccuccaccgagaagucccgcgaggaggaccagcaggccuccaaccagcccaacuccaucgcccuccccggcaccuccgccaagcgcaccaaggagaagauguccaucaagggcuccaagguccucugccccaagaagaaggccgagcacaccgacaacccccgcccccagaagaagauccccauccccccccuccccuccaagcucccccccgucaaccucauccaccgcgacauccuccgcgccuggugccagcagcucaagcucuccuccaagggccagaagcucgacgccuacaagcgccucugcgccuucgccuaccccaaccagaaggacuuccccuccaccgccaaggaggccaagauccgcaagucccuccagaagaagcucaaggucgagaagggcgagaccucccuccaguccuccgagacccacccccccgaggucgcccucccccccgucggcgagccccccgcccucgagaacuccaccgcccuccucgagggcgucaacaccgucgucgucaccaccuccgcccccgaggcccuccucgccuccugggcccgcaucuccgcccgcgcccgcacccccgaggccgucgaguccccccaggaggccuccggcguccgcuggugcgucguccacggcaagucccuccccgccgacaccgacggcuggguccaccuccaguuccacgccggccaggccuggguccccgagaagcaggagggccgcgucuccgcccucuuccuccuccccgccuccaacuucccccccccccaccucgaggacaacaugcucugccccaagugcguccaccgcaacaagguccucaucaagucccuccagugggaguga

SEQ ID NO: 42419 - RNA, 606 nt, Artificial Sequence
  derived and/or modified sequence opt2 from DPT__Homo_sapiens__NP_001928
auggaccucucccuccucuggguccuccucccccucgucaccauggccuggggccaguacggcgacuacggcuaccccuaccagcaguaccacgacuacuccgacgacggcugggucaaccucaaccgccagggcuucuccuaccagugcccccagggccaggucaucgucgccguccgcuccaucuucuccaagaaggagggcuccgaccgccaguggaacuacgccugcaugcccaccccccagucccucggcgagcccaccgagugcuggugggaggagaucaaccgcgccggcauggagugguaccagaccugcuccaacaacggccucgucgccggcuuccagucccgcuacuucgaguccguccucgaccgcgaguggcaguucuacugcugccgcuacuccaagcgcugccccuacuccugcuggcucaccaccgaguaccccggccacuacggcgaggagauggacaugaucuccuacaacuacgacuacuacauccgcggcgccaccaccaccuucuccgccgucgagcgcgaccgccaguggaaguucaucaugugccgcaugaccgaguacgacugcgaguucgccaacgucuga

SEQ ID NO: 42420 - RNA, 2277 nt, Artificial Sequence
  derived and/or modified sequence opt2 from DPY19L2__Homo_sapiens__NP_776173
augcgcaagcagggcgucuccuccaagcgccuccaguccuccggccgcucccaguccaagggccgccgcggcgccucccucgcccgcgagcccgaggucgaggaggagauggagaaguccgcccucggcggcggcaagcucccccgcggcuccuggcgcuccucccccggccgcauccagucccucaaggagcgcaagggccucgagcucgaggucgucgccaagaccuuccuccucggccccuuccaguucguccgcaacucccucgcccagcuccgcgagaagguccaggagcuccaggcccgccgcuucuccucccgcaccacccucggcaucgccgucuucgucgccauccuccacuggcuccaccucgucacccucuucgagaacgaccgccacuucucccaccucuccucccucgagcgcgagaugaccuuccgcaccgagaugggccucuacuacuccuacuucaagaccaucaucgaggcccccuccuuccucgagggccucuggaugaucaugaacgaccgccucaccgaguacccccucaucaucaacgccaucaagcgcuuccaccucuaccccgaggucaucaucgccuccugguacugcaccuucaugggcaucaugaaccucuucggccucgagaccaagaccugcuggaacgucacccgcaucgagccccucaacgagguccaguccugcgagggccucggcgaccccgccugcuucuacgucggcgucaucuucauccucaacggccucaugaugggccucuucuucauguacggcgccuaccucuccggcacccagcucggcggccucaucaccguccucugcuucuucuucaaccacggcgaggccacccgcgucauguggacccccccccuccgcgaguccuucuccuaccccuuccucguccuccagaugugcauccucacccucauccuccgcaccuccuccaacgaccgccgccccuucaucgcccucugccucuccaacgucgccuucaugcuccccuggcaguucgcccaguucauccucuucacccagaucgccucccucuuccccauguacgucgucggcuacaucgagcccuccaaguuccagaagaucaucuacaugaacaugaucuccgucacccucuccuucauccucauguucggcaacuccauguaccucuccuccuacuacuccuccucccuccucaugaccugggccaucauccucaagcgcaacgagauccagaagcucggcgucuccaagcucaacuucuggcucauccagggcuccgccugguggugcggcaccaucauccucaaguuccucaccuccaagauccucggcgucuccgaccacauccgccucuccgaccucaucgccgcccgcauccuccgcuacaccgacuucgacacccucaucuacaccugcgcccccgaguucgacuucauggagaaggccaccccccuccgcuacaccaagacccuccuccuccccgucgucauggucaucaccugcuucaucuucaagaagaccguccgcgacaucuccuacguccucgccaccaacaucuaccuccgcaagcagcuccucgagcacuccgagcucgccuuccacacccuccagcuccucgucuucaccgcccucgccauccucaucaugcgccucaagauguuccucaccccccacaugugcgucauggccucccucaucugcucccgccagcucuucggcuggcucuuccgccgcguccgcuucgagaaggucaucuucggcauccucaccgucauguccauccagggcuacgccaaccuccgcaaccagugguccaucaucggcgaguucaacaaccucccccaggaggagcuccuccaguggaucaaguacuccaccaccuccgacgccgucuucgccggcgccaugcccaccauggccuccaucaagcucuccacccuccaccccaucgucaaccacccccacuacgaggacgccgaccuccgcgcccgcaccaagaucgucuacuccaccuacucccgcaaguccgccaaggagguccgcgacaagcuccucgagcuccacgucaacuacuacguccucgaggaggccuggugcgucguccgcaccaagcccggcugcuccaugcucgagaucugggacgucgaggaccccuccaacgccgccaaccccccccucugcuccguccuccucgaggacgcccgccccuacuucaccaccgucuuccagaacuccgucuaccgcguccucaaggucaacuga

SEQ ID NO: 42421 - RNA, 2151 nt, Artificial Sequence
  derived and/or modified sequence opt2 from DPY19L3__Homo_sapiens__XP_011524828
augauguccauccgccagcgccgcgagauccgcgccaccgaggucuccgaggacuuccccgcccaggaggagaacgucaagcucgagaacaagcuccccuccggcugcaccucccgccgccucuggaagauccucucccucaccaucggcggcaccaucgcccucugcaucggccuccucaccuccgucuaccucgccacccuccacgagaacgaccucugguucuccaacaucaaggaggucgagcgcgagaucuccuuccgcaccgagugcggccucuacuacuccuacuacaagcagaugcuccaggcccccacccucguccagggcuuccacggccucaucuacgacaacaagaccgaguccaugaagaccaucaaccuccuccagcgcaugaacaucuaccaggaggucuuccucuccauccucuaccgcguccuccccauccagaaguaccucgagcccgucuacuucuacaucuacacccucuucggccuccaggccaucuacgucaccgcccucuacaucaccuccuggcuccucuccggcaccuggcucuccggccuccucgccgccuucugguacgucaccaaccgcaucgacaccacccgcgucgaguucaccaucccccuccgcgagaacugggcccuccccuucuucgccauccagaucgccgccaucaccuacuuccuccgccccaaccuccagccccucuccgagcgccucacccuccucgccaucuucaucuccaccuuccucuucucccucaccuggcaguucaaccaguucaugaugcucaugcaggcccucguccucuucacccucgacucccucgacaugcuccccgccgucaaggccaccuggcucuacggcauccagaucaccucccuccuccucgucugcauccuccaguucuucaacuccaugauccucggcucccuccucaucuccuucaaccucuccgucuucaucgcccgcaagcuccagaagaaccucaagaccggcuccuuccucaaccgccucggcaagcuccuccuccaccucuucaugguccucugccucacccucuuccucaacaacaucaucaagaagauccucaaccucaaguccgacgagcacaucuucaaguuccucaaggccaaguucggccucggcgccacccgcgacuucgacgccaaccucuaccucugcgaggaggccuucggccuccuccccuucaacaccuucggccgccucuccgacacccuccucuucuacgccuacaucuucguccucuccaucaccgucaucgucgccuucgucgucgccuuccacaaccucuccgacuccaccaaccagcaguccgucggcaagauggagaagggcaccgucgaccucaagcccgagaccgccuacaaccucauccacaccauccucuucggcuuccucgcccucuccaccaugcgcaugaaguaccucuggaccucccacaugugcgucuucgccuccuucggccucugcucccccgagaucugggagcuccuccucaaguccguccaccucuacaaccccaagcgcaucugcaucaugcgcuacuccguccccauccucauccuccucuaccucugcuacaaguucuggcccggcaugauggacgagcucuccgagcuccgcgaguucuacgaccccgacaccgucgagcucaugaacuggaucaacuccaacaccccccgcaaggccgucuucgccggcuccaugcagcuccucgccggcgucaagcucugcaccggccgcacccucaccaaccacccccacuacgaggacuccucccuccgcgagcgcacccgcgccgucuaccagaucuacgccaagcgcgcccccgaggagguccacgcccuccuccgcuccuucggcaccgacuacgucauccucgaggacuccaucugcuacgagcgccgccaccgccgcggcugccgccuccgcgaccuccucgacaucgccaacggccacaugauggacggccccggcgagaacgaccccgaccucaagcccgccgaccacccccgcuucugcgaggagaucaagcgcaaccucccccccuacgucgccuacuucacccgcgucuuccagaacaagaccuuccacgucuacaagcucucccgcaacaaguga

SEQ ID NO: 42422 - RNA, 300 nt, Artificial Sequence
  derived and/or modified sequence opt2 from DPY30__Homo_sapiens__NP_115963
auggagcccgagcagaugcucgagggccagacccaggucgccgagaacccccacuccgaguacggccucaccgacaacgucgagcgcaucgucgagaacgagaagaucaacgccgagaaguccuccaagcagaaggucgaccuccagucccuccccacccgcgccuaccucgaccagaccgucguccccauccuccuccagggccucgccguccucgccaaggagcgcccccccaaccccaucgaguuccucgccuccuaccuccucaagaacaaggcccaguucgaggaccgcaacuga

SEQ ID NO: 42423 - RNA, 1560 nt, Artificial Sequence
  derived and/or modified sequence opt2 from DPYS__Homo_sapiens__NP_001376
auggccgcccccucccgccuccucauccgcggcggccgcgucgucaacgacgacuucuccgaggucgccgacguccucgucgaggacggcgucguccgcgcccucggccacgaccuccucccccccggcggcgcccccgccggccuccgcguccucgacgccgccggcaagcucguccuccccggcggcaucgacacccacacccacaugcaguuccccuucaugggcucccgcuccaucgacgacuuccaccagggcaccaaggccgcccucuccggcggcaccaccaugaucaucgacuucgccaucccccagaagggcggcucccucaucgaggccuucgagaccuggcgcuccugggccgaccccaaggucugcugcgacuacucccuccacgucgccgucaccuggugguccgaccaggucaaggaggagaugaagauccucguccaggacaagggcgucaacuccuucaagauguucauggccuacaaggaccucuacauggucaccgaccucgagcucuacgaggccuucucccgcugcaaggagaucggcgccaucgcccagguccacgccgagaacggcgaccucaucgccgagggcgccaagaagaugcucgcccucggcaucaccggccccgagggccacgagcucugccgccccgaggccgucgaggccgaggccacccuccgcgccaucaccaucgccuccgccgucaacugcccccucuacaucguccacgucauguccaaguccgccgccaaggucaucgccgacgcccgccgcgacggcaaggucgucuacggcgagcccaucgccgccucccucggcaccgacggcacccacuacuggaacaaggaguggcaccacgccgcccaccacgucaugggccccccccuccgccccgaccccuccacccccgacuuccucaugaaccuccucgccaacgacgaccucaccaccaccggcaccgacaacugcaccuucaacaccugccagaaggcccucggcaaggacgacuucaccaagauccccaacggcgucaacggcgucgaggaccgcauguccgucaucugggagaagggcguccacuccggcaagauggacgagaaccgcuucgucgccgucaccuccaccaacgccgccaagaucuucaaccucuacccccgcaagggccgcaucgccgucggcuccgacgccgacaucgucaucugggaccccaagggcacccgcaccaucuccgccaagacccaccaccaggccgucaacuucaacaucuucgagggcauggucugccacggcgucccccucgucaccaucucccgcggcaaggucgucuacgaggccggcgucuucuccgucaccgccggcgacggcaaguucaucccccgcaagcccuucgccgaguacaucuacaagcgcaucaagcagcgcgaccgcaccugcacccccacccccgucgagcgcgcccccuacaagggcgaggucgccacccucaagucccgcgucaccaaggaggacgccaccgccggcacccgcaagcaggcccaccccuga

SEQ ID NO: 42424 - RNA, 2034 nt, Artificial Sequence
  derived and/or modified sequence opt2 from DPYSL2__Homo_sapiens__NP_001184222
auggccgagcgcaagcaguccggcaaggccgccgaggacgaggagguccccgccuucuucaagaaccucggcuccggcucccccaagccccgccagaaguucugcggcauguucugccccgucgagggcuccuccgagaacaagaccaucgacuucgacucccucuccgucggccgcggcuccggccaggucgucgcccagcagcgcgacgucgcccaccucggccccgacccccagccccccuacucccgccagggccgccgcgccggcggcgagcccuccgucgaguccggccgcaaggucgagauccgccgcgccuccggcaaggaggcccuccagaacaucaacgaccaguccgaccgccuccucaucaagggcggcaagaucgucaacgacgaccaguccuucuacgccgacaucuacauggaggacggccucaucaagcagaucggcgagaaccucaucguccccggcggcgucaagaccaucgaggcccacucccgcauggucauccccggcggcaucgacguccacacccgcuuccagaugcccgaccagggcaugaccuccgccgacgacuucuuccagggcaccaaggccgcccucgccggcggcaccaccaugaucaucgaccacgucguccccgagcccggcaccucccuccucgccgccuucgaccaguggcgcgagugggccgacuccaaguccugcugcgacuacucccuccacgucgacaucuccgaguggcacaagggcauccaggaggagauggaggcccucgucaaggaccacggcgucaacuccuuccucgucuacauggccuucaaggaccgcuuccagcucaccgacugccagaucuacgagguccucuccgucauccgcgacaucggcgccaucgcccagguccacgccgagaacggcgacaucaucgccgaggagcagcagcgcauccucgaccucggcaucaccggccccgagggccacguccucucccgccccgaggaggucgaggccgaggccgucaaccgcgccaucaccaucgccaaccagaccaacugcccccucuacaucaccaaggucauguccaaguccuccgccgaggucaucgcccaggcccgcaagaagggcaccgucgucuacggcgagcccaucaccgccucccucggcaccgacggcucccacuacugguccaagaacugggccaaggccgccgccuucgucaccucccccccccucucccccgaccccaccacccccgacuuccucaacucccuccucuccugcggcgaccuccaggucaccggcuccgcccacugcaccuucaacaccgcccagaaggccgucggcaaggacaacuucacccucauccccgagggcaccaacggcaccgaggagcgcauguccgucaucugggacaaggccgucgucaccggcaagauggacgagaaccaguucgucgccgucaccuccaccaacgccgccaaggucuucaaccucuacccccgcaagggccgcaucgccgucggcuccgacgccgaccucgucaucugggaccccgacuccgucaagaccaucuccgccaagacccacaacuccucccucgaguacaacaucuucgagggcauggagugccgcggcuccccccucgucgucaucucccagggcaagaucguccucgaggacggcacccuccacgucaccgagggcuccggccgcuacaucccccgcaagcccuuccccgacuucgucuacaagcgcaucaaggcccgcucccgccucgccgagcuccgcggcgucccccgcggccucuacgacggccccgucugcgaggucuccgucacccccaagaccgucacccccgccuccuccgccaagaccucccccgccaagcagcaggccccccccguccgcaaccuccaccaguccggcuucucccucuccggcgcccagaucgacgacaacaucccccgccgcaccacccagcgcaucgucgccccccccggcggccgcgccaacaucaccucccucggcuga

SEQ ID NO: 42425 - RNA, 2055 nt, Artificial Sequence
  derived and/or modified sequence opt2 from DPYSL3__Homo_sapiens__NP_001184223
auggccuccggccgccgcggcugggacuccucccacgaggacgaccuccccgucuaccucgcccgccccggcaccaccgaccaggucccccgccagaaguacggcggcauguucugcaacgucgagggcgccuucgaguccaagacccucgacuucgacgcccucuccgucggccagcgcggcgccaagaccccccgcuccggccagggcuccgaccgcggcuccggcucccgccccggcaucgagggcgacaccccccgccgcggccagggccgcgaggagucccgcgagcccgcccccgccucccccgcccccgccggcgucgagauccgcuccgccaccggcaaggagguccuccagaaccucggccccaaggacaaguccgaccgccuccucaucaagggcggccgcaucgucaacgacgaccaguccuucuacgccgacaucuacauggaggacggccucaucaagcagaucggcgacaaccucaucguccccggcggcgucaagaccaucgaggccaacggcaagauggucauccccggcggcaucgacguccacacccacuuccagaugcccuacaagggcaugaccaccgucgacgacuucuuccagggcaccaaggccgcccucgccggcggcaccaccaugaucaucgaccacgucguccccgagcccgaguccucccucaccgaggccuacgagaaguggcgcgagugggccgacggcaaguccugcugcgacuacgcccuccacgucgacaucacccacuggaacgacuccgucaagcaggagguccagaaccucaucaaggacaagggcgucaacuccuucauggucuacauggccuacaaggaccucuaccaggucuccaacaccgagcucuacgagaucuucaccugccucggcgagcucggcgccaucgcccagguccacgccgagaacggcgacaucaucgcccaggagcagacccgcaugcucgagaugggcaucaccggccccgagggccacguccucucccgccccgaggagcucgaggccgaggccgucuuccgcgccaucaccaucgccucccagaccaacugcccccucuacgucaccaaggucauguccaaguccgccgccgaccucaucucccaggcccgcaagaagggcaacgucgucuucggcgagcccaucaccgccucccucggcaucgacggcacccacuacugguccaagaacugggccaaggccgccgccuucgucaccucccccccccucucccccgaccccaccacccccgacuacaucaacucccuccucgccuccggcgaccuccagcucuccggcuccgcccacugcaccuucuccaccgcccagaaggccaucggcaaggacaacuucaccgccauccccgagggcaccaacggcgucgaggagcgcauguccgucaucugggacaaggccgucgccaccggcaagauggacgagaaccaguucgucgccgucaccuccaccaacgccgccaagaucuucaaccucuacccccgcaagggccgcaucuccgucggcuccgacuccgaccucgucaucugggaccccgacgccgucaagaucgucuccgccaagaaccaccaguccgccgccgaguacaacaucuucgagggcauggagcuccgcggcgccccccucgucgucaucugccagggcaagaucaugcucgaggacggcaaccuccacgucacccagggcgccggccgcuucauccccugcucccccuucuccgacuacgucuacaagcgcaucaaggcccgccgcaagauggccgaccuccacgccgucccccgcggcauguacgacggccccgucuucgaccucaccaccacccccaagggcggcacccccgccggcuccgcccgcggcucccccacccgccccaacccccccguccgcaaccuccaccaguccggcuucucccucuccggcacccaggucgacgagggcguccgcuccgccuccaagcgcaucgucgccccccccggcggccgcuccaacaucaccucccucuccuga

SEQ ID NO: 42426 - RNA, 1719 nt, Artificial Sequence
  derived and/or modified sequence opt2 from DPYSL4__Homo_sapiens__NP_006417
auguccuuccagggcaagaaguccaucccccgcaucaccuccgaccgccuccucauccgcggcggccgcaucgucaacgacgaccaguccuucuacgccgacguccacgucgaggacggccucaucaagcagaucggcgagaaccucaucguccccggcggcaucaagaccaucgacgcccacggccucaugguccuccccggcggcgucgacguccacacccgccuccagaugcccguccucggcaugacccccgccgacgacuucugccagggcaccaaggccgcccucgccggcggcaccaccaugauccucgaccacgucuuccccgacaccggcgucucccuccucgccgccuacgagcaguggcgcgagcgcgccgacuccgccgccugcugcgacuacucccuccacgucgacaucacccgcuggcacgaguccaucaaggaggagcucgaggcccucgucaaggagaagggcgucaacuccuuccucgucuucauggccuacaaggaccgcugccagugcuccgacucccagauguacgagaucuucuccaucauccgcgaccucggcgcccucgcccagguccacgccgagaacggcgacaucgucgaggaggagcagaagcgccuccucgagcucggcaucaccggccccgagggccacguccucucccaccccgaggaggucgaggccgaggccgucuaccgcgccgucaccaucgccaagcaggccaacugcccccucuacgucaccaaggucauguccaagggcgccgccgacgccaucgcccaggccaagcgccgcggcgucgucgucuucggcgagcccaucaccgccucccucggcaccgacggcucccacuacugguccaagaacugggccaaggccgccgccuucgucaccuccccccccgucaaccccgaccccaccaccgccgaccaccucaccugccuccucuccuccggcgaccuccaggucaccggcuccgcccacugcaccuucaccaccgcccagaaggccgucggcaaggacaacuucgcccucauccccgagggcaccaacggcaucgaggagcgcauguccauggucugggagaagugcgucgccuccggcaagauggacgagaacgaguucgucgccgucaccuccaccaacgccgccaagaucuucaacuucuacccccgcaagggccgcgucgccgucggcuccgacgccgaccucgucaucuggaaccccaaggccaccaagaucaucuccgccaagacccacaaccucaacgucgaguacaacaucuucgagggcgucgagugccgcggcgcccccgccgucgucaucucccagggccgcgucgcccucgaggacggcaagauguucgucacccccggcgccggccgcuucgucccccgcaagaccuuccccgacuucgucuacaagcgcaucaaggcccgcaaccgccucgccgagauccacggcgucccccgcggccucuacgacggccccguccacgaggucaugguccccgccaagcccggcuccggcgcccccgcccgcgccuccugccccggcaagaucuccgucccccccguccgcaaccuccaccaguccggcuucucccucuccggcucccaggccgacgaccacaucgcccgccgcaccgcccagaagaucauggccccccccggcggccgcuccaacaucaccucccucuccuga

SEQ ID NO: 42427 - RNA, 1695 nt, Artificial Sequence
  derived and/or modified sequence opt2 from DPYSL5__Homo_sapiens__NP_001240652
augcucgccaacuccgccuccguccgcauccucaucaagggcggcaaggucgucaacgacgacugcacccacgaggccgacgucuacaucgagaacggcaucauccagcaggucggccgcgagcucaugauccccggcggcgccaaggucaucgacgccaccggcaagcucgucauccccggcggcaucgacaccuccacccacuuccaccagaccuucaugaacgccaccugcgucgacgacuucuaccacggcaccaaggccgcccucgucggcggcaccaccaugaucaucggccacguccuccccgacaaggagaccucccucgucgacgccuacgagaagugccgcggccucgccgaccccaaggucugcugcgacuacgcccuccacgucggcaucaccuggugggcccccaaggucaaggccgagauggagacccucguccgcgagaagggcgucaacuccuuccagauguucaugaccuacaaggaccucuacaugcuccgcgacuccgagcucuaccagguccuccacgccugcaaggacaucggcgccaucgcccgcguccacgccgagaacggcgagcucgucgccgagggcgccaaggaggcccucgaccucggcaucaccggccccgagggcaucgagaucucccgccccgaggagcucgaggccgaggccacccaccgcgucaucaccaucgccaaccgcacccacugccccaucuaccucgucaacgucuccuccaucuccgccggcgacgucaucgccgccgccaagaugcagggcaaggucguccucgccgagaccaccaccgcccacgccacccucaccggccuccacuacuaccaccaggacuggucccacgccgccgccuacgucaccguccccccccuccgccucgacaccaacaccuccaccuaccucaugucccuccucgccaacgacacccucaacaucgucgccuccgaccaccgccccuucaccaccaagcagaaggccaugggcaaggaggacuucaccaagaucccccacggcgucuccggcguccaggaccgcauguccgucaucugggagcgcggcgucgucggcggcaagauggacgagaaccgcuucgucgccgucaccuccuccaacgccgccaagcuccucaaccucuacccccgcaagggccgcaucauccccggcgccgacgccgacgucgucgucugggaccccgaggccaccaagaccaucuccgccuccacccagguccagggcggcgacuucaaccucuacgagaacaugcgcugccacggcgucccccucgucaccaucucccgcggccgcgucgucuacgagaacggcgucuucaugugcgccgagggcaccggcaaguucugcccccuccgcuccuuccccgacaccgucuacaagaagcucguccagcgcgagaagacccucaagguccgcggcgucgaccgcacccccuaccucggcgacgucgccgucgucguccaccccggcaagaaggagaugggcaccccccucgccgacacccccacccgccccgucacccgccacggcggcaugcgcgaccuccacgaguccuccuucucccucuccggcucccagaucgacgaccacguccccaagcgcgccuccgcccgcauccucgccccccccggcggccgcuccuccggcaucugguga

SEQ ID NO: 42428 - RNA, 717 nt, Artificial Sequence
  derived and/or modified sequence opt2 from DRAM1__Homo_sapiens__NP_060840
augcucugcuuccuccgcggcauggccuucguccccuuccuccucgucaccugguccuccgccgccuucaucaucuccuacgucgucgccguccucuccggccacgucaaccccuuccuccccuacaucuccgacaccggcaccaccccccccgaguccggcaucuucggcuucaugaucaacuucuccgccuuccucggcgccgccaccauguacacccgcuacaagaucguccagaagcagaaccagaccugcuacuucuccacccccgucuucaaccucgucucccucguccucggccucgucggcugcuucggcaugggcaucgucgccaacuuccaggagcucgccguccccgucguccacgacggcggcgcccuccucgccuucgucugcggcgucgucuacacccuccuccaguccaucaucuccuacaaguccugcccccaguggaacucccucuccaccugccacauccgcauggucaucuccgccgucuccugcgccgccgucauccccaugaucgucugcgccucccucaucuccaucaccaagcucgaguggaacccccgcgagaaggacuacgucuaccacgucgucuccgccaucugcgaguggaccgucgccuucggcuucaucuucuacuuccucaccuucauccaggacuuccaguccgucacccuccgcaucuccaccgagaucaacggcgacaucuga

SEQ ID NO: 42429 - RNA, 618 nt, Artificial Sequence
  derived and/or modified sequence opt2 from DRAP1__Homo_sapiens__NP_006433
augcccuccaagaagaagaaguacaacgcccgcuucccccccgcccgcaucaagaagaucaugcagaccgacgaggagaucggcaaggucgccgccgccguccccgucaucaucucccgcgcccucgagcucuuccucgagucccuccucaagaaggccugccaggucacccagucccgcaacgccaagaccaugaccaccucccaccucaagcagugcaucgagcucgagcagcaguucgacuuccucaaggaccucgucgccuccguccccgacaugcagggcgacggcgaggacaaccacauggacggcgacaagggcgcccgccgcggccgcaagcccggcuccggcggccgcaagaacggcggcaugggcaccaaguccaaggacaagaagcucuccggcaccgacuccgagcaggaggacgaguccgaggacaccgacaccgacggcgaggaggagaccucccagccccccccccaggccucccaccccuccgcccacuuccaguccccccccacccccuuccuccccuucgccuccacccucccccucccccccgccccccccggccccuccgcccccgacgaggaggacgaggaggacuacgacuccuga

SEQ ID NO: 42430 - RNA, 2223 nt, Artificial Sequence
  derived and/or modified sequence opt2 from DRC1__Homo_sapiens__NP_659475
augaacccccccggcucccucgaggcccucgaccccaacgucgacgagcaccucuccacccagauccucgcccccuccguccacuccgacaacucccaggagcgcauccaggcccgccgccuccgcaucgccgcccgccucgaggcccgccgccgcgaggcccucggcgaguaccucgacggcaagaaggaguccgaggaggaccaguccaaguccuacaagcagaaggaggagucccgccucaagcucgccaagcuccuccucugcggcaccgagcucgucaccaacauccaggucgccaucgacauccgcgagauccaccgccgcgucgaggaggaggagaucaagcgccagcgcaucgagaagcucgagaacgaggucaagaccucccaggacaaguucgacgagaucaccuccaagugggaggagggcaagcagaagcgcaucccccaggagcucugggagaugcucaacacccagcagcuccacugcgccggccuccucgaggacaagaacaagcucaucuccgagcuccagcaggagcucaagaccaaggacgaccaguacgucaaggaccucaagaagcaguccgacgacaucugccuccuccucgagcgcauggaggagcaggucaagaacgucaugaagaccuuccgcgaggagcucuacaacaucgagaaggccuucgaggucgagcgccaggagcuccucgccuccaacaagaagaagugggagcaggcccuccaggcccacaacgccaaggagcucgaguaccucaacaaccgcaugaagaaggucgaggacuacgagaagcagcucaaccgccagcgcaucugggacugcgaggaguacaacaugaucaagaucaagcucgagcaggacguccagauccucgagcagcagcuccagcagcgcaaggccaucuaccagcucaaccaggagaagcucgaguacaaccuccagguccucaagaagcgcgacgaggaguccaccgucaucaagucccagcagaagcgcaagaucaaccgccuccacgacauccucaacaaccuccgcuccaaguacgccaagcagaucaagcaguuccaggaggagaaccagucccucaccuccgacuacaagcgccucgucaugcaguucaaggagcuccagaaggccaugcgccacuucgcccucaucgacgacgagaaguucugggagaucuggcucaugaacgaggaggaggccaaggaccucaucgcccgcgccuucgacgucgaccgcaucauccacacccaccaccucggccuccccugggccgcccccgacuucugguuccucaacaacgucggccccaucucccagcagccccagaaguccgccacccagaucgucgaggagaugcucaugcgcuccgaggaggaggaggccgaggaggccgccgccgagcccgaguccuaccucgaccuccccaagcagaucuccgagaagaccaccaagcgcauccucaugcuccucugcgacgaguccggcuuccucaucgaguccaagcuccucucccuccuccucccccucgagcagaacgagugcuaccuccuccgccucgacgccaucuucuccgcccucggcaucgaguccgaggacgaccucuacaagcucgucaacuucuuccucaaguaccgcgcccaccgccucuccuccucccuccagaucaagcccugcucccaggccuccauggagaaggccuccauggaggagaccuccacccgcuccgagcucgagcucgccgagcagaccgagauggagggcgagaaggaggagucccucgucgagggcgagaaggaggaggaggaggagaccccccccucccccugggucauccaccccaacgacguccucaagauccucgaggccuucgucaugggccucaagaagccccgcgacucccgcgccccccuccgcguccagaagaacguccgcgacaacuccaaggacuccgaguacuggcaggcccucaccaccgucauccccuccuccaagcagaaccucugggacgcccucuacaccgcccucgagaaguaccaccucguccucacccagcgcgccaagcuccuccucgagaacuccucccucgagcagcagaacaccgagcuccaggcccuccuccagcaguaccucaacuccaagaucaacuccgagcuccaggucccccccacccagguccuccgcguccccaccaaguga

SEQ ID NO: 42431 - RNA, 1341 nt, Artificial Sequence
  derived and/or modified sequence opt2 from DRD1__Homo_sapiens__NP_000785
augcgcacccucaacaccuccgccauggacggcaccggccucgucgucgagcgcgacuucuccguccgcauccucaccgccugcuuccucucccuccucauccucuccacccuccucggcaacacccucgucugcgccgccgucauccgcuuccgccaccuccgcuccaaggucaccaacuucuucgucaucucccucgccgucuccgaccuccucgucgccguccucgucaugcccuggaaggccgucgccgagaucgccggcuucuggcccuucggcuccuucugcaacaucugggucgccuucgacaucaugugcuccaccgccuccauccucaaccucugcgucaucuccgucgaccgcuacugggccaucuccucccccuuccgcuacgagcgcaagaugacccccaaggccgccuucauccucaucuccgucgccuggacccucuccguccucaucuccuucauccccguccagcucuccuggcacaaggccaagcccaccucccccuccgacggcaacgccaccucccucgccgagaccaucgacaacugcgacuccucccucucccgcaccuacgccaucuccuccuccgucaucuccuucuacauccccgucgccaucaugaucgucaccuacacccgcaucuaccgcaucgcccagaagcagauccgccgcaucgccgcccucgagcgcgccgccguccacgccaagaacugccagaccaccaccggcaacggcaagcccgucgagugcucccagcccgaguccuccuucaagauguccuucaagcgcgagaccaagguccucaagacccucuccgucaucaugggcgucuucgucugcugcuggcuccccuucuucauccucaacugcauccuccccuucugcggcuccggcgagacccagcccuucugcaucgacuccaacaccuucgacgucuucgucugguucggcugggccaacuccucccucaaccccaucaucuacgccuucaacgccgacuuccgcaaggccuucuccacccuccucggcugcuaccgccucugccccgccaccaacaacgccaucgagaccgucuccaucaacaacaacggcgccgccauguucuccucccaccacgagccccgcggcuccaucuccaaggagugcaaccucgucuaccucaucccccacgccgucggcuccuccgaggaccucaagaaggaggaggccgccggcaucgcccgcccccucgagaagcucucccccgcccucuccgucauccucgacuacgacaccgacgucucccucgagaagauccagcccaucacccagaacggccagcaccccaccuga

SEQ ID NO: 42432 - RNA, 1332 nt, Artificial Sequence
  derived and/or modified sequence opt2 from DRD2__Homo_sapiens__NP_000786
auggacccccucaaccucuccugguacgacgacgaccucgagcgccagaacuggucccgccccuucaacggcuccgacggcaaggccgaccgcccccacuacaacuacuacgccacccuccucacccuccucaucgccgucaucgucuucggcaacguccucgucugcauggccgucucccgcgagaaggcccuccagaccaccaccaacuaccucaucgucucccucgccgucgccgaccuccucgucgccacccucgucaugcccugggucgucuaccucgaggucgucggcgaguggaaguucucccgcauccacugcgacaucuucgucacccucgacgucaugaugugcaccgccuccauccucaaccucugcgccaucuccaucgaccgcuacaccgccgucgccaugcccaugcucuacaacacccgcuacuccuccaagcgccgcgucaccgucaugaucuccaucgucuggguccucuccuucaccaucuccugcccccuccucuucggccucaacaacgccgaccagaacgagugcaucaucgccaaccccgccuucgucgucuacuccuccaucgucuccuucuacguccccuucaucgucacccuccucgucuacaucaagaucuacaucguccuccgccgccgccgcaagcgcgucaacaccaagcgcuccucccgcgccuuccgcgcccaccuccgcgccccccucaagggcaacugcacccaccccgaggacaugaagcucugcaccgucaucaugaaguccaacggcuccuuccccgucaaccgccgccgcgucgaggccgcccgccgcgcccaggagcucgagauggagaugcucuccuccaccuccccccccgagcgcacccgcuacucccccaucccccccucccaccaccagcucacccuccccgaccccucccaccacggccuccacuccacccccgacucccccgccaagcccgagaagaacggccacgccaaggaccaccccaagaucgccaagaucuucgagauccagaccaugcccaacggcaagacccgcaccucccucaagaccaugucccgccgcaagcucucccagcagaaggagaagaaggccacccagaugcucgccaucguccucggcgucuucaucaucugcuggcuccccuucuucaucacccacauccucaacauccacugcgacugcaacaucccccccguccucuacuccgccuucaccuggcucggcuacgucaacuccgccgucaaccccaucaucuacaccaccuucaacaucgaguuccgcaaggccuuccucaagauccuccacugcuga

SEQ ID NO: 42433 - RNA, 1203 nt, Artificial Sequence
  derived and/or modified sequence opt2 from DRD3__Homo_sapiens__NP_001269492
auggccucccucucccagcucuccggccaccucaacuacaccugcggcgccgagaacuccaccggcgccucccaggcccgcccccacgccuacuacgcccucuccuacugcgcccucauccucgccaucgucuucggcaacggccucgucugcauggccguccucaaggagcgcgcccuccagaccaccaccaacuaccucgucgucucccucgccgucgccgaccuccucgucgccacccucgucaugcccugggucgucuaccucgaggucaccggcggcgucuggaacuucucccgcaucugcugcgacgucuucgucacccucgacgucaugaugugcaccgccuccauccucaaccucugcgccaucuccaucgaccgcuacaccgccgucgucaugcccguccacuaccagcacggcaccggccaguccuccugccgccgcgucgcccucaugaucaccgccgucuggguccucgccuucgccgucuccugcccccuccucuucggcuucaacaccaccggcgaccccaccgucugcuccaucuccaaccccgacuucgucaucuacuccuccgucgucuccuucuaccuccccuucggcgucaccguccucgucuacgcccgcaucuacgucguccucaagcagcgccgccgcaagcgcauccucacccgccagaacucccagugcaacuccguccgccccggcuucccccagcagacccucucccccgaccccgcccaccucgagcucaagcgcuacuacuccaucugccaggacaccgcccucggcggccccggcuuccaggagcgcggcggcgagcucaagcgcgaggagaagacccgcaacucccucucccccaccaucgcccccaagcucucccucgagguccgcaagcucuccaacggccgccucuccaccucccucaagcucggcccccuccagccccgcggcgucccccuccgcgagaagaaggccacccagauggucgccaucguccucggcgccuucaucgucugcuggcuccccuucuuccucacccacguccucaacacccacugccagaccugccacgucucccccgagcucuacuccgccaccaccuggcucggcuacgucaacuccgcccucaaccccgucaucuacaccaccuucaacaucgaguuccgcaaggccuuccucaagauccucuccugcuga

SEQ ID NO: 42434 - RNA, 1260 nt, Artificial Sequence
  derived and/or modified sequence opt2 from DRD4__Homo_sapiens__NP_000788
augggcaaccgcuccaccgccgacgccgacggccuccucgccggccgcggccccgccgccggcgccuccgccggcgccuccgccggccucgccggccagggcgccgccgcccucgucggcggcguccuccucaucggcgccguccucgccggcaacucccucgucugcgucuccgucgccaccgagcgcgcccuccagacccccaccaacuccuucaucgucucccucgccgccgccgaccuccuccucgcccuccucguccucccccucuucgucuacuccgagguccagggcggcgccuggcuccucuccccccgccucugcgacgcccucauggccauggacgucaugcucugcaccgccuccaucuucaaccucugcgccaucuccgucgaccgcuucgucgccgucgccgucccccuccgcuacaaccgccagggcggcucccgccgccagcuccuccucaucggcgccaccuggcuccucuccgccgccgucgccgcccccguccucugcggccucaacgacguccgcggccgcgaccccgccgucugccgccucgaggaccgcgacuacgucgucuacuccuccgucugcuccuucuuccuccccugcccccucaugcuccuccucuacugggccaccuuccgcggccuccagcgcugggaggucgcccgccgcgccaagcuccacggccgcgccccccgccgccccuccggccccggcccccccucccccaccccccccgccccccgccucccccaggaccccugcggccccgacugcgccccccccgcccccggccucccccgcggccccugcggccccgacugcgcccccgccgcccccucccucccccaggaccccugcggccccgacugcgccccccccgcccccggccucccccccgaccccugcggcuccaacugcgccccccccgacgccguccgcgccgccgcccuccccccccagacccccccccagacccgccgccgccgccgcgccaagaucaccggccgcgagcgcaaggccaugcgcguccuccccgucgucgucggcgccuuccuccucugcuggacccccuucuucgucguccacaucacccaggcccucugccccgccugcuccguccccccccgccucgucuccgccgucaccuggcucggcuacgucaacuccgcccucaaccccgucaucuacaccgucuucaacgccgaguuccgcaacgucuuccgcaaggcccuccgcgccugcugcuga

SEQ ID NO: 42435 - RNA, 1434 nt, Artificial Sequence
  derived and/or modified sequence opt2 from DRD5__Homo_sapiens__NP_000789
augcucccccccggcuccaacggcaccgccuaccccggccaguucgcccucuaccagcagcucgcccagggcaacgccgucggcggcuccgccggcgcccccccccucggccccucccaggucgucaccgccugccuccucacccuccucaucaucuggacccuccucggcaacguccucgucugcgccgccaucguccgcucccgccaccuccgcgccaacaugaccaacgucuucaucgucucccucgccgucuccgaccucuucgucgcccuccucgucaugcccuggaaggccgucgccgaggucgccggcuacuggcccuucggcgccuucugcgacgucugggucgccuucgacaucaugugcuccaccgccuccauccucaaccucugcgucaucuccgucgaccgcuacugggccaucucccgccccuuccgcuacaagcgcaagaugacccagcgcauggcccucgucauggucggccucgccuggacccucuccauccucaucuccuucauccccguccagcucaacuggcaccgcgaccaggccgccuccuggggcggccucgaccuccccaacaaccucgccaacuggacccccugggaggaggacuucugggagcccgacgucaacgccgagaacugcgacuccucccucaaccgcaccuacgccaucuccuccucccucaucuccuucuacauccccgucgccaucaugaucgucaccuacacccgcaucuaccgcaucgcccagguccagauccgccgcaucuccucccucgagcgcgccgccgagcacgcccaguccugccgcuccuccgccgccugcgcccccgacaccucccuccgcgccuccaucaagaaggagaccaagguccucaagacccucuccgucaucaugggcgucuucgucugcugcuggcuccccuucuucauccucaacugcaugguccccuucugcuccggccaccccgagggcccccccgccggcuuccccugcgucuccgagaccaccuucgacgucuucgucugguucggcugggccaacuccucccucaaccccgucaucuacgccuucaacgccgacuuccagaaggucuucgcccagcuccucggcugcucccacuucugcucccgcacccccgucgagaccgucaacaucuccaacgagcucaucuccuacaaccaggacaucgucuuccacaaggagaucgccgccgccuacauccacaugaugcccaacgccgucacccccggcaaccgcgaggucgacaacgacgaggaggagggccccuucgaccgcauguuccagaucuaccagaccucccccgacggcgaccccgucgccgaguccgucugggagcucgacugcgagggcgagaucucccucgacaagaucacccccuucacccccaacggcuuccacuga

SEQ ID NO: 42436 - RNA, 1104 nt, Artificial Sequence
  derived and/or modified sequence opt2 from DRG1__Homo_sapiens__NP_004138
auguccuccacccucgccaagaucgccgagaucgaggccgagauggcccgcacccagaagaacaaggccaccgcccaccaccucggccuccucaaggcccgccucgccaagcuccgccgcgagcucaucacccccaagggcggcggcggcggcggccccggcgagggcuucgacgucgccaagaccggcgacgcccgcaucggcuucgucggcuuccccuccgucggcaaguccacccuccucuccaaccucgccggcgucuacuccgaggucgccgccuacgaguucaccacccucaccaccguccccggcgucauccgcuacaagggcgccaagauccagcuccucgaccuccccggcaucaucgagggcgccaaggacggcaagggccgcggccgccaggucaucgccgucgcccgcaccugcaaccucauccucaucguccucgacguccucaagccccucggccacaagaagaucaucgagaacgagcucgagggcuucggcauccgccucaacuccaagccccccaacaucggcuucaagaagaaggacaagggcggcaucaaccucaccgccaccugcccccaguccgagcucgacgccgagaccgucaaguccauccucgccgaguacaagauccacaacgccgacgucacccuccgcuccgacgccaccgccgacgaccucaucgacgucgucgagggcaaccgcgucuacauccccugcaucuacguccucaacaagaucgaccagaucuccaucgaggagcucgacaucaucuacaaggucccccacugcguccccaucuccgcccaccaccgcuggaacuucgacgaccuccucgagaagaucugggacuaccucaagcucguccgcaucuacaccaagcccaagggccagcuccccgacuacaccucccccgucguccuccccuacucccgcaccaccgucgaggacuucugcaugaagauccacaagaaccucaucaaggaguucaaguacgcccucgucuggggccucuccgucaagcacaacccccagaaggucggcaaggaccacacccucgaggacgaggacgucauccagaucgucaagaaguga

SEQ ID NO: 42437 - RNA, 792 nt, Artificial Sequence
  derived and/or modified sequence opt2 from DRGX__Homo_sapiens__NP_001263380
auguucuacuuccacugccccccccagcucgagggcaccgccaccuucggcaaccacuccuccggcgacuucgacgacggcuuccuccgccgcaagcagcgccgcaaccgcaccaccuucacccuccagcagcucgaggcccucgaggccgucuucgcccagacccacuaccccgacgucuucacccgcgaggagcucgccaugaagaucaaccucaccgaggcccgcguccaggucugguuccagaaccgccgcgccaaguggcgcaagaccgagcgcggcgccuccgaccaggagcccggcgccaaggagcccauggccgaggucacccccccccccguccgcaacaucaacucccccccccccggcgaccaggcccgcuccaagaaggaggcccucgaggcccagcagucccucggccgcaccgucggccccgccggccccuucuuccccuccugccuccccggcacccuccucaacaccgccaccuacgcccaggcccucucccacgucgccucccucaagggcggcccccucugcuccugcugcguccccgaccccaugggccucuccuuccuccccaccuacggcugccaguccaaccgcaccgccuccgucgccacccuccgcaugaaggcccgcgagcacuccgaggccguccuccaguccgccaaccuccuccccuccaccuccuccucccccggccccgucgccaagcccgccccccccgacggcucccaggagaagaccucccccaccaaggagcaguccgaggccgagaaguccgucuga

SEQ ID NO: 42438 - RNA, 4014 nt, Artificial Sequence
  derived and/or modified sequence opt2 from DROSHA__Homo_sapiens__NP_001093882
augaugcagggcaacaccugccaccgcauguccuuccaccccggccgcggcugcccccgcggccgcggcggccacggcgcccgccccuccgcccccuccuuccgcccccagaaccuccgccuccuccacccccagcagccccccguccaguaccaguacgagccccccuccgcccccuccaccaccuucuccaacucccccgcccccaacuuccuccccccccgccccgacuucguccccuuccccccccccaugccccccuccgcccagggcccccucccccccugccccauccgcccccccuuccccaaccaccagaugcgccaccccuuccccgucccccccugcuucccccccaugcccccccccaugcccugccccaacaacccccccguccccggcgccccccccggccagggcaccuuccccuucaugaugcccccccccuccaugccccaccccccccccccccccgucaugccccagcaggucaacuaccaguacccccccggcuacucccaccacaacuuccccccccccuccuucaacuccuuccagaacaaccccuccuccuuccuccccuccgccaacaacuccuccuccccccacuuccgccaccucccccccuacccccuccccaaggcccccuccgagcgccgcucccccgagcgccucaagcacuacgacgaccaccgccaccgcgaccacucccacggccgcggcgagcgccaccgcucccucgaccgccgcgagcgcggccgcucccccgaccgccgccgccaggacucccgcuaccgcuccgacuacgaccgcggccgcacccccucccgccaccgcuccuacgagcgcucccgcgagcgcgagcgcgagcgccaccgccaccgcgacaaccgccgcucccccucccucgagcgcuccuacaagaaggaguacaagcgcuccggcucccgcucccccucccgcgagaagaagcgcgcccgcugggaggaggagaaggaccgcugguccgacaaccaguccuccggcaaggacaagaacuacaccuccaucaaggagaaggagcccgaggagaccaugcccgacaagaacgaggaggaggaggaggagcuccucaagcccgucuggauccgcugcacccacuccgagaacuacuacuccuccgaccccauggaccaggucggcgacuccaccgucgucggcaccucccgccuccgcgaccucuacgacaaguucgaggaggagcucggcucccgccaggagaaggccaaggccgcccgcccccccugggagccccccaagaccaagcucgacgaggaccucgaguccuccuccgaguccgagugcgaguccgacgaggacuccaccugcuccuccuccuccgacuccgaggucuucgacgucaucgccgagaucaagcgcaagaaggcccaccccgaccgccuccacgacgagcucugguacaacgaccccggccagaugaacgacggcccccucugcaagugcuccgccaaggcccgccgcaccggcauccgccacuccaucuaccccggcgaggaggccaucaagcccugccgccccaugaccaacaacgccggccgccucuuccacuaccgcaucaccgucuccccccccaccaacuuccucaccgaccgccccaccgucaucgaguacgacgaccacgaguacaucuucgagggcuucuccauguucgcccacgccccccucaccaacaucccccucugcaaggucauccgcuucaacaucgacuacaccauccacuucaucgaggagaugaugcccgagaacuucugcgucaagggccucgagcucuucucccucuuccucuuccgcgacauccucgagcucuacgacuggaaccucaagggcccccucuucgaggacuccccccccugcugcccccgcuuccacuucaugccccgcuucguccgcuuccuccccgacggcggcaaggagguccucuccaugcaccagauccuccucuaccuccuccgcugcuccaaggcccucguccccgaggaggagaucgccaacaugcuccagugggaggagcucgaguggcagaaguacgccgaggagugcaagggcaugaucgucaccaaccccggcaccaagcccuccuccguccgcaucgaccagcucgaccgcgagcaguucaaccccgacgucaucaccuuccccaucaucguccacuucggcauccgccccgcccagcucuccuacgccggcgacccccaguaccagaagcucuggaaguccuacgucaagcuccgccaccuccucgccaacucccccaaggucaagcagaccgacaagcagaagcucgcccagcgcgaggaggcccuccagaagauccgccagaagaacaccaugcgccgcgaggucaccgucgagcucuccucccagggcuucuggaagaccggcauccgcuccgacgucugccagcacgccaugaugcuccccguccucacccaccacauccgcuaccaccagugccucaugcaccucgacaagcucaucggcuacaccuuccaggaccgcugccuccuccagcucgccaugacccaccccucccaccaccucaacuucggcaugaaccccgaccacgcccgcaacucccucuccaacugcggcauccgccagcccaaguacggcgaccgcaagguccaccacaugcacaugcgcaagaagggcaucaacacccucaucaacaucaugucccgccucggccaggacgaccccacccccucccgcaucaaccacaacgagcgccucgaguuccucggcgacgccgucgucgaguuccucaccuccguccaccucuacuaccucuuccccucccucgaggagggcggccucgccaccuaccgcaccgccaucguccagaaccagcaccucgccaugcucgccaagaagcucgagcucgaccgcuucaugcucuacgcccacggccccgaccucugccgcgaguccgaccuccgccacgccauggccaacugcuucgaggcccucaucggcgccgucuaccucgagggcucccucgaggaggccaagcagcucuucggccgccuccucuucaacgaccccgaccuccgcgaggucuggcucaacuacccccuccacccccuccagcuccaggagcccaacaccgaccgccagcucaucgagaccucccccguccuccagaagcucaccgaguucgaggaggccaucggcgucaucuucacccacguccgccuccucgcccgcgccuucacccuccgcaccgucggcuucaaccaccucacccucggccacaaccagcgcauggaguuccucggcgacuccaucaugcagcucgucgccaccgaguaccucuucauccacuuccccgaccaccacgagggccaccucacccuccuccgcuccucccucgucaacaaccgcacccaggccaaggucgccgaggagcucggcaugcaggaguacgccaucaccaacgacaagaccaagcgccccgucgcccuccgcaccaagacccucgccgaccuccucgaguccuucaucgccgcccucuacaucgacaaggaccucgaguacguccacaccuucaugaacgucugcuucuucccccgccucaaggaguucauccucaaccaggacuggaacgaccccaagucccagcuccagcagugcugccucacccuccgcaccgagggcaaggagcccgacaucccccucuacaagacccuccagaccgucggccccucccacgcccgcaccuacaccgucgccgucuacuucaagggcgagcgcaucggcugcggcaagggccccuccauccagcaggccgagaugggcgccgccauggacgcccucgagaaguacaacuucccccagauggcccaccagaagcgcuucaucgagcgcaaguaccgccaggagcucaaggagaugcgcugggagcgcgagcaccaggagcgcgagcccgacgagaccgaggacaucaagaaguga

SEQ ID NO: 42439 - RNA, 2640 nt, Artificial Sequence
  derived and/or modified sequence opt2 from DRP2__Homo_sapiens__NP_001164655
augaaccucugcuggaacgagaucaagaagaagucccacaaccuccgcgcccgccucgaggccuucuccgaccacuccggcaagcuccagcucccccuccaggagaucaucgacuggcucucccagaaggacgaggagcucuccgcccagcucccccuccagggcgacgucgcccucguccagcaggagaaggagacccacgccgccuucauggaggaggucaagucccgcggccccuacaucuacuccguccucgaguccgcccaggccuuccucucccagcaccccuucgaggagcucgaggagccccacuccgaguccaaggacaccucccccaagcagcgcauccagaaccucucccgcuucgucuggaagcaggccaccgucgccuccgagcucugggagaagcucaccgcccgcugcgucgaccagcaccgccacaucgagcgcacccucgagcagcuccucgagauccagggcgccauggaggagcucuccaccacccucucccaggccgagggcguccgcgccaccugggagcccaucggcgaccucuucaucgacucccuccccgagcacauccaggccaucaagcucuucaaggaggaguucucccccaugaaggacggcgucaagcucgucaacgaccucgcccaccagcucgccaucuccgacguccaccucuccauggagaacucccaggcccucgagcagaucaacguccgcuggaagcagcuccaggccuccgucuccgagcgccucaagcagcuccaggacgcccaccgcgacuucggccccggcucccagcacuuccucuccuccuccguccagguccccugggagcgcgccaucucccccaacaagguccccuacuacaucaaccaccaggcccagaccaccugcugggaccaccccaagaugaccgagcucuaccagacccucgccgaccucaacaacaucaaguucuccgccuaccgcaccgccaugaagcuccgccgcguccagaaggcccuccgccucgaccucgucacccucaccaccgcccucgagaucuucaacgagcacgaccuccaggccuccgagcacgucauggacgucgucgaggucauccacugccucaccgcccucuacgagcgccucgaggaggagcgcggcauccucgucaacgucccccucugcgucgacaugucccucaacuggcuccucaacgucuucgacuccggccgcuccggcaagaugcgcgcccucuccuucaagaccggcaucgccugccucugcggcaccgaggucaaggagaagcuccaguaccucuucucccaggucgccaacuccggcucccagugcgaccagcgccaccucggcguccuccuccacgaggccauccaggucccccgccagcucggcgaggucgccgccuucggcggcuccaacgucgagcccuccguccgcuccugcuuccgcuucuccaccggcaagcccgucaucgaggccucccaguuccucgagugggucaaccucgagccccaguccauggucuggcucgccguccuccaccgcgucaccaucgccgagcaggucaagcaccagaccaagugcuccaucugccgccagugccccaucaagggcuuccgcuaccgcucccucaagcaguucaacgucgacaucugccagaccugcuuccucaccggccgcgccuccaagggcaacaagcuccacuaccccaucauggaguacuacacccccaccaccuccuccgagaacaugcgcgacuucgccaccacccucaagaacaaguuccgcuccaagcacuacuucuccaagcacccccagcgcggcuaccuccccguccaguccguccucgaggccgacuacuccgagacccccgccuccucccccauguggccccacgccgacacccacucccgcaucgagcacuucgccucccgccucgccgagauggagucccagaacugcuccuucuucaacgacucccucucccccgacgacuccaucgacgaggaccaguaccuccuccgccacuccucccccaucaccgaccgcgagcccgccuucggccagcaggcccccugcuccgucgccaccgaguccaagggcgagcuccagaagauccucgcccaccucgaggacgagaaccgcauccuccagggcgagcuccgccgccucaaguggcagcacgaggaggccgccgaggcccccucccucgccgacggcuccaccgaggccgccaccgaccaccgcaacgaggagcuccucgccgaggcccgcauccuccgccagcacaagucccgccucgagacccgcaugcagauccucgaggaccacaacaagcagcucgagucccagcuccagcgccuccgcgagcuccuccuccagccccccaccgaguccgacggcuccggcuccgccggcuccucccucgccuccuccccccagcaguccgagggcucccacccccgcgagaagggccagaccacccccgacaccgaggccgccgacgacgucggcuccaagucccaggacgucucccucugccucgaggacaucauggagaagcuccgccacgccuuccccuccguccgcuccuccgacgucaccgccaacacccuccucgccuccuga

SEQ ID NO: 42440 - RNA, 2523 nt, Artificial Sequence
  derived and/or modified sequence opt2 from DSC1__Homo_sapiens__NP_004939
auggcccucgccuccgccgcccccggcuccaucuucugcaagcagcuccucuucucccuccucguccucacccuccucugcgacgccugccagaaggucuaccuccgcguccccucccaccuccaggccgagacccucgucggcaaggucaaccucgaggagugccucaaguccgccucccucauccgcuccuccgaccccgccuuccgcauccucgaggacggcuccaucuacaccacccacgaccucauccucuccuccgagcgcaaguccuucuccaucuuccucuccgacggccagcgccgcgagcagcaggagaucaaggucguccucuccgcccgcgagaacaagucccccaagaagcgccacaccaaggacaccgcccucaagcgcuccaagcgccgcugggcccccauccccgccucccucauggagaacucccucggccccuucccccagcacguccagcagauccaguccgacgccgcccagaacuacaccaucuucuacuccaucuccggccccggcgucgacaaggagcccuucaaccucuucuacaucgagaaggacaccggcgacaucuucugcacccgcuccaucgaccgcgagaaguacgagcaguucgcccucuacggcuacgccaccaccgccgacggcuacgcccccgaguacccccucccccucaucaucaagaucgaggacgacaacgacaacgcccccuacuucgagcaccgcgucaccaucuucaccguccccgagaacugccgcuccggcaccuccgucggcaaggucaccgccaccgaccucgacgagcccgacacccuccacacccgccucaaguacaagauccuccagcagauccccgaccaccccaagcacuucuccauccaccccgacaccggcgucaucaccaccaccacccccuuccucgaccgcgagaagugcgacaccuaccagcucaucauggagguccgcgacaugggcggccagcccuucggccucuucaacaccggcaccaucaccaucucccucgaggacgagaacgacaacccccccuccuucaccgagaccuccuacgucaccgaggucgaggagaaccgcaucgacgucgagauccuccgcaugaagguccaggaccaggaccuccccaacaccccccacuccaaggccgucuacaagauccuccagggcaacgagaacggcaacuucaucaucuccaccgaccccaacaccaacgagggcguccucugcgucgucaagccccucaacuacgaggucaaccgccaggucauccuccaggucggcgucaucaacgaggcccaguucuccaaggccgccuccucccagacccccaccaugugcaccaccaccgucaccgucaagaucaucgacuccgacgagggccccgagugccacccccccgucaaggucauccagucccaggacggcuuccccgccggccaggagcuccucggcuacaaggcccucgaccccgagaucuccuccggcgagggccuccgcuaccagaagcucggcgacgaggacaacugguucgagaucaaccagcacaccggcgaccuccgcacccucaagguccucgaccgcgaguccaaguucgucaagaacaaccaguacaacaucuccgucgucgccgucgacgccgucggccgcuccugcaccggcacccucgucguccaccucgacgacuacaacgaccacgccccccagaucgacaaggaggucaccaucugccagaacaacgaggacuucgccguccucaagcccgucgaccccgacggccccgagaacggcccccccuuccaguucuuccucgacaacuccgccuccaagaacuggaacaucgaggagaaggacggcaagaccgccauccuccgccagcgccagaaccucgacuacaacuacuacuccguccccauccagaucaaggaccgccacggccucgucgccacccacaugcucaccguccgcgucugcgacugcuccacccccuccgagugccgcaugaaggacaaguccacccgcgacguccgccccaacgucauccucggccgcugggccauccucgccaugguccucggcuccguccuccuccucugcauccucuucaccugcuucugcgucaccgccaagcgcaccgucaagaagugcuuccccgaggacaucgcccagcagaaccucaucgucuccaacaccgagggccccggcgaggaggucaccgaggccaacauccgccuccccaugcagaccuccaacaucugcgacaccuccauguccgucggcaccgucggcggccagggcaucaagacccagcaguccuucgagauggucaagggcggcuacacccucgacuccaacaagggcggcggccaccagacccucgaguccgucaagggcgucggccagggcgacaccggccgcuacgccuacaccgacuggcaguccuucacccagccccgccucggcgaggaguccauccgcggccacacccucaucaagaacuga

SEQ ID NO: 42441 - RNA, 2544 nt, Artificial Sequence
  derived and/or modified sequence opt2 from DSC2__Homo_sapiens__NP_004940
auggaggccgcccgccccuccggcuccuggaacggcgcccucugccgccuccuccuccucacccucgccauccucaucuucgccuccgacgccugcaagaacgucacccuccacguccccuccaagcucgacgccgagaagcucgucggccgcgucaaccucaaggagugcuucaccgccgccaaccucauccacuccuccgaccccgacuuccagauccucgaggacggcuccgucuacaccaccaacaccauccuccucuccuccgagaagcgcuccuucaccauccuccucuccaacaccgagaaccaggagaagaagaagaucuucgucuuccucgagcaccagaccaagguccucaagaagcgccacaccaaggagaagguccuccgccgcgccaagcgccgcugggcccccauccccugcuccaugcucgagaacucccucggccccuucccccucuuccuccagcagguccaguccgacaccgcccagaacuacaccaucuacuacuccauccgcggccccggcgucgaccaggagccccgcaaccucuucuacgucgagcgcgacaccggcaaccucuacugcacccgccccgucgaccgcgagcaguacgaguccuucgagaucaucgccuucgccaccacccccgacggcuacacccccgagcucccccucccccucaucaucaagaucgaggacgagaacgacaacuaccccaucuucaccgaggagaccuacaccuucaccaucuucgagaacugccgcgucggcaccaccgucggccaggucugcgccaccgacaaggacgagcccgacaccaugcacacccgccucaaguacuccaucaucggccaggucccccccucccccacccucuucuccaugcaccccaccaccggcgucaucaccaccaccuccucccagcucgaccgcgagcucaucgacaaguaccagcucaagaucaagguccaggacauggacggccaguacuucggccuccagaccaccuccaccugcaucaucaacaucgacgacgucaacgaccaccuccccaccuucacccgcaccuccuacgucaccuccgucgaggagaacaccgucgacgucgagauccuccgcgucaccgucgaggacaaggaccucgucaacaccgccaacuggcgcgccaacuacaccauccucaagggcaacgagaacggcaacuucaagaucgucaccgacgccaagaccaacgagggcguccucugcgucgucaagccccucaacuacgaggagaagcagcagaugauccuccagaucggcgucgucaacgaggcccccuucucccgcgaggccuccccccgcuccgccauguccaccgccaccgucaccgucaacgucgaggaccaggacgagggccccgagugcaacccccccauccagaccguccgcaugaaggagaacgccgaggucggcaccaccuccaacggcuacaaggccuacgaccccgagacccgcuccuccuccggcauccgcuacaagaagcucaccgaccccaccggcugggucaccaucgacgagaacaccggcuccaucaaggucuuccgcucccucgaccgcgaggccgagaccaucaagaacggcaucuacaacaucaccguccucgccuccgaccagggcggccgcaccugcaccggcacccucggcaucauccuccaggacgucaacgacaacucccccuucauccccaagaagaccgucaucaucugcaagcccaccauguccuccgccgagaucgucgccgucgaccccgacgagcccauccacggcccccccuucgacuucucccucgaguccuccaccuccgagguccagcgcauguggcgccucaaggccaucaacgacaccgccgcccgccucuccuaccagaacgacccccccuucggcuccuacgucguccccaucaccguccgcgaccgccucggcauguccuccgucaccucccucgacgucacccucugcgacugcaucaccgagaacgacugcacccaccgcgucgacccccgcaucggcggcggcggcguccagcucggcaagugggccauccucgccauccuccucggcaucgcccuccucuucugcauccucuucacccucgucugcggcgccuccggcaccuccaagcagcccaaggucauccccgacgaccucgcccagcagaaccucaucgucuccaacaccgaggcccccggcgacgacaaggucuacuccgccaacggcuucaccacccagaccgucggcgccuccgcccagggcgucugcggcaccgucggcuccggcaucaagaacggcggccaggagaccaucgagauggucaagggcggccaccagaccuccgaguccugccgcggcgccggccaccaccacacccucgacuccugccgcggcggccacaccgaggucgacaacugccgcuacaccuacuccgaguggcacuccuucacccagccccgccucggcgaggaguccauccgcggccacacccucaucaagaacuga

SEQ ID NO: 42442 - RNA, 2691 nt, Artificial Sequence
  derived and/or modified sequence opt2 from DSC3__Homo_sapiens__NP_001932
auggccgccgccggcccccgccgcuccguccgcggcgccgucugccuccaccuccuccucacccucgucaucuucucccgcgccggcgaggccugcaagaaggucauccucaacguccccuccaagcucgaggccgacaagaucaucggccgcgucaaccucgaggagugcuuccgcuccgccgaccucauccgcuccuccgaccccgacuuccgcguccucaacgacggcuccgucuacaccgcccgcgccgucgcccucuccgacaagaagcgcuccuucaccaucuggcucuccgacaagcgcaagcagacccagaaggaggucaccguccuccucgagcaccagaagaaggucuccaagacccgccacacccgcgagaccguccuccgccgcgccaagcgccgcugggcccccauccccugcuccaugcaggagaacucccucggccccuucccccucuuccuccagcaggucgaguccgacgccgcccagaacuacaccgucuucuacuccaucuccggccgcggcgucgacaaggagccccucaaccucuucuacaucgagcgcgacaccggcaaccucuucugcacccgccccgucgaccgcgaggaguacgacgucuucgaccucaucgccuacgccuccaccgccgacggcuacuccgccgaccucccccucccccuccccauccgcgucgaggacgagaacgacaaccaccccgucuucaccgaggccaucuacaacuucgagguccucgaguccucccgccccggcaccaccgucggcgucgucugcgccaccgaccgcgacgagcccgacaccaugcacacccgccucaaguacuccauccuccagcagaccccccgcucccccggccucuucuccguccaccccuccaccggcgucaucaccaccgucucccacuaccucgaccgcgaggucgucgacaaguacucccucaucaugaagguccaggacauggacggccaguucuucggccucaucggcaccuccaccugcaucaucaccgucaccgacuccaacgacaacgcccccaccuuccgccagaacgccuacgaggccuucgucgaggagaacgccuucaacgucgagauccuccgcauccccaucgaggacaaggaccucaucaacaccgccaacuggcgcgucaacuucaccauccucaagggcaacgagaacggccacuucaagaucuccaccgacaaggagaccaacgagggcguccucuccgucgucaagccccucaacuacgaggagaaccgccaggucaaccucgagaucggcgucaacaacgaggcccccuucgcccgcgacaucccccgcgucaccgcccucaaccgcgcccucgucaccguccacguccgcgaccucgacgagggccccgagugcacccccgccgcccaguacguccgcaucaaggagaaccucgccgucggcuccaagaucaacggcuacaaggccuacgaccccgagaaccgcaacggcaacggccuccgcuacaagaagcuccacgaccccaagggcuggaucaccaucgacgagaucuccggcuccaucaucaccuccaagauccucgaccgcgaggucgagacccccaagaacgagcucuacaacaucaccguccucgccaucgacaaggacgaccgcuccugcaccggcacccucgccgucaacaucgaggacgucaacgacaacccccccgagauccuccaggaguacgucgucaucugcaagcccaagaugggcuacaccgacauccucgccgucgaccccgacgagcccguccacggcgcccccuucuacuucucccuccccaacaccucccccgagaucucccgccucuggucccucaccaaggucaacgacaccgccgcccgccucuccuaccagaagaacgccggcuuccaggaguacaccauccccaucaccgucaaggaccgcgccggccaggccgccaccaagcuccuccgcgucaaccucugcgagugcacccaccccacccagugccgcgccaccucccgcuccaccggcgucauccucggcaagugggccauccucgccauccuccucggcaucgcccuccucuucuccguccuccucacccucgucugcggcgucuucggcgccaccaagggcaagcgcuuccccgaggaccucgcccagcagaaccucaucaucuccaacaccgaggcccccggcgacgaccgcgucugcuccgccaacggcuucaugacccagaccaccaacaacuccucccagggcuucugcggcaccaugggcuccggcaugaagaacggcggccaggagaccaucgagaugaugaagggcggcaaccagacccucgaguccugccgcggcgccggccaccaccacacccucgacuccugccgcggcggccacaccgaggucgacaacugccgcuacaccuacuccgaguggcacuccuucacccagccccgccucggcgagaagcuccaccgcugcaaccagaacgaggaccgcaugcccucccaggacuacguccucaccuacaacuacgagggccgcggcucccccgccggcuccgucggcugcugcuccgagaagcaggaggaggacggccucgacuuccucaacaaccucgagcccaaguucaucacccucgccgaggccugcaccaagcgcuga

SEQ ID NO: 42443 - RNA, 6039 nt, Artificial Sequence
  derived and/or modified sequence opt2 from DSCAM__Homo_sapiens__NP_001380
auguggauccucgcccucucccucuuccaguccuucgccaacgucuucuccgaggaccuccacuccucccucuacuucgucaacgccucccuccaggaggucgucuucgccuccaccaccggcacccucguccccugccccgccgccggcaucccccccgucacccuccgcugguaccucgccaccggcgaggagaucuacgacguccccggcauccgccacguccaccccaacggcacccuccagaucuuccccuucccccccuccuccuucuccacccucauccacgacaacaccuacuacugcaccgccgagaaccccuccggcaagauccgcucccaggacguccacaucaaggccguccuccgcgagcccuacaccguccgcgucgaggaccagaagaccaugcgcggcaacgucgccgucuucaagugcaucauccccuccuccgucgaggccuacaucaccgucgucuccugggagaaggacaccgucucccucgucuccggcucccgcuuccucaucaccuccaccggcgcccucuacaucaaggacguccagaacgaggacggccucuacaacuaccgcugcaucacccgccaccgcuacaccggcgagacccgccaguccaacuccgcccgccucuucgucuccgaccccgccaacuccgcccccuccauccucgacggcuucgaccaccgcaaggccauggccggccagcgcgucgagcuccccugcaaggcccucggccaccccgagcccgacuaccgcuggcucaaggacaacaugccccucgagcucuccggccgcuuccagaagaccgucaccggccuccucaucgagaacauccgccccuccgacuccggcuccuacgucugcgaggucuccaaccgcuacggcaccgccaaggucaucggccgccucuacgucaagcagccccucaaggccaccaucuccccccgcaaggucaaguccuccgucggcucccaggucucccucuccugcuccgucaccggcaccgaggaccaggagcucuccugguaccgcaacggcgagauccucaaccccggcaagaacguccgcaucaccggcaucaaccacgagaaccucaucauggaccacauggucaaguccgacggcggcgccuaccagugcuucguccgcaaggacaagcucuccgcccaggacuacguccaggucguccucgaggacggcacccccaagaucaucuccgccuucuccgagaaggucgucucccccgccgagcccgucucccucaugugcaacgucaagggcaccccccuccccaccaucaccuggacccucgacgacgaccccauccucaagggcggcucccaccgcaucucccagaugaucaccuccgagggcaacgucgucuccuaccucaacaucuccuccucccagguccgcgacggcggcgucuaccgcugcaccgccaacaacuccgccggcgucguccucuaccaggcccgcaucaacguccgcggccccgccuccauccgccccaugaagaacaucaccgccaucgccggccgcgacaccuacauccacugccgcgucaucggcuaccccuacuacuccaucaagugguacaagaacuccaaccuccuccccuucaaccaccgccaggucgccuucgagaacaacggcacccucaagcucuccgacguccagaaggaggucgacgagggcgaguacaccugcaacguccucguccagccccagcucuccaccucccaguccguccacgucaccgucaaggucccccccuucauccagcccuucgaguucccccgcuucuccaucggccagcgcgucuucauccccugcgucgucgucuccggcgaccuccccaucaccaucaccuggcagaaggacggccgccccauccccggcucccucggcgucaccaucgacaacaucgacuucaccuccucccuccgcaucuccaaccucucccucaugcacaacggcaacuacaccugcaucgcccgcaacgaggccgccgccgucgagcaccagucccagcucaucguccgcgucccccccaaguucgucguccagccccgcgaccaggacggcaucuacggcaaggccgucauccucaacugcuccgccgagggcuaccccguccccaccaucgucuggaaguucuccaagggcgccggcgucccccaguuccagcccaucgcccucaacggccgcauccagguccucuccaacggcucccuccucaucaagcacgucgucgaggaggacuccggcuacuaccucugcaaggucuccaacgacgucggcgccgacgucuccaaguccauguaccucaccgucaagauccccgccaugaucaccuccuaccccaacaccacccucgccacccagggccagaagaaggagauguccugcaccgcccacggcgagaagcccaucaucguccgcugggagaaggaggaccgcaucaucaaccccgagauggcccgcuaccucgucuccaccaaggaggucggcgaggaggucaucuccacccuccagauccuccccaccguccgcgaggacuccggcuucuucuccugccacgccaucaacuccuacggcgaggaccgcggcaucauccagcucaccguccaggagccccccgacccccccgagaucgagaucaaggacgucaaggcccgcaccaucacccuccgcuggaccaugggcuucgacggcaacucccccaucaccggcuacgacaucgagugcaagaacaaguccgacuccugggacuccgcccagcgcaccaaggacgucuccccccagcucaacuccgccaccaucaucgacauccaccccuccuccaccuacuccauccgcauguacgccaagaaccgcaucggcaaguccgagcccuccaacgagcucaccaucaccgccgacgaggccgcccccgacggccccccccaggagguccaccucgagcccaucuccucccaguccauccgcgucaccuggaaggcccccaagaagcaccuccagaacggcaucauccgcggcuaccagaucggcuaccgcgaguacuccaccggcggcaacuuccaguucaacaucaucuccgucgacaccuccggcgacuccgaggucuacacccucgacaaccucaacaaguucacccaguacggccucgucguccaggccugcaaccgcgccggcaccggccccuccucccaggagaucaucaccaccacccucgaggacguccccuccuacccccccgagaacguccaggccaucgccaccucccccgaguccaucuccaucuccugguccacccucuccaaggaggcccucaacggcauccuccagggcuuccgcgucaucuacugggccaaccucauggacggcgagcucggcgagaucaagaacaucaccaccacccagcccucccucgagcucgacggccucgagaaguacaccaacuacuccauccagguccucgccuucacccgcgccggcgacggcguccgcuccgagcagaucuucacccgcaccaaggaggacguccccggcccccccgccggcgucaaggccgccgccgccuccgccuccauggucuucgucuccuggcuccccccccucaagcucaacggcaucauccgcaaguacaccgucuucugcucccaccccuaccccaccgucaucuccgaguucgaggccucccccgacuccuucuccuaccgcauccccaaccucucccgcaaccgccaguacuccgucugggucgucgccgucaccuccgccggccgcggcaacuccuccgagaucaucaccgucgagccccucgccaaggcccccgcccgcauccucaccuucuccggcaccgucaccacccccuggaugaaggacaucguccuccccugcaaggccgucggcgaccccucccccgccgucaaguggaugaaggacuccaacggcacccccucccucgucaccaucgacggccgccgcuccaucuucuccaacggcuccuucaucauccgcaccgucaaggccgaggacuccggcuacuacuccugcaucgccaacaacaacuggggcuccgacgagaucauccucaaccuccagguccaggucccccccgaccagccccgccucaccgucuccaagaccaccuccuccuccaucacccucuccuggcuccccggcgacaacggcggcuccuccauccgcggcuacauccuccaguacuccgaggacaacuccgagcaguggggcuccuuccccaucucccccuccgagcgcuccuaccgccucgagaaccucaagugcggcaccugguacaaguucacccucaccgcccagaacggcgucggccccggccgcaucuccgagaucaucgaggccaagacccucggcaaggagccccaguucuccaaggagcaggagcucuucgccuccaucaacaccacccgcguccgccucaaccucaucggcuggaacgacggcggcugccccaucaccuccuucacccucgaguaccgccccuucggcaccaccgucuggaccaccgcccagcgcaccucccucuccaaguccuacauccucuacgaccuccaggaggccaccugguacgagcuccagaugcgcgucugcaacuccgccggcugcgccgagaagcaggccaacuucgccacccucaacuacgacggcuccaccauccccccccucaucaaguccgucguccagaacgaggagggccucaccaccaacgagggccucaagaugcucgucaccaucuccugcauccucgucggcguccuccuccucuucguccuccuccucgucguccgccgccgccgccgcgagcagcgccucaagcgccuccgcgacgccaagucccucgccgagaugcucauguccaagaacacccgcaccuccgacacccucuccaagcagcagcagacccuccgcaugcacaucgacaucccccgcgcccagcuccucaucgaggagcgcgacaccauggagaccaucgacgaccgcuccaccguccuccucaccgacgccgacuucggcgaggccgccaagcagaagucccucaccgucacccacaccguccacuaccaguccgucucccaggccaccggcccccucgucgacgucuccgacgcccgccccggcaccaaccccaccacccgccgcaacgccaaggccggccccaccgcccgcaaccgcuacgccucccaguggacccucaaccgcccccaccccaccaucuccgcccacacccucaccaccgacuggcgccuccccaccccccgcgccgccggcuccgucgacaaggaguccgacuccuacuccgucucccccucccaggacaccgaccgcgcccgcuccuccauggucuccaccgaguccgccuccuccaccuacgaggagcucgcccgcgccuacgagcacgccaagauggaggagcagcuccgccacgccaaguucaccaucaccgagugcuucaucuccgacaccuccuccgagcagcucaccgccggcaccaacgaguacaccgacucccucaccuccuccacccccuccgaguccggcaucugccgcuucaccgccuccccccccaagccccaggacggcggccgcgucaugaacauggccguccccaaggcccaccgccccggcgaccucauccaccucccccccuaccuccgcauggacuuccuccucaaccgcggcggccccggcaccucccgcgaccucucccucggccaggccugccucgagccccagaagucccgcacccucaagcgccccaccguccucgagcccauccccauggaggccgccuccuccgccuccuccacccgcgagggccaguccuggcagcccggcgccgucgccacccucccccagcgcgagggcgccgagcucggccaggccgccaagauguccuccucccaggagucccuccucgacucccgcggccaccucaagggcaacaaccccuacgccaaguccuacacccucgucuga

SEQ ID NO: 42444 - RNA, 6342 nt, Artificial Sequence
  derived and/or modified sequence opt2 from DSCAML1__Homo_sapiens__NP_065744
augaccggcgccggcgagccccgccgcgaggagccccccccccagcccuccgccggccuccgcucccgcgaguccggcgcccccuccgccggcggcugggagcgcgccgagcgcggccgcggcgccgccgcccgccccgccaccggcccccccccccgccgcaucggcccccucuacggcauguggcucgucaccuuccuccuccuccucgacucccuccacaaggcccgccccgaggacgucggcaccucccucuacuucgucaacgacucccuccagcaggucaccuucuccuccuccgucggcgucgucguccccugccccgccgccggcucccccuccgccgcccuccgcugguaccucgccaccggcgacgacaucuacgacgucccccacauccgccacguccacgccaacggcacccuccagcucuaccccuucucccccuccgccuucaacuccuucauccacgacaacgacuacuucugcaccgccgagaacgccgccggcaagauccgcucccccaacauccgcgucaaggccgucuuccgcgagcccuacaccguccgcgucgaggaccagcgcuccaugcgcggcaacgucgccgucuucaagugccucauccccuccuccguccaggaguacgucuccgucgucuccugggagaaggacaccgucuccaucauccccgagcaccgcuucuucaucaccuaccacggcggccucuacaucuccgacguccagaaggaggacgcccucuccaccuaccgcugcaucaccaagcacaaguacuccggcgagacccgccaguccaacggcgcccgccucuccgucaccgaccccgccgaguccauccccaccauccucgacggcuuccacucccaggaggucugggccggccacaccgucgagcuccccugcaccgccuccggcuaccccauccccgccauccgcuggcucaaggacggccgcccccuccccgccgacucccgcuggaccaagcgcaucaccggccucaccaucuccgaccuccgcaccgaggacuccggcaccuacaucugcgaggucaccaacaccuucggcuccgccgaggccaccggcauccucauggucaucgacccccuccacgucacccucacccccaagaagcucaagaccggcaucggcuccaccgucauccucuccugcgcccucaccggcucccccgaguucaccauccgcugguaccgcaacaccgagcucguccuccccgacgaggccaucuccauccgcggccucuccaacgagacccuccucaucaccuccgcccagaagucccacuccggcgccuaccagugcuucgccacccgcaaggcccagaccgcccaggacuucgccaucaucgcccucgaggacggcaccccccgcaucgucuccuccuucuccgagaaggucgucaaccccggcgagcaguucucccucaugugcgccgccaagggcgcccccccccccaccgucaccugggcccucgacgacgagcccaucguccgcgacggcucccaccgcaccaaccaguacaccauguccgacggcaccaccaucucccacaugaacgucaccggcccccagauccgcgacggcggcgucuaccgcugcaccgcccgcaaccucgucggcuccgccgaguaccaggcccgcaucaacguccgcggcccccccuccauccgcgccaugcgcaacaucaccgccgucgccggccgcgacacccucaucaacugccgcgucaucggcuaccccuacuacuccaucaagugguacaaggacgcccuccuccuccccgacaaccaccgccaggucgucuucgagaacggcacccucaagcucaccgacguccagaagggcauggacgagggcgaguaccucugcuccguccucauccagccccagcucuccaucucccaguccguccacgucgccgucaagguccccccccucauccagcccuucgaguucccccccgccuccaucggccagcuccucuacauccccugcgucgucuccuccggcgacaugcccauccgcaucaccuggcgcaaggacggccaggucaucaucuccggcuccggcgucaccaucgaguccaaggaguucauguccucccuccagaucuccuccgucucccucaagcacaacggcaacuacaccugcaucgccuccaacgccgccgccaccgucucccgcgagcgccagcucaucguccgcguccccccccgcuucgucguccagcccaacaaccaggacggcaucuacggcaaggccggcguccucaacugcuccgucgacggcuaccccccccccaaggucauguggaagcacgccaagggcuccggcaacccccagcaguaccaccccgucccccucaccggccgcauccagauccuccccaacuccucccuccucauccgccacguccucgaggaggacaucggcuacuaccucugccaggccuccaacggcgucggcaccgacaucuccaaguccauguuccucaccgucaagauccccgccaugaucaccucccaccccaacaccaccaucgccaucaagggccacgccaaggagcucaacugcaccgcccgcggcgagcgccccaucaucauccgcugggagaagggcgacaccgucaucgaccccgaccgcgucaugcgcuacgccaucgccaccaaggacaacggcgacgaggucgucuccacccucaagcucaagcccgccgaccgcggcgacuccgucuucuucuccugccacgccaucaacuccuacggcgaggaccgcggccucauccagcucaccguccaggagccccccgacccccccgagcucgagauccgcgaggucaaggcccgcuccaugaaccuccgcuggacccagcgcuucgacggcaacuccaucaucaccggcuucgacaucgaguacaagaacaaguccgacuccugggacuucaagcaguccacccgcaacaucucccccaccaucaaccaggccaacaucgucgaccuccaccccgccuccgucuacuccauccgcauguacuccuucaacaagaucggccgcuccgagcccuccaaggagcucaccaucuccaccgaggaggccgcccccgacggcccccccauggacgucacccuccagcccgucaccucccaguccauccaggucaccuggaaggcccccaagaaggagcuccagaacggcgucauccgcggcuaccagaucggcuaccgcgagaacucccccggcuccaacggccaguacuccaucgucgagaugaaggccaccggcgacuccgaggucuacacccucgacaaccucaagaaguucgcccaguacggcgucgucguccaggccuucaaccgcgccggcaccggccccuccuccuccgagaucaacgccaccacccucgaggacguccccucccagccccccgagaacguccgcgcccucuccaucaccuccgacgucgccgucaucuccugguccgagcccccccgcuccacccucaacggcguccucaagggcuaccgcgucaucuucuggucccucuacgucgacggcgaguggggcgagaugcagaacaucaccaccacccgcgagcgcgucgagcuccgcggcauggagaaguucaccaacuacuccguccagguccucgccuacacccaggccggcgacggcguccgcuccuccguccucuacauccagaccaaggaggacguccccggcccccccgccggcaucaaggccguccccuccuccgccuccuccgucgucgucuccuggcucccccccaccaagcccaacggcgucauccgcaaguacaccaucuucugcuccucccccggcuccggccagcccgcccccuccgaguacgagaccucccccgagcagcucuucuaccgcaucgcccaccucaaccgcggccagcaguaccuccucugggucgccgccgucaccuccgccggccgcggcaacuccuccgagaaggucaccaucgagcccgccggcaaggcccccgccaagaucaucuccuucggcggcaccgucaccacccccuggaugaaggacguccgccuccccugcaacuccgucggcgaccccgcccccgccgucaaguggaccaaggacuccgaggacuccgccauccccgucuccauggacggccaccgccucauccacaccaacggcacccuccuccuccgcgccgucaaggccgaggacuccggcuacuacaccugcaccgccaccaacaccggcggcuucgacaccaucaucgucaaccuccucguccaggucccccccgaccagccccgccucaccgucuccaagaccuccgccuccuccaucacccucaccuggauccccggcgacaacggcggcuccuccauccgcggcuucguccuccaguacuccgucgacaacuccgaggaguggaaggacgucuucaucuccuccuccgagcgcuccuucaagcucgacucccucaagugcggcaccugguacaaggucaagcucgccgccaagaacuccgucggcuccggccgcaucuccgagaucaucgaggccaagacccacggccgcgagcccuccuucuccaaggaccagcaccucuucacccacaucaacuccacccacgcccgccucaaccuccagggcuggaacaacggcggcugccccaucaccgccaucguccucgaguaccgccccaagggcaccugggccuggcagggccuccgcgccaacuccuccggcgaggucuuccucaccgagcuccgcgaggccaccugguacgagcuccgcaugcgcgccugcaacuccgccggcugcggcaacgagaccgcccaguucgccacccucgacuacgacggcuccaccaucccccccaucaaguccgcccagggcgagggcgacgacgucaagaagcucuucaccaucggcugccccgucauccucgccacccucggcgucgcccuccucuucaucguccgcaagaagcgcaaggagaagcgccucaagcgccuccgcgacgccaagucccucgccgagaugcucaucuccaagaacaaccgcuccuucgacacccccgucaagggccccccccagggcccccgccuccacaucgacaucccccgcguccagcuccucaucgaggacaaggagggcaucaagcagcucggcgacgacaaggccaccauccccgucaccgacgccgaguucucccaggccgucaacccccaguccuucugcaccggcgucucccuccaccaccccacccucauccaguccaccggcccccucaucgacauguccgacauccgccccggcaccaaccccgucucccgcaagaacgucaaguccgcccacuccacccgcaaccgcuacuccucccaguggacccucaccaagugccaggccuccacccccgcccgcacccucaccuccgacuggcgcaccgucggcucccagcacggcgucaccgucaccgaguccgacuccuacuccgccucccucucccaggacaccgacaagggccgcaacuccauggucuccaccgaguccgccuccuccaccuacgaggagcucgcccgcgccuacgagcacgccaagcucgaggagcagcuccagcacgccaaguucgagaucaccgagugcuucaucuccgacuccuccuccgaccagaugaccaccggcaccaacgagaacgccgacuccaugaccuccauguccacccccuccgagcccggcaucugccgcuucaccgccuccccccccaagccccaggacgccgaccgcggcaagaacgucgccguccccaucccccaccgcgccaacaaguccgacuacugcaaccucccccucuacgccaaguccgaggccuucuuccgcaaggccgacggccgcgagcccugccccgucguccccccccgcgaggccuccauccgcaaccucgcccgcaccuaccacacccaggcccgccaccucacccucgaccccgccuccaagucccucggccucccccaccccggcgcccccgccgccgccuccaccgccacccucccccagcgcacccucgccaugcccgccccccccgccggcaccgccccccccgcccccggccccacccccgccgagccccccaccgcccccuccgccgccccccccgcccccuccaccgagcccccccgcgccggcggcccccacaccaagaugggcggcucccgcgacucccuccucgagauguccaccuccggcgucggccgcucccagaagcagggcgccggcgccuacuccaaguccuacacccucgucuga

SEQ ID NO: 42445 - RNA, 1182 nt, Artificial Sequence
  derived and/or modified sequence opt2 from DSCC1__Homo_sapiens__NP_076999
augaagcgcacccgcgacgaggucgacgccacccuccagaucgccaagcucaacgccgccgagcuccuccccgccguccacugccucggcuucggccccggcgccuccggcgccgccgccggcgacuucugccuccucgagcucgagcccacccucugccagcagcucgaggacggccacucccucgucauccgcggcgacaaggacgagcaggccguccucugcuccaaggacaagaccuacgaccucaagaucgccgacaccuccaacaugcuccucuucauccccggcugcaagacccccgaccagcucaagaaggaggacucccacugcaacaucauccacaccgagaucuucggcuucuccaacaacuacugggagcuccgccgccgccgccccaagcucaagaagcucaagaagcuccucauggagaaccccuacgagggccccgacucccagaaggagaaggacuccaacuccuccaaguacaccaccgaggaccuccucgaccagauccaggccuccgaggaggagaucaugacccagcuccagguccucaacgccugcaagaucggcggcuacuggcgcauccucgaguucgacuacgagaugaagcuccucaaccacgucacccagcucgucgacuccgaguccugguccuucggcaaggucccccucaacaccugccuccaggagcucggcccccucgagcccgaggagaugaucgagcacugccucaagugcuacggcaagaaguacgucgacgagggcgaggucuacuucgagcucgacgccgacaagaucugccgcgccgccgcccgcaugcuccuccagaacgccgucaaguucaaccucgccgaguuccaggaggucuggcagcaguccguccccgagggcauggucaccucccucgaccagcucaagggccucgcccucgucgaccgccacucccgccccgagaucaucuuccuccucaaggucgacgaccuccccgaggacaaccaggagcgcuucaacucccucuucucccuccgcgagaaguggaccgaggaggacaucgcccccuacauccaggaccucugcggcgagaagcagaccaucggcgcccuccucaccaaguacucccacuccuccaugcagaacggcgucaaggucuacaacucccgccgccccaucuccuga

SEQ ID NO: 42446 - RNA, 357 nt, Artificial Sequence
  derived and/or modified sequence opt2 from DSCR4__Homo_sapiens__NP_005858
augucccucaucauccucacccgcgacgacgagccccgcaucuucacccccgacuccgacgccgccucccccgcccuccacuccaccuccccccuccccgaccccgccuccgccuccccccuccaccgcgaggagaagauccuccccaaggucugcaacaucgucuccugccucuccuucucccuccccgccucccccaccgacuccggccucgccucccccaccaucaucacccgcgagggccagcaguucugggccaagugccucaucuggaaguaccagcucuaccuccacggccuccacaagaaguccgacggccgccgcgacaagcagaucuccgccucccccuccaccuga

SEQ ID NO: 42447 - RNA, 2877 nt, Artificial Sequence
  derived and/or modified sequence opt2 from DSE__Homo_sapiens__NP_037484
augcgcacccacacccgcggcgcccccuccgucuucuucaucuaccuccucugcuucgucuccgccuacaucaccgacgagaaccccgaggucaugauccccuucaccaacgccaacuacgacucccaccccaugcucuacuucucccgcgccgaggucgccgagcuccagcuccgcgccgccuccucccacgagcacaucgccgcccgccucaccgaggccguccacaccaugcucuccuccccccucgaguaccucccccccugggaccccaaggacuacuccgcccgcuggaacgagaucuucggcaacaaccucggcgcccucgccauguucugcguccucuaccccgagaacaucgaggcccgcgacauggccaaggacuacauggagcgcauggccgcccagcccuccuggcucgucaaggacgcccccugggacgaggucccccucgcccacucccucgucggcuucgccaccgccuacgacuuccucuacaacuaccucuccaagacccagcaggagaaguuccucgaggucaucgccaacgccuccggcuacauguacgagaccuccuaccgccgcggcuggggcuuccaguaccuccacaaccaccagcccaccaacugcauggcccuccucaccggcucccucguccucaugaaccagggcuaccuccaggaggccuaccucuggaccaagcagguccucaccaucauggagaagucccucguccuccuccgcgaggucaccgacggcucccucuacgagggcgucgccuacggcuccuacaccacccgcucccucuuccaguacauguuccucguccagcgccacuucaacaucaaccacuucggccaccccuggcucaagcagcacuucgccuucauguaccgcaccauccuccccggcuuccagcgcaccgucgccaucgccgacuccaacuacaacugguucuacggccccgagucccagcucgucuuccucgacaaguucgucaugcgcaacggcuccggcaacuggcucgccgaccagauccgccgcaaccgcgucgucgagggccccggcacccccuccaagggccagcgcuggugcacccuccacaccgaguuccucugguacgacggcucccucaaguccguccccccccccgacuucggcacccccacccuccacuacuucgaggacuggggcgucgucaccuacggcuccgcccuccccgccgagaucaaccgcuccuuccucuccuucaaguccggcaagcucggcggccgcgccaucuacgacaucguccaccgcaacaaguacaaggacuggaucaagggcuggcgcaacuucaacgccggccacgagcaccccgaccagaacuccuucaccuucgcccccaacggcguccccuucaucaccgaggcccucuacggccccaaguacaccuucuucaacaacguccucauguucucccccgccgucuccaaguccugcuucucccccugggucggccaggucaccgaggacugcuccuccaagugguccaaguacaagcacgaccucgccgccuccugccagggccgcgucgucgccgccgaggagaagaacggcgucgucuucauccgcggcgagggcgucggcgccuacaacccccagcucaaccucaagaacguccagcgcaaccucauccuccuccacccccagcuccuccuccucgucgaccagauccaccucggcgaggaguccccccucgagaccgccgccuccuucuuccacaacgucgacguccccuucgaggagaccgucgucgacggcguccacggcgccuucauccgccagcgcgacggccucuacaagauguacuggauggacgacaccggcuacuccgagaaggccaccuucgccuccgucaccuacccccgcggcuaccccuacaacggcaccaacuacgucaacgucaccaugcaccuccgcucccccaucacccgcgccgccuaccucuucaucggccccuccaucgacguccaguccuucaccguccacggcgacucccagcagcucgacgucuucaucgccaccuccaagcacgccuacgccaccuaccucuggaccggcgaggccaccggccaguccgccuucgcccaggucaucgccgaccgccacaagauccucuucgaccgcaacuccgccaucaaguccuccaucguccccgaggucaaggacuacgccgccaucgucgagcagaaccuccagcacuucaagcccgucuuccagcuccucgagaagcagauccucucccgcguccgcaacaccgccuccuuccgcaagaccgccgagcgccuccuccgcuucuccgacaagcgccagaccgaggaggccaucgaccgcaucuucgccaucucccagcagcagcagcagcaguccaaguccaagaagaaccgccgcgccggcaagcgcuacaaguucgucgacgccguccccgacaucuucgcccagaucgaggucaacgagaagaagauccgccagaaggcccagauccucgcccagaaggagcuccccaucgacgaggacgaggagaugaaggaccuccucgacuucgccgacgucaccuacgagaagcacaagaacggcggccucaucaagggccgcuucggccaggcccgcauggucaccaccacccacucccgcgcccccucccucuccgccuccuacacccgccucuuccucauccucaacaucgccaucuucuucgucaugcucgccaugcagcucaccuacuuccagcgcgcccagucccuccacggccagcgcugccucuacgccguccuccucaucgacuccugcauccuccucuggcucuacuccuccugcucccagucccagugcuga

SEQ ID NO: 42448 - RNA, 3669 nt, Artificial Sequence
  derived and/or modified sequence opt2 from DSEL__Homo_sapiens__NP_115536
augcccaagggcggcgccccccccuggaucauggcccucauguucaccggccaccuccucuuccucgcccuccucauguucgccuucuccaccuucgaggaguccgucuccaacuacuccgagugggccgucuucaccgacgacaucgaccaguucaagacccagaagguccaggacuuccgccccaaccagaagcucaagaaguccaugcuccaccccucccucuacuucgacgccggcgagauccaggccaugcgccagaagucccgcgccucccaccuccaccucuuccgcgccauccgcuccgccgucaccgucaugcucuccaaccccaccuacuaccuccccccccccaagcacgccgacuucgccgccaaguggaacgagaucuacggcaacaaccuccccccccucgcccucuacugccuccucugccccgaggacaaggucgccuucgaguucguccucgaguacauggaccgcauggucggcuacaaggacuggcucgucgagaacgcccccggcgacgagguccccaucggccacucccucaccggcuucgccaccgccuucgacuuccucuacaaccuccucgacaaccaccgccgccagaaguaccucgagaagaucugggucaucaccgaggagauguacgaguacuccaagguccgcuccuggggcaagcagcuccuccacaaccaccaggccaccaacaugaucgcccuccucaccggcgcccucgucaccggcgucgacaagggcuccaaggccaacaucuggaagcaggccgucgucgacgucauggagaagaccauguuccuccucaaccacaucgucgacggcucccucgacgagggcgucgccuacggcuccuacaccgccaaguccgucacccaguacgucuuccucgcccagcgccacuucaacaucaacaaccucgacaacaacuggcucaagaugcacuucugguucuacuacgccacccuccuccccggcuuccagcgcaccgucggcaucgccgacuccaacuacaacugguucuacggccccgagucccagcucgucuuccucgacaaguucauccucaagaacggcgccggcaacuggcucgcccagcagauccgcaagcaccgccccaaggacggccccaugguccccuccaccgcccagcgcugguccacccuccacaccgaguacaucugguacgacccccagcucaccccccagccccccgccgacuacggcaccgccaagauccacaccuuccccaacuggggcgucgucaccuacggcgccggccuccccaacacccagaccaacaccuucgucuccuucaaguccggcaagcucggcggccgcgccgucuacgacaucguccacuuccagcccuacuccuggaucgacggcuggcgcuccuucaaccccggccacgagcaccccgaccagaacuccuucaccuucgcccccaacggccaggucuucgucuccgaggcccucuacggccccaagcucucccaccucaacaacguccucgucuucgcccccucccccuccucccagugcaacaagcccugggagggccagcucggcgagugcgcccaguggcucaaguggaccggcgaggaggucggcgacgccgccggcgagaucaucaccgccucccagcacggcgagauggucuucgucuccggcgaggccgucuccgccuacuccuccgccaugcgccucaaguccgucuaccgcgcccuccuccuccucaacucccagacccuccucgucgucgaccacaucgagcgccaggaggacucccccaucaacuccgucuccgccuucuuccacaaccucgacaucgacuucaaguacauccccuacaaguucaugaaccgcuacaacggcgccaugauggacgucugggacgcccacuacaagauguucugguucgaccaccacggcaacucccccauggccuccauccaggaggccgagcaggccgccgaguucaagaagcgcuggacccaguucgucaacgucaccuuccagauggagcccaccaucacccgcaucgccuacgucuucuacggccccuacaucaacgucuccuccugccgcuucaucgacuccuccaaccccggccuccagaucucccucaacgucaacaacaccgagcacgucgucuccaucgucaccgacuaccacaaccucaagacccgcuucaacuaccucggcuucggcggcuucgccuccgucgccgaccagggccagaucacccgcuucggccucggcacccaggccaucgucaagcccguccgccacgaccgcaucaucuuccccuucggcuucaaguucaacaucgccgucggccucauccucugcaucucccucgucauccucaccuuccaguggcgcuucuaccucuccuuccgcaagcucaugcgcuggauccucauccucgucaucgcccucugguucaucgagcuccucgacgucugguccaccugcucccagcccaucugcgccaaguggacccgcaccgaggccgagggcuccaagaagucccucuccuccgagggccaccacauggaccuccccgacgucgucaucaccucccuccccggcuccggcgccgagauccucaagcagcucuucuucaacuccuccgacuuccucuacauccgcguccccaccgccuacaucgacauccccgagaccgagcucgagaucgacuccuucgucgacgccugcgaguggaaggucuccgacauccgcuccggccacuuccgccuccuccgcggcuggcuccagucccucguccaggacaccaagcuccaccuccagaacauccaccuccacgagcccaaccgcggcaagcucgcccaguacuucgccaugaacaaggacaagaagcgcaaguucaagcgccgcgagucccuccccgagcagcgcucccagaugaagggcgccuucgaccgcgacgccgaguacauccgcgcccuccgccgccaccucgucuacuaccccuccgcccgccccguccucucccucuccuccggcuccuggacccucaagcuccacuucuuccaggagguccucggcgccuccaugcgcgcccucuacaucguccgcgacccccgcgccuggaucuacuccaugcucuacaacuccaagcccucccucuacucccucaagaacguccccgagcaccucgccaagcucuucaagaucgagggcggcaagggcaagugcaaccucaacuccggcuacgccuucgaguacgagccccuccgcaaggagcucuccaaguccaaguccaacgccgucucccuccucucccaccucuggcucgccaacaccgccgccgcccuccgcaucaacaccgaccuccuccccaccuccuaccagcucgucaaguucgaggacaucguccacuucccccagaagaccaccgagcgcaucuucgccuuccucggcaucccccucucccccgccucccucaaccagauccucuucgccaccuccaccaaccucuucuaccuccccuacgagggcgagaucucccccaccaacaccaacgucuggaagcagaaccucccccgcgacgagaucaagcucaucgagaacaucugcuggacccucauggaccgccucggcuaccccaaguucauggacuga

SEQ ID NO: 42449 - RNA, 3150 nt, Artificial Sequence
  derived and/or modified sequence opt2 from DSG1__Homo_sapiens__NP_001933
auggacugguccuucuuccgcgucgucgccaugcucuucaucuuccucgucgucgucgaggucaacuccgaguuccgcauccagguccgcgacuacaacaccaagaacggcaccaucaaguggcacuccauccgccgccagaagcgcgaguggaucaaguucgccgccgccugccgcgagggcgaggacaacuccaagcgcaaccccaucgccaagauccacuccgacugcgccgccaaccagcaggucaccuaccgcaucuccggcgucggcaucgaccagccccccuacggcaucuucgucaucaaccagaagaccggcgagaucaacaucaccuccaucgucgaccgcgaggucacccccuucuucaucaucuacugccgcgcccucaacuccaugggccaggaccucgagcgcccccucgagcuccgcguccgcguccucgacaucaacgacaacccccccgucuucuccauggccaccuucgccggccagaucgaggagaacuccaacgccaacacccucgucaugauccucaacgccaccgacgccgacgagcccaacaaccucaacuccaagaucgccuucaagaucauccgccaggagcccuccgacucccccauguucaucaucaaccgcaacaccggcgagauccgcaccaugaacaacuuccucgaccgcgagcaguacggccaguacgcccucgccguccgcggcuccgaccgcgacggcggcgccgacggcauguccgccgagugcgagugcaacaucaagauccucgacgucaacgacaacauccccuacauggagcaguccuccuacaccaucgagauccaggagaacacccucaacuccaaccuccucgagauccgcgucaucgaccucgacgaggaguucuccgccaacuggauggccgucaucuucuucaucuccggcaacgagggcaacugguucgagaucgagaugaacgagcgcaccaacgucggcauccucaaggucgucaagccccucgacuacgaggccaugcagucccuccagcucuccaucggcguccgcaacaaggccgaguuccaccacuccaucaugucccaguacaagcucaaggccuccgccaucuccgucaccguccucaacgucaucgagggccccgucuuccgccccggcuccaagaccuacgucgucaccggcaacaugggcuccaacgacaaggucggcgacuucgucgccaccgaccucgacaccggccgccccuccaccaccguccgcuacgucaugggcaacaaccccgccgaccuccucgccgucgacucccgcaccggcaagcucacccucaagaacaaggucaccaaggagcaguacaacaugcucggcggcaaguaccagggcaccauccucuccaucgacgacaaccuccagcgcaccugcaccggcaccaucaacaucaacauccaguccuucggcaacgacgaccgcaccaacaccgagcccaacaccaagaucaccaccaacaccggccgccaggaguccaccuccuccaccaacuacgacaccuccaccaccuccaccgacuccucccaggucuacuccuccgagcccggcaacggcgccaaggaccuccucuccgacaacguccacuucggccccgccggcaucggccuccucaucaugggcuuccucguccucggccucguccccuuccucaugaucugcugcgacugcggcggcgccccccgcuccgccgccggcuucgagcccguccccgagugcuccgacggcgccauccacuccugggccgucgagggcccccagcccgagccccgcgacaucaccaccgucaucccccagaucccccccgacaacgccaacaucaucgagugcaucgacaacuccggcgucuacaccaacgaguacggcggccgcgagaugcaggaccucggcggcggcgagcgcaugaccggcuucgagcucaccgagggcgucaagaccuccggcaugcccgagaucugccaggaguacuccggcacccuccgccgcaacuccaugcgcgagugccgcgagggcggccucaacaugaacuucauggaguccuacuucugccagaaggccuacgccuacgccgacgaggacgagggccgccccuccaacgacugccuccucaucuacgacaucgagggcgucggcucccccgccggcuccgucggcugcugcuccuucaucggcgaggaccucgacgacuccuuccucgacacccucggccccaaguucaagaagcucgccgacaucucccucggcaaggaguccuaccccgaccucgaccccuccuggcccccccaguccaccgagcccgucugccucccccaggagaccgagcccgucgucuccggccacccccccaucuccccccacuucggcaccaccaccgucaucuccgaguccaccuaccccuccggccccggcguccuccaccccaagcccauccucgacccccucggcuacggcaacgucaccgucaccgaguccuacaccaccuccgacacccucaagcccuccguccacguccacgacaaccgccccgccuccaacgucgucgucaccgagcgcgucgucggccccaucuccggcgccgaccuccacggcaugcucgagaugcccgaccuccgcgacggcuccaacgucaucgucaccgagcgcgucaucgcccccuccuccucccuccccaccucccucaccauccaccacccccgcgaguccuccaacgucgucgucaccgagcgcgucauccagcccaccuccggcaugaucggcucccucuccaugcaccccgagcucgccaacgcccacaacgucaucgucaccgagcgcgucgucuccggcgccggcgucaccggcaucuccggcaccaccggcaucuccggcggcaucggcuccuccggccucgucggcaccuccaugggcgccggcuccggcgcccucuccggcgccggcaucuccggcggcggcaucggccucuccucccucggcggcaccgccuccaucggccacaugcgcuccuccuccgaccaccacuucaaccagaccaucggcuccgccucccccuccaccgcccgcucccgcaucaccaaguacuccaccguccaguacuccaaguga

SEQ ID NO: 42450 - RNA, 3357 nt, Artificial Sequence
  derived and/or modified sequence opt2 from DSG2__Homo_sapiens__NP_001934
auggcccgcucccccggccgcgccuacgcccuccuccuccuccucaucugcuucaacgucggcuccggccuccaccuccagguccucuccacccgcaacgagaacaagcuccuccccaagcacccccaccucguccgccagaagcgcgccuggaucaccgcccccgucgcccuccgcgagggcgaggaccucuccaagaagaaccccaucgccaagauccacuccgaccucgccgaggagcgcggccucaagaucaccuacaaguacaccggcaagggcaucaccgagccccccuucggcaucuucgucuucaacaaggacaccggcgagcucaacgucaccuccauccucgaccgcgaggagacccccuucuuccuccucaccggcuacgcccucgacgcccgcggcaacaacgucgagaagccccucgagcuccgcaucaagguccucgacaucaacgacaacgagcccgucuucacccaggacgucuucgucggcuccgucgaggagcucuccgccgcccacacccucgucaugaagaucaacgccaccgacgccgacgagcccaacacccucaacuccaagaucuccuaccgcaucgucucccucgagcccgccuacccccccgucuucuaccucaacaaggacaccggcgagaucuacaccaccuccgucacccucgaccgcgaggagcacuccuccuacacccucaccgucgaggcccgcgacggcaacggcgaggucaccgacaagcccgucaagcaggcccagguccagauccgcauccucgacgucaacgacaacauccccgucgucgagaacaagguccucgagggcauggucgaggagaaccaggucaacgucgaggucacccgcaucaaggucuucgacgccgacgagaucggcuccgacaacuggcucgccaacuucaccuucgccuccggcaacgagggcggcuacuuccacaucgagaccgacgcccagaccaacgagggcaucgucacccucaucaaggaggucgacuacgaggagaugaagaaccucgacuucuccgucaucgucgccaacaaggccgccuuccacaaguccauccgcuccaaguacaagcccacccccauccccaucaaggucaaggucaagaacgucaaggagggcauccacuucaaguccuccgucaucuccaucuacgucuccgaguccauggaccgcuccuccaagggccagaucaucggcaacuuccaggccuucgacgaggacaccggccuccccgcccacgcccgcuacgucaagcucgaggaccgcgacaacuggaucuccgucgacuccgucaccuccgagaucaagcucgccaagcuccccgacuucgagucccgcuacguccagaacggcaccuacaccgucaagaucgucgccaucuccgaggacuacccccgcaagaccaucaccggcaccguccucaucaacgucgaggacaucaacgacaacugccccacccucaucgagcccguccagaccaucugccacgacgccgaguacgucaacgucaccgccgaggaccucgacggccaccccaacuccggccccuucuccuucuccgucaucgacaagccccccggcauggccgagaaguggaagaucgcccgccaggaguccaccuccguccuccuccagcaguccgagaagaagcucggccgcuccgagauccaguuccucaucuccgacaaccagggcuucuccugccccgagaagcagguccucacccucaccgucugcgagugccuccacggcuccggcugccgcgaggcccagcacgacuccuacgucggccucggccccgccgccaucgcccucaugauccucgccuuccuccuccuccuccucgucccccuccuccuccucaugugccacugcggcaagggcgccaagggcuucacccccauccccggcaccaucgagaugcuccaccccuggaacaacgagggcgccccccccgaggacaaggucguccccuccuuccuccccgucgaccagggcggcucccucgucggccgcaacggcgucggcggcauggccaaggaggccaccaugaagggcuccuccuccgccuccaucgucaagggccagcacgagauguccgagauggacggccgcugggaggagcaccgcucccuccucuccggccgcgccacccaguucaccggcgccaccggcgccaucaugaccaccgagaccaccaagaccgcccgcgccaccggcgccucccgcgacauggccggcgcccaggccgccgccgucgcccucaacgaggaguuccuccgcaacuacuucaccgacaaggccgccuccuacaccgaggaggacgagaaccacaccgccaaggacugccuccucgucuacucccaggaggagaccgagucccucaacgccuccaucggcugcugcuccuucaucgagggcgagcucgacgaccgcuuccucgacgaccucggccucaaguucaagacccucgccgaggucugccucggccagaagaucgacaucaacaaggagaucgagcagcgccagaagcccgccaccgagaccuccaugaacaccgccucccacucccucugcgagcagaccauggucaacuccgagaacaccuacuccuccggcuccuccuuccccguccccaagucccuccaggaggccaacgccgagaaggucacccaggagaucgucaccgagcgcuccgucuccucccgccaggcccagaaggucgccaccccccuccccgaccccauggccucccgcaacgucaucgccaccgagaccuccuacgucaccggcuccaccaugccccccaccaccgucauccucggccccucccagccccagucccucaucgucaccgagcgcgucuacgcccccgccuccacccucgucgaccagcccuacgccaacgagggcaccgucgucgucaccgagcgcgucauccagccccacggcggcggcuccaacccccucgagggcacccagcaccuccaggacguccccuacgucaugguccgcgagcgcgaguccuuccucgcccccuccuccggcguccagcccacccucgccaugcccaacaucgccgucggccagaacgucaccgucaccgagcgcguccucgcccccgccuccacccuccaguccuccuaccagauccccaccgagaacuccaugaccgcccgcaacaccaccgucuccggcgccggcguccccggcccccuccccgacuucggccucgaggaguccggccacuccaacuccaccaucaccaccuccuccacccgcgucaccaagcacuccaccguccagcacuccuacuccuga

SEQ ID NO: 42451 - RNA, 3000 nt, Artificial Sequence
  derived and/or modified sequence opt2 from DSG3__Homo_sapiens__NP_001935
augaugggccucuucccccgcaccaccggcgcccucgccaucuucgucgucgucauccucguccacggcgagcuccgcaucgagaccaagggccaguacgacgaggaggagaugaccaugcagcaggccaagcgccgccagaagcgcgagugggucaaguucgccaagcccugccgcgagggcgaggacaacuccaagcgcaaccccaucgccaagaucaccuccgacuaccaggccacccagaagaucaccuaccgcaucuccggcgucggcaucgaccagccccccuucggcaucuucgucgucgacaagaacaccggcgacaucaacaucaccgccaucgucgaccgcgaggagacccccuccuuccucaucaccugccgcgcccucaacgcccagggccucgacgucgagaagccccucauccucaccgucaagauccucgacaucaacgacaacccccccgucuucucccagcagaucuucaugggcgagaucgaggagaacuccgccuccaacucccucgucaugauccucaacgccaccgacgccgacgagcccaaccaccucaacuccaagaucgccuucaagaucgucucccaggagcccgccggcacccccauguuccuccucucccgcaacaccggcgagguccgcacccucaccaacucccucgaccgcgagcaggccuccuccuaccgccucgucgucuccggcgccgacaaggacggcgagggccucuccacccagugcgagugcaacaucaaggucaaggacgucaacgacaacuuccccauguuccgcgacucccaguacuccgcccgcaucgaggagaacauccucuccuccgagcuccuccgcuuccaggucaccgaccucgacgaggaguacaccgacaacuggcucgccgucuacuucuucaccuccggcaacgagggcaacugguucgagauccagaccgacccccgcaccaacgagggcauccucaaggucgucaaggcccucgacuacgagcagcuccaguccgucaagcucuccaucgccgucaagaacaaggccgaguuccaccaguccgucaucucccgcuaccgcguccaguccacccccgucaccauccaggucaucaacguccgcgagggcaucgccuuccgccccgccuccaagaccuucaccguccagaagggcaucuccuccaagaagcucgucgacuacauccucggcaccuaccaggccaucgacgaggacaccaacaaggccgccuccaacgucaaguacgucaugggccgcaacgacggcggcuaccucaugaucgacuccaagaccgccgagaucaaguucgucaagaacaugaaccgcgacuccaccuucaucgucaacaagaccaucaccgccgagguccucgccaucgacgaguacaccggcaagaccuccaccggcaccgucuacguccgcguccccgacuucaacgacaacugccccaccgccguccucgagaaggacgccgucugcuccuccucccccuccgucgucgucuccgcccgcacccucaacaaccgcuacaccggccccuacaccuucgcccucgaggaccagcccgucaagcuccccgccgucugguccaucaccacccucaacgccaccuccgcccuccuccgcgcccaggagcagaucccccccggcgucuaccacaucucccucguccucaccgacucccagaacaaccgcugcgagaugccccgcucccucacccucgaggucugccagugcgacaaccgcggcaucugcggcaccuccuaccccaccaccucccccggcacccgcuacggccgcccccacuccggccgccucggccccgccgccaucggccuccuccuccucggccuccuccuccuccuccucgccccccuccuccuccucaccugcgacugcggcgccggcuccaccggcggcgucaccggcggcuucauccccguccccgacggcuccgagggcaccauccaccaguggggcaucgagggcgcccaccccgaggacaaggagaucaccaacaucugcgucccccccgucaccgccaacggcgccgacuucauggaguccuccgaggucugcaccaacaccuacgcccgcggcaccgccgucgagggcaccuccggcauggagaugaccaccaagcucggcgccgccaccgaguccggcggcgccgccggcuucgccaccggcaccgucuccggcgccgccuccggcuucggcgccgccaccggcgucggcaucugcuccuccggccaguccggcaccaugcgcacccgccacuccaccggcggcaccaacaaggacuacgccgacggcgccaucuccaugaacuuccucgacuccuacuucucccagaaggccuucgccugcgccgaggaggacgacggccaggaggccaacgacugccuccucaucuacgacaacgagggcgccgacgccaccggcucccccgucggcuccgucggcugcugcuccuucaucgccgacgaccucgacgacuccuuccucgacucccucggccccaaguucaagaagcucgccgagaucucccucggcgucgacggcgagggcaaggagguccagccccccuccaaggacuccggcuacggcaucgaguccugcggccaccccaucgagguccagcagaccggcuucgucaagugccagacccucuccggcucccagggcgccuccgcccucuccaccuccggcuccguccagcccgccgucuccauccccgacccccuccagcacggcaacuaccucgucaccgagaccuacuccgccuccggcucccucguccagcccuccaccgccggcuucgacccccuccucacccagaacgucaucgucaccgagcgcgucaucugccccaucuccuccguccccggcaaccucgccggccccacccagcuccgcggcucccacaccaugcucugcaccgaggaccccugcucccgccucaucuga

SEQ ID NO: 42452 - RNA, 3180 nt, Artificial Sequence
  derived and/or modified sequence opt2 from DSG4__Homo_sapiens__NP_001127925
auggacuggcucuucuuccgcaacaucugccuccucaucauccucauggucgucauggaggucaacuccgaguucaucgucgaggucaaggaguucgacaucgagaacggcaccaccaaguggcagaccguccgccgccagaagcgcgaguggaucaaguucgccgccgccugccgcgagggcgaggacaacuccaagcgcaaccccaucgccaagauccgcuccgacugcgaguccaaccagaagaucaccuaccgcaucuccggcgucggcaucgaccgcccccccuacggcgucuucaccaucaacccccgcaccggcgagaucaacaucaccuccgucgucgaccgcgagaucaccccccucuuccucaucuacugccgcgcccucaacucccgcggcgaggaccucgagcgcccccucgagcuccgcgucaaggucauggacaucaacgacaacgcccccgucuucucccaguccgucuacaccgccuccaucgaggagaacuccgacgccaacacccucgucgucaagcucugcgccaccgacgccgacgaggagaaccaccucaacuccaagaucgccuacaagaucgucucccaggagcccuccggcgcccccauguucauccucaaccgcuacaccggcgaggucugcaccauguccuccuuccucgaccgcgagcagcacuccauguacaaccucgucguccgcggcuccgaccgcgacggcgccgccgacggccucuccuccgagugcgacugccgcaucaagguccucgacgucaacgacaacuuccccacccucgagaagaccuccuacuccgccuccaucgaggagaacugccucuccuccgagcucauccgccuccaggccaucgaccucgacgaggagggcaccgacaacuggcucgcccaguaccucauccucuccggcaacgacggcaacugguucgacauccagaccgacccccagaccaacgagggcauccucaaggucgucaagaugcucgacuacgagcaggcccccaacauccagcucuccaucggcgucaagaaccaggccgacuuccacuacuccgucgccucccaguuccagaugcaccccacccccguccgcauccaggucgucgacguccgcgagggccccgccuuccaccccuccaccauggccuucuccguccgcgagggcaucaagggcuccucccuccucaacuacguccucggcaccuacaccgccaucgaccucgacaccggcaaccccgccaccgacguccgcuacaucaucggccacgacgccggcuccuggcucaagaucgacucccgcaccggcgagauccaguucucccgcgaguucgacaagaaguccaaguacaucaucaacggcaucuacaccgccgagauccucgccaucgacgacggcuccggcaagaccgccaccggcaccaucugcaucgagguccccgacaucaacgacuacugccccaacaucuuccccgagcgccgcaccaucugcaucgacucccccuccguccucaucuccgucaacgagcacuccuacggcucccccuucaccuucugcgucgucgacgagccccccggcaucgccgacaugugggacguccgcuccaccaacgccaccuccgccauccucaccgccaagcagguccucucccccggcuucuacgagauccccauccucgucaaggacuccuacaaccgcgccugcgagcucgcccagaugguccagcucuacgccugcgacugcgacgacaaccacaugugccucgacuccggcgccgccggcaucuacaccgaggacaucaccggcgacaccuacggccccgucaccgaggaccaggccggcgucuccaacgucggccucggccccgccggcaucggcaugaugguccucggcauccuccuccucauccucgccccccuccuccuccuccucugcugcugcaagcagcgccagcccgagggccucggcacccgcuucgcccccguccccgagggcggcgagggcgucaugcaguccuggcgcaucgagggcgcccaccccgaggaccgccucuucuccgccuacgcccuccccggcggcggcggcaccgccgacggcggcggcuccguccucggccgcugcgcccuccaggccacccccgcccuccucaaccagcacccccccuucuccgagaucuacaccaacaccuacgccgccggcggcaccgucgagggcggcgucuccggcgucgagcucaacaccggcaugggcaccgccgucggccucauggccgccggcgccgccggcgccuccggcgccgcccgcaagcgcuccuccaccaugggcacccuccgcgacuacgccgacgccgacaucaacauggccuuccucgacuccuacuucuccgagaaggccuacgccuacgccgacgaggacgagggccgccccgccaacgacugccuccucaucuacgaccacgagggcgucggcucccccgucggcuccaucggcugcugcuccuggaucgucgacgaccucgacgaguccugcauggagacccucgaccccaaguuccgcacccucgccgagaucugccucaacaccgagaucgagcccuuccccucccaccaggccugcauccccaucuccaccgaccucccccuccucggccccaacuacuucgucaacgaguccuccggccucacccccuccgaggucgaguuccaggaggagauggccgccuccgagcccgucguccacggcgacaucaucgucaccgagaccuacggcaacgccgaccccugcguccagcccaccaccaucaucuucgacccccagcucgcccccaacgucgucgucaccgaggccgucauggcccccgucuacgacauccagggcaacaucugcguccccgccgagcucgccgacuacaacaacgucaucuacgccgagcgcguccucgccucccccggcguccccgacauguccaacuccuccaccaccgagggcugcaugggccccgucauguccggcaacauccucgucggccccgagauccaggucaugcagaugaugucccccgaccuccccaucggccagaccgucggcuccaccucccccaugaccucccgccaccgcgucacccgcuacuccaacauccacuacacccagcaguga

SEQ ID NO: 42453 - RNA, 6819 nt, Artificial Sequence
  derived and/or modified sequence opt2 from DSP__Homo_sapiens__NP_001008844
auguccugcaacggcggcucccacccccgcaucaacacccucggccgcaugauccgcgccgaguccggccccgaccuccgcuacgaggucaccuccggcggcggcggcaccucccgcauguacuacucccgccgcggcgucaucaccgaccagaacuccgacggcuacugccagaccggcaccaugucccgccaccagaaccagaacaccauccaggagcuccuccagaacugcuccgacugccucaugcgcgccgagcucaucguccagcccgagcucaaguacggcgacggcauccagcucacccgcucccgcgagcucgacgagugcuucgcccaggccaacgaccagauggagauccucgacucccucauccgcgagaugcgccagaugggccagcccugcgacgccuaccagaagcgccuccuccagcuccaggagcagaugcgcgcccucuacaaggccaucuccgucccccgcguccgccgcgccuccuccaagggcggcggcggcuacaccugccaguccggcuccggcugggacgaguucaccaagcacgucaccuccgagugccucggcuggaugcgccagcagcgcgccgagauggacauggucgccuggggcgucgaccucgccuccgucgagcagcacaucaacucccaccgcggcauccacaacuccaucggcgacuaccgcuggcagcucgacaagaucaaggccgaccuccgcgagaaguccgccaucuaccagcucgaggaggaguacgagaaccuccucaaggccuccuucgagcgcauggaccaccuccgccagcuccagaacaucauccaggccaccucccgcgagaucauguggaucaacgacugcgaggaggaggagcuccucuacgacugguccgacaagaacaccaacaucgcccagaagcaggaggccuucuccauccgcaugucccagcucgaggucaaggagaaggagcucaacaagcucaagcaggaguccgaccagcucguccucaaccagcaccccgccuccgacaagaucgaggccuacauggacacccuccagacccagugguccuggauccuccagaucaccaagugcaucgacguccaccucaaggagaacgccgccuacuuccaguucuucgaggaggcccaguccaccgaggccuaccucaagggccuccaggacuccauccgcaagaaguaccccugcgacaagaacaugccccuccagcaccuccucgagcagaucaaggagcucgagaaggagcgcgagaagauccucgaguacaagcgccagguccagaaccucgucaacaaguccaagaagaucguccagcucaagccccgcaaccccgacuaccgcuccaacaagcccaucauccuccgcgcccucugcgacuacaagcaggaccagaagaucguccacaagggcgacgagugcauccucaaggacaacaacgagcgcuccaagugguacgucaccggccccggcggcgucgacaugcucguccccuccgucggccucaucauccccccccccaacccccucgccgucgaccucuccugcaagaucgagcaguacuacgaggccauccucgcccucuggaaccagcucuacaucaacaugaagucccucgucuccuggcacuacugcaugaucgacaucgagaagauccgcgccaugaccaucgccaagcucaagaccaugcgccaggaggacuacaugaagaccaucgccgaccucgagcuccacuaccaggaguucauccgcaacucccagggcuccgagauguucggcgacgacgacaagcgcaagauccagucccaguucaccgacgcccagaagcacuaccagacccucgucauccagcuccccggcuacccccagcaccagaccgucaccaccaccgagaucacccaccacggcaccugccaggacgucaaccacaacaaggucaucgagaccaaccgcgagaacgacaagcaggagaccuggaugcucauggagcuccagaagauccgccgccagaucgagcacugcgagggccgcaugacccucaagaaccucccccucgccgaccagggcuccucccaccacaucaccgucaagaucaacgagcucaaguccguccagaacgacucccaggccaucgccgagguccucaaccagcucaaggacaugcucgccaacuuccgcggcuccgagaaguacugcuaccuccagaacgaggucuucggccucuuccagaagcucgagaacaucaacggcgucaccgacggcuaccucaacucccucugcaccguccgcgcccuccuccaggccauccuccagaccgaggacaugcucaaggucuacgaggcccgccucaccgaggaggagaccgucugccucgaccucgacaaggucgaggccuaccgcugcggccucaagaagaucaagaacgaccucaaccucaagaagucccuccucgccaccaugaagaccgagcuccagaaggcccagcagauccacucccagaccucccagcaguacccccucuacgaccucgaccucggcaaguucggcgagaaggucacccagcucaccgaccgcuggcagcgcaucgacaagcagaucgacuuccgccucugggaccucgagaagcagaucaagcagcuccgcaacuaccgcgacaacuaccaggccuucugcaaguggcucuacgacgccaagcgccgccaggacucccucgaguccaugaaguucggcgacuccaacaccgucaugcgcuuccucaacgagcagaagaaccuccacuccgagaucuccggcaagcgcgacaaguccgaggagguccagaagaucgccgagcucugcgccaacuccaucaaggacuacgagcuccagcucgccuccuacaccuccggccucgagacccuccucaacauccccaucaagcgcaccaugauccagucccccuccggcgucauccuccaggaggccgccgacguccacgcccgcuacaucgagcuccucacccgcuccggcgacuacuaccgcuuccucuccgagaugcucaagucccucgaggaccucaagcucaagaacaccaagaucgagguccucgaggaggagcuccgccucgcccgcgacgccaacuccgagaacugcaacaagaacaaguuccucgaccagaaccuccagaaguaccaggccgagugcucccaguucaaggccaagcucgccucccucgaggagcucaagcgccaggccgagcucgacggcaaguccgccaagcagaaccucgacaagugcuacggccagaucaaggagcucaacgagaagaucacccgccucaccuacgagaucgaggacgagaagcgccgccgcaaguccgucgaggaccgcuucgaccagcagaagaacgacuacgaccagcuccagaaggcccgccagugcgagaaggagaaccucggcuggcagaagcucgaguccgagaaggccaucaaggagaaggaguacgagaucgagcgccuccgcguccuccuccaggaggagggcacccgcaagcgcgaguacgagaacgagcucgccaaggccuccaaccgcauccaggaguccaagaaccagugcacccaggucguccaggagcgcgagucccuccucgucaagaucaagguccucgagcaggacaaggcccgccuccagcgccucgaggacgagcucaaccgcgccaaguccacccucgaggccgagacccgcgucaagcagcgccucgagugcgagaagcagcagauccagaacgaccucaaccaguggaagacccaguacucccgcaaggaggaggccauccgcaagaucgaguccgagcgcgagaaguccgagcgcgagaagaacucccuccgcuccgagaucgagcgccuccaggccgagaucaagcgcaucgaggagcgcugccgccgcaagcucgaggacuccacccgcgagacccagucccagcucgagaccgagcgcucccgcuaccagcgcgagaucgacaagcuccgccagcgccccuacggcucccaccgcgagacccagaccgagugcgaguggaccgucgacaccuccaagcucgucuucgacggccuccgcaagaaggucaccgccaugcagcucuacgagugccagcucaucgacaagaccacccucgacaagcuccucaagggcaagaaguccgucgaggaggucgccuccgagauccagcccuuccuccgcggcgccggcuccaucgccggcgccuccgccucccccaaggagaaguacucccucgucgaggccaagcgcaagaagcucaucucccccgaguccaccgucaugcuccucgaggcccaggccgccaccggcggcaucaucgacccccaccgcaacgagaagcucaccgucgacuccgccaucgcccgcgaccucaucgacuucgacgaccgccagcagaucuacgccgccgagaaggccaucaccggcuucgacgaccccuucuccggcaagaccgucuccgucuccgaggccaucaagaagaaccucaucgaccgcgagaccggcaugcgccuccucgaggcccagaucgccuccggcggcgucgucgaccccgucaacuccgucuuccuccccaaggacgucgcccucgcccgcggccucaucgaccgcgaccucuaccgcucccucaacgacccccgcgacucccagaagaacuucgucgaccccgucaccaagaagaaggucuccuacguccagcucaaggagcgcugccgcaucgagccccacaccggccuccuccuccucuccguccagaagcgcuccauguccuuccagggcauccgccagcccgucaccgucaccgagcucgucgacuccggcauccuccgccccuccaccgucaacgagcucgaguccggccagaucuccuacgacgaggucggcgagcgcaucaaggacuuccuccagggcuccuccugcaucgccggcaucuacaacgagaccaccaagcagaagcucggcaucuacgaggccaugaagaucggccucguccgccccggcaccgcccucgagcuccucgaggcccaggccgccaccggcuucaucgucgaccccgucuccaaccuccgccuccccgucgaggaggccuacaagcgcggccucgucggcaucgaguucaaggagaagcuccucuccgccgagcgcgccgucaccggcuacaacgaccccgagaccggcaacaucaucucccucuuccaggccaugaacaaggagcucaucgagaagggccacggcauccgccuccucgaggcccagaucgccaccggcggcaucaucgaccccaaggagucccaccgccuccccgucgacaucgccuacaagcgcggcuacuucaacgaggagcucuccgagauccucuccgaccccuccgacgacaccaagggcuucuucgaccccaacaccgaggagaaccucaccuaccuccagcucaaggagcgcugcaucaaggacgaggagaccggccucugccuccucccccucaaggagaagaagaagcagguccagaccucccagaagaacacccuccgcaagcgccgcgucgucaucgucgaccccgagaccaacaaggagauguccguccaggaggccuacaagaagggccucaucgacuacgagaccuucaaggagcucugcgagcaggagugcgagugggaggagaucaccaucaccggcuccgacggcuccacccgcgucguccucgucgaccgcaagaccggcucccaguacgacauccaggacgccaucgacaagggccucgucgaccgcaaguucuucgaccaguaccgcuccggcucccucucccucacccaguucgccgacaugaucucccucaagaacggcgucggcaccuccuccuccaugggcuccggcgucuccgacgacgucuucuccuccucccgccacgaguccgucuccaagaucuccaccaucuccuccguccgcaaccucaccauccgcuccuccuccuucuccgacacccucgaggaguccucccccaucgccgccaucuucgacaccgagaaccucgagaagaucuccaucaccgagggcaucgagcgcggcaucgucgacuccaucaccggccagcgccuccucgaggcccaggccugcaccggcggcaucauccaccccaccaccggccagaagcucucccuccaggacgccgucucccagggcgucaucgaccaggacauggccacccgccucaagcccgcccagaaggccuucaucggcuucgagggcgucaagggcaagaagaagauguccgccgccgaggccgucaaggagaaguggcuccccuacgaggccggccagcgcuuccucgaguuccaguaccucaccggcggccucgucgaccccgagguccacggccgcaucuccaccgaggaggccauccgcaagggcuucaucgacggccgcgccgcccagcgccuccaggacaccuccuccuacgccaagauccucaccugccccaagaccaagcucaagaucuccuacaaggacgccaucaaccgcuccauggucgaggacaucaccggccuccgccuccucgaggccgccuccgucuccuccaagggccuccccucccccuacaacauguccuccgcccccggcucccgcuccggcucccgcuccggcucccgcuccggcucccgcuccggcucccgcuccggcucccgccgcggcuccuucgacgccaccggcaacuccuccuacuccuacuccuacuccuucuccuccuccuccaucggccacuga

SEQ ID NO: 42454 - RNA, 3906 nt, Artificial Sequence
  derived and/or modified sequence opt2 from DSPP__Homo_sapiens__NP_055023
augaagaucaucaccuacuucugcaucugggccgucgccugggccauccccgucccccaguccaagccccucgagcgccacgucgagaaguccaugaaccuccaccuccucgcccgcuccaacgucuccguccaggacgagcucaacgccuccggcaccaucaaggaguccggcguccucguccacgagggcgaccgcggccgccaggagaacacccaggacggccacaagggcgagggcaacggcuccaagugggccgaggucggcggcaaguccuucuccaccuacuccacccucgccaacgaggagggcaacaucgagggcuggaacggcgacaccggcaaggccgagaccuacggccacgacggcauccacggcaaggaggagaacaucaccgccaacggcauccagggccaggucuccaucaucgacaacgccggcgccaccaaccgcuccaacaccaacggcaacaccgacaagaacacccagaacggcgacgucggcgacgccggccacaacgaggacgucgccgucguccaggaggacggcccccaggucgccggcuccaacaacuccaccgacaacgaggacgagaucaucgagaacuccugccgcaacgagggcaacaccuccgagaucaccccccagaucaacuccaagcgcaacggcaccaaggaggccgaggucacccccggcaccggcgaggacgccggccucgacaacuccgacggcucccccuccggcaacggcgccgacgaggacgaggacgagggcuccggcgacgacgaggacgaggaggccggcaacggcaaggacuccuccaacaacuccaagggccaggagggccaggaccacggcaaggaggacgaccacgacuccuccaucggccagaacuccgacuccaaggaguacuacgaccccgagggcaaggaggacccccacaacgaggucgacggcgacaagaccuccaaguccgaggagaacuccgccggcauccccgaggacaacggcucccagcgcaucgaggacacccagaagcucaaccaccgcgaguccaagcgcgucgagaaccgcaucaccaaggaguccgagacccacgccgucggcaagucccaggacaagggcaucgagaucaagggccccuccuccggcaaccgcaacaucaccaaggaggucggcaagggcaacgagggcaaggaggacaagggccagcacggcaugauccucggcaagggcaacgucaagacccagggcgaggucgucaacaucgagggccccggccagaaguccgagcccggcaacaaggucggccacuccaacaccggcuccgacuccaacuccgacggcuacgacuccuacgacuucgacgacaaguccaugcagggcgacgaccccaacuccuccgacgaguccaacggcaacgacgacgccaacuccgaguccgacaacaacuccuccucccgcggcgacgccuccuacaacuccgacgaguccaaggacaacggcaacggcuccgacuccaagggcgccgaggacgacgacuccgacuccaccuccgacaccaacaacuccgacuccaacggcaacggcaacaacggcaacgacgacaacgacaaguccgacuccggcaagggcaaguccgacuccuccgacuccgacuccuccgacuccuccaacuccuccgacuccuccgacuccuccgacuccgacuccuccgacuccaacuccuccuccgacuccgacuccuccgacuccgacuccuccgacuccuccgacuccgacuccuccgacuccuccaacuccuccgacuccuccgacuccuccgacuccuccgacuccuccgacuccuccgacuccuccgacuccaaguccgacuccuccaaguccgaguccgacuccuccgacuccgacuccaaguccgacuccuccgacuccaacuccuccgacuccuccgacaacuccgacuccuccgacuccuccaacuccuccaacuccuccgacuccuccgacuccuccgacuccuccgacuccuccuccuccuccgacuccuccaacuccuccgacuccuccgacuccuccgacuccuccaacuccuccgaguccuccgacuccuccgacuccuccgacuccgacuccuccgacuccuccgacuccuccaacuccaacuccuccgacuccgacuccuccaacuccuccgacuccuccgacuccuccaacuccuccgacuccuccgacuccuccgacuccuccaacuccuccgacuccuccgacuccuccgacuccuccaacuccuccgacuccuccgacuccuccgacuccuccgacuccuccgacuccuccaacuccuccgacuccaacgacuccuccaacuccuccgacuccuccgacuccuccaacuccuccgacuccuccaacuccuccgacuccuccgacuccuccgacuccuccgacuccgacuccuccaacuccuccgacuccuccaacuccuccgacuccuccgacuccuccaacuccuccgacuccuccgacuccuccgacuccuccgacggcuccgacuccgacuccuccaaccgcuccgacuccuccaacuccuccgacuccuccgacuccuccgacuccuccaacuccuccgacuccuccgacuccuccgacuccaacgaguccuccaacuccuccgacuccuccgacuccuccaacuccuccgacuccgacuccuccgacuccuccaacuccuccgacuccuccgacuccuccaacuccuccgacuccuccgaguccuccaacuccuccgacaacuccaacuccuccgacuccuccaacuccuccgacuccuccgacuccuccgacuccuccaacuccuccgacuccuccaacuccuccgacuccuccaacuccuccgacuccuccgacuccaacuccuccgacuccuccgacuccuccaacuccuccgacuccuccgacuccuccgacuccuccgacuccuccgacuccuccgacuccuccaacuccuccgacuccuccgacuccuccgacuccuccgacuccuccaacuccuccgacuccuccaacuccuccgacuccuccaacuccuccgacuccuccgacuccuccgacuccuccgacuccuccgacuccuccgacuccuccgacuccuccgacuccuccaacuccuccgacuccuccgacuccuccgacuccuccgacuccuccgacuccuccgacuccuccgacuccuccgacuccuccgaguccuccgacuccuccgacuccuccaacuccuccgacuccuccgacuccuccgacuccuccgacuccuccgacuccuccgacuccuccgacuccuccgacuccuccgacuccuccaacuccuccgacuccuccgacuccuccgacuccuccgacuccuccgacuccuccaacuccuccgacuccuccgacuccuccgaguccuccgacuccuccgacuccuccgacuccuccgacuccuccgacuccuccgacuccuccgacuccuccgacuccuccgacuccuccaacuccuccgacuccuccgacuccuccgacuccuccgacuccuccgacuccuccgacuccuccgacuccuccgacuccuccgacuccuccgacuccuccgacuccuccgacuccuccgacuccuccgacuccuccgacuccuccgacuccuccgacuccaacgaguccuccgacuccuccgacuccuccgacuccuccgacuccuccaacuccuccgacuccuccgacuccuccgacuccuccgacuccaccuccgacuccaacgacgaguccgacucccaguccaaguccggcaacggcaacaacaacggcuccgacuccgacuccgacuccgagggcuccgacuccaaccacuccaccuccgacgacuga

SEQ ID NO: 42455 - RNA, 7950 nt, Artificial Sequence
  derived and/or modified sequence opt2 from DST__Homo_sapiens__NP_001714
augcacuccuccuccuacuccuaccgcuccuccgacuccgucuucuccaacaccaccuccacccgcaccucccucgacuccaacgagaaccuccuccucguccacugcggccccacccucaucaacuccugcaucuccuucggcuccgaguccuucgacggccaccgccucgagaugcuccagcagaucgccaaccgcguccagcgcgacuccgucaucugcgaggacaagcucauccucgccggcaacgcccuccaguccgacuccaagcgccucgaguccggcguccaguuccagaacgaggccgagaucgccggcuacauccucgagugcgagaaccuccuccgccagcacgucaucgacguccagauccucaucgacggcaaguacuaccaggccgaccagcucguccagcgcgucgccaagcuccgcgacgagaucauggcccuccgcaacgagugcuccuccgucuacuccaagggccgcauccucaccaccgagcagaccaagcucaugaucuccggcaucacccagucccucaacuccggcuucgcccagacccuccaccccucccucaccuccggccucacccagucccucacccccucccucaccuccuccuccaugaccuccggccucuccuccggcaugaccucccgccucacccccuccgucacccccgccuacacccccggcuuccccuccggccucguccccaacuucuccuccggcgucgagcccaacucccuccagacccucaagcucaugcagauccgcaagccccuccucaaguccucccuccucgaccagaaccucaccgaggaggagaucaacaugaaguucguccaggaccuccucaacugggucgacgagaugcagguccagcucgaccgcaccgaguggggcuccgaccuccccuccgucgagucccaccucgagaaccacaagaacguccaccgcgccaucgaggaguucgaguccucccucaaggaggccaagaucuccgagauccagaugaccgccccccucaagcucaccuacgccgagaagcuccaccgccucgagucccaguacgccaagcuccucaacaccucccgcaaccaggagcgccaccucgacacccuccacaacuucgucucccgcgccaccaacgagcucaucuggcucaacgagaaggaggaggaggaggucgccuacgacugguccgagcgcaacaccaacaucgcccgcaagaaggacuaccacgccgagcucaugcgcgagcucgaccagaaggaggagaacaucaaguccguccaggagaucgccgagcagcuccuccucgagaaccaccccgcccgccucaccaucgaggccuaccgcgccgccaugcagacccagugguccuggauccuccagcucugccagugcgucgagcagcacaucaaggagaacaccgccuacuucgaguucuucaacgacgccaaggaggccaccgacuaccuccgcaaccucaaggacgccauccagcgcaaguacuccugcgaccgcuccuccuccauccacaagcucgaggaccucguccaggaguccauggaggagaaggaggagcuccuccaguacaaguccaccaucgccaaccucaugggcaaggccaagaccaucauccagcucaagccccgcaacuccgacugcccccucaagaccuccauccccaucaaggccaucugcgacuaccgccagaucgagaucaccaucuacaaggacgacgagugcguccucgccaacaacucccaccgcgccaaguggaaggucaucucccccaccggcaacgaggccaugguccccuccgucugcuucaccguccccccccccaacaaggaggccgucgaccucgccaaccgcaucgagcagcaguaccagaacguccucacccucuggcacgagucccacaucaacaugaaguccgucgucuccuggcacuaccucaucaacgagaucgaccgcauccgcgccuccaacgucgccuccaucaagaccaugcuccccggcgagcaccagcagguccucuccaaccuccagucccgcuucgaggacuuccucgaggacucccaggagucccaggucuucuccggcuccgacaucacccagcucgagaaggaggucaacgucugcaagcaguacuaccaggagcuccucaaguccgccgagcgcgaggagcaggaggaguccgucuacaaccucuacaucuccgagguccgcaacauccgccuccgccucgagaacugcgaggaccgccucauccgccagauccgcaccccccucgagcgcgacgaccuccacgaguccgucuuccgcaucaccgagcaggagaagcucaagaaggagcucgagcgccucaaggacgaccucggcaccaucaccaacaagugcgaggaguucuucucccaggccgccgccuccuccuccguccccacccuccgcuccgagcucaacgucguccuccagaacaugaaccaggucuacuccauguccuccaccuacaucgacaagcucaagaccgucaaccucguccucaagaacacccaggccgccgaggcccucgucaagcucuacgagaccaagcucugcgaggaggaggccgucaucgccgacaagaacaacaucgagaaccucaucuccacccucaagcaguggcgcuccgaggucgacgagaagcgccaggucuuccacgcccucgaggacgagcuccagaaggccaaggccaucuccgacgagauguucaagaccuacaaggagcgcgaccucgacuucgacuggcacaaggagaaggccgaccagcucgucgagcgcuggcagaacguccacguccagaucgacaaccgccuccgcgaccucgagggcaucggcaagucccucaaguacuaccgcgacaccuaccacccccucgacgacuggauccagcaggucgagaccacccagcgcaagauccaggagaaccagcccgagaacuccaagacccucgccacccagcucaaccagcagaagaugcucgucuccgagaucgagaugaagcaguccaagauggacgagugccagaaguacgccgagcaguacuccgccaccgucaaggacuacgagcuccagaccaugaccuaccgcgccauggucgacucccagcagaagucccccgucaagcgccgccgcaugcaguccuccgccgaccucaucauccaggaguucauggaccuccgcacccgcuacaccgcccucgucacccucaugacccaguacaucaaguucgccggcgacucccucaagcgccucgaggaggaggagaucaagcgcugcaaggagaccuccgagcacggcgccuacuccgaccuccuccagcgccagaaggccaccguccucgagaacuccaagcucaccggcaagaucuccgagcucgagcgcauggucgccgagcucaagaagcagaagucccgcgucgaggaggagcuccccaagguccgcgaggccgccgagaacgagcuccgcaagcagcagcgcaacgucgaggacaucucccuccagaagauccgcgccgaguccgaggccaagcaguaccgccgcgagcucgagaccaucguccgcgagaaggaggccgccgagcgcgagcucgagcgcguccgccagcucaccaucgaggccgaggccaagcgcgccgccgucgaggagaaccuccucaacuuccgcaaccagcucgaggagaacaccuucacccgccgcacccucgaggaccaccucaagcgcaaggaccucucccucaacgaccucgagcagcagaagaacaagcucauggaggagcuccgccgcaagcgcgacaacgaggaggagcuccucaagcucaucaagcagauggagaaggaccucgccuuccagaagcaggucgccgagaagcagcucaaggagaagcagaagaucgagcucgaggcccgccgcaagaucaccgagauccaguacaccugccgcgagaacgcccuccccgucugccccaucacccaggccaccuccugccgcgccgucaccggccuccagcaggagcacgacaagcagaaggccgaggagcucaagcagcaggucgacgagcucaccgccgccaaccgcaaggccgagcaggacaugcgcgagcucaccuacgagcucaacgcccuccagcucgagaagaccuccuccgaggagaaggcccgccuccucaaggacaagcucgacgagaccaacaacacccuccgcugccucaagcucgagcucgagcgcaaggaccaggccgagaagggcuacucccagcagcuccgcgagcucggccgccagcucaaccagaccaccggcaaggccgaggaggccaugcaggaggccuccgaccucaagaagaucaagcgcaacuaccagcucgagcucgagucccucaaccacgagaagggcaagcuccagcgcgaggucgaccgcaucacccgcgcccacgccgucgccgagaagaacauccagcaccucaacucccagauccacuccuuccgcgacgagaaggagcucgagcgccuccagaucugccagcgcaaguccgaccaccucaaggagcaguucgagaagucccacgagcagcuccuccagaacaucaaggccgagaaggagaacaacgacaagauccagcgccucaacgaggagcucgagaaguccaacgagugcgccgagaugcucaagcagaaggucgaggagcucacccgccagaacaacgagaccaagcucaugaugcagcgcauccaggccgaguccgagaacaucguccucgagaagcagaccauccagcagcgcugcgaggcccucaagauccaggccgacggcuucaaggaccagcuccgcuccaccaacgagcaccuccacaagcagaccaagaccgagcaggacuuccagcgcaagaucaagugccucgaggaggaccucgccaagucccagaaccucgucuccgaguucaagcagaagugcgaccagcagaacaucaucauccagaacaccaagaaggagguccgcaaccucaacgccgagcucaacgccuccaaggaggagaagcgccgcggcgagcagaagguccagcuccagcaggcccagguccaggagcucaacaaccgccucaagaagguccaggacgagcuccaccucaagaccaucgaggagcagaugacccaccgcaagaugguccucuuccaggaggaguccggcaaguucaagcaguccgccgaggaguuccgcaagaagauggagaagcucauggaguccaaggucaucaccgagaacgacaucuccggcauccgccucgacuucgucucccuccagcaggagaacucccgcgcccaggagaacgccaagcucugcgagaccaacaucaaggagcucgagcgccagcuccagcaguaccgcgagcagaugcagcagggccagcacauggaggccaaccacuaccagaagugccagaagcucgaggacgagcucaucgcccagaagcgcgaggucgagaaccucaagcagaagauggaccagcagaucaaggagcacgagcaccagcucguccuccuccagugcgagauccagaagaaguccaccgccaaggacugcaccuucaagcccgacuucgagaugaccgucaaggagugccagcacuccggcgagcucuccucccgcaacaccggccaccuccaccccaccccccgcuccccccuccuccgcuggacccaggagccccagccccucgaggagaaguggcagcaccgcgucgucgagcagauccccaaggagguccaguuccagccccccggcgccccccucgagaaggagaagucccagcagugcuacuccgaguacuucucccagaccuccaccgagcuccagaucaccuucgacgagaccaaccccaucacccgccucuccgagaucgagaagauccgcgaccaggcccucaacaacucccgcccccccguccgcuaccaggacaacgccugcgagauggagcucgucaagguccucaccccccucgagaucgccaagaacaagcaguacgacaugcacaccgaggucaccacccucaagcaggagaagaaccccguccccuccgccgaggaguggaugcucgagggcugccgcgccuccggcggccucaagaagggcgacuuccucaagaagggccucgagcccgagaccuuccagaacuucgacggcgaccacgccugcuccguccgcgacgacgaguucaaguuccagggccuccgccacaccgucaccgcccgccagcucgucgaggccaagcuccucgacaugcgcaccaucgagcagcuccgccucggccucaagaccgucgaggagguccagaagacccucaacaaguuccucaccaaggccaccuccaucgccggccucuaccucgaguccaccaaggagaagaucuccuucgccuccgccgccgagcgcaucaucaucgacaagauggucgcccucgccuuccucgaggcccaggccgccaccggcuucaucaucgaccccaucuccggccagaccuacuccgucgaggacgccguccucaagggcgucgucgaccccgaguuccgcauccgccuccucgaggccgagaaggccgccgucggcuacuccuacuccuccaagacccucuccgucuuccaggccauggagaaccgcaugcucgaccgccagaagggcaagcacauccucgaggcccagaucgccuccggcggcgucaucgaccccguccgcggcauccgcgucccccccgagaucgcccuccagcagggccuccucaacaacgccauccuccaguuccuccacgagcccuccuccaacacccgcgucuuccccaaccccaacaacaagcaggcccucuacuacuccgagcuccuccgcaugugcgucuucgacgucgagucccagugcuuccucuuccccuucggcgagcgcaacaucuccaaccucaacgucaagaagacccaccgcaucuccgucgucgacaccaagaccggcuccgagcucaccgucuacgaggccuuccagcgcaaccucaucgagaaguccaucuaccucgagcucuccggccagcaguaccaguggaaggaggccauguucuucgaguccuacggccacuccucccacaugcucaccgacaccaagaccggccuccacuucaacaucaacgaggccaucgagcagggcaccaucgacaaggcccucgucaagaaguaccaggagggccucaucacccucaccgagcucgccgacucccuccucucccgccucguccccaagaaggaccuccacucccccgucgccggcuacuggcucaccgccuccggcgagcgcaucuccguccucaaggccucccgccgcaaccucgucgaccgcaucaccgcccuccgcugccucgaggcccaggucuccaccggcggcaucaucgacccccucaccggcaagaaguaccgcgucgccgaggcccuccaccgcggccucgucgacgagggcuucgcccagcagcuccgccagugcgagcucgucaucaccggcaucggccaccccaucaccaacaagaugauguccgucgucgaggccgucaacgccaacaucaucaacaaggagaugggcauccgcugccucgaguuccaguaccucaccggcggccucaucgagccccagguccacucccgccucuccaucgaggaggcccuccaggucggcaucaucgacguccucaucgccaccaagcucaaggaccagaaguccuacguccgcaacaucaucugcccccagaccaagcgcaagcucaccuacaaggaggcccucgagaaggccgacuucgacuuccacaccggccucaagcuccucgaggucuccgagccccucaugaccggcaucuccucccucuacuacuccuccuga

SEQ ID NO: 42456 - RNA, 498 nt, Artificial Sequence
  derived and/or modified sequence opt2 from DSTN__Homo_sapiens__XP_011527445
auggccuccggcguccaggucgccgacgaggucugccgcaucuucuacgacaugaagguccgcaagugcuccacccccgaggagaucaagaagcgcaagaaggccgucaucuucugccucuccgccgacaagaagugcaucaucgucgaggagggcaaggagauccucgucggcgacgucggcgucaccaucaccgaccccuucaagcacuucgucggcaugcuccccgagaaggacugccgcuacgcccucuacgacgccuccuucgagaccaaggagucccgcaaggaggagcucauguucuuccucugggcccccgagcucgccccccucaaguccaagaugaucuacgccuccuccaaggacgccaucaagaagaaguuccagggcaucaagcacgagugccaggccaacggccccgaggaccucaaccgcgccugcaucgccgagaagcucggcggcucccucaucgucgccuucgagggcugccccgucuga

SEQ ID NO: 42457 - RNA, 2790 nt, Artificial Sequence
  derived and/or modified sequence opt2 from DSTYK__Homo_sapiens__NP_056190
auggagggcgacggcguccccuggggcuccgagcccgucuccggccccggccccggcggcggcggcaugauccgcgagcucugccgcggcuucggccgcuaccgccgcuaccucggccgccuccgccagaaccuccgcgagacccagaaguucuuccgcgacaucaagugcucccacaaccacaccugccucuccucccucaccggcggcggcggcgccgagcgcggccccgccggcgacgucgccgagaccggccuccaggccggccagcucuccugcaucuccuucccccccaaggaggagaaguaccuccagcagaucgucgacugccuccccugcauccucauccucggccaggacugcaacgucaagugccagcuccucaaccuccuccucggcguccagguccuccccaccaccaagcucggcuccgaggaguccugcaagcuccgccgccuccgcuucaccuacggcacccagacccgcgucucccucgcccuccccggccaguacgagcucguccacacccucgucgcccaccagggcaacugggagaccauccccgaggaggaccucgagguccaggagaacaacgaggacgccgcccacguccucgccgagcucgaggucaccaugcaccacgcccuccuccaggaggucgacgucgucgucgcccccugccagggccuccgccccaccgucgacguccucggcgaccucgucaacgacuuccuccccgucaucaccuacgcccuccacaaggacgagcucuccgagcgcgacgagcaggagcuccaggagauccgcaaguacuucuccuuccccgucuucuucuucaagguccccaagcucggcuccgagaucaucgacuccuccacccgccgcauggaguccgagcgcuccccccucuaccgccagcucaucgaccucggcuaccucuccuccucccacuggaacugcggcgcccccggccaggacaccaaggcccaguccaugcucgucgagcaguccgagaagcuccgccaccucuccaccuucucccaccagguccuccagacccgccucgucgacgccgccaaggcccucaaccucguccacugccacugccucgacaucuucaucaaccaggccuucgacaugcagcgcgaccuccagaucacccccaagcgccucgaguacacccgcaagaaggagaacgagcucuacgagucccucaugaacaucgccaaccgcaagcaggaggagaugaaggacaugaucgucgagacccucaacaccaugaaggaggagcuccucgacgacgccaccaacauggaguucaaggacgucaucguccccgagaacggcgagcccgucggcacccgcgagaucaagugcugcauccgccagauccaggagcucaucaucucccgccucaaccaggccgucgccaacaagcucaucuccuccgucgacuaccuccgcgaguccuucgucggcacccucgagcgcugccuccagucccucgagaagucccaggacgucuccguccacaucaccuccaacuaccucaagcagauccucaacgccgccuaccacgucgaggucaccuuccacuccggcuccuccgucacccgcaugcucugggagcagaucaagcagaucauccagcgcaucaccugggucuccccccccgccaucacccucgaguggaagcgcaaggucgcccaggaggccaucgagucccucuccgccuccaagcucgccaaguccaucugcucccaguuccgcacccgccucaacuccucccacgaggccuucgccgccucccuccgccagcucgaggccggccacuccggccgccucgagaagaccgaggaccucuggcuccgcguccgcaaggaccacgccccccgccucgcccgccucucccucgaguccugcucccuccaggacguccuccuccaccgcaagcccaagcucggccaggagcucggccgcggccaguacggcgucgucuaccucugcgacaacuggggcggccacuuccccugcgcccucaaguccgucgucccccccgacgagaagcacuggaacgaccucgcccucgaguuccacuacaugcgcucccuccccaagcacgagcgccucgucgaccuccacggcuccgucaucgacuacaacuacggcggcggcuccuccaucgccguccuccucaucauggagcgccuccaccgcgaccucuacaccggccucaaggccggccucacccucgagacccgccuccagaucgcccucgacgucgucgagggcauccgcuuccuccacucccagggccucguccaccgcgacaucaagcucaagaacguccuccucgacaagcagaaccgcgccaagaucaccgaccucggcuucugcaagcccgaggccaugauguccggcuccaucgucggcacccccauccacauggcccccgagcucuucaccggcaaguacgacaacuccgucgacgucuacgccuucggcauccucuucugguacaucugcuccggcuccgucaagcuccccgaggccuucgagcgcugcgccuccaaggaccaccucuggaacaacguccgccgcggcgcccgccccgagcgccuccccgucuucgacgaggagugcuggcagcucauggaggccugcugggacggcgacccccucaagcgcccccuccucggcaucguccagcccaugcuccagggcaucaugaaccgccucugcaaguccaacuccgagcagcccaaccgcggccucgacgacuccaccuga

SEQ ID NO: 42458 - RNA, 630 nt, Artificial Sequence
  derived and/or modified sequence opt2 from DTD1__Homo_sapiens__NP_543010
augaaggccgucguccagcgcgucacccgcgccuccgucaccgucggcggcgagcagaucuccgccaucggccgcggcaucugcguccuccucggcaucucccucgaggacacccagaaggagcucgagcacaugguccgcaagauccucaaccuccgcgucuucgaggacgaguccggcaagcacugguccaaguccgucauggacaagcaguacgagauccucugcgucucccaguucacccuccagugcguccucaagggcaacaagcccgacuuccaccucgccaugcccaccgagcaggccgagggcuucuacaacuccuuccucgagcagcuccgcaagaccuaccgccccgagcucaucaaggacggcaaguucggcgccuacaugcagguccacauccagaacgacggccccgucaccaucgagcucgagucccccgcccccggcaccgccaccuccgaccccaagcagcucuccaagcucgagaagcagcagcagcgcaaggagaagacccgcgccaagggccccuccgaguccuccaaggagcgcaacaccccccgcaaggaggaccgcuccgccuccuccggcgccgagggcgacgucuccuccgagcgcgagcccuga

SEQ ID NO: 42459 - RNA, 1851 nt, Artificial Sequence
  derived and/or modified sequence opt2 from DTHD1__Homo_sapiens__NP_001130008
augugccucgagaagcgcuaccucgacguccucuccgacgucaccggcccccaggucuccugcuacaucaccgcccccuccuacguccuccagcagcucgagugccgcaucaucaaccacauguccucccucaucgucggcgacaacgaggagcucgucuccaacgucaucaccaucgagugcuccgacaaggagaagcgcguccccuuccccaucggcaucgccauccccuucaccgcccgcuaccgcggcaacuaccgcgacaucauggucaaggucugcgacaucaaccuccaguccuccuaccucaaccccaacucccucgagggcaugaagggcggcuacaagggcaccugcgccuccgucaaggucuacaagcucggcaucuucuccgucgucuccugccucaagaaggaguccuucaccgucaccaagaagggccucgcccucaaguccuccauggacucccgcaucucccucaacuacccccccggcgucuucaccucccccguccucguccagcucaagauccagcccgucgaccccgcccucgucgcccaccucaaggcccagcaggacaccuucuacuccguccaguccaccuccccccucauccacauccagcaccccuccaccuaccccuuccagaagcccgucacccucuuccuccccugcucccccuaccucgacaagaacaaccucggcuccgagaucgaccacaagcgccgcgccuccgccaccaucaaccgcaucacccccuccuacuucaaccgcaccaagaucgccuccauccgcaagccccgcaagaacgccuccgagugccucaagcuccucggcuuccgcucccaggacuccggcuggugcggccucgacgacgucgucaagaccauccaguccggccucgucuccgucgagcucuacgagcaccucgagcgcuucaucguccuccaccucuccuccaccauggacaacucccaccucgucaccuucgucaagucccucgaggaggccaugcucuccaccaccgccugcaucguccucucccaccagaaggacaacccccaccgcaucgccguccucgucguccccuccaaggaccucucccagguccucaaggaccuccaccucgagggcuucggcggcccccccgagcccucccgccacuuccagguccgcgagggcgagcagcuccuccuccgcuucaccggcaacaucuucgccuccuccaacggcaaggacuacggcaaggacuacacccucaucuuccaccuccagcgcaagccccgccucgagcuccagaucaaggaggucgacgaguucggcaacuacuccugcccccacuacaagggcaccaucgucgucuacaagguccccaagggcaagaucguccccaaccucaaccagucccucgucaucaacgagaaccacucccagcuccccaucugcaagcucccccucaagcuccccaagcacaagaagcucaucaaccgcccccaguccaccaagcgcgucuccaaggaccccgucgaggcccucugggacaaccuccuccacuggcucgccgaggagcucuccgaggagaacgccgagucccucuccuccacccucccccuccgccgcuccaccauccagcucaucaagcucaagaaccccgacgaccucaccgagcagauccacgaguuccucugcuucuggaagaagucccuccccaccuucaccgacaagcuccgccuccucgcccgccaccuccgcaagaucggccgcuccgaccucgccgaggagcucaaguucaagugggagaacaaggucuucaccgagccccagcagugcuucgacgucgcccccgaguga

SEQ ID NO: 42460 - RNA, 1380 nt, Artificial Sequence
  derived and/or modified sequence opt2 from DTL__Homo_sapiens__NP_001273158
augggcuacuccucccucauccucgacuccaccggcuccacccucuucgccaacugcaccgacgacaacaucuacauguucaacaugaccggccucaagaccucccccgucgccaucuucaacggccaccagaacuccaccuucuacgucaaguccucccucucccccgacgaccaguuccucgucuccggcuccuccgacgaggccgccuacaucuggaaggucuccacccccuggcagccccccaccguccuccucggccacucccaggaggucaccuccgucugcuggugccccuccgacuucaccaagaucgccaccugcuccgacgacaacacccucaagaucuggcgccucaaccgcggccucgaggagaagcccggcggcgacaagcucuccaccgucggcugggccucccagaagaagaaggagucccgccccggccucgucaccgucaccuccucccaguccacccccgccaaggccccccgcgucaagugcaaccccuccaacuccucccccuccuccgccgccugcgcccccuccugcgccggcgaccucccccuccccuccaacacccccaccuucuccaucaagaccucccccgccaaggcccgcucccccaucaaccgccgcggcuccgucuccuccgucucccccaagccccccuccuccuucaagauguccauccgcaacugggucacccgcacccccuccuccuccccccccaucaccccccccgccuccgagaccaagaucauguccccccgcaaggcccucauccccgucucccagaaguccucccaggccgaggccugcuccgagucccgcaaccgcgucaagcgccgccucgacuccuccugccucgaguccgucaagcagaagugcgucaaguccugcaacugcgucaccgagcucgacggccaggucgagaaccuccaccucgaccucugcugccucgccggcaaccaggaggaccucuccaaggacucccucggccccaccaaguccuccaagaucgagggcgccggcaccuccaucuccgagccccccucccccaucucccccuacgccuccgaguccugcggcacccucccccucccccuccgccccugcggcgagggcuccgagauggucggcaaggagaacuccucccccgagaacaagaacuggcuccucgccauggccgccaagcgcaaggccgagaaccccuccccccgcucccccuccucccagacccccaacucccgccgccaguccggcaagacccuccccucccccgucaccaucacccccuccuccaugcgcaagaucugcaccuacuuccaccgcaagucccaggaggacuucugcggccccgagcacuccaccgagcucuga

SEQ ID NO: 42461 - RNA, 1116 nt, Artificial Sequence
  derived and/or modified sequence opt2 from DTNA__Homo_sapiens__NP_001121647
augaucgaggacuccggcaagcgcggcaacaccauggccgagcgccgccagcucuucgccgagaugcgcgcccaggaccucgaccgcauccgccucuccaccuaccgcaccgccugcaagcuccgcuucguccagaagaagugcaaccuccaccucgucgacaucuggaacgucaucgaggcccuccgcgagaacgcccucaacaaccucgaccccaacaccgagcucaacgucucccgccucgaggccguccucuccaccaucuucuaccagcucaacaagcgcaugcccaccacccaccagauccacgucgagcaguccaucucccuccuccucaacuuccuccucgccgccuucgaccccgagggccacggcaagaucuccgucuucgccgucaagauggcccucgccacccucugcggcggcaagaucauggacaagcuccgcuacaucuucuccaugaucuccgacuccuccggcgucauggucuacggccgcuacgaccaguuccuccgcgagguccucaagcuccccaccgccgucuucgagggccccuccuucggcuacaccgagcaguccgcccgcuccugcuucucccagcagaagaaggucacccucaacggcuuccucgacacccucauguccgacccccccccccagugccucgucuggcucccccuccuccaccgccucgccaacgucgagaacgucuuccaccccgucgagugcuccuacugccacuccgaguccaugaugggcuuccgcuaccgcugccagcagugccacaacuaccagcucugccaggacugcuucuggcgcggccacgccggcggcucccacuccaaccagcaccagaugaaggaguacaccuccuggaagucccccgccaagaagcucaccaacgcccucuccaagucccucuccugcgccuccucccgcgagccccuccaccccauguuccccgaccagcccgagaagccccucaaccucgcccacaucguccccccccgccccgucaccuccaugaacgacacccucuucucccacuccguccccuccuccggcucccccuucaucacccgcuccuccgacggcgccuucggcggcugcgucuga

SEQ ID NO: 42462 - RNA, 1863 nt, Artificial Sequence
  derived and/or modified sequence opt2 from DTNB__Homo_sapiens__NP_001243232
augaucgaggaguccggcaacaagcgcaagaccauggccgagaagcgccagcucuucaucgagaugcgcgcccagaacuucgacgucauccgccucuccaccuaccgcaccgccugcaagcuccgcuucguccagaagcgcugcaaccuccaccucgucgacaucuggaacaugaucgaggccuuccgcgacaacggccucaacacccucgaccacaccaccgagaucuccgucucccgccucgagaccgucaucuccuccaucuacuaccagcucaacaagcgccuccccuccacccaccagaucuccgucgagcaguccaucucccuccuccucaacuucaugaucgccgccuacgacuccgagggccgcggcaagcucaccgucuucuccgucaaggccaugcucgccaccaugugcggcggcaagaugcucgacaagcuccgcuacgucuucucccagauguccgacuccaacggccucaugaucuucuccaaguucgaccaguuccucaaggagguccucaagcuccccaccgccgucuucgagggccccuccuucggcuacaccgagcacuccguccgcaccugcuucccccagcagcgcaagaucaugcucaacauguuccucgacaccaugauggccgacccccccccccagugccucgucuggcucccccucaugcaccgccucgcccacgucgagaacgucuuccaccccgucgagugcuccuacugccgcugcgaguccaugaugggcuuccgcuaccgcugccagcagugccacaacuaccagcucugccagaacugcuucuggcgcggccacgccggcggcccccacuccaaccagcaccagaugaaggagcacuccuccuggaagucccccgccaagaagcucucccacgccaucuccaagucccucggcugcguccccacccgcgagcccccccaccccgucuuccccgagcagcccgagaagccccucgaccucgcccacaucguccccccccgcccccucaccaacaugaacgacaccauggucucccacauguccuccggcguccccacccccaccaagcgccuccaguacucccaggacauccccucccaccucgccgacgagcacgcccucaucgccuccuacgucgcccgccuccagcacugcgcccgcguccucgacucccccucccgccucgacgaggagcaccgccucaucgcccgcuacgccgcccgccucgccgccgaggccggcaacgucacccgcccccccaccgaccucuccuucaacuucgacgccaacaagcagcagcgccagcucaucgccgagcucgagaacaagaaccgcgagauccuccaggagauccagcgccuccgccucgagcacgagcaggccucccagcccacccccgagaaggcccagcagaaccccacccuccucgccgagcuccgccuccuccgccagcgcaaggacgagcucgagcagcgcauguccgcccuccaggagucccgccgcgagcucaugguccagcucgaggagcucaugaagcuccucaaggcccaggccaccggcuccccccacaccucccccacccacggcggcggccgccccaugcccaugcccguccgcuccaccuccgccggcuccacccccacccacugcccccaggacucccucuccggcgucggcggcgacguccaggaggccuucgcccagggcacccgccgcaaccuccgcaacgaccuccucgucgccgccgacuccaucaccaacaccauguccucccucgucaaggagcuccacuccgccgaggagggcgccgaggaggaggaggagaagaugcagaacggcaaggaccgcggcuga

SEQ ID NO: 42463 - RNA, 813 nt, Artificial Sequence
  derived and/or modified sequence opt2 from DTNBP1__Homo_sapiens__NP_001258596
augcucuccgcccacugggagaagaagaagaccucccucgucgagcuccaggagcagcuccagcagcuccccgcccucaucgccgaccucgaguccaugaccgccaaccucacccaccucgaggccuccuucgaggaggucgagaacaaccuccuccaccucgaggaccucugcggccagugcgagcucgagcgcugcaagcacaugcagucccagcagcucgagaacuacaagaagaacaagcgcaaggagcucgagaccuucaaggccgagcucgacgccgagcacgcccagaagguccucgagauggagcacacccagcagaugaagcucaaggagcgccagaaguucuucgaggaggccuuccagcaggacauggagcaguaccucuccaccggcuaccuccagaucgccgagcgccgcgagcccaucggcuccauguccuccauggaggucaacgucgacaugcucgagcagauggaccucauggacaucuccgaccaggaggcccucgacgucuuccucaacuccggcggcgaggagaacaccguccucucccccgcccucggccccgaguccuccaccugccagaacgagaucacccuccagguccccaaccccuccgagcuccgcgccaagccccccuccuccuccuccaccugcaccgacuccgccacccgcgacaucuccgagggcggcgagucccccgucguccaguccgacgaggaggagguccaggucgacaccgcccucgccaccucccacaccgaccgcgaggccacccccgacggcggcgaggacuccgacuccuga

SEQ ID NO: 42464 - RNA, 1863 nt, Artificial Sequence
  derived and/or modified sequence opt2 from DTX1__Homo_sapiens__XP_011536311
augucccgccccggccacggcggccucaugcccgucaacggccucggcuuccccccccagaacgucgcccgcgucgucgucugggaguggcucaacgagcacucccgcuggcgccccuacaccgccaccgucugccaccacaucgagaacguccucaaggaggacgcccgcggcuccgucguccucggccaggucgacgcccagcucguccccuacaucaucgaccuccaguccaugcaccaguuccgccaggacaccggcaccaugcgccccguccgccgcaacuucuacgaccccuccuccgcccccggcaagggcaucgucugggagugggagaacgacggcggcgccuggaccgccuacgacauggacaucugcaucaccauccagaacgccuacgagaagcagcaccccuggcucgaccucuccucccucggcuucugcuaccucaucuacuucaacuccaugucccagaugaaccgccagacccgccgccgccgccgccuccgccgccgccucgaccucgccuacccccucaccgucggcuccauccccaagucccaguccuggcccgucggcgccuccuccggccagcccugcuccugccagcagugccuccucgucaacuccacccgcgccgccuccaacgccauccucgccucccagcgccgcaaggccccccccgcccccccccucccccccccccccccccccggcggcccccccggcgcccucgccguccgccccuccgccaccuucaccggcgccgcccucugggccgcccccgccgccggccccgccgagcccgcccccccccccggcgcccccccccgcucccccggcgcccccggcggcgcccgcacccccggccagaacaaccucaaccgccccggcccccagcgcaccaccuccgucuccgcccgcgccuccaucccccccggcguccccgcccuccccgucaagaaccucaacggcaccggccccguccaccccgcccucgccggcaugaccggcauccuccucugcgccgccggccuccccgucugccucacccgcgcccccaagcccauccuccaccccccccccgucuccaaguccgacgucaagcccguccccggcguccccggcgucugccgcaagaccaagaagaagcaccucaagaaguccaagaaccccgaggacgucguccgccgcuacaugcagaaggucaagaacccccccgacgaggacugcaccaucugcauggagcgccucgucaccgccuccggcuacgagggcguccuccgccacaagggcguccgccccgagcucgucggccgccucggccgcugcggccacauguaccaccuccucugccucgucgccauguacuccaacggcaacaaggacggcucccuccagugccccaccugcaaggccaucuacggcgagaagaccggcacccagccccccggcaagauggaguuccaccucaucccccacucccuccccggcuuccccgacacccagaccauccgcaucgucuacgacauccccaccggcauccagggccccgagcaccccaaccccggcaagaaguucaccgcccgcggcuucccccgccacugcuaccuccccaacaacgagaagggccgcaagguccuccgccuccucaucaccgccugggagcgccgccucaucuucaccaucggcaccuccaacaccaccggcgaguccgacaccgucgucuggaacgagauccaccacaagaccgaguucggcuccaaccucaccggccacggcuaccccgacgccuccuaccucgacaacguccucgccgagcucaccgcccagggcgucuccgaggccgccgccaaggccuga

SEQ ID NO: 42465 - RNA, 1869 nt, Artificial Sequence
  derived and/or modified sequence opt2 from DTX2__Homo_sapiens__NP_001096064
auggccauggcccccucccccucccucguccaggucuacaccucccccgccgccgucgccgucugggaguggcaggacggccucggcaccuggcaccccuacuccgccaccgucugcuccuucaucgagcagcaguucguccagcagaagggccagcgcuucggccucggcucccucgcccacuccaucccccucggccaggccgaccccucccucgcccccuacaucaucgaccuccccuccuggacccaguuccgccaggacaccggcaccaugcgcgccguccgccgccaccucuucccccagcacuccgcccccggccgcggcgucgucugggaguggcucuccgacgacggcuccuggaccgccuacgaggccuccgucugcgacuaccucgagcagcaggucgcccgcggcaaccagcucgucgaccucgccccccucggcuacaacuacaccgucaacuacaccacccacacccagaccaacaagaccuccuccuucugccgcuccguccgccgccaggccggcccccccuaccccgucaccaccaucaucgccccccccggccacaccggcgucgccugcuccugccaccagugccucuccggcucccgcaccggccccgucuccggccgcuaccgccacuccaugaccaaccuccccgccuaccccgucccccagcaccccccccaccgcaccgccuccgucuucggcacccaccaggccuucgcccccuacaacaagcccucccucuccggcgcccgcuccgccccccgccucaacaccaccaacgccuggggcgccgccccccccucccucggcucccagccccucuaccgcuccucccucucccaccucggcccccagcaccucccccccggcuccuccaccuccggcgccgucuccgccucccuccccuccggccccuccuccucccccggcuccguccccgccaccguccccaugcagaugcccaagcccucccgcguccagcaggcccucgccggcaugaccuccguccucauguccgccaucggccuccccgucugccucucccgcgccccccagcccaccuccccccccgccucccgccucgccuccaagucccacggcuccgucaagcgccuccgcaagauguccgucaagggcgccacccccaagcccgagcccgagcccgagcaggucaucaagaacuacaccgaggagcucaaggucccccccgacgaggacugcaucaucugcauggagaagcucuccaccgccuccggcuacuccgacgucaccgacuccaaggccaucggcucccucgccgucggccaccucaccaagugcucccacgccuuccaccuccucugccuccucgccauguacugcaacggcaacaaggacggcucccuccagugccccuccugcaagaccaucuacggcgagaagaccggcacccagccccagggcaagauggagguccuccgcuuccagaugucccuccccggccacgaggacugcggcaccauccucaucgucuacuccaucccccacggcauccagggccccgagcaccccaaccccggcaagcccuucaccgcccgcggcuucccccgccagugcuaccuccccgacaacgcccagggccgcaagguccucgagcuccucaaggucgccuggaagcgccgccucaucuucaccgucggcaccuccuccaccaccggcgagaccgacaccgucgucuggaacgagauccaccacaagaccgagauggaccgcaacaucaccggccacggcuaccccgaccccaacuaccuccagaacguccucgccgagcucgccgcccagggcgucaccgaggacugccucgagcagcaguga

SEQ ID NO: 42466 - RNA, 1053 nt, Artificial Sequence
  derived and/or modified sequence opt2 from DTX3__Homo_sapiens__NP_001273174
augcccauccucuccuccuccggcuccaagauggccgccugcggcggcaccugcaagaacaaggucaccgucuccaagcccgucugggacuuccucuccaaggagacccccgcccgccucgcccgccuccgcgaggagcaccgcgucuccauccucaucgacggcgagaccuccgacaucuacguccuccagcucuccccccagggccccccccccgccccccccaacggccucuaccucgcccgcaaggcccucaagggccuccucaaggaggccgagaaggagcucaagaaggcccagcgccagggcgagcucaugggcugccucgcccucggcggcggcggcgagcaccccgagaugcaccgcgccggcccccccccccuccgcgccgccccccuccucccccccggcgcccgcggccuccccccccccccccccccccucccccccccccuccccccccgccuccgcgaggaggccgaggagcaggaguccaccugccccaucugccucggcgagauccagaacgccaagacccucgagaagugccgccacuccuucugcgagggcugcaucacccgcgcccuccaggucaagaaggccugccccaugugcggccgcuucuacggccagcucgucggcaaccagccccagaacggccgcaugcucgucuccaaggacgccacccuccuccuccccuccuacgagaaguacggcaccaucgucauccaguacgucuucccccccggcguccagggcgccgagcaccccaaccccggcguccgcuaccccggcaccacccgcgucgccuaccuccccgacugccccgagggcaacaagguccucacccucuuccgcaaggccuucgaccagcgccucaccuucaccaucggcaccuccaugaccaccggccgccccaacgucaucaccuggaacgacauccaccacaagaccuccugcaccggcggcccccagcucuucggcuaccccgaccccaccuaccucacccgcguccaggaggagcuccgcgccaagggcaucaccgacgacuga

SEQ ID NO: 42467 - RNA, 1542 nt, Artificial Sequence
  derived and/or modified sequence opt2 from DTX4__Homo_sapiens__NP_001287656
auggaggucggcaucaccauccagcacgccuacgagaagcagcaccccuggaucgaccucaccuccaucggcuucuccuacgucaucgacuucaacaccaugggccagaucaaccgccagacccagcgccagcgccgcguccgccgccgccucgaccucaucuaccccauggucaccggcacccuccccaaggcccaguccuggcccgucucccccggccccgccaccuccccccccaugucccccugcuccugcccccagugcguccucgucauguccgucaaggccgccgucgucaacggcuccaccggcccccuccagcuccccgucacccgcaagaacaugcccccccccggcgucgucaagcuccccccccuccccggcuccggcgccaagccccucgacuccaccggcaccauccgcggcccccucaagaccgcccccucccaggucauccgccgccaggccuccuccaugcccaccggcaccaccaugggcucccccgccuccccccccggccccaacuccaagaccggccgcgucgcccucgccacccucaaccgcaccaaccuccagcgccucgccaucgcccagucccgcguccucaucgccuccggcguccccaccguccccgucaagaaccucaacggcuccucccccgucaaccccgcccucgccggcaucaccggcauccucauguccgccgccggccuccccgucugccucacccgcccccccaagcucguccuccaccccccccccgucuccaaguccgagaucaaguccauccccggcgucuccaacaccucccgcaagaccaccaagaagcaggccaagaagggcaagacccccgaggagguccucaagaaguaccuccagaagguccgccacccccccgacgaggacugcaccaucugcauggagcgccucaccgcccccuccggcuacaagggcccccagcccaccgucaagcccgaccucgucggcaagcucucccgcugcggccacgucuaccacaucuacugccucgucgccauguacaacaacggcaacaaggacggcucccuccagugccccaccugcaagaccaucuacggcgucaagaccggcacccagccccccggcaagauggaguaccaccucaucccccacucccuccccggccaccccgacugcaagaccauccgcaucaucuacuccaucccccccggcauccagggccccgagcaccccaaccccggcaaguccuucuccgcccgcggcuucccccgccacugcuaccuccccgacuccgagaagggccgcaagguccucaagcuccuccucgucgccugggaccgccgccucaucuucgccaucggcaccuccuccaccaccggcgaguccgacaccgucaucuggaacgagguccaccacaagaccgaguucggcuccaaccucaccggccacggcuaccccgacgccaacuaccucgacaacguccucgccgagcucgccgcccagggcaucuccgaggacuccaccgcccaggagaaggacuga

SEQ ID NO: 42468 - RNA, 639 nt, Artificial Sequence
  derived and/or modified sequence opt2 from DTYMK__Homo_sapiens__NP_036277
auggccgcccgccgcggcgcccucaucguccucgagggcgucgaccgcgccggcaaguccacccagucccgcaagcucgucgaggcccucugcgccgccggccaccgcgccgagcuccuccgcuuccccgagcgcuccaccgagaucggcaagcuccucuccuccuaccuccagaagaaguccgacgucgaggaccacuccguccaccuccucuucuccgccaaccgcugggagcaggucccccucaucaaggagaagcucucccagggcgucacccucgucgucgaccgcuacgccuucuccggcgucgccuucaccggcgccaaggagaacuucucccucgacuggugcaagcagcccgacgucggccuccccaagcccgaccucguccucuuccuccagcuccagcucgccgacgccgccaagcgcggcgccuucggccacgagcgcuacgagaacggcgccuuccaggagcgcgcccuccgcugcuuccaccagcucaugaaggacaccacccucaacuggaagauggucgacgccuccaaguccaucgaggccguccacgaggacauccgcguccucuccgaggacgccauccgcaccgccaccgagaagccccucggcgagcucuggaaguga

SEQ ID NO: 42469 - RNA, 4656 nt, Artificial Sequence
  derived and/or modified sequence opt2 from DUOX1__Homo_sapiens__NP_787954
augggcuucugccucgcccucgccuggacccuccucgucggcgccuggaccccccucggcgcccagaaccccaucuccugggagguccagcgcuucgacggcugguacaacaaccucauggagcaccgcuggggcuccaagggcucccgccuccagcgccucguccccgccuccuacgccgacggcgucuaccagccccucggcgagccccaccuccccaacccccgcgaccucuccaacaccaucucccgcggccccgccggccucgccucccuccgcaaccgcaccguccucggcgucuucuucggcuaccacguccucuccgaccucgucuccgucgagacccccggcugccccgccgaguuccucaacauccgcaucccccccggcgaccccauguucgaccccgaccagcgcggcgacgucguccuccccuuccagcgcucccgcugggaccccgagaccggccgcucccccuccaacccccgcgaccccgccaaccaggucaccggcuggcucgacggcuccgccaucuacggcuccucccacuccugguccgacgcccuccgcuccuucucccgcggccagcucgccuccggccccgaccccgccuucccccgcgacucccagaacccccuccucaugugggccgcccccgaccccgccaccggccagaacggcccccgcggccucuacgccuucggcgccgagcgcggcaaccgcgagcccuuccuccaggcccucggccuccucugguuccgcuaccacaaccucugggcccagcgccucgcccgccagcaccccgacugggaggacgaggagcucuuccagcacgcccgcaagcgcgucaucgccaccuaccagaacaucgccgucuacgaguggcuccccuccuuccuccagaagacccuccccgaguacaccggcuaccgccccuuccucgaccccuccaucuccuccgaguucgucgccgccuccgagcaguuccucuccaccauggucccccccggcgucuacaugcgcaacgccuccugccacuuccagggcgucaucaaccgcaacuccuccgucucccgcgcccuccgcgucugcaacuccuacuggucccgcgagcaccccucccuccaguccgccgaggacgucgacgcccuccuccucggcauggccucccagaucgccgagcgcgaggaccacguccucgucgaggacguccgcgacuucuggcccggcccccucaaguucucccgcaccgaccaccucgccuccugccuccagcgcggccgcgaccucggccuccccuccuacaccaaggcccgcgccgcccucggccucucccccaucacccgcuggcaggacaucaaccccgcccucucccgcuccaacgacaccguccucgaggccaccgccgcccucuacaaccaggaccucuccuggcucgagcuccuccccggcggccuccucgagucccaccgcgaccccggcccccucuucuccaccaucguccucgagcaguucguccgccuccgcgacggcgaccgcuacugguucgagaacacccgcaacggccucuucuccaagaaggagaucgaggagauccgcaacaccacccuccaggacguccucgucgccgucaucaacaucgaccccuccgcccuccagcccaacgucuucgucuggcacaagggcgaccccugcccccagccccgccagcucuccaccgagggccuccccgccugcgcccccuccgucguccgcgacuacuucgagggcuccggcuucggcuucggcgucaccaucggcacccucugcugcuucccccucgucucccuccucuccgccuggaucgucgcccgccuccgcaugcgcaacuucaagcgccuccagggccaggaccgccaguccaucgucuccgagaagcucgucggcggcauggaggcccucgaguggcagggccacaaggagcccugccgccccguccucgucuaccuccagcccggccagauccgcgucgucgacggccgccucaccguccuccgcaccauccagcuccagcccccccagaaggucaacuucguccucuccuccaaccgcggccgccgcacccuccuccucaagauccccaaggaguacgaccucguccuccucuucaaccucgaggaggagcgccaggcccucgucgagaaccuccgcggcgcccucaaggaguccggccucuccauccaggagugggagcuccgcgagcaggagcucaugcgcgccgccgucacccgcgagcagcgccgccaccuccucgagaccuucuuccgccaccucuucucccagguccucgacaucaaccaggccgacgccggcacccucccccucgacuccucccagaagguccgcgaggcccucaccugcgagcucucccgcgccgaguucgccgagucccucggccucaagccccaggacauguucgucgaguccauguucucccucgccgacaaggacggcaacggcuaccucuccuuccgcgaguuccucgacauccucgucgucuucaugaagggcucccccgaggagaagucccgccucauguuccgcauguacgacuucgacggcaacggccucaucuccaaggacgaguucauccgcaugcuccgcuccuucaucgagaucuccaacaacugccucuccaaggcccagcucgccgaggucgucgaguccauguuccgcgaguccggcuuccaggacaaggaggagcucaccugggaggacuuccacuucaugcuccgcgaccacaacuccgagcuccgcuucacccagcucugcgucaagggcgucgagguccccgaggucaucaaggaccucugccgccgcgccuccuacaucucccaggacaugaucugccccuccccccgcgucuccgcccgcugcucccgcuccgacaucgagaccgagcucaccccccagcgccuccagugccccauggacaccgaccccccccaggagauccgccgccgcuucggcaagaaggucaccuccuuccagccccuccucuucaccgaggcccaccgcgagaaguuccagcgcuccugccuccaccagaccguccagcaguucaagcgcuucaucgagaacuaccgccgccacaucggcugcgucgccgucuucuacgccaucgccggcggccucuuccucgagcgcgccuacuacuacgccuucgccgcccaccacaccggcaucaccgacaccacccgcgucggcaucauccucucccgcggcaccgccgccuccaucuccuucauguucuccuacauccuccucaccaugugccgcaaccucaucaccuuccuccgcgagaccuuccucaaccgcuacguccccuucgacgccgccgucgacuuccaccgccucaucgccuccaccgccaucguccucaccguccuccacuccgucggccacgucgucaacgucuaccucuucuccaucuccccccucuccguccucuccugccucuuccccggccucuuccacgacgacggcuccgagcucccccagaaguacuacuggugguucuuccagaccguccccggccucaccggcgucguccuccuccucauccucgccaucauguacgucuucgccucccaccacuuccgccgccgcuccuuccgcggcuucuggcucacccaccaccucuacauccuccucuacguccuccucaucauccacggcuccuucgcccucauccagcucccccgcuuccacaucuucuuccucguccccgccaucaucuacggcggcgacaagcucgucucccucucccgcaagaaggucgagaucuccgucgucaaggccgagcuccuccccuccggcgucacccaccuccgcuuccagcgcccccagggcuucgaguacaaguccggccaguggguccgcaucgccugccucgcccucggcaccaccgaguaccaccccuucacccucaccuccgccccccacgaggacacccucucccuccacauccgcgccgccggccccuggaccacccgccuccgcgagaucuacuccgcccccaccggcgaccgcugcgcccgcuaccccaagcucuaccucgacggccccuucggcgagggccaccaggaguggcacaaguucgaggucuccguccucgucggcggcggcaucggcgucacccccuucgccuccauccucaaggaccucgucuucaaguccuccgucuccugccaggucuucugcaagaagaucuacuucaucugggucacccgcacccagcgccaguucgaguggcucgccgacaucauccgcgaggucgaggagaacgaccaccaggaccucgucuccguccacaucuacaucacccagcucgccgagaaguucgaccuccgcaccaccaugcucuacaucugcgagcgccacuuccagaagguccucaaccgcucccucuucaccggccuccgcuccaucacccacuucggccgcccccccuucgagcccuucuucaacucccuccaggagguccacccccagguccgcaagaucggcgucuucuccugcggcccccccggcaugaccaagaacgucgagaaggccugccagcucaucaaccgccaggaccgcacccacuucucccaccacuacgagaacuucuga

SEQ ID NO: 42470 - RNA, 4647 nt, Artificial Sequence
  derived and/or modified sequence opt2 from DUOX2__Homo_sapiens__NP_054799
augcuccgcgcccgccccgaggcccucaugcuccucggcgcccuccucaccggcucccucggccccuccggcaaccaggacgcccucucccuccccugggagguccagcgcuacgacggcugguucaacaaccuccgccaccacgagcgcggcgccgucggcugccgccuccagcgccgcguccccgccaacuacgccgacggcgucuaccaggcccucgaggagccccagcuccccaacccccgccgccucuccaacgccgccacccgcggcaucgccggccuccccucccuccacaaccgcaccguccucggcgucuucuucggcuaccacguccucuccgacgucgucuccgucgagacccccggcugccccgccgaguuccucaacauccgcaucccccccggcgaccccgucuucgaccccgaccagcgcggcgacgucguccuccccuuccagcgcucccgcugggaccccgagaccggccgcucccccuccaacccccgcgaccucgccaaccaggucaccggcuggcucgacggcuccgccaucuacggcuccucccacuccugguccgacgcccuccgcuccuucuccggcggccagcucgccuccggccccgaccccgccuucccccgcgacucccagaacccccuccucaugugggccgcccccgaccccgccaccggccagaacggcccccgcggccucuacgccuucggcgccgagcgcggcaaccgcgagcccuuccuccaggcccucggccuccucugguuccgcuaccacaaccucugggcccagcgccucgcccgccagcaccccgacugggaggacgaggagcucuuccagcacgcccgcaagcgcgucaucgccaccuaccagaacaucgccgucuacgaguggcuccccuccuuccuccagaagacccuccccgaguacaccggcuaccgccccuuccucgaccccuccaucucccccgaguucgucgucgccuccgagcaguucuucuccaccauggucccccccggcgucuacaugcgcaacgccuccugccacuuccgcaagguccucaacaagggcuuccaguccucccaggcccuccgcgucugcaacaacuacuggauccgcgagaaccccaaccucaacuccacccaggaggucaacgagcuccuccucggcauggccucccagaucuccgagcucgaggacaacaucgucgucgaggaccuccgcgacuacuggcccggccccggcaaguucucccgcaccgacuacgucgccuccuccauccagcgcggccgcgacaugggccuccccuccuacucccaggcccuccucgccuucggccucgacaucccccgcaacugguccgaccucaaccccaacgucgacccccagguccucgaggccaccgccgcccucuacaaccaggaccucucccagcucgagcuccuccucggcggccuccucgagucccacggcgaccccggcccccucuucuccgccaucguccucgaccaguucguccgccuccgcgacggcgaccgcuacugguucgagaacacccgcaacggccucuucuccaagaaggagaucgaggacauccgcaacaccacccuccgcgacguccucgucgccgucaucaacaucgaccccuccgcccuccagcccaacgucuucgucuggcacaagggcgcccccugcccccagcccaagcagcucaccaccgacggccucccccagugcgccccccucaccguccucgacuucuucgagggcuccucccccggcuucgccaucaccaucaucgcccucugcugccucccccucgucucccuccuccucuccggcgucgucgccuacuuccgcggccgcgagcacaagaagcuccagaagaagcucaaggaguccgucaagaaggaggccgccaaggacggcguccccgccauggaguggcccggccccaaggagcgcuccucccccaucaucauccagcuccucuccgaccgcugccuccagguccucaaccgccaccucaccguccuccgcgucguccagcuccagccccuccagcaggucaaccucauccucuccaacaaccgcggcugccgcacccuccuccucaagauccccaaggaguacgaccucguccuccucuucuccuccgaggaggagcgcggcgccuucguccagcagcucugggacuucugcguccgcugggcccucggccuccacgucgccgagauguccgagaaggagcucuuccgcaaggccgucaccaagcagcagcgcgagcgcauccucgagaucuucuuccgccaccucuucgcccagguccucgacaucaaccaggccgacgccggcacccucccccucgacuccucccagaagguccgcgaggcccucaccugcgagcucucccgcgccgaguucgccgagucccucggccucaagccccaggacauguucgucgaguccauguucucccucgccgacaaggacggcaacggcuaccucuccuuccgcgaguuccucgacauccucgucgucuucaugaagggcucccccgaggacaagucccgccucauguucaccauguacgaccucgacgagaacggcuuccucuccaaggacgaguucuucaccaugaugcgcuccuucaucgagaucuccaacaacugccucuccaaggcccagcucgccgaggucgucgaguccauguuccgcgaguccggcuuccaggacaaggaggagcucaccugggaggacuuccacuucaugcuccgcgaccacgacuccgagcuccgcuucacccagcucugcgucaagggcggcggcggcggcggcaacggcauccgcgacaucuucaagcagaacaucuccugccgcgucuccuucaucacccgcacccccggcgagcgcucccacccccagggccucggcccccccgcccccgaggcccccgagcucggcggccccggccucaagaagcgcuucggcaagaaggccgccguccccaccccccgccucuacaccgaggcccuccaggagaagaugcagcgcggcuuccucgcccagaagcuccagcaguacaagcgcuucgucgagaacuaccgccgccacaucgucugcgucgccaucuucuccgccaucugcgucggcgucuucgccgaccgcgccuacuacuacggcuucgccuccccccccuccgacaucgcccagaccacccucgucggcaucauccucucccgcggcaccgccgccuccgucuccuucauguucuccuacauccuccucaccaugugccgcaaccucaucaccuuccuccgcgagaccuuccucaaccgcuacguccccuucgacgccgccgucgacuuccaccgcuggaucgccauggccgccgucguccucgccauccuccacuccgccggccacgccgucaacgucuacaucuucuccgucuccccccucucccuccucgccugcaucuuccccaacgucuucgucaacgacggcuccaagcucccccagaaguucuacuggugguucuuccagaccguccccggcaugaccggcguccuccuccuccucguccucgccaucauguacgucuucgccucccaccacuuccgccgccgcuccuuccgcggcuucuggcucacccaccaccucuacauccuccucuacgcccuccucaucauccacggcuccuacgcccucauccagcuccccaccuuccacaucuacuuccucguccccgccaucaucuacggcggcgacaagcucgucucccucucccgcaagaaggucgagaucuccgucgucaaggccgagcuccuccccuccggcgucaccuaccuccaguuccagcgcccccagggcuucgaguacaaguccggccaguggguccgcaucgccugccucgcccucggcaccaccgaguaccaccccuucacccucaccuccgccccccacgaggacacccucucccuccacauccgcgccgucggccccuggaccacccgccuccgcgagaucuacuccucccccaagggcaacggcugcgccggcuaccccaagcucuaccucgacggccccuucggcgagggccaccaggaguggcacaaguucgaggucuccguccucgucggcggcggcaucggcgucacccccuucgccuccauccucaaggaccucgucuucaaguccucccucggcucccagaugcucugcaagaagaucuacuucaucugggucacccgcacccagcgccaguucgaguggcucgccgacaucauccaggaggucgaggagaacgaccaccaggaccucgucuccguccacaucuacgucacccagcucgccgagaaguucgaccuccgcaccaccaugcucuacaucugcgagcgccacuuccagaagguccucaaccgcucccucuucaccggccuccgcuccaucacccacuucggccgcccccccuucgagcccuucuucaacucccuccaggagguccacccccagguccgcaagaucggcgucuucuccugcggcccccccggcaugaccaagaacgucgagaaggccugccagcucgucaaccgccaggaccgcgcccacuucaugcaccacuacgagaacuucuga

SEQ ID NO: 42471 - RNA, 1452 nt, Artificial Sequence
  derived and/or modified sequence opt2 from DUOXA1__Homo_sapiens__NP_001263193
auggccacccucggccacaccuuccccuucuacgccggccccaagcccaccuuccccauggacaccacccucgccuccaucaucaugaucuuccucaccgcccucgccaccuucaucgucauccuccccggcauccgcggcaagacccgccucuucuggcuccuccgcgucgucaccucccucuucaucggcgccgccauccucgccgucaacuucuccuccgagugguccgucggccaggucuccaccaacaccuccuacaaggccuucuccuccgaguggaucuccgccgacaucggccuccaggucggccucggcggcgucaacaucacccucaccggcacccccguccagcagcucaacgagaccaucaacuacaacgaggaguucaccuggcgccucggcgagaacuacgccgaggaguacgccaaggcccucgagaagggccuccccgaccccguccucuaccucgccgagaaguucaccccccgcucccccugcggccucuaccgccaguaccgccucgccggccacuacaccuccgccaugcucugggucgccuuccucugcuggcuccucgccaacgucaugcucuccaugcccguccucgucuacggcggcuacaugcuccucgccaccggcaucuuccagcuccucgcccuccucuucuucuccauggccaccucccucaccucccccugcccccuccaccucggcgccuccguccuccacacccaccacggccccgccuucuggaucacccucaccaccggccuccucugcguccuccucggccucgccauggccgucgcccaccgcaugcagccccaccgccucaaggccuucuucaaccaguccgucgacgaggaccccaugcucgaguggucccccgaggagggcggccuccucuccccccgcuaccgcuccauggccgacucccccaagucccaggacaucccccucuccgaggccuccuccaccaaggccuacuaccgcccccgccgccucucccucguccccgccgacguccgcggccucgcccccgccgcccucuccgcccuccccggcgcccuccucgcccaggccuggcgcgcccuccuccccggccuccgcugccccaaggccggcaaggagucccgccucggccccccccacucccccuggcgcuucggccccgagggcugcgaggagcgcugggccgagcacaccggcgacuccccccgcccccuccgcggccgcggcaccggccgccucuggcgcuggggcuccaaggagcgccgcgccugcggcguccgcgccaugcucccccgccucgucuccaacuccggccucaagcgccccuccugccucgaccuccccaagugcugggacuaccgccgcgacgcccgcgccuucuuccaccuccucgagcccacccccugcgucaccucccgccacaccccccucaucuga

SEQ ID NO: 42472 - RNA, 963 nt, Artificial Sequence
  derived and/or modified sequence opt2 from DUOXA2__Homo_sapiens__NP_997464
augacccucuggaacggcguccuccccuucuacccccagccccgccacgccgccggcuucuccgucccccuccucaucgucauccucgucuuccucgcccucgccgccuccuuccuccucauccuccccggcauccgcggccacucccgcugguucuggcucguccgcguccuccucucccucuucaucggcgccgagaucgucgccguccacuucuccgccgagugguucgucggcaccgucaacaccaacaccuccuacaaggccuucuccgccgcccgcgucaccgcccgcguccgccuccucgucggccucgagggcaucaacaucacccucaccggcacccccguccaccagcucaacgagaccaucgacuacaacgagcaguucaccuggcgccucaaggagaacuacgccgccgaguacgccaacgcccucgagaagggccuccccgaccccguccucuaccucgccgagaaguucacccccuccucccccugcggccucuaccaccaguaccaccucgccggccacuacgccuccgccacccucugggucgccuucugcuucuggcuccucuccaacguccuccucuccacccccgccccccucuacggcggccucgcccuccucaccaccggcgccuucgcccucuucggcgucuucgcccucgccuccaucuccuccgucccccucugcccccuccgccucggcuccuccgcccucaccacccaguacggcgccgccuucugggucacccucgccaccggcguccucugccucuuccucggcggcgccgucgucucccuccaguacguccgccccuccgcccuccgcacccuccucgaccaguccgccaaggacugcucccaggagcgcggcggcuccccccucauccucggcgacccccuccacaagcaggccgcccuccccgaccucaagugcaucaccaccaaccucuga

SEQ ID NO: 42473 - RNA, 663 nt, Artificial Sequence
  derived and/or modified sequence opt2 from DUPD1__Homo_sapiens__NP_001003892
augaccuccggcgaggucaagaccucccucaagaacgccuacuccuccgccaagcgccucucccccaagauggaggaggagggcgaggaggaggacuacugcacccccggcgccuucgagcucgagcgccucuucuggaagggcuccccccaguacacccacgucaacgaggucuggcccaagcucuacaucggcgacgaggccaccgcccucgaccgcuaccgccuccagaaggccggcuucacccacguccucaacgccgcccacggccgcuggaacgucgacaccggccccgacuacuaccgcgacauggacauccaguaccacggcgucgaggccgacgaccuccccaccuucgaccucuccgucuucuucuaccccgccgccgccuucaucgaccgcgcccucuccgacgaccacuccaagauccucguccacugcgucaugggccgcucccgcuccgccacccucguccucgccuaccucaugauccacaaggacaugacccucgucgacgccauccagcaggucgccaagaaccgcugcguccuccccaaccgcggcuuccucaagcagcuccgcgagcucgacaagcagcucguccagcagcgccgccgcucccagcgccaggacggcgaggaggaggacggccgcgagcucuga

SEQ ID NO: 42474 - RNA, 1482 nt, Artificial Sequence
  derived and/or modified sequence opt2 from DUS2__Homo_sapiens__NP_001258691
augauccucaacucccucucccucugcuaccacaacaagcucauccucgcccccaugguccgcgucggcacccuccccaugcgccuccucgcccucgacuacggcgccgacaucgucuacugcgaggagcucaucgaccucaagaugauccagugcaagcgcgucgucaacgagguccucuccaccgucgacuucgucgcccccgacgaccgcgucgucuuccgcaccugcgagcgcgagcagaaccgcgucgucuuccagaugggcaccuccgacgccgagcgcgcccucgccgucgcccgccucgucgagaacgacgucgccggcaucgacgucaacaugggcugccccaagcaguacuccaccaagggcggcaugggcgccgcccuccucuccgaccccgacaagaucgagaagauccucuccacccucgucaagggcacccgccgccccgucaccugcaagauccgcauccuccccucccucgaggacacccucucccucgucaagcgcaucgagcgcaccggcaucgccgccaucgccguccacggccgcaagcgcgaggagcgcccccagcaccccgucuccugcgaggucaucaaggccaucgccgacacccucuccauccccgucaucgccaacggcggcucccacgaccacauccagcaguacuccgacaucgaggacuuccgccaggccaccgccgccuccuccgucauggucgcccgcgccgccauguggaaccccuccaucuuccucaaggagggccuccgcccccucgaggaggucaugcagaaguacauccgcuacgccguccaguacgacaaccacuacaccaacaccaaguacugccucugccagaugcuccgcgagcagcucgaguccccccagggccgccuccuccacgccgcccaguccucccgcgagaucugcgaggccuucggccucggcgccuucuacgaggagaccacccaggagcucgacgcccagcaggcccgccucuccgccaagaccuccgagcagaccggcgagcccgccgaggacaccuccggcgucaucaagauggccgucaaguucgaccgccgcgccuaccccgcccagaucacccccaagaugugccuccucgaguggugccgccgcgagaagcucgcccagcccgucuacgagaccguccagcgcccccucgaccgccucuucuccuccaucgucaccgucgccgagcagaaguaccaguccacccucugggacaaguccaagaagcucgccgagcaggccgccgccaucgucugccuccgcucccagggccuccccgagggccgccucggcgaggagucccccucccuccacaagcgcaagcgcgaggcccccgaccaggaccccggcggcccccgcgcccaggagcucgcccagcccggcgaccucugcaagaagcccuucgucgcccucggcuccggcgaggaguccccccucgagggcugguga

SEQ ID NO: 42475 - RNA, 1449 nt, Artificial Sequence
  derived and/or modified sequence opt2 from DUSP10__Homo_sapiens__NP_009138
augccccccuccccccucgacgaccgcgucgucgucgcccucucccgccccguccgcccccaggaccucaaccucugccucgacuccuccuaccucggcuccgccaaccccggcuccaacucccacccccccgucaucgccaccaccgucgucucccucaaggccgccaaccucaccuacaugcccuccuccuccggcuccgcccgcucccucaacugcggcugcuccuccgccuccugcugcaccgucgccaccuacgacaaggacaaccaggcccagacccaggccaucgccgccggcaccaccaccaccgccaucggcaccuccaccaccugccccgccaaccagauggucaacaacaacgagaacaccggcucccucucccccuccuccggcgucggcucccccgucuccggcacccccaagcagcucgccuccaucaagaucaucuaccccaacgaccucgccaagaagaugaccaagugcuccaagucccaccuccccucccagggccccgucaucaucgacugccgccccuucauggaguacaacaagucccacauccagggcgccguccacaucaacugcgccgacaagaucucccgccgccgccuccagcagggcaagaucaccguccucgaccucaucuccugccgcgagggcaaggacuccuucaagcgcaucuucuccaaggagaucaucgucuacgacgagaacaccaacgagcccucccgcgucaugcccucccagccccuccacaucguccucgagucccucaagcgcgagggcaaggagccccucguccucaagggcggccucuccuccuucaagcagaaccacgagaaccucugcgacaacucccuccagcuccaggagugccgcgaggucggcggcggcgccuccgccgccuccucccuccucccccagcccauccccaccacccccgacaucgagaacgccgagcucacccccauccuccccuuccucuuccucggcaacgagcaggacgcccaggaccucgacaccaugcagcgccucaacaucggcuacgucaucaacgucaccacccaccucccccucuaccacuacgagaagggccucuucaacuacaagcgccuccccgccaccgacuccaacaagcagaaccuccgccaguacuucgaggaggccuucgaguucaucgaggaggcccaccagugcggcaagggccuccucauccacugccaggccggcgucucccgcuccgccaccaucgucaucgccuaccucaugaagcacacccgcaugaccaugaccgacgccuacaaguucgucaagggcaagcgccccaucaucucccccaaccucaacuucaugggccagcuccucgaguucgaggaggaccucaacaacggcgucaccccccgcauccucacccccaagcucaugggcgucgagaccgucgucuga

SEQ ID NO: 42476 - RNA, 1134 nt, Artificial Sequence
  derived and/or modified sequence opt2 from DUSP11__Homo_sapiens__NP_003575
augcgcaacuccgagacccucgagcgcggcgucggcggcugccgcgucuucuccugccucggcuccuaccccggcaucgagggcgccggccucgcccuccucgccgaccucgcccucggcggccgccuccucggcacccacaugucccaguggcaccacccccgcuccggcuggggccgccgccgcgacuucuccggccgcuccuccgccaagaagaagggcggcaaccacauccccgagcgcuggaaggacuaccuccccgucggccagcgcaugcccggcacccgcuucaucgccuucaaggucccccuccagaaguccuucgagaagaagcucgcccccgaggagugcuucuccccccucgaccucuucaacaagauccgcgagcagaacgaggagcucggccucaucaucgaccucaccuacacccagcgcuacuacaagcccgaggaccuccccgagaccguccccuaccucaagaucuucaccgucggccaccagguccccgacgacgagaccaucuucaaguucaagcacgccgucaacggcuuccucaaggagaacaaggacaacgacaagcucaucggcguccacugcacccacggccucaaccgcaccggcuaccucaucugccgcuaccucaucgacgucgagggcguccgccccgacgacgccaucgagcucuucaaccgcugccgcggccacugccucgagcgccagaacuacaucgaggaccuccagaacggccccauccgcaagaacuggaacuccuccgucccccgcuccuccgacuucgaggacuccgcccaccucaugcagcccguccacaacaagcccgucaagcagggcccccgcuacaaccuccaccagauccagggccacuccgccccccgccacuuccacacccagacccagucccuccagcaguccguccgcaaguucuccgagaacccccacgucuaccagcgccaccaccuccccccccccggcccccccggcgaggacuacucccaccgccgcuacuccuggaacgucaagcccaacgccucccgcgccgcccaggaccgccgccgcugguaccccuacaacuacucccgccucuccuaccccgccugcugggaguggacccaguga

SEQ ID NO: 42477 - RNA, 1023 nt, Artificial Sequence
  derived and/or modified sequence opt2 from DUSP12__Homo_sapiens__NP_009171
augcucgaggcccccggccccuccgacggcugcgagcucuccaaccccuccgccucccgcgucuccugcgccggccagaugcucgagguccagcccggccucuacuucggcggcgccgccgccgucgccgagcccgaccaccuccgcgaggccggcaucaccgccguccucaccgucgacuccgaggagcccuccuucaaggccggccccggcgucgaggaccucuggcgccucuucguccccgcccucgacaagcccgagaccgaccuccucucccaccucgaccgcugcgucgccuucaucggccaggcccgcgccgagggccgcgccguccucguccacugccacgccggcgucucccgcuccgucgccaucaucaccgccuuccucaugaagaccgaccagcuccccuucgagaaggccuacgagaagcuccagauccucaagcccgaggccaagaugaacgagggcuucgaguggcagcucaagcucuaccaggccaugggcuacgaggucgacaccuccuccgccaucuacaagcaguaccgccuccagaaggucaccgagaaguaccccgagcuccagaaccucccccaggagcucuucgccgucgaccccaccaccgucucccagggccucaaggacgagguccucuacaagugccgcaagugccgccgcucccucuuccgcuccuccuccauccucgaccaccgcgagggcuccggccccaucgccuucgcccacaagcgcaugacccccuccuccaugcucaccaccggccgccaggcccagugcaccuccuacuucaucgagcccguccaguggauggaguccgcccuccucggcgucauggacggccagcuccucugccccaagugcuccgccaagcucggcuccuucaacugguacggcgagcagugcuccugcggccgcuggaucacccccgccuuccagauccacaagaaccgcgucgacgagaugaagauccuccccguccucggcucccagaccggcaagaucuga

SEQ ID NO: 42478 - RNA, 567 nt, Artificial Sequence
  derived and/or modified sequence opt2 from DUSP13__Homo_sapiens__NP_001007272
auggccgagaccucccuccccgagcucggcggcgaggacaaggccacccccugccccuccauccucgagcucgaggagcuccuccgcgccggcaaguccuccugcucccgcgucgacgaggucuggcccaaccucuucaucggcgacgccgccaccgccaacaaccgcuucgagcucuggaagcucggcaucacccacguccucaacgccgcccacaagggccucuacugccagggcggccccgacuucuacggcuccuccgucuccuaccucggcguccccgcccacgaccuccccgacuucgacaucuccgccuacuucuccuccgccgccgacuucauccaccgcgcccucaacacccccggcgccaagguccucguccacugcgucgucggcgucucccgcuccgccacccucguccucgccuaccucaugcuccaccagcgccucucccuccgccaggccgucaucaccguccgccagcaccgcugggucuuccccaaccgcggcuuccuccaccagcucugccgccucgaccagcagcuccgcggcgccggccaguccuga

SEQ ID NO: 42479 - RNA, 597 nt, Artificial Sequence
  derived and/or modified sequence opt2 from DUSP14__Homo_sapiens__NP_008957
auguccucccgcggccacuccacccucccccgcacccucauggccccccgcaugaucuccgagggcgacaucggcggcaucgcccagaucaccuccucccucuuccucggccgcggcuccgucgccuccaaccgccaccuccuccaggcccgcggcaucaccugcaucgucaacgccaccaucgagauccccaacuucaacuggccccaguucgaguacgucaaggucccccucgccgacaugccccacgcccccaucggccucuacuucgacaccgucgccgacaagauccacuccgucucccgcaagcacggcgccacccucguccacugcgccgccggcgucucccgcuccgccacccucugcaucgccuaccucaugaaguuccacaacgucugccuccucgaggccuacaacugggucaaggcccgccgccccgucauccgccccaacgucggcuucuggcgccagcucaucgacuacgagcgccagcucuucggcaaguccaccgucaagaugguccagacccccuacggcaucguccccgacgucuacgagaaggagucccgccaccucaugcccuacuggggcaucuga

SEQ ID NO: 42480 - RNA, 708 nt, Artificial Sequence
  derived and/or modified sequence opt2 from DUSP15__Homo_sapiens__NP_542178
augggcaacggcaugaccaagguccuccccggccucuaccucggcaacuucaucgacgccaaggaccucgaccagcucggccgcaacaagaucacccacaucaucuccauccacgaguccccccagccccuccuccaggacaucaccuaccuccgcauccccgucgccgacacccccgagguccccaucaagaagcacuucaaggagugcaucaacuucauccacugcugccgccucaacggcggcaacugccucguccacugcuucgccggcaucucccgcuccaccaccaucgucaccgccuacgucaugaccgucaccggccucggcuggcgcgacguccucgaggccaucaaggccacccgccccaucgccaaccccaaccccggcuuccgccagcagcucgaggaguucggcugggccuccucccagaagcuccgccgccagcucgaggagcgcuucggcgagucccccuuccgcgacgaggaggagcuccgcgcccuccucccccucugcaagcgcugccgccagggcuccgccaccuccgccuccuccgccggcccccacuccgccgccuccgagggcaccguccagcgccucgucccccgcaccccccgcgaggcccaccgcccccucccccuccucgcccgcgucaagcagaccuucuccugccucccccgcugccucucccgcaagggcggcaaguga

SEQ ID NO: 42481 - RNA, 1554 nt, Artificial Sequence
  derived and/or modified sequence opt2 from DUSP16__Homo_sapiens__XP_005253545
augcucccccucucccuccagaccgucuucucccucuacuucugggucaacuggcgccgcgccuccacccucuucaccugccuccaggagcucaugcagcagaacggcaucggcuacguccucaacgccuccaacaccugccccaagcccgacuucauccccgagucccacuuccuccgcguccccgucaacgacuccuucugcgagaagauccuccccuggcucgacaaguccgucgacuucaucgagaaggccaaggccuccaacggcugcguccucguccacugccucgccggcaucucccgcuccgccaccaucgccaucgccuacaucaugaagcgcauggacaugucccucgacgaggccuaccgcuucgucaaggagaagcgccccaccaucucccccaacuucaacuuccucggccagcuccucgacuacgagaagaagaucaagaaccagaccggcgccuccggccccaaguccaagcucaagcuccuccaccucgagaagcccaacgagcccguccccgccgucuccgagggcggccagaaguccgagaccccccucuccccccccugcgccgacuccgccaccuccgaggccgccggccagcgccccguccaccccgccuccguccccuccguccccuccguccagcccucccuccucgaggacuccccccucguccaggcccucuccggccuccaccucuccgccgaccgccucgaggacuccaacaagcucaagcgcuccuucucccucgacaucaaguccgucuccuacuccgccuccauggccgccucccuccacggcuucuccuccuccgaggacgcccucgaguacuacaagcccuccaccacccucgacggcaccaacaagcucugccaguucucccccguccaggagcucuccgagcagacccccgagaccucccccgacaaggaggaggccuccauccccaagaagcuccagaccgcccgccccuccgacucccaguccaagcgccuccacuccguccgcaccuccuccuccggcaccgcccagcgcucccuccucuccccccuccaccgcuccggcuccgucgaggacaacuaccacaccuccuuccucuucggccucuccaccucccagcagcaccucaccaaguccgccggccucggccucaagggcuggcacuccgacauccucgccccccagaccuccacccccucccucaccuccuccugguacuucgccaccgaguccucccacuucuacuccgccuccgccaucuacggcggcuccgccuccuacuccgccuacuccugcucccagcuccccaccugcggcgaccaggucuacuccguccgccgccgccagaagcccuccgaccgcgccgacucccgccgcuccuggcacgaggagucccccuucgagaagcaguucaagcgccgcuccugccagauggaguucggcgaguccaucauguccgagaaccgcucccgcgaggagcucggcaaggucggcucccaguccuccuucuccggcuccauggagaucaucgaggucuccuga

SEQ ID NO: 42482 - RNA, 567 nt, Artificial Sequence
  derived and/or modified sequence opt2 from DUSP18__Homo_sapiens__NP_001291723
augaccgcccccuccugcgccuuccccguccaguuccgccagcccuccgucuccggccucucccagaucaccaagucccucuacaucuccaacggcgucgccgccaacaacaagcucaugcucuccuccaaccagaucaccauggucaucaacgucuccgucgaggucgucaacacccucuacgaggacauccaguacaugcagguccccgucgccgacucccccaacucccgccucugcgacuucuucgaccccaucgccgaccacauccacuccgucgagaugaagcagggccgcacccuccuccacugcgccgccggcgucucccgcuccgccgcccucugccucgccuaccucaugaaguaccacgccaugucccuccucgacgcccacaccuggaccaaguccugccgccccaucauccgccccaacuccggcuucugggagcagcucauccacuacgaguuccagcucuucggcaagaacaccguccacauggucuccucccccgucggcaugauccccgacaucuacgagaaggagguccgccucaugaucccccucuga

SEQ ID NO: 42483 - RNA, 1104 nt, Artificial Sequence
  derived and/or modified sequence opt2 from DUSP1__Homo_sapiens__NP_004408
auggucauggaggucggcacccucgacgccggcggccuccgcgcccuccucggcgagcgcgccgcccagugccuccuccucgacugccgcuccuucuucgccuucaacgccggccacaucgccggcuccgucaacguccgcuucuccaccaucguccgccgccgcgccaagggcgccaugggccucgagcacaucguccccaacgccgagcuccgcggccgccuccucgccggcgccuaccacgccgucguccuccucgacgagcgcuccgccgcccucgacggcgccaagcgcgacggcacccucgcccucgccgccggcgcccucugccgcgaggcccgcgccgcccaggucuucuuccucaagggcggcuacgaggccuucuccgccuccugccccgagcucugcuccaagcaguccacccccaugggccucucccucccccucuccaccuccguccccgacuccgccgaguccggcugcuccuccugcuccaccccccucuacgaccagggcggccccgucgagauccuccccuuccucuaccucggcuccgccuaccacgccucccgcaaggacaugcucgacgcccucggcaucaccgcccucaucaacgucuccgccaacugccccaaccacuucgagggccacuaccaguacaaguccauccccgucgaggacaaccacaaggccgacaucuccuccugguucaacgaggccaucgacuucaucgacuccaucaagaacgccggcggccgcgucuucguccacugccaggccggcaucucccgcuccgccaccaucugccucgccuaccucaugcgcaccaaccgcgucaagcucgacgaggccuucgaguucgucaagcagcgccgcuccaucaucucccccaacuucuccuucaugggccagcuccuccaguucgagucccagguccucgccccccacugcuccgccgaggccggcucccccgccauggccguccucgaccgcggcaccuccaccaccaccgucuucaacuuccccgucuccauccccguccacuccaccaacuccgcccucuccuaccuccagucccccaucaccaccucccccuccugcuga

SEQ ID NO: 42484 - RNA, 573 nt, Artificial Sequence
  derived and/or modified sequence opt2 from DUSP21__Homo_sapiens__NP_071359
augaccgccuccgccuccuccuucuccuccucccagggcguccagcagcccuccaucuacuccuucucccagaucacccgcucccucuuccucuccaacggcgucgccgccaacgacaagcuccuccucuccuccaaccgcaucaccgccaucgucaacgccuccgucgaggucgucaacgucuucuucgagggcauccaguacaucaagguccccgucaccgacgcccgcgacucccgccucuacgacuucuucgaccccaucgccgaccucauccacaccaucgacaugcgccagggccgcacccuccuccacugcauggccggcgucucccgcuccgccucccucugccucgccuaccucaugaaguaccacuccaugucccuccucgacgcccacaccuggaccaagucccgccgccccaucauccgccccaacaacggcuucugggagcagcucaucaacuacgaguucaagcucuucaacaacaacaccguccgcaugaucaacucccccgucggcaacauccccgacaucuacgagaaggaccuccgcaugaugaucuccauguga

SEQ ID NO: 42485 - RNA, 618 nt, Artificial Sequence
  derived and/or modified sequence opt2 from DUSP22__Homo_sapiens__NP_001273484
augggcaacggcaugaacaagauccuccccggccucuacaucggcaacuucaaggacgcccgcgacgccgagcagcucuccaagaacaaggucacccacauccucuccguccacgacuccgcccgccccaugcucgagggcgucaaguaccucugcauccccgccgccgacucccccucccagaaccucacccgccacuucaaggaguccaucaaguucauccacgagugccgccuccgcggcgaguccugccucguccacugccucgccggcgucucccgcuccgucacccucgucaucgccuacaucaugaccgucaccgacuucggcugggaggacgcccuccacaccguccgcgccggccgcuccugcgccaaccccaacgucggcuuccagcgccagcuccaggaguucgagaagcacgagguccaccaguaccgccaguggcucaaggaggaguacggcgaguccccccuccaggacgccgaggaggccaagaacauccucggcaaguacaaggagcagggccgcaccgagccccagcccggcgcccgccgcugguccuccuuccccgcccucgccccccucaccuacgacaacuacaccaccgagaccuga

SEQ ID NO: 42486 - RNA, 453 nt, Artificial Sequence
  derived and/or modified sequence opt2 from DUSP23__Homo_sapiens__NP_060293
augggcguccagccccccaacuucuccuggguccuccccggccgccucgccggccucgcccucccccgccuccccgcccacuaccaguuccuccucgaccucggcguccgccaccucgucucccucaccgagcgcggccccccccacuccgacuccugccccggccucacccuccaccgccuccgcauccccgacuucugcccccccgcccccgaccagaucgaccgcuucguccagaucgucgacgaggccaacgcccgcggcgaggccgucggcguccacugcgcccucggcuucggccgcaccggcaccaugcucgccugcuaccucgucaaggagcgcggccucgccgccggcgacgccaucgccgagauccgccgccuccgccccggcuccaucgagaccuacgagcaggagaaggccgucuuccaguucuaccagcgcaccaaguga

SEQ ID NO: 42487 - RNA, 3477 nt, Artificial Sequence
  derived and/or modified sequence opt2 from DUSP27__Homo_sapiens__XP_005245660
auggccacccgcaaggacaccgaggaggagcaggucguccccuccgaggaggacgaggccaacguccgcgccguccaggcccacuaccuccgcucccccucccccucccaguacuccauggucuccgacgccgagaccgaguccaucuucauggagcccauccaccucuccuccgccaucgccgccaagcagaucaucaacgaggagcucaagccccccggcguccgcgccgacgccgagugccccggcaugcucgaguccgccgagcagcuccucgucgaggaccucuacaaccgcguccgcgagaagauggacgacaccucccucuacaacacccccugcguccucgaccuccagcgcgcccucguccaggaccgccaggaggcccccuggaacgaggucgacgaggucuggcccaacgucuucaucgccgagaaguccgucgccgucaacaagggccgccucaagcgccucggcaucacccacauccucaacgccgcccacggcaccggcgucuacaccggccccgaguucuacaccggccucgagauccaguaccucggcgucgaggucgacgacuuccccgaggucgacaucucccagcacuuccgcaaggccuccgaguuccucgacgaggcccuccucaccuaccgcggcaagguccucgucuccuccgagaugggcaucucccgcuccgccguccucgucgucgccuaccucaugaucuuccacaacauggccauccucgaggcccucaugaccguccgcaagaagcgcgccaucuaccccaacgagggcuuccucaagcagcuccgcgagcucaacgagaagcucauggaggagcgcgaggaggacuacggccgcgagggcggcuccgccgaggccgaggagggcgagggcaccggcuccaugcucggcgcccgcguccacgcccucaccgucgaggaggaggacgacuccgccucccaccucuccggcuccucccucggcaaggccacccaggccuccaagccccucacccucaucgacgaggaggaggaggagaagcucuacgagcaguggaagaagggccagggccuccucuccgacaaggucccccaggacggcggcggcuggcgcuccgccuccuccggccagggcggcgaggagcucgaggacgaggacgucgagcgcaucauccaggaguggcagucccgcaacgagcgcuaccaggccgagggcuaccgccgcuggggccgcgaggaggagaaggaggaggaguccgacgccggcuccuccgucggccgccgccgccgcacccucuccgaguccuccgccugggaguccgucuccucccacgacaucuggguccucaagcagcagcucgagcucaaccgccccgaccacggccgccgccgccgcgccgacuccauguccuccgaguccaccugggacgccuggaacgagcgccuccucgagaucgagaaggaggccucccgccgcuaccacgccaaguccaagcgcgaggaggccgccgaccgcuccuccgaggccggcucccgcguccgcgaggacgacgaggacuccgucggcuccgaggccuccuccuucuacaacuucugcucccgcaacaaggacaagcucaccgcccucgagcgcuggaagaucaagcgcauccaguucggcuuccacaagaaggaccucggcgccggcgacuccuccggcgagcccggcgccgaggaggccgucggcgagaagaaccccuccgacgucucccucaccgccuaccaggccuggaagcucaagcaccagaagaaggucggcuccgagaacaaggaggaggucgucgagcucuccaagggcgaggacuccgcccucgccaagaagcgccagcgccgccucgagcuccucgagcgcucccgccagacccucgaggagucccaguccauggccuccugggaggccgacuccuccaccgccuccggcuccaucccccucuccgccuucugguccgccgaccccuccgucuccgccgacggcgacaccaccuccguccucuccacccagucccaccgcucccaccucucccaggccgccuccaacaucgccggcugcuccaccuccaaccccaccaccccccuccccaaccuccccgucggccccggcgacaccaucuccaucgccuccauccagaacuggaucgccaacgucgucuccgagacccucgcccagaagcagaacgagaugcuccuccucucccgcucccccuccgucgccuccaugaaggccguccccgccgccuccugccucggcgacgaccaggucuccaugcucuccggccacuccuccuccucccucggcggcugccuccucccccagucccaggcccgccccuccuccgacaugcaguccguccucuccugcaacaccacccucuccucccccgccgaguccugccgcuccaagguccgcggcaccuccaagcccaucuucucccucuucgccgacaacgucgaccucaaggagcucggccgcaaggagaaggagaugcagauggagcuccgcgagaagauguccgaguacaagauggagaagcucgccuccgacaacaagcgcuccucccucuucaagaagaagaaggucaaggaggacgaggacgacggcgucggcgacggcgacgaggacaccgacuccgccaucggcuccuuccgcuacuccucccgcuccaacucccagaagcccgagaccgacaccugcuccucccucgccgucugcgaccacuacgccuccggcucccgcgucggcaaggagauggacuccuccaucaacaaguggcucuccggccuccgcaccgaggagaagccccccuuccaguccgacugguccggcuccucccgcggcaaguacacccgcuccucccuccuccgcgagaccgaguccaaguccuccuccuacaaguucuccaagucccaguccgaggagcaggacaccuccuccuaccacgaggccaacggcaacuccguccgcuccaccucccgcuucuccuccuccuccacccgcgagggccgcgagaugcacaaguucucccgcuccaccuacaacgagaccuccuccucccgcgaggagucccccgagcccuacuucuuccgccgcacccccgaguccuccgagcgcgaggagucccccgagccccagcgccccaacugggcccgcucccgcgacugggaggacgucgaggaguccuccaaguccgacuucuccgaguucggcgccaagcgcaaguucacccaguccuucaugcgcuccgaggaggagggcgagaaggagcgcaccgagaaccgcgaggagggccgcuucgccuccggccgccgcucccaguaccgccgcuccaccgaccgcgaggaggaggaggagauggacgacgaggccaucaucgccgccuggcgccgccgccaggaggagacccgcaccaagcuccagaagcgccgcgaggacuga

SEQ ID NO: 42488 - RNA, 531 nt, Artificial Sequence
  derived and/or modified sequence opt2 from DUSP28__Homo_sapiens__NP_001028747
augggccccgccgaggccggccgccgcggcgccgccucccccgucccccccccccucguccgcgucgcccccucccucuuccucggcuccgcccgcgccgccggcgccgaggagcagcucgcccgcgccggcgucacccucugcgucaacgucucccgccagcagcccggcccccgcgcccccggcgucgccgagcuccgcguccccgucuucgacgaccccgccgaggaccuccucgcccaccucgagcccaccugcgccgccauggaggccgccguccgcgccggcggcgccugccucgucuacugcaagaacggccgcucccgcuccgccgccgucugcaccgccuaccucaugcgccaccgcggccucucccucgccaaggccuuccagauggucaaguccgcccgccccgucgccgagcccaaccccggcuucuggucccagcuccagaaguacgaggaggcccuccaggcccaguccugccuccagggcgagccccccgcccucggccucggccccgaggccuga

SEQ ID NO: 42489 - RNA, 945 nt, Artificial Sequence
  derived and/or modified sequence opt2 from DUSP2__Homo_sapiens__NP_004409
augggccucgaggccgcccgcgagcucgagugcgccgcccucggcacccuccuccgcgacccccgcgaggccgagcgcacccuccuccucgacugccgccccuuccucgccuucugccgccgccacguccgcgccgcccgccccguccccuggaacgcccuccuccgccgccgcgcccgcggcccccccgccgccguccucgccugccuccuccccgaccgcgcccuccgcacccgccucguccgcggcgagcucgcccgcgccgucguccucgacgagggcuccgccuccgucgccgagcuccgccccgacucccccgcccacguccuccucgccgcccuccuccacgagacccgcgccggccccaccgccgucuacuuccuccgcggcggcuucgacggcuuccagggcugcugccccgaccucugcuccgaggcccccgcccccgcccucccccccaccggcgacaagaccucccgcuccgacucccgcgcccccgucuacgaccagggcggccccgucgagauccuccccuaccucuuccucggcuccugcucccacuccuccgaccuccagggccuccaggccugcggcaucaccgccguccucaacgucuccgccuccugccccaaccacuucgagggccucuuccgcuacaaguccauccccgucgaggacaaccagauggucgagaucuccgccugguuccaggaggccaucggcuucaucgacugggucaagaacuccggcggccgcguccucguccacugccaggccggcaucucccgcuccgccaccaucugccucgccuaccucaugcagucccgccgcguccgccucgacgaggccuucgacuucgucaagcagcgccgcggcgucaucucccccaacuucuccuucaugggccagcuccuccaguucgagacccagguccucugccacuga

SEQ ID NO: 42490 - RNA, 558 nt, Artificial Sequence
  derived and/or modified sequence opt2 from DUSP3__Homo_sapiens__NP_004081
auguccggcuccuucgagcucuccguccaggaccucaacgaccuccucuccgacggcuccggcugcuacucccuccccucccagcccugcaacgaggucaccccccgcaucuacgucggcaacgccuccgucgcccaggacauccccaagcuccagaagcucggcaucacccacguccucaacgccgccgagggccgcuccuucaugcacgucaacaccaacgccaacuucuacaaggacuccggcaucaccuaccucggcaucaaggccaacgacacccaggaguucaaccucuccgccuacuucgagcgcgccgccgacuucaucgaccaggcccucgcccagaagaacggccgcguccucguccacugccgcgagggcuacucccgcucccccacccucgucaucgccuaccucaugaugcgccagaagauggacgucaaguccgcccucuccaucguccgccagaaccgcgagaucggccccaacgacggcuuccucgcccagcucugccagcucaacgaccgccucgccaaggagggcaagcucaagcccuga

SEQ ID NO: 42491 - RNA, 1185 nt, Artificial Sequence
  derived and/or modified sequence opt2 from DUSP4__Homo_sapiens__NP_001385
auggucaccauggaggagcuccgcgagauggacugcuccguccucaagcgccucaugaaccgcgacgagaacggcggcggcgccggcggcuccggcucccacggcacccucggccuccccuccggcggcaagugccuccuccucgacugccgccccuuccucgcccacuccgccggcuacauccucggcuccgucaacguccgcugcaacaccaucguccgccgccgcgccaagggcuccgucucccucgagcagauccuccccgccgaggaggagguccgcgcccgccuccgcuccggccucuacuccgccgucaucgucuacgacgagcgcuccccccgcgccgagucccuccgcgaggacuccaccgucucccucgucguccaggcccuccgccgcaacgccgagcgcaccgacaucugccuccucaagggcggcuacgagcgcuucuccuccgaguaccccgaguucugcuccaagaccaaggcccucgccgccauccccccccccgucccccccuccgccaccgagccccucgaccucggcugcuccuccugcggcaccccccuccacgaccagggcggccccgucgagauccuccccuuccucuaccucggcuccgccuaccacgccgcccgccgcgacaugcucgacgcccucggcaucaccgcccuccucaacgucuccuccgacugccccaaccacuucgagggccacuaccaguacaagugcauccccgucgaggacaaccacaaggccgacaucuccuccugguucauggaggccaucgaguacaucgacgccgucaaggacugccgcggccgcguccucguccacugccaggccggcaucucccgcuccgccaccaucugccucgccuaccucaugaugaagaagcgcguccgccucgaggaggccuucgaguucgucaagcagcgccgcuccaucaucucccccaacuucuccuucaugggccagcuccuccaguucgagucccagguccucgccaccuccugcgccgccgaggccgccucccccuccggcccccuccgcgagcgcggcaagacccccgccacccccaccucccaguucgucuucuccuuccccgucuccgucggcguccacuccgcccccuccucccuccccuaccuccacucccccaucaccaccucccccuccugcuga

SEQ ID NO: 42492 - RNA, 1155 nt, Artificial Sequence
  derived and/or modified sequence opt2 from DUSP5__Homo_sapiens__NP_004410
augaaggucaccucccucgacggccgccagcuccgcaagaugcuccgcaaggaggccgccgcccgcugcgucguccucgacugccgccccuaccucgccuucgccgccuccaacguccgcggcucccucaacgucaaccucaacuccgucguccuccgccgcgcccgcggcggcgccgucuccgcccgcuacguccuccccgacgaggccgcccgcgcccgccuccuccaggagggcggcggcggcgucgccgccgucgucguccucgaccagggcucccgccacuggcagaagcuccgcgaggaguccgccgcccgcgucguccucaccucccuccucgccugccuccccgccggcccccgcgucuacuuccucaagggcggcuacgagaccuucuacuccgaguaccccgagugcugcgucgacgucaagcccaucucccaggagaagaucgaguccgagcgcgcccucaucucccagugcggcaagcccgucgucaacgucuccuaccgccccgccuacgaccagggcggccccgucgagauccuccccuuccucuaccucggcuccgccuaccacgccuccaagugcgaguuccucgccaaccuccacaucaccgcccuccucaacgucucccgccgcaccuccgaggccugcgccacccaccuccacuacaaguggauccccgucgaggacucccacaccgccgacaucuccucccacuuccaggaggccaucgacuucaucgacugcguccgcgagaagggcggcaagguccucguccacugcgaggccggcaucucccgcucccccaccaucugcauggccuaccucaugaagaccaagcaguuccgccucaaggaggccuucgacuacaucaagcagcgccgcuccauggucucccccaacuucggcuucaugggccagcuccuccaguacgaguccgagauccuccccuccacccccaacccccagccccccuccugccagggcgaggccgccggcuccucccucaucggccaccuccagacccucucccccgacaugcagggcgccuacugcaccuuccccgccuccguccucgcccccguccccacccacuccaccgucuccgagcucucccgcucccccgucgccaccgccaccuccugcuga

SEQ ID NO: 42493 - RNA, 1146 nt, Artificial Sequence
  derived and/or modified sequence opt2 from DUSP6__Homo_sapiens__NP_001937
augaucgacacccuccgccccguccccuucgccuccgagauggccaucuccaagaccgucgccuggcucaacgagcagcucgagcucggcaacgagcgccuccuccucauggacugccgcccccaggagcucuacgaguccucccacaucgaguccgccaucaacgucgccauccccggcaucaugcuccgccgccuccagaagggcaaccuccccguccgcgcccucuucacccgcggcgaggaccgcgaccgcuucacccgccgcugcggcaccgacaccgucguccucuacgacgaguccuccuccgacuggaacgagaacaccggcggcgaguccguccucggccuccuccucaagaagcucaaggacgagggcugccgcgccuucuaccucgagggcggcuucuccaaguuccaggccgaguucucccuccacugcgagaccaaccucgacggcuccugcuccuccuccucccccccccuccccguccucggccucggcggccuccgcaucuccuccgacuccuccuccgacaucgaguccgaccucgaccgcgaccccaacuccgccaccgacuccgacggcuccccccucuccaacucccagcccuccuuccccgucgagauccuccccuuccucuaccucggcugcgccaaggacuccaccaaccucgacguccucgaggaguucggcaucaaguacauccucaacgucacccccaaccuccccaaccucuucgagaacgccggcgaguucaaguacaagcagauccccaucuccgaccacuggucccagaaccucucccaguucuuccccgaggccaucuccuucaucgacgaggcccgcggcaagaacugcggcguccucguccacugccucgccggcaucucccgcuccgucaccgucaccgucgccuaccucaugcagaagcucaaccucuccaugaacgacgccuacgacaucgucaagaugaagaaguccaacaucucccccaacuucaacuucaugggccagcuccucgacuucgagcgcacccucggccucuccucccccugcgacaaccgcguccccgcccagcagcucuacuucaccacccccuccaaccagaacgucuaccaggucgacucccuccaguccaccuga

SEQ ID NO: 42494 - RNA, 1260 nt, Artificial Sequence
  derived and/or modified sequence opt2 from DUSP7__Homo_sapiens__NP_001938
augaagaaccagcuccgcggcccccccgcccgcgcccacauguccaccuccggcgccgccgccgccggcggcacccgcgccggcuccgagcccggcgccggcuccggcuccggcgccggcaccggcgccggcgccgccaccggcgccggcgccaugcccugcaaguccgccgaguggcuccaggaggagcucgaggcccgcggcggcgccucccuccuccuccucgacugccgcccccacgagcucuucgaguccucccacaucgagaccgccaucaaccucgccauccccggccucaugcuccgccgccuccgcaagggcaaccuccccauccgcuccaucauccccaaccacgccgacaaggagcgcuucgccacccgcugcaaggccgccaccguccuccucuacgacgaggccaccgccgaguggcagcccgagcccggcgcccccgccuccguccucggccuccuccuccagaagcuccgcgacgacggcugccaggccuacuaccuccagggcggcuucaacaaguuccagaccgaguacuccgagcacugcgagaccaacgucgacuccuccuccucccccuccuccuccccccccaccuccguccucggccucggcggccuccgcaucuccuccgacugcuccgacggcgaguccgaccgcgagcuccccuccuccgccaccgaguccgacggcucccccguccccuccucccagcccgccuuccccguccagauccuccccuaccucuaccucggcugcgccaaggacuccaccaaccucgacguccucggcaaguacggcaucaaguacauccucaacgucacccccaaccuccccaacgccuucgagcacggcggcgaguucaccuacaagcagauccccaucuccgaccacuggucccagaaccucucccaguucuuccccgaggccaucuccuucaucgacgaggcccgcuccaagaagugcggcguccucguccacugccucgccggcaucucccgcuccgucaccgucaccgucgccuaccucaugcagaagaugaaccucucccucaacgacgccuacgacuucgucaagcgcaagaaguccaacaucucccccaacuucaacuucaugggccagcuccucgacuucgagcgcacccucggccucuccucccccugcgacaaccacgccuccuccgagcagcucuacuucuccacccccaccaaccacaaccucuucccccucaacacccucgaguccaccuga

SEQ ID NO: 42495 - RNA, 1878 nt, Artificial Sequence
  derived and/or modified sequence opt2 from DUSP8__Homo_sapiens__XP_011518235
auggccggcgaccgccucccccgcaaggucauggacgccaagaagcucgccucccuccuccgcggcggccccggcggcccccucgucaucgacucccgcuccuucgucgaguacaacuccuggcacguccucuccuccgucaacaucugcugcuccaagcucgucaagcgccgccuccagcagggcaaggucaccaucgccgagcucauccagcccgccgcccgcucccaggucgaggccaccgagccccaggacgucgucgucuacgaccaguccacccgcgacgccuccguccucgccgccgacuccuuccucuccauccuccucuccaagcucgacggcugcuucgacuccgucgccauccucaccggcggcuucgccaccuucuccuccugcuuccccggccucugcgagggcaagcccgccgcccuccuccccaugucccucucccagcccugccuccccguccccuccgucggccucacccgcauccucccccaccucuaccucggcucccagaaggacguccucaacaaggaccucaugacccagaacggcaucuccuacguccucaacgccuccaacuccugccccaagcccgacuucaucugcgagucccgcuucaugcgcguccccaucaacgacaacuacugcgagaagcuccuccccuggcucgacaaguccaucgaguucaucgacaaggccaagcucuccuccugccaggucaucguccacugccucgccggcaucucccgcuccgccaccaucgccaucgccuacaucaugaagaccaugggcauguccuccgacgacgccuaccgcuucgucaaggaccgccgccccuccaucucccccaacuucaacuuccucggccagcuccucgaguacgagcgcucccucaagcuccucgccgcccuccagggcgaccccggcacccccuccggcacccccgagcccccccccucccccgccgccggcgccccccucccccgccuccccccccccaccuccgaguccgccgccaccggcaacgccgccgcccgcgagggcggccucuccgccggcggcgagccccccgccccccccaccccccccgccaccuccgcccuccagcagggccuccgcggccuccaccucuccuccgaccgccuccaggacaccaaccgccucaagcgcuccuucucccucgacaucaaguccgccuacgcccccucccgccgccccgacggccccggcccccccgaccccggcgaggcccccaagcucugcaagcucgacucccccuccggcgccgcccucggccucuccucccccucccccgacucccccgacgccgcccccgaggcccgcccccgcccccgccgccgcccccgcccccccgccggcucccccgcccgcucccccgcccacucccucggccucaacuucggcgacgccgcccgccagaccccccgccacggccucuccgcccucuccgcccccggccuccccggccccggccagcccgccggccccggcgccugggcccccccccucgacucccccggcacccccucccccgacggccccuggugcuucucccccgagggcgcccagggcgccggcggcguccucuucgcccccuucggccgcgccggcgcccccggccccggcggcggcuccgaccuccgccgccgcgaggccgcccgcgccgagccccgcgacgcccgcaccggcuggcccgaggagcccgcccccgagacccaguucaagcgccgcuccugccagauggaguucgaggagggcauggucgagggccgcgcccgcggcgaggagcucgccgcccucggcaagcaggccuccuucuccggcuccgucgaggucaucgaggucuccuga

SEQ ID NO: 42496 - RNA, 1248 nt, Artificial Sequence
  derived and/or modified sequence opt2 from DUSP9__Homo_sapiens__XP_011529425
auggaggccgcccaggucggccccaagggccgccagcuccccggcaagcacgucgucgcccccgucguccagcgcgucggcucccgcucccccauggagggccucggccgcuccugccucuggcuccgccgcgagcucucccccccccgcccccgccuccuccuccucgacugccgcucccgcgagcucuacgaguccgcccgcaucggcggcgcccucuccgucgcccuccccgcccuccuccuccgccgccuccgccgcggcucccucuccguccgcgcccuccuccccggccccccccuccagccccccccccccgcccccguccuccucuacgaccagggcggcggccgccgccgccgcggcgaggccgaggccgaggccgaggagugggaggccgaguccguccucggcacccuccuccagaagcuccgcgaggagggcuaccucgccuacuaccuccagggcggcuucucccgcuuccaggccgagugcccccaccucugcgagaccucccucgccggccgcgccggcuccuccauggcccccguccccggccccguccccgucgucggccucggcucccucugccucggcuccgacugcuccgacgccgaguccgaggccgaccgcgacuccauguccugcggccucgacuccgagggcgccacccccccccccgucggccuccgcgccuccuuccccguccagauccuccccaaccucuaccucggcuccgcccgcgacuccgccaaccucgagucccucgccaagcucggcauccgcuacauccucaacgucacccccaaccuccccaacuucuucgagaagaacggcgacuuccacuacaagcagauccccaucuccgaccacuggucccagaaccucucccgcuucuuccccgaggccaucgaguucaucgacgaggcccucucccagaacugcggcguccucguccacugccucgccggcgucucccgcuccgucaccgucaccgucgccuaccucaugcagaagcuccaccucucccucaacgacgccuacgaccucgucaagcgcaagaaguccaacaucucccccaacuucaacuucaugggccagcuccucgacuucgagcgcucccuccgccucgaggagcgccacucccaggagcagggcuccggcggccaggccuccgccgccuccaacccccccuccuucuucaccacccccaccuccgacggcgccuucgagcucgcccccaccuga

SEQ ID NO: 42497 - RNA, 759 nt, Artificial Sequence
  derived and/or modified sequence opt2 from DUT__Homo_sapiens__NP_001020419
augaccccccucugcccccgccccgcccucugcuaccacuuccucaccucccuccuccgcuccgccaugcagaacgcccgcggcgcccgccagcgcgccgaggccgccguccucuccggccccggccccccccucggccgcgccgcccagcacggcaucccccgcccccucuccuccgccggccgccucucccagggcugccgcggcgccuccaccgucggcgccgccggcuggaagggcgagcuccccaaggccggcggcucccccgcccccggccccgagacccccgccaucucccccuccaagcgcgcccgccccgccgaggucggcggcaugcagcuccgcuucgcccgccucuccgagcacgccaccgcccccacccgcggcuccgcccgcgccgccggcuacgaccucuacuccgccuacgacuacaccaucccccccauggagaaggccgucgucaagaccgacauccagaucgcccuccccuccggcugcuacggccgcgucgccccccgcuccggccucgccgccaagcacuucaucgacgucggcgccggcgucaucgacgaggacuaccgcggcaacgucggcgucguccucuucaacuucggcaaggagaaguucgaggucaagaagggcgaccgcaucgcccagcucaucugcgagcgcaucuucuaccccgagaucgaggagguccaggcccucgacgacaccgagcgcggcuccggcggcuucggcuccaccggcaagaacuga

SEQ ID NO: 42498 - RNA, 483 nt, Artificial Sequence
  derived and/or modified sequence opt2 from DUX4__Homo_sapiens__XP_011529816
auggcccuccccacccccuccgacuccacccuccccgccgaggcccgcggccgcggccgccgccgccgccucgucuggacccccucccaguccgaggcccuccgcgccugcuucgagcgcaaccccuaccccggcaucgccacccgcgagcgccucgcccaggccaucggcauccccgagccccgcguccagaucugguuccagaacgagcgcucccgccagcuccgccagcaccgccgcgagucccgccccuggcccggccgccgcggcccccccgagggccgccgcaagcgcaccgccgucaccggcucccagaccgcccuccuccuccgcgccuucgagaaggaccgcuuccccggcaucgccgcccgcgaggagcucgcccgcgagaccggccuccccgagucccgcauccagaucugguuccagaaccgccgcgcccgccaccccggccagggcggccgcgcccccgcccaggucuga

SEQ ID NO: 42499 - RNA, 2211 nt, Artificial Sequence
  derived and/or modified sequence opt2 from DVL2__Homo_sapiens__NP_004413
auggccggcuccuccaccggcggcggcggcgucggcgagaccaaggucaucuaccaccucgacgaggaggagacccccuaccucgucaagauccccguccccgccgagcgcaucacccucggcgacuucaaguccguccuccagcgccccgccggcgccaaguacuucuucaaguccauggaccaggacuucggcgucgucaaggaggagaucuccgacgacaacgcccgccuccccugcuucaacggccgcgucgucuccuggcucgucuccuccgacaacccccagcccgagauggccccccccguccacgagccccgcgccgagcucgccccccccgcccccccccuccccccccucccccccgagcgcaccuccggcaucggcgacucccgcccccccuccuuccaccccaacgucuccuccucccacgagaaccucgagcccgagaccgagaccgaguccgucgucucccuccgccgcgagcgcccccgccgccgcgacuccuccgagcacggcgccggcggccaccgcaccggcggccccucccgccucgagcgccaccucgccggcuacgaguccuccuccacccucaugaccuccgagcucgaguccaccucccucggcgacuccgacgaggaggacaccaugucccgcuucuccuccuccaccgagcaguccuccgccucccgccuccucaagcgccaccgccgccgccgcaagcagcgccccccccgccucgagcgcaccuccuccuucuccuccgucaccgacuccaccaugucccucaacaucaucaccgucacccucaacauggagaaguacaacuuccucggcaucuccaucgucggccaguccaacgagcgcggcgacggcggcaucuacaucggcuccaucaugaagggcggcgccgucgccgccgacggccgcaucgagcccggcgacaugcuccuccaggucaacgacaugaacuucgagaacauguccaacgacgacgccguccgcguccuccgcgacaucguccacaagcccggccccaucguccucaccgucgccaagugcugggaccccuccccccaggccuacuucacccucccccgcaacgagcccauccagcccaucgaccccgccgccugggucucccacuccgccgcccucaccggcaccuuccccgccuaccccggcuccuccuccauguccaccaucaccuccggcuccucccuccccgacggcugcgagggccgcggccucuccguccacaccgacauggccuccgucaccaaggccauggccgcccccgaguccggccucgagguccgcgaccgcauguggcucaagaucaccauccccaacgccuuccucggcuccgacgucgucgacuggcucuaccaccacgucgagggcuuccccgagcgccgcgaggcccgcaaguacgccuccggccuccucaaggccggccucauccgccacaccgucaacaagaucaccuucuccgagcagugcuacuacgucuucggcgaccucuccggcggcugcgaguccuaccucgucaaccucucccucaacgacaacgacggcuccuccggcgccuccgaccaggacacccucgccccccuccccggcgccacccccuggccccuccuccccaccuucuccuaccaguaccccgccccccaccccuacuccccccagcccccccccuaccacgagcucuccuccuacaccuacggcggcggcuccgccuccucccagcacuccgagggcucccgcuccuccggcuccacccgcuccgacggcggcgccggccgcaccggccgccccgaggagcgcgcccccgaguccaaguccggcuccggcuccgaguccgagcccuccucccgcggcggcucccuccgccgcggcggcgaggccuccggcaccuccgacggcggccccccccccucccgcggcuccaccggcggcgcccccaaccuccgcgcccaccccggccuccaccccuacggccccccccccggcauggcccuccccuacaaccccaugauggucgucaugaugccccccccccccccccccgucccccccgccguccagccccccggcgccccccccguccgcgaccucggcuccgucccccccgagcucaccgccucccgccaguccuuccacauggccaugggcaaccccuccgaguucuucgucgacgucauguga

SEQ ID NO: 42500 - RNA, 2151 nt, Artificial Sequence
  derived and/or modified sequence opt2 from DVL3__Homo_sapiens__NP_004414
augggcgagaccaagaucaucuaccaccucgacggccaggagacccccuaccucgucaagcucccccuccccgccgagcgcgucacccucgccgacuucaagggcguccuccagcgccccuccuacaaguucuucuucaaguccauggacgacgacuucggcgucgucaaggaggagaucuccgacgacaacgccaagcuccccugcuucaacggccgcgucgucuccuggcucgucuccgccgagggcucccaccccgaccccgcccccuucugcgccgacaaccccuccgagcuccccccccccauggagcgcaccggcggcaucggcgacucccgcccccccuccuuccacccccacgccggcggcggcucccaggagaaccucgacaacgacaccgagaccgacucccucgucuccgcccagcgcgagcgcccccgccgccgcgacggccccgagcacgccacccgccucaacggcaccgccaagggcgagcgccgccgcgagcccggcggcuacgacuccuccuccacccucauguccuccgagcucgagaccaccuccuucuucgacuccgacgaggacgacuccaccucccgcuucuccuccuccaccgagcaguccuccgccucccgccucaugcgccgccacaagcgccgccgccgcaagcagaaggucucccgcaucgagcgcuccuccuccuucuccuccaucaccgacuccaccaugucccucaacaucaucaccgucacccucaacauggagaaguacaacuuccucggcaucuccaucgucggccaguccaacgagcgcggcgacggcggcaucuacaucggcuccaucaugaagggcggcgccgucgccgccgacggccgcaucgagcccggcgacaugcuccuccaggucaacgagaucaacuucgagaacauguccaacgacgacgccguccgcguccuccgcgagaucguccacaagcccggccccaucacccucaccgucgccaagugcugggaccccuccccccgcggcugcuucacccucccccgcuccgagcccauccgccccaucgaccccgccgccugggucucccacaccgccgccaugaccggcaccuuccccgccuacggcaugucccccucccucuccaccaucaccuccaccuccuccuccaucaccuccuccauccccgacaccgagcgccucgacgacuuccaccucuccauccacuccgacauggccgccaucgucaaggccauggccucccccgaguccggccucgagguccgcgaccgcauguggcucaagaucaccauccccaacgccuucaucggcuccgacgucgucgacuggcucuaccacaacgucgagggcuucaccgaccgccgcgaggcccgcaaguacgccuccaaccuccucaaggccggcuucauccgccacaccgucaacaagaucaccuucuccgagcagugcuacuacaucuucggcgaccucugcggcaacauggccaaccucucccuccacgaccacgacggcuccuccggcgccuccgaccaggacacccucgccccccucccccaccccggcgccgcccccuggcccauggccuuccccuaccaguaccccccccccccccaccccuacaacccccaccccggcuuccccgagcucggcuacuccuacggcggcggcuccgccuccucccagcacuccgagggcucccgcuccuccggcuccaaccgcuccggcuccgaccgccgcaaggagaaggaccccaaggccggcgacuccaaguccggcggcuccggcuccgaguccgaccacaccacccgcuccucccuccgcggcccccgcgagcgcgcccccuccgagcgcuccggccccgccgccuccgagcacucccaccgcucccaccacucccucgccuccucccuccgcucccaccacacccaccccuccuacggcccccccggcguccccccccucuacggcccccccaugcucaugaugccccccccccccgccgccaugggcccccccggcgccccccccggccgcgaccucgccuccgucccccccgagcucaccgccucccgccaguccuuccgcauggccaugggcaaccccuccgaguucuucgucgacgucauguga

SEQ ID NO: 42501 - RNA, 1191 nt, Artificial Sequence
  derived and/or modified sequence opt2 from DXO__Homo_sapiens__XP_006715068
auggacccccgcggcaccaagcgcggcgccgagaagaccgaggucgccgagccccgcaacaagcucccccgccccgcccccucccuccccaccgaccccgcccucuacuccggccccuuccccuucuaccgccgccccuccgagcucggcugcuucucccucgacgcccagcgccaguaccacggcgacgcccgcgcccuccgcuacuacucccccccccccaccaacggccccggccccaacuucgaccuccgcgacggcuaccccgaccgcuaccagccccgcgacgaggagguccaggagcgccucgaccaccuccucugcuggcuccucgagcaccgcggccgccucgagggcggccccggcuggcucgccgaggccaucgucaccuggcgcggccaccucaccaagcuccucaccacccccuacgagcgccaggagggcuggcagcucgccgccucccgcuuccagggcacccucuaccucuccgaggucgagacccccaacgcccgcgcccagcgccucgcccgccccccccuccuccgcgagcucauguacaugggcuacaaguucgagcaguacaugugcgccgacaagcccggcuccucccccgaccccuccggcgaggucaacaccaacgucgccuucugcuccguccuccgcucccgccucggcucccacccccuccucuucuccggcgaggucgacugcaccgacccccaggcccccuccacccagccccccaccugcuacgucgagcucaagaccuccaaggagaugcacucccccggccaguggcgcuccuucuaccgccacaagcuccucaaguggugggcccaguccuuccuccccggcguccccaacgucgucgccggcuuccgcaaccccgacggcuucgucuccucccucaagaccuuccccaccaugaagauguucgaguacguccgcaacgaccgcgacggcuggaaccccuccgucugcaugaacuucugcgccgccuuccucuccuucgcccaguccaccgucguccaggacgacccccgccucguccaccucuucuccugggagcccggcggccccgucaccgucuccguccaccaggacgcccccuacgccuuccuccccaucugguacgucgaggccaugacccaggaccuccccuccccccccaagacccccucccccaaguga

SEQ ID NO: 42502 - RNA, 2010 nt, Artificial Sequence
  derived and/or modified sequence opt2 from DYM__Homo_sapiens__NP_060123
augggcuccaacuccucccgcaucggcgaccuccccaagaacgaguaccucaagaagcucuccggcaccgaguccaucuccgagaacgaccccuucuggaaccagcuccucuccuucuccuuccccgcccccaccuccuccuccgagcucaagcuccucgaggaggccaccaucuccgucugccgcucccucgucgagaacaacccccgcaccggcaaccucggcgcccucaucaaggucuuccucucccgcaccaaggagcucaagcucuccgccgagugccagaaccacaucuucaucuggcagacccacaacgcccucuucaucaucugcugccuccucaaggucuucaucugccagauguccgaggaggagcuccagcuccacuucaccuacgaggagaagucccccggcaacuacuccuccgacuccgaggaccuccucgaggagcuccucugcugccucaugcagcucaucaccgacaucccccuccucgacaucaccuacgagaucuccgucgaggccaucuccaccauggucgucuuccucuccugccagcucuuccacaaggagguccuccgccaguccaucucccacaaguaccucaugcgcggccccugccuccccuacaccuccaagcucgucaagacccuccucuacaacuucauccgccaggagaagccccccccccccggcgcccacgucuucccccagcaguccgacggcggcggccuccucuacggccucgccuccggcgucgccaccggccucuggaccgucuucacccucggcggcgucggcuccaaggccgccgccucccccgagcucuccuccccccucgccaaccagucccuccuccuccuccucguccucgccaaccucaccgacgccuccgacgcccccaaccccuaccgccaggccaucauguccuucaagaacacccaggacuccucccccuuccccuccuccaucccccacgccuuccagaucaacuucaacucccucuacaccgcccucugcgagcagcagaccuccgaccaggccacccuccuccucuacacccuccuccaccagaacuccaacauccgcaccuacaugcucgcccgcaccgacauggagaaccucguccuccccauccucgagauccucuaccacgucgaggagcgcaacucccaccacgucuacauggcccucaucauccuccucauccucaccgaggacgacggcuucaaccgcuccauccacgaggucauccucaagaacaucaccugguacuccgagcgcguccucaccgagaucucccucggcucccuccucauccucgucgucauccgcaccauccaguacaacaugacccgcacccgcgacaaguaccuccacaccaacugccucgccgcccucgccaacauguccgcccaguuccgcucccuccaccaguacgccgcccagcgcaucaucucccucuucucccuccucuccaagaagcacaacaagguccucgagcaggccacccagucccuccgcggcucccucuccuccaacgacgucccccuccccgacuacgcccaggaccucaacgucaucgaggaggucauccgcaugaugcucgagaucaucaacuccugccucaccaacucccuccaccacaaccccaaccucgucuacgcccuccucuacaagcgcgaccucuucgagcaguuccgcacccaccccuccuuccaggacaucaugcagaacaucgaccucgucaucuccuucuucuccucccgccuccuccaggccggcgccgagcucuccgucgagcgcguccucgagaucaucaagcagggcgucgucgcccuccccaaggaccgccucaagaaguuccccgagcucaaguucaaguacgucgaggaggagcagcccgaggaguucuucauccccuacgucuggucccucgucuacaacuccgccgucggccucuacuggaacccccaggacauccagcucuucaccauggacuccgacuga

SEQ ID NO: 42503 - RNA, 633 nt, Artificial Sequence
  derived and/or modified sequence opt2 from DYNAP__Homo_sapiens__NP_775900
auggucgccgacaucaagggcaacgagcagaucgagaaguacuccuggcgcgaggccugcgacaccggcuccucccgcauggaccgcaagcacggcaaguacauccucaacgucgagcacuccgagaaccagccccccaucacccaccccaacgaccaggaggcccacuccuccaucugcuggugccuccccuccaacgacaucaccuccgacgucucccccaaccucaccggcgucugcgucaaccccggcauccucgcccacucccgcugccuccaguccgaguccugcaacacccaggucaaggaguacugccgcaacgacugguccauguggaaggucuuccucgccugccuccucgccugcgucaucaugaccgccaucggcguccucaucaucugccucgucaacaacaagggcuccgccaacuccuccaucgucauccagcucuccaccaacgacggcgagugcgucaccgucaagcccggcacccccucccccgccugcccccccaccaugaccaccaccuccaccguccccgccuccaccgccaccgaguccaccaccuccaccgccaccgccgccaccaccuccaccgagcccaucaccgucgcccccaccgaccaccucuga

SEQ ID NO: 42504 - RNA, 13941 nt, Artificial Sequence
  derived and/or modified sequence opt2 from DYNC1H1__Homo_sapiens__NP_001367
auguccgagcccggcggcggcggcggcgaggacggcuccgccggccucgaggucuccgccguccagaacgucgccgacgucuccguccuccagaagcaccuccgcaagcucgucccccuccuccucgaggacggcggcgaggcccccgccgcccucgaggccgcccucgaggagaaguccgcccucgagcagaugcgcaaguuccucuccgacccccagguccacaccguccucgucgagcgcuccacccucaaggaggacgucggcgacgagggcgaggaggagaaggaguucaucuccuacaacaucaacaucgacauccacuacggcgucaaguccaacucccucgccuucaucaagcgcacccccgucaucgacgccgacaagcccgucuccucccagcuccgcguccucacccucuccgaggacucccccuacgagacccuccacuccuucaucuccaacgccgucgcccccuucuucaaguccuacauccgcgaguccggcaaggccgaccgcgacggcgacaagauggcccccuccgucgagaagaagaucgccgagcucgagaugggccuccuccaccuccagcagaacaucgagauccccgagaucucccuccccauccaccccaugaucaccaacgucgccaagcagugcuacgagcgcggcgagaagcccaaggucaccgacuucggcgacaaggucgaggaccccaccuuccucaaccagcuccaguccggcgucaaccgcuggauccgcgagauccagaaggucaccaagcucgaccgcgaccccgccuccggcaccgcccuccaggagaucuccuucuggcucaaccucgagcgcgcccucuaccgcauccaggagaagcgcgagucccccgagguccuccucacccucgacauccucaagcacggcaagcgcuuccacgccaccgucuccuucgacaccgacaccggccucaagcaggcccucgagaccgucaacgacuacaacccccucaugaaggacuucccccucaacgaccuccucuccgccaccgagcucgacaagauccgccaggcccucgucgccaucuucacccaccuccgcaagauccgcaacaccaaguaccccauccagcgcgcccuccgccucgucgaggccaucucccgcgaccucuccucccagcuccucaagguccucggcacccgcaagcucaugcacgucgccuacgaggaguucgagaaggucauggucgccugcuucgaggucuuccagaccugggacgacgaguacgagaagcuccagguccuccuccgcgacaucgucaagcgcaagcgcgaggagaaccucaagauggucuggcgcaucaaccccgcccaccgcaagcuccaggcccgccucgaccagaugcgcaaguuccgccgccagcacgagcagcuccgcgccgucaucguccgcguccuccgcccccaggucaccgccgucgcccagcagaaccagggcgagguccccgagccccaggacaugaaggucgccgagguccucuucgacgccgccgacgccaacgccaucgaggaggucaaccucgccuacgagaacgucaaggaggucgacggccucgacgucuccaaggagggcaccgaggccugggaggccgccaugaagcgcuacgacgagcgcaucgaccgcgucgagacccgcaucaccgcccgccuccgcgaccagcucggcaccgccaagaacgccaacgagauguuccgcaucuucucccgcuucaacgcccucuucguccgcccccacauccgcggcgccauccgcgaguaccagacccagcucauccagcgcgucaaggacgacaucgagucccuccacgacaaguucaagguccaguacccccagucccaggccugcaagaugucccacguccgcgaccucccccccgucuccggcuccaucaucugggccaagcagaucgaccgccagcucaccgccuacaugaagcgcgucgaggacguccucggcaagggcugggagaaccacgucgagggccagaagcucaagcaggacggcgacuccuuccgcaugaagcucaacacccaggagaucuucgacgacugggcccgcaagguccagcagcgcaaccucggcgucuccggccgcaucuucaccaucgaguccacccgcguccgcggccgcaccggcaacguccucaagcucaaggucaacuuccuccccgagaucaucacccucuccaaggagguccgcaaccucaaguggcucggcuuccgcgucccccucgccaucgucaacaaggcccaccaggccaaccagcucuaccccuucgccaucucccucaucgaguccguccgcaccuacgagcgcaccugcgagaaggucgaggagcgcaacaccaucucccuccucgucgccggccucaagaaggagguccaggcccucaucgccgagggcaucgcccucgucugggaguccuacaagcucgaccccuacguccagcgccucgccgagaccgucuucaacuuccaggagaaggucgacgaccuccucaucaucgaggagaagaucgaccucgagguccgcucccucgagaccugcauguacgaccacaagaccuucuccgagauccucaaccgcguccagaaggccgucgacgaccucaaccuccacuccuacuccaaccuccccaucugggucaacaagcucgacauggagaucgagcgcauccucggcguccgccuccaggccggccuccgcgccuggacccagguccuccucggccaggccgaggacaaggccgaggucgacauggacaccgacgccccccaggucucccacaagcccggcggcgagcccaagaucaagaacgucguccacgagcuccgcaucaccaaccaggucaucuaccucaacccccccaucgaggagugccgcuacaagcucuaccaggagauguucgccuggaagauggucguccucucccucccccgcauccagucccagcgcuaccaggucggcguccacuacgagcucaccgaggaggagaaguucuaccgcaacgcccucacccgcaugcccgacggccccgucgcccucgaggaguccuacuccgccgucaugggcaucgucuccgaggucgagcaguacgucaaggucuggcuccaguaccagugccucugggacaugcaggccgagaacaucuacaaccgccucggcgaggaccucaacaaguggcaggcccuccucguccagauccgcaaggcccgcggcaccuucgacaacgccgagaccaagaaggaguucggccccgucgucaucgacuacggcaagguccaguccaaggucaaccucaaguacgacuccuggcacaaggagguccucuccaaguucggccagaugcucggcuccaacaugaccgaguuccacucccagaucuccaagucccgccaggagcucgagcagcacuccgucgacaccgccuccaccuccgacgccgucaccuucaucaccuacguccagucccucaagcgcaagaucaagcaguucgagaagcaggucgagcucuaccgcaacggccagcgccuccucgagaagcagcgcuuccaguucccccccuccuggcucuacaucgacaacaucgagggcgaguggggcgccuucaacgacaucaugcgccgcaaggacuccgccauccagcagcaggucgccaaccuccagaugaagaucguccaggaggaccgcgccgucgagucccgcaccaccgaccuccucaccgacugggagaagaccaagcccgucaccggcaaccuccgccccgaggaggcccuccaggcccucaccaucuacgagggcaaguucggccgccucaaggacgaccgcgagaagugcgccaaggccaaggaggcccucgagcucaccgacaccggccuccucuccggcuccgaggagcgcguccaggucgcccucgaggagcuccaggaccucaagggcgucugguccgagcucuccaaggucugggagcagaucgaccagaugaaggagcagcccugggucuccguccagccccgcaagcuccgccagaaccucgacgcccuccucaaccagcucaaguccuuccccgcccgccuccgccaguacgccuccuacgaguucguccagcgccuccucaagggcuacaugaagaucaacaugcucgucaucgagcucaaguccgaggcccucaaggaccgccacuggaagcagcucaugaagcgccuccacgucaacugggucgucuccgagcucacccucggccagaucugggacgucgaccuccagaagaacgaggccaucgucaaggacguccuccucgucgcccagggcgagauggcccucgaggaguuccucaagcagauccgcgaggucuggaacaccuacgagcucgaccucgucaacuaccagaacaagugccgccucauccgcggcugggacgaccucuucaacaaggucaaggagcacaucaacuccgucuccgccaugaagcucucccccuacuacaaggucuucgaggaggacgcccucuccugggaggacaagcucaaccgcaucauggcccucuucgacgucuggaucgacguccagcgccgcugggucuaccucgagggcaucuucaccggcuccgccgacaucaagcaccuccuccccgucgagacccagcgcuuccaguccaucuccaccgaguuccucgcccucaugaagaaggucuccaaguccccccucgucauggacguccucaacauccagggcguccagcgcucccucgagcgccucgccgaccuccucggcaagauccagaaggcccucggcgaguaccucgagcgcgagcgcuccuccuucccccgcuucuacuucgucggcgacgaggaccuccucgagaucaucggcaacuccaagaacgucgccaagcuccagaagcacuucaagaagauguucgccggcgucuccuccaucauccucaacgaggacaacuccgucguccucggcaucuccucccgcgagggcgaggaggucauguucaagacccccgucuccaucaccgagcaccccaagaucaacgaguggcucacccucgucgagaaggagaugcgcgucacccucgccaagcuccucgccgaguccgucaccgaggucgagaucuucggcaaggccaccuccaucgaccccaacaccuacaucaccuggaucgacaaguaccaggcccagcucgucguccucuccgcccagaucgccugguccgagaacgucgagaccgcccucuccuccaugggcggcggcggcgacgccgccccccuccacuccguccucuccaacgucgaggucacccucaacguccucgccgacuccguccucauggagcagcccccccuccgccgccgcaagcucgagcaccucaucaccgagcucguccaccagcgcgacgucacccgcucccucaucaaguccaagaucgacaacgccaaguccuucgaguggcucucccagaugcgcuucuacuucgaccccaagcagaccgacguccuccagcagcucuccauccagauggccaacgccaaguucaacuacggcuucgaguaccucggcguccaggacaagcucguccagaccccccucaccgaccgcugcuaccucaccaugacccaggcccucgaggcccgccucggcggcucccccuucggccccgccggcaccggcaagaccgaguccgucaaggcccucggccaccagcucggccgcuucguccucgucuucaacugcgacgagaccuucgacuuccaggccaugggccgcaucuucgucggccucugccaggucggcgccuggggcugcuucgacgaguucaaccgccucgaggagcgcaugcucuccgccgucucccagcagguccagugcauccaggaggcccuccgcgagcacuccaaccccaacuacgacaagaccuccgcccccaucaccugcgagcuccucaacaagcaggucaaggucucccccgacauggccaucuucaucaccaugaaccccggcuacgccggccgcuccaaccuccccgacaaccucaagaagcucuuccgcucccucgccaugaccaagcccgaccgccagcucaucgcccaggucaugcucuacucccagggcuuccgcaccgccgagguccucgccaacaagaucguccccuucuucaagcucugcgacgagcagcucuccucccagucccacuacgacuucggccuccgcgcccucaaguccguccucgucuccgccggcaacgucaagcgcgagcgcauccagaagaucaagcgcgagaaggaggagcgcggcgaggccgucgacgagggcgagaucgccgagaaccuccccgagcaggagauccucauccaguccgucugcgagaccaugguccccaagcucgucgccgaggacaucccccuccucuucucccuccucuccgacgucuuccccggcguccaguaccaccgcggcgagaugaccgcccuccgcgaggagcucaagaaggucugccaggagauguaccucaccuacggcgacggcgaggaggucggcggcaugugggucgagaagguccuccagcucuaccagaucacccagaucaaccacggccucaugauggucggccccuccggcuccggcaaguccauggccuggcgcguccuccucaaggcccucgagcgccucgagggcgucgagggcgucgcccacaucaucgaccccaaggccaucuccaaggaccaccucuacggcacccucgaccccaacacccgcgaguggaccgacggccucuucacccacguccuccgcaagaucaucgacuccguccgcggcgagcuccagaagcgccaguggaucgucuucgacggcgacgucgaccccgagugggucgagaaccucaacuccguccucgacgacaacaagcuccucacccuccccaacggcgagcgccucucccucccccccaacguccgcaucauguucgagguccaggaccucaaguacgccacccucgccaccgucucccgcugcggcauggucugguucuccgaggacguccucuccaccgacaugaucuucaacaacuuccucgcccgccuccgcuccaucccccucgacgagggcgaggacgaggcccagcgccgccgcaagggcaaggaggacgagggcgaggaggccgccucccccaugcuccagauccagcgcgacgccgccaccaucaugcagcccuacuucaccuccaacggccucgucaccaaggcccucgagcacgccuuccagcucgagcacaucauggaccucacccgccuccgcugccucggcucccucuucuccaugcuccaccaggccugccgcaacgucgcccaguacaacgccaaccaccccgacuuccccaugcagaucgagcagcucgagcgcuacauccagcgcuaccucgucuacgccauccucuggucccucuccggcgacucccgccucaagaugcgcgccgagcucggcgaguacauccgccgcaucaccaccgucccccuccccaccgcccccaacauccccaucaucgacuacgaggucuccaucuccggcgaguggucccccuggcaggccaaggucccccagaucgaggucgagacccacaaggucgccgcccccgacgucgucguccccacccucgacaccguccgccacgaggcccuccucuacaccuggcucgccgagcacaagccccucguccucugcggcccccccggcuccggcaagaccaugacccucuucuccgcccuccgcgcccuccccgacauggaggucgucggccucaacuucuccuccgccaccacccccgagcuccuccucaagaccuucgaccacuacugcgaguaccgccgcacccccaacggcgucguccucgcccccguccagcucggcaaguggcucguccucuucugcgacgagaucaaccuccccgacauggacaaguacggcacccagcgcgucaucuccuucauccgccagauggucgagcacggcggcuucuaccgcaccuccgaccagaccugggucaagcucgagcgcauccaguucgucggcgccugcaacccccccaccgaccccggccgcaagccccucucccaccgcuuccuccgccacguccccgucgucuacgucgacuaccccggccccgccucccucacccagaucuacggcaccuucaaccgcgccaugcuccgccucauccccucccuccgcaccuacgccgagccccucaccgccgccauggucgaguucuacaccaugucccaggagcgcuucacccaggacacccagccccacuacaucuacuccccccgcgagaugacccgcuggguccgcggcaucuucgaggcccuccgcccccucgagacccuccccgucgagggccucauccgcaucugggcccacgaggcccuccgccucuuccaggaccgccucgucgaggacgaggagcgccgcuggaccgacgagaacaucgacaccgucgcccucaagcacuuccccaacaucgaccgcgagaaggccaugucccgccccauccucuacuccaacuggcucuccaaggacuacauccccgucgaccaggaggagcuccgcgacuacgucaaggcccgccucaaggucuucuacgaggaggagcucgacgucccccucguccucuucaacgagguccucgaccacguccuccgcaucgaccgcaucuuccgccagccccagggccaccuccuccucaucggcgucuccggcgccggcaagaccacccucucccgcuucgucgccuggaugaacggccucuccgucuaccagaucaagguccaccgcaaguacaccggcgaggacuucgacgaggaccuccgcaccguccuccgccgcuccggcugcaagaacgagaagaucgccuucaucauggacgaguccaacguccucgacuccggcuuccucgagcgcaugaacacccuccucgccaacggcgagguccccggccucuucgagggcgacgaguacgccacccucaugacccagugcaaggagggcgcccagaaggagggccucaugcucgacucccacgaggagcucuacaagugguucaccucccaggucauccgcaaccuccacgucgucuucaccaugaaccccuccuccgagggccucaaggaccgcgccgccaccucccccgcccucuucaaccgcugcguccucaacugguucggcgacugguccaccgaggcccucuaccaggucggcaaggaguucaccuccaagauggaccucgagaagcccaacuacaucguccccgacuacaugcccgucgucuacgacaagcucccccagccccccucccaccgcgaggccaucgucaacuccugcgucuucguccaccagacccuccaccaggccaacgcccgccucgccaagcgcggcggccgcaccauggccaucaccccccgccacuaccucgacuucaucaaccacuacgccaaccucuuccacgagaagcgcuccgagcucgaggagcagcagaugcaccucaacgucggccuccgcaagaucaaggagaccgucgaccaggucgaggagcuccgccgcgaccuccgcaucaagucccaggagcucgaggucaagaacgccgccgccaacgacaagcucaagaagauggucaaggaccagcaggaggccgagaagaagaaggucaugucccaggagauccaggagcagcuccacaagcagcaggaggucaucgccgacaagcagauguccgucaaggaggaccucgacaaggucgagcccgccgucaucgaggcccagaacgccgucaaguccaucaagaagcagcaccucgucgagguccgcuccauggccaacccccccgccgccgucaagcucgcccucgaguccaucugccuccuccucggcgaguccaccaccgacuggaagcagauccgcuccaucaucaugcgcgagaacuucauccccaccaucgucaacuucuccgccgaggagaucuccgacgccauccgcgagaagaugaagaagaacuacauguccaaccccuccuacaacuacgagaucgucaaccgcgccucccucgccugcggccccauggucaagugggccaucgcccagcucaacuacgccgacaugcucaagcgcgucgagccccuccgcaacgagcuccagaagcucgaggacgacgccaaggacaaccagcagaaggccaacgaggucgagcagaugauccgcgaccucgaggccuccaucgcccgcuacaaggaggaguacgccguccucaucuccgaggcccaggccaucaaggccgaccucgccgccgucgaggccaaggucaaccgcuccaccgcccuccucaagucccucuccgccgagcgcgagcgcugggagaagaccuccgagaccuucaagaaccagauguccaccaucgccggcgacugccuccucuccgccgccuucaucgccuacgccggcuacuucgaccagcagaugcgccagaaccucuucaccaccuggucccaccaccuccagcaggccaacauccaguuccgcaccgacaucgcccgcaccgaguaccucuccaacgccgacgagcgccuccgcuggcaggccuccucccuccccgccgacgaccucugcaccgagaacgccaucaugcucaagcgcuucaaccgcuacccccucaucaucgaccccuccggccaggccaccgaguucaucaugaacgaguacaaggaccgcaagaucacccgcaccuccuuccucgacgacgccuuccgcaagaaccucgaguccgcccuccgcuucggcaacccccuccucguccaggacgucgaguccuacgaccccguccucaaccccguccucaaccgcgagguccgccgcaccggcggccgcguccucaucacccucggcgaccaggacaucgaccucucccccuccuucgucaucuuccucuccacccgcgaccccaccgucgaguucccccccgaccucugcucccgcgucaccuucgucaacuucaccgucacccgcuccucccuccagucccagugccucaacgagguccucaaggccgagcgccccgacgucgacgagaagcgcuccgaccuccucaagcuccagggcgaguuccagcuccgccuccgccagcucgagaagucccuccuccaggcccucaacgaggucaagggccgcauccucgacgacgacaccaucaucaccacccucgagaaccucaagcgcgaggccgccgaggucacccgcaaggucgaggagaccgacaucgucaugcaggaggucgagaccgucucccagcaguaccucccccucuccaccgccugcuccuccaucuacuucaccauggagucccucaagcagauccacuuccucuaccaguacucccuccaguucuuccucgacaucuaccacaacguccucuacgagaaccccaaccucaagggcgucaccgaccacacccagcgccucuccaucaucaccaaggaccucuuccaggucgccuucaaccgcgucgcccgcggcaugcuccaccaggaccacaucaccuucgccaugcuccucgcccgcaucaagcucaagggcaccgucggcgagcccaccuacgacgccgaguuccagcacuuccuccgcggcaacgagaucguccucuccgccggcuccaccccccgcauccagggccucaccgucgagcaggccgaggccgucguccgccucuccugccuccccgccuucaaggaccucaucgccaagguccaggccgacgagcaguucggcaucuggcucgacuccuccucccccgagcagaccguccccuaccucugguccgaggagacccccgccacccccaucggccaggccauccaccgccuccuccucauccaggccuuccgccccgaccgccuccucgccauggcccacauguucgucuccaccaaccucggcgaguccuucauguccaucauggagcagccccucgaccucacccacaucgucggcaccgaggucaagcccaacacccccguccucaugugcuccguccccggcuacgacgccuccggccacgucgaggaccucgccgccgagcagaacacccagaucaccuccaucgccaucggcuccgccgagggcuucaaccaggccgacaaggccaucaacaccgccgucaaguccggccgcugggucaugcucaagaacguccaccucgcccccggcuggcucaugcagcucgagaagaagcuccacucccuccagccccacgccugcuuccgccucuuccucaccauggagaucaaccccaagguccccgucaaccuccuccgcgccggccgcaucuucgucuucgagcccccccccggcgucaaggccaacaugcuccgcaccuucuccuccauccccgucucccgcaucugcaagucccccaacgagcgcgcccgccucuacuuccuccucgccugguuccacgccaucauccaggagcgccuccgcuacgccccccucggcugguccaagaaguacgaguucggcgaguccgaccuccgcuccgccugcgacaccgucgacaccuggcucgacgacaccgccaagggccgccagaacaucucccccgacaagauccccugguccgcccucaagacccucauggcccaguccaucuacggcggccgcgucgacaacgaguucgaccagcgccuccucaacaccuuccucgagcgccucuucaccacccgcuccuucgacuccgaguucaagcucgccugcaaggucgacggccacaaggacauccagaugcccgacggcauccgccgcgaggaguucguccagugggucgagcuccuccccgacacccagacccccuccuggcucggccuccccaacaacgccgagcgcguccuccucaccacccagggcgucgacaugaucuccaagaugcucaagaugcagaugcucgaggacgaggacgaccucgccuacgccgagaccgagaagaagacccgcaccgacuccaccuccgacggccgccccgccuggaugcgcacccuccacaccaccgccuccaacuggcuccaccucaucccccagacccucucccaccucaagcgcaccgucgagaacaucaaggacccccucuuccgcuucuucgagcgcgaggucaagaugggcgccaagcuccuccaggacguccgccaggaccucgccgacgucguccaggucugcgagggcaagaagaagcagaccaacuaccuccgcacccucaucaacgagcucgucaagggcauccucccccgcuccuggucccacuacaccguccccgccggcaugaccgucauccagugggucuccgacuucuccgagcgcaucaagcagcuccagaacaucucccucgccgccgccuccggcggcgccaaggagcucaagaacauccacgucugccucggcggccucuucguccccgaggccuacaucaccgccacccgccaguacgucgcccaggccaacuccuggucccucgaggagcucugccucgaggucaacgucaccaccucccagggcgccacccucgacgccugcuccuucggcgucaccggccucaagcuccagggcgccaccugcaacaacaacaagcucucccucuccaacgccaucuccaccgcccucccccucacccagcuccgcugggucaagcagaccaacaccgagaagaaggccuccgucgucacccuccccgucuaccucaacuucacccgcgccgaccucaucuucaccgucgacuucgagaucgccaccaaggaggacccccgcuccuucuacgagcgcggcgucgccguccucugcaccgaguga

SEQ ID NO: 42505 - RNA, 1827 nt, Artificial Sequence
  derived and/or modified sequence opt2 from DYNC1I1__Homo_sapiens__NP_001129029
auguccgacaaguccgaccucaaggccgagcucgagcgcaagaagcagcgccucgcccagauccgcgaggagaagaagcgcaaggaggaggagcgcaagaagaaggaggccgacaugcagcagaagaaggagcccguccaggacgacuccgaccucgaccgcaagcgccgcgagaccgaggcccuccuccaguccaucggcaucucccccgagcccccccucguccccacccccaugucccccuccuccaaguccgucuccacccccuccgaggccggcucccaggacuccggcgaccucggcccccucacccgccgccgccuccacaagcucggcgucuccaaggucacccaggucgacuuccucccccgcgaggucgucuccuacuccaaggagacccagaccccccucgccacccaccaguccgaggaggacgaggaggacgaggagauggucgaguccaaggucggccaggacuccgagcucgagaaccaggacaagaagcaggaggucaaggaggcccccccccgcgagcucaccgaggaggagaagcagcagauccuccacuccgaggaguuccucaucuucuucgaccgcaccauccgcgucaucgagcgcgcccucgccgaggacuccgacaucuucuucgacuacuccggccgcgagcucgaggagaaggacggcgacguccaggccggcgccaaccucuccuucaaccgccaguucuacgacgagcacugguccaagcaccgcgucgucaccugcauggacuggucccuccaguaccccgagcucauggucgccuccuacaacaacaacgaggacgccccccacgagcccgacggcgucgcccucgucuggaacaugaaguucaagaagaccacccccgaguacgucuuccacugccaguccuccgucauguccgucugcuucgcccgcuuccaccccaaccucgucgucggcggcaccuacuccggccagaucguccucugggacaaccgcucccaccgccgcacccccguccagcgcaccccccucuccgccgccgcccacacccaccccgucuacugcgucaacgucgucggcacccagaacgcccacaaccucaucaccgucuccaccgacggcaagaugugcuccuggucccucgacaugcucuccaccccccaggaguccauggagcucgucuacaacaaguccaagcccgucgccgucaccggcauggccuuccccaccggcgacgucaacaacuucgucgucggcuccgaggagggcaccgucuacaccgccugccgccacggcuccaaggccggcaucggcgaggucuucgagggccaccagggccccgucaccggcaucaacugccacauggccgucggccccaucgacuucucccaccucuucgucaccuccuccuucgacuggaccgucaagcucuggaccaccaagcacaacaagccccucuacuccuucgaggacaacgccgacuacgucuacgacgucauguggucccccguccaccccgcccucuucgccugcgucgacggcaugggccgccucgaccucuggaaccucaacaacgacaccgagguccccaccgccuccgucgccaucgagggcgccuccgcccucaaccgcguccgcugggcccaggccggcaaggaggucgccgucggcgacuccgagggccgcaucugggucuacgacgucggcgagcucgccgucccccacaacgacgaguggacccgcuucgcccgcacccucgucgagauccgcgccaaccgcgccgacuccgaggaggagggcaccgucgagcucuccgccuga

SEQ ID NO: 42506 - RNA, 1893 nt, Artificial Sequence
  derived and/or modified sequence opt2 from DYNC1I2__Homo_sapiens__NP_001258715
auguccgacaaguccgagcucaaggccgagcucgagcgcaagaagcagcgccucgcccagauccgcgaggagaagaagcgcaaggaggaggagcgcaagaagaaggagaccgaccagaagaaggaggccgucgcccccguccaggaggaguccgaccucgagaagaagcgccgcgaggccgaggcccuccuccaguccaugggccucacccccgagucccccaucgccgagcagccccuccgcgucgucaccgccgacaccugccucuuccacuaccucguccccccccccaugucccccuccuccaaguccgucuccacccccuccgaggccggcucccaggacuccggcgacggcgccgucggcucccgccgcggccccaucaagcucggcauggccaagaucacccaggucgacuuccccccccgcgagaucgucaccuacaccaaggagacccagacccccgucauggcccagcccaaggaggacgaggaggaggacgacgacgucgucgcccccaagccccccaucgagcccgaggaggagaagacccucaagaaggacgaggagaacgacuccaaggcccccccccacgagcucaccgaggaggagaagcagcagauccuccacuccgaggaguuccucuccuucuucgaccacuccacccgcaucgucgagcgcgcccucuccgagcagaucaacaucuucuucgacuacuccggccgcgaccucgaggacaaggagggcgagauccaggccggcgccaagcucucccucaaccgccaguucuucgacgagcgcugguccaagcaccgcgucgucuccugccucgacugguccucccaguaccccgagcuccucgucgccuccuacaacaacaacgaggacgccccccacgagcccgacggcgucgcccucgucuggaacaugaaguacaagaagaccacccccgaguacgucuuccacugccaguccgccgucauguccgccaccuucgccaaguuccaccccaaccucgucgucggcggcaccuacuccggccagaucguccucugggacaaccgcuccaacaagcgcacccccguccagcgcaccccccucuccgccgccgcccacacccaccccgucuacugcgucaacgucgucggcacccagaacgcccacaaccucaucuccaucuccaccgacggcaagaucugcuccuggucccucgacaugcucucccacccccaggacuccauggagcucguccacaagcaguccaaggccgucgccgucaccuccauguccuuccccgucggcgacgucaacaacuucgucgucggcuccgaggagggcuccgucuacaccgccugccgccacggcuccaaggccggcaucuccgagauguucgagggccaccagggccccaucaccggcauccacugccacgccgccgucggcgccgucgacuucucccaccucuucgucaccuccuccuucgacuggaccgucaagcucuggaccaccaagaacaacaagccccucuacuccuucgaggacaacgccgacuacgucuacgacgucauguggucccccacccaccccgcccucuucgccugcgucgacggcaugggccgccucgaccucuggaaccucaacaacgacaccgagguccccaccgccuccaucuccgucgagggcaaccccgcccucaaccgcguccgcuggacccacuccggccgcgagaucgccgucggcgacuccgagggccagaucgucaucuacgacgucggcgagcagaucgccgucccccgcaacgacgagugggcccgcuucggccgcacccucgccgagaucaacgccaaccgcgccgacgccgaggaggaggccgccacccgcauccccgccuga

SEQ ID NO: 42507 - RNA, 1572 nt, Artificial Sequence
  derived and/or modified sequence opt2 from DYNC1LI1__Homo_sapiens__NP_057225
auggccgccgucggccgcgucggcuccuucggcuccuccccccccggccucuccuccaccuacaccggcggcccccucggcaacgagaucgccuccggcaacggcggcgccgccgccggcgacgacgaggacggccagaaccucugguccugcauccucuccgaggucuccacccgcucccgcuccaagcuccccgccggcaagaacguccuccuccucggcgaggacggcgccggcaagaccucccucauccgcaagauccagggcaucgaggaguacaagaagggccgcggccucgaguaccucuaccucaacguccacgacgaggaccgcgacgaccagacccgcugcaacgucuggauccucgacggcgaccucuaccacaagggccuccucaaguucucccucgacgccgucucccucaaggacacccucgucaugcucgucgucgacauguccaagcccuggaccgcccucgacucccuccagaagugggccuccgucguccgcgagcacgucgacaagcucaagaucccccccgaggagaugaagcagauggagcagaagcucauccgcgacuuccaggaguacgucgagcccggcgaggacuuccccgccuccccccagcgccgcaacaccgccucccaggaggacaaggacgacuccgucguccucccccucggcgccgacacccucacccacaaccucggcauccccguccucgucgucugcaccaagugcgacgccaucuccguccucgagaaggagcacgacuaccgcgacgagcacuucgacuucauccagucccacauccgcaaguucugccuccaguacggcgccgcccucaucuacaccuccgucaaggagaacaagaacaucgaccucgucuacaaguacaucguccagaagcucuacggcuuccccuacaagauccccgccgucgucgucgagaaggacgccgucuucauccccgccggcugggacaacgacaagaagaucggcauccuccacgagaacuuccagacccucaaggccgaggacaacuucgaggacaucaucaccaagccccccguccgcaaguucguccacgagaaggagaucauggccgaggacgaccaggucuuccucaugaagcuccagucccuccucgccaagcagccccccaccgccgccggccgccccgucgacgccuccccccgcguccccggcggcuccccccgcacccccaaccgcuccgucuccuccaacgucgccuccgucucccccauccccgccggcuccaagaagaucgaccccaacaugaaggccggcgccaccuccgagggcguccucgccaacuucuucaacucccuccucuccaagaagaccggcucccccggcggccccggcgucuccggcggcucccccgccggcggcgccggcggcggcuccuccggccucccccccuccaccaagaaguccggccagaagcccguccucgacguccacgccgagcucgaccgcaucacccgcaagcccgucaccgucucccccaccacccccaccucccccaccgagggcgaggccuccuga

SEQ ID NO: 42508 - RNA, 12945 nt, Artificial Sequence
  derived and/or modified sequence opt2 from DYNC2H1__Homo_sapiens__NP_001073932
auggccaacggcaccgccgacguccgcaagcucuucaucuucaccaccacccagaacuacuucggccucauguccgagcucugggaccagccccuccucugcaacugccucgagaucaacaacuuccucgacgacggcaaccagaugcuccuccgcguccagcgcuccgacgccggcaucuccuucuccaacaccaucgaguucggcgacaccaaggacaagguccucgucuucuucaagcuccgccccgaggucaucaccgacgagaaccuccacgacaacauccucgucuccuccaugcucgagucccccaucuccucccucuaccaggccguccgccaggucuucgcccccaugcuccucaaggaccaggaguggucccgcaacuucgaccccaagcuccagaaccuccucuccgagcucgaggccggccucggcaucguccuccgccgcuccgacaccaaccucaccaagcucaaguucaaggaggacgacacccgcggcauccucacccccuccgacgaguuccaguucuggaucgagcaggcccaccgcggcaacaagcagaucuccaaggagcgcgccaacuacuucaaggagcucuucgagaccaucgcccgcgaguucuacaaccucgacucccucucccuccucgaggucgucgaccucgucgagaccacccaggacgucgucgacgacgucuggcgccagaccgagcacgaccacuaccccgagucccgcaugcuccaccuccucgacaucaucggcggcuccuucggccgcuucguccagaagaagcucggcacccucaaccucugggaggaccccuacuaccucgucaaggagucccucaaggccggcaucuccaucugcgagcagugggucaucgucugcaaccaccucaccggccaggucuggcagcgcuacgucccccaccccuggaagaacgagaaguacuuccccgagacccucgacaagcucggcaagcgccucgaggagguccucgccauccgcaccauccacgagaaguuccucuacuuccuccccgccuccgaggagaagaucaucugccucacccgcgucuucgagcccuucaccggccucaaccccguccaguacaaccccuacaccgagccccucuggaaggccgccgucucccaguacgagaagaucaucgcccccgccgagcagaagaucgccggcaagcucaagaacuacaucuccgagauccaggacuccccccagcagcuccuccaggccuuccucaaguacaaggagcucgucaagcgccccaccaucuccaaggagcucaugcucgagcgcgagacccuccucgcccgccucgucgacuccaucaaggacuuccgccucgacuucgagaaccgcugccgcggcauccccggcgacgccuccggcccccucuccggcaagaaccucuccgaggucgucaacuccaucgucuggguccgccagcucgagcucaaggucgacgacaccaucaagaucgccgaggcccuccucuccgaccuccccggcuuccgcugcuuccaccaguccgccaaggaccuccucgaccagcucaagcucuacgagcaggagcaguucgacgacuggucccgcgacauccaguccggccucuccgacucccgcuccggccucugcaucgaggccuccucccgcaucauggagcucgacuccaacgacggccuccucaagguccacuacuccgaccgccucgucauccuccuccgcgagguccgccagcucuccgcccucggcuucgucauccccgccaagauccagcaggucgccaacaucgcccagaaguucugcaagcaggccaucauccucaagcaggucgcccacuucuacaacuccaucgaccagcagaugauccagucccagcgccccaugaugcuccaguccgcccucgccuucgagcagaucaucaagaacuccaaggccggcuccggcggcaagucccagaucaccugggacaaccccaaggagcucgagggcuacauccagaagcuccagaacgccgccgagcgccucgccaccgagaaccgcaagcuccgcaaguggcacaccaccuucugcgagaaggucgucguccucaugaacaucgaccuccuccgccagcagcagcgcuggaaggacggccuccaggagcuccgcaccggccucgccaccgucgaggcccagggcuuccaggccuccgacaugcacgccuggaagcagcacuggaaccaccagcucuacaaggcccucgagcaccaguaccagaugggccucgaggcccucaacgagaaccuccccgagaucaacaucgaccucaccuacaagcagggccgccuccaguuccgcccccccuucgaggagauccgcgccaaguacuaccgcgagaugaagcgcuucaucggcauccccaaccaguucaagggcgucggcgaggccggcgacgaguccaucuucuccaucaugaucgaccgcaacgccuccggcuuccucaccaucuucuccaaggccgaggaccucuuccgccgccucuccgccguccuccaccagcacaaggaguggaucgucaucggccaggucgacauggaggcccucgucgagaagcaccucuucaccguccacgacugggagaagaacuucaaggcccucaagaucaagggcaaggaggucgagcgccuccccuccgccgucaaggucgacugccucaacaucaacugcaaccccgucaagaccgucaucgacgaccucauccagaagcucuucgaccuccucguccucucccucaagaaguccauccaggcccaccuccacgagaucgacaccuucgucaccgaggccauggagguccucaccaucaugccccaguccgucgaggagaucggcgacgccaaccuccaguacuccaagcuccaggagcgcaagcccgagauccucccccucuuccaggaggccgaggacaagaaccgccuccuccgcaccgucgccggcggcggccucgagaccaucuccaaccucaaggccaagugggacaaguucgagcucaugauggagucccaccagcucaugaucaaggaccagaucgaggucaugaagggcaacgucaagucccgccuccagaucuacuaccaggagcucgagaaguucaaggcccgcugggaccagcucaagcccggcgacgacgucaucgagaccggccagcacaacacccucgacaaguccgccaagcucaucaaggagaagaagaucgaguucgacgaccucgaggucacccgcaagaagcucgucgacgacugccaccacuuccgccucgaggagcccaacuucucccucgccuccuccaucuccaaggacaucgaguccugcgcccagaucugggccuucuacgaggaguuccagcagggcuuccaggagauggccaacgaggacuggaucaccuuccgcaccaagaccuaccucuucgaggaguuccucaugaacuggcacgaccgccuccgcaaggucgaggagcacuccgucaugaccgucaagcuccaguccgaggucgacaaguacaagaucgucauccccauccucaaguacguccgcggcgagcaccucucccccgaccacuggcucgaccucuuccgccuccucggccucccccgcggcaccucccucgagaagcuccucuucggcgaccuccuccgcgucgccgacaccaucgucgccaaggccgccgaccucaaggaccucaacucccgcgcccagggcgaggucaccauccgcgaggcccuccgcgagcucgaccucuggggcgucggcgccgucuucacccucaucgacuacgaggacucccagucccgcaccaugaagcucaucaaggacuggaaggacaucgucaaccaggucggcgacaaccgcugccuccuccagucccucaaggacucccccuacuacaagggcuucgaggacaaggucuccaucugggagcgcaagcucgccgagcucgacgaguaccuccagaaccucaaccacauccagcgcaagugggucuaccucgagcccaucuucggccgcggcgcccuccccaaggagcagacccgcuucaaccgcgucgacgaggacuuccgcuccaucaugaccgacaucaagaaggacaaccgcgucaccacccucaccacccacgccggcauccgcaacucccuccucaccauccucgaccagcuccagcgcugccagaagucccucaacgaguuccucgaggagaagcgcuccgccuucccccgcuucuacuucaucggcgacgacgaccuccucgagauccucggccaguccaccaaccccuccgucauccagucccaccucaagaagcucuucgccggcaucaacuccgucugcuucgacgagaaguccaagcacaucaccgccaugaagucccucgagggcgaggucguccccuucaagaacaaggucccccucuccaacaacgucgagaccuggcucaacgaccucgcccucgagaugaagaagacccucgagcagcuccucaaggagugcgucaccaccggccgcuccucccagggcgccgucgaccccucccucuuccccucccagauccucugccucgccgagcagaucaaguucaccgaggacgucgagaacgccaucaaggaccacucccuccaccagaucgagacccagcucgucaacaagcucgagcaguacaccaacaucgacaccuccuccgaggaccccggcaacaccgaguccggcauccucgagcucaagcucaaggcccucauccucgacaucauccacaacaucgacgucgucaagcagcucaaccagauccagguccacaccaccgaggacugggccuggaagaagcagcuccgcuucuacaugaaguccgaccacaccugcugcguccagauggucgacuccgaguuccaguacaccuacgaguaccagggcaacgccuccaagcucgucuacaccccccucaccgacaagugcuaccucacccucacccaggccaugaagaugggccucggcggcaaccccuacggccccgccggcaccggcaagaccgaguccgucaaggcccucggcggccuccucggccgccagguccucgucuucaacugcgacgagggcaucgacgucaaguccaugggccgcaucuucgucggccucgucaagugcggcgccuggggcugcuucgacgaguucaaccgccucgaggaguccguccucuccgccgucuccaugcagauccagaccauccaggacgcccucaagaaccaccgcaccgucugcgagcuccucggcaaggaggucgaggucaacuccaacuccggcaucuucaucaccaugaaccccgccggcaagggcuacggcggccgccagaagcuccccgacaaccucaagcagcucuuccgccccgucgccaugucccaccccgacaacgagcucaucgccgaggucauccucuacuccgagggcuucaaggacgccaagguccucucccgcaagcucgucgccaucuucaaccucucccgcgagcuccucaccccccagcagcacuacgacuggggccuccgcgcccucaagaccguccuccgcggcuccggcaaccuccuccgccagcucaacaaguccggcaccacccagaacgccaacgagucccacaucgucguccaggcccuccgccucaacaccauguccaaguucaccuucaccgacugcacccgcuucgacgcccucaucaaggacgucuuccccggcaucgagcucaaggaggucgaguacgacgagcucuccgccgcccucaagcaggucuucgaggaggccaacuacgagaucauccccaaccagaucaagaaggcccucgagcucuacgagcagcucugccagcgcaugggcgucgucaucgucggccccuccggcgccggcaaguccacccucuggcgcaugcuccgcgccgcccucugcaagaccggcaaggucgucaagcaguacaccaugaaccccaaggccaugccccgcuaccagcuccucggccacaucgacauggacacccgcgagugguccgacggcguccucaccaacuccgcccgccaggucguccgcgagccccaggacgucuccuccuggaucaucugcgacggcgacaucgaccccgaguggaucgagucccucaacuccguccucgacgacaaccgccuccucaccaugcccuccggcgagcgcauccaguucggccccaacgucaacuucgucuucgagacccacgaccucuccugcgccucccccgccaccaucucccgcaugggcaugaucuuccucuccgacgaggagaccgaccucaacucccucaucaaguccuggcuccgcaaccagcccgccgaguaccgcaacaaccucgagaacuggaucggcgacuacuucgagaaggcccuccaguggguccucaagcagaacgacuacgucgucgagaccucccucgucggcaccgucaugaacggccucucccaccuccacggcugccgcgaccacgacgaguucaucaucaaccucauccgcggccucggcggcaaccucaacaugaagucccgccucgaguucaccaaggaggucuuccacugggcccgcgaguccccccccgacuuccacaagcccauggacaccuacuacgacuccacccgcggccgccucgccaccuacguccucaagaagcccgaggaccucaccgccgacgacuucuccaacggccucacccuccccgucauccagacccccgacaugcagcgcggccucgacuacuucaagcccuggcucuccuccgacaccaagcagcccuucauccucgucggccccgagggcugcggcaagggcaugcuccuccgcuacgccuucucccagcuccgcuccacccagaucgccaccguccacugcuccgcccagaccaccucccgccaccuccuccagaagcucucccagaccugcauggucaucuccaccaacaccggccgcgucuaccgccccaaggacugcgagcgccucguccucuaccucaaggacaucaaccuccccaagcucgacaaguggggcaccuccacccucgucgccuuccuccagcagguccucaccuaccagggcuucuacgacgagaaccucgagugggucggccucgagaacauccagaucgucgccuccauguccgccggcggccgccucggccgccacaagcucaccacccgcuucaccuccaucguccgccucugcuccaucgacuaccccgagcgcgagcagcuccagaccaucuacggcgccuaccucgagcccguccuccacaagaaccucaagaaccacuccaucuggggcuccuccuccaagaucuaccuccucgccggcuccaugguccaggucuacgagcagguccgcgccaaguucaccgucgacgacuacucccacuacuucuucacccccugcauccucacccaguggguccucggccucuuccgcuacgaccucgagggcggcuccuccaaccacccccucgacuacguccucgagaucgucgccuacgaggcccgccgccucuuccgcgacaagaucgucggcgccaaggagcuccaccucuucgacaucauccucaccuccgucuuccagggcgacuggggcuccgacauccucgacaacauguccgacuccuucuacgucaccuggggcgcccgccacaacuccggcgcccgcgccgcccccggccagccccuccccccccacggcaagccccucggcaagcucaacuccaccgaccucaaggacgucaucaagaagggccucauccacuacggccgcgacaaccagaaccucgacauccuccucuuccacgagguccucgaguacaugucccgcaucgaccgcguccucuccuuccccggcggcucccuccuccucgccggccgcuccggcgucggccgccgcaccaucaccucccucgucucccacaugcacggcgccguccucuucucccccaagaucucccgcggcuacgagcucaagcaguucaagaacgaccucaagcacguccuccagcucgccggcaucgaggcccagcaggucguccuccuccucgaggacuaccaguucguccaccccaccuuccucgagaugaucaacucccuccucuccuccggcgagguccccggccucuacacccucgaggagcucgagccccuccuccucccccucaaggaccaggccucccaggacggcuucuucggccccgucuucaacuacuucaccuaccgcauccagcagaaccuccacaucguccucaucauggacuccgccaacuccaacuucaugaucaacugcgaguccaaccccgcccuccacaagaagugccagguccucuggauggagggcugguccaacuccuccaugaagaagauccccgagaugcucuucuccgagaccggcggcggcgagaaguacaacgacaagaagcgcaaggaggagaagaagaagaacuccgucgaccccgacuuccucaaguccuuccuccucauccacgaguccugcaaggccuacggcgccacccccucccgcuacaugaccuuccuccacgucuacuccgccaucuccuccuccaagaagaaggagcuccucaagcgccagucccaccuccaggccggcgucuccaagcucaacgaggccaaggcccucgucgacgagcucaaccgcaaggccggcgagcaguccguccuccucaagaccaagcaggacgaggccgacgccgcccuccagaugaucaccgucuccaugcaggacgccuccgagcagaagaccgagcucgagcgccucaagcaccgcaucgccgaggaggucgucaagaucgaggagcgcaagaacaagaucgacgacgagcucaaggagguccagccccucgucaacgaggccaagcucgccgucggcaacaucaagcccgagucccucuccgagauccgcucccuccgcaugccccccgacgucauccgcgacauccucgagggcguccuccgccucaugggcaucuucgacaccuccugggucuccaugaaguccuuccucgccaagcgcggcguccgcgaggacaucgccaccuucgacgcccgcaacaucuccaaggagauccgcgaguccgucgaggagcuccucuucaagaacaagggcuccuucgaccccaagaacgccaagcgcgccuccaccgccgccgccccccucgccgccugggucaaggccaacauccaguacucccacguccucgagcgcauccacccccucgagaccgagcaggccggccucgaguccaaccucaagaagaccgaggaccgcaagcgcaagcucgaggagcuccucaacuccgucggccagaaggucuccgagcucaaggagaaguuccagucccgcaccuccgaggccgccaagcucgaggccgaggucuccaaggcccaggagaccaucaaggccgccgagguccucaucaaccagcucgaccgcgagcacaagcgcuggaacgcccaggucgucgagaucaccgaggagcucgccacccuccccaagcgcgcccagcucgccgccgccuucaucaccuaccucuccgccgcccccgagucccuccgcaagaccugccucgaggaguggaccaaguccgccggccucgagaaguucgaccuccgccgcuuccucugcaccgaguccgagcagcucaucuggaaguccgagggccuccccuccgacgaccucuccaucgagaacgcccucgucauccuccagaucaucggccucaaguccuggucccgcgucugccccuuccucaucgaccccuccucccaggccaccgaguggcucaagacccaccucaaggacucccgccucgaggucaucaaccagcaggacuccaacuucaucaccgcccucgagcucgccguccgcuucggcaagacccucaucauccaggagauggacggcgucgagcccguccucuacccccuccuccgccgcgaccucgucgcccagggcccccgcuacgucguccagaucggcgacaagaucaucgacuacaacgaggaguuccgccucuuccucuccacccgcaaccccaaccccuucaucccccccgacgccgccuccaucgucaccgaggucaacuucaccaccacccgcuccggccuccgcggccagcuccucgcccucaccauccagcacgagaagcccgaccucgaggagcagaagaccaagcuccuccagcaggaggaggacaagaagauccagcucgccaagcucgaggagucccuccucgagacccucgccaccucccagggcaacauccucgagaacaaggaccucaucgagucccucaaccagaccaaggccuccuccgcccucauccaggagucccucaaggaguccuacaagcuccagaucucccucgaccaggagcgcgacgccuaccucccccucgccgaguccgccuccaagauguacuucaucaucuccgaccucuccaagaucaacaacauguaccgcuucucccucgccgccuuccuccgccucuuccagcgcgcccuccagaacaagcaggacuccgagaacaccgagcagcgcauccagucccucaucuccucccuccagcacauggucuacgaguacaucugccgcugccucuucaaggccgaccagcucauguucgcccuccacuucguccgcggcaugcaccccgagcucuuccaggagaacgagugggacaccuucaccggcgucgucgucggcgacaugcuccgcaaggccgacucccagcagaagauccgcgaccagcuccccuccuggaucgaccaggagcgcuccugggccgucgccacccucaagaucgcccuccccucccucuaccagacccucugcuucgaggacgccgcccucuggcgcaccuacuacaacaacuccaugugcgagcaggaguuccccuccauccucgccaagaaggucucccucuuccagcagauccucgucguccaggcccuccgccccgaccgccuccaguccgccauggcccucuucgccugcaagacccucggccucaaggaggucuccccccucccccucaaccucaagcgccucuacaaggagacccucgagaucgagcccauccucaucaucaucucccccggcgccgaccccucccaggagcuccaggagcucgccaacgccgagcgcuccggcgagugcuaccaccaggucgccaugggccagggccaggccgaccucgccauccagaugcucaaggagugcgcccgcaacggcgacuggcucugccucaagaaccuccaccucgucgucuccuggcuccccguccucgagaaggagcucaacacccuccagcccaaggacaccuuccgccucuggcucaccgccgagguccaccccaacuucacccccauccuccuccaguccucccucaagaucaccuacgaguccccccccggccucaagaagaaccucaugcgcaccuacgaguccuggacccccgagcagaucuccaagaaggacaacacccaccgcgcccacgcccucuucucccucgccugguuccacgccgccugccaggagcgccgcaacuacaucccccagggcuggaccaaguucuacgaguucucccucuccgaccuccgcgccggcuacaacaucaucgaccgccucuucgacggcgccaaggacguccagugggaguucguccacggccuccucgagaacgccaucuacggcggccgcaucgacaacuacuucgaccuccgcguccuccaguccuaccucaagcaguucuucaacuccuccgucaucgacgucuucaaccagcgcaacaagaaguccaucuuccccuacuccgucucccucccccaguccugcuccauccucgacuaccgcgccgucaucgagaagauccccgaggacgacaagcccuccuucuucggccuccccgccaacaucgcccgcuccucccagcgcaugaucuccucccaggucaucucccagcuccgcauccucggccgcuccaucaccgccggcuccaaguucgaccgcgagaucugguccaacgagcucucccccguccucaaccucuggaagaagcucaaccagaacuccaaccucauccaccagaagguccccccccccaacgaccgccagggcucccccauccucuccuucaucauccucgagcaguucaacgccauccgccucguccaguccguccaccagucccucgccgcccucuccaaggucauccgcggcaccacccuccucuccuccgagguccagaagcucgccuccgcccuccucaaccagaagugcccccucgccuggcaguccaagugggagggccccgaggacccccuccaguaccuccgcggccucgucgcccgcgcccucgccauccagaacugggucgacaaggccgagaagcaggcccuccucuccgagacccucgaccucuccgagcucuuccaccccgacaccuuccucaacgcccuccgccaggagaccgcccgcgccgucggccgcuccgucgacucccucaaguucgucgccuccuggaagggccgccuccaggaggccaagcuccagaucaagaucuccggccuccuccucgagggcugcuccuucgacggcaaccagcucuccgagaaccagcucgacucccccuccgucuccuccguccuccccugcuucaugggcuggaucccccaggacgccugcggccccuacucccccgacgagugcaucucccuccccgucuacaccuccgccgagcgcgaccgcgucgucaccaacaucgacguccccugcggcggcaaccaggaccaguggauccagugcggcgccgcccucuuccucaagaaccaguga

SEQ ID NO: 42509 - RNA, 270 nt, Artificial Sequence
  derived and/or modified sequence opt2 from DYNLL1__Homo_sapiens__NP_001032584
augugcgaccgcaaggccgucaucaagaacgccgacauguccgaggagaugcagcaggacuccgucgagugcgccacccaggcccucgagaaguacaacaucgagaaggacaucgccgcccacaucaagaaggaguucgacaagaaguacaaccccaccuggcacugcaucgucggccgcaacuucggcuccuacgucacccacgagaccaagcacuucaucuacuucuaccucggccaggucgccauccuccucuucaaguccggcuga

SEQ ID NO: 42510 - RNA, 270 nt, Artificial Sequence
  derived and/or modified sequence opt2 from DYNLL2__Homo_sapiens__NP_542408
auguccgaccgcaaggccgucaucaagaacgccgacauguccgaggacaugcagcaggacgccgucgacugcgccacccaggccauggagaaguacaacaucgagaaggacaucgccgccuacaucaagaaggaguucgacaagaaguacaaccccaccuggcacugcaucgucggccgcaacuucggcuccuacgucacccacgagaccaagcacuucaucuacuucuaccucggccaggucgccauccuccucuucaaguccggcuga

SEQ ID NO: 42511 - RNA, 312 nt, Artificial Sequence
  derived and/or modified sequence opt2 from DYNLRB1__Homo_sapiens__NP_001268658
augaacucccagcgccgcggcccccacuccugccucaagaccgcccccaaggccaagcccuuccacugggaggcccucgccgccuaccuccucgacaccuccauccccaucaaguccaccauggacaaccccaccaccacccaguacgccucccucaugcacuccuucauccucaaggcccgcuccaccguccgcgacaucgacccccagaacgaccucaccuuccuccgcauccgcuccaagaagaacgagaucauggucgcccccgacaaggacuacuuccucaucgucauccagaaccccaccgaguga

SEQ ID NO: 42512 - RNA, 300 nt, Artificial Sequence
  derived and/or modified sequence opt2 from DYNLT1__Homo_sapiens__NP_001278531
auggaggacuaccaggccgccgaggaggccaucgaguccgccaucggcggcaacgccuaccagcacuccaaggucaaccaguggaccaccaacgucgucgagcagacccucucccagcucaccaagcucggcaagcccuucaaguacaucgucaccugcgucaucaugcagaagaacggcgccggccuccacaccgccuccuccugcuucugggacuccuccaccgacggcuccugcaccguccgcugggagaacaagaccauguacugcaucgucuccgccuucggccucuccaucuga

SEQ ID NO: 42513 - RNA, 351 nt, Artificial Sequence
  derived and/or modified sequence opt2 from DYNLT3__Homo_sapiens__NP_006511
auggaggaguaccaccgccacugcgacgaggucggcuucaacgccgaggaggcccacaacaucgucaaggagugcgucgacggcguccucggcggcgaggacuacaaccacaacaacaucaaccaguggaccgccuccaucgucgagcagucccucacccaccucgucaagcucggcaaggccuacaaguacaucgucaccugcgccgucguccagaaguccgccuacggcuuccacaccgccuccuccugcuucugggacaccaccuccgacggcaccugcaccguccgcugggagaaccgcaccaugaacugcaucgucaacgucuucgccaucgccaucguccucuga

SEQ ID NO: 42514 - RNA, 2292 nt, Artificial Sequence
  derived and/or modified sequence opt2 from DYRK1A__Homo_sapiens__NP_001387
augcacaccggcggcgagaccuccgccugcaagcccuccuccguccgccucgcccccuccuucuccuuccacgccgccggccuccagauggccggccagaugccccacucccaccaguacuccgaccgccgccagcccaacaucuccgaccagcaggucuccgcccucuccuacuccgaccagauccagcagccccucaccaaccaggucaugcccgacaucgucaugcuccagcgccgcaugccccagaccuuccgcgaccccgccaccgccccccuccgcaagcucuccgucgaccucaucaagaccuacaagcacaucaacgaggucuacuacgccaagaagaagcgccgccaccagcagggccagggcgacgacuccucccacaagaaggagcgcaaggucuacaacgacggcuacgacgacgacaacuacgacuacaucgucaagaacggcgagaaguggauggaccgcuacgagaucgacucccucaucggcaagggcuccuucggccaggucgucaaggccuacgaccgcgucgagcaggagugggucgccaucaagaucaucaagaacaagaaggccuuccucaaccaggcccagaucgagguccgccuccucgagcucaugaacaagcacgacaccgagaugaaguacuacaucguccaccucaagcgccacuucauguuccgcaaccaccucugccucgucuucgagaugcucuccuacaaccucuacgaccuccuccgcaacaccaacuuccgcggcgucucccucaaccucacccgcaaguucgcccagcagaugugcaccgcccuccucuuccucgccacccccgagcucuccaucauccacugcgaccucaagcccgagaacauccuccucugcaaccccaagcgcuccgccaucaagaucgucgacuucggcuccuccugccagcucggccagcgcaucuaccaguacauccagucccgcuucuaccgcucccccgagguccuccucggcaugcccuacgaccucgccaucgacauguggucccucggcugcauccucgucgagaugcacaccggcgagccccucuucuccggcgccaacgaggucgaccagaugaacaagaucgucgagguccucggcaucccccccgcccacauccucgaccaggcccccaaggcccgcaaguucuucgagaagcuccccgacggcaccuggaaccucaagaagaccaaggacggcaagcgcgaguacaagccccccggcacccgcaagcuccacaacauccucggcgucgagaccggcggccccggcggccgccgcgccggcgaguccggccacaccgucgccgacuaccucaaguucaaggaccucauccuccgcaugcucgacuacgaccccaagacccgcauccagcccuacuacgcccuccagcacuccuucuucaagaagaccgccgacgagggcaccaacaccuccaacuccgucuccaccucccccgccauggagcagucccaguccuccggcaccaccuccuccaccuccuccuccuccggcggcuccuccggcaccuccaacuccggccgcgcccgcuccgaccccacccaccagcaccgccacuccggcggccacuucaccgccgccguccaggccauggacugcgagacccacuccccccagguccgccagcaguuccccgccccccucggcugguccggcaccgaggcccccacccaggucaccgucgagacccaccccguccaggagaccaccuuccacgucgccccccagcagaacgcccuccaccaccaccacggcaacuccucccaccaccaccaccaccaccaccaccaccaccaccaccacggccagcaggcccucggcaaccgcacccgcccccgcgucuacaacucccccaccaacuccuccuccacccaggacuccauggaggucggccacucccaccacuccaugaccucccucuccuccuccaccaccuccuccuccaccuccuccuccuccaccggcaaccagggcaaccaggccuaccagaaccgccccgucgccgccaacacccucgacuucggccagaacggcgccauggacgucaaccucaccgucuacuccaacccccgccaggagaccggcaucgccggccaccccaccuaccaguucuccgccaacaccggccccgcccacuacaugaccgagggccaccucaccaugcgccagggcgccgaccgcgaggagucccccaugaccggcgucugcguccagcagucccccgucgccuccuccuga

SEQ ID NO: 42515 - RNA, 1890 nt, Artificial Sequence
  derived and/or modified sequence opt2 from DYRK1B__Homo_sapiens__NP_004705
auggccgucccccccggccacggccccuucuccggcuuccccggcccccaggagcacacccagguccuccccgacguccgccuccucccccgccgccucccccucgccuuccgcgacgccaccuccgccccccuccgcaagcucuccgucgaccucaucaagaccuacaagcacaucaacgaggucuacuacgccaagaagaagcgccgcgcccagcaggcccccccccaggacuccuccaacaagaaggagaagaagguccucaaccacggcuacgacgacgacaaccacgacuacaucguccgcuccggcgagcgcuggcucgagcgcuacgagaucgacucccucaucggcaagggcuccuucggccaggucgucaaggccuacgaccaccagacccaggagcucgucgccaucaagaucaucaagaacaagaaggccuuccucaaccaggcccagaucgagcuccgccuccucgagcucaugaaccagcacgacaccgagaugaaguacuacaucguccaccucaagcgccacuucauguuccgcaaccaccucugccucgucuucgagcuccucuccuacaaccucuacgaccuccuccgcaacacccacuuccgcggcgucucccucaaccucacccgcaagcucgcccagcagcucugcaccgcccuccucuuccucgccacccccgagcucuccaucauccacugcgaccucaagcccgagaacauccuccucugcaaccccaagcgcuccgccaucaagaucgucgacuucggcuccuccugccagcucggccagcgcaucuaccaguacauccagucccgcuucuaccgcucccccgagguccuccucggcacccccuacgaccucgccaucgacauguggucccucggcugcauccucgucgagaugcacaccggcgagccccucuucuccggcuccaacgaggucgaccagaugaaccgcaucgucgagguccucggcaucccccccgccgccaugcucgaccaggcccccaaggcccgcaaguacuucgagcgccuccccggcggcggcuggacccuccgccgcaccaaggagcuccgcaaggacuaccagggccccggcacccgccgccuccaggagguccucggcguccagaccggcggccccggcggccgccgcgccggcgagcccggccacucccccgccgacuaccuccgcuuccaggaccucguccuccgcaugcucgaguacgagcccgccgcccgcaucuccccccucggcgcccuccagcacggcuucuuccgccgcaccgccgacgaggccaccaacaccggccccgccggcuccuccgccuccaccucccccgccccccucgacaccugccccuccuccuccaccgccuccuccaucuccuccuccggcggcuccuccggcuccuccuccgacaaccgcaccuaccgcuacuccaaccgcuacugcggcggccccggcccccccaucaccgacugcgagaugaacuccccccaggucccccccucccagccccuccgccccugggccggcggcgacgucccccacaagacccaccaggcccccgccuccgccuccucccuccccggcaccggcgcccagcuccccccccagccccgcuaccucggccgcccccccucccccaccuccccccccccccccgagcucauggacgucucccucgucggcggccccgccgacugcucccccccccaccccgcccccgccccccagcaccccgccgccuccgcccuccgcacccgcaugaccggcggccgccccccccuccccccccccgacgaccccgccacccucggcccccaccucggccuccgcggcgucccccaguccaccgccgccuccuccuga

SEQ ID NO: 42516 - RNA, 1587 nt, Artificial Sequence
  derived and/or modified sequence opt2 from DYRK2__Homo_sapiens__NP_003574
augaacgaccaccuccacgucggcucccacgcccacggccagauccagguccagcagcucuucgaggacaacuccaacaagcgcaccguccucaccacccagcccaacggccucaccaccgucggcaagaccggccuccccgucguccccgagcgccagcucgacuccauccaccgccgccagggcuccuccaccucccucaaguccauggagggcaugggcaaggucaaggccacccccaugacccccgagcaggccaugaagcaguacaugcagaagcucaccgccuucgagcaccacgagaucuucuccuaccccgagaucuacuuccucggccucaacgccaagaagcgccagggcaugaccggcggccccaacaacggcggcuacgacgacgaccagggcuccuacguccaggucccccacgaccacgucgccuaccgcuacgagguccucaaggucaucggcaagggcuccuucggccaggucgucaaggccuacgaccacaagguccaccagcacgucgcccucaagaugguccgcaacgagaagcgcuuccaccgccaggccgccgaggagauccgcauccucgagcaccuccgcaagcaggacaaggacaacaccaugaacgucauccacaugcucgagaacuucaccuuccgcaaccacaucugcaugaccuucgagcuccucuccaugaaccucuacgagcucaucaagaagaacaaguuccagggcuucucccucccccucguccgcaaguucgcccacuccauccuccagugccucgacgcccuccacaagaaccgcaucauccacugcgaccucaagcccgagaacauccuccucaagcagcagggccgcuccggcaucaaggucaucgacuucggcuccuccugcuacgagcaccagcgcgucuacaccuacauccagucccgcuucuaccgcgcccccgaggucauccucggcgcccgcuacggcaugcccaucgacauguggucccucggcugcauccucgccgagcuccucaccggcuacccccuccuccccggcgaggacgagggcgaccagcucgccugcaugaucgagcuccucggcaugcccucccagaagcuccucgacgccuccaagcgcgccaagaacuucgucuccuccaagggcuacccccgcuacugcaccgucaccacccucuccgacggcuccgucguccucaacggcggccgcucccgccgcggcaagcuccgcggcccccccgagucccgcgaguggggcaacgcccucaagggcugcgacgacccccucuuccucgacuuccucaagcagugccucgagugggaccccgccguccgcaugacccccggccaggcccuccgccaccccuggcuccgccgccgccuccccaagccccccaccggcgagaagaccuccgucaagcgcaucaccgaguccaccggcgccaucaccuccaucuccaagcuccccccccccuccuccuccgccuccaagcuccgcaccaaccucgcccagaugaccgacgccaacggcaacauccagcagcgcaccguccuccccaagcucgucuccuga

SEQ ID NO: 42517 - RNA, 1707 nt, Artificial Sequence
  derived and/or modified sequence opt2 from DYRK3__Homo_sapiens__NP_001004023
augaaguggaaggagaagcucggcgacggcgucuacgacaccuucaugaugaucgacgagaccaagugcccccccugcuccaacguccucugcaaccccuccgagcccccccccccccgccgccucaacaugaccaccgagcaguucaccggcgaccacacccagcacuuccucgacggcggcgagaugaaggucgagcagcucuuccaggaguucggcaaccgcaaguccaacaccauccaguccgacggcaucuccgacuccgagaagugcucccccaccgucucccagggcaaguccuccgacugccucaacaccgucaaguccaacuccuccuccaaggcccccaaggucgucccccucacccccgagcaggcccucaagcaguacaagcaccaccucaccgccuacgagaagcucgagaucaucaacuaccccgagaucuacuucgucggccccaacgccaagaagcgccacggcgucaucggcggccccaacaacggcggcuacgacgacgccgacggcgccuacauccacgucccccgcgaccaccucgccuaccgcuacgagguccucaagaucaucggcaagggcuccuucggccaggucgcccgcgucuacgaccacaagcuccgccaguacgucgcccucaagaugguccgcaacgagaagcgcuuccaccgccaggccgccgaggagauccgcauccucgagcaccucaagaagcaggacaagaccggcuccaugaacgucauccacaugcucgaguccuucaccuuccgcaaccacgucugcauggccuucgagcuccucuccaucgaccucuacgagcucaucaagaagaacaaguuccagggcuucuccguccagcucguccgcaaguucgcccaguccauccuccagucccucgacgcccuccacaagaacaagaucauccacugcgaccucaagcccgagaacauccuccucaagcaccacggccgcuccuccaccaaggucaucgacuucggcuccuccugcuucgaguaccagaagcucuacaccuacauccagucccgcuucuaccgcgcccccgagaucauccucggcucccgcuacuccacccccaucgacaucugguccuucggcugcauccucgccgagcuccucaccggccagccccucuuccccggcgaggacgagggcgaccagcucgccugcaugauggagcuccucggcaugcccccccccaagcuccucgagcaguccaagcgcgccaaguacuucaucaacuccaagggcaucccccgcuacugcuccgucaccacccaggccgacggccgcgucguccucgucggcggccgcucccgccgcggcaagaagcgcggcccccccggcuccaaggacuggggcaccgcccucaagggcugcgacgacuaccucuucaucgaguuccucaagcgcugccuccacugggaccccuccgcccgccucacccccgcccaggcccuccgccaccccuggaucuccaaguccgucccccgcccccucaccaccaucgacaaggucuccggcaagcgcgucgucaaccccgccuccgccuuccagggccucggcuccaagcucccccccgucgucggcaucgccaacaagcucaaggccaaccucauguccgagaccaacggcuccaucccccucugcuccguccuccccaagcucaucuccuga

SEQ ID NO: 42518 - RNA, 6246 nt, Artificial Sequence
  derived and/or modified sequence opt2 from DYSF__Homo_sapiens__NP_001123927
augcucugcugccuccucguccgcgccuccaaccuccccuccgccaagaaggaccgccgcuccgaccccgucgccucccucaccuuccgcggcgucaagaagcgcaccaaggucaucaagaacuccgucaaccccgucuggaacgagggcuucgagugggaccucaagggcaucccccucgaccagggcuccgagcuccacgucgucgucaaggaccacgagaccaugggccgcaaccgcuuccucggcgaggccaaggucccccuccgcgagguccucgccacccccucccucuccgccuccuucaacgccccccuccucgacaccaagaagcagcccaccggcgccucccucguccuccaggucuccuacaccccccuccccggcgccgucccccucuuccccccccccaccccccucgagcccucccccacccuccccgaccucgacgucgucgccgacaccggcggcgaggaggacaccgaggaccagggccucaccggcgacgaggccgagcccuuccucgaccaguccggcggccccggcgcccccaccaccccccgcaagcuccccucccgcccccccccccacuaccccggcaucaagcgcaagcgcuccgcccccaccucccgcaagcuccucuccgacaagccccaggacuuccagauccgcguccaggucaucgagggccgccagcuccccggcgucaacaucaagcccgucgucaaggucaccgccgccggccagaccaagcgcacccgcauccacaagggcaacuccccccucuucaacgagacccucuucuucaaccucuucgacucccccggcgagcucuucgacgagcccaucuucaucaccgucgucgacucccgcucccuccgcaccgacgcccuccucggcgaguuccgcauggacgucggcaccaucuaccgcgagccccgccacgccuaccuccgcaaguggcuccuccucuccgaccccgacgacuucuccgccggcgcccgcggcuaccucaagaccucccucugcguccucggccccggcgacgaggccccccucgagcgcaaggaccccuccgaggacaaggaggacaucgaguccaaccuccuccgccccaccggcgucgcccuccgcggcgcccacuucugccucaaggucuuccgcgccgaggaccucccccagauggacgacgccgucauggacaacgucaagcagaucuucggcuucgaguccaacaagaagaaccucgucgaccccuucgucgaggucuccuucgccggcaagaugcucugcuccaagauccucgagaagaccgccaacccccaguggaaccagaacaucacccuccccgccauguuccccuccaugugcgagaagaugcgcauccgcaucaucgacugggaccgccucacccacaacgacaucgucgccaccaccuaccucuccauguccaagaucuccgcccccggcggcgagaucgaggaggagcccgccggcgccgucaagcccuccaaggccuccgaccucgacgacuaccucggcuuccuccccaccuucggccccugcuacaucaaccucuacggcuccccccgcgaguucaccggcuuccccgaccccuacaccgagcucaacaccggcaagggcgagggcgucgccuaccgcggccgccuccuccucucccucgagaccaagcucgucgagcacuccgagcagaaggucgaggaccuccccgccgacgacauccuccgcgucgagaaguaccuccgccgccgcaaguacucccucuucgccgccuucuacuccgccaccaugcuccaggacgucgacgacgccauccaguucgaggucuccaucggcaacuacggcaacaaguucgacaugaccugccucccccucgccuccaccacccaguacucccgcgccgucuucgacggcugccacuacuacuaccuccccuggggcaacgucaagcccgucgucguccucuccuccuacugggaggacaucucccaccgcaucgagacccagaaccagcuccucggcaucgccgaccgccucgaggccggccucgagcagguccaccucgcccucaaggcccagugcuccaccgaggacgucgacucccucgucgcccagcucaccgacgagcucaucgccggcugcucccagccccucggcgacauccacgagacccccuccgccacccaccucgaccaguaccucuaccagcuccgcacccaccaccucucccagaucaccgaggccgcccucgcccucaagcucggccacuccgagcuccccgccgcccucgagcaggccgaggacuggcuccuccgccuccgcgcccucgccgaggagccccagaacucccuccccgacaucgucaucuggaugcuccagggcgacaagcgcgucgccuaccagcgcguccccgcccaccagguccucuucucccgccgcggcgccaacuacugcggcaagaacugcggcaagcuccagaccaucuuccucaaguaccccauggagaagguccccggcgcccgcaugcccguccagauccgcgucaagcucugguucggccucuccgucgacgagaaggaguucaaccaguucgccgagggcaagcucuccgucuucgccgagaccuacgagaacgagaccaagcucgcccucgucggcaacuggggcaccaccggccucaccuaccccaaguucuccgacgucaccggcaagaucaagcuccccaaggacuccuuccgccccuccgccggcuggaccugggccggcgacugguucgucugccccgagaagacccuccuccacgacauggacgccggccaccucuccuucgucgaggaggucuucgagaaccagacccgccuccccggcggccaguggaucuacauguccgacaacuacaccgacgucaacggcgagaagguccuccccaaggacgacaucgagugcccccucggcuggaagugggaggacgaggagugguccaccgaccucaaccgcgccgucgacgagcagggcugggaguacuccaucaccaucccccccgagcgcaagcccaagcacuggguccccgccgagaagauguacuacacccaccgccgccgccgcuggguccgccuccgccgccgcgaccucucccagauggaggcccucaagcgccaccgccaggccgaggccgagggcgagggcugggaguacgccucccucuucggcuggaaguuccaccucgaguaccgcaagaccgacgccuuccgccgccgccgcuggcgccgccgcauggagccccucgagaagaccggccccgccgccgucuucgcccucgagggcgcccucggcggcgucauggacgacaaguccgaggacuccauguccgucuccacccucuccuucggcgucaaccgccccaccaucuccugcaucuucgacuacggcaaccgcuaccaccuccgcugcuacauguaccaggcccgcgaccucgccgccauggacaaggacuccuucuccgaccccuacgccaucgucuccuuccuccaccagucccagaagaccgucgucgucaagaacacccucaaccccaccugggaccagacccucaucuucuacgagaucgagaucuucggcgagcccgccaccgucgccgagcagccccccuccaucgucgucgagcucuacgaccacgacaccuacggcgccgacgaguucaugggccgcugcaucugccagcccucccucgagcgcaugccccgccucgccugguucccccucacccgcggcucccagcccuccggcgagcuccucgccuccuucgagcucauccagcgcgagaagcccgccauccaccacauccccggcuucgagguccaggagaccucccgcauccucgacgaguccgaggacaccgaccuccccuacccccccccccagcgcgaggccaacaucuacauggucccccagaacaucaagcccgcccuccagcgcaccgccaucgagauccucgccuggggccuccgcaacaugaaguccuaccagcucgccaacaucuccucccccucccucgucgucgagugcggcggccagaccguccaguccugcgucauccgcaaccuccgcaagaaccccaacuucgacaucugcacccucuucauggaggucaugcucccccgcgaggagcucuacugcccccccaucaccgucaaggucaucgacaaccgccaguucggccgccgccccgucgucggccagugcaccauccgcucccucgaguccuuccucugcgaccccuacuccgccgagucccccuccccccagggcggccccgacgacgucucccuccucucccccggcgaggacguccucaucgacaucgacgacaaggagccccucauccccauccaggaggaggaguucaucgacuggugguccaaguucuucgccuccaucggcgagcgcgagaagugcggcuccuaccucgagaaggacuucgacacccucaaggucuacgacacccagcucgagaacgucgaggccuucgagggccucuccgacuucugcaacaccuucaagcucuaccgcggcaagacccaggaggagaccgaggaccccuccgucaucggcgaguucaagggccucuucaagaucuacccccuccccgaggaccccgccauccccaugcccccccgccaguuccaccagcucgccgcccagggcccccaggagugccucguccgcaucuacaucguccgcgccuucggccuccagcccaaggaccccaacggcaagugcgaccccuacaucaagaucuccaucggcaagaaguccgucuccgaccaggacaacuacauccccugcacccucgagcccgucuucggcaagauguucgagcucaccugcacccucccccucgagaaggaccucaagaucacccucuacgacuacgaccuccucuccaaggacgagaagaucggcgagaccgucgucgaccucgagaaccgccuccucuccaaguucggcgcccgcugcggccucccccagaccuacugcgucuccggccccaaccaguggcgcgaccagcuccgccccucccagcuccuccaccucuucugccagcagcaccgcgucaaggcccccgucuaccgcaccgaccgcgucauguuccaggacaaggaguacuccaucgaggagaucgaggccggccgcauccccaacccccaccucggccccgucgaggagcgccucgcccuccacguccuccagcagcagggccucguccccgagcacgucgagucccgcccccucuacuccccccuccagcccgacaucgagcagggcaagcuccagaugugggucgaccucuuccccaaggcccucggccgccccggcccccccuucaacaucaccccccgccgcgcccgccgcuucuuccuccgcugcaucaucuggaacacccgcgacgucauccucgacgaccucucccucaccggcgagaagauguccgacaucuacgucaagggcuggaugaucggcuucgaggagcacaagcagaagaccgacguccacuaccgcucccucggcggcgagggcaacuucaacuggcgcuucaucuuccccuucgacuaccuccccgccgagcaggucugcaccaucgccaagaaggacgccuucuggcgccucgacaagaccgaguccaagauccccgcccgcgucgucuuccagaucugggacaacgacaaguucuccuucgacgacuuccucggcucccuccagcucgaccucaaccgcaugcccaagcccgccaagaccgccaagaagugcucccucgaccagcucgacgacgccuuccaccccgagugguucgucucccucuucgagcagaagaccgucaagggcugguggcccugcgucgccgaggagggcgagaagaagauccucgccggcaagcucgagaugacccucgagaucgucgccgaguccgagcacgaggagcgccccgccggccagggccgcgacgagcccaacaugaaccccaagcucgaggacccccgccgccccgacaccuccuuccucugguucaccucccccuacaagaccaugaaguucauccucuggcgccgcuuccgcugggccaucauccucuucaucauccucuucauccuccuccucuuccucgccaucuucaucuacgccuuccccaacuacgccgccaugaagcucgucaagcccuucuccuga

SEQ ID NO: 42519 - RNA, 1131 nt, Artificial Sequence
  derived and/or modified sequence opt2 from DYX1C1__Homo_sapiens__NP_001028731
augccccuccaggucuccgacuacuccuggcagcagaccaagaccgccgucuuccucucccucccccucaagggcgucugcguccgcgacaccgacgucuucugcaccgagaacuaccucaaggucaacuucccccccuuccucuucgaggccuuccucuacgcccccaucgacgacgaguccuccaaggccaagaucggcaacgacaccaucgucuucacccucuacaagaaggaggccgccaugugggagacccucuccgucaccggcgucgacaaggagaugaugcagcgcauccgcgagaaguccauccuccaggcccaggagcgcgccaaggaggccaccgaggccaaggccgccgccaagcgcgaggaccagaaguacgcccucuccgucaugaugaagaucgaggaggaggagcgcaagaagaucgaggacaugaaggagaacgagcgcaucaaggccaccaaggcccucgaggccuggaaggaguaccagcgcaaggccgaggagcagaagaagauccagcgcgaggagaagcucugccagaaggagaagcagaucaaggaggagcgcaagaagaucaaguacaagucccucacccgcaaccucgccucccgcaaccucgcccccaagggccgcaacuccgagaacaucuucaccgagaagcucaaggaggacuccauccccgccccccgcuccgucggcuccaucaagaucaacuucaccccccgcgucuuccccaccgcccuccgcgagucccaggucgccgaggaggaggaguggcuccacaagcaggccgaggcccgccgcgccaugaacaccgacaucgccgagcucugcgaccucaaggaggaggagaagaaccccgaguggcucaaggacaagggcaacaagcucuucgccaccgagaacuaccucgccgccaucaacgccuacaaccucgccauccgccucaacaacaagaugccccuccucuaccucaaccgcgccgccugccaccucaagcucaagaaccuccacaaggccaucgaggacuccuccaaggccuaccgcaucaugaagcgccaccuccgccucauccaccccaccaagcucuacaagcucaugcuccgccgcuucggcauguga

SEQ ID NO: 42520 - RNA, 2547 nt, Artificial Sequence
  derived and/or modified sequence opt2 from DZIP1__Homo_sapiens__NP_055749
augcaggccgaggccgccgacugguucuccuccaugcccuuccagaagcacgucuacuacccccucgccuccggccccgagggccccgacgucgccgucgccgccgccgccgccggcgccgccuccauggccugcgccccccccuccgccgccuccggcccccuccccuucuuccaguuccgcccccgccucgaguccgucgacuggcgccgccucuccgccaucgacgucgacaaggucgccggcgccgucgacguccucacccuccaggagaacaucaugaacaucaccuucugcaagcucgaggacgagaagugcccccacugccaguccggcgucgaccccguccuccucaagcucauccgccucgcccaguucaccaucgaguaccuccuccacucccaggaguuccucaccucccagcuccacacccucgaggagcgccuccgccucucccacugcgacggcgagcaguccaagaagcuccucaccaagcaggccggcgagaucaagacccucaaggaggagugcaagcgccgcaagaagaugaucuccacccagcagcucaugaucgaggccaaggccaacuacuaccagugccacuucugcgacaaggccuucaugaaccaggccuuccuccagucccacauccagcgccgccacaccgaggagaacucccacuucgaguaccagaagaacgcccagaucgagaagcuccgcuccgagaucgucguccucaaggaggagcuccagcucacccgcuccgagcucgaggccgcccaccacgccuccgccguccgcuucuccaaggaguacgagaugcagaagaccaaggaggaggacuuccucaagcucuucgaccgcuggaaggaggaggagaaggagaagcucgucgacgagauggagaaggucaaggagauguucaugaaggaguucaaggagcucaccuccaagaacuccgcccucgaguaccagcucuccgagauccagaaguccaacaugcagaucaaguccaacaucggcacccucaaggacgcccacgaguucaaggaggaccgcucccccuacccccaggacuuccacaacgucaugcagcuccucgacucccaggaguccaaguggaccgcccgcguccaggccauccaccaggagcacaagaaggagaagggccgccuccucucccacaucgagaagcuccgcaccuccaugaucgacgaccucaacgccuccaacgucuucuacaagaagcgcaucgaggagcucggccagcgccuccaggagcagaacgagcucaucaucacccagcgccagcagaucaaggacuucaccugcaacccccucaacuccaucuccgagcccaaggucaacgcccccgcccuccacacccucgagaccaaguccucccuccccaugguccacgagcaggccuucuccucccacauccucgagcccaucgaggagcucuccgaggaggagaagggccgcgagaacgagcagaagcucaacaacaacaagaugcaccuccgcaaggcccucaaguccaacuccucccucaccaagggccuccgcaccauggucgagcagaaccucauggagaagcucgagacccucggcaucaacgccgacauccgcggcaucuccuccgaccagcuccaccgcguccucaaguccgucgaguccgagcgccacaagcaggagcgcgagauccccaacuuccaccagauccgcgaguuccucgagcaccaggucuccugcaagaucgaggagaaggcccuccucuccuccgaccagugcuccgucucccagauggacacccucuccaccggcgagguccccaagaugauccagcuccccuccaagaaccgccagcucauccgccagaaggccgucuccaccgaccgcaccuccguccccaagaucaagaagaacgucauggaggaccccuucccccgcaaguccuccaccaucaccaccccccccuucuccuccgaggaggagcaggaggacgacgaccucauccgcgccuacgccucccccggcccccuccccgucccccccccccagaacaagggcuccuucggcaagaacaccgucaaguccgacgccgacggcaccgagggcuccgagaucgaggacaccgacgacucccccaagcccgccggcgucgccgucaagacccccaccgagaaggucgagaagauguucccccaccgcaagaacgucaacaagcccgucggcggcaccaacguccccgagauguucaucaagaaggaggagcuccaggagcucaagugcgccgacgucgaggacgaggacugggacaucuccucccucgaggaggagaucucccucggcaagaaguccggcaaggagcagaaggagcccccccccgccaagaacgagccccacuucgcccacguccucaacgccuggggcgccuucaaccccaagggccccaagggcgagggccuccaggagaacgaguccuccacccucaaguccucccucgucaccgucaccgacugguccgacaccuccgacgucuga

SEQ ID NO: 42521 - RNA, 1314 nt, Artificial Sequence
  derived and/or modified sequence opt2 from E2F1__Homo_sapiens__NP_005216
auggcccucgccggcgcccccgccggcggccccugcgcccccgcccucgaggcccuccucggcgccggcgcccuccgccuccucgacuccucccagaucgucaucaucuccgccgcccaggacgccuccgccccccccgcccccaccggccccgccgcccccgccgccggccccugcgaccccgaccuccuccucuucgccaccccccaggccccccgccccacccccuccgccccccgccccgcccucggccgcccccccgucaagcgccgccucgaccucgagaccgaccaccaguaccucgccgaguccuccggccccgcccgcggccgcggccgccaccccggcaagggcgucaagucccccggcgagaagucccgcuacgagaccucccucaaccucaccaccaagcgcuuccucgagcuccucucccacuccgccgacggcgucgucgaccucaacugggccgccgagguccucaagguccagaagcgccgcaucuacgacaucaccaacguccucgagggcauccagcucaucgccaagaaguccaagaaccacauccaguggcucggcucccacaccaccgucggcgucggcggccgccucgagggccucacccaggaccuccgccagcuccaggaguccgagcagcagcucgaccaccucaugaacaucugcaccacccagcuccgccuccucuccgaggacaccgacucccagcgccucgccuacgucaccugccaggaccuccgcuccaucgccgaccccgccgagcagauggucauggucaucaaggccccccccgagacccagcuccaggccgucgacuccuccgagaacuuccagaucucccucaaguccaagcagggccccaucgacgucuuccucugccccgaggagaccgucggcggcaucucccccggcaagacccccucccaggaggucaccuccgaggaggagaaccgcgccaccgacuccgccaccaucgucucccccccccccuccuccccccccuccucccucaccaccgaccccucccagucccuccucucccucgagcaggagccccuccucucccgcaugggcucccuccgcgcccccgucgacgaggaccgccucuccccccucgucgccgccgacucccuccucgagcacguccgcgaggacuucuccggccuccuccccgaggaguucaucucccucucccccccccacgaggcccucgacuaccacuucggccucgaggagggcgagggcauccgcgaccucuucgacugcgacuucggcgaccucaccccccucgacuucuga

SEQ ID NO: 42522 - RNA, 1005 nt, Artificial Sequence
  derived and/or modified sequence opt2 from E2F3__Homo_sapiens__NP_001230005
augccccuccagcagcaggccaagcgccgccucgagcucggcgaguccggccaccaguaccucuccgacggccucaagacccccaagggcaagggccgcgccgcccuccgcucccccgacucccccaagaagaagacccgcuacgacaccucccucggccuccucaccaagaaguucauccagcuccucucccagucccccgacggcguccucgaccucaacaaggccgccgagguccucaagguccagaagcgccgcaucuacgacaucaccaacguccucgagggcauccaccucaucaagaagaaguccaagaacaacguccaguggaugggcugcucccucuccgaggacggcggcaugcucgcccagugccagggccucuccaaggaggucaccgagcucucccaggaggagaagaagcucgacgagcucauccaguccugcacccucgaccucaagcuccucaccgaggacuccgagaaccagcgccucgccuacgucaccuaccaggacauccgcaagaucuccggccucaaggaccagaccgucaucgucgucaaggccccccccgagacccgccucgagguccccgacuccaucgagucccuccagauccaccucgccuccacccagggccccaucgaggucuaccucugccccgaggagaccgagacccacucccccaugaagaccaacaaccaggaccacaacggcaacauccccaagcccgccuccaaggaccucgccuccaccaacuccggccacuccgacugcuccgucuccaugggcaaccucuccccccucgccucccccgccaaccuccuccagcagaccgaggaccagauccccuccaaccucgagggccccuucgucaaccuccuccccccccuccuccaggaggacuaccuccucucccucggcgaggaggagggcaucuccgaccucuucgacgccuacgaccucgagaagcucccccucgucgaggacuucaugugcuccuga

SEQ ID NO: 42523 - RNA, 1242 nt, Artificial Sequence
  derived and/or modified sequence opt2 from E2F4__Homo_sapiens__NP_001941
auggccgaggccggcccccaggccccccccccccccggcacccccucccgccacgagaagucccucggccuccucaccaccaaguucgucucccuccuccaggaggccaaggacggcguccucgaccucaagcucgccgccgacacccucgccguccgccagaagcgccgcaucuacgacaucaccaacguccucgagggcaucggccucaucgagaagaaguccaagaacuccauccaguggaagggcgucggccccggcugcaacacccgcgagaucgccgacaagcucaucgagcucaaggccgagaucgaggagcuccagcagcgcgagcaggagcucgaccagcacaaggucuggguccagcaguccauccgcaacgucaccgaggacguccagaacuccugccucgccuacgucacccacgaggacaucugccgcugcuucgccggcgacacccuccucgccauccgcgcccccuccggcaccucccucgagguccccauccccgagggccucaacggccagaagaaguaccagauccaccucaaguccgucuccggccccaucgagguccuccucgucaacaaggaggccugguccuccccccccgucgccguccccguccccccccccgaggaccuccuccagucccccuccgccgucuccaccccccccccccuccccaagcccgcccucgcccagucccaggaggccucccgccccaacuccccccagcucacccccaccgccguccccggcuccgccgagguccagggcauggccggccccgccgccgagaucaccgucuccggcggccccggcaccgacuccaaggacuccggcgagcucuccucccucccccucggccccaccacccucgacacccgcccccuccaguccuccgcccuccucgacuccuccuccuccuccuccuccuccuccuccuccuccuccaacuccaacuccuccuccuccuccggccccaaccccuccaccuccuucgagcccaucaaggccgaccccaccggcguccucgagcuccccaaggagcucuccgagaucuucgaccccacccgcgagugcauguccuccgagcuccucgaggagcucauguccuccgaggucuucgccccccuccuccgccucucccccccccccggcgaccacgacuacaucuacaaccucgacgaguccgagggcgucugcgaccucuucgacguccccguccucaaccucuga

SEQ ID NO: 42524 - RNA, 1038 nt, Artificial Sequence
  derived and/or modified sequence opt2 from E2F5__Homo_sapiens__NP_001077057
auggccgccgccgagcccgccuccuccggccagcaggcccccgccggccagggccagggccagcgcccccccccccagcccccccaggcccaggccccccagccccccccccccccccagcucggcggcgccggcggcggcuccucccgccacgagaagucccucggccuccucaccaccaaguucgucucccuccuccaggaggccaaggacggcguccucgaccucaaggccgccgccgacacccucgccguccgccagaagcgccgcaucuacgacaucaccaacguccucgagggcaucgaccucaucgagaagaaguccaagaacuccauccaguggaagggcgucggcgccggcugcaacaccaaggaggucaucgaccgccuccgcuaccucaaggccgagaucgaggaccucgagcucaaggagcgcgagcucgaccagcagaagcucuggcuccagcaguccaucaagaacgucauggacgacuccaucaacaaccgcuucuccuacgucacccacgaggacaucugcaacugcuucaacggcgacacccuccucgccauccaggcccccuccggcacccagcucgagguccccauccccgagaugggccagaacggccagaagaaguaccagaucaaccucaagucccacuccggccccauccacguccuccucaucaacaaggaguccuccuccuccaagcccgucgucuuccccguccccccccccgacgaccucacccagcccuccucccagucccucacccccgucaccccccagaaguccuccauggccacccagaaccuccccgagcagcacgucuccgagcgcucccaggcccuccagcagaccuccgccaccgacaucuccuccggcuccaucuccggcgacaucaucgacgagcucauguccuccgacgucuucccccuccuccgccucucccccacccccgccgacgacuacaacuucaaccucgacgacaacgagggcgucugcgaccucuucgacguccagauccucaacuacuga

SEQ ID NO: 42525 - RNA, 750 nt, Artificial Sequence
  derived and/or modified sequence opt2 from E2F6__Homo_sapiens__NP_001265204
augaaccccucccccuccaagauccgcaucaaccucgaggacaacguccaguacgucuccaugcgcaaggcccucaaggucaagcgcccccgcuucgacgucucccucgucuaccucacccgcaaguucauggaccucguccgcuccgcccccggcggcauccucgaccucaacaaggucgccaccaagcucggcguccgcaagcgccgcgucuacgacaucaccaacguccucgacggcaucgaccucgucgagaagaaguccaagaaccacauccgcuggaucggcuccgaccucuccaacuucggcgccgucccccagcagaagaagcuccaggaggagcucuccgaccucuccgccauggaggacgcccucgacgagcucaucaaggacugcgcccagcagcucuucgagcucaccgacgacaaggagaacgagcgccucgccuacgucaccuaccaggacauccacuccauccaggccuuccacgagcagaucgucaucgccgucaaggcccccgccgagacccgccucgacguccccgccccccgcgaggacuccaucaccguccacauccgcuccaccaacggccccaucgacgucuaccucugcgaggucgagcagggccagaccuccaacaagcgcuccgagggcgucggcaccuccuccuccgaguccacccaccccgagggccccgaggaggaggagaacccccagcaguccgaggagcuccucgaggucuccaacuga

SEQ ID NO: 42526 - RNA, 2736 nt, Artificial Sequence
  derived and/or modified sequence opt2 from E2F7__Homo_sapiens__NP_976328
auggaggucaacugccucacccucaaggaccucaucuccccccgccagccccgccucgacuucgccgucgaggacggcgagaacgcccagaaggagaacaucuucgucgaccgcucccgcauggcccccaagacccccaucaagaacgagcccaucgaccucuccaagcagaagaaguucacccccgagcgcaaccccaucacccccgucaaguucgucgaccgccagcaggccgagcccuggacccccaccgccaaccucaagaugcucaucuccgccgccucccccgacauccgcgaccgcgagaagaagaagggccucuuccgccccaucgagaacaaggacgacgccuucaccgacucccuccagcucgacgucgucggcgacuccgccgucgacgaguucgagaagcagcgccccucccgcaagcagaagucccucggccuccucugccagaaguuccucgcccgcuaccccuccuacccccucuccaccgagaagaccaccaucucccucgacgaggucgccgucucccucggcgucgagcgccgccgcaucuacgacaucgucaacguccucgagucccuccaccucgucucccgcgucgccaagaaccaguacggcuggcacggccgccacucccuccccaagacccuccgcaaccuccagcgccucggcgaggagcagaaguacgaggagcagauggccuaccuccagcagaaggagcucgaccucaucgacuacaaguucggcgagcgcaagaaggacggcgaccccgacucccaggagcagcagcuccucgacuucuccgagcccgacugccccuccuccuccgccaacucccgcaaggacaagucccuccgcaucaugucccagaaguucgucaugcucuuccucgucuccaagaccaagaucgucacccucgacgucgccgccaagauccucaucgaggagucccaggacgcccccgaccacuccaaguucaagaccaagguccgccgccucuacgacaucgccaacguccucaccucccucgcccucaucaagaagguccacgucaccgaggagcgcggccgcaagcccgccuucaaguggaucggccccgucgacuucuccuccuccgacgaggagcucgucgacgucuccgccuccguccuccccgagcucaagcgcgagaccuacggccagauccaggucugcgccaagcagaagcucgcccgccacggcuccuucaacaccguccaggccuccgagcgcauccagcgcaaggucaacuccgagcccuccucccccuaccgcgaggagcagggcuccggcggcuacucccucgagaucggcucccucgccgccgucuaccgccagaagaucgaggacaacucccagggcaaggccuucgccuccaagcgcgucgucccccccuccuccucccucgaccccgucgcccccuuccccguccucuccgucgaccccgaguacugcgucaacccccucgcccaccccgucuucuccgucgcccagaccgaccuccaggccuucuccaugcagaacggccucaacggccaggucgacgucucccucgccuccgccgccuccgccgucgagucccucaagcccgcccuccucgccggccagccccucgucuacguccccuccgccucccucuucaugcucuacggcucccuccaggagggccccgccuccggcuccggcuccgagcgcgacgaccgcuccuccgaggcccccgccaccgucgagcucuccuccgcccccuccgcccagaagcgccucugcgaggagcgcaagccccaggaggaggacgagcccgccaccaagcgccagucccgcgaguacgaggacggcccccucucccucgucaugcccaagaagcccuccgacuccaccgaccucgccucccccaagaccaugggcaaccgcgccuccaucccccucaaggacauccacgucaacggccagcuccccgccgccgaggagaucuccggcaaggccaccgccaacucccucgucuccuccgaguggggcaaccccucccgcaacaccgacgucgagaagcccuccaaggagaacgaguccaccaaggagcccucccuccuccaguaccucugcguccagucccccgccggccucaacggcuucaacguccuccucuccggcucccagaccccccccaccgucggccccuccuccggccagcuccccuccuucuccguccccugcaugguccuccccucccccccccucggccccuuccccguccucuacucccccgccaugcccggccccgucuccuccacccucggcgcccuccccaacaccggccccgucaacuucucccuccccggccucggcuccaucgcccagcuccucgucggccccaccgccgucgucaaccccaaguccuccacccuccccuccgccgacccccagcuccagucccagcccucccucaaccucucccccgucaugucccgcucccacuccgucguccagcagcccgagucccccgucuacgucggccaccccgucuccgucgucaagcuccaccagucccccguccccgucacccccaaguccauccagcgcacccaccgcgagaccuucuucaagacccccggcucccucggcgaccccguccucaagcgccgcgagcgcaaccagucccgcaacaccuccuccgcccagcgccgccucgagauccccuccggcggcgccgacuga

SEQ ID NO: 42527 - RNA, 2604 nt, Artificial Sequence
  derived and/or modified sequence opt2 from E2F8__Homo_sapiens__NP_078956
auggagaacgagaaggagaaccucuucugcgagccccacaagcgcggccucaugaagaccccccucaaggaguccaccaccgccaacaucguccucgccgagauccagcccgacuucggcccccucaccacccccaccaagcccaaggagggcucccagggcgagcccuggacccccaccgccaaccucaagaugcucaucuccgccgucucccccgagauccgcaaccgcgaccagaagcgcggccucuucgacaaccgcuccggccuccccgaggccaaggacugcauccacgagcaccucuccggcgacgaguucgagaagucccagcccucccgcaaggagaagucccucggccuccucugccacaaguuccucgcccgcuaccccaacuaccccaaccccgccgucaacaacgacaucugccucgacgaggucgccgaggagcucaacgucgagcgccgccgcaucuacgacaucgucaacguccucgagucccuccacauggucucccgccucgccaagaaccgcuacaccuggcacggccgccacaaccucaacaagacccucggcacccucaaguccaucggcgaggagaacaaguacgccgagcagaucaugaugaucaagaagaaggaguacgagcaggaguucgacuucaucaaguccuacuccaucgaggaccacaucaucaaguccaacaccggccccaacggccaccccgacaugugcuucgucgagcuccccggcgucgaguuccgcgccgccuccgucaacucccgcaaggacaagucccuccgcgucaugucccagaaguucgucaugcucuuccucgucuccaccccccagaucgucucccucgaggucgccgccaagauccucaucggcgaggaccacgucgaggaccucgacaaguccaaguucaagaccaagauccgccgccucuacgacaucgccaacguccucuccucccucgaccucaucaagaagguccacgucaccgaggagcgcggccgcaagcccgccuucaaguggaccggccccgagaucucccccaacaccuccggcuccucccccgucauccacuucacccccuccgaccucgagguccgccgcuccuccaaggagaacugcgccaagaaccucuucuccacccgcggcaagcccaacuucacccgccaccccucccucaucaagcucgucaaguccaucgaguccgaccgccgcaagaucaacuccgcccccuccucccccaucaagaccaacaaggccgaguccucccagaacuccgcccccuuccccuccaagauggcccagcucgccgccaucugcaagaugcagcucgaggagcaguccuccgagucccgccagaaggucaagguccagcucgcccgcuccggccccugcaagcccgucgccccccucgacccccccgucaacgccgagauggagcucaccgcccccucccucauccagccccucggcauggucccccucauccccuccccccucuccuccgccgucccccucauccucccccaggcccccuccggccccuccuacgccaucuaccuccagcccacccaggcccaccaguccgucacccccccccagggccucucccccaccgucugcaccacccacuccuccaaggccaccggcuccaaggacuccaccgacgccaccaccgagaaggccgccaacgacaccuccaaggccuccgccuccacccgccccggcucccuccuccccgcccccgagcgccagggcgccaagucccgcacccgcgagcccgccggcgagcgcggcuccaagcgcgccuccaugcucgaggacuccggcuccaagaagaaguucaaggaggaccucaagggccucgagaacgucuccgccacccucuuccccuccggcuaccucaucccccucacccagugcuccucccucggcgccgaguccauccucuccggcaaggagaacuccuccgcccucucccccaaccaccgcaucuacuccucccccaucgccggcgucauccccgucaccuccuccgagcucaccgccgucaacuuccccuccuuccacgucaccccccucaagcucauggucucccccaccuccgucgccgccguccccgucggcaacucccccgcccucgccuccucccaccccguccccauccagaaccccuccuccgccaucgucaacuucacccuccagcaccucggccucaucucccccaacguccagcucuccgccucccccggcuccggcaucguccccgucuccccccgcaucgaguccgucaacgucgcccccgagaacgccggcacccagcagggccgcgccaccaacuacgacucccccguccccggccagucccagcccaacggccaguccgucgccgucaccggcgcccagcagcccguccccgucacccccaagggcucccagcucgucgccgaguccuucuuccgcacccccggcggccccaccaagcccaccuccuccuccugcauggacuucgagggcgccaacaagaccucccucggcacccucuucgucccccagcgcaagcucgaggucuccaccgaggacguccacuga

SEQ ID NO: 42528 - RNA, 2355 nt, Artificial Sequence
  derived and/or modified sequence opt2 from E4F1__Homo_sapiens__NP_004415
auggagggcgccauggccguccgcgucaccgccgcccacaccgccgaggcccaggccgaggccggccgcgaggccggcgagggcgccgucgccgccgucgccgccgcccucgcccccuccggcuuccucggccuccccgcccccuucuccgaggaggacgaggacgacguccaccgcugcggccgcugccaggccgaguucaccgcccucgaggacuucguccagcacaagauccagaaggccugccagcgcgccccccccgaggcccuccccgccacccccgccaccaccgcccuccucggccaggaggucguccccgccgcccccggccccgaggagcccaucaccgucgcccacaucgucgucgaggccgccucccucgccgccgacaucucccacgccuccgaccucgucggcggcggccacaucaaggaggucaucgucgccgccgaggccgagcucggcgacggcgagauggccgaggcccccggcuccccccaccagcagggccucggccucgccggcgagggcgagcaggcccaggucaagcuccucgucaacaaggacggccgcuacgucugcgcccucugccacaagaccuucaagaccggcuccauccucaaggcccacauggucacccacuccucccgcaaggaccacgagugcaagcucugcggcgccuccuuccgcaccaagggcucccucauccgccaccaccgccgccacaccgacgagcgccccuacaagugcuccaagugcggcaaguccuuccgcgaguccggcgcccucacccgccaccucaagucccucacccccugcaccgagaagauccgcuucuccgucuccaaggacgucgucgucuccaaggaggacgcccgcgccggcuccggcgccggcgccgccggccucggcaccgccaccuccuccgucaccggcgagcccaucgagaccucccccgucauccaccucgucaccgacgccaagggcaccgucauccacgagguccacguccagaugcaggagcucucccucggcaugaaggcccucgcccccgagccccccgucucccaggagcuccccugcuccuccgagggcucccgcgagaaccuccuccaccaggccaugcagaacuccggcaucguccucgagcgcgccgccggcgaggagggcgcccucgagcccgcccccgccgccggcuccuccccccagccccucgccgucgccgccccccagcuccccguccucgagguccagccccucgagacccaggucgccuccgaggccuccgccgucccccgcacccaccccugcccccagugcuccgagaccuuccccaccgccgccacccucgaggcccacaagcgcggccacaccggcccccgccccuucgccugcgcccagugcggcaaggccuuccccaaggccuaccuccucaagaagcaccaggagguccacguccgcgagcgccgcuuccgcugcggcgacugcggcaagcucuacaagaccaucgcccacguccgcggccaccgccgcguccacuccgacgagcgccccuaccccugccccaagugcggcaagcgcuacaagaccaagaacgcccagcagguccacuuccgcacccaccucgaggagaagccccacgucugccaguucugcucccgcggcuuccgcgagaagggcucccucguccgccacguccgccaccacaccggcgagaagcccuucaagugcuacaagugcggccgcggcuucgccgagcacggcacccucaaccgccaccuccgcaccaagggcggcugccuccucgaggucgaggagcuccucgucuccgaggacucccccgccgccgccaccaccguccucaccgaggacccccacaccguccucgucgaguucuccuccgucgucgccgacacccaggaguacaucaucgaggccaccgccgacgacgccgagaccuccgaggccaccgagaucaucgagggcacccagaccgaggucgacucccacaucaugaaggucguccagcagaucguccaccaggccuccgccggccaccagaucaucguccagaacgucaccauggacgaggagaccgcccucggccccgaggccgccgccgccgacaccaucaccaucgccacccccgagucccucaccgagcaggucgccaugacccucgccuccgccaucuccgagggcaccguccucgccgcccgcgccggcaccuccggcaccgagcaggccaccgucaccauggucuccuccgaggacaucgagauccucgagcacgccggcgagcucgucaucgccucccccgagggccagcucgagguccagaccgucaucgucuga

SEQ ID NO: 42529 - RNA, 807 nt, Artificial Sequence
  derived and/or modified sequence opt2 from EAF1__Homo_sapiens__NP_149074
augaacggcaccgccaacccccuccucgaccgcgaggagcacugccuccgccucggcgaguccuucgagaagcgcccccgcgccuccuuccacaccauccgcuacgacuucaagcccgccuccaucgacaccuccugcgagggcgagcuccaggucggcaagggcgacgaggucaccaucacccucccccacauccccggcuccaccccccccaugaccgucuucaagggcaacaagcgccccuaccagaaggacugcguccucaucaucaaccacgacaccggcgaguacguccucgagaagcucuccuccuccauccaggucaagaagacccgcgccgagggcuccuccaagauccaggcccgcauggagcagcagcccacccgccccccccagaccucccagcccccccccccccccccccccaugcccuuccgcgcccccaccaagccccccgucggccccaagaccuccccccucaaggacaaccccucccccgagccccagcucgacgacaucaagcgcgagcuccgcgccgaggucgacaucaucgagcagauguccuccuccuccggcuccuccuccuccgacuccgaguccuccuccggcuccgacgacgacuccuccuccuccggcggcgaggacaacggccccgccucccccccccagcccucccaccagcagcccuacaacucccgccccgccgucgccaacggcaccucccgcccccagggcuccaaccagcucaugaacacccuccgcaacgaccuccagcucuccgaguccggcuccgacuccgacgacuga

SEQ ID NO: 42530 - RNA, 783 nt, Artificial Sequence
  derived and/or modified sequence opt2 from EAF2__Homo_sapiens__NP_060926
augaacuccgccgccggcuucucccaccucgaccgccgcgagcgcguccucaagcucggcgaguccuucgagaagcagccccgcugcgccuuccacaccguccgcuacgacuucaagcccgccuccaucgacaccuccuccgagggcuaccucgaggucggcgagggcgagcaggucaccaucacccuccccaacaucgagggcuccaccccccccgucaccgucuucaagggcuccaagaagcccuaccucaaggagugcauccucaucaucaaccacgacaccggcgagugccgccucgagaagcucuccuccaacaucaccgucaagaagacccgcgucgagggcuccuccaagauccaguaccgcaaggagcagcagcagcagcagauguggaacuccgcccgcacccccaaccucgucaagcacucccccuccgaggacaagaugucccccgccucccccaucgacgacaucgagcgcgagcucaaggccgaggccucccucauggaccagauguccuccugcgacuccuccuccgacuccaaguccuccuccuccuccuccuccgaggacuccuccuccgacuccgaggacgaggacugcaaguccuccaccuccgacaccggcaacugcgucuccggccaccccaccaugacccaguaccgcauccccgacaucgacgccucccacaaccgcuuccgcgacaacuccggccuccucaugaacacccuccgcaacgaccuccagcucuccgaguccggcuccgacuccgacgacuga

SEQ ID NO: 42531 - RNA, 1572 nt, Artificial Sequence
  derived and/or modified sequence opt2 from EARS2__Homo_sapiens__NP_001077083
auggccgcccuccuccgccgccuccuccagcgcgagcgccccuccgccgccuccggccgccccgucggccgccgcgaggccaaccucggcaccgacgccggcgucgccguccgcguccgcuucgcccccucccccaccggcuuccuccaccucggcggccuccgcaccgcccucuacaacuacaucuucgccaagaaguaccagggcuccuucauccuccgccucgaggacaccgaccagacccgcgucguccccggcgccgccgagaacaucgaggacaugcucgagugggccggcaucccccccgacgaguccccccgccgcggcggccccgccggccccuaccagcagucccagcgccucgagcucuacgcccaggccaccgaggcccuccucaagaccggcgccgccuaccccugcuucugcuccccccagcgccucgagcuccucaagaaggaggcccuccgcaaccaccagaccccccgcuacgacaaccgcugccgcaacaugucccaggagcaggucgcccagaagcucgccaaggaccccaagcccgccauccgcuuccgccucgagcaggucguccccgccuuccaggaccucgucuacggcuggaaccgccacgaggucgccuccgucgagggcgaccccgucaucaugaaguccgacggcuuccccaccuaccaccucgccugcgucgucgacgaccaccacaugggcaucucccacguccuccgcggcuccgaguggcucgucuccaccgccaagcaccuccuccucuaccaggcccucggcuggcagcccccccacuucgcccaccucccccuccuccucaaccgcgacggcuccaagcucuccaagcgccagggcgacgucuuccucgagcacuucgccgccgacggcuuccuccccgacucccuccucgacaucaucaccaacugcggcuccggcuucgccgagaaccagaugggccgcacccuccccgagcucaucacccaguucaaccucacccaggucaccugccacuccgcccuccucgaccucgagaagcuccccgaguucaaccgccuccaccuccagcgccucgucuccaacgagucccagcgccgccagcucgucggcaagcuccagguccucgucgaggaggccuucggcugccagcuccagaaccgcgacguccucaaccccgucuacgucgagcgcauccuccuccuccgccagggccacaucugccgccuccaggaccucgucucccccgucuacuccuaccucuggacccgccccgccgucggccgcgcccagcucgacgccaucuccgagaaggucgacgucaucgccaagcgcguccucggccuccucgagcgcuccuccaugucccucacccaggacaugcucaacggcgagcucaagaagcucuccgagggccucgagggcaccaaguacuccaacgucaugaagcuccuccgcauggcccucuccggccagcagcagggcccccccgucgccgagaugaugcucgcccucggccccaaggagguccgcgagcgcauccagaaggucgucuccuccuga

SEQ ID NO: 42532 - RNA, 642 nt, Artificial Sequence
  derived and/or modified sequence opt2 from EBAG9__Homo_sapiens__NP_001265867
auggccaucacccaguuccgccucuucaaguucugcaccugccucgccaccgucuucuccuuccucaagcgccucaucugccgcuccggccgcggccgcaagcucuccggcgaccagaucacccuccccaccaccgucgacuacuccuccguccccaagcagaccgacgucgaggaguggaccuccugggacgaggacgcccccaccuccgucaagaucgagggcggcaacggcaacgucgccacccagcagaacucccucgagcagcucgagcccgacuacuucaaggacaugacccccaccauccgcaagacccagaagaucgucaucaagaagcgcgagccccucaacuucggcauccccgacggcuccaccggcuucuccucccgccucgccgccacccaggaccuccccuucauccaccaguccuccgagcucggcgaccucgacaccuggcaggagaacaccaacgccugggaggaggaggaggacgccgccuggcaggccgaggagguccuccgccagcagaagcucgccgaccgcgagaagcgcgccgccgagcagcagcgcaagaagauggagaaggaggcccagcgccucaugaagaaggagcagaacaagaucggcgucaagcucuccuga

SEQ ID NO: 42533 - RNA, 1776 nt, Artificial Sequence
  derived and/or modified sequence opt2 from EBF1__Homo_sapiens__NP_076870
auguucggcauccaggaguccauccagcgcuccggcuccuccaugaaggaggagccccucggcuccggcaugaacgccguccgcaccuggaugcagggcgccggcguccucgacgccaacaccgccgcccaguccggcgucggccucgcccgcgcccacuucgagaagcagccccccuccaaccuccgcaaguccaacuucuuccacuucguccucgcccucuacgaccgccagggccagcccgucgagaucgagcgcaccgccuucgucggcuucgucgagaaggagaaggaggccaacuccgagaagaccaacaacggcauccacuaccgccuccagcuccucuacuccaacggcauccgcaccgagcaggacuucuacguccgccucaucgacuccaugaccaagcaggccaucgucuacgagggccaggacaagaaccccgagaugugccgcguccuccucacccacgagaucaugugcucccgcugcugcgacaagaaguccugcggcaaccgcaacgagacccccuccgaccccgucaucaucgaccgcuucuuccucaaguucuuccucaagugcaaccagaacugccucaagaacgccggcaacccccgcgacaugcgccgcuuccaggucgucgucuccaccaccgucaacgucgacggccacguccucgccgucuccgacaacauguucguccacaacaacuccaagcacggccgccgcgcccgccgccucgaccccuccgagggcacccccuccuaccucgagcacgccacccccugcaucaaggccaucucccccuccgagggcuggaccaccggcggcgccaccgucaucaucaucggcgacaacuucuucgacggccuccaggucaucuucggcaccaugcucgucugguccgagcucaucaccccccacgccauccgcguccagacccccccccgccacauccccggcgucgucgaggucacccucuccuacaaguccaagcaguucugcaagggcacccccggccgcuucaucuacaccgcccucaacgagcccaccaucgacuacggcuuccagcgccuccagaaggucaucccccgccaccccggcgaccccgagcgccuccccaaggaggucauccucaagcgcgccgccgaccucgucgaggcccucuacggcaugccccacaacaaccaggagaucauccucaagcgcgccgccgacaucgccgaggcccucuacuccgucccccgcaaccacaaccagcuccccgcccucgccaacaccuccguccacgccggcaugaugggcgucaacuccuucuccggccagcucgccgucaacgucuccgaggccucccaggccaccaaccagggcuucacccgcaacuccuccuccgucuccccccacggcuacguccccuccaccaccccccagcagaccaacuacaacuccgucaccaccuccaugaacggcuacggcuccgccgccauguccaaccucggcggcucccccaccuuccucaacggcuccgccgccaacucccccuacgccaucguccccuccucccccaccauggccuccuccaccucccuccccuccaacugcuccuccuccuccggcaucuucuccuucucccccgccaacauggucuccgccgucaagcagaaguccgccuucgcccccgucguccgcccccagaccucccccccccccaccugcaccuccaccaacggcaacucccuccaggccaucuccggcaugaucgucccccccauguga

SEQ ID NO: 42534 - RNA, 1728 nt, Artificial Sequence
  derived and/or modified sequence opt2 from EBF2__Homo_sapiens__NP_073150
auguucggcauccaggacacccucggccgcggccccacccucaaggagaagucccucggcgccgagauggacuccguccgcuccuggguccgcaacgucggcgucgucgacgccaacgucgccgcccaguccggcgucgcccucucccgcgcccacuucgagaagcagccccccuccaaccuccgcaaguccaacuucuuccacuucguccucgcccucuacgaccgccagggccagcccgucgagaucgagcgcaccgccuucgucgacuucgucgagaacgacaaggagcagggcaacgagaagaccaacaacggcacccacuacaagcuccagcuccucuacuccaacggcguccgcaccgagcaggaccucuacguccgccucaucgacuccgucaccaagcagcccaucgccuacgagggccagaacaagaaccccgagaugugccgcguccuccucacccacgaggucaugugcucccgcugcugcgagaagaaguccugcggcaaccgcaacgagacccccuccgaccccgucaucaucgaccgcuucuuccucaaguucuuccucaagugcaaccagaacugccucaagaccgccggcaacccccgcgacaugcgccgcuuccaggucguccucuccaccaccgucaacgucgacggccacguccucgccgucuccgacaacauguucguccacaacaacuccaagcacggccgccgcgcccgccgccucgaccccuccgaggccacccccugcaucaaggccaucucccccuccgagggcuggaccaccggcggcgccauggucaucaucaucggcgacaacuucuucgacggccuccaggucgucuucggcaccaugcucgucugguccgagcucaucaccccccacgccauccgcguccagacccccccccgccacauccccggcgucgucgaggucacccucuccuacaaguccaagcaguucugcaagggcgcccccggccgcuucaucuacaccgcccucaacgagcccaccaucgacuacggcuuccagcgccuccagaaggucaucccccgccaccccggcgaccccgagcgccucgccaaggagaugcuccucaagcgcgccgccgaccucgucgaggcccucuacggcaccccccacaacaaccaggacaucauccucaagcgcgccgccgacaucgccgaggcccucuacuccgucccccgcaaccccucccagcuccccgcccucuccuccucccccgcccacuccggcaugaugggcaucaacuccuacggcucccagcucggcgucuccaucuccgaguccacccagggcaacaaccagggcuacauccgcaacaccuccuccaucuccccccgcggcuacuccuccuccuccaccccccagcaguccaacuacuccaccuccuccaacuccaugaacggcuacuccaacguccccauggccaaccucggcguccccggcucccccggcuuccucaacggcucccccaccggcucccccuacggcaucauguccuccucccccaccgucggcuccuccuccaccuccuccauccuccccuucuccuccuccgucuuccccgccgucaagcagaaguccgccuucgcccccgucauccgcccccagggcucccccucccccgccugcuccuccggcaacggcaacggcuuccgcgccaugaccggccucgucgucccccccauguga

SEQ ID NO: 42535 - RNA, 1656 nt, Artificial Sequence
  derived and/or modified sequence opt2 from EBF3__Homo_sapiens__NP_001005463
auguucggcauccaggagaacaucccccgcggcggcaccaccaugaaggaggagccccucggcuccggcaugaaccccguccgcuccuggaugcacaccgccggcgucgucgacgccaacaccgccgcccaguccggcgucggccucgcccgcgcccacuucgagaagcagccccccuccaaccuccgcaaguccaacuucuuccacuucguccucgcccucuacgaccgccagggccagcccgucgagaucgagcgcaccgccuucgucgacuucgucgagaaggagaaggagcccaacaacgagaagaccaacaacggcauccacuacaagcuccagcuccucuacuccaacggcguccgcaccgagcaggaccucuacguccgccucaucgacuccaugaccaagcaggccaucgucuacgagggccaggacaagaaccccgagaugugccgcguccuccucacccacgagaucaugugcucccgcugcugcgacaagaaguccugcggcaaccgcaacgagacccccuccgaccccgucaucaucgaccgcuucuuccucaaguucuuccucaagugcaaccagaacugccucaagaacgccggcaacccccgcgacaugcgccgcuuccaggucgucgucuccaccaccgucaacgucgacggccacguccucgccgucuccgacaacauguucguccacaacaacuccaagcacggccgccgcgcccgccgccucgaccccuccgaggccacccccugcaucaaggccaucucccccuccgagggcuggaccaccggcggcgccaccgucaucaucaucggcgacaacuucuucgacggccuccaggucgucuucggcaccaugcucgucugguccgagcucaucaccccccacgccauccgcguccagacccccccccgccacauccccggcgucgucgaggucacccucuccuacaaguccaagcaguucugcaagggcgcccccggccgcuucgucuacaccgcccucaacgagcccaccaucgacuacggcuuccagcgccuccagaaggucaucccccgccaccccggcgaccccgagcgccuccccaaggagguccuccucaagcgcgccgccgaccucgucgaggcccucuacggcaugccccacaacaaccaggagaucauccucaagcgcgccgccgacaucgccgaggcccucuacuccgucccccgcaaccacaaccagauccccacccucggcaacaaccccgcccacaccggcaugaugggcgucaacuccuucuccucccagcucgccgucaacgucuccgagaccucccaggccaacgaccaggucggcuacucccgcaacaccuccuccgucuccccccgcggcuacguccccuccuccaccccccagcaguccaacuacaacaccgucuccaccuccaugaacggcuacggcuccggcgccauggccucccucggcguccccggcucccccggcuuccucaacggcuccuccgccaacucccccuacggcaugaagcagaaguccgccuucgcccccgucguccgcccccaggccucccccccccccuccugcaccuccgccaacggcaacggccuccaggccauguccggccucgucgucccccccauguga

SEQ ID NO: 42536 - RNA, 1797 nt, Artificial Sequence
  derived and/or modified sequence opt2 from EBF4__Homo_sapiens__NP_001103984
auggacgcccucccccgcuccggccucaaccucaaggaggagccccuccuccccgccggccucggcuccguccgcuccuggaugcagggcgccggcauccucgacgccuccaccgccgcccaguccggcgucggccucgcccgcgcccacuucgagaagcagccccccuccaaccuccgcaaguccaacuucuuccacuucguccucgccauguacgaccgccagggccagcccgucgaggucgagcgcaccgccuucaucgacuucgucgagaaggaccgcgagcccggcgccgagaagaccaacaacggcauccacuaccgccuccgccucgucuacaacaacggccuccgcaccgagcaggaccucuacguccgccucaucgacuccauguccaagcaggccaucaucuacgagggccaggacaagaaccccgagaugugccgcguccuccucacccacgagaucaugugcucccgcugcugcgaccgcaaguccugcggcaaccgcaacgagacccccuccgaccccgucaucaucgaccgcuucuuccucaaguucuuccucaagugcaaccagaacugccucaagaacgccggcaacccccgcgacaugcgccgcuuccaggucgucgucuccaccaccgucuccgucgacggccacguccucgccgucuccgacaacauguucguccacaacaacuccaagcacggccgccgcgcccgccgccucgaccccuccgaggccgccacccccugcaucaaggccaucucccccggcgagggcuggaccaccggcggcgccaccgucaucgucaucggcgacaacuucuucgacggccuccaggucgucuucggcaacguccucgucugguccgagcucaucaccccccacgccauccgcguccagacccccccccgccacauccccggcgucgucgaggucacccucuccuacaaguccaagcaguucugcaagggcugccccggccgcuucgucuacaccgcccucaacgagcccaccaucgacuacggcuuccagcgccuccagaaggucaucccccgccaccccggcgaccccgagcgccuccccaaggagguccuccucaagcgcgccgccgaccucgccgaggcccucuacggcguccccggcuccaaccaggagcuccuccucaagcgcgccgccgacgucgccgaggcccucuacuccaccccccgcgcccccggcccccucgccccccucgcccccucccacccccaccccgccgucgucggcaucaacgccuucuccuccccccucgccaucgccgucggcgacgccacccccggccccgagcccggcuacgcccgcuccugcuccuccgccuccccccgcggcuucgcccccucccccggcucccagcaguccggcuacggcggcggccucggcgccggccucggcggcuacggcgcccccggcgucgccggccucggcguccccggcucccccuccuuccucaacggcuccaccgccaccucccccuucgccaucaugcccuccucccccccccucgccgccgccuccuccaugucccuccccgccgccgcccccaccaccuccgucuucuccuucucccccgucaacaugaucuccgccgucaagcagcgcuccgccuucgcccccguccuccgcccccccuccucccccccccaggccugcccccgcgcccacggcgagggccuccccgaccaguccuucgaggacuccgacaaguuccacucccccgcccgcggccuccagggccucgccuacuccuga

SEQ ID NO: 42537 - RNA, 690 nt, Artificial Sequence
  derived and/or modified sequence opt2 from EBI3__Homo_sapiens__NP_005746
augaccccccagcuccuccucgcccucguccucugggccuccugcccccccugcuccggccgcaagggcccccccgccgcccucacccucccccgcguccagugccgcgccucccgcuaccccaucgccgucgacugcuccuggacccucccccccgcccccaacuccaccucccccgucuccuucaucgccaccuaccgccucggcauggccgcccgcggccacuccuggcccugccuccagcagacccccaccuccaccuccugcaccaucaccgacguccagcucuucuccauggcccccuacguccucaacgucaccgccguccaccccuggggcuccuccuccuccuucguccccuucaucaccgagcacaucaucaagcccgacccccccgagggcguccgccucuccccccucgccgagcgccagcuccagguccagugggagccccccggcuccuggcccuuccccgagaucuucucccucaaguacuggauccgcuacaagcgccagggcgccgcccgcuuccaccgcgucggccccaucgaggccaccuccuucauccuccgcgccguccgcccccgcgcccgcuacuacguccaggucgccgcccaggaccucaccgacuacggcgagcucuccgacuggucccuccccgccaccgccaccaugucccucggcaaguga

SEQ ID NO: 42538 - RNA, 693 nt, Artificial Sequence
  derived and/or modified sequence opt2 from EBP__Homo_sapiens__NP_006570
augaccaccaacgccggcccccuccaccccuacuggccccagcaccuccgccucgacaacuucguccccaacgaccgccccaccuggcacauccucgccggccucuucuccgucaccggcguccucgucgucaccaccuggcuccucuccggccgcgccgccgucgucccccucggcaccuggcgccgccucucccucugcugguucgccgucugcggcuucauccaccucgucaucgagggcugguucguccucuacuacgaggaccuccucggcgaccaggccuuccucucccagcucuggaaggaguacgccaagggcgacucccgcuacauccucggcgacaacuucaccgucugcauggagaccaucaccgccugccucuggggcccccucucccucugggucgucaucgccuuccuccgccagcacccccuccgcuucauccuccagcucgucgucuccgucggccagaucuacggcgacguccucuacuuccucaccgagcaccgcgacggcuuccagcacggcgagcucggccacccccucuacuucugguucuacuucgucuucaugaacgcccucuggcucguccuccccggcguccucguccucgacgccgucaagcaccucacccacgcccaguccacccucgacgccaaggccaccaaggccaaguccaagaagaacuga

SEQ ID NO: 42539 - RNA, 405 nt, Artificial Sequence
  derived and/or modified sequence opt2 from EBPL__Homo_sapiens__NP_001265565
augggcgccgagugggagcucggcgccgaggccggcggcucccuccuccucugcgccgcccuccucgccgccggcugcgcccucggccuccgccucggccgcggccagggcgccgccgaccgcggcgcccucaucuggcucugcuacgacgcccucguccacuucgcccucgagggccccuucgucuaccucucccucgucggcaacgucgccaacuccgacggccucaucgccucccucuggaaggaguacggcaaggccgacgcccgcugggucuacuucgaccccaccaucgucuccgucgagauccucaccgucgcccucgacggcucccucgcccucuuccucaucuacgccaucgucaaggagaaguacuaccgcgaccgcgucgccuggggcgaguga

SEQ ID NO: 42540 - RNA, 2034 nt, Artificial Sequence
  derived and/or modified sequence opt2 from ECD__Homo_sapiens__NP_001129224
auggaggagaccaugaagcucgccaccauggaggacaccgucgaguacugccucuuccucauccccgacgagucccgcgacuccgacaagcacaaggagauccuccagaaguacaucgagcgcaucaucacccgcuucgcccccaugcucguccccuacaucuggcagaaccagcccuucaaccucaaguacaagcccggcaagggcggcguccccgcccacauguucggcgucaccaaguucggcgacaacaucgaggacgagugguucaucgucuacgucaucaagcagaucaccaaggaguuccccgagcucgucgcccgcaucgaggacaacgacggcgaguuccuccucaucgaggccgccgacuuccuccccaaguggcucgaccccgagaacuccaccaaccgcgucuucuucugccacggcgagcucugcaucauccccgccccccgcaaguccggcgccgaguccuggcuccccaccaccccccccaccaucccccaggcccucaacaucaucaccgcccacuccgagaagauccucgccuccgaguccauccgcgccgccgucaaccgccgcauccgcggcuaccccgagaagauccaggccucccuccaccgcgcccacugcuuccuccccgccggcaucgucgccguccucaagcagcgcccccgccucgucgccgccgccguccaggccuucuaccuccgcgaccccaucgaccuccgcgccugccgcgucuucaagaccuuccuccccgagacccgcaucaugaccuccgucaccuucaccaagugccucuacgcccagcucguccagcagcgcuucguccccgaccgccgcuccggcuaccgccuccccccccccuccgacccccaguaccgcgcccacgagcucggcaugaagcucgcccacggcuucgagauccucugcuccaagugcuccccccacuucuccgacugcaagaagucccucgucaccgccuccccccucugggccuccuuccucgagucccucaagaagaacgacuacuucaagggccucaucgagggcuccgcccaguaccgcgagcgccucgagauggccgagaacuacuuccagcucuccgucgacuggcccgagcgccucgagguccaguggcgcgaccccggccuccuccaggcccccccccccggcuucacccccuucaucugccucucccuccucuccaccugggacaacuccucccucgccaugucccccggcgaggagauccucacccuccuccagaccauccccuucgacaucgaggaccucaagaaggaggccgccaaccucccccccgaggacgacgaccaguggcucgaccucucccccgaccagcucgaccagcuccuccaggaggccgucggcaagaaggaguccgaguccgucuccaaggaggagaaggagcagaacuacgaccucaccgaggucuccgaguccaugaaggccuucaucuccaaggucuccacccacaagggcgccgagcucccccgcgagcccuccgaggcccccaucaccuucgacgccgacuccuuccucaacuacuucgacaagauccucggcccccgccccaacgaguccgacuccgacgaccucgacgacgaggacuucgagugccucgacuccgacgacgaccucgacuucgagacccacgagcccggcgaggaggccucccucaagggcacccucgacaaccucaaguccuacauggcccagauggaccaggagcucgcccacaccugcaucuccaaguccuucaccacccgcaaccaggucgagcccgucucccagaccaccgacaacaacuccgacgaggaggacuccggcaccggcgaguccgucauggcccccgucgacgucgaccucaaccucgucuccaacauccucgaguccuacuccucccaggccggccucgccggccccgccuccaaccuccuccaguccaugggcguccagcuccccgacaacaccgaccaccgccccaccuccaagcccaccaagaacuga

SEQ ID NO: 42541 - RNA, 2211 nt, Artificial Sequence
  derived and/or modified sequence opt2 from ECE2__Homo_sapiens__NP_001032401
augaacgucgcccuccaggagcucggcgccggcuccaacgucggcuuccagaagggcacccgccagcuccucggcucccgcacccagcucgagcucguccucgccggcgccucccuccuccucgccgcccuccuccucggcugccucgucgcccucggcguccaguaccaccgcgaccccucccacuccaccugccucaccgaggccugcauccgcgucgccggcaagauccucgagucccucgaccgcggcgucucccccugcgaggacuucuaccaguucuccugcggcggcuggauccgccgcaacccccuccccgacggccgcucccgcuggaacaccuucaacucccucugggaccagaaccaggccauccucaagcaccuccucgagaacaccaccuucaacuccuccuccgaggccgagcagaagacccagcgcuucuaccucuccugccuccaggucgagcgcaucgaggagcucggcgcccagccccuccgcgaccucaucgagaagaucggcggcuggaacaucaccggccccugggaccaggacaacuucauggagguccucaaggccgucgccggcaccuaccgcgccacccccuucuucaccgucuacaucuccgccgacuccaaguccuccaacuccaacgucauccaggucgaccaguccggccucuuccuccccucccgcgacuacuaccucaaccgcaccgccaacgagaagguccucaccgccuaccucgacuacauggaggagcucggcaugcuccucggcggccgccccaccuccacccgcgagcagaugcagcagguccucgagcucgagauccagcucgccaacaucaccgucccccaggaccagcgccgcgacgaggagaagaucuaccacaagauguccaucuccgagcuccaggcccucgcccccuccauggacuggcucgaguuccucuccuuccuccucuccccccucgagcucuccgacuccgagcccgucgucgucuacggcauggacuaccuccagcaggucuccgagcucaucaaccgcaccgagcccuccauccucaacaacuaccucaucuggaaccucguccagaagaccaccuccucccucgaccgccgcuucgaguccgcccaggagaagcuccucgagacccucuacggcaccaagaaguccugcgucccccgcuggcagaccugcaucuccaacaccgacgacgcccucggcuucgcccucggcucccucuucgucaaggccaccuucgaccgccaguccaaggagaucgccgagggcaugaucuccgagauccgcaccgccuucgaggaggcccucggccagcucgucuggauggacgagaagacccgccaggccgccaaggagaaggccgacgccaucuacgacaugaucggcuuccccgacuucauccucgagcccaaggagcucgacgacgucuacgacggcuacgagaucuccgaggacuccuucuuccagaacaugcucaaccucuacaacuucuccgccaaggucauggccgaccagcuccgcaagccccccucccgcgaccagugguccaugaccccccagaccgucaacgccuacuaccuccccaccaagaacgagaucgucuuccccgccggcauccuccaggcccccuucuacgcccgcaaccaccccaaggcccucaacuucggcggcaucggcgucgucaugggccacgagcucacccacgccuucgacgaccagggccgcgaguacgacaaggagggcaaccuccgccccugguggcagaacgagucccucgccgccuuccgcaaccacaccgccugcauggaggagcaguacaaccaguaccaggucaacggcgagcgccucaacggccgccagacccucggcgagaacaucgccgacaacggcggccucaaggccgccuacaacgccuacaaggccuggcuccgcaagcacggcgaggagcagcagcuccccgccgucggccucaccaaccaccagcucuucuucgucggcuucgcccaggucuggugcuccguccgcacccccgaguccucccacgagggccucgucaccgacccccacucccccgcccgcuuccgcguccucggcacccucuccaacucccgcgacuuccuccgccacuucggcugccccgucggcucccccaugaaccccggccagcucugcgaggucugguga

SEQ ID NO: 42542 - RNA, 2322 nt, Artificial Sequence
  derived and/or modified sequence opt2 from ECEL1__Homo_sapiens__NP_001277716
auggagccccccuacucccucaccgcccacuacgacgaguuccaggaggucaaguacgucucccgcugcggcgccggcggcgcccgcggcgccucccucccccccggcuucccccucggcgccgcccgcuccgccaccggcgcccgcuccggccucccccgcuggaaccgccgcgaggucugccuccucuccggccucgucuucgccgccggccucugcgccauccucgccgccaugcucgcccucaaguaccucggccccgucgccgccggcggcggcgccugccccgagggcugccccgagcgcaaggccuucgcccgcgccgcccgcuuccucgccgccaaccucgacgccuccaucgaccccugccaggacuucuacuccuucgccugcggcggcuggcuccgccgccacgccauccccgacgacaagcucaccuacggcaccaucgccgccaucggcgagcagaacgaggagcgccuccgccgccuccucgcccgccccggcggcggccccggcggcgccgcccagcgcaagguccgcgccuucuuccgcuccugccucgacaugcgcgagaucgagcgccucggcccccgccccaugcucgaggucaucgaggacugcggcggcugggaccucggcggcgccgaggagcgccccggcgucgccgcccgcugggaccucaaccgccuccucuacaaggcccagggcgucuacuccgccgccgcccucuucucccucaccgucucccucgacgaccgcaacuccucccgcuacgucauccgcaucgaccaggacggccucacccuccccgagcgcacccucuaccucgcccaggacgaggacuccgagaagauccucgccgccuaccgcgucuucauggagcgcguccucucccuccucggcgccgacgccgucgagcagaaggcccaggagauccuccaggucgagcagcagcucgccaacaucaccgucuccgagcacgacgaccuccgccgcgacgucuccuccauguacaacaaggucacccucggccagcuccagaagaucaccccccaccuccgcuggaaguggcuccucgaccagaucuuccaggaggacuucuccgaggaggaggaggucguccuccucgccaccgacuacaugcagcaggucucccagcucauccgcuccaccccccaccgcguccuccacaacuaccucgucuggcgcgucgucgucguccucuccgagcaccucuccccccccuuccgcgaggcccuccacgagcucgcccaggagauggagggcuccgacaagccccaggagcucgcccgcgucugccucggccaggccaaccgccacuucggcauggcccucggcgcccucuucguccacgagcacuucuccgccgccuccaaggccaagguccagcagcucgucgaggacaucaaguacauccucggccagcgccucgaggagcucgacuggauggacgccgagacccgcgccgccgcccgcgccaagcuccaguacaugauggucauggucggcuaccccgacuuccuccucaagcccgacgccgucgacaaggaguacgaguucgagguccacgagaagaccuacuucaagaacauccucaacuccauccgcuucuccauccagcucuccgucaagaagauccgccaggaggucgacaaguggcuccuccccccccaggcccucaacgccuacuaccuccccaacaagaaccagauggucuuccccgccggcauccuccagcccacccucuacgaccccgacuucccccagucccucaacuacggcggcaucggcaccaucaucggccacgagcucacccacggcuacgacgacuggggcggccaguacgaccgcuccggcaaccuccuccacugguggaccgaggccuccuacucccgcuuccuccgcaaggccgagugcaucguccgccucuacgacaacuucaccgucuacaaccagcgcgucaacggcaagcacacccucggcgagaacaucgccgacaugggcggccucaagcucgccuaccacgccuaccagaaguggguccgcgagcacggccccgagcacccccucccccgccucaaguacacccacgaccagcucuucuucaucgccuucgcccagaacuggugcaucaagcgccgcucccaguccaucuaccuccagguccucaccgacaagcacgcccccgagcacuaccgcguccucggcuccgucucccaguucgaggaguucggccgcgccuuccacugccccaaggacucccccaugaaccccgcccacaagugcuccgucugguga

SEQ ID NO: 42543 - RNA, 681 nt, Artificial Sequence
  derived and/or modified sequence opt2 from ECHDC1__Homo_sapiens__NP_001099014
augaugcuccagcuccucgagaaggucaucgagcucgagaacuggaccgagggcaagggccucaucguccgcggcgccaagaacaccuucuccuccggcuccgaccucaacgccgucaagucccucggcacccccgaggacggcauggccgucugcauguucaugcagaacacccucacccgcuucaugcgccucccccucaucuccgucgcccucguccagggcugggcccucggcggcggcgccgaguucaccaccgccugcgacuuccgccucaugacccccgaguccaagauccgcuucguccacaaggagaugggcaucauccccuccuggggcggcaccacccgccucgucgagaucaucggcucccgccaggcccucaagguccucuccggcgcccucaagcucgacuccaagaacgcccucaacaucggcauggucgaggagguccuccaguccuccgacgagaccaagucccucgaggaggcccaggaguggcucaagcaguucauccagggcccccccgaggucauccgcgcccucaagaaguccgucugcuccggccgcgagcucuaccucgaggaggcccuccagaacgagcgcgaccuccucggcaccgucuggggcggccccgccaaccucgaggccaucgccaagaagggcaaguucaacaaguga

SEQ ID NO: 42544 - RNA, 912 nt, Artificial Sequence
  derived and/or modified sequence opt2 from ECHDC3__Homo_sapiens__NP_078969
auggccgccgucgccguccuccgcgccuucggcgccuccggccccaugugccuccgccgcggccccugggcccagcuccccgcccgcuucugcucccgcgaccccgccggcgccggccgccgcgaguccgagccccgccccaccuccgcccgccagcucgacggcauccgcaacaucguccucuccaaccccaagaagcgcaacacccucucccucgccaugcucaagucccuccaguccgacauccuccacgacgccgacuccaacgaccucaaggucaucaucaucuccgccgagggccccgucuucuccuccggccacgaccucaaggagcucaccgaggagcagggccgcgacuaccacgccgaggucuuccagaccugcuccaaggucaugaugcacauccgcaaccaccccguccccgucaucgccauggucaacggccucgccaccgccgccggcugccagcucgucgccuccugcgacaucgccgucgccuccgacaaguccuccuucgccacccccggcgucaacgucggccucuucugcuccacccccggcgucgcccucgcccgcgccgucccccgcaaggucgcccucgagaugcucuucaccggcgagcccaucuccgcccaggaggcccuccuccacggccuccucuccaaggucguccccgaggccgagcuccaggaggagaccaugcgcaucgcccgcaagaucgccucccucucccgccccgucgucucccucggcaaggccaccuucuacaagcagcucccccaggaccucggcaccgccuacuaccucaccucccaggccauggucgacaaccucgcccuccgcgacggccaggagggcaucaccgccuuccuccagaagcgcaagcccgucuggucccacgagcccgucuga

SEQ ID NO: 42545 - RNA, 873 nt, Artificial Sequence
  derived and/or modified sequence opt2 from ECHS1__Homo_sapiens__NP_004083
auggccgcccuccgcguccuccucuccugcguccgcggcccccuccgcccccccguccgcugccccgccuggcgccccuucgccuccggcgccaacuucgaguacaucaucgccgagaagcgcggcaagaacaacaccgucggccucauccagcucaaccgccccaaggcccucaacgcccucugcgacggccucaucgacgagcucaaccaggcccucaagaccuucgaggaggaccccgccgucggcgccaucguccucaccggcggcgacaaggccuucgccgccggcgccgacaucaaggagaugcagaaccucuccuuccaggacugcuacuccuccaaguuccucaagcacugggaccaccucacccaggucaagaagcccgucaucgccgccgucaacggcuacgccuucggcggcggcugcgagcucgccaugaugugcgacaucaucuacgccggcgagaaggcccaguucgcccagcccgagauccucaucggcaccauccccggcgccggcggcacccagcgccucacccgcgccgucggcaagucccucgccauggagaugguccucaccggcgaccgcaucuccgcccaggacgccaagcaggccggccucgucuccaagaucugccccgucgagacccucgucgaggaggccauccagugcgccgagaagaucgccuccaacuccaagaucgucgucgccauggccaaggaguccgucaacgccgccuucgagaugacccucaccgagggcuccaagcucgagaagaagcucuucuacuccaccuucgccaccgacgaccgcaaggagggcaugaccgccuucgucgagaagcgcaaggccaacuucaaggaccaguga

SEQ ID NO: 42546 - RNA, 858 nt, Artificial Sequence
  derived and/or modified sequence opt2 from ECI1__Homo_sapiens__NP_001171500
auggcccucgucgccuccguccgcguccccgcccgcguccuccuccgcgccggcgcccgccuccccggcgccgcccucggccgcaccgagcgcgccgccggcggcggcgacggcgcccgccgcuucggcucccagcgcguccucgucgagcccgacgccggcgccggcgucgccgucaugaaguucaagaacccccccgucaacucccucucccucgaguuccucaccgagcucgucaucucccucgagaagcucgagaacgacaaguccuuccgcggcgucauccucaccuccgaccgccccggcgucuucuccgccggccucgaccucaccgagaugugcggccgcucccccgcccacuacgccggcuacuggaaggccguccaggagcucuggcuccgccucuaccaguccaaccucguccucgucuccgccaucaacggcgccugccccgccggcggcugccucgucgcccucaccugcgacuaccgcauccucgccgacaacccccgccucaaggacacccucgagaacaccaucggccaccgcgccgccgagcgcgcccuccagcucggccuccucuucccccccgccgaggcccuccaggucggcaucgucgaccaggucguccccgaggagcagguccaguccaccgcccucuccgccaucgcccaguggauggccauccccgaccacgcccgccagcucaccaaggccaugaugcgcaaggccaccgccucccgccucgucacccagcgcgacgccgacguccagaacuucgucuccuucaucuccaaggacuccauccagaagucccuccagauguaccucgagcgccucaaggaggagaagggcuga

SEQ ID NO: 42547 - RNA, 1095 nt, Artificial Sequence
  derived and/or modified sequence opt2 from ECI2__Homo_sapiens__NP_006108
augaaccgcaccgccaugcgcgccucccagaaggacuucgagaacuccaugaaccaggucaagcuccucaagaaggaccccggcaacgaggucaagcucaagcucuacgcccucuacaagcaggccaccgagggccccugcaacaugcccaagcccggcgucuucgaccucaucaacaaggccaagugggacgccuggaacgcccucggcucccuccccaaggaggccgcccgccagaacuacgucgaccucgucuccucccucucccccucccucgaguccuccucccaggucgagcccggcaccgaccgcaaguccaccggcuucgagacccucgucgucaccuccgaggacggcaucaccaagaucauguucaaccgccccaagaagaagaacgccaucaacaccgagauguaccacgagaucaugcgcgcccucaaggccgccuccaaggacgacuccaucaucaccguccucaccggcaacggcgacuacuacuccuccggcaacgaccucaccaacuucaccgacaucccccccggcggcgucgaggagaaggccaagaacaacgccguccuccuccgcgaguucgucggcugcuucaucgacuuccccaagccccucaucgccgucgucaacggccccgccgucggcaucuccgucacccuccucggccucuucgacgccgucuacgccuccgaccgcgccaccuuccacacccccuucucccaccucggccagucccccgagggcugcuccuccuacaccuuccccaagaucaugucccccgccaaggccaccgagaugcucaucuucggcaagaagcucaccgccggcgaggccugcgcccagggccucgucaccgaggucuuccccgacuccaccuuccagaaggaggucuggacccgccucaaggccuucgccaagcucccccccaacgcccuccgcaucuccaaggaggucauccgcaagcgcgagcgcgagaagcuccacgccgucaacgccgaggagugcaacguccuccagggccgcuggcucuccgacgagugcaccaacgccgucgucaacuuccucucccgcaaguccaagcucuga

SEQ ID NO: 42548 - RNA, 618 nt, Artificial Sequence
  derived and/or modified sequence opt2 from ECSCR__Homo_sapiens__NP_001071161
augggcaccgccggcgccaugcagcucugcugggucauccucggcuuccuccucuuccgcggccacaacucccagcccaccaugacccagaccuccuccucccagggcggccucggcggccucucccucaccaccgagcccgucuccuccaaccccggcuacauccccuccuccgaggccaaccgccccucccaccucuccuccaccggcacccccggcgccggcguccccuccuccggccgcgacggcggcaccucccgcgacaccuuccagaccgucccccccaacuccaccaccaugucccucuccaugcgcgaggacgccaccauccuccccucccccaccuccgagaccguccucaccgucgccgccuucggcgucaucuccuucaucgucauccucgucgucgucgucaucauccucgucggcgucgucucccuccgcuucaagugccgcaaguccaaggaguccgaggacccccagaagcccggcuccuccggccucuccgaguccugcuccaccgccaacggcgagaaggacuccaucacccucaucuccaugaagaacaucaacaugaacaacggcaagcagucccucuccgccgagaagguccucuga

SEQ ID NO: 42549 - RNA, 891 nt, Artificial Sequence
  derived and/or modified sequence opt2 from ECSIT__Homo_sapiens__NP_001135936
auguccuggguccaggccacccuccucgcccgcggccucugccgcgccuggggcggcaccugcggcgccgcccucaccggcaccuccaucucccaggucccccgccgccucccccgcggccuccacugcuccgccgccgcccacuccuccgagcagucccucguccccuccccccccgagccccgccagcgccccaccaaggcccucguccccuucgaggaccucuucggccaggcccccggcggcgagcgcgacaaggccuccuuccuccagaccguccagaaguucgccgagcacuccguccgcaagcgcggccacaucgacuucaucuaccucgcccuccgcaagaugcgcgaguacggcgucgagcgcgaccucgccgucuacaaccagcuccucaacaucuuccccaaggaggucuuccgcccccgcaacaucauccagcgcaucuucguccacuacccccgccagcaggagugcggcaucgccguccucgagcagauggagaaccacggcgucaugcccaacaaggagaccgaguuccuccucauccagaucuucggccgcaaguccuaccccaugcucaagcucguccgccucaagcucugguucccccgcuucaugaacgucaaccccuuccccgucccccgcgaccucccccaggaccccgucgagcucgccauguucggccuccgccacauggagcccgaccucuccgcccgcgucaccaucuaccaggucccccuccccaaggacuccaccggcgccgccgaccccccccagccccacaucgucggcuccggccgcgacgccggcggcgucgagccccuccuccccgacgccgccggccccggcgucugcgaggaguggcucggccagcuccgcgucuga

SEQ ID NO: 42550 - RNA, 2745 nt, Artificial Sequence
  derived and/or modified sequence opt2 from ECT2__Homo_sapiens__NP_001245244
auggccgagaacuccguccucaccuccaccaccggccgcaccucccucgccgacuccuccaucuucgacuccaaggucaccgagaucuccaaggagaaccuccucaucggcuccaccuccuacgucgaggaggagaugccccagaucgagacccgcgucauccucguccaggaggccggcaagcaggaggagcucaucaaggcccucaagaccaucaagaucauggagguccccgucaucaagaucaaggaguccugccccggcaaguccgacgagaagcucaucaaguccgucaucaacauggacaucaaggucggcuucgucaagauggaguccgucgaggaguucgagggccucgacucccccgaguucgagaacgucuucgucgucaccgacuuccaggacuccgucuucaacgaccucuacaaggccgacugccgcgucaucggcccccccgucguccucaacugcucccagaagggcgagccccuccccuucuccugccgcccccucuacugcaccuccaugaugaaccucguccucugcuucaccggcuuccgcaagaaggaggagcucguccgccucgucacccucguccaccacaugggcggcgucauccgcaaggacuucaacuccaaggucacccaccucgucgccaacugcacccagggcgagaaguuccgcgucgccgucucccucggcacccccaucaugaagcccgaguggaucuacaaggccugggagcgccgcaacgagcaggacuucuacgccgccgucgacgacuuccgcaacgaguucaaggucccccccuuccaggacugcauccucuccuuccucggcuucuccgacgaggagaagaccaacauggaggagaugaccgagaugcagggcggcaaguaccucccccucggcgacgagcgcugcacccaccucgucgucgaggagaacaucgucaaggaccuccccuucgagcccuccaagaagcucuacgucgucaagcaggagugguucuggggcuccauccagauggacgcccgcgccggcgagaccauguaccucuacgagaaggccaacacccccgagcucaagaaguccgucuccaugcucucccucaacacccccaacuccaaccgcaagcgccgccgccucaaggagacccucgcccagcucucccgcgagaccgacgucucccccuuccccccccgcaagcgccccuccgccgagcacucccucuccaucggcucccuccucgacaucuccaacacccccgaguccuccaucaacuacggcgacacccccaaguccugcaccaaguccuccaaguccuccacccccguccccuccaagcaguccgcccgcuggcaggucgccaaggagcucuaccagaccgaguccaacuacgucaacauccucgccaccaucauccagcucuuccaggucccccucgaggaggagggccagcgcggcggccccauccucgcccccgaggagaucaagaccaucuucggcuccauccccgacaucuucgacguccacaccaagaucaaggacgaccucgaggaccucaucgucaacugggacgaguccaaguccaucggcgacaucuuccucaaguacuccaaggaccucgucaagaccuacccccccuucgucaacuucuucgagauguccaaggagaccaucaucaagugcgagaagcagaagccccgcuuccacgccuuccucaagaucaaccaggccaagcccgagugcggccgccagucccucgucgagcuccucauccgccccguccagcgccuccccuccgucgcccuccuccucaacgaccucaagaagcacaccgccgacgagaaccccgacaaguccacccucgagaaggccaucggcucccucaaggaggucaugacccacaucaacgaggacaagcgcaagaccgaggcccagaagcagaucuucgacgucgucuacgaggucgacggcugccccgccaaccuccucuccucccaccgcucccucguccagcgcgucgagaccaucucccucggcgagcaccccugcgaccgcggcgagcaggucacccucuuccucuucaacgacugccucgagaucgcccgcaagcgccacaaggucaucggcaccuuccgcuccccccacggccagacccgcccccccgccucccucaagcacauccaccucaugccccucucccagaucaagaagguccucgacauccgcgagaccgaggacugccacaacgccuucgcccuccucguccgcccccccaccgagcaggccaacguccuccucuccuuccagaugaccuccgacgagcuccccaaggagaacuggcucaagaugcucugccgccacgucgccaacaccaucugcaaggccgacgccgagaaccucaucuacaccgccgaccccgaguccuucgaggucaacaccaaggacauggacuccacccucucccgcgccucccgcgccaucaagaagaccuccaagaaggucacccgcgccuucuccuucuccaagacccccaagcgcgcccuccgccgcgcccucaugaccucccacggcuccgucgagggccgcucccccuccuccaacgacaagcacgucaugucccgccucuccuccaccuccucccucgccggcauccccucccccucccucgucucccuccccuccuucuucgagcgccgcucccacacccucucccgcuccaccacccaccucaucuga

SEQ ID NO: 42551 - RNA, 894 nt, Artificial Sequence
  derived and/or modified sequence opt2 from EDA2R__Homo_sapiens__NP_001186616
auggacugccaggagaacgaguacugggaccaguggggccgcugcgucaccugccagcgcugcggccccggccaggagcucuccaaggacugcggcuacggcgagggcggcgacgccuacugcaccgccugccccccccgccgcuacaaguccuccuggggccaccaccgcugccaguccugcaucaccugcgccgucaucaaccgcguccagaaggucaacugcaccgccaccuccaacgccgucugcggcgacugccucccccgcuucuaccgcaagacccgcaucggcggccuccaggaccaggagugcauccccugcaccaagcagacccccaccuccgagguccagugcgccuuccagcucucccucgucgaggccgacgcccccaccguccccccccaggaggccacccucgucgcccucgucuccucccuccucgucgucuucacccucgccuuccucggccucuucuuccucuacugcaagcaguucuucaaccgccacugccagcgcggcggccuccuccaguucgaggccgacaagaccgccaaggaggagucccucuuccccgucccccccuccaaggagaccuccgccgagucccaggucuccgagaacaucuuccagacccagccccucaaccccauccucgaggacgacugcuccuccaccuccggcuuccccacccaggaguccuucaccauggccuccugcaccuccgagucccacucccacuggguccacucccccaucgagugcaccgagcucgaccuccagaaguucuccuccuccgccuccuacaccggcgccgagacccucggcggcaacaccgucgaguccaccggcgaccgccucgagcucaacguccccuucgagguccccucccccuga

SEQ ID NO: 42552 - RNA, 1170 nt, Artificial Sequence
  derived and/or modified sequence opt2 from EDA__Homo_sapiens__NP_001005609
augggcuaccccgaggucgagcgccgcgagcuccuccccgccgccgccccccgcgagcgcggcucccagggcugcggcugcggcggcgcccccgcccgcgccggcgagggcaacuccugccuccucuuccucggcuucuucggccucucccucgcccuccaccuccucacccucugcugcuaccucgagcuccgcuccgagcuccgccgcgagcgcggcgccgagucccgccucggcggcuccggcacccccggcaccuccggcacccucuccucccucggcggccucgaccccgacucccccaucaccucccaccucggccagcccucccccaagcagcagccccucgagcccggcgaggccgcccuccacuccgacucccaggacggccaccagauggcccuccucaacuucuucuuccccgacgagaagcccuacuccgaggaggagucccgccgcguccgccgcaacaagcgcuccaaguccaacgagggcgccgacggccccgucaagaacaagaagaagggcaagaaggccggcccccccggccccaacggcccccccggcccccccggcccccccggcccccagggcccccccggcauccccggcauccccggcauccccggcaccaccgucaugggcccccccggcccccccggcccccccggcccccagggcccccccggccuccagggccccuccggcgccgccgacaaggccggcacccgcgagaaccagcccgccgucguccaccuccagggccagggcuccgccauccaggucaagaacgaccucuccggcggcguccucaacgacuggucccgcaucaccaugaaccccaaggucuucaagcuccacccccgcuccggcgagcucgagguccucgucgacggcaccuacuucaucuacucccaggucuacuacaucaacuucaccgacuucgccuccuacgaggucgucgucgacgagaagcccuuccuccagugcacccgcuccaucgagaccggcaagaccaacuacaacaccugcuacaccgccggcgucugccuccucaaggcccgccagaagaucgccgucaagaugguccacgccgacaucuccaucaacauguccaagcacaccaccuucuucggcgccauccgccucggcgaggcccccgccuccuga

SEQ ID NO: 42553 - RNA, 618 nt, Artificial Sequence
  derived and/or modified sequence opt2 from EDARADD__Homo_sapiens__NP_542776
auggccucccccgacgacccccuccgcgccgaccacauggucaaggagcccgucgaggacaccgaccccuccacccucuccuucaacauguccgacaaguaccccauccaggacaccgagcuccccaaggccgaggagugcgacaccaucacccucaacugcccccgcaacuccgacaugaagaaccagggcgaggagaacggcuuccccgacuccaccggcgacccccuccccgagaucuccaaggacaacuccugcaaggagaacugcaccugcuccuccugccuccuccgcgcccccaccaucuccgaccuccucaacgaccaggaccuccucgacgucauccgcaucaagcucgaccccugccaccccaccgucaagaacuggcgcaacuucgccuccaaguggggcauguccuacgacgagcucugcuuccucgagcagcgcccccagucccccacccucgaguuccuccuccgcaacucccagcgcaccgucggccagcucauggagcucugccgccucuaccaccgcgccgacgucgagaagguccuccgccgcugggucgacgaggaguggcccaagcgcgagcgcggcgaccccucccgccacuucuga

SEQ ID NO: 42554 - RNA, 1347 nt, Artificial Sequence
  derived and/or modified sequence opt2 from EDAR__Homo_sapiens__NP_071731
auggcccacgucggcgacugcacccagacccccuggcuccccguccucgucgucucccucaugugcuccgcccgcgccgaguacuccaacugcggcgagaacgaguacuacaaccagaccaccggccucugccaggagugcccccccugcggccccggcgaggagcccuaccucuccugcggcuacggcaccaaggacgaggacuacggcugcguccccugccccgccgagaaguucuccaagggcggcuaccagaucugccgccgccacaaggacugcgagggcuucuuccgcgccaccguccucacccccggcgacauggagaacgacgccgagugcggccccugccuccccggcuacuacaugcucgagaaccgcccccgcaacaucuacggcauggucugcuacuccugccuccucgccccccccaacaccaaggagugcgucggcgccaccuccggcgccuccgccaacuuccccggcaccuccggcuccuccacccucucccccuuccagcacgcccacaaggagcucuccggccagggccaccucgccaccgcccucaucaucgccauguccaccaucuucaucauggccaucgccaucguccucaucaucauguucuacauccucaagaccaagcccuccgcccccgccugcugcaccucccaccccggcaaguccgucgaggcccaggucuccaaggacgaggagaagaaggaggcccccgacaacgucgucauguucuccgagaaggacgaguucgagaagcucaccgccacccccgccaagcccaccaaguccgagaacgacgccuccuccgagaacgagcagcuccucucccgcuccgucgacuccgacgaggagcccgcccccgacaagcagggcucccccgagcucugccuccucucccucguccaccucgcccgcgagaaguccgccaccuccaacaaguccgccggcauccagucccgccgcaagaagauccucgacgucuacgccaacgucugcggcgucgucgagggccucucccccaccgagcuccccuucgacugccucgagaagaccucccgcaugcucuccuccaccuacaacuccgagaaggccgucgucaagaccuggcgccaccucgccgaguccuucggccucaagcgcgacgagaucggcggcaugaccgacggcaugcagcucuucgaccgcaucuccaccgccggcuacuccauccccgagcuccucaccaagcucguccagaucgagcgccucgacgccgucgagucccucugcgccgacauccucgagugggccggcgucgucccccccgccucccagccccacgccgccuccuga

SEQ ID NO: 42555 - RNA, 4206 nt, Artificial Sequence
  derived and/or modified sequence opt2 from EDC4__Homo_sapiens__NP_055144
auggccuccugcgccuccaucgacaucgaggacgccacccagcaccuccgcgacauccucaagcucgaccgccccgccggcggccccuccgccgaguccccccgccccuccuccgccuacaacggcgaccucaacggccuccucguccccgacccccucugcuccggcgacuccaccuccgccaacaagaccggccuccgcaccaugccccccaucaaccuccaggagaagcaggucaucugccucuccggcgacgacuccuccaccugcaucggcauccucgccaaggaggucgagaucgucgccuccuccgacuccuccaucuccuccaaggcccgcggcuccaacaaggucaagauccagcccgucgccaaguacgacugggagcagaaguacuacuacggcaaccucaucgccgucuccaacuccuuccucgccuacgccauccgcgccgccaacaacggcuccgccaugguccgcgucaucuccgucuccaccuccgagcgcacccuccucaagggcuucaccggcuccgucgccgaccucgccuucgcccaccucaacuccccccagcucgccugccucgacgaggccggcaaccucuucgucuggcgccucgcccucgucaacggcaagauccaggaggagauccucguccacauccgccagcccgagggcaccccccucaaccacuuccgccgcaucaucuggugccccuucauccccgaggaguccgaggacugcugcgaggaguccucccccaccgucgcccuccuccacgaggaccgcgccgaggucugggaccucgacaugcuccgcuccucccacuccaccuggcccgucgacgucucccagaucaagcagggcuucaucgucgucaagggccacuccaccugccucuccgagggcgcccucucccccgacggcaccguccucgccaccgccucccacgacggcuacgucaaguucuggcagaucuacaucgagggccaggacgagccccgcugccuccacgaguggaagccccacgacggccgcccccucuccugccuccucuucugcgacaaccacaagaagcaggaccccgacguccccuucuggcgcuuccucaucaccggcgccgaccagaaccgcgagcucaagauguggugcaccgucuccuggaccugccuccagaccauccgcuucucccccgacaucuucuccuccgucuccgucccccccucccucaaggucugccucgaccucuccgccgaguaccucauccucuccgacguccagcgcaagguccucuacgucauggagcuccuccagaaccaggaggagggccacgccugcuucuccuccaucuccgaguuccuccucacccaccccguccucuccuucggcauccaggucgucucccgcugccgccuccgccacaccgagguccuccccgccgaggaggagaacgacucccucggcgccgacggcacccacggcgccggcgccauggaguccgccgccggcguccucaucaagcucuucugcguccacaccaaggcccuccaggacguccagauccgcuuccagccccagcucaaccccgacgucgucgccccccuccccacccacaccgcccacgaggacuucaccuucggcgagucccgccccgagcucggcuccgagggccucggcuccgccgcccacggcucccagcccgaccuccgccgcaucgucgagcuccccgcccccgccgacuuccucucccucuccuccgagaccaagcccaagcucaugacccccgacgccuucaugacccccuccgccucccuccagcagaucaccgccucccccuccuccuccuccuccggcuccuccuccuccuccuccuccuccuccuccucccucaccgccgucuccgccauguccuccaccuccgccgucgaccccucccucacccgcccccccgaggagcucacccucucccccaagcuccagcucgacggcucccucaccauguccuccuccggcucccuccaggccuccccccgcggccuccuccccggccuccuccccgcccccgccgacaagcucacccccaagggccccggccagguccccaccgccaccuccgcccucucccucgagcuccaggaggucgagccccucggccucccccaggccucccccucccgcacccgcucccccgacgucaucuccuccgccuccaccgcccucucccaggacauccccgagaucgccuccgaggcccucucccgcggcuucggcuccuccgcccccgagggccucgagcccgacuccauggccuccgccgccuccgcccuccaccuccucuccccccgcccccgccccggccccgagcucggcccccagcucggccucgacggcggccccggcgacggcgaccgccacaacacccccucccuccucgaggccgcccucacccaggaggccuccacccccgacucccaggucuggcccaccgcccccgacaucacccgcgagaccugcuccacccucgccgaguccccccgcaacggccuccaggagaagcacaagucccucgccuuccaccgcccccccuaccaccuccuccagcagcgcgacucccaggacgccuccgccgagcaguccgaccacgacgacgaggucgccucccucgccuccgccuccggcggcuucggcaccaagguccccgccccccgccuccccgccaaggacuggaagaccaagggcuccccccgcaccucccccaagcucaagcgcaaguccaagaaggacgacggcgacgccgccaugggcucccgccucaccgagcaccaggucgccgagccccccgaggacuggcccgcccucaucuggcagcagcagcgcgagcucgccgagcuccgccacucccaggaggagcuccuccagcgccucugcacccagcucgagggccuccaguccaccgucaccggccacgucgagcgcgcccucgagacccgccacgagcaggagcagcgccgccucgagcgcgcccucgccgagggccagcagcgcggcggccagcuccaggagcagcucacccagcagcucucccaggcccucuccuccgccgucgccggccgccucgagcgcuccauccgcgacgagaucaagaagaccgucccccccugcgucucccgcucccucgagcccauggccggccagcucuccaacuccgucgccaccaagcucaccgccgucgagggcuccaugaaggagaacaucuccaagcuccucaaguccaagaaccucaccgacgccaucgcccgcgccgccgccgacacccuccagggccccaugcaggccgccuaccgcgaggccuuccaguccgucguccuccccgccuucgagaaguccugccaggccauguuccagcagaucaacgacuccuuccgccucggcacccaggaguaccuccagcagcucgagucccacaugaagucccgcaaggcccgcgagcaggaggcccgcgagcccguccucgcccagcuccgcggccucgucuccacccuccaguccgccaccgagcagauggccgccaccgucgccggcuccguccgcgccgagguccagcaccagcuccacgucgccgucggcucccuccaggaguccauccucgcccagguccagcgcaucgucaagggcgaggucuccgucgcccucaaggagcagcaggccgccgucaccuccuccaucaugcaggccaugcgcuccgccgccggcacccccguccccuccgcccaccucgacugccaggcccagcaggcccacauccuccagcuccuccagcagggccaccucaaccaggccuuccagcaggcccucaccgccgccgaccucaaccucguccucuacgucugcgagaccgucgaccccgcccaggucuucggccagccccccugcccccucucccagcccguccuccucucccucauccagcagcucgccuccgaccucggcacccgcaccgaccucaagcucuccuaccucgaggaggccgucaugcaccucgaccacuccgaccccaucacccgcgaccacaugggcuccgucauggcccagguccgccagaagcucuuccaguuccuccaggccgagccccacaacucccucggcaaggccgcccgccgccucucccucaugcuccacggccucgucacccccucccuccccuga

SEQ ID NO: 42556 - RNA, 1974 nt, Artificial Sequence
  derived and/or modified sequence opt2 from EDEM1__Homo_sapiens__NP_055489
augcaguggcgcgcccucguccucggccucguccuccuccgccucggccuccacggcguccucuggcucgucuucggccucggccccuccaugggcuucuaccagcgcuucccccucuccuucggcuuccagcgccuccgcucccccgacggccccgccucccccaccuccggccccgucggccgccccggcggcgucuccggccccuccuggcuccagccccccggcaccggcgccgcccaguccccccgcaaggccccccgccgccccggccccggcaugugcggccccgccaacuggggcuacguccucggcggccgcggccgcggccccgacgaguacgagaagcgcuacuccggcgccuuccccccccagcuccgcgcccagaugcgcgaccucgcccgcggcauguucgucuucggcuacgacaacuacauggcccacgccuucccccaggacgagcucaaccccauccacugccgcggccgcggccccgaccgcggcgaccccuccaaccucaacaucaacgacguccucggcaacuacucccucacccucgucgacgcccucgacacccucgccaucaugggcaacuccuccgaguuccagaaggccgucaagcucgucaucaacaccgucuccuucgacaaggacuccaccguccaggucuucgaggccaccauccgcguccucggcucccuccucuccgcccaccgcaucaucaccgacuccaagcagcccuucggcgacaugaccaucaaggacuacgacaacgagcuccucuacauggcccacgaccucgccguccgccuccuccccgccuucgagaacaccaagaccggcauccccuacccccgcgucaaccucaagaccggcgucccccccgacaccaacaacgagaccugcaccgccggcgccggcucccuccucgucgaguucggcauccucucccgccuccucggcgacuccaccuucgagugggucgcccgccgcgccgucaaggcccucuggaaccuccgcuccaacgacaccggccuccucggcaacgucgucaacauccagaccggccacugggucggcaagcaguccggccucggcgccggccucgacuccuucuacgaguaccuccucaaguccuacauccucuucggcgagaaggaggaccucgagauguucaacgccgccuaccaguccauccagaacuaccuccgccgcggccgcgaggccugcaacgagggcgagggcgaccccccccucuacgucaacgucaacauguucuccggccagcucaugaacaccuggaucgacucccuccaggccuucuuccccggccuccagguccucaucggcgacgucgaggacgccaucugccuccacgccuucuacuacgccaucuggaagcgcuacggcgcccuccccgagcgcuacaacuggcagcuccaggcccccgacguccucuucuacccccuccgccccgagcucgucgaguccaccuaccuccucuaccaggccaccaagaaccccuucuaccuccacgucggcauggacauccuccagucccucgagaaguacaccaaggucaagugcggcuacgccacccuccaccacgucaucgacaaguccaccgaggaccgcauggaguccuucuuccucuccgagaccugcaaguaccucuaccuccucuucgacgaggacaaccccguccacaaguccggcacccgcuacauguucaccaccgagggccacaucgucuccgucgacgagcaccuccgcgagcuccccuggaaggaguucuucuccgaggagggcggccaggaccagggcggcaaguccguccaccgccccaagccccacgagcucaaggucaucaacuccuccuccaacugcaaccgcguccccgacgagcgccgcuacucccucccccucaaguccaucuacaugcgccagaucgaccagauggucggccucaucuga

SEQ ID NO: 42557 - RNA, 1413 nt, Artificial Sequence
  derived and/or modified sequence opt2 from EDIL3__Homo_sapiens__NP_001265571
augaagcgcuccgucgccgucuggcuccucgucggccucucccucggcgucccccaguucggcaagggcgacaucugcgaccccaaccccugcgagaacggcggcaucugccuccccggccucgccgacggcuccuucuccugcgagugccccgacggcuucaccgaccccaacugcuccuccgucgucgaggucggccccugcacccccaaccccugccacaacggcggcaccugcgagaucuccgaggccuaccgcggcgacaccuucaucggcuacgucugcaagugcccccgcggcuucaacggcauccacugccagcacaacaucaacgagugcgaggucgagcccugcaagaacggcggcaucugcaccgaccucgucgccaacuacuccugcgagugccccggcgaguucaugggccgcaacugccaguacaagugcuccggcccccucggcaucgagggcggcaucaucuccaaccagcagaucaccgccuccuccacccaccgcgcccucuucggccuccagaagugguaccccuacuacgcccgccucaacaagaagggccucaucaacgccuggaccgccgccgagaacgaccgcuggcccuggauccagaucaaccuccagcgcaagaugcgcgucaccggcgucaucacccagggcgccaagcgcaucggcucccccgaguacaucaaguccuacaagaucgccuacuccaacgacggcaagaccugggccauguacaaggucaagggcaccaacgaggacauggucuuccgcggcaacaucgacaacaacacccccuacgccaacuccuucaccccccccaucaaggcccaguacguccgccucuacccccaggucugccgccgccacugcacccuccgcauggagcuccucggcugcgagcucuccggcugcuccgagccccucggcaugaaguccggccacauccaggacuaccagaucaccgccuccuccaucuuccgcacccucaacauggacauguucaccugggagccccgcaaggcccgccucgacaagcagggcaaggucaacgccuggaccuccggccacaacgaccagucccaguggcuccaggucgaccuccucguccccaccaaggucaccggcaucaucacccagggcgccaaggacuucggccacguccaguucgucggcuccuacaagcucgccuacuccaacgacggcgagcacuggaccgucuaccaggacgagaagcagcgcaaggacaaggucuuccagggcaacuucgacaacgacacccaccgcaagaacgucaucgacccccccaucuacgcccgccacauccgcauccuccccugguccugguacggccgcaucacccuccgcuccgagcuccucggcugcaccgaggaggaguga

SEQ ID NO: 42558 - RNA, 639 nt, Artificial Sequence
  derived and/or modified sequence opt2 from EDN1__Homo_sapiens__NP_001946
auggacuaccuccucaugaucuucucccuccucuucgucgccugccagggcgcccccgagaccgccguccucggcgccgagcucuccgccgucggcgagaacggcggcgagaagcccacccccuccccccccuggcgccuccgccgcuccaagcgcugcuccugcuccucccucauggacaaggagugcgucuacuucugccaccucgacaucaucugggucaacacccccgagcacgucguccccuacggccucggcuccccccgcuccaagcgcgcccucgagaaccuccuccccaccaaggccaccgaccgcgagaaccgcugccagugcgccucccagaaggacaagaagugcuggaacuucugccaggccggcaaggagcuccgcgccgaggacaucauggagaaggacuggaacaaccacaagaagggcaaggacugcuccaagcucggcaagaagugcaucuaccagcagcucguccgcggccgcaagauccgccgcuccuccgaggagcaccuccgccagacccgcuccgagaccaugcgcaacuccgucaaguccuccuuccacgaccccaagcucaagggcaagcccucccgcgagcgcuacgucacccacaaccgcgcccacugguga

SEQ ID NO: 42559 - RNA, 579 nt, Artificial Sequence
  derived and/or modified sequence opt2 from EDN3__Homo_sapiens__NP_001289385
auggagcccggccucuggcuccucuucggccucaccgucaccuccgccgccggcuucguccccugcucccaguccggcgacgccggccgccgcggcgucucccaggcccccaccgccgcccgcuccgagggcgacugcgaggagaccgucgccggccccggcgaggagaccgucgccggccccggcgagggcaccgucgcccccaccgcccuccagggccccucccccggcucccccggccaggagcaggccgccgagggcgcccccgagcaccaccgcucccgccgcugcaccugcuucaccuacaaggacaaggagugcgucuacuacugccaccucgacaucaucuggaucaacacccccgagcagaccguccccuacggccucuccaacuaccgcggcuccuuccgcggcaagcgcuccgccggcccccuccccggcaaccuccagcucucccaccgcccccaccuccgcugcgccugcgucggccgcuacgacaaggccugccuccacuucugcacccagacccucgacgucucccgccucaagucccgcaccaacaaggccucccgccucuga

SEQ ID NO: 42560 - RNA, 957 nt, Artificial Sequence
  derived and/or modified sequence opt2 from EDNRA__Homo_sapiens__NP_001159527
auggagacccucugccuccgcgccuccuucuggcucgcccucgucggcugcgucaucuccgacaaccccgagcgcuacuccaccaaccucuccaaccacgucgacgacuucaccaccuuccgcggcaccgagcucuccuuccucgucaccacccaccagcccaccaaccucguccuccccuccaacggcuccaugcacaacuacugcccccagcagaccaagaucaccuccgccuucaaguacaucaacaccgucaucuccugcaccaucuucaucgucggcauggucggcaacgccacccuccuccgcaucaucuaccagaacaagugcaugcgcaacggccccaacgcccucaucgccucccucgcccucggcgaccucaucuacgucgucaucgaccuccccaucaacgucuucaaguucuaccaggacgucaaggacugguggcucuucggcuucuacuucugcaugccccucgucugcaccgccaucuucuacacccucaugaccugcgagaugcucaaccgccgcaacggcucccuccgcaucgcccucuccgagcaccucaagcagcgccgcgaggucgccaagaccgucuucugccucgucgucaucuucgcccucugcugguucccccuccaccucucccgcauccucaagaagaccgucuacaacgagauggacaagaaccgcugcgagcuccucuccuuccuccuccucauggacuacaucggcaucaaccucgccaccaugaacuccugcaucaaccccaucgcccucuacuucgucuccaagaaguucaagaacugcuuccaguccugccucugcugcugcugcuaccaguccaagucccucaugaccuccguccccaugaacggcaccuccauccaguggaagaaccacgaccagaacaaccacaacaccgaccgcuccucccacaaggacuccaugaacuga

SEQ ID NO: 42561 - RNA, 1329 nt, Artificial Sequence
  derived and/or modified sequence opt2 from EDNRB__Homo_sapiens__NP_000106
augcagcccccccccucccucugcggccgcgcccucgucgcccucguccucgccugcggccucucccgcaucuggggcgaggagcgcggcuucccccccgaccgcgccaccccccuccuccagaccgccgagaucaugaccccccccaccaagacccucuggcccaagggcuccaacgccucccucgcccgcucccucgcccccgccgagguccccaagggcgaccgcaccgccggcucccccccccgcaccaucucccccccccccugccagggccccaucgagaucaaggagaccuucaaguacaucaacaccgucgucuccugccucgucuucguccucggcaucaucggcaacuccacccuccuccgcaucaucuacaagaacaagugcaugcgcaacggccccaacauccucaucgccucccucgcccucggcgaccuccuccacaucgucaucgacauccccaucaacgucuacaagcuccucgccgaggacuggcccuucggcgccgagaugugcaagcucguccccuucauccagaaggccuccgucggcaucaccguccucucccucugcgcccucuccaucgaccgcuaccgcgccgucgccuccuggucccgcaucaagggcaucggcguccccaaguggaccgccgucgagaucguccucaucugggucgucuccgucguccucgccguccccgaggccaucggcuucgacaucaucaccauggacuacaagggcuccuaccuccgcaucugccuccuccaccccguccagaagaccgccuucaugcaguucuacaagaccgccaaggacugguggcucuucuccuucuacuucugccucccccucgccaucaccgccuucuucuacacccucaugaccugcgagaugcuccgcaagaaguccggcaugcagaucgcccucaacgaccaccucaagcagcgccgcgaggucgccaagaccgucuucugccucguccucgucuucgcccucugcuggcucccccuccaccucucccgcauccucaagcucacccucuacaaccagaacgaccccaaccgcugcgagcuccucuccuuccuccucguccucgacuacaucggcaucaacauggccucccucaacuccugcaucaaccccaucgcccucuaccucgucuccaagcgcuucaagaacugcuucaaguccugccucugcugcuggugccaguccuucgaggagaagcagucccucgaggagaagcaguccugccucaaguucaaggccaacgaccacggcuacgacaacuuccgcuccuccaacaaguacuccuccuccuga

SEQ ID NO: 42562 - RNA, 4236 nt, Artificial Sequence
  derived and/or modified sequence opt2 from EEA1__Homo_sapiens__NP_003557
augcuccgccgcauccuccagcgcacccccggccgcgucggcucccagggcuccgaccucgacuccuccgccacccccaucaacaccgucgacgucaacaacgaguccuccuccgagggcuucaucugcccccagugcaugaagucccucggcuccgccgacgagcucuucaagcacuacgaggccguccacgacgccggcaacgacuccggccacggcggcgaguccaaccucgcccucaagcgcgacgacgucacccuccuccgccaggagguccaggaccuccaggccucccucaaggaggagaagugguacuccgaggagcucaagaaggagcucgagaaguaccagggccuccagcagcaggaggccaagcccgacggccucgucaccgacuccuccgccgagcuccagucccucgagcagcagcucgaggaggcccagaccgagaacuucaacaucaagcagaugaaggaccucuucgagcagaaggccgcccagcucgccaccgagaucgccgacaucaaguccaaguacgacgaggagcgcucccuccgcgaggccgccgagcagaaggucacccgccucaccgaggagcucaacaaggaggccaccgucauccaggaccucaagaccgagcuccuccagcgccccggcaucgaggacgucgccguccucaagaaggagcucguccagguccagacccucauggacaacaugacccucgagcgcgagcgcgaguccgagaagcucaaggacgagugcaagaagcuccagucccaguacgccuccuccgaggccaccaucucccagcuccgcuccgagcucgccaagggcccccaggaggucgccgucuacguccaggagcuccagaagcucaaguccuccgucaacgagcucacccagaagaaccagacccucaccgagaaccuccucaagaaggagcaggacuacaccaagcucgaggagaagcacaacgaggaguccgucuccaagaagaacauccaggccacccuccaccagaaggaccucgacugccagcagcuccagucccgccucuccgccuccgagaccucccuccaccgcauccacgucgagcucuccgagaagggcgaggccacccagaagcucaaggaggagcucuccgaggucgagaccaaguaccagcaccucaaggccgaguucaagcagcuccagcagcagcgcgaggagaaggagcagcacggccuccagcuccaguccgagaucaaccagcuccacuccaagcuccucgagaccgagcgccagcucggcgaggcccacggccgccucaaggagcagcgccagcucuccuccgagaagcucauggacaaggagcagcaggucgccgaccuccagcucaagcucucccgccucgaggagcagcucaaggagaaggucaccaacuccaccgagcuccagcaccagcucgacaagaccaagcagcagcaccaggagcagcaggcccuccagcaguccaccaccgccaagcuccgcgaggcccagaacgaccucgagcagguccuccgccagaucggcgacaaggaccagaagauccagaaccucgaggcccuccuccagaaguccaaggagaacaucucccuccucgagaaggagcgcgaggaccucuacgccaagauccaggccggcgagggcgagaccgccguccucaaccagcuccaggagaagaaccacacccuccaggagcaggucacccagcucaccgagaagcucaagaaccaguccgagucccacaagcaggcccaggagaaccuccacgaccagguccaggagcagaaggcccaccuccgcgccgcccaggaccgcguccucucccucgagaccuccgucaacgagcucaacucccagcucaacgaguccaaggagaaggucucccagcucgacauccagaucaaggccaagaccgagcuccuccucuccgccgaggccgccaagaccgcccagcgcgccgaccuccagaaccaccucgacaccgcccagaacgcccuccaggacaagcagcaggagcucaacaagaucaccacccagcucgaccaggucaccgccaagcuccaggacaagcaggagcacugcucccagcucgagucccaccucaaggaguacaaggagaaguaccucucccucgagcagaagaccgaggagcucgagggccagaucaagaagcucgaggccgacucccucgaggucaaggccuccaaggagcaggcccuccaggaccuccagcagcagcgccagcucaacaccgaccucgagcuccgcgccaccgagcucuccaagcagcucgagauggagaaggagaucgucuccuccacccgccucgaccuccagaagaaguccgaggcccucgaguccaucaagcagaagcucaccaagcaggaggaggagaagcagauccucaagcaggacuucgagacccucucccaggagaccaagauccagcacgaggagcucaacaaccgcauccagaccaccgucaccgagcuccagaaggucaagauggagaaggaggcccucaugaccgagcucuccaccgucaaggacaagcucuccaaggucuccgacucccucaagaacuccaaguccgaguucgagaaggagaaccagaagggcaaggccgccauccucgaccucgagaagaccugcaaggagcucaagcaccagcuccagguccagauggagaacacccucaaggagcagaaggagcucaagaagucccucgagaaggagaaggaggccucccaccagcucaagcucgagcucaacuccaugcaggagcagcucauccaggcccagaacacccucaagcagaacgagaaggaggagcagcagcuccagggcaacaucaacgagcucaagcaguccuccgagcagaagaagaagcagaucgaggcccuccagggcgagcucaagaucgccguccuccagaagaccgagcucgagaacaagcuccagcagcagcucacccaggccgcccaggagcucgccgccgagaaggagaagaucuccguccuccagaacaacuacgagaagucccaggagaccuucaagcagcuccaguccgacuucuacggccgcgaguccgagcuccucgccacccgccaggaccucaaguccgucgaggagaagcucucccucgcccaggaggaccucaucuccaaccgcaaccagaucggcaaccagaacaagcucauccaggagcucaagaccgccaaggccacccucgagcaggacuccgccaagaaggagcagcagcuccaggagcgcugcaaggcccuccaggacauccagaaggagaagucccucaaggagaaggagcucgucaacgagaaguccaagcucgccgagaucgaggagaucaagugccgccaggagaaggagaucaccaagcucaacgaggagcucaagucccacaagcucgaguccaucaaggagaucaccaaccucaaggacgccaagcagcuccucauccagcagaagcucgagcuccagggcaaggccgacucccucaaggccgccgucgagcaggagaagcgcaaccagcagauccucaaggaccaggucaagaaggaggaggaggagcucaagaaggaguucaucgagaaggaggccaagcuccacuccgagaucaaggagaaggaggucggcaugaagaagcacgaggagaacgaggccaagcucaccaugcagaucaccgcccucaacgagaaccucggcaccgucaagaaggaguggcaguccucccagcgccgcgucuccgagcucgagaagcagaccgacgaccuccgcggcgagaucgccguccucgaggccaccguccagaacaaccaggacgagcgccgcgcccuccucgagcgcugccucaagggcgagggcgagaucgagaagcuccagaccaagguccucgagcuccagcgcaagcucgacaacaccaccgccgccguccaggagcucggccgcgagaaccagucccuccagaucaagcacacccaggcccucaaccgcaagugggccgaggacaacgagguccagaacugcauggccugcggcaagggcuucuccgucaccguccgccgccaccacugccgccagugcggcaacaucuucugcgccgagugcuccgccaagaacgcccucacccccuccuccaagaagcccguccgcgucugcgacgccugcuucaacgaccuccagggcuga

SEQ ID NO: 42563 - RNA, 1326 nt, Artificial Sequence
  derived and/or modified sequence opt2 from EED__Homo_sapiens__NP_003788
auguccgagcgcgaggucuccaccgcccccgccggcaccgacaugcccgccgccaagaagcagaagcucuccuccgacgagaacuccaaccccgaccucuccggcgacgagaacgacgacgccgucuccaucgaguccggcaccaacaccgagcgccccgacacccccaccaacacccccaacgcccccggccgcaaguccuggggcaagggcaaguggaaguccaagaagugcaaguacuccuucaagugcgucaacucccucaaggaggaccacaaccagccccucuucggcguccaguucaacuggcacuccaaggagggcgacccccucgucuucgccaccgucggcuccaaccgcgucacccucuacgagugccacucccagggcgagauccgccuccuccaguccuacgucgacgccgacgccgacgagaacuucuacaccugcgccuggaccuacgacuccaacaccucccacccccuccucgccgucgccggcucccgcggcaucauccgcaucaucaaccccaucaccaugcagugcaucaagcacuacgucggccacggcaacgccaucaacgagcucaaguuccacccccgcgaccccaaccuccuccucuccgucuccaaggaccacgcccuccgccucuggaacauccagaccgacacccucgucgccaucuucggcggcgucgagggccaccgcgacgagguccucuccgccgacuacgaccuccucggcgagaagaucauguccugcggcauggaccacucccucaagcucuggcgcaucaacuccaagcgcaugaugaacgccaucaaggaguccuacgacuacaaccccaacaagaccaaccgccccuucaucucccagaagauccacuuccccgacuucuccacccgcgacauccaccgcaacuacgucgacugcguccgcuggcucggcgaccucauccucuccaaguccugcgagaacgccaucgucugcuggaagcccggcaagauggaggacgacaucgacaagaucaagcccuccgaguccaacgucaccauccucggccgcuucgacuacucccagugcgacaucugguacaugcgcuucuccauggacuucuggcagaagaugcucgcccucggcaaccaggucggcaagcucuacgucugggaccucgaggucgaggacccccacaaggccaagugcaccacccucacccaccacaagugcggcgccgccauccgccagaccuccuucucccgcgacuccuccauccucaucgccgucugcgacgacgccuccaucuggcgcugggaccgccuccgcuga

SEQ ID NO: 42564 - RNA, 1389 nt, Artificial Sequence
  derived and/or modified sequence opt2 from EEF1A1__Homo_sapiens__XP_011533816
augggcaaggagaagacccacaucaacaucgucgucaucggccacgucgacuccggcaaguccaccaccaccggccaccucaucuacaagugcggcggcaucgacaagcgcaccaucgagaaguucgagaaggaggccgccgagaugggcaagggcuccuucaaguacgccuggguccucgacaagcucaaggccgagcgcgagcgcggcaucaccaucgacaucucccucuggaaguucgagaccuccaaguacuacgucaccaucaucgacgcccccggccaccgcgacuucaucaagaacaugaucaccggcaccucccaggccgacugcgccguccucaucgucgccgccggcgucggcgaguucgaggccggcaucuccaagaacggccagacccgcgagcacgcccuccucgccuacacccucggcgucaagcagcucaucgucggcgucaacaagauggacuccaccgagccccccuacucccagaagcgcuacgaggagaucgucaaggaggucuccaccuacaucaagaagaucggcuacaaccccgacaccgucgccuucguccccaucuccggcuggaacggcgacaacaugcucgagcccuccgccaacaugcccugguucaagggcuggaaggucacccgcaaggacggcaacgccuccggcaccacccuccucgaggcccucgacugcauccucccccccacccgccccaccgacaagccccuccgccucccccuccaggacgucuacaagaucggcggcaucggcaccguccccgucggccgcgucgagaccggcguccucaagcccggcauggucgucaccuucgcccccgucaacgucaccaccgaggucaaguccgucgagaugcaccacgaggcccucuccgaggcccuccccggcgacaacgucggcuucaacgucaagaacgucuccgucaaggacguccgccgcggcaacgucgccggcgacuccaagaacgacccccccauggaggccgccggcuucaccgcccaggucaucauccucaaccaccccggccagaucuccgccggcuacgcccccguccucgacugccacaccgcccacaucgccugcaaguucgccgagcucaaggagaagaucgaccgccgcuccggcaagaagcucgaggacggccccaaguuccucaaguccggcgacgccgccaucgucgacaugguccccggcaagcccaugugcgucgaguccuucuccgacuaccccccccucggccgcuucgccguccgcgacaugcgccagaccgucgccgucggcgucaucaaggccgucgacaagaaggccgccggcgccggcaaggucaccaaguccgcccagaaggcccagaaggccaaguga

SEQ ID NO: 42565 - RNA, 1392 nt, Artificial Sequence
  derived and/or modified sequence opt2 from EEF1A2__Homo_sapiens__NP_001949
augggcaaggagaagacccacaucaacaucgucgucaucggccacgucgacuccggcaaguccaccaccaccggccaccucaucuacaagugcggcggcaucgacaagcgcaccaucgagaaguucgagaaggaggccgccgagaugggcaagggcuccuucaaguacgccuggguccucgacaagcucaaggccgagcgcgagcgcggcaucaccaucgacaucucccucuggaaguucgagaccaccaaguacuacaucaccaucaucgacgcccccggccaccgcgacuucaucaagaacaugaucaccggcaccucccaggccgacugcgccguccucaucgucgccgccggcgucggcgaguucgaggccggcaucuccaagaacggccagacccgcgagcacgcccuccucgccuacacccucggcgucaagcagcucaucgucggcgucaacaagauggacuccaccgagcccgccuacuccgagaagcgcuacgacgagaucgucaaggaggucuccgccuacaucaagaagaucggcuacaaccccgccaccguccccuucguccccaucuccggcuggcacggcgacaacaugcucgagcccucccccaacaugcccugguucaagggcuggaaggucgagcgcaaggagggcaacgccuccggcgucucccuccucgaggcccucgacaccauccucccccccacccgccccaccgacaagccccuccgccucccccuccaggacgucuacaagaucggcggcaucggcaccguccccgucggccgcgucgagaccggcauccuccgccccggcauggucgucaccuucgcccccgucaacaucaccaccgaggucaaguccgucgagaugcaccacgaggcccucuccgaggcccuccccggcgacaacgucggcuucaacgucaagaacgucuccgucaaggacauccgccgcggcaacgucugcggcgacuccaaguccgaccccccccaggaggccgcccaguucaccucccaggucaucauccucaaccaccccggccagaucuccgccggcuacucccccgucaucgacugccacaccgcccacaucgccugcaaguucgccgagcucaaggagaagaucgaccgccgcuccggcaagaagcucgaggacaaccccaagucccucaaguccggcgacgccgccaucgucgagaugguccccggcaagcccaugugcgucgaguccuucucccaguaccccccccucggccgcuucgccguccgcgacaugcgccagaccgucgccgucggcgucaucaagaacgucgagaagaaguccggcggcgccggcaaggucaccaaguccgcccagaaggcccagaaggccggcaaguga

SEQ ID NO: 42566 - RNA, 678 nt, Artificial Sequence
  derived and/or modified sequence opt2 from EEF1B2__Homo_sapiens__NP_001032752
augggcuucggcgaccucaagucccccgccggccuccagguccucaacgacuaccucgccgacaaguccuacaucgagggcuacguccccucccaggccgacgucgccgucuucgaggccgucuccucccccccccccgccgaccucugccacgcccuccgcugguacaaccacaucaaguccuacgagaaggagaaggccucccuccccggcgucaagaaggcccucggcaaguacggccccgccgacgucgaggacaccaccggcuccggcgccaccgacuccaaggacgacgacgacaucgaccucuucggcuccgacgacgaggaggaguccgaggaggccaagcgccuccgcgaggagcgccucgcccaguacgaguccaagaaggccaagaagcccgcccucgucgccaaguccuccauccuccucgacgucaagcccugggacgacgagaccgacauggccaagcucgaggagugcguccgcuccauccaggccgacggccucgucuggggcuccuccaagcucguccccgucggcuacggcaucaagaagcuccagauccagugcgucgucgaggacgacaaggucggcaccgacaugcucgaggagcagaucaccgccuucgaggacuacguccaguccauggacgucgccgccuucaacaagaucuga

SEQ ID NO: 42567 - RNA, 1944 nt, Artificial Sequence
  derived and/or modified sequence opt2 from EEF1D__Homo_sapiens__NP_001123525
augcgcuccggcaaggccuccugcacccucgagaccgucugggaggacaagcacaaguacgaggaggccgagcgccgcuucuacgagcacgaggccacccaggccgccgccuccgcccagcagcuccccgccgagggccccgccaugaacggccccggccaggacgaccccgaggacgccgacgaggccgaggcccccgacggcggcucccgccgcgacccccgcaagucccaggacucccgcaagccccuccagaagaagcgcaagcgcucccccaaguccggccucggccccgccgaccucgcccuccucggccucuccgccgagcgcgucuggcucgacaagucccucuucgaccaggccgaguccuccuaccgccagaagcucgccgacgucgccgcccaggccgccuggccccccgcccucgcccccuggggccucugcacccacggcaaccaggucgccugccaccacgucaccuggggcaucugggucaacaaguccuccuucgaccaggccgagcgcgccuucgucgaguggucccaggcccuccuccucgcccccgagggcucccgccgccagggcacccccaacaccggccagcaggucgccguccccgaccucgcccaccagcccuccccccccgucaacggccagcccccccucggcucccuccaggcccucguccgcgaggucuggcucgagaagccccgcuacgacgccgccgagcgcggcuucuacgaggcccucuucgacggccacccccccggcaagguccgccuccaggagcgcgccggccucgccgagggcgcccgccgcggccgccgcgaccgccgcggccgcaacauccucggcaacaagcgcgccggccuccgccgcgccgacggcgaggcccccuccgcccuccccuacugcuacuuccuccagaaggacgccgaggcccccuggcucuccaagcccgccuacgacuccgccgagugccgccaccacgccgccgaggcccuccgcgucgccuggugccucgaggccgccucccucucccaccgccccggcccccgcuccggccucuccgucuccucccuccgccccaaccgcaagauggccaccaacuuccucgcccacgagaagaucugguucgacaaguucaaguacgacgacgccgagcgccgcuucuacgagcagaugaacggccccgucgccggcgccucccgccaggagaacggcgccuccgucauccuccgcgacaucgcccgcgcccgcgagaacauccagaagucccucgccggcuccuccggccccggcgccuccuccggcaccuccggcgaccacggcgagcucgucguccgcaucgccucccucgaggucgagaaccagucccuccgcggcgucguccaggagcuccagcaggccaucuccaagcucgaggcccgccucaacguccucgagaaguccucccccggccaccgcgccaccgccccccagacccagcacgucucccccaugcgccaggucgagccccccgccaagaagcccgccacccccgccgaggacgacgaggacgacgacaucgaccucuucggcuccgacaacgaggaggaggacaaggaggccgcccagcuccgcgaggagcgccuccgccaguacgccgagaagaaggccaagaagcccgcccucgucgccaaguccuccauccuccucgacgucaagcccugggacgacgagaccgacauggcccagcucgaggccugcguccgcuccauccagcucgacggccucgucuggggcgccuccaagcucguccccgucggcuacggcauccgcaagcuccagauccagugcgucgucgaggacgacaaggucggcaccgaccuccucgaggaggagaucaccaaguucgaggagcacguccaguccgucgacaucgccgccuucaacaagaucuga

SEQ ID NO: 42568 - RNA, 420 nt, Artificial Sequence
  derived and/or modified sequence opt2 from EEF1E1__Homo_sapiens__NP_001129122
auggccgccgccgccgagcucucccuccucgagaagucccucggccucuccaagggcaacaaguacuccgcccagggcgagcgccagauccccguccuccagaccaacaacggccccucccucaccggccucaccaccaucgccgcccaccucgucaagcaggccaacaaggaguaccuccucggcuccaccgccgaggagaaggccaucguccagcaguggcucgaguaccgcgucacccaggucgacggccacuccuccaagaacgacauccacacccuccucaaggaccucaacuccuaccucgaggacaaggucuaccucaccggcuacaacuucacccucgccgacauccuccucuacuacggccuccaccgcuucaucauccgcaagcuccgccacaccgaggucggcaacuga

SEQ ID NO: 42569 - RNA, 1314 nt, Artificial Sequence
  derived and/or modified sequence opt2 from EEF1G__Homo_sapiens__NP_001395
auggccgccggcacccucuacaccuaccccgagaacuggcgcgccuucaaggcccucaucgccgcccaguacuccggcgcccagguccgcguccucuccgcccccccccacuuccacuucggccagaccaaccgcacccccgaguuccuccgcaaguuccccgccggcaagguccccgccuucgagggcgacgacggcuucugcgucuucgaguccaacgccaucgccuacuacgucuccaacgaggagcuccgcggcuccacccccgaggccgccgcccaggucguccagugggucuccuucgccgacuccgacaucgucccccccgccuccaccugggucuuccccacccucggcaucaugcaccacaacaagcaggccaccgagaacgccaaggaggagguccgccgcauccucggccuccucgacgccuaccucaagacccgcaccuuccucgucggcgagcgcgucacccucgccgacaucaccgucgucugcacccuccucuggcucuacaagcagguccucgagcccuccuuccgccaggccuuccccaacaccaaccgcugguuccucaccugcaucaaccagccccaguuccgcgccguccucggcgaggucaagcucugcgagaagauggcccaguucgacgccaagaaguucgccgagacccagcccaagaaggacaccccccgcaaggagaagggcucccgcgaggagaagcagaagccccaggccgagcgcaaggaggagaagaaggccgccgcccccgcccccgaggaggagauggacgagugcgagcaggcccucgccgccgagcccaaggccaaggaccccuucgcccaccuccccaaguccaccuucguccucgacgaguucaagcgcaaguacuccaacgaggacacccucuccgucgcccuccccuacuucugggagcacuucgacaaggacggcuggucccucugguacuccgaguaccgcuuccccgaggagcucacccagaccuucauguccugcaaccucaucaccggcauguuccagcgccucgacaagcuccgcaagaacgccuucgccuccgucauccucuucggcaccaacaacuccuccuccaucuccggcgucugggucuuccgcggccaggagcucgccuucccccucucccccgacuggcaggucgacuacgaguccuacaccuggcgcaagcucgaccccggcuccgaggagacccagacccucguccgcgaguacuucuccugggagggcgccuuccagcacgucggcaaggccuucaaccagggcaagaucuucaaguga

SEQ ID NO: 42570 - RNA, 2577 nt, Artificial Sequence
  derived and/or modified sequence opt2 from EEF2__Homo_sapiens__NP_001952
auggucaacuucaccgucgaccagauccgcgccaucauggacaagaaggccaacauccgcaacauguccgucaucgcccacgucgaccacggcaaguccacccucaccgacucccucgucugcaaggccggcaucaucgccuccgcccgcgccggcgagacccgcuucaccgacacccgcaaggacgagcaggagcgcugcaucaccaucaaguccaccgccaucucccucuucuacgagcucuccgagaacgaccucaacuucaucaagcaguccaaggacggcgccggcuuccucaucaaccucaucgacucccccggccacgucgacuucuccuccgaggucaccgccgcccuccgcgucaccgacggcgcccucgucgucgucgacugcgucuccggcgucugcguccagaccgagaccguccuccgccaggccaucgccgagcgcaucaagcccguccucaugaugaacaagauggaccgcgcccuccucgagcuccagcucgagcccgaggagcucuaccagaccuuccagcgcaucgucgagaacgucaacgucaucaucuccaccuacggcgagggcgaguccggccccaugggcaacaucaugaucgaccccguccucggcaccgucggcuucggcuccggccuccacggcugggccuucacccucaagcaguucgccgagauguacgucgccaaguucgccgccaagggcgagggccagcucggccccgccgagcgcgccaagaaggucgaggacaugaugaagaagcucuggggcgaccgcuacuucgaccccgccaacggcaaguucuccaaguccgccaccucccccgagggcaagaagcucccccgcaccuucugccagcucauccucgaccccaucuucaaggucuucgacgccaucaugaacuucaagaaggaggagaccgccaagcucaucgagaagcucgacaucaagcucgacuccgaggacaaggacaaggagggcaagccccuccucaaggccgucaugcgccgcuggcuccccgccggcgacgcccuccuccagaugaucaccauccaccuccccucccccgucaccgcccagaaguaccgcugcgagcuccucuacgagggcccccccgacgacgaggccgccaugggcaucaaguccugcgaccccaagggcccccucaugauguacaucuccaagaugguccccaccuccgacaagggccgcuucuacgccuucggccgcgucuucuccggccucgucuccaccggccucaagguccgcaucaugggccccaacuacacccccggcaagaaggaggaccucuaccucaagcccauccagcgcaccauccucaugaugggccgcuacgucgagcccaucgaggacguccccugcggcaacaucgucggccucgucggcgucgaccaguuccucgucaagaccggcaccaucaccaccuucgagcacgcccacaacaugcgcgucaugaaguucuccgucucccccgucguccgcgucgccgucgaggccaagaaccccgccgaccuccccaagcucgucgagggccucaagcgccucgccaaguccgaccccaugguccagugcaucaucgaggaguccggcgagcacaucaucgccggcgccggcgagcuccaccucgagaucugccucaaggaccucgaggaggaccacgccugcauccccaucaagaaguccgaccccgucgucuccuaccgcgagaccgucuccgaggaguccaacguccucugccucuccaagucccccaacaagcacaaccgccucuacaugaaggcccgccccuuccccgacggccucgccgaggacaucgacaagggcgaggucuccgcccgccaggagcucaagcagcgcgcccgcuaccucgccgagaaguacgagugggacgucgccgaggcccgcaagaucuggugcuucggccccgacggcaccggccccaacauccucaccgacaucaccaagggcguccaguaccucaacgagaucaaggacuccgucgucgccggcuuccagugggccaccaaggagggcgcccucugcgaggagaacaugcgcggcguccgcuucgacguccacgacgucacccuccacgccgacgccauccaccgcggcggcggccagaucauccccaccgcccgccgcugccucuacgccuccguccucaccgcccagccccgccucauggagcccaucuaccucgucgagauccagugccccgagcaggucgucggcggcaucuacggcguccucaaccgcaagcgcggccacgucuucgaggagucccaggucgccggcacccccauguucgucgucaaggccuaccuccccgucaacgaguccuucggcuucaccgccgaccuccgcuccaacaccggcggccaggccuucccccagugcgucuucgaccacuggcagauccuccccggcgaccccuucgacaacuccucccgccccucccaggucgucgccgagacccgcaagcgcaagggccucaaggagggcauccccgcccucgacaacuuccucgacaagcucuga

SEQ ID NO: 42571 - RNA, 1791 nt, Artificial Sequence
  derived and/or modified sequence opt2 from EEFSEC__Homo_sapiens__NP_068756
auggccggccgccgcgucaacgucaacgucggcguccucggccacaucgacuccggcaagaccgcccucgcccgcgcccucuccaccaccgccuccaccgccgccuucgacaagcagccccagucccgcgagcgcggcaucacccucgaccucggcuucuccugcuucuccgucccccuccccgcccgccuccgcuccucccuccccgaguuccaggccgcccccgaggccgagcccgagcccggcgagccccuccuccaggucacccucgucgacugccccggccacgccucccucauccgcaccaucaucggcggcgcccagaucaucgaccucaugaugcucgucaucgacgucaccaagggcaugcagacccaguccgccgagugccucgucaucggccagaucgccugccagaagcucgucgucguccucaacaagaucgaccuccuccccgagggcaagcgccaggccgccaucgacaagaugaccaagaagaugcagaagacccucgagaacaccaaguuccgcggcgcccccaucauccccgucgccgccaagcccggcggccccgaggcccccgagaccgaggccccccagggcauccccgagcucaucgagcuccucaccucccagaucuccauccccacccgcgaccccuccggccccuuccucauguccgucgaccacugcuucuccaucaagggccagggcaccgucaugaccggcaccauccucuccggcuccaucucccucggcgacuccgucgagauccccgcccucaaggucgucaagaaggucaaguccaugcagauguuccacaugcccaucaccuccgccaugcagggcgaccgccucggcaucugcgucacccaguucgaccccaagcuccucgagcgcggccucgucugcgcccccgagucccuccacaccguccacgccgcccucaucuccgucgagaagauccccuacuuccgcggcccccuccagaccaaggccaaguuccacaucaccgucggccacgagaccgucaugggccgccucauguucuucucccccgcccccgacaacuucgaccaggagcccauccucgacuccuucaacuucucccaggaguaccucuuccaggagcaguaccucuccaaggaccucacccccgccgucaccgacaacgacgaggccgacaagaaggccggccaggccaccgagggccacugcccccgccagcagugggcccucgucgaguucgagaagcccgucaccugcccccgccucugccucgucaucggcucccgccucgacgccgacauccacaccaacaccugccgccucgccuuccacggcauccuccuccacggccucgaggaccgcaacuacgccgacuccuuccucccccgccucaaggucuacaagcucaagcacaagcacggccucgucgagcgcgccauggacgacuacuccgucaucggccgcucccucuucaagaaggagaccaacauccagcucuucgucggccucaagguccaccucuccaccggcgagcucggcaucaucgacuccgccuucggccaguccggcaaguucaagauccacauccccggcggccucucccccgaguccaagaagauccucacccccgcccucaagaagcgcgcccgcgccggccgcggcgaggccacccgccaggaggaguccgccgagcgcuccgagcccucccagcacgucguccucucccucaccuucaagcgcuacgucuucgacacccacaagcgcaugguccagucccccuga

SEQ ID NO: 42572 - RNA, 429 nt, Artificial Sequence
  derived and/or modified sequence opt2 from EFCAB11__Homo_sapiens__NP_001271195
auguucuucuccgaggcccgcgcccgcucccgcaccugggaggccucccccuccgagcaccgcaagugggucgaggucuucaaggccugcgacgaggaccacaagggcuaccucucccgcgaggacuucaagaccgccgucgucaugcucuucggcuacaagcccuccaagaucgaggucgacuccgucauguccuccaucaaccccaacaccuccggcauccuccucgagggcuuccucaacaucguccgcaagaagaaggaggcccagcgcuaccgcaacgagguccgccacaucuucaccgccuucgacaccuacuaccgcggcuuccucacccucgaggacuucaagaaggccuuccgccaggucgcccccaagcuccccgagcgcaccguccucgaggucuuccgcggcaucuucuccgccuga

SEQ ID NO: 42573 - RNA, 480 nt, Artificial Sequence
  derived and/or modified sequence opt2 from EFCAB1__Homo_sapiens__XP_005251361
augaaccgcaagaagcuccagaagcucaccgacacccucaccaagaacugcaagcaccucuuccgcggcuucgacaaggacaacgacggcugcgucaacguccucgaguggauccacggccucucccucuuccuccgcggcucccucgaggagaagaugaaguacugcuucgaggucuucgaccucaacggcgacggcuucaucuccaaggaggagauguuccacaugcucaagaacucccuccucaagcagcccuccgaggaggaccccgacgagggcaucaaggaccucgucgagaucacccucaagaagauggaccacgaccacgacggcaagcucuccuucgccgacuacgagcucgccguccgcgaggagacccuccuccucgaggccuucggccccugccuccccgaccccaagucccagauggaguucgaggcccaggucuucaaggaccccaacgaguucaacgacauguga

SEQ ID NO: 42574 - RNA, 1482 nt, Artificial Sequence
  derived and/or modified sequence opt2 from EFEMP1__Homo_sapiens__NP_001034438
augcucaaggcccucuuccucaccaugcucacccucgcccucgucaagucccaggacaccgaggagaccaucaccuacacccagugcaccgacggcuacgagugggaccccguccgccagcagugcaaggacaucgacgagugcgacaucguccccgacgccugcaagggcggcaugaagugcgucaaccacuacggcggcuaccucugccuccccaagaccgcccagaucaucgucaacaacgagcagccccagcaggagacccagcccgccgagggcaccuccggcgccaccaccggcgucgucgccgccuccuccauggccaccuccggcguccuccccggcggcggcuucgucgccuccgccgccgccgucgccggccccgagaugcagaccggccgcaacaacuucgucauccgccgcaaccccgccgacccccagcgcauccccuccaaccccucccaccgcauccagugcgccgccggcuacgagcaguccgagcacaacgucugccaggacaucgacgagugcaccgccggcacccacaacugccgcgccgaccaggucugcaucaaccuccgcggcuccuucgccugccagugcccccccggcuaccagaagcgcggcgagcagugcgucgacaucgacgagugcaccaucccccccuacugccaccagcgcugcgucaacacccccggcuccuucuacugccagugcucccccggcuuccagcucgccgccaacaacuacaccugcgucgacaucaacgagugcgacgccuccaaccagugcgcccagcagugcuacaacauccucggcuccuucaucugccagugcaaccagggcuacgagcucuccuccgaccgccucaacugcgaggacaucgacgagugccgcaccuccuccuaccucugccaguaccagugcgucaacgagcccggcaaguucuccugcaugugcccccagggcuaccaggucguccgcucccgcaccugccaggacaucaacgagugcgagaccaccaacgagugccgcgaggacgagaugugcuggaacuaccacggcggcuuccgcugcuacccccgcaaccccugccaggaccccuacauccucacccccgagaaccgcugcgucugccccgucuccaacgccaugugccgcgagcucccccaguccaucgucuacaaguacauguccauccgcuccgaccgcuccguccccuccgacaucuuccagauccaggccaccaccaucuacgccaacaccaucaacaccuuccgcaucaaguccggcaacgagaacggcgaguucuaccuccgccagaccucccccgucuccgccaugcucguccucgucaagucccucuccggcccccgcgagcacaucgucgaccucgagaugcucaccgucuccuccaucggcaccuuccgcaccuccuccguccuccgccucaccaucaucgucggccccuucuccuucuga

SEQ ID NO: 42575 - RNA, 1332 nt, Artificial Sequence
  derived and/or modified sequence opt2 from EFEMP2__Homo_sapiens__NP_058634
augcuccccugcgccuccugccuccccggcucccuccuccucugggcccuccuccuccuccuccucggcuccgccuccccccaggacuccgaggagcccgacuccuacaccgagugcaccgacggcuacgagugggaccccgacucccagcacugccgcgacgucaacgagugccucaccauccccgaggccugcaagggcgagaugaagugcaucaaccacuacggcggcuaccucugccucccccgcuccgccgccgucaucaacgaccuccacggcgagggcccccccccccccgucccccccgcccagcaccccaaccccugcccccccggcuacgagcccgacgaccaggacuccugcgucgacgucgacgagugcgcccaggcccuccacgacugccgccccucccaggacugccacaaccuccccggcuccuaccagugcaccugccccgacggcuaccgcaagaucggccccgagugcgucgacaucgacgagugccgcuaccgcuacugccagcaccgcugcgucaaccuccccggcuccuuccgcugccagugcgagcccggcuuccagcucggccccaacaaccgcuccugcgucgacgucaacgagugcgacaugggcgcccccugcgagcagcgcugcuucaacuccuacggcaccuuccucugccgcugccaccagggcuacgagcuccaccgcgacggcuucuccugcuccgacaucgacgagugcuccuacuccuccuaccucugccaguaccgcugcaucaacgagcccggccgcuucuccugccacugcccccagggcuaccagcuccucgccacccgccucugccaggacaucgacgagugcgaguccggcgcccaccagugcuccgaggcccagaccugcgucaacuuccacggcggcuaccgcugcgucgacaccaaccgcugcgucgagcccuacauccaggucuccgagaaccgcugccucugccccgccuccaacccccucugccgcgagcagcccuccuccaucguccaccgcuacaugaccaucaccuccgagcgcuccguccccgccgacgucuuccagauccaggccaccuccgucuaccccggcgccuacaacgccuuccagauccgcgccggcaacucccagggcgacuucuacauccgccagaucaacaacgucuccgccaugcucguccucgcccgccccgucaccggcccccgcgaguacguccucgaccucgagauggucaccaugaacucccucauguccuaccgcgccuccuccguccuccgccucaccgucuucgucggcgccuacaccuucuga

SEQ ID NO: 42576 - RNA, 2502 nt, Artificial Sequence
  derived and/or modified sequence opt2 from EFHB__Homo_sapiens__NP_653316
augaacauggagaucggccacccccacgagggcaaggacgaccucggcgacaagcgcgucaucaugggcaccaaguuccccauggagcucggcauccgcgucggccucggcaaggaggacucccgcugcggcgagucccccgucgucuccaacaagugcgagggccgcauggccccccccgagaccaaguucccccucuccaagggccucgagaugggccucgagcgccagaacaucucccgcaccgucaugcagcgcggcucccucggcgucgacuccgucuccgccucccagggcaccaagcccucccuccuccccggccgcaugggccucgagaacgagucccuccucgccggcuacacccacgagcgcaucauccagcccccccucggccgcgucugcggcuccucccaggccgccggcucccgccgcgccccccucgccuccggccccgagggcgucgaggagcucgucggcaagcccgccuucgucauggagccccgccaggagauggagaaggaguccaccugcguccucaugaagcccaacaccgagaucaagcuccccgucgaggucgacaucggccucacccaggccgagggccccgacgagaccaagaacaccgagccccagaugggccucgucaucgagcccccccagugccaguucgcccagcagcacgagcagcgcaaggaggccggcaacaucgaguccggcgucgagccccccgaccgcauccgccccaucuacuccggcaaguucuucgaccgcacccccugcuggcccuccgccggcaaggucauccccgucggcuaccgcgucgccaccugccucaccgagaagcucccccgccucaucaccccccccgaggccaagaaguacuucaacuuccgcuacccccccgccggcgucgagcgcgucuucuacggccgcgccaacgacccccagaucgcccccuaccucacccacggcauccgcuccaagaucuccguccucgccaacacccucaucaacccccagcccaucaccaccuuccagcagaagaucaaggacaagaaggaguccaucuaccucuccaaccgccgcgccccccucggcaagucccacgaccaggcccccggccuccccaagggcauggacaccaccaacaccaccuucggcaccgccgucaucaaggaguacuccgccaaggacgucgucaacccccccaaguccuacgaggaggucuucaaggagggcaacgagggccacgaccucuacgucgucucccacaacgacuacuacgccggcgaggccaagaaccgcaaguacaaccccuccuccuuccaccgcugcuccgucuacggcguccccaccccccacuucaacgacggccgcgccauggccaagucccucuacuggcuccacgagcuccagaugaagcgcggcgccaaguucgucuccaagcgcgccgacgacuucaaggagaaguuccagcacaagcucggccgcguccucgaccccaucgccgagaccaugaacgucccccccgacugcaccuucggcgccugccuccgccccgaggaguacggcgucggcgaccucauccacaaccgccuccccgacgaguaccuccgcggcaaggaccgccagcgcgcccucaucgccgccguccgccaccaccucaagaaggucaacuaccagaaguucgacacccuccucgccgccuuccgccacuacgacaagaagggcgacggcaugaucgacaaggacgagcuccaggaggccugcgaccaggccaaccucucccucgacgacaagcuccucgaccagcucuucgacuacugcgacgucgacaacgacggcuucaucaacuaccucgaguucgccaacuuccucaacuggaaggacaagaugcuccucaaggaguacgaggagcgcgucaucaucaagggccgcaagcccgacugcgucaaccccaccgaggccaacgucgaggagcccgagcagacccuccucaucaagcccgaggacaucguccucaaggaggccggcuccaccgagaagacccuccgcacccuccuccgccccuccgacaaggucuccaacuacuacaagaccaccuccuccgagaucaacgccaucgucggcgccauccccuccaccugcuaccccaucugcggcguccccaccauccgcuccgacauccccgccccccgcauccgccgcaucuccgaccgcaccaacuacggcgaggagggcuccgccuacucccuccucuaccccaccaucuucgcccgcaagggcgucuucgagcgcgacuucuucaagacccgcuccaaggaggagaucgccgagauccucugcaacaucggcgucaagcucuccgacgaggaguucgagaacgucuggaaccucgccuccaagaagcaccaccgcggcgaggucugcgucgagaacauccgcaacguccucgacgagcuccgccacgccgaccgcaucaagugcaagacccucauguga

SEQ ID NO: 42577 - RNA, 1866 nt, Artificial Sequence
  derived and/or modified sequence opt2 from EFHC1__Homo_sapiens__NP_001165891
augcucaagaccgccuuccaccgcucccagacccucuccuaccgcaacggcuacgccaucguccgccgccccaccgucggcaucggcggcgaccgccuccaguucaaccagcucucccaggccgagcucgacgagcucgccuccaaggcccccguccucaccuacggccagcccaagcaggccccccccgccgacuucauccccgcccacgucgccuucgacaagaagguccucaaguucgacgccuacuuccaggaggacguccccauguccaccgaggagcaguaccgcauccgccaggucaacaucuacuacuaccucgaggacgacuccauguccgucaucgagcccgucgucgagaacuccggcauccuccagggcaagcucaucaagcgccagcgccucgccaagaacgaccgcggcgaccacuaccacuggaaggaccucaaccgcggcaucaacaucaccaucuacggcaagaccuuccgcgucgucgacugcgaccaguucacccaggucuuccucgagucccagggcaucgagcucaacccccccgagaagauggcccucgaccccuacaccgagcuccgcaagcagccccuccgcaaguacgucacccccuccgacuucgaccagcucaagcaguuccucaccuucgacaagcagguccuccgcuucuacgccaucugggacgacaccgacuccauguacggcgagugccgcaccuacaucauccacuacuaccucauggacgacaccgucgagauccgcgagguccacgagcgcaacgacggccgcgaccccuucccccuccucaugaaccgccagcgcguccccaagguccucgucgagaacgccaagaacuucccccagugcguccucgagaucuccgaccaggagguccucgagugguacaccgccaaggacuucaucgucggcaagucccucaccauccucggccgcaccuucuucaucuacgacugcgaccccuucacccgccgcuacuacaaggagaaguucggcaucaccgaccucccccgcaucgacgucuccaagcgcgagcccccccccgucaagcaggagcucccccccuacaacggcuucggccucgucgaggacuccgcccagaacugcuucgcccucauccccaaggcccccaagaaggacgucaucaagaugcucgucaacgacaacaagguccuccgcuaccucgccguccucgagucccccauccccgaggacaaggaccgccgcuucgucuucuccuacuuccucgccaccgacaugaucuccaucuucgagccccccguccgcaacuccggcaucaucggcggcaaguaccucggccgcaccaaggucgucaagcccuacuccaccgucgacaaccccgucuacuacggccccuccgacuucuucaucggcgccgucaucgaggucuucggccaccgcuucaucauccucgacaccgacgaguacguccucaaguacauggaguccaacgccgcccaguacucccccgaggcccucgccuccauccagaaccacguccgcaagcgcgaggcccccgcccccgaggccgaguccaagcagaccgagaaggaccccggcguccaggagcucgaggcccucaucgacaccauccagaagcagcucaaggaccacuccugcaaggacaacauccgcgaggccuuccagaucuacgacaaggaggccuccggcuacgucgaccgcgacauguucuucaagaucugcgagucccucaacguccccgucgacgacucccucgucaaggagcucauccgcaugugcucccacggcgagggcaagaucaacuacuacaacuucguccgcgccuucuccaacuga

SEQ ID NO: 42578 - RNA, 2250 nt, Artificial Sequence
  derived and/or modified sequence opt2 from EFHC2__Homo_sapiens__NP_079460
auggcccucccccuccuccccggcaacuccuucaaccgcaacgucggcaaggagaaguuccacaagucccagcacuggggcuucugcaacaacgucaugaugcucgucuccgacgagaagcccggcaucggcggcgagccccuccucggccagaagaucaagcccaagugcuccaucuaccccaagggcgacggcuccgacguccccuccugggucgccuucgacaagcagguccucuccuucgacgccuaccucgaggaggagguccucgacaagucccagaccaacuaccgcauccgcuacuacaagaucuacuucuaccccgaggacgacaccauccaggucaacgagcccgaggucaagaacuccggccuccuccagggcaccuccauccgccgccaccgcaucacccuccccccccccgacgaggaccaguucuacaccgucuaccacuucaacgucggcaccgaggucgucuucuacggccgcaccuucaagaucuacgacugcgacgccuucacccgcaacuuccuccgcaagaucggcgucaaggucaacccccccguccagugccccgaggaccccuacaugaagauccgccgcgaggucgucgagcacgucgagccccuccgccccuacgagucccucgacacccucaagcaguuccuccaguaccacggcaagauccucugcuucuucugccucugggacgacuccgucuccauguucggcgaccgccgcgagcucauccuccacuacuuccucugcgacgacaccaucgagaucaaggagcuccucccccacuccuccggccgcgacgcccucaagauguuccuccgccgcuccaagcuccccaagaacugccccccccgcgucuaccagcccggccagaucaccgaccgcgccguccucaacuccuacggcgacuucaucaagaaccaggccgacggcuaccucuucgaccgcuacaagcucggcaaggucgaccaggaguucuacaaggacuccgaccucucccucggcgucaccaucaacgucuggggccgcaagguccuccucuacgacugcgacgaguucaccaaguccuacuacaaguccaaguacggcaucgagaacuucaccuccgucuccugcaagccccccucccccccccccaagaucgagcgcaaguucccccccuacaacggcuucggcuccgaggaggacucccuccgcaacugcaucgaccucaagcccaccccccaccgccgcaacuucaagaaguucauggagaaggacuccuacggcuccaaguccaacauccuccgcuucuucgccaagcucgucaccgacaagugcgucgaccucgaccgcauguucgucaucuccuacuaccucggcgacgacaccaucuccgucuucgagcccaucgagcgcaacuccggcaucgccggcggcauguuccucaagcgcucccgcgucaagaagcccggccaggaggucuucaaguccgagcucuccgaguacaucaaggccgaggagcucuacaucggcgucaccgucaacgucaacggcuaccucuuccgccuccucaacgccgacgaguacacccucaacuacauggagcagaacaccgacaaguaccccuucuccaaccucaagcucgcccuccagaagcucaagcaggaggagggcaagucccgcgagcucaagcaggucuucaaggccgccgacuccaagcacaccaacauggucgacuacaacaccuuccgcgacauccucaugucccucaccgucggcaaccucgccgagcaggaguucgucaccaucgcccgccacuaccgcguccccgagggcaccugcuccgacauggacuuccucaucgcccucgcccacgagaaguucaagaagaacauguucgagaacuucgacaccuucaucuacuccugcgucuacgaggaccgcgagaagaagaacguccuccccaccaaggacaucaagcgccucugcaaguccucccgccucccccucuccgacgaccuccucgagucccuccucucccgcuucgaggacuccgagaagcagaucgacuacaaguccuucuucuccgcccucaacuggcgcaagaaccccguccccgagcuccagcccgccuccuaccucaaggagcgcugcgaggacgucuggcucggcaugcccucccccauccccgccaaguacaucgacuacuggaccuuccucaaggacgccuucggccucgaggaggaguga

SEQ ID NO: 42579 - RNA, 432 nt, Artificial Sequence
  derived and/or modified sequence opt2 from EFHD1__Homo_sapiens__NP_001230181
augggcgagcuccaguacgacgccggccgcgacggcuucaucgaccucauggagcucaagcucaugauggagaagcucggcgccccccagacccaccucggccucaaguccaugaucaaggaggucgacgaggacuucgacggcaagcucuccuuccgcgaguuccuccucaucuuccacaaggccgccgccggcgagcuccaggaggacuccggccucauggcccucgccaagcucuccgagaucgacgucgcccucgagggcgucaagggcgccaagaacuucuucgaggccaagguccaggcccucuccuccgccuccaaguucgaggccgagcucaaggccgagcaggacgagcgcaagcgcgaggaggaggagcgccgccuccgccaggccgccuuccagaagcucaaggccaacuucaacaccuga

SEQ ID NO: 42580 - RNA, 618 nt, Artificial Sequence
  derived and/or modified sequence opt2 from EFNA1__Homo_sapiens__NP_004419
auggaguuccucugggccccccuccucggccucugcugcucccucgccgccgccgaccgccacaccgucuucuggaacuccuccaaccccaaguuccgcaacgaggacuacaccauccacguccagcucaacgacuacgucgacaucaucugcccccacuacgaggaccacuccgucgccgacgccgccauggagcaguacauccucuaccucgucgagcacgaggaguaccagcucugccagccccaguccaaggaccagguccgcuggcagugcaaccgccccuccgccaagcacggccccgagaagcucuccgagaaguuccagcgcuucacccccuucacccucggcaaggaguucaaggagggccacuccuacuacuacaucuccaagcccauccaccagcacgaggaccgcugccuccgccucaaggucaccgucuccggcaagaucacccacuccccccaggcccacgacaacccccaggagaagcgccucgccgccgacgaccccgagguccgcguccuccacuccaucggccacuccgccgccccccgccucuucccccucgccuggaccguccuccuccucccccuccuccuccuccagacccccuga

SEQ ID NO: 42581 - RNA, 642 nt, Artificial Sequence
  derived and/or modified sequence opt2 from EFNA2__Homo_sapiens__NP_001396
auggcccccgcccagcgcccccuccucccccuccuccuccuccuccucccccucccccccccccccuucgcccgcgccgaggacgccgcccgcgccaacuccgaccgcuacgccgucuacuggaaccgcuccaacccccgcuuccacgccggcgccggcgacgacggcggcggcuacaccgucgaggucuccaucaacgacuaccucgacaucuacugcccccacuacggcgccccccucccccccgccgagcgcauggagcacuacguccucuacauggucaacggcgagggccacgccuccugcgaccaccgccagcgcggcuucaagcgcugggagugcaaccgccccgccgcccccggcggcccccucaaguucuccgagaaguuccagcucuucacccccuucucccucggcuucgaguuccgccccggccacgaguacuacuacaucuccgccaccccccccaacgccgucgaccgccccugccuccgccucaaggucuacguccgccccaccaacgagacccucuacgaggcccccgagcccaucuucaccuccaacaacuccugcuccucccccggcggcugccgccucuuccucuccaccauccccguccucuggacccuccucggcuccuga

SEQ ID NO: 42582 - RNA, 717 nt, Artificial Sequence
  derived and/or modified sequence opt2 from EFNA3__Homo_sapiens__NP_004943
auggccgccgccccccuccuccuccuccuccuccucguccccgucccccuccucccccuccucgcccagggccccggcggcgcccucggcaaccgccacgccgucuacuggaacuccuccaaccagcaccuccgccgcgagggcuacaccguccaggucaacgucaacgacuaccucgacaucuacugcccccacuacaacuccuccggcgucggccccggcgccggccccggccccggcggcggcgccgagcaguacguccucuacauggucucccgcaacggcuaccgcaccugcaacgccucccagggcuucaagcgcugggagugcaaccgcccccacgccccccacucccccaucaaguucuccgagaaguuccagcgcuacuccgccuucucccucggcuacgaguuccacgccggccacgaguacuacuacaucuccacccccacccacaaccuccacuggaagugccuccgcaugaaggucuucgucugcugcgccuccaccucccacuccggcgagaagcccguccccacccucccccaguucaccaugggccccaacgucaagaucaacguccucgaggacuucgagggcgagaacccccagguccccaagcucgagaaguccaucuccggcaccucccccaagcgcgagcaccucccccucgccgucggcaucgccuucuuccucaugaccuuccucgccuccuga

SEQ ID NO: 42583 - RNA, 606 nt, Artificial Sequence
  derived and/or modified sequence opt2 from EFNA4__Homo_sapiens__NP_005218
augcgccuccucccccuccuccgcaccguccucugggccgccuuccucggcuccccccuccgcggcggcuccucccuccgccacgucgucuacuggaacuccuccaacccccgccuccuccgcggcgacgccgucgucgagcucggccucaacgacuaccucgacaucgucugcccccacuacgagggccccggcccccccgagggccccgagaccuucgcccucuacauggucgacuggcccggcuacgaguccugccaggccgagggcccccgcgccuacaagcgcugggucugcucccuccccuucggccacguccaguucuccgagaagauccagcgcuucacccccuucucccucggcuucgaguuccuccccggcgagaccuacuacuacaucuccguccccacccccgaguccuccggccagugccuccgccuccaggucuccgucugcugcaaggagcgcaaguccgaguccgcccaccccgucggcucccccggcgaguccggcaccuccggcuggcgcggcggcgacacccccuccccccucugccuccuccuccuccuccuccuccucauccuccgccuccuccgcauccucuga

SEQ ID NO: 42584 - RNA, 687 nt, Artificial Sequence
  derived and/or modified sequence opt2 from EFNA5__Homo_sapiens__NP_001953
augcuccacgucgagaugcucacccucgucuuccucguccucuggaugugcgucuucucccaggaccccggcuccaaggccgucgccgaccgcuacgccgucuacuggaacuccuccaacccccgcuuccagcgcggcgacuaccacaucgacgucugcaucaacgacuaccucgacgucuucugcccccacuacgaggacuccguccccgaggacaagaccgagcgcuacguccucuacauggucaacuucgacggcuacuccgccugcgaccacaccuccaagggcuucaagcgcugggagugcaaccgcccccacucccccaacggcccccucaaguucuccgagaaguuccagcucuucacccccuucucccucggcuucgaguuccgccccggccgcgaguacuucuacaucuccuccgccauccccgacaacggccgccgcuccugccucaagcucaaggucuucguccgccccaccaacuccugcaugaagaccaucggcguccacgaccgcgucuucgacgucaacgacaaggucgagaacucccucgagcccgccgacgacaccguccacgaguccgccgagcccucccgcggcgagaacgccgcccagaccccccgcauccccucccgccuccucgccauccuccucuuccuccucgccaugcuccucacccucuga

SEQ ID NO: 42585 - RNA, 1041 nt, Artificial Sequence
  derived and/or modified sequence opt2 from EFNB1__Homo_sapiens__NP_004420
auggcccgccccggccagcgcuggcucggcaaguggcucgucgccauggucgucugggcccucugccgccucgccaccccccucgccaagaaccucgagcccgucuccugguccucccucaaccccaaguuccucuccggcaagggccucgucaucuaccccaagaucggcgacaagcucgacaucaucugcccccgcgccgaggccggccgccccuacgaguacuacaagcucuaccucguccgccccgagcaggccgccgccugcuccaccguccucgaccccaacguccucgucaccugcaaccgccccgagcaggagauccgcuucaccaucaaguuccaggaguucucccccaacuacaugggccucgaguucaagaagcaccacgacuacuacaucaccuccaccuccaacggcucccucgagggccucgagaaccgcgagggcggcgucugccgcacccgcaccaugaagaucaucaugaaggucggccaggaccccaacgccgucacccccgagcagcucaccaccucccgccccuccaaggaggccgacaacaccgucaagauggccacccaggcccccggcucccgcggcucccucggcgacuccgacggcaagcacgagaccgucaaccaggaggagaaguccggccccggcgccuccggcggcuccuccggcgaccccgacggcuucuucaacuccaaggucgcccucuucgccgccgucggcgccggcugcgucaucuuccuccucaucaucaucuuccucaccguccuccuccucaagcuccgcaagcgccaccgcaagcacacccagcagcgcgccgccgcccucucccucuccacccucgccucccccaagggcggcuccggcaccgccggcaccgagcccuccgacaucaucaucccccuccgcaccaccgagaacaacuacugcccccacuacgagaaggucuccggcgacuacggccaccccgucuacaucguccaggagaugcccccccagucccccgccaacaucuacuacaaggucuga

SEQ ID NO: 42586 - RNA, 1002 nt, Artificial Sequence
  derived and/or modified sequence opt2 from EFNB2__Homo_sapiens__NP_004084
auggccguccgccgcgacuccgucuggaaguacugcuggggcguccucaugguccucugccgcaccgccaucuccaaguccaucguccucgagcccaucuacuggaacuccuccaacuccaaguuccuccccggccagggccucguccucuacccccagaucggcgacaagcucgacaucaucugccccaaggucgacuccaagaccgucggccaguacgaguacuacaaggucuacauggucgacaaggaccaggccgaccgcugcaccaucaagaaggagaacaccccccuccucaacugcgccaagcccgaccaggacaucaaguucaccaucaaguuccaggaguucucccccaaccucuggggccucgaguuccagaagaacaaggacuacuacaucaucuccaccuccaacggcucccucgagggccucgacaaccaggagggcggcgucugccagacccgcgccaugaagauccucaugaaggucggccaggacgccuccuccgccggcuccacccgcaacaaggaccccacccgccgccccgagcucgaggccggcaccaacggccgcuccuccaccaccucccccuucgucaagcccaaccccggcuccuccaccgacggcaacuccgccggccacuccggcaacaacauccucggcuccgaggucgcccucuucgccggcaucgccuccggcugcaucaucuucaucgucaucaucaucacccucgucguccuccuccucaaguaccgccgccgccaccgcaagcacuccccccagcacaccaccacccucucccucuccacccucgccacccccaagcgcuccggcaacaacaacggcuccgagcccuccgacaucaucaucccccuccgcaccgccgacuccgucuucugcccccacuacgagaaggucuccggcgacuacggccaccccgucuacaucguccaggagaugcccccccagucccccgccaacaucuacuacaaggucuga

SEQ ID NO: 42587 - RNA, 1023 nt, Artificial Sequence
  derived and/or modified sequence opt2 from EFNB3__Homo_sapiens__NP_001397
augggccccccccacuccggccccggcggcguccgcgucggcgcccuccuccuccucggcguccucggccucgucuccggccucucccucgagcccgucuacuggaacuccgccaacaagcgcuuccaggccgagggcggcuacguccucuacccccagaucggcgaccgccucgaccuccucugcccccgcgcccgcccccccggcccccacuccucccccaacuacgaguucuacaagcucuaccucgucggcggcgcccagggccgccgcugcgaggccccccccgcccccaaccuccuccucaccugcgaccgccccgaccucgaccuccgcuucaccaucaaguuccaggaguacucccccaaccucuggggccacgaguuccgcucccaccacgacuacuacaucaucgccaccuccgacggcacccgcgagggccucgagucccuccagggcggcgucugccucacccgcggcaugaagguccuccuccgcgucggccaguccccccgcggcggcgccgucccccgcaagcccgucuccgagaugcccauggagcgcgaccgcggcgccgcccacucccucgagcccggcaaggagaaccuccccggcgaccccaccuccaacgccaccucccgcggcgccgagggcccccuccccccccccuccaugcccgccgucgccggcgccgccggcggccucgcccuccuccuccucggcgucgccggcgccggcggcgccaugugcuggcgccgccgccgcgccaagcccuccgagucccgccaccccggccccggcuccuucggccgcggcggcucccucggccucggcggcggcggcggcaugggcccccgcgaggccgagcccggcgagcucggcaucgcccuccgcggcggcggcgccgccgacccccccuucugcccccacuacgagaaggucuccggcgacuacggccaccccgucuacaucguccaggacggccccccccaguccccccccaacaucuacuacaaggucuga

SEQ ID NO: 42588 - RNA, 2466 nt, Artificial Sequence
  derived and/or modified sequence opt2 from EFR3A__Homo_sapiens__NP_055952
augcccacccgcgucugcugcugcugcuccgcccuccgcccccgcuacaagcgccucgucgacaacaucuuccccgaggaccccaaggacggccucgucaagaccgacauggagaagcucaccuucuacgccgucuccgcccccgagaagcucgaccgcaucggcuccuaccucgccgagcgccucucccgcgacgucguccgccaccgcuccggcuacguccucaucgccauggaggcccucgaccagcuccucauggccugccacucccaguccaucaagcccuucgucgaguccuuccuccacauggucgccaagcuccucgaguccggcgagcccaagcuccagguccucggcaccaacuccuucgucaaguucgccaacaucgaggaggacacccccuccuaccaccgccgcuacgacuucuucgucucccgcuucuccgccaugugccacuccugccacuccgaccccgagauccgcaccgagauccgcaucgccggcauccgcggcauccagggcgucguccgcaagaccgucaacgacgagcuccgcgccaccaucugggagccccagcacauggacaagaucguccccucccuccucuucaacaugcagaagaucgaggaggucgacucccgcaucggcccccccuccucccccuccgccaccgacaaggaggagaaccccgccguccucgccgagaacugcuuccgcgagcuccucggccgcgccaccuucggcaacaugaacaacgccguccgccccgucuucgcccaccucgaccaccacaagcucugggaccccaacgaguucgccguccacugcuucaagaucaucauguacuccauccaggcccaguacucccaccacgucauccaggagauccucggccaccucgacgcccgcaagaaggacgccccccgcguccgcgccggcaucauccagguccuccucgaggccgucgccaucgccgccaagggcuccaucggccccaccguccucgaggucuucaacacccuccucaagcaccuccgccucuccgucgaguucgaggccaacgaccuccagggcggcuccgucggcuccgucaaccucaacaccuccuccaaggacaacgacgagaagaucguccagaacgccaucauccagaccaucggcuucuucggcuccaaccuccccgacuaccagcgcuccgagaucaugauguucaucaugggcaagguccccgucuucggcaccuccacccacacccucgacaucucccagcucggcgaccucggcacccgccgcauccagaucaugcuccuccgcucccuccucauggucaccuccggcuacaaggccaagaccaucgucaccgcccuccccggcuccuuccucgacccccuccucucccccucccucauggaggacuacgagcuccgccagcucguccucgaggucaugcacaaccucauggaccgccacgacaaccgcgccaagcuccgcggcauccgcaucauccccgacgucgccgaccucaagaucaagcgcgagaagaucugccgccaggacaccuccuucaugaagaagaacggccagcagcucuaccgccacaucuaccucggcugcaaggaggaggacaacguccagaagaacuacgagcuccucuacaccucccucgcccucaucaccaucgagcucgccaacgaggaggucgucaucgaccucauccgccucgccaucgcccuccaggacuccgccaucaucaacgaggacaaccuccccauguuccaccgcugcggcaucauggcccucgucgccgccuaccucaacuucgucucccagaugaucgccguccccgccuucugccagcacgucuccaaggucaucgagauccgcaccauggaggcccccuacuuccuccccgagcacaucuuccgcgacaagugcaugcuccccaagucccucgagaagcacgagaaggaccucuacuuccucaccaacaagaucgccgagucccucggcggcuccggcuacuccgucgagcgccucuccguccccuacgucccccaggucaccgacgaggaccgccucucccgccgcaaguccaucgucgacaccgucuccauccaggucgacauccucuccaacaacguccccuccgacgacgucgucuccaacaccgaggagaucaccuucgaggcccucaagaaggccaucgacaccuccggcauggaggagcaggagaaggagaagcgccgccucgucaucgagaaguuccagaaggcccccuucgaggagaucgccgcccagugcgaguccaaggccaaccuccuccacgaccgccucgcccagauccucgagcucaccauccgccccccccccucccccuccggcacccucaccaucaccuccggccacgcccaguaccaguccguccccgucuacgagaugaaguuccccgaccucugcgucuacuga

SEQ ID NO: 42589 - RNA, 2454 nt, Artificial Sequence
  derived and/or modified sequence opt2 from EFR3B__Homo_sapiens__NP_055786
auguacggcgucugcggcugcugcggcgcccuccgcccccgcuacaagcgccucgucgacaacaucuuccccgaggaccccgaggacggccucgucaagaccaacauggagaagcucaccuucuacgcccucuccgcccccgagaagcucgaccgcaucggcgccuaccucuccgagcgccucauccgcgacgucggccgccaccgcuacggcuacgucugcaucgccauggaggcccucgaccagcuccucauggccugccacugccaguccaucaaccucuucgucgaguccuuccucaagauggucgccaagcuccucgaguccgagaagcccaaccuccagauccucggcaccaacuccuucgucaaguucgccaacaucgaggaggacacccccuccuaccaccgcuccuacgacuucuucgucucccgcuucuccgagaugugccacuccucccacgacgaccucgagaucaagaccaagauccgcauguccggcaucaagggccuccagggcgucguccgcaagaccgucaacgacgagcuccaggccaacaucugggacccccagcacauggacaagaucguccccucccuccucuucaaccuccagcacgucgaggaggccgagucccgcucccccuccccccuccaggcccccgagaaggagaaggagucccccgccgagcucgccgagcgcugccuccgcgagcuccucggccgcgccgccuucggcaacaucaagaacgccaucaagcccguccucauccaccucgacaaccacucccucugggagcccaaggucuucgccauccgcugcuucaagaucaucauguacuccauccagccccagcacucccaccucgucauccagcagcuccucggccaccucgacgccaacucccgcuccgccgccaccguccgcgccggcaucgucgagguccucuccgaggccgccgucaucgccgccaccggcuccgucggccccaccguccucgagauguucaacacccuccuccgccagcuccgccucuccaucgacuacgcccucaccggcuccuacgacggcgccgucucccucggcaccaagaucaucaaggagcacgaggagcgcauguuccaggaggccgucaucaagaccgucggcuccuucgccuccacccuccccaccuaccagcgcuccgaggucauccucuucaucauguccaaggucccccgccccucccuccaccaggccgucgacaccggccgcaccggcgagaaccgcaaccgccucacccagaucaugcuccucaagucccuccuccaggucuccaccggcuuccagugcaacaacaugauguccgcccuccccuccaacuuccucgaccgccuccucuccaccgcccucauggaggacgccgagauccgccucuucguccucgagauccucaucuccuucaucgaccgccacggcaaccgccacaaguucuccaccaucuccacccucuccgacaucuccguccucaagcucaaggucgacaagugcucccgccaggacaccgucuucaugaagaagcacucccagcagcucuaccgccacaucuaccucuccugcaaggaggagaccaacguccagaagcacuacgaggcccucuacggccuccucgcccucaucuccaucgagcucgccaacgaggaggucgucgucgaccucauccgccucguccucgccguccaggacgucgcccaggucaacgaggagaaccuccccgucuacaaccgcugcgcccucuacgcccucggcgccgccuaccucaaccucaucucccagcucaccaccguccccgccuucugccagcacauccacgaggucaucgagacccgcaagaaggaggcccccuacaugcuccccgaggacgucuucgucgagcgcccccgccucucccagaaccucgacggcgucgucaucgagcuccucuuccgccaguccaagaucuccgagguccucggcggcuccggcuacaacuccgaccgccucugccuccccuacaucccccagcucaccgacgaggaccgccucuccaagcgccgcuccaucggcgagaccaucucccuccaggucgaggucgagucccgcaacucccccgagaaggaggagcgcguccccgccgaggagaucaccuacgagacccucaagaaggccaucgucgacuccgucgccgucgaggagcaggagcgcgagcgccgccgccaggucgucgagaaguuccagaaggcccccuucgaggagaucgccgcccacugcggcgcccgcgccucccuccuccaguccaagcucaaccagaucuucgagaucaccauccgccccccccccucccccuccggcaccaucaccgccgccuacggccagccccagaaccacuccauccccgucuacgagaugaaguuccccgaccucugcgucuacuga

SEQ ID NO: 42590 - RNA, 1179 nt, Artificial Sequence
  derived and/or modified sequence opt2 from EFS__Homo_sapiens__NP_001264103
auggccaucgccaccuccgucuacgucguccccccccccgcccgccccugccccaccuccggcccccccgccggccccugcccccccucccccgaccucaucuacaagaucccccgcgccuccggcacccagcucgccgccccccgcgacgcccucgaggucuacgacgucccccccaccgcccuccgcguccccuccuccggccccuacgacugccccgccuccuucucccacccccucacccgcgucgccccccagccccccggcgaggacgacgccccccccucccccgagccccccggcgcccucgccucccacgaccaggacacccucgcccagcuccucgcccgcucccccccccccccccaccgcccccgccuccccuccgccgagucccucucccgccgcccccuccccgcccuccccguccccgaggcccccucccccucccccguccccucccccgcccccggccgcaagggcuccauccaggaccgcccccucccccccccccccccccgccuccccggcuacggcggccccaaggucgagggcgaccccgagggccgcgagauggaggacgaccccgccggccaccacaacgaguacgagggcauccccauggccgaggaguacgacuacguccaccucaagggcauggacaaggcccagggcucccgcccccccgaccaggccugcaccggcgaccccgagcuccccgagcgcggcaugcccgccccccaggaggcccucucccccggcgagccccucgucgucuccaccggcgaccuccagcuccucuacuucuacgccggccagugccagucccacuacuccgcccuccaggccgccgucgccgcccucauguccuccacccaggccaaccagcccccccgccucuucgucccccacuccaagcgcgucgucgucgccgcccaccgccucgucuucgucggcgacacccucggccgccucgccgccuccgccccccuccgcgcccagguccgcgccgccggcaccgcccucggccaggcccuccgcgccaccguccucgccgucaagggcgccgcccucggcuaccccuccucccccgccauccaggagaugguccagugcgucaccgagcucgccggccaggcccuccaguucaccacccuccucaccucccucgcccccuga

SEQ ID NO: 42591 - RNA, 3210 nt, Artificial Sequence
  derived and/or modified sequence opt2 from EFTUD1__Homo_sapiens__NP_001035700
augguccucaacucccucgacaagaugauccagcuccagaagaacaccgccaacauccgcaacaucugcguccucgcccacgucgaccacggcaacgaggaguaccucaucaaccucaucgacucccccggccacgucgacuucuccuccgaggucuccaccgccguccgcaucugcgacggcugcaucaucgucgucgacgccgucgagggcgucugcccccagacccaggccguccuccgccaggccuggcucgagaacauccgccccguccucgucaucaacaagaucgaccgccucaucgucgagcucaaguucaccccccaggaggccuacucccaccucaagaacauccucgagcagaucaacgcccucaccggcacccucuucaccuccaagguccucgaggagcgcgccgagcgcgagaccgagucccaggucaaccccaacuccgagcagggcgagcaggucuacgacugguccaccggccucgaggacaccgacgacucccaccucuacuucucccccgagcagggcaacgucgucuucaccuccgccaucgacggcuggggcuucggcaucgagcacuucgcccgcaucuacucccagaagaucggcaucaagaaggagguccucaugaagacccucuggggcgacuacuacaucaacaugaaggccaagaagaucaugaagggcgaccaggccaagggcaagaagccccucuucguccagcucauccucgagaacaucuggucccucuacgacgccguccucaagaaggacaaggacaagaucgacaagaucgucaccucccucggccucaagaucggcgcccgcgaggcccgccacuccgaccccaagguccagaucaacgccaucugcucccaguggcuccccaucucccacgccguccucgccauggucugccagaagcuccccuccccccucgacaucaccgccgagcgcgucgagcgccucaugugcaccggcucccagaccuucgacuccuucccccccgagacccaggcccucaaggccgccuucaugaagugcggcuccgaggacaccgcccccgucaucaucuucgucuccaagauguucgccgucgacgccaaggcccucccccagaacaagccccgcccccucacccaggaggagaucgcccagcgccgcgagcgcgcccgccagcgccacgccgagaagcucgccgccgcccagggccaggccccccucgagcccacccaggacggcuccgccaucgagaccugccccaagggcgaggagccccgcggcgacgagcagcaggucgaguccaugacccccaagcccguccuccaggaggagaacaaccaggaguccuucaucgccuucgcccgcgucuucuccggcgucgcccgccgcggcaagaagaucuucguccucggccccaaguacuccccccucgaguuccuccgccgcgucccccucggcuucuccgccccccccgacggccucccccaggucccccacauggccuacugcgcccucgagaaccucuaccuccucaugggccgcgagcucgaguaccucgaggaggucccccccggcaacguccucggcaucggcggccuccaggacuucguccucaaguccgccacccucugcucccuccccuccugcccccccuucaucccccucaacuucgaggccacccccaucguccgcgucgccgucgagcccaagcaccccuccgagaugccccagcucgucaagggcaugaagcuccucaaccaggccgaccccugcguccagauccucauccaggagaccggcgagcacguccucgucaccgccggcgagguccaccuccagcgcugccucgacgaccucaaggagcgcuucgccaagauccacaucuccgucuccgagcccaucauccccuuccgcgagaccaucaccaagccccccaaggucgacauggucaacgaggagaucggcaagcagcagaaggucgccgucauccaccagaugaaggaggaccaguccaagauccccgagggcauccaggucgacuccgacggccucaucaccaucaccacccccaacaagcucgccacccucuccguccgcgccaugccccuccccgaggaggucacccagauccucgaggagaacuccgaccucauccgcuccauggagcagcucaccuccucccucaacgagggcgagaacacccacaugauccaccagaagacccaggagaagaucugggaguucaagggcaagcucgagcagcaccucaccggccgccgcuggcgcaacaucgucgaccagaucugguccuucggcccccgcaagugcggccccaacauccucgucaacaaguccgaggacuuccagaacuccgucuggaccggccccgccgacaaggccuccaaggaggccucccgcuaccgcgaccucggcaacuccaucgucuccggcuuccagcucgccacccucuccggccccaugugcgaggagccccucaugggcgucugcuucguccucgagaagugggaccucuccaaguucgaggagcagggcgccuccgaccucgccaaggagggccaggaggagaacgagaccugcuccggcggcaacgagaaccaggagcuccaggacggcugcuccgaggccuucgagaagcgcaccucccagaagggcgaguccccccucaccgacugcuacggccccuucuccggccagcucaucgccaccaugaaggaggccugccgcuacgcccuccaggucaagccccagcgccucauggccgccauguacaccugcgacaucauggccaccggcgacguccucggccgcgucuacgccguccucuccaagcgcgagggccgcguccuccaggaggagaugaaggagggcaccgacauguucaucaucaaggccguccuccccgucgccgaguccuucggcuucgccgacgagauccgcaagcgcaccuccggccucgccuccccccagcucgucuucucccacugggagaucauccccuccgaccccuucuggguccccaccaccgaggaggaguaccuccacuucggcgagaaggccgacuccgagaaccaggcccgcaaguacaugaacgccguccgcaagcgcaagggccucuacgucgaggagaagaucgucgagcacgccgagaagcagcgcacccucuccaagaacaaguga

SEQ ID NO: 42592 - RNA, 2814 nt, Artificial Sequence
  derived and/or modified sequence opt2 from EFTUD2__Homo_sapiens__NP_001136077
auggacgacgacgacgacgacgacgacgucggcgaccacgacgacgaccaccccggcauggaggucguccuccacgaggacaagaaguacuaccccaccgccgaggaggucuacggccccgaggucgagaccaucguccaggaggaggacacccagccccucaccgagcccaucaucaagcccgucaagaccaagaaguucacccucauggagcagacccuccccgucaccgucuacgagauggacuuccucgccgaccucauggacaacuccgagcucauccgcaacgucacccucugcggccaccuccaccacggcaagaccugcuucgucgacugccucaucgagcagacccaccccgagauccgcaagcgcuacgaccaggaccucugcuacaccgacauccucuucaccgagcaggagcgcggcgucggcaucaaguccacccccgucaccgucguccuccccgacaccaagggcaaguccuaccucuucaacaucauggacacccccggccacgucaacuucuccgacgaggucaccgccggccuccgcaucuccgacggcgucguccucuucaucgacgccgccgagggcgucaugcucaacaccgagcgccucaucaagcacgccguccaggagcgccucgccgucaccgucugcaucaacaagaucgaccgccucauccucgagcucaagcucccccccaccgacgccuacuacaagcuccgccacaucgucgacgaggucaacggccucaucuccauguacuccaccgacgagaaccucauccucuccccccuccucggcaacgucugcuucuccuccucccaguacuccaucugcuucacccucggcuccuucgccaagaucuacgccgacaccuucggcgacaucaacuaccaggaguucgccaagcgccucuggggcgacaucuacuucaaccccaagacccgcaaguucaccaagaaggcccccaccuccuccucccagcgcuccuucgucgaguucauccucgagccccucuacaagauccucgcccaggucgucggcgacgucgacaccucccucccccgcacccucgacgagcucggcauccaccucaccaaggaggagcucaagcucaacauccgcccccuccuccgccucgucugcaagaaguucuucggcgaguucaccggcuucgucgacaugugcguccagcacauccccucccccaaggucggcgccaagcccaagaucgagcacaccuacaccggcggcgucgacuccgaccucggcgaggccauguccgacugcgaccccgacggcccccucaugugccacaccaccaagauguacuccaccgacgacggcguccaguuccacgccuucggccgcguccucuccggcaccauccacgccggccagcccgucaagguccucggcgagaacuacacccucgaggacgaggaggacucccagaucugcaccgucggccgccucuggaucuccgucgcccgcuaccacaucgaggucaaccgcguccccgccggcaacuggguccucaucgagggcgucgaccagcccaucgucaagaccgccaccaucaccgagccccgcggcaacgaggaggcccagaucuuccgcccccucaaguucaacaccaccuccgucaucaagaucgccgucgagcccgucaaccccuccgagcuccccaagaugcucgacggccuccgcaaggucaacaaguccuaccccucccucaccaccaaggucgaggaguccggcgagcacgucauccucggcaccggcgagcucuaccucgacugcgucaugcacgaccuccgcaagauguacuccgagaucgacaucaaggucgccgaccccgucgucaccuucugcgagaccgucgucgagaccuccucccucaagugcuucgccgagacccccaacaagaagaacaagaucaccaugaucgccgagccccucgagaagggccucgccgaggacaucgagaacgaggucguccagaucaccuggaaccgcaagaagcucggcgaguucuuccagaccaaguacgacugggaccuccucgccgcccgcuccaucugggccuucggccccgacgccaccggccccaacauccucgucgacgacacccuccccuccgaggucgacaaggcccuccucggcuccgucaaggacuccaucguccagggcuuccaguggggcacccgcgagggcccccucugcgacgagcucauccgcaacgucaaguucaagauccucgacgccgucgucgcccaggagccccuccaccgcggcggcggccagaucauccccaccgcccgccgcgucgucuacuccgccuuccucauggccaccccccgccucauggagcccuacuacuucgucgagguccaggcccccgccgacugcgucuccgccgucuacaccguccucgcccgccgccgcggccacgucacccaggacgcccccauccccggcuccccccucuacaccaucaaggccuucauccccgccaucgacuccuucggcuucgagaccgaccuccgcacccacacccagggccaggccuucucccucuccgucuuccaccacuggcagaucguccccggcgacccccucgacaaguccaucgucauccgcccccucgagccccagcccgccccccaccucgcccgcgaguucaugaucaagacccgccgccgcaagggccucuccgaggacgucuccaucuccaaguucuucgacgaccccaugcuccucgagcucgccaagcaggacgucguccucaacuaccccauguga

SEQ ID NO: 42593 - RNA, 3501 nt, Artificial Sequence
  derived and/or modified sequence opt2 from EGF__Homo_sapiens__NP_001171601
augcuccucacccucaucauccuccuccccgucgucuccaaguucuccuucgucucccucuccgccccccagcacugguccugccccgagggcacccucgccggcaacggcaacuccaccugcgucggccccgcccccuuccucaucuucucccacggcaacuccaucuuccgcaucgacaccgagggcaccaacuacgagcagcucgucgucgacgccggcgucuccgucaucauggacuuccacuacaacgagaagcgcaucuacugggucgaccucgagcgccagcuccuccagcgcgucuuccucaacggcucccgccaggagcgcgucugcaacaucgagaagaacgucuccggcauggccaucaacuggaucaacgaggaggucaucugguccaaccagcaggagggcaucaucaccgucaccgacaugaagggcaacaacucccacauccuccucuccgcccucaaguaccccgccaacgucgccgucgaccccgucgagcgcuucaucuucugguccuccgaggucgccggcucccucuaccgcgccgaccucgacggcgucggcgucaaggcccuccucgagaccuccgagaagaucaccgccgucucccucgacguccucgacaagcgccucuucuggauccaguacaaccgcgagggcuccaacucccucaucugcuccugcgacuacgacggcggcuccguccacaucuccaagcaccccacccagcacaaccucuucgccaugucccucuucggcgaccgcaucuucuacuccaccuggaagaugaagaccaucuggaucgccaacaagcacaccggcaaggacaugguccgcaucaaccuccacuccuccuucgucccccucggcgagcucaaggucguccacccccucgcccagcccaaggccgaggacgacaccugggagcccgagcagaagcucugcaagcuccgcaagggcaacugcuccuccaccgucugcggccaggaccuccagucccaccucugcaugugcgccgagggcuacgcccucucccgcgaccgcaaguacugcgaggacgucaacgagugcgccuucuggaaccacggcugcacccucggcugcaagaacacccccggcuccuacuacugcaccugccccgucggcuucguccuccuccccgacggcaagcgcugccaccagcucgucuccugcccccgcaacgucuccgagugcucccacgacugcguccucaccuccgagggcccccucugcuucugccccgagggcuccguccucgagcgcgacggcaagaccugcuccggcugcuccucccccgacaacggcggcugcucccagcucugcgucccccucucccccgucuccugggagugcgacugcuuccccggcuacgaccuccagcucgacgagaaguccugcgccgccuccggcccccagcccuuccuccucuucgccaacucccaggacauccgccacaugcacuucgacggcaccgacuacggcacccuccucucccagcagaugggcauggucuacgcccucgaccacgaccccgucgagaacaagaucuacuucgcccacaccgcccucaaguggaucgagcgcgccaacauggacggcucccagcgcgagcgccucaucgaggagggcgucgacguccccgagggccucgccgucgacuggaucggccgccgcuucuacuggaccgaccgcggcaagucccucaucggccgcuccgaccucaacggcaagcgcuccaagaucaucaccaaggagaacaucucccagccccgcggcaucgccguccaccccauggccaagcgccucuucuggaccgacaccggcaucaacccccgcaucgaguccuccucccuccagggccucggccgccucgucaucgccuccuccgaccucaucuggcccuccggcaucaccaucgacuuccucaccgacaagcucuacuggugcgacgccaagcaguccgucaucgagauggccaaccucgacggcuccaagcgccgccgccucacccagaacgacgucggccaccccuucgccgucgccgucuucgaggacuacgucugguucuccgacugggccaugcccuccgucaugcgcgucaacaagcgcaccggcaaggaccgcguccgccuccagggcuccaugcucaagcccuccucccucgucgucguccacccccucgccaagcccggcgccgaccccugccucuaccagaacggcggcugcgagcacaucugcaagaagcgccucggcaccgccuggugcuccugccgcgagggcuucaugaaggccuccgacggcaagaccugccucgcccucgacggccaccagcuccucgccggcggcgaggucgaccucaagaaccaggucaccccccucgacauccucuccaagacccgcgucuccgaggacaacaucaccgagucccagcacaugcucgucgccgagaucauggucuccgaccaggacgacugcgcccccgucggcugcuccauguacgcccgcugcaucuccgagggcgaggacgccaccugccagugccucaagggcuucgccggcgacggcaagcucugcuccgacaucgacgagugcgagaugggcguccccgucugcccccccgccuccuccaagugcaucaacaccgagggcggcuacgucugccgcugcuccgagggcuaccagggcgacggcauccacugccucgacuccaccccccccccccaccuccgcgaggacgaccaccacuacuccguccgcaacuccgacuccgagugcccccucucccacgacggcuacugccuccacgacggcgucugcauguacaucgaggcccucgacaaguacgccugcaacugcgucgucggcuacaucggcgagcgcugccaguaccgcgaccucaaguggugggagcuccgccacgccggccacggccagcagcagaaggucaucgucgucgccgucugcgucgucguccucgucaugcuccuccuccucucccucuggggcgcccacuacuaccgcacccagaagcuccucuccaagaaccccaagaaccccuacgaggaguccucccgcgacguccgcucccgccgccccgccgacaccgaggacggcauguccuccugcccccagcccugguucgucgucaucaaggagcaccaggaccucaagaacggcggccagcccgucgccggcgaggacggccaggccgccgacggcuccaugcagcccaccuccuggcgccaggagccccagcucugcggcaugggcaccgagcagggcugcuggauccccgucuccuccgacaagggcuccugcccccaggucauggagcgcuccuuccacaugcccuccuacggcacccagacccucgagggcggcgucgagaagccccacucccuccucuccgccaacccccucuggcagcagcgcgcccucgaccccccccaccagauggagcucacccaguga

SEQ ID NO: 42594 - RNA, 1665 nt, Artificial Sequence
  derived and/or modified sequence opt2 from EGFL6__Homo_sapiens__NP_001161362
augccccuccccuggucccucgcccucccccuccuccucuccugggucgccggcggcuucggcaacgccgccuccgcccgccaccacggccuccucgccuccgcccgccagcccggcgucugccacuacggcaccaagcucgccugcugcuacggcuggcgccgcaacuccaagggcgucugcgaggccaccugcgagcccggcugcaaguucggcgagugcgucggccccaacaagugccgcugcuuccccggcuacaccggcaagaccugcucccaggacgucaacgagugcggcaugaagccccgccccugccagcaccgcugcgucaacacccacggcuccuacaagugcuucugccucuccggccacaugcucaugcccgacgccaccugcgucaacucccgcaccugcgccaugaucaacugccaguacuccugcgaggacaccgaggagggcccccagugccucugccccuccuccggccuccgccucgcccccaacggccgcgacugccucgacaucgacgagugcgccuccggcaaggucaucugccccuacaaccgccgcugcgucaacaccuucggcuccuacuacugcaagugccacaucggcuucgagcuccaguacaucuccggccgcuacgacugcaucgacaucaacgagugcaccauggacucccacaccugcucccaccacgccaacugcuucaacacccagggcuccuucaagugcaagugcaagcagggcuacaagggcaacggccuccgcugcuccgccauccccgagaacuccgucaaggagguccuccgcgcccccggcaccaucaaggaccgcaucaagaagcuccucgcccacaagaacuccaugaagaagaaggccaagaucaagaacgucacccccgagcccacccgcacccccacccccaaggucaaccuccagcccuucaacuacgaggagaucgucucccgcggcggcaacucccacggcggcaagaagggcaacgaggagaagaugaaggagggccucgaggacgagaagcgcgaggagaaggcccucaagaacgacaucgaggagcgcucccuccgcggcgacgucuucuuccccaaggucaacgaggccggcgaguucggccucauccucguccagcgcaaggcccucaccuccaagcucgagcacaaggccgaccucaacaucuccgucgacugcuccuucaaccacggcaucugcgacuggaagcaggaccgcgaggacgacuucgacuggaaccccgccgaccgcgacaacgccaucggcuucuacauggccguccccgcccucgccggccacaagaaggacaucggccgccucaagcuccuccuccccgaccuccagccccaguccaacuucugccuccucuucgacuaccgccucgccggcgacaaggucggcaagcuccgcgucuucgucaagaacuccaacaacgcccucgccugggagaagaccaccuccgaggacgagaaguggaagaccggcaagauccagcucuaccagggcaccgacgccaccaaguccaucaucuucgaggccgagcgcggcaagggcaagaccggcgagaucgccgucgacggcguccuccucgucuccggccucugccccgacucccuccucuccgucgacgacuga

SEQ ID NO: 42595 - RNA, 822 nt, Artificial Sequence
  derived and/or modified sequence opt2 from EGFL7__Homo_sapiens__XP_011517068
augcgcggcucccaggagguccuccucauguggcuccucguccucgccgucggcggcaccgagcacgccuaccgccccggccgccgcgucugcgccguccgcgcccacggcgaccccgucuccgaguccuucguccagcgcgucuaccagcccuuccucaccaccugcgacggccaccgcgccugcuccaccuaccgcaccaucuaccgcaccgccuaccgccgcucccccggccucgcccccgcccgcccccgcuacgccugcugccccggcuggaagcgcaccuccggccuccccggcgccugcggcgccgccaucugccagccccccugccgcaacggcggcuccugcguccagcccggccgcugccgcugccccgccggcuggcgcggcgacaccugccaguccgacgucgacgagugcuccgcccgccgcggcggcugcccccagcgcugcgucaacaccgccggcuccuacuggugccagugcugggagggccacucccucuccgccgacggcacccucugcguccccaagggcggccccccccgcgucgcccccaaccccaccggcgucgacuccgccaugaaggaggagguccagcgccuccagucccgcgucgaccuccucgaggagaagcuccagcucguccucgccccccuccacucccucgccucccaggcccucgagcacggccuccccgaccccggcucccuccucguccacuccuuccagcagcucggccgcaucgacucccucuccgagcagaucuccuuccucgaggagcagcucggcuccugcuccugcaagaaggacuccuga

SEQ ID NO: 42596 - RNA, 882 nt, Artificial Sequence
  derived and/or modified sequence opt2 from EGFL8__Homo_sapiens__NP_085155
augggcucccgcgccgagcucugcacccuccucggcggcuucuccuuccuccuccuccucauccccggcgagggcgccaagggcggcucccuccgcgagucccagggcgucugcuccaagcagacccucgucgucccccuccacuacaacgaguccuacucccagcccgucuacaagcccuaccucacccucugcgccggccgccgcaucugcuccaccuaccgcaccauguaccgcgucauguggcgcgagguccgccgcgagguccagcagacccacgccgucugcugccagggcuggaagaagcgccaccccggcgcccucaccugcgaggccaucugcgccaagcccugccucaacggcggcgucugcguccgccccgaccagugcgagugcgcccccggcuggggcggcaagcacugccacgucgacgucgacgagugccgcaccuccaucacccucugcucccaccacugcuucaacaccgccggcuccuucaccugcggcugcccccacgaccucguccucggcgucgacggccgcaccugcauggagggcucccccgagccccccaccuccgccuccauccucuccgucgccguccgcgaggccgagaaggacgagcgcgcccucaagcaggagauccacgagcuccgcggccgccucgagcgccucgagcagugggccggccaggccggcgccuggguccgcgccguccuccccgucccccccgaggagcuccagcccgagcaggucgccgagcucuggggccgcggcgaccgcaucgagucccucuccgaccagguccuccuccucgaggagcgccucggcgccugcuccugcgaggacaacucccucggccucggcgucaaccaccgcuga

SEQ ID NO: 42597 - RNA, 3054 nt, Artificial Sequence
  derived and/or modified sequence opt2 from EGFLAM__Homo_sapiens__NP_001192230
auggaccucauccgcggcguccuccuccgccuccuccuccucgccuccucccucggccccggcgccgucucccuccgcgccgccauccgcaagcccggcaaggucggccccccccucgacaucaagcucggcgcccucaacugcaccgccuucuccauccaguggaagaugccccgccaccccggcucccccauccucggcuacaccgucuucuacuccgaggucggcgccgacaagucccuccaggagcagcuccacuccgucccccucucccgcgacauccccaccaccgaggaggucaucggcgaccucaagcccggcaccgaguaccgcgucuccaucgccgccuacucccaggccggcaagggccgccucuccuccccccgccacgucaccacccucucccaggacuccugccucccccccgccgccccccagcagccccacgucaucgucgucuccgacuccgaggucgcccucuccuggaagcccggcgccuccgagggcuccgcccccauccaguacuacuccgucgaguucauccgccccgacuucgacaagaaguggaccuccauccacgagcgcauccagauggacuccauggucaucaagggccucgaccccgacaccaacuaccaguucgccguccgcgccaugaacucccacggccccuccccccgcuccuggcccuccgacaucauccgcacccucugccccgaggaggccggcuccggccgcuacggcccccgcuacaucaccgacaugggcgccggcgaggacgacgagggcuucgaggacgaccucgaccucgacaucuccuucgaggaggucaagccccuccccgccaccaagggcggcaacaagaaguuccucgucgaguccaagaagauguccaucuccaaccccaagaccaucucccgccucaucccccccaccuccgccucccuccccgucaccaccgucgccccccagcccauccccauccagcgcaagggcaagaacggcgucgccaucaugucccgccucuucgacaugcccugcgacgagacccucugcuccgccgacuccuucugcgucaacgacuacaccuggggcggcucccgcugccagugcacccucggcaagggcggcgaguccugcuccgaggacaucgucauccaguacccccaguucuucggccacuccuacgucaccuucgagccccucaagaacuccuaccaggccuuccagaucacccucgaguuccgcgccgaggccgaggacggccuccuccucuacugcggcgagaacgagcacggccgcggcgacuucaugucccucgccaucauccgccgcucccuccaguuccgcuucaacugcggcaccggcgucgccaucaucgucuccgagaccaagaucaagcucggcggcuggcacaccgucaugcucuaccgcgacggccucaacggccuccuccagcucaacaacggcacccccgucaccggccagucccagggccaguacuccaagaucaccuuccgcaccccccucuaccucggcggcgcccccuccgccuacuggcucguccgcgccaccggcaccaaccgcggcuuccagggcugcguccagucccucgccgucaacggccgccgcaucgacaugcgccccuggccccucggcaaggcccucuccggcgccgacgucggcgagugcuccuccggcaucugcgacgaggccuccugcauccacggcggcaccugcaccgccaucaaggccgacuccuacaucugccucugcccccucggcuucaagggccgccacugcgaggacgccuucacccucaccaucccccaguuccgcgagucccuccgcuccuacgccgccacccccuggccccucgagccccagcacuaccucuccuucauggaguucgagaucaccuuccgccccgacuccggcgacggcguccuccucuacuccuacgacaccggcuccaaggacuuccucuccaucaaccucgccggcggccacgucgaguuccgcuucgacugcggcuccggcaccggcguccuccgcuccgaggacccccucacccucggcaacuggcacgagcuccgcgucucccgcaccgccaagaacggcauccuccaggucgacaagcagaagaucgucgagggcauggccgagggcggcuucacccagaucaagugcaacaccgacaucuucaucggcggcguccccaacuacgacgacgucaagaagaacuccggcguccucaagcccuucuccggcuccauccagaagaucauccucaacgaccgcaccauccacgucaagcacgacuucaccuccggcgucaacgucgagaacgccgcccaccccugcguccgcgcccccugcgcccacggcggcuccugccgcccccgcaaggagggcuacgacugcgacugcccccucggcuucgagggccuccacugccagaaggagugcggcaacuacugccucaacaccaucaucgaggccaucgagaucccccaguucaucggccgcuccuaccucaccuacgacaaccccgacauccucaagcgcgucuccggcucccgcuccaacgucuucaugcgcuucaagaccaccgccaaggacggccuccuccucuggcgcggcgacucccccaugcgccccaacuccgacuucaucucccucggccuccgcgacggcgcccucgucuucuccuacaaccucggcuccggcgucgccuccaucauggucaacggcuccuucaacgacggccgcuggcaccgcgucaaggccguccgcgacggccaguccggcaagaucaccgucgacgacuacggcgcccgcaccggcaagucccccggcaugaugcgccagcucaacaucaacggcgcccucuacgucggcggcaugaaggagaucgcccuccacaccaaccgccaguacaugcgcggccucgucggcugcaucucccacuucacccucuccaccgacuaccacaucucccucgucgaggacgccgucgacggcaagaacaucaacaccugcggcgccaaguga

SEQ ID NO: 42598 - RNA, 3633 nt, Artificial Sequence
  derived and/or modified sequence opt2 from EGFR__Homo_sapiens__NP_005219
augcgccccuccggcaccgccggcgccgcccuccucgcccuccucgccgcccucugccccgccucccgcgcccucgaggagaagaaggucugccagggcaccuccaacaagcucacccagcucggcaccuucgaggaccacuuccucucccuccagcgcauguucaacaacugcgaggucguccucggcaaccucgagaucaccuacguccagcgcaacuacgaccucuccuuccucaagaccauccaggaggucgccggcuacguccucaucgcccucaacaccgucgagcgcaucccccucgagaaccuccagaucauccgcggcaacauguacuacgagaacuccuacgcccucgccguccucuccaacuacgacgccaacaagaccggccucaaggagcuccccaugcgcaaccuccaggagauccuccacggcgccguccgcuucuccaacaaccccgcccucugcaacgucgaguccauccaguggcgcgacaucgucuccuccgacuuccucuccaacauguccauggacuuccagaaccaccucggcuccugccagaagugcgaccccuccugccccaacggcuccugcuggggcgccggcgaggagaacugccagaagcucaccaagaucaucugcgcccagcagugcuccggccgcugccgcggcaagucccccuccgacugcugccacaaccagugcgccgccggcugcaccggcccccgcgaguccgacugccucgucugccgcaaguuccgcgacgaggccaccugcaaggacaccugccccccccucaugcucuacaaccccaccaccuaccagauggacgucaaccccgagggcaaguacuccuucggcgccaccugcgucaagaagugcccccgcaacuacgucgucaccgaccacggcuccugcguccgcgccugcggcgccgacuccuacgagauggaggaggacggcguccgcaagugcaagaagugcgagggccccugccgcaaggucugcaacggcaucggcaucggcgaguucaaggacucccucuccaucaacgccaccaacaucaagcacuucaagaacugcaccuccaucuccggcgaccuccacauccuccccgucgccuuccgcggcgacuccuucacccacacccccccccucgacccccaggagcucgacauccucaagaccgucaaggagaucaccggcuuccuccucauccaggccuggcccgagaaccgcaccgaccuccacgccuucgagaaccucgagaucauccgcggccgcaccaagcagcacggccaguucucccucgccgucgucucccucaacaucaccucccucggccuccgcucccucaaggagaucuccgacggcgacgucaucaucuccggcaacaagaaccucugcuacgccaacaccaucaacuggaagaagcucuucggcaccuccggccagaagaccaagaucaucuccaaccgcggcgagaacuccugcaaggccaccggccaggucugccacgcccucugcucccccgagggcugcuggggccccgagccccgcgacugcgucuccugccgcaacgucucccgcggccgcgagugcgucgacaagugcaaccuccucgagggcgagccccgcgaguucgucgagaacuccgagugcauccagugccaccccgagugccucccccaggccaugaacaucaccugcaccggccgcggccccgacaacugcauccagugcgcccacuacaucgacggcccccacugcgucaagaccugccccgccggcgucaugggcgagaacaacacccucgucuggaaguacgccgacgccggccacgucugccaccucugccaccccaacugcaccuacggcugcaccggccccggccucgagggcugccccaccaacggccccaagauccccuccaucgccaccggcauggucggcgcccuccuccuccuccucgucgucgcccucggcaucggccucuucaugcgccgccgccacaucguccgcaagcgcacccuccgccgccuccuccaggagcgcgagcucgucgagccccucacccccuccggcgaggcccccaaccaggcccuccuccgcauccucaaggagaccgaguucaagaagaucaagguccucggcuccggcgccuucggcaccgucuacaagggccucuggauccccgagggcgagaaggucaagauccccgucgccaucaaggagcuccgcgaggccaccucccccaaggccaacaaggagauccucgacgaggccuacgucauggccuccgucgacaacccccacgucugccgccuccucggcaucugccucaccuccaccguccagcucaucacccagcucaugcccuucggcugccuccucgacuacguccgcgagcacaaggacaacaucggcucccaguaccuccucaacuggugcguccagaucgccaagggcaugaacuaccucgaggaccgccgccucguccaccgcgaccucgccgcccgcaacguccucgucaagaccccccagcacgucaagaucaccgacuucggccucgccaagcuccucggcgccgaggagaaggaguaccacgccgagggcggcaagguccccaucaaguggauggcccucgaguccauccuccaccgcaucuacacccaccaguccgacgucugguccuacggcgucaccgucugggagcucaugaccuucggcuccaagcccuacgacggcauccccgccuccgagaucuccuccauccucgagaagggcgagcgccucccccagccccccaucugcaccaucgacgucuacaugaucauggucaagugcuggaugaucgacgccgacucccgccccaaguuccgcgagcucaucaucgaguucuccaagauggcccgcgacccccagcgcuaccucgucauccagggcgacgagcgcaugcaccuccccucccccaccgacuccaacuucuaccgcgcccucauggacgaggaggacauggacgacgucgucgacgccgacgaguaccucaucccccagcagggcuucuucuccucccccuccaccucccgcaccccccuccucuccucccucuccgccaccuccaacaacuccaccgucgccugcaucgaccgcaacggccuccaguccugccccaucaaggaggacuccuuccuccagcgcuacuccuccgaccccaccggcgcccucaccgaggacuccaucgacgacaccuuccuccccguccccgaguacaucaaccaguccguccccaagcgccccgccggcuccguccagaaccccgucuaccacaaccagccccucaaccccgcccccucccgcgacccccacuaccaggacccccacuccaccgccgucggcaaccccgaguaccucaacaccguccagcccaccugcgucaacuccaccuucgacucccccgcccacugggcccagaagggcucccaccagaucucccucgacaaccccgacuaccagcaggacuucuuccccaaggaggccaagcccaacggcaucuucaagggcuccaccgccgagaacgccgaguaccuccgcgucgccccccaguccuccgaguucaucggcgccuga

SEQ ID NO: 42599 - RNA, 1281 nt, Artificial Sequence
  derived and/or modified sequence opt2 from EGLN1__Homo_sapiens__NP_071334
auggccaacgacuccggcggccccggcggccccucccccuccgagcgcgaccgccaguacugcgagcucugcggcaagauggagaaccuccuccgcugcucccgcugccgcuccuccuucuacugcugcaaggagcaccagcgccaggacuggaagaagcacaagcucgucugccagggcuccgagggcgcccucggccacggcgucggcccccaccagcacuccggccccgccccccccgccgccgucccccccccccgcgccggcgcccgcgagccccgcaaggccgccgcccgccgcgacaacgccuccggcgacgccgccaagggcaaggucaaggccaagccccccgccgaccccgccgccgccgccucccccugccgcgccgccgccggcggccagggcuccgccgucgccgccgaggccgagcccggcaaggaggagccccccgcccgcuccucccucuuccaggagaaggccaaccucuacccccccuccaacacccccggcgacgcccucucccccggcggcggccuccgccccaacggccagaccaagccccuccccgcccucaagcucgcccucgaguacaucguccccugcaugaacaagcacggcaucugcgucgucgacgacuuccucggcaaggagaccggccagcagaucggcgacgagguccgcgcccuccacgacaccggcaaguucaccgacggccagcucgucucccagaaguccgacuccuccaaggacauccgcggcgacaagaucaccuggaucgagggcaaggagcccggcugcgagaccaucggccuccucauguccuccauggacgaccucauccgccacugcaacggcaagcucggcuccuacaagaucaacggccgcaccaaggccauggucgccugcuaccccggcaacggcaccggcuacguccgccacgucgacaaccccaacggcgacggccgcugcgucaccugcaucuacuaccucaacaaggacugggacgccaaggucuccggcggcauccuccgcaucuuccccgagggcaaggcccaguucgccgacaucgagcccaaguucgaccgccuccucuucuucugguccgaccgccgcaacccccacgagguccagcccgccuacgccacccgcuacgccaucaccgucugguacuucgacgccgacgagcgcgcccgcgccaaggucaaguaccucaccggcgagaagggcguccgcgucgagcucaacaagcccuccgacuccgucggcaaggacgucuucuga

SEQ ID NO: 42600 - RNA, 1224 nt, Artificial Sequence
  derived and/or modified sequence opt2 from EGLN2__Homo_sapiens__NP_444274
auggacucccccugccagccccagccccucucccaggcccucccccagcuccccggcuccuccuccgagccccucgagcccgagcccggccgcgcccgcaugggcgucgaguccuaccuccccugcccccuccuccccuccuaccacugccccggcguccccuccgaggccuccgccggcuccggcaccccccgcgccaccgccaccuccaccaccgccuccccccuccgcgacggcuucggcggccaggacggcggcgagcuccgcccccuccaguccgagggcgccgccgcccucgucaccaagggcugccagcgccucgccgcccagggcgcccgccccgaggcccccaagcgcaagugggccgaggacggcggcgacgcccccucccccuccaagcgccccugggcccgccaggagaaccaggaggccgagcgcgagggcggcauguccugcuccugcuccuccggcuccggcgaggccuccgccggccucauggaggaggcccuccccuccgcccccgagcgccucgcccucgacuacaucguccccugcaugcgcuacuacggcaucugcgucaaggacuccuuccucggcgccgcccucggcggccgcguccucgccgaggucgaggcccucaagcgcggcggccgccuccgcgacggccagcucgucucccagcgcgccauccccccccgcuccauccgcggcgaccagaucgccugggucgagggccacgagcccggcugccgcuccaucggcgcccucauggcccacgucgacgccgucauccgccacugcgccggccgccucggcuccuacgucaucaacggccgcaccaaggccauggucgccugcuaccccggcaacggccucggcuacguccgccacgucgacaacccccacggcgacggccgcugcaucaccugcaucuacuaccucaaccagaacugggacgucaagguccacggcggccuccuccagaucuuccccgagggccgccccgucgucgccaacaucgagccccucuucgaccgccuccucaucuucugguccgaccgccgcaacccccacgaggucaagcccgccuacgccacccgcuacgccaucaccgucugguacuucgacgccaaggagcgcgccgccgccaaggacaaguaccagcucgccuccggccagaagggcguccagguccccgucucccagccccccacccccaccuga

SEQ ID NO: 42601 - RNA, 720 nt, Artificial Sequence
  derived and/or modified sequence opt2 from EGLN3__Homo_sapiens__NP_071356
augccccucggccacaucaugcgccucgaccucgagaagaucgcccucgaguacaucguccccugccuccacgaggucggcuucugcuaccucgacaacuuccucggcgaggucgucggcgacugcguccucgagcgcgucaagcagcuccacugcaccggcgcccuccgcgacggccagcucgccggcccccgcgccggcgucuccaagcgccaccuccgcggcgaccagaucaccuggaucggcggcaacgaggagggcugcgaggccaucuccuuccuccucucccucaucgaccgccucguccucuacugcggcucccgccucggcaaguacuacgucaaggagcgcuccaaggccauggucgccugcuaccccggcaacggcaccggcuacguccgccacgucgacaaccccaacggcgacggccgcugcaucaccugcaucuacuaccucaacaagaacugggacgccaagcuccacggcggcauccuccgcaucuuccccgagggcaaguccuucaucgccgacgucgagcccaucuucgaccgccuccucuucuucugguccgaccgccgcaacccccacgagguccagcccuccuacgccacccgcuacgccaugaccgucugguacuucgacgccgaggagcgcgccgaggccaagaagaaguuccgcaaccucacccgcaagaccgaguccgcccucaccgaggacuga

SEQ ID NO: 42602 - RNA, 1632 nt, Artificial Sequence
  derived and/or modified sequence opt2 from EGR1__Homo_sapiens__NP_001955
auggccgccgccaaggccgagaugcagcucauguccccccuccagaucuccgaccccuucggcuccuucccccacucccccaccauggacaacuaccccaagcucgaggagaugaugcuccucuccaacggcgccccccaguuccucggcgccgccggcgcccccgagggcuccggcuccaacuccuccuccuccuccuccggcggcggcggcggcggcggcggcggcuccaacuccuccuccuccuccuccaccuucaacccccaggccgacaccggcgagcagcccuacgagcaccucaccgccgaguccuuccccgacaucucccucaacaacgagaagguccucgucgagaccuccuaccccucccagaccacccgccucccccccaucaccuacaccggccgcuucucccucgagcccgcccccaacuccggcaacacccucuggcccgagccccucuucucccucgucuccggccucgucuccaugaccaacccccccgccuccuccuccuccgcccccucccccgccgccuccuccgccuccgccucccagucccccccccucuccugcgccguccccuccaacgacuccucccccaucuacuccgccgcccccaccuuccccacccccaacaccgacaucuuccccgagccccagucccaggccuuccccggcuccgccggcaccgcccuccaguaccccccccccgccuaccccgccgccaagggcggcuuccagguccccaugauccccgacuaccucuucccccagcagcagggcgaccucggccucggcacccccgaccagaagcccuuccagggccucgagucccgcacccagcagcccucccucaccccccucuccaccaucaaggccuucgccacccaguccggcucccaggaccucaaggcccucaacaccuccuaccagucccagcucaucaagcccucccgcaugcgcaaguaccccaaccgccccuccaagacccccccccacgagcgccccuacgccugccccgucgaguccugcgaccgccgcuucucccgcuccgacgagcucacccgccacauccgcauccacaccggccagaagcccuuccagugccgcaucugcaugcgcaacuucucccgcuccgaccaccucaccacccacauccgcacccacaccggcgagaagcccuucgccugcgacaucugcggccgcaaguucgcccgcuccgacgagcgcaagcgccacaccaagauccaccuccgccagaaggacaagaaggccgacaaguccgucgucgccuccuccgccaccuccucccucuccuccuaccccucccccgucgccaccuccuaccccucccccgucaccaccuccuaccccucccccgccaccaccuccuaccccucccccguccccaccuccuucuccucccccggcuccuccaccuaccccucccccguccacuccggcuuccccucccccuccgucgccaccaccuacuccuccgucccccccgccuuccccgcccaggucuccuccuuccccuccuccgccgucaccaacuccuucuccgccuccaccggccucuccgacaugaccgccaccuucuccccccgcaccaucgagaucugcuga

SEQ ID NO: 42603 - RNA, 1431 nt, Artificial Sequence
  derived and/or modified sequence opt2 from EGR2__Homo_sapiens__NP_001129650
augaugaccgccaaggccgucgacaagauccccgucacccucuccggcuucguccaccagcucuccgacaacaucuaccccgucgaggaccucgccgccaccuccgucaccaucuuccccaacgccgagcucggcggccccuucgaccagaugaacggcgucgccggcgacggcaugaucaacaucgacaugaccggcgagaagcgcucccucgaccuccccuaccccuccuccuucgcccccgucuccgccccccgcaaccagaccuucaccuacaugggcaaguucuccaucgacccccaguaccccggcgccuccugcuaccccgagggcaucaucaacaucgucuccgccggcauccuccagggcgucaccucccccgccuccaccaccgccuccuccuccgucaccuccgccucccccaacccccucgccaccggcccccucggcgucugcaccaugucccagacccagcccgaccucgaccaccucuacucccccccccccccccccccccccuacuccggcugcgccggcgaccucuaccaggaccccuccgccuuccucuccgccgccaccaccuccaccuccuccucccucgccuacccccccccccccuccuaccccucccccaagcccgccaccgaccccggccucuuccccaugauccccgacuaccccggcuucuuccccucccagugccagcgcgaccuccacggcaccgccggccccgaccgcaagcccuuccccugcccccucgacacccuccgcgucccccccccccucaccccccucuccaccauccgcaacuucacccucggcggccccuccgccggcgucaccggccccggcgccuccggcggcuccgagggcccccgccuccccggcuccuccuccgccgccgccgccgccgccgccgccgccgccuacaacccccaccaccucccccuccgccccauccuccgcccccgcaaguaccccaaccgccccuccaagacccccguccacgagcgccccuaccccugccccgccgagggcugcgaccgccgcuucucccgcuccgacgagcucacccgccacauccgcauccacaccggccacaagcccuuccagugccgcaucugcaugcgcaacuucucccgcuccgaccaccucaccacccacauccgcacccacaccggcgagaagcccuucgccugcgacuacugcggccgcaaguucgcccgcuccgacgagcgcaagcgccacaccaagauccaccuccgccagaaggagcgcaaguccuccgcccccuccgccuccguccccgcccccuccaccgccuccugcuccggcggcguccagcccggcggcacccucugcuccuccaacuccuccucccucggcggcggcccccucgcccccugcuccucccgcacccgcacccccuga

SEQ ID NO: 42604 - RNA, 1002 nt, Artificial Sequence
  derived and/or modified sequence opt2 from EGR3__Homo_sapiens__NP_001186810
auggacaucggccucaccaacgagaagcccaaccccgagcucuccuacuccggcuccuuccagcccgcccccggcaacaagaccgucaccuaccucggcaaguucgccuucgacucccccuccaacuggugccaggacaacaucaucucccucauguccgccggcauccucggcgucccccccgccuccggcgcccucuccacccagaccuccaccgccuccaugguccagcccccccagggcgacgucgaggccauguaccccgcccucccccccuacuccaacugcggcgaccucuacuccgagcccgucuccuuccacgacccccagggcaaccccggccucgccuacuccccccaggacuaccaguccgccaagcccgcccucgacuccaaccucuuccccaugauccccgacuacaaccucuaccaccaccccaacgacaugggcuccauccccgagcacaagcccuuccagggcauggaccccauccgcgucaaccccccccccaucaccccccucgagaccaucaaggccuucaaggacaagcagauccaccccggcuucggcucccucccccagcccccccucacccucaagcccauccgcccccgcaaguaccccaaccgccccuccaagaccccccuccacgagcgcccccacgccugccccgccgagggcugcgaccgccgcuucucccgcuccgacgagcucacccgccaccuccgcauccacaccggccacaagcccuuccagugccgcaucugcaugcgcuccuucucccgcuccgaccaccucaccacccacauccgcacccacaccggcgagaagcccuucgccugcgaguucugcggccgcaaguucgcccgcuccgacgagcgcaagcgccacgccaagauccaccucaagcagaaggagaagaaggccgagaagggcggcgcccccuccgccuccuccgccccccccgucucccucgcccccgucgucaccaccugcgccuga

SEQ ID NO: 42605 - RNA, 1770 nt, Artificial Sequence
  derived and/or modified sequence opt2 from EGR4__Homo_sapiens__NP_001956
auggccgucgcccgcggcgucggcucccccgagcccgcccccccccagcucuacaaguggggcggcugcggccucggcgagcccggcuccgcccucgagcgccgcggcgccgccgcccgcggccgcugcggccgcgcccgcgccccccgccuccccgacuccuucccccgcggcgagugccccaagcccggcgcccgcgccccccgcuccguccgcugcggcgagccccucccccccgccucccccccccccgcccgcccccaggcccagcgcgcccgcccccgcgccccccacucccgccgccgcgccaugcuccaccucuccgaguucuccgagcccgacgcccuccucgucaaguccaccgagggcugcugcgccgagcccuccgccgagcucccccgccuccccgcccgcgacgcccccgccgccaccggcuaccccggcgccggcgacuuccucuccugggcccucaacuccugcggcgccuccggcgaccucgccgacuccugcuuccucgagggccccgcccccacccccccccccggccucuccuacuccggcuccuucuucauccaggccguccccgagcacccccacgaccccgaggcccucuucaaccucauguccggcauccucggccucgcccccuuccccggccccgaggccgccgccucccgcuccccccucgacgcccccuuccccgccggcuccgacgcccuccuccccggcccccccgaccucuacucccccgaccucggcgccgcccccuuccccgaggccuucugggaggccucccccugcgccggcgcccccucccagugccucuacgagccccagcucuccccccccgacgucaagcccggccuccgcgccccccccgccucccccgcccucgacgccgucuccgccuucaagggccccuacgcccccugggagcuccucuccgucggcgcccccggcaacugcggcucccagggcgacuaccaggccgcccccgaggcccgcuuccccgucaucggcaccaagaucgaggaccuccucuccaucuccugccccgccgagcuccccgccguccccgccaaccgccucuaccccuccggcgccuacgacgccuucccccucgcccccggcgaccucggcgagggcgccgagggccuccccggccuccucaccccccccuccggcgagggcggcuccuccggcgacggcggcgaguuccucgccuccacccagccccagcucuccccccucggccuccgcuccgccgccgccgccgacuuccccaagccccucgucgccgacauccccggcuccuccggcgucgccgccccccccguccccccccccccccccacccccuucccccaggccaaggcccgccgcaagggccgccgcggcggcaagugcuccacccgcugcuucugcccccgcccccacgccaaggccuucgccugccccgucgaguccugcguccgcuccuucgcccgcuccgacgagcucaaccgccaccuccgcauccacaccggccacaagcccuuccagugccgcaucugccuccgcaacuucucccgcuccgaccaccucaccacccacguccgcacccacaccggcgagaagcccuucgccugcgacgucugcggccgccgcuucgcccgcuccgacgagaagaagcgccacuccaagguccaccucaagcagaaggcccgcgccgaggagcgccucaagggccucggcuucuacucccucggccucuccuucgccucccucuga

SEQ ID NO: 42606 - RNA, 3483 nt, Artificial Sequence
  derived and/or modified sequence opt2 from EHBP1__Homo_sapiens__NP_001136087
auggccuccgucuggaagcgccuccagcgcgucggcaagcacgccuccaaguuccaguucgucgccuccuaccaggagcucauggucgagugcaccaagaaguggcagcccgacaagcucgucgucgucuggacccgccgcucccgccgcaaguccuccaaggcccacuccuggcagcccggcaucaagaaccccuaccgcggcgucgucgucuggcccguccccgagaacaucgagaucaccgucacccucuucaaggacccccacgccgaggaguucgaggacaaggaguggaccuucgucaucgagaacgagucccccuccggccgccgcaaggcccucgccaccuccuccaucaacaugaagcaguacgccucccccaugcccacccagaccgacgucaagcucaaguucaagccccucuccaagaaggucgucuccgccgcccuccaguucucccucuccugcaucuuccuccgcgagggcaaggccaccgacgaggacaugcagucccucgccucccucauguccaugaagcaggccgacaucggcaaccucgacgacuucgaggaggacaacgaggacgacgacgagaaccgcgucaaccaggaggagaaggccgccaagaucaccgagcucaucaacaagcucaacuuccucgacgaggccgagaaggaccucgccaccgucaacuccaaccccuucgacgaccccgacgccgccgagcucaaccccuucggcgaccccgacuccgaggagcccaucaccgagaccgccuccccccgcaagaccgaggacuccuucuacaacaacuccuacaaccccuucaaggagguccagaccccccaguaccucaaccccuucgacgagcccgaggccuucgucaccaucaaggacucccccccccaguccaccaagcgcaagaacauccgccccgucgacauguccaaguaccucuacgccgacuccuccaagaccgaggaggaggagcucgacgaguccaaccccuucuacgagcccaaguccacccccccccccaacaaccucgucaaccccguccaggagcucgagaccgagcgccgcgucaagcgcaaggcccccgccccccccguccucucccccaagaccggcguccucaacgagaacaccgucuccgccggcaaggaccucuccaccucccccaagcccucccccauccccucccccguccucggccgcaagcccaacgccucccagucccuccucgucuggugcaaggaggucaccaagaacuaccgcggcgucaagaucaccaacuucaccaccuccuggcgcaacggccucuccuucugcgccauccuccaccacuuccgccccgaccucaucgacuacaagucccucaacccccaggacaucaaggagaacaacaagaaggccuacgacggcuucgccuccaucggcaucucccgccuccucgagcccuccgacaugguccuccucgccauccccgacaagcucaccgucaugaccuaccucuaccagauccgcgcccacuucuccggccaggagcucaacgucguccagaucgaggagaacuccuccaaguccaccuacaaggucggcaacuacgagaccgacaccaacuccuccgucgaccaggagaaguucuacgccgagcucuccgaccucaagcgcgagcccgagcuccagcagcccaucuccggcgccgucgacuuccucucccaggacgacuccgucuucgucaacgacuccggcgucggcgaguccgaguccgagcaccagacccccgacgaccaccucucccccuccaccgccucccccuacugccgccgcaccaaguccgacaccgagccccagaagucccagcaguccuccggccgcaccuccggcuccgacgaccccggcaucugcuccaacaccgacuccacccaggcccagguccuccucggcaagaagcgccuccucaaggccgagacccucgagcucuccgaccucuacgucuccgacaagaagaaggacauguccccccccuucaucugcgaggagaccgacgagcagaagcuccagacccucgacaucggcuccaaccucgagaaggagaagcucgagaacucccgcucccucgagugccgcuccgaccccgagucccccaucaagaagaccucccucucccccaccuccaagcucggcuacuccuacucccgcgaccucgaccucgccaagaagaagcacgccucccuccgccagaccgaguccgaccccgacgccgaccgcaccacccucaaccacgccgaccacuccuccaagaucguccagcaccgccuccucucccgccaggaggagcucaaggagcgcgcccgcguccuccucgagcaggcccgccgcgacgccgcccucaaggccggcaacaagcacaacaccaacaccgccacccccuucugcaaccgccagcucuccgaccagcaggacgaggagcgccgccgccagcuccgcgagcgcgcccgccagcucaucgccgaggcccgcuccggcgucaagauguccgagcuccccuccuacggcgagauggccgccgagaagcucaaggagcgcuccaaggccuccggcgagcagaacuccaagcucgucgaccucaagcucaagaagcuccucgagguccagccccaggucgccaacucccccuccuccgccgcccagaaggccgucaccgaguccuccgagcaggacaugaaguccggcaccgaggaccuccgcaccgagcgccuccagaagaccaccgagcgcuuccgcaaccccgucgucuucuccaaggacuccaccguccgcaagacccagcuccaguccuucucccaguacaucgagaaccgccccgagaugaagcgccagcgcuccauccaggaggacaccaagaagggcaacgaggagaaggccgccaucaccgagacccagcgcaagcccuccgaggacgagguccucaacaagggcuucaaggacaccucccaguacgucgucggcgagcucgccgcccucgagaacgagcagaagcagaucgacacccgcgccgcccucgucgagaagcgccuccgcuaccucauggacaccggccgcaacaccgaggaggaggaggccaugaugcaggagugguucaugcucgucaacaagaagaacgcccucauccgccgcaugaaccagcucucccuccucgagaaggagcacgaccucgagcgccgcuacgagcuccucaaccgcgagcuccgcgccaugcucgccaucgaggacuggcagaagaccgaggcccagaagcgccgcgagcagcuccuccucgacgagcucgucgcccucgucaacaagcgcgacgcccucguccgcgaccucgacgcccaggagaagcaggccgaggaggaggacgagcaccucgagcgcacccucgagcagaacaagggcaagauggccaagaaggaggagaagugcguccuccaguga

SEQ ID NO: 42607 - RNA, 1647 nt, Artificial Sequence
  derived and/or modified sequence opt2 from EHD1__Homo_sapiens__NP_001269374
auggagcagcccggcaccgccgccucccccgucuccggcuccauguucuccugggucuccaaggacgcccgccgcaagaaggagcccgagcucuuccagaccgucgccgagggccuccgccagcucuacgcccagaagcuccucccccucgaggagcacuaccgcuuccacgaguuccacucccccgcccucgaggacgccgacuucgacaacaagcccaugguccuccucgucggccaguacuccaccggcaagaccaccuucauccgccaccucaucgagcaggacuuccccggcaugcgcaucggccccgagcccaccaccgacuccuucaucgccgucaugcacggccccaccgagggcgucguccccggcaacgcccucgucgucgacccccgccgccccuuccgcaagcucaacgccuucggcaacgccuuccucaaccgcuucaugugcgcccagcuccccaaccccguccucgacuccaucuccaucaucgacacccccggcauccucuccggcgagaagcagcgcaucucccgcggcuacgacuucgccgccguccucgagugguucgccgagcgcgucgaccgcaucauccuccucuucgacgcccacaagcucgacaucuccgacgaguucuccgaggucaucaaggcccucaagaaccacgaggacaagauccgcgucguccucaacaaggccgaccagaucgagacccagcagcucaugcgcgucuacggcgcccucauguggucccucggcaagaucaucaacacccccgaggucguccgcgucuacaucggcuccuucuggucccacccccuccucauccccgacaaccgcaagcucuucgaggccgaggagcaggaccucuucaaggacauccagucccucccccgcaacgccgcccuccgcaagcucaacgaccucaucaagcgcgcccgccucgccaagguccacgccuacaucaucuccucccucaagaaggagaugcccaacgucuucggcaaggaguccaagaagaaggagcucgucaacaaccucggcgagaucuaccagaagaucgagcgcgagcaccagaucucccccggcgacuuccccucccuccgcaagaugcaggagcuccuccagacccaggacuucuccaaguuccaggcccucaagcccaagcuccucgacaccgucgacgacaugcucgccaacgacaucgcccgccucauggucaugguccgccaggaggagucccucaugcccucccaggucgucaagggcggcgccuucgacggcaccaugaacggccccuucggccacggcuacggcgagggcgccggcgagggcaucgacgacgucgagugggucgucggcaaggacaagcccaccuacgacgagaucuucuacacccucucccccgucaacggcaagaucaccggcgccaacgccaagaaggagauggucaaguccaagcuccccaacaccguccucggcaagaucuggaagcucgccgacgucgacaaggacggccuccucgacgacgaggaguucgcccucgccaaccaccucaucaaggucaagcucgagggccacgagcuccccgccgaccuccccccccaccucgucccccccuccaagcgccgccacgaguga

SEQ ID NO: 42608 - RNA, 1632 nt, Artificial Sequence
  derived and/or modified sequence opt2 from EHD2__Homo_sapiens__NP_055416
auguucuccuggcucaagcgcggcggcgcccgcggccagcagcccgaggccauccgcaccgucaccuccgcccucaaggagcucuaccgcaccaagcuccucccccucgaggagcacuaccgcuucggcgccuuccacucccccgcccucgaggacgccgacuucgacggcaagcccaugguccucgucgccggccaguacuccaccggcaagaccuccuucauccaguaccuccucgagcaggagguccccggcucccgcgucggccccgagcccaccaccgacugcuucgucgccgucaugcacggcgacaccgagggcaccguccccggcaacgcccucgucgucgaccccgacaagcccuuccgcaagcucaaccccuucggcaacaccuuccucaaccgcuucaugugcgcccagcuccccaaccagguccucgaguccaucuccaucaucgacacccccggcauccucuccggcgccaagcagcgcgucucccgcggcuacgacuuccccgccguccuccgcugguucgccgagcgcgucgaccucaucauccuccucuucgacgcccacaagcucgagaucuccgacgaguucuccgaggccaucggcgcccuccgcggccacgaggacaagauccgcgucguccucaacaaggccgacauggucgagacccagcagcucaugcgcgucuacggcgcccucaugugggcccucggcaaggucgucggcacccccgagguccuccgcgucuacaucggcuccuucuggucccagccccuccucguccccgacaaccgccgccucuucgagcucgaggagcaggaccucuuccgcgacauccagggccucccccgccacgccgcccuccgcaagcucaacgaccucgucaagcgcgcccgccucguccgcguccacgccuacaucaucuccuaccucaagaaggagaugcccuccgucuucggcaaggagaacaagaagaagcagcucauccucaagcuccccgucaucuucgccaagauccagcucgagcaccacaucucccccggcgacuuccccgacugccagaagaugcaggagcuccucauggcccacgacuucaccaaguuccacucccucaagcccaagcuccucgaggcccucgacgagaugcucacccacgacaucgccaagcucaugccccuccuccgccaggaggagcucgaguccaccgaggucggcguccagggcggcgccuucgagggcacccacaugggccccuucgucgagcgcggccccgacgaggccauggaggacggcgaggagggcuccgacgacgaggccgagugggucgucaccaaggacaaguccaaguacgacgagaucuucuacaaccucgcccccgccgacggcaagcucuccggcuccaaggccaagaccuggauggucggcaccaagcuccccaacuccguccucggccgcaucuggaagcucuccgacgucgaccgcgacggcaugcucgacgacgaggaguucgcccucgccucccaccucaucgaggccaagcucgagggccacggccuccccgccaaccucccccgccgccucgucccccccuccaagcgccgccacaagggcuccgccgaguga

SEQ ID NO: 42609 - RNA, 1608 nt, Artificial Sequence
  derived and/or modified sequence opt2 from EHD3__Homo_sapiens__NP_055415
auguucuccuggcucggcaccgacgaccgccgccgcaaggaccccgaggucuuccagaccgucuccgagggccucaagaagcucuacaaguccaagcuccucccccucgaggagcacuaccgcuuccacgaguuccacucccccgcccucgaggacgccgacuucgacaacaagcccaugguccuccucgucggccaguacuccaccggcaagaccaccuucauccgcuaccuccucgagcaggacuuccccggcaugcgcaucggccccgagcccaccaccgacuccuucaucgccgucaugcagggcgacauggagggcaucauccccggcaacgcccucgucgucgaccccaagaagcccuuccgcaagcucaacgccuucggcaacgccuuccucaaccgcuucgucugcgcccagcuccccaaccccguccucgaguccaucuccgucaucgacacccccggcauccucuccggcgagaagcagcgcaucucccgcggcuacgacuucgccgccguccucgagugguucgccgagcgcgucgaccgcaucauccuccucuucgacgcccacaagcucgacaucuccgacgaguucuccgaggucaucaaggcccucaagaaccacgaggacaagaugcgcgucguccucaacaaggccgaccagaucgagacccagcagcucaugcgcgucuacggcgcccucauguggucccucggcaagaucgucaacacccccgaggucauccgcgucuacaucggcuccuucuggucccacccccuccucauccccgacaaccgcaagcucuucgaggccgaggagcaggaccucuuccgcgacauccagucccucccccgcaacgccgcccuccgcaagcucaacgaccucaucaagcgcgcccgccucgccaagguccacgccuacaucaucuccucccucaagaaggagaugcccuccgucuucggcaaggacaacaagaagaaggagcucgucaacaaccucgccgagaucuacggccgcaucgagcgcgagcaccagaucucccccggcgacuuccccaaccucaagcgcaugcaggaccagcuccaggcccaggacuucuccaaguuccagccccucaaguccaagcuccucgaggucgucgacgacaugcucgcccacgacaucgcccagcucaugguccucguccgccaggaggagucccagcgccccauccagauggucaagggcggcgccuucgagggcacccuccacggccccuucggccacggcuacggcgagggcgccggcgagggcaucgacgacgccgagugggucgucgcccgcgacaagcccauguacgacgagaucuucuacacccucucccccgucgacggcaagaucaccggcgccaacgccaagaaggagaugguccgcuccaagcuccccaacuccguccucggcaagaucuggaagcucgccgacaucgacaaggacggcaugcucgacgacgacgaguucgcccucgccaaccaccucaucaaggucaagcucgagggccacgagcuccccaacgagcuccccgcccaccuccucccccccuccaagcgcaaggucgccgaguga

SEQ ID NO: 42610 - RNA, 1626 nt, Artificial Sequence
  derived and/or modified sequence opt2 from EHD4__Homo_sapiens__NP_644670
auguucuccuggaugggccgccaggccggcggccgcgagcgcgccggcggcgccgacgccguccagaccgucaccggcggccuccgcucccucuaccuccgcaagguccucccccucgaggaggccuaccgcuuccacgaguuccacucccccgcccucgaggacgccgacuucgagaacaagcccaugauccuccucgucggccaguacuccaccggcaagaccaccuucauccgcuaccuccucgagcaggacuuccccggcaugcgcaucggccccgagcccaccaccgacuccuucaucgccgucauguacggcgagaccgagggcuccacccccggcaacgcccucgucgucgaccccaagaagcccuuccgcaagcucucccgcuucggcaacgccuuccucaaccgcuucaugugcucccagcuccccaaccagguccucaaguccaucuccgucaucgacucccccggcauccucuccggcgagaagcagcgcaucucccgcggcuacgacuucugccagguccuccagugguucgccgagcgcgucgaccgcaucauccuccucuucgacgcccacaagcucgacaucuccgacgaguucuccgaggccaucaaggccuuccgcggccaggacgacaagauccgcgucguccucaacaaggccgaccaggucgacacccagcagcucaugcgcgucuacggcgcccucauguggucccucggcaaggucaucaacacccccgagguccuccgcgucuacaucggcuccuucugggcccagccccuccagaacaccgacaaccgccgccucuucgaggccgaggcccaggaccucuuccgcgacauccagucccucccccagaaggccgccguccgcaagcucaacgaccucaucaagcgcgcccgccucgccaagguccacgccuacaucaucuccuaccucaagaaggagaugcccuccgucuucggcaaggagaacaagaagcgcgagcucaucucccgccuccccgagaucuacauccagcuccagcgcgaguaccagaucuccgccggcgacuuccccgaggucaaggccaugcaggagcagcucgagaacuacgacuucaccaaguuccacucccucaagcccaagcucaucgaggccgucgacaacaugcucuccaacaagaucuccccccucaugaaccucaucucccaggaggagaccuccacccccacccagcucguccagggcggcgccuucgacggcaccaccgagggccccuucaaccagggcuacggcgagggcgccaaggagggcgccgacgaggaggagugggucgucgccaaggacaagcccgucuacgacgagcucuucuacacccucucccccaucaacggcaagaucuccggcgucaacgccaagaaggagauggucaccuccaagcuccccaacuccguccucggcaagaucuggaagcucgccgacugcgacugcgacggcaugcucgacgaggaggaguucgcccucgccaagcaccucaucaagaucaagcucgacggcuacgagcuccccuccucccuccccccccaccucgucccccccucccaccgcaagucccuccccaaggccgacuga

SEQ ID NO: 42611 - RNA, 969 nt, Artificial Sequence
  derived and/or modified sequence opt2 from EHF__Homo_sapiens__NP_001193545
augggccuccccgagcgccgcggccucguccuccuccucucccucgccgagauccucuucaagaucaugauccucgagggcggcggcgucaugaaccucaaccccggcaacaaccuccuccaccagccccccgccuggaccgacuccuacuccaccugcaacgucuccuccggcuucuucggcggccaguggcacgagauccacccccaguacuggaccaaguaccaggucugggaguggcuccagcaccuccucgacaccaaccagcucgacgccaacugcauccccuuccaggaguucgacaucaacggcgagcaccucugcuccaugucccuccaggaguucacccgcgccgccggcaccgccggccagcuccucuacuccaaccuccagcaccucaaguggaacggccagugcuccuccgaccucuuccaguccacccacaacgucaucgucaagaccgagcagaccgagcccuccaucaugaacaccuggaaggacgagaacuaccucuacgacaccaacuacggcuccaccgucgaccuccucgacuccaagaccuucugccgcgcccagaucuccaugaccaccaccucccaccuccccgucgccgagucccccgacaugaagaaggagcaggacccccccgccaagugccacaccaagaagcacaacccccgcggcacccaccucugggaguucauccgcgacauccuccucaaccccgacaagaaccccggccucaucaagugggaggaccgcuccgagggcgucuuccgcuuccucaaguccgaggccgucgcccagcucuggggcaagaagaagaacaacuccuccaugaccuacgagaagcucucccgcgccaugcgcuacuacuacaagcgcgagauccucgagcgcgucgacggccgccgccucgucuacaaguucggcaagaacgcccgcggcuggcgcgagaacgagaacuga

SEQ ID NO: 42612 - RNA, 1884 nt, Artificial Sequence
  derived and/or modified sequence opt2 from EHHADH__Homo_sapiens__NP_001159887
auggccuucggcggcggccucgagcucgcccucggcugccacuaccgcaucgcccacgccgaggcccaggucggccuccccgaggucacccucggccuccuccccggcgcccgcggcacccagcuccucccccgccucaccggcguccccgccgcccucgaccucaucaccuccggccgccgcauccucgccgacgaggcccucaagcucggcauccucgacaaggucgucaacuccgaccccgucgaggaggccauccgcuucgcccagcgcgucuccgaccagccccucgagucccgccgccucugcaacaagcccauccagucccuccccaacauggacuccaucuucuccgaggcccuccucaagaugcgccgccagcaccccggcugccucgcccaggaggccugcguccgcgccguccaggccgccguccaguaccccuacgaggucggcaucaagaaggaggaggagcucuuccucuaccuccuccaguccggccaggcccgcgcccuccaguacgccuucuucgccgagcgcaaggccaacaagugguccacccccuccggcgccuccuggaagaccgccuccgcccgccccgucuccuccgucggcgucgucggccucggcaccaugggccgcggcaucgucaucuccuucgcccgcgcccgcauccccgucaucgccgucgacuccgacaagaaccagcucgccaccgccaacaagaugaucaccuccguccucgagaaggaggccuccaagaugcagcaguccggccaccccugguccggccccaagccccgccucaccuccuccgucaaggagcucggcggcgucgaccucgucaucgaggccgucuucgaggagaugucccucaagaagcaggucuucgccgagcucuccgccgucugcaagcccgaggccuuccucugcaccaacaccuccgcccucgacgucgacgagaucgccuccuccaccgaccgcccccaccucgucaucggcacccacuucuucucccccgcccacgucaugaagcuccucgaggucauccccucccaguacuccucccccaccaccaucgccaccgucaugaaccucuccaagaagaucaagaagaucggcgucgucgucggcaacugcuucggcuucgucggcaaccgcaugcucaaccccuacuacaaccaggccuacuuccuccucgaggagggcuccaagcccgaggaggucgaccagguccucgaggaguucggcuucaagaugggccccuuccgcgucuccgaccucgccggccucgacgucggcuggaagucccgcaagggccagggccucaccggccccacccuccuccccggcacccccgcccgcaagcgcggcaaccgccgcuacugccccauccccgacguccucugcgagcucggccgcuucggccagaagaccggcaagggcugguaccaguacgacaagccccucggccgcauccacaagcccgaccccuggcucuccaaguuccucucccgcuaccgcaagacccaccacaucgagccccgcaccaucucccaggacgagauccucgagcgcugccucuacucccucaucaacgaggccuuccgcauccucggcgagggcaucgccgccucccccgagcacaucgacgucgucuaccuccacggcuacggcuggccccgccacaagggcggccccauguucuacgccuccaccgucggccuccccaccguccucgagaagcuccagaaguacuaccgccagaaccccgacaucccccagcucgagcccuccgacuaccucaagaagcucgccucccagggcaaccccccccucaaggaguggcagucccucgccggcucccccuccuccaagcucuga

SEQ ID NO: 42613 - RNA, 2427 nt, Artificial Sequence
  derived and/or modified sequence opt2 from EHMT1__Homo_sapiens__NP_001138999
auggccgccgccgacgccgaggccguccccgcccgcggcgagccccagcaggacugcugcgucaagaccgagcuccucggcgaggagacccccauggccgccgacgagggcuccgccgagaagcaggccggcgaggcccacauggccgccgacggcgagaccaacggcuccugcgagaacuccgacgccuccucccacgccaacgccgccaagcacacccaggacuccgcccgcgucaacccccaggacggcaccaacacccucacccgcaucgccgagaacggcgucuccgagcgcgacuccgaggccgccaagcagaaccacgucaccgccgacgacuucguccagaccuccgucaucggcuccaacggcuacauccucaacaagcccgcccuccaggcccagccccuccgcaccaccuccacccucgccuccucccuccccggccacgccgccaagacccuccccggcggcgccggcaagggccgcacccccuccgccuucccccagacccccgccgccccccccgccacccucggcgagggcuccgccgacaccgaggaccgcaagcuccccgcccccggcgccgacgucaagguccaccgcgcccgcaagaccaugcccaaguccgucgucggccuccacgccgccuccaaggacccccgcgagguccgcgaggcccgcgaccacaaggagcccaaggaggagaucaacaagaacaucuccgacuucggccgccagcagcuccucccccccuuccccucccuccaccagucccucccccagaaccagugcuacauggccaccaccaagucccagaccgccugccuccccuucguccucgccgccgccgucucccgcaagaagaagcgccgcaugggcaccuacucccucguccccaagaagaagaccaagguccucaagcagcgcaccgucaucgagauguucaaguccaucacccacuccaccgucggcuccaagggcgagaaggaccucggcgccuccucccuccacgucaacggcgagucccucgagauggacuccgacgaggacgacuccgaggagcucgaggaggacgacggccacggcgccgagcaggccgccgccuuccccaccgaggacucccgcaccuccaaggaguccauguccgaggccgaccgcgcccagaagauggacggcgaguccgaggaggagcaggaguccgucgacaccggcgaggaggaggagggcggcgacgaguccgaccucuccuccgaguccuccaucaagaagaaguuccucaagcgcaagggcaagaccgacucccccuggaucaagcccgcccgcaagcgccgccgccgcucccgcaagaagcccuccggcgcccucggcuccgaguccuacaaguccuccgccggcuccgccgagcagaccgcccccggcgacuccaccggcuacauggaggucucccucgacucccucgaccuccgcgucaagggcauccucuccucccaggccgagggccucgccaacggccccgacguccucgagaccgacggccuccaggaggucccccucugcuccugccgcauggagacccccaagucccgcgagaucaccacccucgccaacaaccagugcauggccaccgaguccgucgaccacgagcucggccgcugcaccaacuccgucgucaaguacgagcucaugcgccccuccaacaaggccccccuccucguccucugcgaggaccaccgcggccgcauggucaagcaccagugcugccccggcugcggcuacuucugcaccgccggcaacuucauggagugccagcccgaguccuccaucucccaccgcuuccacaaggacugcgccucccgcgucaacaacgccuccuacugcccccacugcggcgaggaguccuccaaggccaaggaggucaccaucgccaaggccgacaccaccuccaccgucacccccguccccggccaggagaagggcuccgcccucgagggccgcgccgacaccaccaccggcuccgccgccggccccccccucuccgaggacgacaagcuccagggcgccgccucccacguccccgagggcuucgaccccaccggccccgccggccucggccgccccacccccggccucucccagggccccggcaaggagacccucgaguccgcccucaucgcccucgacuccgagaagcccaagaagcuccgcuuccaccccaagcagcucuacuucuccgcccgccagggcgagcuccagaagguccuccucaugcucgucgacggcaucgaccccaacuucaagauggagcaccagaacaagcgcuccccccuccacgccgccgccgaggccggccacgucgacaucugccacaugcucguccaguucugccgccucggcuccccccgcucccgcggcugccucugguga

SEQ ID NO: 42614 - RNA, 3702 nt, Artificial Sequence
  derived and/or modified sequence opt2 from EHMT2__Homo_sapiens__NP_001276342
augcgcggccucccccgcggccgcggccucaugcgcgcccgcggccgcggccgcgccgccccccccggcucccgcggccgcggccgcggcggcccccaccgcggccgcggccgcccccgcucccuccucucccucccccgcgcccaggccuccuggaccccccagcucuccaccggccucaccuccccccccguccccugccuccccucccagggcgaggcccccgccgagaugggcgcccuccuccucgagaaggagacccgcggcgccaccgagcgcguccacggcucccucggcgacaccccccgcuccgaggagacccuccccaaggccacccccgacucccucgagcccgccggccccuccucccccgccuccgucaccgucaccgucggcgacgagggcgccgacacccccgucggcgccaccccccucaucggcgacgaguccgagaaccucgagggcgacggcgaccuccgcggcggccgcauccuccucggccacgccaccaaguccuuccccuccucccccuccaagggcggcuccugccccucccgcgccaagauguccaugaccggcgccggcaaguccccccccuccguccagucccucgccaugcgccuccucuccaugcccggcgcccagggcgccgccgccgccggcuccgagcccccccccgccaccaccucccccgagggccagcccaagguccaccgcgcccgcaagaccauguccaagcccggcaacggccagccccccguccccgagaagcgcccccccgagauccagcacuuccgcauguccgacgacguccacucccucggcaaggucaccuccgaccucgccaagcgccgcaagcucaacuccggcggcggccucuccgaggagcucggcuccgcccgccgcuccggcgaggucacccucaccaagggcgaccccggcucccucgaggagugggagaccgucgucggcgacgacuucucccucuacuacgacuccuacuccgucgacgagcgcgucgacuccgacuccaaguccgaggucgaggcccucaccgagcagcucuccgaggaggaggaggaggaggaggaggaggaggaggaggaggaggaggaggaggaggaggaggaggaggaggaggacgaggaguccggcaaccaguccgaccgcuccggcuccuccggccgccgcaaggccaagaagaaguggcgcaaggacucccccugggucaagcccucccgcaagcgccgcaagcgcgagcccccccgcgccaaggagccccgcggcgucuccaacgacaccuccucccucgagaccgagcgcggcuucgaggagcucccccucugcuccugccgcauggaggcccccaagaucgaccgcaucuccgagcgcgccggccacaagugcauggccaccgaguccgucgacggcgagcucuccggcugcaacgccgccauccucaagcgcgagaccaugcgccccuccucccgcgucgcccucaugguccucugcgagacccaccgcgcccgcauggucaagcaccacugcugccccggcugcggcuacuucugcaccgccggcaccuuccucgagugccaccccgacuuccgcgucgcccaccgcuuccacaaggccugcgucucccagcucaacggcauggucuucugcccccacugcggcgaggacgccuccgaggcccaggaggucaccaucccccgcggcgacggcgucaccccccccgccggcaccgccgcccccgccccccccccccucucccaggacguccccggccgcgccgacaccucccagcccuccgcccgcaugcgcggccacggcgagccccgccgcccccccugcgacccccucgccgacaccaucgacuccuccggccccucccucacccuccccaacggcggcugccucuccgccgucggccucccccucggccccggccgcgaggcccucgagaaggcccucgucauccaggaguccgagcgccgcaagaagcuccgcuuccacccccgccagcucuaccucuccgucaagcagggcgagcuccagaaggucauccucaugcuccucgacaaccucgaccccaacuuccaguccgaccagcaguccaagcgcaccccccuccacgccgccgcccagaagggcuccgucgagaucugccacguccuccuccaggccggcgccaacaucaacgccgucgacaagcagcagcgcaccccccucauggaggccgucgucaacaaccaccucgaggucgcccgcuacaugguccagcgcggcggcugcgucuacuccaaggaggaggacggcuccaccugccuccaccacgccgccaagaucggcaaccucgagauggucucccuccuccucuccaccggccaggucgacgucaacgcccaggacuccggcggcuggacccccaucaucugggccgccgagcacaagcacaucgaggucauccgcaugcuccucacccgcggcgccgacgucacccucaccgacaacgaggagaacaucugccuccacugggccuccuucaccggcuccgccgccaucgccgagguccuccucaacgcccgcugcgaccuccacgccgucaacuaccacggcgacaccccccuccacaucgccgcccgcgaguccuaccacgacugcguccuccucuuccucucccgcggcgccaaccccgagcuccgcaacaaggagggcgacaccgccugggaccucacccccgagcgcuccgacgucugguucgcccuccagcucaaccgcaagcuccgccucggcgucggcaaccgcgccauccgcaccgagaagaucaucugccgcgacgucgcccgcggcuacgagaacguccccauccccugcgucaacggcgucgacggcgagcccugccccgaggacuacaaguacaucuccgagaacugcgagaccuccaccaugaacaucgaccgcaacaucacccaccuccagcacugcaccugcgucgacgacugcuccuccuccaacugccucugcggccagcucuccauccgcugcugguacgacaaggacggccgccuccuccaggaguucaacaagaucgagcccccccucaucuucgagugcaaccaggccugcuccugcuggcgcaacugcaagaaccgcgucguccaguccggcaucaagguccgccuccagcucuaccgcaccgccaagaugggcuggggcguccgcgcccuccagaccaucccccagggcaccuucaucugcgaguacgucggcgagcucaucuccgacgccgaggccgacguccgcgaggacgacuccuaccucuucgaccucgacaacaaggacggcgaggucuacugcaucgacgcccgcuacuacggcaacaucucccgcuucaucaaccaccucugcgaccccaacaucauccccguccgcgucuucaugcuccaccaggaccuccgcuucccccgcaucgccuucuucuccucccgcgacauccgcaccggcgaggagcucggcuucgacuacggcgaccgcuucugggacaucaaguccaaguacuucaccugccagugcggcuccgagaagugcaagcacuccgccgaggccaucgcccucgagcagucccgccucgcccgccucgacccccaccccgagcuccuccccgagcucggcucccucccccccgucaacaccuga

SEQ ID NO: 42615 - RNA, 1023 nt, Artificial Sequence
  derived and/or modified sequence opt2 from EI24__Homo_sapiens__XP_011541371
auggccgacuccgucaagaccuuccuccaggaccucgcccgcggcaucaaggacuccaucuggggcaucugcaccaucuccaagcucgacgcccgcauccagcagaagcgcgaggagcagcgccgccgccgcgccuccuccguccucgcccagcgccgcgcccaguccaucgagcgcaagcaggaguccgagccccgcaucgucucccgcaucuuccagugcugcgccuggaacggcggcgucuucugguucucccuccuccucuucuaccgcgucuucauccccguccuccaguccgucaccgcccgcaucaucggcgaccccucccuccacggcgacgucugguccuggcucgaguucuuccucaccuccaucuucuccgcccucuggguccucccccucuucguccucuccaaggucgucaacgccaucugguuccaggacaucgccgaccucgccuucgaggucuccggccgcaagccccaccccuuccccuccgucuccaagaucaucgccgacaugcucuucaaccuccuccuccaggcccucuuccucauccagggcauguucgucucccucuuccccauccaccucgucggccagcucgucucccuccuccacaugucccuccucuacucccucuacugcuucgaguaccgcugguucaacaagggcaucgagaugcaccagcgccucuccaacaucgagcgcaacuggcccuacuacuucggcuucggccucccccucgccuuccucaccgccaugcaguccuccuacaucaucuccggcugccucuucuccauccucuucccccucuucaucaucuccgccaacgaggccaagacccccggcaaggccuaccucuuccagcuccgccucuucucccucgucgucuuccucuccaaccgccucuuccacaagaccgucuaccuccaguccgcccucuccuccuccaccuccgccgagaaguuccccuccccccaccccucccccgccaagcucaaggccaccgccggccacuga

SEQ ID NO: 42616 - RNA, 564 nt, Artificial Sequence
  derived and/or modified sequence opt2 from EID1__Homo_sapiens__NP_055150
auguccgagauggccgagcucuccgagcucuacgaggaguccuccgaccuccagauggacgucaugcccggcgagggcgaccucccccagauggaggucggcuccggcucccgcgagcucucccuccgccccucccgcuccggcgcccagcagcucgaggaggagggccccauggaggaggaggaggcccagcccauggccgcccccgagggcaagcgcucccucgccaacggccccaacgccggcgagcagcccggccaggucgccggcgccgacuucgaguccgaggacgagggcgaggaguucgacgacugggaggacgacuacgacuaccccgaggaggagcagcucuccggcgccggcuaccgcgucuccgccgcccucgaggaggccgacaagauguuccuccgcacccgcgagcccgcccucgacggcggcuuccagaugcacuacgagaagacccccuucgaccagcucgccuucaucgaggagcucuucucccucauggucgucaaccgccucaccgaggagcucggcugcgacgagaucaucgaccgcgaguga

SEQ ID NO: 42617 - RNA, 498 nt, Artificial Sequence
  derived and/or modified sequence opt2 from EIF1AD__Homo_sapiens__NP_001229411
augucccaggccaccaagcgcaagcacgucgucaaggagguccucggcgagcacaucguccccuccgaccagcagcagaucguccgcguccuccgcacccccggcaacaaccuccacgaggucgagaccgcccagggccagcgcuuccucgucuccaugcccuccaaguaccgcaagaacaucuggaucaagcgcggcgacuuccucaucgucgaccccaucgaggagggcgagaaggucaaggccgagaucuccuucguccucugcaaggaccacguccgcucccuccagaaggagggcuucuggcccgaggccuucuccgaggucgccgagaagcacaacaaccgcaaccgccagacccagcccgagcuccccgccgagccccagcucuccggcgaggaguccuccuccgaggacgacuccgaccucuucgucaacaccaaccgccgccaguaccacgaguccgaggaggaguccgaggaggaggaggccgccuga

SEQ ID NO: 42618 - RNA, 435 nt, Artificial Sequence
  derived and/or modified sequence opt2 from EIF1AX__Homo_sapiens__NP_001403
augcccaagaacaagggcaagggcggcaagaaccgccgccgcggcaagaacgagaacgaguccgagaagcgcgagcucgucuucaaggaggacggccaggaguacgcccaggucaucaagaugcucggcaacggccgccucgaggccaugugcuucgacggcgucaagcgccucugccacauccgcggcaagcuccgcaagaaggucuggaucaacaccuccgacaucauccucgucggccuccgcgacuaccaggacaacaaggccgacgucauccucaaguacaacgccgacgaggcccgcucccucaaggccuacggcgagcuccccgagcacgccaagaucaacgagaccgacaccuucggccccggcgacgacgacgagauccaguucgacgacaucggcgacgacgacgaggacaucgacgacaucuga

SEQ ID NO: 42619 - RNA, 384 nt, Artificial Sequence
  derived and/or modified sequence opt2 from EIF1AY__Homo_sapiens__NP_001265541
augcccaagaacaagggcaagggcggcaagaaccgccgccgcggcaagaacgagaacgaguccgagaagcgcgagcucgucuucaaggaggacggccaggaguacgcccaggucaucaagaugcucggcaacggccgccucgaggcccucugcuucgacggcgucaagcgccucugccacauccgcggcaagcuccgcaagaaggacaacaaggccgacgucauccucaaguacaacgccgacgaggcccgcucccucaaggccuacggcgagcuccccgagcacgccaagaucaacgagaccgacaccuucggccccggcgacgacgacgagauccaguucgacgacaucggcgacgacgacgaggacaucgacgacaucuga

SEQ ID NO: 42620 - RNA, 342 nt, Artificial Sequence
  derived and/or modified sequence opt2 from EIF1__Homo_sapiens__NP_005792
auguccgccauccagaaccuccacuccuucgaccccuucgccgacgccuccaagggcgacgaccuccuccccgccggcaccgaggacuacauccacauccgcauccagcagcgcaacggccgcaagacccucaccaccguccagggcaucgccgacgacuacgacaagaagaagcucgucaaggccuucaagaagaaguucgccugcaacggcaccgucaucgagcaccccgaguacggcgaggucauccagcuccagggcgaccagcgcaagaacaucugccaguuccucgucgagaucggccucgccaaggacgaccagcucaagguccacggcuucuga

SEQ ID NO: 42621 - RNA, 1758 nt, Artificial Sequence
  derived and/or modified sequence opt2 from EIF2A__Homo_sapiens__NP_114414
auggcccccuccaccccccuccucaccguccgcggcuccgagggccucuacauggucaacggccccccccacuucaccgaguccaccgucuucccccgcgaguccggcaagaacugcaaggucugcaucuucuccaaggacggcacccucuucgccuggggcaacggcgagaaggucaacaucaucuccgucaccaacaagggccuccuccacuccuucgaccuccucaaggccgucugccucgaguucucccccaagaacaccguccucgccaccuggcagcccuacaccaccuccaaggacggcaccgccggcauccccaaccuccagcucuacgacgucaagaccggcaccugccucaaguccuucauccagaagaagaugcagaacuggugccccuccugguccgaggacgagacccucugcgcccgcaacgucaacaacgagguccacuucuucgagaacaacaacuucaacaccaucgccaacaagcuccaccuccagaagaucaacgacuucguccucucccccggcccccagcccuacaaggucgccgucuacguccccggcuccaagggcgcccccuccuucguccgccucuaccaguaccccaacuucgccggcccccacgccgcccucgccaacaaguccuucuucaaggccgacaaggucaccaugcucuggaacaagaaggccaccgccguccucgucaucgccuccaccgacgucgacaagaccggcgccuccuacuacggcgagcagacccuccacuacaucgccaccaacggcgaguccgccgucguccagcuccccaagaacggccccaucuacgacgucgucuggaacuccuccuccaccgaguucugcgccgucuacggcuucaugcccgccaaggccaccaucuucaaccucaagugcgaccccgucuucgacuucggcaccggcccccgcaacgccgccuacuacuccccccacggccacauccucguccucgccggcuucggcaaccuccgcggccagauggaggucugggacgucaagaacuacaagcucaucuccaagcccgucgccuccgacuccaccuacuucgccuggugccccgacggcgagcacauccucaccgccaccugcgccccccgccuccgcgucaacaacggcuacaagaucuggcacuacaccggcuccauccuccacaaguacgacguccccuccaacgccgagcucuggcaggucuccuggcagcccuuccucgacggcaucuuccccgccaagaccaucaccuaccaggccguccccuccgagguccccaacgaggagcccaaggucgccaccgccuaccgcccccccgcccuccgcaacaagcccaucaccaacuccaagcuccacgaggaggagcccccccagaacaugaagccccaguccggcaacgacaagccccucuccaagaccgcccucaagaaccagcgcaagcacgaggccaagaaggccgccaagcaggaggcccgcuccgacaagucccccgaccucgcccccacccccgccccccaguccaccccccgcaacaccgucucccaguccaucuccggcgaccccgagaucgacaagaagaucaagaaccucaagaagaagcucaaggccaucgagcagcucaaggagcaggccgccaccggcaagcagcucgagaagaaccagcucgagaagauccagaaggagaccgcccuccuccaggagcucgaggaccucgagcucggcaucuga

SEQ ID NO: 42622 - RNA, 1893 nt, Artificial Sequence
  derived and/or modified sequence opt2 from EIF2AK1__Homo_sapiens__NP_055228
augcagggcggcaacuccggcguccgcaagcgcgaggaggagggcgacggcgccggcgccgucgccgccccccccgccaucgacuuccccgccgagggccccgaccccgaguacgacgaguccgacguccccgccgagauccagguccucaaggagccccuccagcagcccaccuuccccuucgccgucgccaaccagcuccuccucgucucccuccucgagcaccucucccacguccacgagcccaacccccuccgcucccgccaggucuucaagcuccucugccagaccuucaucaagaugggccuccucuccuccuucaccugcuccgacgaguucuccucccuccgccuccaccacaaccgcgccaucacccaccucaugcgcuccgccaaggagcgcguccgccaggaccccugcgaggacaucucccgcauccagaagauccgcucccgcgaggucgcccucgaggcccagaccucccgcuaccucaacgaguucgaggagcucgccauccucggcaagggcggcuacggccgcgucuacaagguccgcaacaagcucgacggccaguacuacgccaucaagaagauccucaucaagggcgccaccaagaccgucugcaugaagguccuccgcgaggucaagguccucgccggccuccagcaccccaacaucgucggcuaccacaccgccuggaucgagcacguccacgucauccagccccgcgccgaccgcgccgccaucgagcuccccucccucgagguccucuccgaccaggaggaggaccgcgagcagugcggcgucaagaacgacgaguccuccuccuccuccaucaucuucgccgagcccacccccgagaaggagaagcgcuucggcgaguccgacaccgagaaccagaacaacaaguccgucaaguacaccaccaaccucgucauccgcgaguccggcgagcucgaguccacccucgagcuccaggagaacggccucgccggccucuccgccuccuccaucgucgagcagcagcucccccuccgccgcaacucccaccucgaggaguccuucaccuccaccgaggaguccuccgaggagaacgucaacuuccucggccagaccgaggcccaguaccaccucaugcuccacauccagaugcagcucugcgagcucucccucugggacuggaucgucgagcgcaacaagcgcggccgcgaguacgucgacgaguccgccugccccuacgucauggccaacgucgccaccaagaucuuccaggagcucgucgagggcgucuucuacauccacaacaugggcaucguccaccgcgaccucaagccccgcaacaucuuccuccacggccccgaccagcaggucaagaucggcgacuucggccucgccugcaccgacauccuccagaagaacaccgacuggaccaaccgcaacggcaagcgcacccccacccacaccucccgcgucggcaccugccucuacgccucccccgagcagcucgagggcuccgaguacgacgccaaguccgacauguacucccucggcgucguccuccucgagcucuuccagcccuucggcaccgagauggagcgcgccgagguccucaccggccuccgcaccggccagcuccccgagucccuccgcaagcgcugccccguccaggccaaguacauccagcaccucacccgccgcaacuccucccagcgccccuccgccauccagcuccuccaguccgagcucuuccagaacuccggcaacgucaaccucacccuccagaugaagaucaucgagcaggagaaggagaucgccgagcucaagaagcagcucaaccuccucucccaggacaagggcguccgcgacgacggcaaggacggcggcgucggcuga

SEQ ID NO: 42623 - RNA, 1533 nt, Artificial Sequence
  derived and/or modified sequence opt2 from EIF2AK2__Homo_sapiens__NP_001129124
auggccggcgaccucuccgccggcuucuucauggaggagcucaacaccuaccgccagaagcagggcgucguccucaaguaccaggagcuccccaacuccggccccccccacgaccgccgcuucaccuuccaggucaucaucgacggccgcgaguuccccgagggcgagggccgcuccaagaaggaggccaagaacgccgccgccaagcucgccgucgagauccucaacaaggagaagaaggccgucuccccccuccuccucaccaccaccaacuccuccgagggccucuccaugggcaacuacaucggccucaucaaccgcaucgcccagaagaagcgccucaccgucaacuacgagcagugcgccuccggcguccacggccccgagggcuuccacuacaagugcaagaugggccagaaggaguacuccaucggcaccggcuccaccaagcaggaggccaagcagcucgccgccaagcucgccuaccuccagauccucuccgaggagaccuccgucaaguccgacuaccucuccuccggcuccuucgccaccaccugcgagucccaguccaacucccucgucaccuccacccucgccuccgaguccuccuccgagggcgacuucuccgccgacaccuccgagaucaacuccaacuccgacucccucaacuccuccucccuccucaugaacggccuccgcaacaaccagcgcaaggccaagcgcucccucgccccccgcuucgaccuccccgacaugaaggagaccaaguacaccgucgacaagcgcaaggccgagcgcgaggucaaggcccucgccaagcucgaccacgucaacaucguccacuacaacggcugcugggacggcuucgacuacgaccccgagaccuccgacgacucccucgaguccuccgacuacgaccccgagaacuccaagaacuccucccgcuccaagaccaagugccucuucauccagauggaguucugcgacaagggcacccucgagcaguggaucgagaagcgccgcggcgagaagcucgacaagguccucgcccucgagcucuucgagcagaucaccaagggcgucgacuacauccacuccaagaagcucauccaccgcgaccucaagcccuccaacaucuuccucgucgacaccaagcaggucaagaucggcgacuucggccucgucaccucccucaagaacgacggcaagcgcacccgcuccaagggcacccuccgcuacaugucccccgagcagaucuccucccaggacuacggcaaggaggucgaccucuacgcccucggccucauccucgccgagcuccuccacgucugcgacaccgccuucgagaccuccaaguucuucaccgaccuccgcgacggcaucaucuccgacaucuucgacaagaaggagaagacccuccuccagaagcuccucuccaagaagcccgaggaccgccccaacaccuccgagauccuccgcacccucaccgucuggaagaagucccccgagaagaacgagcgccacaccugcuga

SEQ ID NO: 42624 - RNA, 3351 nt, Artificial Sequence
  derived and/or modified sequence opt2 from EIF2AK3__Homo_sapiens__NP_004827
auggagcgcgccaucucccccggccuccucguccgcgcccuccuccuccuccuccuccuccucggccucgccgcccgcaccgucgccgccggccgcgcccgcggccuccccgcccccaccgccgaggccgccuucggccucggcgccgccgccgcccccaccuccgccacccgcguccccgccgccggcgccgucgccgccgccgaggucaccgucgaggacgccgaggcccuccccgccgccgccggcgagcaggagccccgcggccccgagcccgacgacgagaccgagcuccgcccccgcggccgcucccucgucaucaucuccacccucgacggccgcaucgccgcccucgaccccgagaaccacggcaagaagcagugggaccucgacgucggcuccggcucccucgucuccuccucccucuccaagcccgaggucuucggcaacaagaugaucauccccucccucgacggcgcccucuuccagugggaccaggaccgcgaguccauggagaccguccccuucaccgucgagucccuccucgaguccuccuacaaguucggcgacgacgucguccucgucggcggcaagucccucaccaccuacggccucuccgccuacuccggcaagguccgcuacaucugcuccgcccucggcugccgccagugggacuccgacgagauggagcaggaggaggacauccuccuccuccagcgcacccagaagaccguccgcgccgucggcccccgcuccggcaacgagaaguggaacuucuccgucggccacuucgagcuccgcuacauccccgacauggagacccgcgccggcuucaucgaguccaccuucaagcccaacgagaacaccgaggaguccaagaucaucuccgacgucgaggagcaggaggccgccaucauggacaucgucaucaaggucuccgucgccgacuggaaggucauggccuucuccaagaagggcggccaccucgagugggaguaccaguucugcacccccaucgccuccgccuggcuccucaaggacggcaaggucauccccaucucccucuucgacgacaccuccuacaccuccaacgacgacguccucgaggacgaggaggacaucgucgaggccgcccgcggcgccaccgagaacuccgucuaccucggcauguaccgcggccagcucuaccuccaguccuccguccgcaucuccgagaaguuccccuccucccccaaggcccucgaguccgucaccaacgagaacgccaucaucccccuccccaccaucaaguggaagccccucauccacucccccucccgcacccccguccucgucggcuccgacgaguucgacaagugccucuccaacgacaaguucucccacgaggaguacuccaacggcgcccucuccauccuccaguaccccuacgacaacggcuacuaccuccccuacuacaagcgcgagcgcaacaagcgcuccacccagaucaccguccgcuuccucgacaacccccacuacaacaagaacauccgcaagaaggaccccguccuccuccuccacugguggaaggagaucgucgccaccauccucuucugcaucaucgccaccaccuucaucguccgccgccucuuccacccccacccccaccgccagcgcaaggaguccgagacccagugccagaccgagaacaaguacgacuccgucuccggcgaggccaacgacuccuccuggaacgacaucaagaacuccggcuacaucucccgcuaccucaccgacuucgagcccauccagugccucggccgcggcggcuucggcgucgucuucgaggccaagaacaaggucgacgacugcaacuacgccaucaagcgcauccgccuccccaaccgcgagcucgcccgcgagaaggucaugcgcgaggucaaggcccucgccaagcucgagcaccccggcaucguccgcuacuucaacgccuggcucgaggccccccccgagaaguggcaggagaagauggacgagaucuggcucaaggacgaguccaccgacuggccccucuccucccccucccccauggacgcccccuccgucaagauccgccgcauggaccccuucgccaccaaggagcacaucgagaucaucgcccccuccccccagcgcucccgcuccuucuccgucggcaucuccugcgaccagaccuccuccuccgagucccaguucuccccccucgaguucuccggcauggaccacgaggacaucuccgaguccgucgacgccgccuacaaccuccaggacuccugccucaccgacugcgacgucgaggacggcaccauggacggcaacgacgagggccacuccuucgagcucugccccuccgaggccucccccuacguccgcucccgcgagcgcaccuccuccuccaucgucuucgaggacuccggcugcgacaacgccuccuccaaggaggagcccaagaccaaccgccuccacaucggcaaccacugcgccaacaagcucaccgccuucaagcccaccuccuccaaguccuccuccgaggccacccucuccaucucccccccccgccccaccacccucucccucgaccucaccaagaacaccaccgagaagcuccagcccuccucccccaaggucuaccucuacauccagaugcagcucugccgcaaggagaaccucaaggacuggaugaacggccgcugcaccaucgaggagcgcgagcgcuccgucugccuccacaucuuccuccagaucgccgaggccgucgaguuccuccacuccaagggccucaugcaccgcgaccucaagcccuccaacaucuucuucaccauggacgacgucgucaaggucggcgacuucggccucgucaccgccauggaccaggacgaggaggagcagaccguccucacccccaugcccgccuacgcccgccacaccggccaggucggcaccaagcucuacaugucccccgagcagauccacggcaacuccuacucccacaaggucgacaucuucucccucggccucauccucuucgagcuccucuaccccuucuccacccagauggagcgcguccgcacccucaccgacguccgcaaccucaaguuccccccccucuucacccagaaguaccccugcgaguacgucaugguccaggacaugcucucccccucccccauggagcgccccgaggccaucaacaucaucgagaacgccgucuucgaggaccucgacuuccccggcaagaccguccuccgccagcgcucccgcucccucuccuccuccggcaccaagcacucccgccaguccaacaacucccacuccccccuccccuccaacuga

SEQ ID NO: 42625 - RNA, 4950 nt, Artificial Sequence
  derived and/or modified sequence opt2 from EIF2AK4__Homo_sapiens__NP_001013725
auggccggcggccgcggcgcccccggccgcggccgcgacgagccccccgaguccuacccccagcgccaggaccacgagcuccaggcccucgaggccaucuacggcgccgacuuccaggaccuccgccccgacgccugcggccccgucaaggagccccccgagaucaaccucguccucuacccccagggccucaccggcgaggaggucuacgucaaggucgaccuccgcgucaagugcccccccaccuaccccgacgucguccccgagaucgagcucaagaacgccaagggccucuccaacgaguccgucaaccuccucaagucccgccucgaggagcucgccaagaagcacugcggcgaggucaugaucuucgagcucgccuaccacguccaguccuuccucuccgagcacaacaagcccccccccaaguccuuccacgaggagaugcucgagcgccgcgcccaggaggagcagcagcgccuccucgaggccaagcgcaaggaggagcaggagcagcgcgagauccuccacgagauccagcgccgcaaggaggagaucaaggaggagaagaagcgcaaggagauggccaagcaggagcgccucgagaucgccucccucuccaaccaggaccacaccuccaagaaggaccccggcggccaccgcaccgccgccauccuccacggcggcucccccgacuucgucggcaacggcaagcaccgcgccaacuccuccggccgcucccgccgcgagcgccaguacuccgucugcaacuccgaggacucccccggcuccugcgagauccucuacuucaacaugggcucccccgaccagcucaugguccacaagggcaagugcaucggcuccgacgagcagcucggcaagcucgucuacaacgcccucgagaccgccaccggcggcuucguccuccucuacgaguggguccuccaguggcagaagaagaugggccccuuccucaccucccaggagaaggagaagaucgacaagugcaagaagcagauccagggcaccgagaccgaguucaacucccucgucaagcucucccaccccaacgucguccgcuaccucgccaugaaccucaaggagcaggacgacuccaucgucgucgacauccucgucgagcacaucuccggcgucucccucgccgcccaccucucccacuccggccccauccccguccaccagcuccgccgcuacaccgcccagcuccucuccggccucgacuaccuccacuccaacuccgucguccacaagguccucuccgccuccaacguccucgucgacgccgagggcaccgucaagaucaccgacuacuccaucuccaagcgccucgccgacaucugcaaggaggacgucuucgagcagacccgcguccgcuucuccgacaacgcccuccccuacaagaccggcaagaagggcgacgucuggcgccucggccuccuccuccucucccucucccagggccaggagugcggcgaguaccccgucaccauccccuccgaccuccccgccgacuuccaggacuuccucaagaagugcgucugccucgacgacaaggagcgcugguccccccagcagcuccucaagcacuccuucaucaacccccagcccaagaugccccucgucgagcagucccccgaggacuccgagggccaggacuacgucgagaccgucauccccuccaaccgccuccccuccgccgccuucuucuccgagacccagcgccaguucucccgcuacuucaucgaguucgaggagcuccagcuccucggcaagggcgccuucggcgccgucaucaagguccagaacaagcucgacggcugcugcuacgccgucaagcgcauccccaucaaccccgccucccgccaguuccgccgcaucaagggcgaggucacccuccucucccgccuccaccacgagaacaucguccgcuacuacaacgccuggaucgagcgccacgagcgccccgccggccccggcacccccccccccgacuccggcccccucgccaaggacgaccgcgccgcccgcggccagcccgccuccgacaccgacggccucgacuccgucgaggccgccgcccccccccccauccucuccuccuccgucgagugguccaccuccggcgagcgcuccgccuccgcccgcuuccccgccaccggccccggcuccuccgacgacgaggacgacgacgaggacgagcacggcggcgucuucucccaguccuuccuccccgccuccgacuccgaguccgacaucaucuucgacaacgaggacgagaacuccaagucccagaaccaggacgaggacugcaacgagaagaacggcugccacgaguccgagcccuccgucaccaccgaggccguccacuaccucuacauccagauggaguacugcgagaaguccacccuccgcgacaccaucgaccagggccucuaccgcgacaccguccgccucuggcgccucuuccgcgagauccucgacggccucgccuacauccacgagaagggcaugauccaccgcgaccucaagcccgucaacaucuuccucgacuccgacgaccacgucaagaucggcgacuucggccucgccaccgaccaccucgccuucuccgccgacuccaagcaggacgaccagaccggcgaccucaucaaguccgaccccuccggccaccucaccggcauggucggcaccgcccucuacgucucccccgagguccagggcuccaccaaguccgccuacaaccagaaggucgaccucuucucccucggcaucaucuucuucgagauguccuaccaccccauggucaccgccuccgagcgcaucuucguccucaaccagcuccgcgaccccaccucccccaaguuccccgaggacuucgacgacggcgagcacgccaagcagaaguccgucaucuccuggcuccucaaccacgaccccgccaagcgccccaccgccaccgagcuccucaaguccgagcuccucccccccccccagauggaggaguccgagcuccacgagguccuccaccacacccucaccaacgucgacggcaaggccuaccgcaccaugauggcccagaucuucucccagcgcaucucccccgccaucgacuacaccuacgacuccgacauccucaagggcaacuucuccauccgcaccgccaagaugcagcagcacgucugcgagaccaucauccgcaucuucaagcgccacggcgccguccagcucugcaccccccuccuccucccccgcaaccgccagaucuacgagcacaacgaggccgcccucuucauggaccacuccggcaugcucgucaugcuccccuucgaccuccgcauccccuucgcccgcuacgucgcccgcaacaacauccucaaccucaagcgcuacugcaucgagcgcgucuuccgcccccgcaagcucgaccgcuuccaccccaaggagcuccucgagugcgccuucgacaucgucaccuccaccaccaacuccuuccuccccaccgccgagaucaucuacaccaucuacgagaucauccaggaguuccccgcccuccaggagcgcaacuacuccaucuaccucaaccacaccaugcuccucaaggccauccuccuccacugcggcauccccgaggacaagcucucccaggucuacaucauccucuacgacgccgucaccgagaagcucacccgccgcgaggucgaggccaaguucugcaaccucucccucuccuccaacucccucugccgccucuacaaguucaucgagcagaagggcgaccuccaggaccucaugcccaccaucaacucccucaucaagcagaagaccggcaucgcccagcucgucaaguacggccucaaggaccucgaggaggucgucggccuccucaagaagcucggcaucaagcuccagguccucaucaaccucggccucgucuacaagguccagcagcacaacggcaucaucuuccaguucgucgccuucaucaagcgccgccagcgcgccguccccgagauccucgccgccggcggccgcuacgaccuccucaucccccaguuccgcggcccccaggcccucggccccguccccaccgccaucggcgucuccaucgccaucgacaagaucuccgccgccguccucaacauggaggaguccgucaccaucuccuccugcgaccuccucgucgucuccgucggccagauguccaugucccgcgccaucaaccucacccagaagcucuggaccgccggcaucaccgccgagaucauguacgacuggucccagucccaggaggagcuccaggaguacugccgccaccacgagaucaccuacgucgcccucgucuccgacaaggagggcucccacgucaaggucaaguccuucgagaaggagcgccagaccgagaagcgcguccucgagaccgagcucgucgaccacguccuccagaagcuccgcaccaaggucaccgacgagcgcaacggccgcgaggccuccgacaaccucgccguccagaaccucaagggcuccuucuccaacgccuccggccucuucgagauccacggcgccaccgucguccccaucgucuccguccucgcccccgagaagcucuccgccuccacccgccgccgcuacgagacccagguccagacccgccuccagaccucccucgccaaccuccaccagaaguccuccgagaucgagauccucgccgucgaccuccccaaggagaccauccuccaguuccucucccucgagugggacgccgacgagcaggccuucaacaccaccgucaagcagcuccucucccgccuccccaagcagcgcuaccucaagcucgucugcgacgagaucuacaacaucaaggucgagaagaaggucuccguccucuuccucuacuccuaccgcgacgacuacuaccgcauccucuucuga

SEQ ID NO: 42626 - RNA, 918 nt, Artificial Sequence
  derived and/or modified sequence opt2 from EIF2B1__Homo_sapiens__NP_001405
auggacgacaaggagcucaucgaguacuucaagucccagaugaaggaggaccccgacauggccuccgccgucgccgccauccgcacccuccucgaguuccucaagcgcgacaagggcgagaccauccagggccuccgcgccaaccucaccuccgccaucgagacccucugcggcgucgacuccuccgucgccgucuccuccggcggcgagcucuuccuccgcuucaucucccucgccucccucgaguacuccgacuacuccaagugcaagaagaucaugaucgagcgcggcgagcucuuccuccgccgcaucucccucucccgcaacaagaucgccgaccucugccacaccuucaucaaggacggcgccaccauccucacccacgccuacucccgcgucguccuccgcguccucgaggccgccgucgccgccaagaagcgcuucuccgucuacgucaccgagucccagcccgaccucuccggcaagaagauggccaaggcccucugccaccucaacguccccgucaccgucguccucgacgccgccgucggcuacaucauggagaaggccgaccucgucaucgucggcgccgagggcgucgucgagaacggcggcaucaucaacaagaucggcaccaaccagauggccgucugcgccaaggcccagaacaagcccuucuacgucgucgccgaguccuucaaguucguccgccucuucccccucaaccagcaggacguccccgacaaguucaaguacaaggccgacacccucaaggucgcccagaccggccaggaccucaaggaggagcaccccugggucgacuacaccgcccccucccucaucacccuccucuucaccgaccucggcguccucacccccuccgccgucuccgacgagcucaucaagcucuaccucuga

SEQ ID NO: 42627 - RNA, 1056 nt, Artificial Sequence
  derived and/or modified sequence opt2 from EIF2B2__Homo_sapiens__NP_055054
augcccggcuccgccgccaagggcuccgagcucuccgagcgcaucgaguccuucgucgagacccucaagcgcggcggcggcccccgcuccuccgaggagauggcccgcgagacccucggccuccuccgccagaucaucaccgaccaccgcugguccaacgccggcgagcucauggagcucauccgccgcgagggccgccgcaugaccgccgcccagcccuccgagaccaccgucggcaacaugguccgccgcguccucaagaucauccgcgaggaguacggccgccuccacggccgcuccgacgaguccgaccagcaggagucccuccacaagcuccucaccuccggcggccucaacgaggacuucuccuuccacuacgcccagcuccaguccaacaucaucgaggccaucaacgagcuccucgucgagcucgagggcaccauggagaacaucgccgcccaggcccucgagcacauccacuccaacgaggucaucaugaccaucggcuucucccgcaccgucgaggccuuccucaaggaggccgcccgcaagcgcaaguuccacgucaucgucgccgagugcgcccccuucugccagggccacgagauggccgucaaccucuccaaggccggcaucgagaccaccgucaugaccgacgccgccaucuucgccgucaugucccgcgucaacaaggucaucaucggcaccaagaccauccucgccaacggcgcccuccgcgccgucaccggcacccacacccucgcccucgccgccaagcaccacuccaccccccucaucgucugcgcccccauguucaagcucuccccccaguuccccaacgaggaggacuccuuccacaaguucgucgcccccgaggagguccuccccuucaccgagggcgacauccucgagaaggucuccguccacugccccgucuucgacuacgucccccccgagcucaucacccucuucaucuccaacaucggcggcaacgcccccuccuacaucuaccgccucauguccgagcucuaccaccccgacgaccacguccucuga

SEQ ID NO: 42628 - RNA, 1269 nt, Artificial Sequence
  derived and/or modified sequence opt2 from EIF2B3__Homo_sapiens__XP_011540698
auggaguuccaggccgucgucauggccgucggcggcggcucccgcaugaccgaccucaccuccuccauccccaagccccuccuccccgucggcaacaagccccucaucugguacccccucaaccuccucgagcgcgucggcuucgaggaggucaucgucgucaccacccgcgacguccagaaggcccucugcgccgaguucaagaugaagaugaagcccgacaucgucugcauccccgacgacgccgacaugggcaccgccgacucccuccgcuacaucuaccccaagcucaagaccgacguccucguccucuccugcgaccucaucaccgacgucgcccuccacgaggucgucgaccucuuccgcgccuacgacgccucccucgccaugcucaugcgcaagggccaggacuccaucgagcccguccccggccagaagggcaagaagaaggccgucgagcagcgcgacuucaucggcgucgacuccaccggcaagcgccuccucuucauggccaacgaggccgaccucgacgaggagcucgucaucaagggcuccauccuccagaaguccaucaccuccauccgcuccgagcucauccccuaccucguccgcaagcaguucuccuccgccuccucccagcagggccaggaggagaaggaggaggaccucaagaagaaggagcucaagucccucgacaucuacuccuucaucaaggaggccaacacccucaaccucgcccccuacgacgccugcuggaacgccugccgcggcgaccgcugggaggaccucucccgcucccagguccgcugcuacguccacaucaugaaggagggccucugcucccgcgucuccacccucggccucuacauggaggccaaccgccagguccccaagcuccucuccgcccucugccccgaggagccccccguccacuccuccgcccagaucgucuccaagcaccucgucggcgucgacucccucaucggccccgagacccagaucggcgagaaguccuccaucaagcgcuccgucaucggcuccuccugccucaucaaggaccgcgucaccaucaccaacugccuccucaugaacuccgucaccgucgaggagggcuccaacauccagggcuccgucaucugcaacaacgccgucaucgagaagggcgccgacaucaaggacugccucaucggcuccggccagcgcaucgaggccaaggccaagcgcgucaacgaggucaucgucggcaacgaccagcucauggagaucuga

SEQ ID NO: 42629 - RNA, 1572 nt, Artificial Sequence
  derived and/or modified sequence opt2 from EIF2B4__Homo_sapiens__NP_001029288
auggccgccgucgccgucgccguccgcgaggacuccggcuccggcaugaaggccgagcucccccccggccccggcgccgucggccgcgagaugaccaaggaggagaagcuccagcuccgcaaggagaagaagcagcagaagaagaagcgcaaggaggagaagggcgccgagcccgagaccggcuccgccgucuccgccgcccagugccaggucggccccacccgcgagcuccccgaguccggcauccagcucggcaccccccgcgagaagguccccgccggccgcuccaaggccgagcuccgcgccgagcgccgcgccaagcaggaggccgagcgcgcccucaagcaggcccgcaagggcgagcagggcggccccccccccaaggccucccccuccaccgccggcgagacccccuccggcgucaagcgccuccccgaguacccccaggucgacgaccuccuccuccgccgccucgucaagaagcccgagcgccagcagguccccacccgcaaggacuacggcuccaaggucucccucuucucccaccucccccaguacucccgccagaacucccucacccaguucauguccauccccuccuccgucauccaccccgccaugguccgccucggccuccaguacucccagggccucgucuccggcuccaacgcccgcugcaucgcccuccuccgcgcccuccagcaggucauccaggacuacaccaccccccccaacgaggagcucucccgcgaccucgucaacaagcucaagcccuacauguccuuccucacccagugccgcccccucuccgccuccaugcacaacgccaucaaguuccucaacaaggagaucaccuccgucggcuccuccaagcgcgaggaggaggccaaguccgagcuccgcgccgccaucgaccgcuacguccaggagaagaucguccucgccgcccaggccaucucccgcuucgccuaccagaagaucuccaacggcgacgucauccucgucuacggcugcuccucccucgucucccgcauccuccaggaggccuggaccgagggccgccgcuuccgcgucgucgucgucgacucccgccccuggcucgagggccgccacacccuccgcucccucguccacgccggcguccccgccuccuaccuccucauccccgccgccuccuacguccuccccgaggucuccaagguccuccucggcgcccacgcccuccucgccaacggcuccgucaugucccgcgucggcaccgcccagcucgcccucgucgcccgcgcccacaacguccccguccucgucugcugcgagaccuacaaguucugcgagcgcguccagaccgacgccuucgucuccaacgagcucgacgaccccgacgaccuccagugcaagcgcggcgagcacgucgcccucgccaacuggcagaaccacgccucccuccgccuccucaaccucgucuacgacgucaccccccccgagcucgucgaccucgucaucaccgagcucggcaugauccccugcuccuccguccccgucguccuccgcgucaaguccuccgaccaguga

SEQ ID NO: 42630 - RNA, 2166 nt, Artificial Sequence
  derived and/or modified sequence opt2 from EIF2B5__Homo_sapiens__NP_003898
auggccgcccccgucgucgccccccccggcgucgucgucucccgcgccaacaagcgcuccggcgccggccccggcggcuccggcggcggcggcgcccgcggcgccgaggaggagcccccccccccccuccaggccguccucgucgccgacuccuucgaccgccgcuucuuccccaucuccaaggaccagccccgcguccuccucccccucgccaacgucgcccucaucgacuacacccucgaguuccucaccgccaccggcguccaggagaccuucgucuucugcugcuggaaggccgcccagaucaaggagcaccuccucaaguccaaguggugccgccccaccucccucaacgucguccgcaucaucaccuccgagcucuaccgcucccucggcgacguccuccgcgacgucgacgccaaggcccucguccgcuccgacuuccuccucgucuacggcgacgucaucuccaacaucaacaucacccgcgcccucgaggagcaccgccuccgccgcaagcucgagaagaacgucuccgucaugaccaugaucuucaaggaguccucccccucccaccccacccgcugccacgaggacaacgucgucgucgccgucgacuccaccaccaaccgcguccuccacuuccagaagacccagggccuccgccgcuucgccuucccccucucccucuuccagggcuccuccgacggcgucgagguccgcuacgaccuccucgacugccacaucuccaucugcuccccccaggucgcccagcucuucaccgacaacuucgacuaccagacccgcgacgacuucguccgcggccuccucgucaacgaggagauccucggcaaccagauccacaugcacgucaccgccaaggaguacggcgcccgcgucuccaaccuccacauguacuccgccgucugcgccgacgucauccgccgcugggucuacccccucacccccgaggccaacuucaccgacuccaccacccaguccugcacccacucccgccacaacaucuaccgcggccccgaggucucccucggccacggcuccauccucgaggagaacguccuccucggcuccggcaccgucaucggcuccaacugcuucaucaccaacuccgucaucggccccggcugccacaucggcgacaacgucguccucgaccagaccuaccucuggcagggcguccgcgucgccgccggcgcccagauccaccagucccuccucugcgacaacgccgaggucaaggagcgcgucacccucaagccccgcuccguccucaccucccaggucgucgucggccccaacaucacccuccccgagggcuccgucaucucccuccacccccccgacgccgaggaggacgaggacgacggcgaguucuccgacgacuccggcgccgaccaggagaaggacaaggucaagaugaagggcuacaaccccgccgaggucggcgccgccggcaagggcuaccucuggaaggccgccggcaugaacauggaggaggaggaggagcuccagcagaaccucuggggccucaagaucaacauggaggaggaguccgaguccgaguccgagcaguccauggacuccgaggagcccgacucccgcggcggcuccccccagauggacgacaucaaggucuuccagaacgagguccucggcacccuccagcgcggcaaggaggagaacaucuccugcgacaaccucguccucgagaucaacucccucaaguacgccuacaacaucucccucaaggaggucaugcagguccucucccacgucguccucgaguucccccuccagcagauggacuccccccucgacuccucccgcuacugcgcccuccuccucccccuccucaaggccuggucccccgucuuccgcaacuacaucaagcgcgccgccgaccaccucgaggcccucgccgccaucgaggacuucuuccucgagcacgaggcccucggcaucuccauggccaagguccucauggccuucuaccagcucgagauccucgccgaggagaccauccucuccugguucucccagcgcgacaccaccgacaagggccagcagcuccgcaagaaccagcagcuccagcgcuucauccaguggcucaaggaggccgaggaggaguccuccgaggacgacuga

SEQ ID NO: 42631 - RNA, 948 nt, Artificial Sequence
  derived and/or modified sequence opt2 from EIF2S1__Homo_sapiens__NP_004085
augcccggccucuccugccgcuucuaccagcacaaguuccccgaggucgaggacgucgucauggucaacguccgcuccaucgccgagaugggcgccuacgucucccuccucgaguacaacaacaucgagggcaugauccuccucuccgagcucucccgccgccgcauccgcuccaucaacaagcucauccgcaucggccgcaacgagugcgucgucgucauccgcgucgacaaggagaagggcuacaucgaccucuccaagcgccgcgucucccccgaggaggccaucaagugcgaggacaaguucaccaaguccaagaccgucuacuccauccuccgccacgucgccgagguccucgaguacaccaaggacgagcagcucgagucccucuuccagcgcaccgccugggucuucgacgacaaguacaagcgccccggcuacggcgccuacgacgccuucaagcacgccgucuccgaccccuccauccucgacucccucgaccucaacgaggacgagcgcgagguccucaucaacaacaucaaccgccgccucaccccccaggccgucaagauccgcgccgacaucgaggucgccugcuacggcuacgagggcaucgacgccgucaaggaggcccuccgcgccggccucaacugcuccaccgagaacaugcccaucaagaucaaccucaucgcccccccccgcuacgucaugaccaccaccacccucgagcgcaccgagggccucuccguccucucccaggccauggccgucaucaaggagaagaucgaggagaagcgcggcgucuucaacguccagauggagcccaaggucgucaccgacaccgacgagaccgagcucgcccgccagauggagcgccucgagcgcgagaacgccgaggucgacggcgacgacgacgccgaggagauggaggccaaggccgaggacuga

SEQ ID NO: 42632 - RNA, 1002 nt, Artificial Sequence
  derived and/or modified sequence opt2 from EIF2S2__Homo_sapiens__NP_003899
auguccggcgacgagaugaucuucgaccccaccauguccaagaagaagaagaagaagaagaagcccuucaugcucgacgaggagggcgacacccagaccgaggagacccagcccuccgagaccaaggaggucgagcccgagcccaccgaggacaaggaccucgaggccgacgaggaggacacccgcaagaaggacgccuccgacgaccucgacgaccucaacuucuucaaccagaagaagaagaagaagaagaccaagaagaucuucgacaucgacgaggccgaggagggcgucaaggaccucaagaucgaguccgacguccaggagcccaccgagcccgaggacgaccucgacaucaugcucggcaacaagaagaagaagaagaagaacgucaaguuccccgacgaggacgagauccucgagaaggacgaggcccucgaggacgaggacaacaagaaggacgacggcaucuccuucuccaaccagaccggccccgccugggccggcuccgagcgcgacuacaccuacgaggagcuccucaaccgcgucuucaacaucaugcgcgagaagaaccccgacauggucgccggcgagaagcgcaaguucgucaugaagcccccccaggucguccgcgucggcaccaagaagaccuccuucgucaacuucaccgacaucugcaagcuccuccaccgccagcccaagcaccuccucgccuuccuccucgccgagcucggcaccuccggcuccaucgacggcaacaaccagcucgucaucaagggccgcuuccagcagaagcagaucgagaacguccuccgccgcuacaucaaggaguacgucaccugccacaccugccgcucccccgacaccauccuccagaaggacacccgccucuacuuccuccagugcgagaccugccacucccgcugcuccgucgccuccaucaagaccggcuuccaggccgucaccggcaagcgcgcccagcuccgcgccaaggccaacuga

SEQ ID NO: 42633 - RNA, 1419 nt, Artificial Sequence
  derived and/or modified sequence opt2 from EIF2S3__Homo_sapiens__NP_001406
auggccggcggcgaggccggcgucacccucggccagccccaccucucccgccaggaccucaccacccucgacgucaccaagcucaccccccucucccacgaggucaucucccgccaggccaccaucaacaucggcaccaucggccacgucgcccacggcaaguccaccgucgucaaggccaucuccggcguccacaccguccgcuucaagaacgagcucgagcgcaacaucaccaucaagcucggcuacgccaacgccaagaucuacaagcucgacgaccccuccugcccccgccccgagugcuaccgcuccugcggcuccuccacccccgacgaguuccccaccgacauccccggcaccaagggcaacuucaagcucguccgccacgucuccuucgucgacugccccggccacgacauccucauggccaccaugcucaacggcgccgccgucauggacgccgcccuccuccucaucgccggcaacgaguccugcccccagccccagaccuccgagcaccucgccgccaucgagaucaugaagcucaagcacauccucauccuccagaacaagaucgaccucgucaaggagucccaggccaaggagcaguacgagcagauccucgccuucguccagggcaccgucgccgagggcgcccccaucauccccaucuccgcccagcucaaguacaacaucgaggucgucugcgaguacaucgucaagaagauccccguccccccccgcgacuucaccuccgagccccgccucaucgucauccgcuccuucgacgucaacaagcccggcugcgaggucgacgaccucaagggcggcgucgccggcggcuccauccucaagggcguccucaaggucggccaggagaucgagguccgccccggcaucgucuccaaggacuccgagggcaagcucaugugcaagcccaucuucuccaagaucgucucccucuucgccgagcacaacgaccuccaguacgccgcccccggcggccucaucggcgucggcaccaagaucgaccccacccucugccgcgccgaccgcauggucggccagguccucggcgccgucggcgcccuccccgagaucuucaccgagcucgagaucuccuacuuccuccuccgccgccuccucggcguccgcaccgagggcgacaagaaggccgccaagguccagaagcucuccaagaacgagguccucauggucaacaucggcucccucuccaccggcggccgcgucuccgccgucaaggccgaccucggcaagaucguccucaccaaccccgucugcaccgaggucggcgagaagaucgcccucucccgccgcgucgagaagcacuggcgccucaucggcuggggccagauccgccgcggcgucaccaucaagcccaccgucgacgacgacuga

SEQ ID NO: 42634 - RNA, 4149 nt, Artificial Sequence
  derived and/or modified sequence opt2 from EIF3A__Homo_sapiens__NP_003741
augcccgccuacuuccagcgccccgagaacgcccucaagcgcgccaacgaguuccucgaggucggcaagaagcagcccgcccucgacguccucuacgacgucaugaaguccaagaagcaccgcaccuggcagaagauccacgagcccaucaugcucaaguaccucgagcucugcgucgaccuccgcaagucccaccucgccaaggagggccucuaccaguacaagaacaucugccagcaggucaacaucaagucccucgaggacgucguccgcgccuaccucaagauggccgaggagaagaccgaggccgccaaggaggagucccagcagaugguccucgacaucgaggaccucgacaacauccagacccccgaguccguccuccucuccgccgucuccggcgaggacacccaggaccgcaccgaccgccuccuccucacccccugggucaaguuccucugggaguccuaccgccagugccucgaccuccuccgcaacaacucccgcgucgagcgccucuaccacgacaucgcccagcaggccuucaaguucugccuccaguacacccgcaaggccgaguuccgcaagcucugcgacaaccuccgcaugcaccucucccagauccagcgccaccacaaccaguccaccgccaucaaccucaacaaccccgagucccaguccaugcaccucgagacccgccucguccagcucgacuccgccaucuccauggagcucuggcaggaggccuucaaggccgucgaggacauccacggccucuucucccucuccaagaagccccccaagccccagcucauggccaacuacuacaacaaggucuccaccgucuucuggaaguccggcaacgcccucuuccacgccuccacccuccaccgccucuaccaccucucccgcgagaugcgcaagaaccucacccaggacgagaugcagcgcauguccacccgcguccuccucgccacccucuccauccccaucacccccgagcgcaccgacaucgcccgccuccucgacauggacggcaucaucgucgagaagcagcgccgccucgccacccuccucggccuccaggccccccccacccgcaucggccucaucaacgacaugguccgcuucaacguccuccaguacgucguccccgaggucaaggaccucuacaacuggcucgaggucgaguucaacccccucaagcucugcgagcgcgucaccaagguccucaacuggguccgcgagcagcccgagaaggagcccgagcuccagcaguacgucccccagcuccagaacaacaccauccuccgccuccuccagcaggucucccagaucuaccaguccaucgaguucucccgccucaccucccucguccccuucgucgacgccuuccagcucgagcgcgccaucgucgacgccgcccgccacugcgaccuccagguccgcaucgaccacaccucccgcacccucuccuucggcuccgaccucaacuacgccacccgcgaggacgcccccaucggcccccaccuccaguccaugcccuccgagcagauccgcaaccagcucaccgccauguccuccguccucgccaaggcccucgaggucaucaagcccgcccacauccuccaggagaaggaggagcagcaccagcucgccgucaccgccuaccucaagaacucccgcaaggagcaccagcgcauccucgcccgccgccagaccaucgaggagcgcaaggagcgccucgagucccucaacauccagcgcgagaaggaggagcucgagcagcgcgaggccgagcuccagaagguccgcaaggccgaggaggagcgccuccgccaggaggccaaggagcgcgagaaggagcgcauccuccaggagcacgagcagaucaagaagaagaccguccgcgagcgccucgagcagaucaagaagaccgagcucggcgccaaggccuucaaggacaucgacaucgaggaccucgaggagcucgaccccgacuucaucauggccaagcaggucgagcagcucgagaaggagaagaaggagcuccaggagcgccucaagaaccaggagaagaagaucgacuacuucgagcgcgccaagcgccucgaggagaucccccucaucaaguccgccuacgaggagcagcgcaucaaggacauggaccucugggagcagcaggaggaggagcgcaucaccaccaugcagcucgagcgcgagaaggcccucgagcacaagaaccgcaugucccgcaugcucgaggaccgcgaccucuucgucaugcgccucaaggccgcccgccaguccgucuacgaggagaagcucaagcaguucgaggagcgccucgccgaggagcgccacaaccgccucgaggagcgcaagcgccagcgcaaggaggagcgccgcaucaccuacuaccgcgagaaggaggaggaggagcagcgccgcgccgaggagcagaugcucaaggagcgcgaggagcgcgagcgcgccgagcgcgccaagcgcgaggaggagcuccgcgaguaccaggagcgcgucaagaagcucgaggaggucgagcgcaagaagcgccagcgcgagcucgagaucgaggagcgcgagcgccgccgcgaggaggagcgccgccucggcgacuccucccucucccgcaaggacucccgcuggggcgaccgcgacuccgagggcaccuggcgcaagggccccgaggccgacuccgaguggcgccgcggcccccccgagaaggaguggcgccgcggcgagggccgcgacgaggaccgcucccaccgccgcgacgaggagcgcccccgccgccucggcgacgacgaggaccgcgagcccucccuccgccccgacgacgaccgcgucccccgccgcggcauggacgacgaccgcggcccccgccgcggccccgaggaggaccgcuucucccgccgcggcgccgacgacgaccgccccuccuggcgcaacaccgacgacgaccgccccccccgccgcaucgccgacgaggaccgcggcaacuggcgccacgccgacgacgaccgccccccccgccgcggccucgacgaggaccgcggcuccuggcgcaccgccgacgaggaccgcggcccccgccgcggcauggacgacgaccgcggcccccgccgcggcggcgccgacgacgagcgcuccuccuggcgcaacgccgacgacgaccgcggcccccgccgcggccucgacgacgaccgcggcccccgccgcggcauggacgacgaccgcggcccccgccgcggcauggacgacgaccgcggcccccgccgcggcauggacgacgaccgcggcccccgccgcggccucgacgacgaccgcggccccuggcgcaacgccgacgacgaccgcaucccccgccgcggcgccgaggacgaccgcggccccuggcgcaacauggacgacgaccgccucucccgccgcgccgacgacgaccgcuucccccgccgcggcgacgacucccgccccggccccuggcgcccccucgucaagcccggcggcuggcgcgagaaggagaaggcccgcgaggaguccuggggccccccccgcgagucccgccccuccgaggagcgcgagugggaccgcgagaaggagcgcgaccgcgacaaccaggaccgcgaggagaacgacaaggaccccgagcgcgagcgcgaccgcgagcgcgacgucgaccgcgaggaccgcuuccgccgcccccgcgacgagggcggcuggcgccgcggccccgccgaggaguccuccuccuggcgcgacuccucccgccgcgacgaccgcgaccgcgacgaccgccgccgcgagcgcgacgaccgccgcgaccuccgcgagcgccgcgaccuccgcgacgaccgcgaccgccgcggccccccccuccgcuccgagcgcgaggaggucuccuccuggcgccgcgccgacgaccgcaaggacgaccgcgucgaggagcgcgaccccccccgccgcguccccccccccgcccucucccgcgaccgcgagcgcgaccgcgaccgcgagcgcgagggcgagaaggagaaggccuccuggcgcgccgagaaggaccgcgagucccuccgccgcaccaagaacgagaccgacgaggacggcuggaccaccguccgccgcuga

SEQ ID NO: 42635 - RNA, 2445 nt, Artificial Sequence
  derived and/or modified sequence opt2 from EIF3B__Homo_sapiens__NP_001032360
augcaggacgccgagaacgucgccguccccgaggccgccgaggagcgcgccgagcccggccagcagcagcccgccgccgagcccccccccgccgagggccuccuccgccccgccggccccggcgcccccgaggccgccggcaccgaggccuccuccgaggaggucggcaucgccgaggccggccccgaguccgagguccgcaccgagcccgccgccgaggccgaggccgccuccggccccuccgagucccccuccccccccgccgccgaggagcuccccggcucccacgccgagccccccguccccgcccagggcgaggcccccggcgagcaggcccgcgacgagcgcuccgacucccgcgcccaggccgucuccgaggacgccggcggcaacgagggccgcgccgccgaggccgagccccgcgcccucgagaacggcgacgccgacgagcccuccuucuccgaccccgaggacuucgucgacgacgucuccgaggaggagcuccucggcgacguccucaaggaccgcccccaggaggccgacggcaucgacuccgucaucgucgucgacaacgucccccaggucggccccgaccgccucgagaagcucaagaacgucauccacaagaucuucuccaaguucggcaagaucaccaacgacuucuaccccgaggaggacggcaagaccaagggcuacaucuuccucgaguacgccucccccgcccacgccgucgacgccgucaagaacgccgacggcuacaagcucgacaagcagcacaccuuccgcgucaaccucuucaccgacuucgacaaguacaugaccaucuccgacgagugggacauccccgagaagcagcccuucaaggaccucggcaaccuccgcuacuggcucgaggaggccgagugccgcgaccaguacuccgucaucuucgaguccggcgaccgcaccuccaucuucuggaacgacgucaaggaccccgucuccaucgaggagcgcgcccgcuggaccgagaccuacguccgcuggucccccaagggcaccuaccucgccaccuuccaccagcgcggcaucgcccucuggggcggcgagaaguucaagcagauccagcgcuucucccaccagggcguccagcucaucgacuucucccccugcgagcgcuaccucgucaccuucuccccccucauggacacccaggacgacccccaggccaucaucaucugggacauccucaccggccacaagaagcgcggcuuccacugcgaguccuccgcccacuggcccaucuucaaguggucccacgacggcaaguucuucgcccgcaugacccucgacacccucuccaucuacgagacccccuccaugggccuccucgacaagaagucccucaagaucuccggcaucaaggacuucuccuggucccccggcggcaacaucaucgccuucuggguccccgaggacaaggacauccccgcccgcgucacccucaugcagcuccccacccgccaggagauccgcguccgcaaccucuucaacgucgucgacugcaagcuccacuggcagaagaacggcgacuaccucugcgucaaggucgaccgcacccccaagggcacccagggcgucgucaccaacuucgagaucuuccgcaugcgcgagaagcagguccccgucgacgucgucgagaugaaggagaccaucaucgccuucgccugggagcccaacggcuccaaguucgccguccuccacggcgaggccccccgcaucuccgucuccuucuaccacgucaagaacaacggcaagaucgagcucaucaagauguucgacaagcagcaggccaacaccaucuucugguccccccagggccaguucgucguccucgccggccuccgcuccaugaacggcgcccucgccuucgucgacaccuccgacugcaccgucaugaacaucgccgagcacuacauggccuccgacgucgagugggaccccaccggccgcuacgucgucaccuccgucuccugguggucccacaaggucgacaacgccuacuggcucuggaccuuccagggccgccuccuccagaagaacaacaaggaccgcuucugccagcuccucuggcgcccccgcccccccacccuccucucccaggagcagaucaagcagaucaagaaggaccucaagaaguacuccaagaucuucgagcagaaggaccgccucucccaguccaaggccuccaaggagcucgucgagcgccgccgcaccaugauggaggacuuccgcaaguaccgcaagauggcccaggagcucuacauggagcagaagaacgagcgccucgagcuccgcggcggcgucgacaccgacgagcucgacuccaacgucgacgacugggaggaggagaccaucgaguucuucgucaccgaggagaucaucccccucggcaaccaggaguga

SEQ ID NO: 42636 - RNA, 2742 nt, Artificial Sequence
  derived and/or modified sequence opt2 from EIF3C__Homo_sapiens__NP_001254503
augucccgcuucuucaccaccggcuccgacuccgaguccgaguccucccucuccggcgaggagcucgucaccaagcccgucggcggcaacuacggcaagcagccccuccuccucuccgaggacgaggaggacaccaagcgcgucguccgcuccgccaaggacaagcgcuucgaggagcucaccaaccucauccgcaccauccgcaacgccaugaagauccgcgacgucaccaagugccucgaggaguucgagcuccucggcaaggccuacggcaaggccaaguccaucgucgacaaggagggcgucccccgcuucuacauccgcauccucgccgaccucgaggacuaccucaacgagcucugggaggacaaggagggcaagaagaagaugaacaagaacaacgccaaggcccucuccacccuccgccagaagauccgcaaguacaaccgcgacuucgagucccacaucaccuccuacaagcagaaccccgagcaguccgccgacgaggacgccgagaagaacgaggaggacuccgagggcuccuccgacgaggacgaggacgaggacggcgucuccgccgccaccuuccucaagaagaaguccgaggcccccuccggcgagucccgcaaguuccucaagaagauggacgacgaggacgaggacuccgaggacuccgaggacgacgaggacugggacaccggcuccaccuccuccgacuccgacuccgaggaggaggagggcaagcagaccgcccucgccucccgcuuccucaagaaggcccccaccaccgacgaggacaagaaggccgccgagaagaagcgcgaggacaaggccaagaagaagcacgaccgcaaguccaagcgccucgacgaggaggaggaggacaacgagggcggcgagugggagcgcguccgcggcggcgucccccucgucaaggagaagcccaagauguucgccaagggcaccgagaucacccacgccgucgucaucaagaagcucaacgagauccuccaggcccgcggcaagaagggcaccgaccgcgccgcccagaucgagcuccuccagcuccucguccagaucgccgccgagaacaaccucggcgagggcgucaucgucaagaucaaguucaacaucaucgccucccucuacgacuacaaccccaaccucgccaccuacaugaagcccgagauguggggcaagugccucgacugcaucaacgagcucauggacauccucuucgccaaccccaacaucuucgucggcgagaacauccucgaggaguccgagaaccuccacaacgccgaccagccccuccgcguccgcggcugcauccucacccucgucgagcgcauggacgaggaguucaccaagaucaugcagaacaccgacccccacucccaggaguacgucgagcaccucaaggacgaggcccaggucugcgccaucaucgagcgcguccagcgcuaccucgaggagaagggcaccaccgaggaggucugccgcaucuaccuccuccgcauccuccacaccuacuacaaguucgacuacaaggcccaccagcgccagcucaccccccccgagggcuccuccaaguccgagcaggaccaggccgagaacgagggcgaggacuccgccguccucauggagcgccucugcaaguacaucuacgccaaggaccgcaccgaccgcauccgcaccugcgccauccucugccacaucuaccaccacgcccuccacucccgcugguaccaggcccgcgaccucaugcucaugucccaccuccaggacaacauccagcacgccgacccccccguccagauccucuacaaccgcaccaugguccagcucggcaucugcgccuuccgccagggccucaccaaggacgcccacaacgcccuccucgacauccaguccuccggccgcgccaaggagcuccucggccagggccuccuccuccgcucccuccaggagcgcaaccaggagcaggagaaggucgagcgccgccgccagguccccuuccaccuccacaucaaccucgagcuccucgagugcgucuaccucgucuccgccaugcuccucgagauccccuacauggccgcccacgaguccgacgcccgccgccgcaugaucuccaagcaguuccaccaccagcuccgcgucggcgagcgccagccccuccucggcccccccgaguccaugcgcgagcacgucgucgccgccuccaaggccaugaagaugggcgacuggaagaccugccacuccuucaucaucaacgagaagaugaacggcaaggucugggaccucuuccccgaggccgacaagguccgcaccaugcucguccgcaagauccaggaggagucccuccgcaccuaccucuucaccuacuccuccgucuacgacuccaucuccauggagacccucuccgacauguucgagcucgaccuccccaccguccacuccaucaucuccaagaugaucaucaacgaggagcucauggccucccucgaccagcccacccagaccgucgucaugcaccgcaccgagcccaccgcccagcagaaccucgcccuccagcucgccgagaagcucggcucccucgucgagaacaacgagcgcgucuucgaccacaagcagggcaccuacggcggcuacuuccgcgaccagaaggacggcuaccgcaagaacgagggcuacaugcgccgcggcggcuaccgccagcagcagucccagaccgccuacuga

SEQ ID NO: 42637 - RNA, 1338 nt, Artificial Sequence
  derived and/or modified sequence opt2 from EIF3E__Homo_sapiens__NP_001559
auggccgaguacgaccucaccacccgcaucgcccacuuccucgaccgccaccucgucuucccccuccucgaguuccucuccgucaaggagaucuacaacgagaaggagcuccuccagggcaagcucgaccuccucuccgacaccaacauggucgacuucgccauggacgucuacaagaaccucuacuccgacgacaucccccacgcccuccgcgagaagcgcaccaccgucgucgcccagcucaagcagcuccaggccgagaccgagcccaucgucaagauguucgaggaccccgagaccacccgccagaugcaguccacccgcgacggccgcaugcucuucgacuaccucgccgacaagcacggcuuccgccaggaguaccucgacacccucuaccgcuacgccaaguuccaguacgagugcggcaacuacuccggcgccgccgaguaccucuacuucuuccgcguccucguccccgccaccgaccgcaacgcccucuccucccucuggggcaagcucgccuccgagauccucaugcagaacugggacgccgccauggaggaccucacccgccucaaggagaccaucgacaacaacuccgucuccuccccccuccagucccuccagcagcgcaccuggcucauccacuggucccucuucgucuucuucaaccaccccaagggccgcgacaacaucaucgaccucuuccucuaccagccccaguaccucaacgccauccagaccaugugcccccacauccuccgcuaccucaccaccgccgucaucaccaacaaggacguccgcaagcgccgccagguccucaaggaccucgucaaggucauccagcaggaguccuacaccuacaaggaccccaucaccgaguucgucgagugccucuacgucaacuucgacuucgacggcgcccagaagaagcuccgcgagugcgaguccguccucgucaacgacuucuuccucgucgccugccucgaggacuucaucgagaacgcccgccucuucaucuucgagaccuucugccgcauccaccagugcaucuccaucaacaugcucgccgacaagcucaacaugacccccgaggaggccgagcgcuggaucgucaaccucauccgcaacgcccgccucgacgccaagaucgacuccaagcucggccacgucgucaugggcaacaacgccgucucccccuaccagcaggucaucgagaagaccaagucccucuccuuccgcucccagaugcucgccaugaacaucgagaagaagcucaaccagaacucccgcuccgaggcccccaacugggccacccaggacuccggcuucuacuga

SEQ ID NO: 42638 - RNA, 1074 nt, Artificial Sequence
  derived and/or modified sequence opt2 from EIF3F__Homo_sapiens__NP_003745
auggccacccccgccguccccgucuccgccccccccgccacccccacccccguccccgccgccgcccccgccuccguccccgcccccacccccgcccccgccgccgcccccguccccgccgccgcccccgccuccuccuccgaccccgccgccgccgccgccgccaccgccgcccccggccagacccccgccuccgcccaggcccccgcccagacccccgcccccgcccuccccggccccgcccuccccggccccuuccccggcggccgcgucguccgccuccaccccgucauccucgccuccaucgucgacuccuacgagcgccgcaacgagggcgccgcccgcgucaucggcacccuccucggcaccgucgacaagcacuccgucgaggucaccaacugcuucuccgucccccacaacgaguccgaggacgaggucgccgucgacauggaguucgccaagaacauguacgagcuccacaagaaggucucccccaacgagcucauccucggcugguacgccaccggccacgacaucaccgagcacuccguccucauccacgaguacuacucccgcgaggcccccaaccccauccaccucaccgucgacaccucccuccagaacggccgcauguccaucaaggccuacgucuccacccucaugggcguccccggccgcaccaugggcgucauguucaccccccucaccgucaaguacgccuacuacgacaccgagcgcaucggcgucgaccucaucaugaagaccugcuucucccccaaccgcgucaucggccucuccuccgaccuccagcaggucggcggcgccuccgcccgcauccaggacgcccucuccaccguccuccaguacgccgaggacguccucuccggcaaggucuccgccgacaacaccgucggccgcuuccucaugucccucgucaaccagguccccaagaucguccccgacgacuucgagaccaugcucaacuccaacaucaacgaccuccucauggucaccuaccucgccaaccucacccagucccagaucgcccucaacgagaagcucgucaaccucuga

SEQ ID NO: 42639 - RNA, 1059 nt, Artificial Sequence
  derived and/or modified sequence opt2 from EIF3H__Homo_sapiens__NP_003747
auggccucccgcaaggagggcaccggcuccaccgccaccuccuccuccuccaccgccggcgccgccggcaagggcaagggcaagggcggcuccggcgacuccgccgucaagcagguccagaucgacggccucgucguccucaagaucaucaagcacuaccaggaggagggccagggcaccgaggucguccagggcguccuccucggccucgucgucgaggaccgccucgagaucaccaacugcuuccccuucccccagcacaccgaggacgacgccgacuucgacgagguccaguaccagauggagaugaugcgcucccuccgccacgucaacaucgaccaccuccacgucggcugguaccaguccaccuacuacggcuccuucgucacccgcgcccuccucgacucccaguucuccuaccagcacgccaucgaggaguccgucguccucaucuacgaccccaucaagaccgcccagggcucccucucccucaaggccuaccgccucacccccaagcucauggaggucugcaaggagaaggacuucucccccgaggcccucaagaaggccaacaucaccuucgaguacauguucgaggagguccccaucgucaucaagaacucccaccucaucaacguccucaugugggagcucgagaagaaguccgccgucgccgacaagcacgagcuccucucccucgccuccuccaaccaccucggcaagaaccuccagcuccucauggaccgcgucgacgagaugucccaggacaucgucaaguacaacaccuacaugcgcaacaccuccaagcagcagcagcagaagcaccaguaccagcagcgccgccagcaggagaacaugcagcgccagucccgcggcgagcccccccuccccgaggaggaccucuccaagcucuucaagcccccccagccccccgcccgcauggacucccuccucaucgccggccagaucaacaccuacugccagaacaucaaggaguucaccgcccagaaccucggcaagcucuucauggcccaggcccuccaggaguacaacaacuga

SEQ ID NO: 42640 - RNA, 630 nt, Artificial Sequence
  derived and/or modified sequence opt2 from EIF3J__Homo_sapiens__NP_001271265
auggccgccgccgccgccgccgccggcgacuccgacuccugggacgccgacgccuucuccgucgaggaccccguccgcaaggucggcggcggcggcaccgccggcggcgaccgcugggagggcgaggacgaggacgaggacgucaagcucgaggagcccgaggagcccaagguccucacccccgaggagcagcucgccgacaagcuccgccucaagaagcuccaggaggaguccgaccucgagcucgccaaggagaccuucggcgucaacaacgccgucuacggcaucgacgccaugaaccccuccucccgcgacgacuucaccgaguucggcaagcuccucaaggacaagaucacccaguacgagaagucccucuacuacgccuccuuccucgagguccucguccgcgacgucugcaucucccucgagaucgacgaccucaagaagaucaccaacucccucaccguccucugcuccgagaagcagaagcaggagaagcaguccaaggccaagaagaagaagaagggcgucguccccggcggcggccucaaggccaccaugaaggacgaccucgccgacuacggcggcuacgacggcggcuacguccaggacuacgaggacuucauguga

SEQ ID NO: 42641 - RNA, 657 nt, Artificial Sequence
  derived and/or modified sequence opt2 from EIF3K__Homo_sapiens__NP_037366
auggccauguucgagcagaugcgcgccaacgucggcaagcuccucaagggcaucgaccgcuacaaccccgagaaccucgccacccucgagcgcuacgucgagacccaggccaaggagaacgccuacgaccucgaggccaaccucgccguccucaagcucuaccaguucaaccccgccuucuuccagaccaccgucaccgcccagauccuccucaaggcccucaccaaccucccccacaccgacuucacccucugcaagugcaugaucgaccaggcccaccaggaggagcgccccauccgccagauccucuaccucggcgaccuccucgagaccugccacuuccaggccuucuggcaggcccucgacgagaacauggaccuccucgagggcaucaccggcuucgaggacuccguccgcaaguucaucugccacgucgucggcaucaccuaccagcacaucgaccgcuggcuccucgccgagaugcucggcgaccucuccgacucccagcucaaggucuggauguccaaguacggcugguccgccgacgaguccggccagaucuucaucugcucccaggaggaguccaucaagcccaagaacaucgucgagaagaucgacuucgacuccgucuccuccaucauggccuccucccaguga

SEQ ID NO: 42642 - RNA, 1125 nt, Artificial Sequence
  derived and/or modified sequence opt2 from EIF3M__Homo_sapiens__NP_006351
auguccguccccgccuucaucgacaucuccgaggaggaccaggccgccgagcuccgcgccuaccucaaguccaagggcgccgagaucuccgaggagaacuccgagggcggccuccacgucgaccucgcccagaucaucgaggccugcgacgucugccucaaggaggacgacaaggacgucgaguccgucaugaacuccgucgucucccuccuccucauccucgagcccgacaagcaggaggcccucaucgagucccucugcgagaagcucgucaaguuccgcgagggcgagcgccccucccuccgccuccagcuccucuccaaccucuuccacggcauggacaagaacacccccguccgcuacaccgucuacugcucccucaucaaggucgccgccuccugcggcgccauccaguacauccccaccgagcucgaccagguccgcaaguggaucuccgacuggaaccucaccaccgagaagaagcacacccuccuccgccuccucuacgaggcccucgucgacugcaagaaguccgacgccgccuccaaggucauggucgagcuccucggcuccuacaccgaggacaacgccucccaggcccgcgucgacgcccaccgcugcaucguccgcgcccucaaggaccccaacgccuuccucuucgaccaccuccucacccucaagcccgucaaguuccucgagggcgagcucauccacgaccuccucaccaucuucgucuccgccaagcucgccuccuacgucaaguucuaccagaacaacaaggacuucaucgacucccucggccuccuccacgagcagaacauggccaagaugcgccuccucaccuucaugggcauggccgucgagaacaaggagaucuccuucgacaccaugcagcaggagcuccagaucggcgccgacgacgucgaggccuucgucaucgacgccguccgcaccaagauggucuacugcaagaucgaccagacccagcgcaaggucgucgucucccacuccacccaccgcaccuucggcaagcagcaguggcagcagcucuacgacacccucaacgccuggaagcagaaccucaacaaggucaagaacucccuccucucccucuccgacaccuga

SEQ ID NO: 42643 - RNA, 1044 nt, Artificial Sequence
  derived and/or modified sequence opt2 from EIF4A1__Homo_sapiens__NP_001191439
auguccgccucccaggacucccgcucccgcgacaacggccccgacggcauggagcccgagggcgucaucgaguccaacuggaacgagaucgucgacuccuucgacgacaugaaccucuccgagucccuccuccgcggcaucuacgccuacggcuucgagaagcccuccgccauccagcagcgcgccauccuccccugcaucaagggcuacgacgucaucgcccaggcccaguccggcaccggcaagaccgccaccuucgccaucuccauccuccagcagaucgagcucgaccucaaggccacccaggcccucguccucgcccccacccgcgagcucgcccagcagauccagaaggucgucauggcccucggcgacuacaugggcgccuccugccacgccugcaucggcggcaccaacguccgcgccgagguccagaagcuccagauggaggccccccacaucaucgucggcacccccggccgcgucuucgacaugcucaaccgccgcuaccucucccccaaguacaucaagauguucguccucgacgaggccgacgagaugcucucccgcggcuucaaggaccagaucuacgacaucuuccagaagcucaacuccaacacccaggucguccuccucuccgccaccaugcccuccgacguccucgaggucaccaagaaguucaugcgcgaccccauccgcauccucgucaagaaggaggagcucacccucgagggcauccgccaguucuacaucaacgucgagcgcgaggaguggaagcucgacacccucugcgaccucuacgagacccucaccaucacccaggccgucaucuucaucaacacccgccgcaaggucgacuggcucaccgagaagaugcacgcccgcgacuucaccgucuccgccaugcacggcgacauggaccagaaggagcgcgacgucaucaugcgcgaguuccgcuccggcuccucccgcguccucaucaccaccgaccuccucggcaagcucuacccccagaaccgcucccgcuggaccgucuggcccuga

SEQ ID NO: 42644 - RNA, 1224 nt, Artificial Sequence
  derived and/or modified sequence opt2 from EIF4A2__Homo_sapiens__NP_001958
auguccggcggcuccgccgacuacaaccgcgagcacggcggccccgagggcauggaccccgacggcgucaucgaguccaacuggaacgagaucgucgacaacuucgacgacaugaaccucaaggagucccuccuccgcggcaucuacgccuacggcuucgagaagcccuccgccauccagcagcgcgccaucauccccugcaucaagggcuacgacgucaucgcccaggcccaguccggcaccggcaagaccgccaccuucgccaucuccauccuccagcagcucgagaucgaguucaaggagacccaggcccucguccucgcccccacccgcgagcucgcccagcagauccagaaggucauccucgcccucggcgacuacaugggcgccaccugccacgccugcaucggcggcaccaacguccgcaacgagaugcagaagcuccaggccgaggccccccacaucgucgucggcacccccggccgcgucuucgacaugcucaaccgccgcuaccucucccccaaguggaucaagauguucguccucgacgaggccgacgagaugcucucccgcggcuucaaggaccagaucuacgagaucuuccagaagcucaacaccuccauccaggucguccuccucuccgccaccaugcccaccgacguccucgaggucaccaagaaguucaugcgcgaccccauccgcauccucgucaagaaggaggagcucacccucgagggcaucaagcaguucuacaucaacgucgagcgcgaggaguggaagcucgacacccucugcgaccucuacgagacccucaccaucacccaggccgucaucuuccucaacacccgccgcaaggucgacuggcucaccgagaagaugcacgcccgcgacuucaccgucuccgcccuccacggcgacauggaccagaaggagcgcgacgucaucaugcgcgaguuccgcuccggcuccucccgcguccucaucaccaccgaccuccucgcccgcggcaucgacguccagcaggucucccucgucaucaacuacgaccuccccaccaaccgcgagaacuacauccaccgcaucggccgcggcggccgcuucggccgcaagggcgucgccaucaacuucgucaccgaggaggacaagcgcauccuccgcgacaucgagaccuucuacaacaccaccgucgaggagaugcccaugaacgucgccgaccucaucuga

SEQ ID NO: 42645 - RNA, 1236 nt, Artificial Sequence
  derived and/or modified sequence opt2 from EIF4A3__Homo_sapiens__NP_055555
auggccaccaccgccaccauggccaccuccggcuccgcccgcaagcgccuccucaaggaggaggacaugaccaaggucgaguucgagaccuccgaggaggucgacgucacccccaccuucgacaccaugggccuccgcgaggaccuccuccgcggcaucuacgccuacggcuucgagaagcccuccgccauccagcagcgcgccaucaagcagaucaucaagggccgcgacgucaucgcccagucccaguccggcaccggcaagaccgccaccuucuccaucuccguccuccagugccucgacauccagguccgcgagacccaggcccucauccucgcccccacccgcgagcucgccguccagauccagaagggccuccucgcccucggcgacuacaugaacguccagugccacgccugcaucggcggcaccaacgucggcgaggacauccgcaagcucgacuacggccagcacgucgucgccggcacccccggccgcgucuucgacaugauccgccgccgcucccuccgcacccgcgccaucaagaugcucguccucgacgaggccgacgagaugcucaacaagggcuucaaggagcagaucuacgacgucuaccgcuaccucccccccgccacccaggucguccucaucuccgccacccucccccacgagauccucgagaugaccaacaaguucaugaccgaccccauccgcauccucgucaagcgcgacgagcucacccucgagggcaucaagcaguucuucgucgccgucgagcgcgaggaguggaaguucgacacccucugcgaccucuacgacacccucaccaucacccaggccgucaucuucugcaacaccaagcgcaaggucgacuggcucaccgagaagaugcgcgaggccaacuucaccgucuccuccaugcacggcgacaugccccagaaggagcgcgaguccaucaugaaggaguuccgcuccggcgccucccgcguccucaucuccaccgacgucugggcccgcggccucgacgucccccaggucucccucaucaucaacuacgaccuccccaacaaccgcgagcucuacauccaccgcaucggccgcuccggccgcuacggccgcaagggcgucgccaucaacuucgucaagaacgacgacauccgcauccuccgcgacaucgagcaguacuacuccacccagaucgacgagaugcccaugaacgucgccgaccucaucuga

SEQ ID NO: 42646 - RNA, 1836 nt, Artificial Sequence
  derived and/or modified sequence opt2 from EIF4B__Homo_sapiens__NP_001408
auggccgccuccgccaagaagaagaacaagaagggcaagaccaucucccucaccgacuuccucgccgaggacggcggcaccggcggcggcuccaccuacgucuccaagcccgucuccugggccgacgagaccgacgaccucgagggcgacgucuccaccaccuggcacuccaacgacgacgacgucuaccgcgccccccccaucgaccgcuccauccuccccaccgccccccgcgccgcccgcgagcccaacaucgaccgcucccgccuccccaaguccccccccuacaccgccuuccucggcaaccuccccuacgacgucaccgaggaguccaucaaggaguucuuccgcggccucaacaucuccgccguccgccucccccgcgagcccuccaaccccgagcgccucaagggcuucggcuacgccgaguucgaggaccucgacucccuccucuccgcccucucccucaacgaggagucccucggcaaccgccgcauccgcgucgacgucgccgaccaggcccaggacaaggaccgcgacgaccgcuccuucggccgcgaccgcaaccgcgacuccgacaagaccgacaccgacuggcgcgcccgccccgccaccgacuccuucgacgacuaccccccccgccgcggcgacgacuccuucggcgacaaguaccgcgaccgcuacgacuccgaccgcuaccgcgacggcuaccgcgacggcuaccgcgacggcccccgccgcgacauggaccgcuacggcggccgcgaccgcuacgacgaccgcggcucccgcgacuacgaccgcggcuacgacucccgcaucggcuccggccgccgcgccuucggcuccggcuaccgccgcgacgacgacuaccgcggcggcggcgaccgcuacgaggaccgcuacgaccgccgcgacgaccgcuccugguccucccgcgacgacuacucccgcgacgacuaccgccgcgacgaccgcggccccccccagcgccccaagcucaaccucaagccccgcuccacccccaaggaggacgacuccuccgccuccaccucccaguccacccgcgccgccuccaucuucggcggcgccaagcccgucgacaccgccgcccgcgagcgcgaggucgaggagcgccuccagaaggagcaggagaagcuccagcgccagcucgacgagcccaagcucgagcgccgcccccgcgagcgccaccccuccuggcgcuccgaggagacccaggagcgcgagcgcucccgcaccggcuccgaguccucccagaccggcaccuccaccaccuccucccgcaacgcccgccgccgcgaguccgagaagucccucgagaacgagacccucaacaaggaggaggacugccacucccccaccuccaagccccccaagcccgaccagccccucaaggucaugcccgcccccccccccaaggagaacgccugggucaagcgcuccuccaacccccccgcccgcucccaguccuccgacaccgagcagcagucccccaccuccggcggcggcaaggucgcccccgcccagcccuccgaggagggccccggccgcaaggacgagaacaaggucgacggcaugaacgcccccaagggccagaccggcaacuccucccgcggccccggcgacggcggcaaccgcgaccacuggaaggaguccgaccgcaaggacggcaagaaggaccaggacucccgcuccgcccccgagcccaagaagcccgaggagaaccccgccuccaaguucuccuccgccuccaaguacgccgcccucuccgucgacggcgaggacgagaacgagggcgaggacuacgccgaguga

SEQ ID NO: 42647 - RNA, 705 nt, Artificial Sequence
  derived and/or modified sequence opt2 from EIF4E2__Homo_sapiens__NP_001263265
augaacaacaaguucgacgcccucaaggacgacgacuccggcgaccacgaccagaacgaggagaacuccacccagaaggacggcgagaaggagaagaccgagcgcgacaagaaccaguccuccuccaagcgcaaggccgucguccccggccccgccgagcacccccuccaguacaacuacaccuucugguacucccgccgcacccccggccgccccaccuccucccaguccuacgagcagaacaucaagcagaucggcaccuucgccuccgucgagcaguucuggcgcuucuacucccacaugguccgccccggcgaccucaccggccacuccgacuuccaccucuucaaggagggcaucaagcccaugugggaggacgacgccaacaagaacggcggcaaguggaucauccgccuccgcaagggccucgccucccgcugcugggagaaccucauccucgccaugcucggcgagcaguucauggucggcgaggagaucugcggcgccgucgucuccguccgcuuccaggaggacaucaucuccaucuggaacaagaccgccuccgaccaggccaccaccgcccgcauccgcgacacccuccgccgcguccucaaccucccccccaacaccaucauggaguacaagacccacaccgacuccaucaaggacaacuccuccuuccgcaacaccaagaucacccucuga

SEQ ID NO: 42648 - RNA, 357 nt, Artificial Sequence
  derived and/or modified sequence opt2 from EIF4E3__Homo_sapiens__NP_001128121
augcgcggcgagcgccgcccccucugggaggaggaguccaacgccaagggcggcgucuggaagaugaagguccccaaggacuccaccuccaccgucuggaaggagcuccuccucgccaccaucggcgagcaguucaccgacugcgccgccgccgacgacgaggucaucggcgucuccgucuccguccgcgaccgcgaggacgucguccaggucuggaacgucaacgccucccucgucggcgaggccaccguccucgagaagaucuacgagcuccucccccacaucaccuucaaggccgucuucuacaagccccacgaggagcaccacgccuucgagggcggccgcggcaagcacuga

SEQ ID NO: 42649 - RNA, 357 nt, Artificial Sequence
  derived and/or modified sequence opt2 from EIF4EBP1__Homo_sapiens__NP_004086
auguccggcggcuccuccugcucccagacccccucccgcgccauccccgccacccgccgcgucguccucggcgacggcguccagcucccccccggcgacuacuccaccacccccggcggcacccucuucuccaccacccccggcggcacccgcaucaucuacgaccgcaaguuccucauggagugccgcaacucccccgucaccaagacccccccccgcgaccuccccaccauccccggcgucaccucccccuccuccgacgagccccccauggaggccucccagucccaccuccgcaacucccccgaggacaagcgcgccggcggcgaggagucccaguucgagauggacaucuga

SEQ ID NO: 42650 - RNA, 363 nt, Artificial Sequence
  derived and/or modified sequence opt2 from EIF4EBP2__Homo_sapiens__NP_004087
auguccuccuccgccggcuccggccaccagcccucccagucccgcgccauccccacccgcaccgucgccaucuccgacgccgcccagcucccccacgacuacugcaccacccccggcggcacccucuucuccaccacccccggcggcacccgcaucaucuacgaccgcaaguuccuccucgaccgccgcaacucccccauggcccagaccccccccugccaccuccccaacauccccggcgucaccucccccggcacccucaucgaggacuccaaggucgaggucaacaaccucaacaaccucaacaaccacgaccgcaagcacgccgucggcgacgacgcccaguucgagauggacaucuga

SEQ ID NO: 42651 - RNA, 303 nt, Artificial Sequence
  derived and/or modified sequence opt2 from EIF4EBP3__Homo_sapiens__NP_003723
auguccaccuccaccuccugccccauccccggcggccgcgaccagcuccccgacugcuacuccaccacccccggcggcacccucuacgccaccacccccggcggcacccgcaucaucuacgaccgcaaguuccuccucgagugcaagaacucccccaucgcccgcaccccccccugcugccucccccagauccccggcgucaccaccccccccaccgccccccucuccaagcucgaggagcucaaggagcaggagaccgaggaggagauccccgacgacgcccaguucgagauggacaucuga

SEQ ID NO: 42652 - RNA, 714 nt, Artificial Sequence
  derived and/or modified sequence opt2 from EIF4E__Homo_sapiens__NP_001124150
augcucgaccucaccucccgcggccaggucggcaccucccgccgcauggccgaggccgccugcuccgcccacuuccucgagaccacccccacccccaacccccccaccaccgaggaggagaagaccgaguccaaccaggaggucgccaaccccgagcacuacaucaagcacccccuccagaaccgcugggcccucugguucuucaagaacgacaaguccaagaccuggcaggccaaccuccgccucaucuccaaguucgacaccgucgaggacuucugggcccucuacaaccacauccagcucuccuccaaccucaugcccggcugcgacuacucccucuucaaggacggcaucgagcccaugugggaggacgagaagaacaagcgcggcggccgcuggcucaucacccucaacaagcagcagcgccgcuccgaccucgaccgcuucuggcucgagacccuccucugccucaucggcgaguccuucgacgacuacuccgacgacgucugcggcgccgucgucaacguccgcgccaagggcgacaagaucgccaucuggaccaccgagugcgagaaccgcgaggccgucacccacaucggccgcgucuacaaggagcgccucggccucccccccaagaucgucaucggcuaccagucccacgccgacaccgccaccaaguccggcuccaccaccaagaaccgcuucgucgucuga

SEQ ID NO: 42653 - RNA, 2436 nt, Artificial Sequence
  derived and/or modified sequence opt2 from EIF4ENIF1__Homo_sapiens__NP_001157974
auggaccgccgcuccaugggcgagaccgaguccggcgacgccuuccucgaccucaagaagccccccgccuccaagugcccccaccgcuacaccaaggaggagcuccucgacaucaaggagcucccccacuccaagcagcgccccuccugccucuccgagaaguacgacuccgacggcgucugggaccccgagaaguggcacgccucccucuaccccgccuccggccgcuccucccccgucgagucccucaagaaggagcucgacaccgaccgccccucccucguccgccgcaucgucggcaucgucgagugcaacggcggcgucgccgaggaggacgaggucgaggucauccucgcccaggagcccgccgccgaccaggaggucccccgcgacgccguccuccccgagcagucccccggcgacuucgacuucaacgaguucuucaaccucgacaagguccccugccucgccuccaugaucgaggacguccucggcgagggcuccgucuccgccucccgcuucucccgcugguucuccaaccccucccgcuccggcucccgcuccuccucccucggcuccaccccccacgaggagcucgagcgccucgccggccucgagcaggccauccucucccccggccagaacuccggcaacuacuucgcccccaucccccucgaggaccacgccgagaacaaggucgacauccucgagaugcuccagaaggccaaggucgaccucaagccccuccucuccucccucuccgccaacaaggagaagcucaaggaguccucccacuccggcgucguccucuccgucgaggaggucgaggccggccucaagggccucaaggucgaccagcaggucaagaacuccacccccuucauggccgagcaccucgaggagacccucuccgccgucaccaacaaccgccagcucaagaaggacggcgacaugaccgccuucaacaagcucgucuccaccaugaagcgcaaccucgagucccaccucaugucccccgccgagauccccggccagcccguccccaagaacauccuccaggagcuccucggccagcccguccagcgccccgccuccuccaaccuccucuccggccucaugggcucccucgagcccaccaccucccuccucggccagcgcgcccccucccccccccucucccaggucuuccagacccgcgccgccuccgccgacuaccuccgcccccgcauccccucccccaucggcuucacccccggcccccagcagcuccucggcgaccccuuccagggcaugcgcaagcccaugucccccaucaccgcccagcagaugucccagcucgagcuccagcaggccgcccucgagggccucgcccucccccacgaccucgccguccaggccgccaacuucuaccagcccggcuucggcaagccccaggucgaccgcacccgcgacggcuuccgcaaccgccagcagcgcgucaccaagucccccgcccccguccaccgcggcaacuccuccucccccgcccccgccgccuccaucaccuccaugcucucccccuccuucacccccaccuccgucauccgcaagauguacgaguccaaggagaaguccaaggaggagcccgccuccggcaaggccgcccucggcgacuccaaggaggacacccagaaggccuccgaggagaaccuccucuccuccuccuccguccccuccgccgaccgcgacuccucccccaccaccaacuccaagcucuccgcccuccagcgcuccuccugcuccaccccccucucccaggccaaccgcuacaccaaggagcaggacuaccgccccaaggccaccggccgcaagacccccacccucgccucccccguccccaccacccccuuccuccgccccguccaccaggucccccucgucccccacguccccaugguccgccccgcccaccagcuccaccccggccucguccagcgcaugcucgcccagggcguccacccccagcaccuccccucccuccuccagaccggcguccucccccccggcauggaccucucccaccuccagggcaucuccggccccauccucggccagcccuucuacccccuccccgccgccucccacccccuccucaacccccgccccggcaccccccuccaccucgccaugguccagcagcagcuccagcgcuccguccuccacccccccggcuccggcucccacgccgccgccgucuccguccagaccaccccccagaacguccccucccgcuccggccucccccacaugcacucccagcucgagcaccgccccucccagcgcuccuccucccccgucggccucgccaagugguucggcuccgacguccuccagcagccccuccccuccaugcccgccaaggucaucuccgucgacgagcucgaguaccgccaguga

SEQ ID NO: 42654 - RNA, 4821 nt, Artificial Sequence
  derived and/or modified sequence opt2 from EIF4G1__Homo_sapiens__NP_001181876
augaacaaggccccccaguccaccggccccccccccgcccccucccccggccucccccagcccgccuucccccccggccagaccgcccccgucgucuucuccaccccccaggccacccagaugaacacccccucccagccccgccagggcggcuuccgcucccuccagcacuucuaccccucccgcgcccagccccccuccuccgccgccucccgcguccaguccgccgcccccgcccgccccggccccgccgcccacgucuaccccgccggcucccaggucaugaugauccccucccagaucuccuaccccgccucccagggcgccuacuacauccccggccagggccgcuccaccuacgucguccccacccagcaguaccccguccagcccggcgcccccggcuucuaccccggcgccucccccaccgaguucggcaccuacgccggcgccuacuaccccgcccagggcguccagcaguuccccaccggcgucgcccccgcccccguccucaugaaccagcccccccagaucgcccccaagcgcgagcgcaagaccauccgcauccgcgaccccaaccagggcggcaaggacaucaccgaggagaucauguccggcgcccgcaccgccuccacccccacccccccccagaccggcggcggccucgagccccaggccaacggcgagaccccccaggucgccgucaucguccgccccgacgaccgcucccagggcgccaucaucgccgaccgccccggccuccccggccccgagcacucccccuccgagucccagcccuccucccccucccccacccccucccccucccccguccucgagcccggcuccgagcccaaccucgccguccucuccauccccggcgacaccaugaccaccauccagauguccgucgaggaguccacccccaucucccgcgagaccggcgagcccuaccgccucucccccgagcccaccccccucgccgagcccauccucgaggucgaggucacccucuccaagcccguccccgaguccgaguucuccuccuccccccuccaggcccccaccccccucgccucccacaccgucgagauccacgagcccaacggcaugguccccuccgaggaccucgagcccgaggucgaguccucccccgagcucgcccccccccccgccugccccuccgagucccccguccccaucgcccccaccgcccagcccgaggagcuccucaacggcgcccccuccccccccgccgucgaccucucccccgucuccgagcccgaggagcaggccaaggaggucaccgccuccauggccccccccaccauccccuccgccacccccgccaccgcccccuccgccaccucccccgcccaggaggaggagauggaggaggaggaggaggaggaggagggcgaggccggcgaggccggcgaggccgaguccgagaagggcggcgaggagcuccucccccccgaguccacccccauccccgccaaccucucccagaaccucgaggccgccgccgccacccaggucgccgucuccguccccaagcgccgccgcaagaucaaggagcucaacaagaaggaggccgucggcgaccuccucgacgccuucaaggaggccaaccccgccguccccgaggucgagaaccagccccccgccggcuccaaccccggccccgaguccgagggcuccggcguccccccccgccccgaggaggccgacgagaccugggacuccaaggaggacaagauccacaacgccgagaacauccagcccggcgagcagaaguacgaguacaaguccgaccaguggaagccccucaaccucgaggagaagaagcgcuacgaccgcgaguuccuccucggcuuccaguucaucuucgccuccaugcagaagcccgagggccucccccacaucuccgacgucguccucgacaaggccaacaagaccccccuccgcccccucgaccccacccgccuccagggcaucaacugcggccccgacuucacccccuccuucgccaaccucggccgcaccacccucuccacccgcggccccccccgcggcggccccggcggcgagcucccccgcggccccgccggccucggcccccgccgcucccagcagggcccccgcaaggagccccgcaagaucaucgccaccguccucaugaccgaggacaucaagcucaacaaggccgagaaggccuggaagcccuccuccaagcgcaccgccgccgacaaggaccgcggcgaggaggacgccgacggcuccaagacccaggaccucuuccgccgcguccgcuccauccucaacaagcucaccccccagauguuccagcagcucaugaagcaggucacccagcucgccaucgacaccgaggagcgccucaagggcgucaucgaccucaucuucgagaaggccaucuccgagcccaacuucuccgucgccuacgccaacaugugccgcugccucauggcccucaagguccccaccaccgagaagcccaccgucaccgucaacuuccgcaagcuccuccucaaccgcugccagaaggaguucgagaaggacaaggacgacgacgaggucuucgagaagaagcagaaggagauggacgaggccgccaccgccgaggagcgcggccgccucaaggaggagcucgaggaggcccgcgacaucgcccgccgccgcucccucggcaacaucaaguucaucggcgagcucuucaagcucaagaugcucaccgaggccaucaugcacgacugcgucgucaagcuccucaagaaccacgacgaggagucccucgagugccucugccgccuccucaccaccaucggcaaggaccucgacuucgagaaggccaagccccgcauggaccaguacuucaaccagauggagaagaucaucaaggagaagaagaccuccucccgcauccgcuucaugcuccaggacguccucgaccuccgcggcuccaacugggucccccgccgcggcgaccagggccccaagaccaucgaccagauccacaaggaggccgagauggaggagcaccgcgagcacaucaagguccagcagcucauggccaagggcuccgacaagcgccgcggcggcccccccggcccccccaucucccgcggccucccccucgucgacgacggcggcuggaacaccguccccaucuccaagggcucccgccccaucgacaccucccgccucaccaagaucaccaagcccggcuccaucgacuccaacaaccagcucuucgcccccggcggccgccucuccuggggcaagggcuccuccggcggcuccggcgccaagcccuccgacgccgccuccgaggccgcccgccccgccaccuccacccucaaccgcuucuccgcccuccagcaggccguccccaccgaguccaccgacaaccgccgcgucguccagcgcuccucccucucccgcgagcgcggcgagaaggccggcgaccgcggcgaccgccucgagcgcuccgagcgcggcggcgaccgcggcgaccgccucgaccgcgcccgcacccccgccaccaagcgcuccuucuccaaggaggucgaggagcgcucccgcgagcgccccucccagcccgagggccuccgcaaggccgccucccucaccgaggaccgcgaccgcggccgcgacgccgucaagcgcgaggccgcccucccccccgucuccccccucaaggccgcccucuccgaggaggagcucgagaagaaguccaaggccaucaucgaggaguaccuccaccucaacgacaugaaggaggccguccagugcguccaggagcucgccucccccucccuccucuucaucuucguccgccacggcgucgaguccacccucgagcgcuccgccaucgcccgcgagcacaugggccagcuccuccaccagcuccucugcgccggccaccucuccaccgcccaguacuaccagggccucuacgagauccucgagcucgccgaggacauggagaucgacaucccccacgucuggcucuaccucgccgagcucgucacccccauccuccaggagggcggcguccccaugggcgagcucuuccgcgagaucaccaagccccuccgcccccucggcaaggccgccucccuccuccucgagauccucggccuccucugcaaguccaugggccccaagaaggucggcacccucuggcgcgaggccggccucuccuggaaggaguuccuccccgagggccaggacaucggcgccuucgucgccgagcagaaggucgaguacacccucggcgaggaguccgaggcccccggccagcgcgcccuccccuccgaggagcucaaccgccagcucgagaagcuccucaaggagggcuccuccaaccagcgcgucuucgacuggaucgaggccaaccucuccgagcagcagaucgucuccaacacccucguccgcgcccucaugaccgccgucugcuacuccgccaucaucuucgagaccccccuccgcgucgacgucgccguccucaaggcccgcgccaagcuccuccagaaguaccucugcgacgagcagaaggagcuccaggcccucuacgcccuccaggcccucgucgucacccucgagcagccccccaaccuccuccgcauguucuucgacgcccucuacgacgaggacgucgucaaggaggacgccuucuacuccugggaguccuccaaggaccccgccgagcagcagggcaagggcgucgcccucaaguccgucaccgccuucuucaaguggcuccgcgaggccgaggaggaguccgaccacaacuga

SEQ ID NO: 42655 - RNA, 2610 nt, Artificial Sequence
  derived and/or modified sequence opt2 from EIF4G2__Homo_sapiens__NP_001036024
auggaguccgccaucgccgagggcggcgccucccgcuucuccgccuccuccggcggcggcggcucccgcggcgccccccagcacuaccccaagaccgccggcaacuccgaguuccucggcaagacccccggccagaacgcccagaaguggauccccgcccgcuccacccgccgcgacgacaacuccgccgccaacaacuccgccaacgagaaggagcgccacgacgccaucuuccgcaagguccgcggcauccucaacaagcucacccccgagaaguucgacaagcucugccucgagcuccucaacgucggcgucgaguccaagcucauccucaagggcgucauccuccucaucgucgacaaggcccucgaggagcccaaguacuccucccucuacgcccagcucugccuccgccucgccgaggacgcccccaacuucgacggccccgccgccgagggccagcccggccagaagcaguccaccaccuuccgccgccuccucaucuccaagcuccaggacgaguucgagaaccgcacccgcaacgucgacgucuacgacaagcgcgagaacccccuccuccccgaggaggaggagcagcgcgccaucgccaagaucaagaugcucggcaacaucaaguucaucggcgagcucggcaagcucgaccucauccacgaguccauccuccacaagugcaucaagacccuccucgagaagaagaagcgcguccagcucaaggacaugggcgaggaccucgagugccucugccagaucaugcgcaccgucggcccccgccucgaccacgagcgcgccaagucccucauggaccaguacuucgcccgcaugugcucccucaugcucuccaaggagcuccccgcccgcauccgcuuccuccuccaggacaccgucgagcuccgcgagcaccacugggucccccgcaaggccuuccucgacaacggccccaagaccaucaaccagauccgccaggacgccgucaaggaccucggcgucuucauccccgcccccauggcccagggcaugcgcuccgacuucuuccucgagggccccuucaugcccccccgcaugaagauggaccgcgacccccucggcggccucgccgacauguucggccagaugcccggcuccggcaucggcaccggccccggcgucauccaggaccgcuucucccccaccaugggccgccaccgcuccaaccagcucuucaacggccacggcggccacaucaugccccccacccagucccaguucggcgagaugggcggcaaguucaugaagucccagaucucccuccgccccgcccaguccuuccucaugaacaagaaccagguccccaagcuccagccccagaucaccaugaucccccccuccgcccagcccccccgcacccagacccccccccucggccagaccccccagcucggccucaagaccaaccccccccucauccaggagaagcccgccaagaccuccaagaagcccccccccuccaaggaggagcuccucaagcucaccgagaccgucgucaccgaguaccucaacuccggcaacgccaacgaggccgucaacggcguccgcgagaugcgcgcccccaagcacuuccuccccgagaugcucuccaaggucaucauccucucccucgaccgcuccgacgaggacaaggagaaggccuccucccucaucucccuccucaagcaggagggcaucgccaccuccgacaacuucaugcaggccuuccucaacguccucgaccagugccccaagcucgaggucgacaucccccucgucaaguccuaccucgcccaguucgccgcccgcgccaucaucuccgagcucgucuccaucuccgagcucgcccagccccucgaguccggcacccacuucccccucuuccuccucugccuccagcagcucgccaagcuccaggaccgcgaguggcucaccgagcucuuccagcaguccaaggucaacaugcagaagaugcuccccgagaucgaccagaacaaggaccgcaugcucgagauccucgagggcaagggccucuccuuccucuucccccuccucaagcucgagaaggagcuccucaagcagaucaagcucgaccccuccccccagaccaucuacaaguggaucaaggacaacaucucccccaagcuccacgucgacaagggcuucgucaacauccucaugaccuccuuccuccaguacaucuccuccgaggucaacccccccuccgacgagaccgacuccuccuccgcccccuccaaggagcagcucgagcaggagaagcagcuccuccucuccuucaagcccgucaugcagaaguuccuccacgaccacgucgaccuccaggucuccgcccucuacgcccuccagguccacugcuacaacuccaacuuccccaagggcaugcuccuccgcuucuucguccacuucuacgacauggagaucaucgaggaggaggccuuccucgccuggaaggaggacaucacccaggaguuccccggcaagggcaaggcccucuuccaggucaaccaguggcucaccuggcucgagaccgccgaggaggaggaguccgaggaggaggccgacuga

SEQ ID NO: 42656 - RNA, 747 nt, Artificial Sequence
  derived and/or modified sequence opt2 from EIF4H__Homo_sapiens__NP_071496
auggccgacuucgacaccuacgacgaccgcgccuacuccuccuucggcggcggccgcggcucccgcggcuccgccggcggccacggcucccgcucccagaaggagcuccccaccgagccccccuacaccgccuacgucggcaaccuccccuucaacaccguccagggcgacaucgacgccaucuucaaggaccucuccauccgcuccguccgccucguccgcgacaaggacaccgacaaguucaagggcuucugcuacgucgaguucgacgaggucgacucccucaaggaggcccucaccuacgacggcgcccuccucggcgaccgcucccuccgcgucgacaucgccgagggccgcaagcaggacaagggcggcuucggcuuccgcaagggcggccccgacgaccgcggcaugggcuccucccgcgagucccgcggcggcugggacucccgcgacgacuucaacuccggcuuccgcgacgacuuccucggcggccgcggcggcucccgccccggcgaccgccgcaccggcccccccaugggcucccgcuuccgcgacggccccccccuccgcggcuccaacauggacuuccgcgagcccaccgaggaggagcgcgcccagcgcccccgccuccagcucaagccccgcaccgucgccaccccccucaaccaggucgccaaccccaacuccgccaucuucggcggcgcccgcccccgcgaggaggucguccagaaggagcaggaguga

SEQ ID NO: 42657 - RNA, 462 nt, Artificial Sequence
  derived and/or modified sequence opt2 from EIF5A2__Homo_sapiens__NP_065123
auggccgacgagaucgacuucaccaccggcgacgccggcgccuccuccaccuaccccaugcagugcuccgcccuccgcaagaacggcuucgucguccucaagggccgccccugcaagaucgucgagauguccaccuccaagaccggcaagcacggccacgccaagguccaccucgucggcaucgacaucuucaccggcaagaaguacgaggacaucugccccuccacccacaacauggacguccccaacaucaagcgcaacgacuaccagcucaucugcauccaggacggcuaccucucccuccucaccgagaccggcgagguccgcgaggaccucaagcuccccgagggcgagcucggcaaggagaucgagggcaaguacaacgccggcgaggacguccaggucuccgucaugugcgccauguccgaggaguacgccgucgccaucaagcccugcaaguga

SEQ ID NO: 42658 - RNA, 555 nt, Artificial Sequence
  derived and/or modified sequence opt2 from EIF5A__Homo_sapiens__NP_001137232
augugcggcaccggcggcaccgacuccaagacccgccgccccccccaccgcgccuccuuccucaagcgccucgaguccaagccccucaagauggccgacgaccucgacuucgagaccggcgacgccggcgccuccgccaccuuccccaugcagugcuccgcccuccgcaagaacggcuucgucguccucaagggccgccccugcaagaucgucgagauguccaccuccaagaccggcaagcacggccacgccaagguccaccucgucggcaucgacaucuucaccggcaagaaguacgaggacaucugccccuccacccacaacauggacguccccaacaucaagcgcaacgacuuccagcucaucggcauccaggacggcuaccucucccuccuccaggacuccggcgagguccgcgaggaccuccgccuccccgagggcgaccucggcaaggagaucgagcagaaguacgacugcggcgaggagauccucaucaccguccucuccgccaugaccgaggaggccgccgucgccaucaaggccauggccaaguga

SEQ ID NO: 42659 - RNA, 1296 nt, Artificial Sequence
  derived and/or modified sequence opt2 from EIF5__Homo_sapiens__NP_892116
auguccgucaacgucaaccgcuccgucuccgaccaguucuaccgcuacaagaugccccgccucaucgccaaggucgagggcaagggcaacggcaucaagaccgucaucgucaacauggucgacgucgccaaggcccucaaccgcccccccaccuaccccaccaaguacuucggcugcgagcucggcgcccagacccaguucgacgucaagaacgaccgcuacaucgucaacggcucccacgaggccaacaagcuccaggacaugcucgacggcuucaucaagaaguucguccucugccccgagugcgagaaccccgagaccgaccuccacgucaaccccaagaagcagaccaucggcaacuccugcaaggccugcggcuaccgcggcaugcucgacacccaccacaagcucugcaccuucauccucaagaacccccccgagaacuccgacuccggcaccggcaagaaggagaaggagaagaagaaccgcaagggcaaggacaaggagaacggcuccgucuccuccuccgagacccccccccccccccccccccccaacgagaucaacccccccccccacaccauggaggaggaggaggacgacgacuggggcgaggacaccaccgaggaggcccagcgccgccgcauggacgagaucuccgaccacgccaagguccucacccucuccgacgaccucgagcgcaccaucgaggagcgcgucaacauccucuucgacuucgucaagaagaagaaggaggagggcgucaucgacuccuccgacaaggagaucgucgccgaggccgagcgccucgacgucaaggccaugggcccccucguccucaccgagguccucuucaacgagaagauccgcgagcagaucaagaaguaccgccgccacuuccuccgcuucugccacaacaacaagaaggcccagcgcuaccuccuccacggccucgagugcgucgucgccaugcaccaggcccagcucaucuccaagaucccccacauccucaaggagauguacgacgccgaccuccucgaggaggaggucaucaucuccugguccgagaaggccuccaagaaguacgucuccaaggagcucgccaaggagauccgcgucaaggccgagcccuucaucaaguggcucaaggaggccgaggaggaguccuccggcggcgaggaggaggacgaggacgagaacaucgaggucgucuacuccaaggccgccuccguccccaaggucgagaccgucaaguccgacaacaaggacgacgacaucgacaucgacgccaucuga

SEQ ID NO: 42660 - RNA, 738 nt, Artificial Sequence
  derived and/or modified sequence opt2 from EIF6__Homo_sapiens__NP_001254739
auggccguccgcgccuccuucgagaacaacugcgagaucggcugcuucgccaagcucaccaacaccuacugccucgucgccaucggcggcuccgagaacuucuacuccgucuucgagggcgagcucuccgacaccauccccgucguccacgccuccaucgccggcugccgcaucaucggccgcaugugcgucggcaaccgccacggccuccucguccccaacaacaccaccgaccaggagcuccagcacauccgcaacucccuccccgacaccguccagauccgccgcgucgaggagcgccucuccgcccucggcaacgucaccaccugcaacgacuacgucgcccucguccaccccgaccucgaccgcgagaccgaggagauccucgccgacguccucaaggucgaggucuuccgccagaccgucgccgaccagguccucgucggcuccuacugcgucuucuccaaccagggcggccucguccaccccaagaccuccaucgaggaccaggacgagcucuccucccuccuccaggucccccucgucgccggcaccgucaaccgcggcuccgaggucaucgccgccggcauggucgucaacgacuggugcgccuucugcggccucgacaccaccuccaccgagcucuccgucgucgaguccgucuucaagcucaacgaggcccagcccuccaccaucgccaccuccaugcgcgacucccucaucgacucccucaccuga

SEQ ID NO: 42661 - RNA, 1092 nt, Artificial Sequence
  derived and/or modified sequence opt2 from ELAC1__Homo_sapiens__NP_061166
auguccauggacgucaccuuccucggcaccggcgccgccuaccccucccccacccgcggcgccuccgccgucguccuccgcugcgagggcgagugcuggcucuucgacugcggcgagggcacccagacccagcucaugaagucccagcucaaggccggccgcaucaccaagaucuucaucacccaccuccacggcgaccacuucuucggccuccccggccuccucugcaccaucucccuccaguccggcuccauggucuccaagcagcccaucgagaucuacggccccgucggccuccgcgacuucaucuggcgcaccauggagcucucccacaccgagcucgucuuccacuacgucguccacgagcucguccccaccgccgaccagugccccgccgaggagcucaaggaguucgcccacgucaaccgcgccgacuccccccccaaggaggagcagggccgcaccauccuccucgacuccgaggagaacuccuaccuccucuucgacgacgagcaguucgucgucaaggccuuccgccucuuccaccgcauccccuccuucggcuucuccgucgucgagaagaagcgccccggcaagcucaacgcccagaagcucaaggaccucggcgucccccccggccccgccuacggcaagcucaagaacggcaucuccgucguccucgagaacggcgucaccaucuccccccaggacguccucaagaagcccaucgucggccgcaagaucugcauccucggcgacugcuccggcgucgucggcgacggcggcgucaagcucugcuucgaggccgaccuccucauccacgaggccacccucgacgacgcccagauggacaaggccaaggagcacggccacuccaccccccagauggccgccaccuucgccaagcucugccgcgccaagcgccucguccucacccacuucucccagcgcuacaagcccgucgcccucgcccgcgagggcgagaccgacggcaucgccgagcucaagaagcaggccgaguccguccucgaccuccaggaggucacccucgccgaggacuucauggucaucuccauccccaucaagaaguga

SEQ ID NO: 42662 - RNA, 2361 nt, Artificial Sequence
  derived and/or modified sequence opt2 from ELAC2__Homo_sapiens__NP_001159434
augugggcccucugcucccuccuccgcuccgccgccggccgcaccaugucccagggccgcaccaucucccaggcccccgcccgccgcgagcgcccccgcaaggacccccuccgccaccuccgcacccgcgagaagcgcggccccuccggcugcuccggcggccccaacaccgucuaccuccaggucgucgccgccggcucccgcgacuccggcgccgcccucuacgucuucuccgaguucaaccgcuaccucuucaacugcggcgagggcguccagcgccucaugcaggagcacaagcucaaggucgcccgccucgacaacaucuuccucacccgcaugcacugguccaacgucggcggccucuccggcaugauccucacccucaaggagaccggccuccccaagugcguccucuccggccccccccagcucgagaaguaccucgaggccaucaagaucuucuccggcccccucaagggcaucgagcucgccguccgcccccacuccgcccccgaguacgaggacgagaccaugaccgucuaccagauccccauccacuccgucucccagcgccgcggcguccgcgacuccucccucgucgucgccuucaucugcaagcuccaccucaagcgcggcaacuuccucguccucaaggccaaggagaugggccuccccgucggcaccgccgccaucgcccccaucaucgccgccgucaaggacggcaaguccaucacccacgagggccgcgagauccucgccgaggagcucugcaccccccccgaccccggcgccgccuucgucgucgucgagugccccgacgaguccuucauccagcccaucugcgagaacgccaccuuccagcgcuaccagggcaaggccgacgcccccgucgcccucgucguccacauggcccccgccuccguccucgucgacucccgcuaccagcaguggauggagcgcuucggccccgacacccagcaccucguccucaacgagaacugcgccuccguccacaaccuccgcucccacaagauccagacccagcucaaccucauccaccccgacaucuucccccuccucaccuccuuccgcugcaagaaggagggccccacccucuccguccccaugguccagggcgagugccuccucaaguaccagcuccgcccccgccgcgaguggcagcgcgacgccaucaucaccugcaaccccgaggaguucaucgucgaggcccuccagcuccccaacuuccagcaguccguccaggaguaccgccgcuccgcccaggacggccccgcccccgccgagaagcgcucccaguaccccgagaucaucuuccucggcaccggcuccgccauccccaugaagauccgcaacgucuccgccacccucgucaacaucucccccgacaccucccuccuccucgacugcggcgagggcaccuucggccagcucugccgccacuacggcgaccaggucgaccgcguccucggcacccucgccgccgucuucgucucccaccuccacgccgaccaccacaccggccuccccuccauccuccuccagcgcgagcgcgcccucgccucccucggcaagccccuccacccccuccucgucgucgcccccaaccagcucaaggccuggcuccagcaguaccacaaccagugccaggagguccuccaccacaucuccaugauccccgccaagugccuccaggagggcgccgagaucuccucccccgccgucgagcgccucaucuccucccuccuccgcaccugcgaccucgaggaguuccagaccugccucguccgccacugcaagcacgccuucggcugcgcccucguccacaccuccggcuggaaggucgucuacuccggcgacaccaugcccugcgaggcccucguccgcaugggcaaggacgccacccuccucauccacgaggccacccucgaggacggccucgaggaggaggccgucgagaagacccacuccaccaccucccaggccaucuccgucggcaugcgcaugaacgccgaguucaucaugcucaaccacuucucccagcgcuacgccaaggucccccucuucucccccaacuucuccgagaaggucggcgucgccuucgaccacaugaaggucugcuucggcgacuuccccaccaugcccaagcucauccccccccucaaggcccucuucgccggcgacaucgaggagauggaggagcgccgcgagaagcgcgagcuccgccagguccgcgccgcccuccucucccgcgagcucgccggcggccucgaggacggcgagccccagcagaagcgcgcccacaccgaggagccccaggccaagaagguccgcgcccaguga

SEQ ID NO: 42663 - RNA, 804 nt, Artificial Sequence
  derived and/or modified sequence opt2 from ELANE__Homo_sapiens__NP_001963
augacccucggccgccgccucgccugccucuuccucgccugcguccuccccgcccuccuccucggcggcaccgcccucgccuccgagaucgucggcggccgccgcgcccgcccccacgccuggcccuucauggucucccuccagcuccgcggcggccacuucugcggcgccacccucaucgcccccaacuucgucauguccgccgcccacugcgucgccaacgucaacguccgcgccguccgcgucguccucggcgcccacaaccucucccgccgcgagcccacccgccaggucuucgccguccagcgcaucuucgagaacggcuacgaccccgucaaccuccucaacgacaucgucauccuccagcucaacggcuccgccaccaucaacgccaacguccaggucgcccagcuccccgcccagggccgccgccucggcaacggcguccagugccucgccaugggcuggggccuccucggccgcaaccgcggcaucgccuccguccuccaggagcucaacgucaccgucgucaccucccucugccgccgcuccaacgucugcacccucguccgcggccgccaggccggcgucugcuucggcgacuccggcuccccccucgucugcaacggccucauccacggcaucgccuccuucguccgcggcggcugcgccuccggccucuaccccgacgccuucgcccccgucgcccaguucgucaacuggaucgacuccaucauccagcgcuccgaggacaaccccugcccccacccccgcgaccccgaccccgccucccgcacccacuga

SEQ ID NO: 42664 - RNA, 981 nt, Artificial Sequence
  derived and/or modified sequence opt2 from ELAVL1__Homo_sapiens__NP_001410
auguccaacggcuacgaggaccacauggccgaggacugccgcggcgacaucggccgcaccaaccucaucgucaacuaccucccccagaacaugacccaggacgagcuccgcucccucuucuccuccaucggcgaggucgaguccgccaagcucauccgcgacaaggucgccggccacucccucggcuacggcuucgucaacuacgucaccgccaaggacgccgagcgcgccaucaacacccucaacggccuccgccuccaguccaagaccaucaaggucuccuacgcccgccccuccuccgaggucaucaaggacgccaaccucuacaucuccggccucccccgcaccaugacccagaaggacgucgaggacauguucucccgcuucggccgcaucaucaacucccgcguccucgucgaccagaccaccggccucucccgcggcgucgccuucauccgcuucgacaagcgcuccgaggccgaggaggccaucaccuccuucaacggccacaagccccccggcuccuccgagcccaucaccgucaaguucgccgccaaccccaaccagaacaagaacgucgcccuccucucccagcucuaccacucccccgcccgccgcuucggcggccccguccaccaccaggcccagcgcuuccgcuucucccccaugggcgucgaccacauguccggccucuccggcgucaacguccccggcaacgccuccuccggcuggugcaucuucaucuacaaccucggccaggacgccgacgagggcauccucuggcagauguucggccccuucggcgccgucaccaacgucaaggucauccgcgacuucaacaccaacaagugcaagggcuucggcuucgucaccaugaccaacuacgaggaggccgccauggccaucgccucccucaacggcuaccgccucggcgacaagauccuccaggucuccuucaagaccaacaagucccacaaguga

SEQ ID NO: 42665 - RNA, 1041 nt, Artificial Sequence
  derived and/or modified sequence opt2 from ELAVL2__Homo_sapiens__NP_001164668
auggagacccagcucuccaacggccccaccugcaacaacaccgccaacggccccaccaccaucaacaacaacugcuccucccccgucgacuccggcaacaccgaggacuccaagaccaaccucaucgucaacuaccucccccagaacaugacccaggaggagcucaagucccucuucggcuccaucggcgagaucgaguccugcaagcucguccgcgacaagaucaccggccagucccucggcuacggcuucgucaacuacaucgaccccaaggacgccgagaaggccaucaacacccucaacggccuccgccuccagaccaagaccaucaaggucuccuacgcccgccccuccuccgccuccauccgcgacgccaaccucuacgucuccggccuccccaagaccaugacccagaaggagcucgagcagcucuucucccaguacggccgcaucaucaccucccgcauccucgucgaccaggucaccggcaucucccgcggcgucggcuucauccgcuucgacaagcgcaucgaggccgaggaggccaucaagggccucaacggccagaagccccccggcgccaccgagcccaucaccgucaaguucgccaacaaccccucccagaagaccaaccaggccauccucucccagcucuaccagucccccaaccgccgcuaccccggcccccucgcccagcaggcccagcgcuuccgcuucucccccaugaccaucgacggcaugaccucccucgccggcaucaacauccccggccaccccggcaccggcuggugcaucuucgucuacaaccucgcccccgacgccgacgaguccauccucuggcagauguucggccccuucggcgccgucaccaacgucaaggucauccgcgacuucaacaccaacaagugcaagggcuucggcuucgucaccaugaccaacuacgacgaggccgccauggccaucgccucccucaacggcuaccgccucggcgaccgcguccuccaggucuccuucaagaccaacaagacccacaaggccuga

SEQ ID NO: 42666 - RNA, 1104 nt, Artificial Sequence
  derived and/or modified sequence opt2 from ELAVL3__Homo_sapiens__NP_001411
auggucacccagauccucggcgccauggagucccaggucggcggcggccccgccggccccgcccuccccaacggcccccuccucggcaccaacggcgccaccgacgacuccaagaccaaccucaucgucaacuaccucccccagaacaugacccaggacgaguucaagucccucuucggcuccaucggcgacaucgaguccugcaagcucguccgcgacaagaucaccggccagucccucggcuacggcuucgucaacuacuccgaccccaacgacgccgacaaggccaucaacacccucaacggccucaagcuccagaccaagaccaucaaggucuccuacgcccgccccuccuccgccuccauccgcgacgccaaccucuacgucuccggccuccccaagaccaugucccagaaggagauggagcagcucuucucccaguacggccgcaucaucaccucccgcauccucgucgaccaggucaccggcgucucccgcggcgucggcuucauccgcuucgacaagcgcaucgaggccgaggaggccaucaagggccucaacggccagaagccccucggcgccgccgagcccaucaccgucaaguucgccaacaaccccucccagaagaccggccaggcccuccucacccaccucuaccaguccuccgcccgccgcuacgccggcccccuccaccaccagacccagcgcuuccgccucgacaaccuccucaacauggccuacggcgucaaguccccccucucccucaucgcccgcuucucccccaucgccaucgacggcauguccggccucgccggcgucggccucuccggcggcgccgccggcgccggcuggugcaucuucgucuacaaccucucccccgaggccgacgaguccguccucuggcagcucuucggccccuucggcgccgucaccaacgucaaggucauccgcgacuucaccaccaacaagugcaagggcuucggcuucgucaccaugaccaacuacgacgaggccgccauggccaucgccucccucaacggcuaccgccucggcgagcgcguccuccaggucuccuucaagaccuccaagcagcacaaggccuga

SEQ ID NO: 42667 - RNA, 1116 nt, Artificial Sequence
  derived and/or modified sequence opt2 from ELAVL4__Homo_sapiens__NP_001281277
auggaguggaacggccucaagaugaucaucuccaccauggagccccaggucuccaacggccccaccuccaacaccuccaacggccccuccuccaacaaccgcaacugccccucccccaugcagaccggcgccaccaccgacgacuccaagaccaaccucaucgucaacuaccucccccagaacaugacccaggaggaguuccgcucccucuucggcuccaucggcgagaucgaguccugcaagcucguccgcgacaagaucaccggccagucccucggcuacggcuucgucaacuacaucgaccccaaggacgccgagaaggccaucaacacccucaacggccuccgccuccagaccaagaccaucaaggucuccuacgcccgccccuccuccgccuccauccgcgacgccaaccucuacgucuccggccuccccaagaccaugacccagaaggagcucgagcagcucuucucccaguacggccgcaucaucaccucccgcauccucgucgaccaggucaccggcgucucccgcggcgucggcuucauccgcuucgacaagcgcaucgaggccgaggaggccaucaagggccucaacggccagaagcccuccggcgccaccgagcccaucaccgucaaguucgccaacaaccccucccagaaguccucccaggcccuccucucccagcucuaccagucccccaaccgccgcuaccccggcccccuccaccaccaggcccagcgcuuccgccucgacaaccuccucaacauggccuacggcgucaagcgcuucucccccaucaccaucgacggcaugaccucccucgucggcaugaacauccccggccacaccggcaccggcuggugcaucuucgucuacaaccucucccccgacuccgacgaguccguccucuggcagcucuucggccccuucggcgccgucaacaacgucaaggucauccgcgacuucaacaccaacaagugcaagggcuucggcuucgucaccaugaccaacuacgacgaggccgccauggccaucgccucccucaacggcuaccgccucggcgaccgcguccuccaggucuccuucaagaccaacaaggcccacaaguccuga

SEQ ID NO: 42668 - RNA, 1788 nt, Artificial Sequence
  derived and/or modified sequence opt2 from ELF1__Homo_sapiens__NP_001138825
auggccgccgucguccagcagaacgaccucgucuucgaguucgccuccaacgucauggaggacgagcgccagcucggcgaccccgccaucuuccccgccgucaucgucgagcacguccccggcgccgacauccucaacuccuacgccggccucgccugcgucgaggagcccaacgacaugaucaccgaguccucccucgacgucgccgaggaggagaucaucgacgacgacgacgacgacaucacccucaccgucgaggccuccugccacgacggcgacgagaccaucgagaccaucgaggccgccgaggcccuccucaacauggacucccccggccccaugcucgacgagaagcgcaucaacggcauccccgaggucauggagacccagcagguccaggagaaguacgccgacucccccggcgccuccucccccgagcagcccaagcgcaagaagggccgcaagaccaagcccccccgccccgacucccccgccaccacccccaacaucuccgucaagaagaagaacaaggacggcaagggcaacaccaucuaccucugggaguuccuccucgcccuccuccaggacaaggccaccugccccaaguacaucaaguggacccagcgcgagaagggcaucuucaagcucgucgacuccaaggccgucucccgccucuggggcaagcacaagaacaagcccgacaugaacuacgagaccaugggccgcgcccuccgcuacuacuaccagcgcggcauccucgccaaggucgagggccagcgccucgucuaccaguucaaggagaugcccaaggaccucaucuacaucaacgacgaggaccccuccuccuccaucgaguccuccgaccccucccucuccuccuccgccaccuccaaccgcaaccagaccucccgcucccgcgucuccuccucccccggcgucaagggcggcgccaccaccguccucaagcccggcaacuccaaggccgccaagcccaaggaccccgucgaggucgcccagcccuccgagguccuccgcaccguccagcccacccagucccccuaccccacccagcucuuccgcaccguccacgucguccagcccguccaggccguccccgagggcgaggccgcccgcaccuccaccaugcaggacgagacccucaacuccuccguccaguccauccgcaccauccaggcccccacccagguccccgucgucgucuccccccgcaaccagcagcuccacaccgucacccuccagaccgucccccucaccaccgucaucgccuccaccgaccccuccgccggcaccggcucccagaaguucauccuccaggccauccccuccucccagcccaugaccguccucaaggagaacgucaugcuccagucccagaaggccggcuccccccccuccaucguccucggccccgcccagguccagcagguccucaccuccaacguccagaccaucugcaacggcaccgucuccgucgccuccucccccuccuucuccgccaccgcccccgucgucaccuucuccccccgcuccucccagcucgucgcccacccccccggcaccgucaucaccuccgucaucaagacccaggagaccaagacccucacccaggaggucgagaagaaggaguccgaggaccaccucaaggagaacaccgagaagaccgagcagcagccccagcccuacgucauggucgucuccuccuccaacggcuucaccucccaggucgccaugaagcagaacgagcuccucgagcccaacuccuucuga

SEQ ID NO: 42669 - RNA, 1515 nt, Artificial Sequence
  derived and/or modified sequence opt2 from ELF2__Homo_sapiens__NP_001263386
auggccaccucccuccacgagggccccaccaaccagcucgaccuccucauccgcgccgucgaggccuccguccacuccuccaacgcccacugcaccgacaagaccaucgaggccgccgaggcccuccuccacauggagucccccaccugccuccgcgacucccgcucccccgucgaggucuucgucccccccugcgucuccacccccgaguucauccacgccgccaugcgccccgacgucaucaccgagaccgucgucgaggucuccaccgaggaguccgagcccauggacaccucccccauccccaccucccccgacucccacgagcccaugaagaagaagaagggcaacaccaccuaccucugggaguuccuccucgaccuccuccaggacaagaacaccugcccccgcuacaucaaguggacccagcgcgagaagggcaucuucaagcucgucgacuccaaggccgucuccaagcucuggggcaagcacaagaacaagcccgacaugaacuacgagaccaugggccgcgcccuccgcuacuacuaccagcgcggcauccucgccaaggucgagggccagcgccucgucuaccaguucaaggacaugcccaagaacaucgucgucaucgacgacgacaaguccgagaccugcaacgaggaccucgccggcaccaccgacgagaagucccucgagcgcgucucccucuccgccgagucccuccucaaggccgccuccuccguccgcuccggcaagaacuccucccccaucaacugcucccgcgccgagaagggcgucgcccgcgucgucaacaucaccucccccggccacgacgccuccucccgcucccccaccaccaccgccuccgucuccgccaccgccgccccccgcaccguccgcgucgccaugcagguccccgucgucaugaccucccucggccagaagaucuccaccgucgccguccaguccgucaacgccggcgccccccucaucaccuccaccucccccaccaccgccaccucccccaaggucgucauccagaccauccccaccgucaugcccgccuccaccgagaacggcgacaagaucaccaugcagcccgccaagaucaucaccauccccgccacccagcucgcccagugccagcuccagaccaaguccaaccucaccggcuccggcuccaucaacaucgucggcaccccccucgccguccgcgcccucacccccgucuccaucgcccacggcacccccgucaugcgccucuccaugcccacccagcaggccuccggccagacccccccccgcgucaucuccgccgucaucaagggccccgaggucaaguccgaggccgucgccaagaagcaggagcacgacgucaagacccuccagcucgucgaggagaagcccgccgacggcaacaagaccgucacccacgucgucgucgucuccgcccccuccgccaucgcccuccccgucaccaugaagaccgagggccucgucaccugcgagaaguga

SEQ ID NO: 42670 - RNA, 1116 nt, Artificial Sequence
  derived and/or modified sequence opt2 from ELF3__Homo_sapiens__NP_001107781
auggccgccaccugcgagaucuccaacaucuucuccaacuacuucuccgccauguacuccuccgaggacuccacccucgccuccgucccccccgccgccaccuucggcgccgacgaccucguccucacccucuccaacccccagaugucccucgagggcaccgagaaggccuccuggcucggcgagcagccccaguucugguccaagacccagguccucgacuggaucuccuaccaggucgagaagaacaaguacgacgccuccgccaucgacuucucccgcugcgacauggacggcgccacccucugcaacugcgcccucgaggagcuccgccucgucuucggcccccucggcgaccagcuccacgcccagcuccgcgaccucaccuccuccuccuccgacgagcucuccuggaucaucgagcuccucgagaaggacggcauggccuuccaggaggcccucgaccccggccccuucgaccagggcucccccuucgcccaggagcuccucgacgacggccagcaggccucccccuaccaccccggcuccugcggcgccggcgcccccucccccggcuccuccgacgucuccaccgccggcaccggcgccucccgcuccucccacuccuccgacuccggcggcuccgacgucgaccucgaccccaccgacggcaagcucuuccccuccgacggcuuccgcgacugcaagaagggcgaccccaagcacggcaagcgcaagcgcggccgcccccgcaagcucuccaaggaguacugggacugccucgagggcaagaaguccaagcacgccccccgcggcacccaccucugggaguucauccgcgacauccucauccaccccgagcucaacgagggccucaugaagugggagaaccgccacgagggcgucuucaaguuccuccgcuccgaggccgucgcccagcucuggggccagaagaagaagaacuccaacaugaccuacgagaagcucucccgcgccaugcgcuacuacuacaagcgcgagauccucgagcgcgucgacggccgccgccucgucuacaaguucggcaagaacuccuccggcuggaaggaggaggagguccuccagucccgcaacuga

SEQ ID NO: 42671 - RNA, 1992 nt, Artificial Sequence
  derived and/or modified sequence opt2 from ELF4__Homo_sapiens__XP_005262446
auggccaucacccuccagcccuccgaccucaucuucgaguucgccuccaacggcauggacgacgacauccaccagcucgaggaccccuccgucuuccccgccgucaucgucgagcagguccccuaccccgaccuccuccaccucuacuccggccucgagcucgacgacguccacaacggcaucaucaccgacggcacccucugcaugacccaggaccagauccucgagggcuccuuccuccucaccgacgacaacgaggccaccucccacaccauguccaccgccgagguccuccucaacauggagucccccuccgacauccucgacgagaagcagaucuucuccaccuccgagaugcuccccgacuccgaccccgcccccgccgucacccuccccaacuaccucuuccccgccuccgagcccgacgcccucaaccgcgccggcgacaccuccgaccaggagggccacucccucgaggagaaggccucccgcgaggaguccgccaagaagaccggcaaguccaagaagcgcauccgcaagaccaagggcaaccgcuccaccucccccgucaccgaccccuccauccccauccgcaagaaguccaaggacggcaagggcuccaccaucuaccucugggaguuccuccucgcccuccuccaggaccgcaacaccugccccaaguacaucaaguggacccagcgcgagaagggcaucuucaagcucgucgacuccaaggccgucuccaagcucuggggcaagcagaagaacaagcccgacaugaacuacgagaccaugggccgcgcccuccgcuacuacuaccagcgcggcauccucgccaaggucgagggccagcgccucgucuaccaguucaaggagaugcccaaggaccucgucgucaucgaggacgaggacgaguccuccgaggccaccgccgcccccccccaggccuccaccgccuccgucgccuccgccuccaccacccgccgcaccuccucccgcgucuccucccgcuccgccccccagggcaagggcuccuccuccugggagaagcccaagauccagcacgucggccuccagcccuccgccucccucgagcucggccccucccucgacgaggagauccccaccaccuccaccaugcucgucucccccgccgagggccaggucaagcucaccaaggccgucuccgccuccuccguccccuccaacauccaccucggcgucgcccccgucggcuccggcuccgcccucacccuccagaccaucccccucaccaccguccucaccaacggcccccccgccuccaccaccgcccccacccagcucguccuccaguccguccccgccgccuccaccuucaaggacaccuucacccuccaggccuccuucccccucaacgccuccuuccaggacucccaggucgccgcccccggcgccccccucauccucuccggccucccccagcuccucgccggcgccaaccgccccaccaaccccgccccccccaccgucaccggcgccggccccgccggccccuccucccagccccccggcaccgucaucgccgccuucauccgcaccuccggcaccaccgccgccccccgcgucaaggagggcccccuccgcuccuccuccuacguccagggcauggucaccggcgcccccauggagggccuccucguccccgaggagacccuccgcgagcuccuccgcgaccaggcccaccuccagccccuccccacccaggucgucucccgcggcucccacaaccccucccuccucggcaaccagacccucuccccccccucccgccccaccgucggccucacccccgucgccgagcucgagcucuccuccggcuccggcucccuccucauggccgagcccuccgucaccaccuccggcucccuccucacccgcucccccacccccgcccccuucucccccuucaaccccaccucccucaucaagauggagccccacgacaucuga

SEQ ID NO: 42672 - RNA, 483 nt, Artificial Sequence
  derived and/or modified sequence opt2 from ELF5__Homo_sapiens__NP_001230009
augcucgacuccgucacccacuccaccuuccuccccaacgccuccuucugcgacccccucauguccuggaccgaccucuucuccaacgaggaguacuaccccgccuucgagcaccagaccgacgccgacuccaacugccucaagaccuccggcaucaagucccaggacugccacucccacucccgcaccucccuccaguccucccaccucugggaguucguccgcgaccuccuccucucccccgaggagaacugcggcauccucgagugggaggaccgcgagcagggcaucuuccgcgucgucaaguccgaggcccucgccaagauguggggccagcgcaagaagaacgaccgcaugaccuacgagaagcucucccgcgcccuccgcuacuacuacaagaccggcauccucgagcgcgucgaccgccgccucgucuacaaguucggcaagaacgcccacggcuggcaggaggacaagcucuga

SEQ ID NO: 42673 - RNA, 288 nt, Artificial Sequence
  derived and/or modified sequence opt2 from ELK1__Homo_sapiens__NP_001244097
auggaccccuccgucacccucuggcaguuccuccuccagcuccuccgcgagcagggcaacggccacaucaucuccuggaccucccgcgacggcggcgaguucaagcucgucgacgccgaggaggucgcccgccucuggggccuccgcaagaacaagaccaacaugaacuacgacaagcucucccgcgcccuccgcuacuacuacgacaagaacaucauccgcaaggucuccggccagaaguucgucuacaaguucgucuccuaccccgagucccacugcgcccccuga

SEQ ID NO: 42674 - RNA, 1224 nt, Artificial Sequence
  derived and/or modified sequence opt2 from ELK3__Homo_sapiens__XP_006719338
auggaguccgccaucacccucuggcaguuccuccuccagcuccuccucgaccagaagcacgagcaccucaucugcuggaccuccaacgacggcgaguucaagcuccucaaggccgaggaggucgccaagcucuggggccuccgcaagaacaagaccaacaugaacuacgacaagcucucccgcgcccuccgcuacuacuacgacaagaacaucaucaagaaggucaucggccagaaguucgucuacaaguucgucuccuuccccgagauccucaagauggacccccacgccgucgagaucucccgcgagucccuccuccuccaggacuccgacugcaaggccucccccgagggccgcgaggcccacaagcacggccucgccgcccuccgcuccaccucccgcaacgaguacauccacuccggccucuacuccuccuucaccaucaacucccuccagaacccccccgacgccuucaaggccaucaagaccgagaagcucgaggagccccccgaggacuccccccccgucgaggagguccgcaccgucauccgcuucgucaccaacaagaccgacaagcacgucacccgccccgucgucucccuccccuccaccuccgaggccgccgccgccuccgccuuccucgccuccuccgucuccgccaagaucuccucccucaugcuccccaacgccgccuccaucuccuccgccucccccuucuccucccgcucccccucccucucccccaacuccccccuccccuccgagcaccgcucccucuuccucgaggccgccugccacgacuccgacucccucgagccccucaaccucuccuccggcuccaagaccaagucccccucccucccccccaaggccaagaagcccaagggccucgagaucuccgcccccccccucguccucuccggcaccgacaucggcuccaucgcccucaacucccccgcccuccccuccggcucccucacccccgccuucuucaccgcccagacccccaacggccuccuccucacccccuccccccuccucuccuccauccacuucugguccucccucucccccgucgccccccucucccccgcccgccuccagggccccuccacccucuuccaguuccccacccuccucaacggccacaugcccguccccauccccucccucgaccgcgccgccucccccguccuccucuccuccaacucccagaaguccuga

SEQ ID NO: 42675 - RNA, 1218 nt, Artificial Sequence
  derived and/or modified sequence opt2 from ELK4__Homo_sapiens__NP_068567
auggacuccgccaucacccucuggcaguuccuccuccagcuccuccagaagccccagaacaagcacaugaucugcuggaccuccaacgacggccaguucaagcuccuccaggccgaggaggucgcccgccucuggggcauccgcaagaacaagcccaacaugaacuacgacaagcucucccgcgcccuccgcuacuacuacgucaagaacaucaucaagaaggucaacggccagaaguucgucuacaaguucgucuccuaccccgagauccucaacauggaccccaugaccgucggccgcaucgagggcgacugcgagucccucaacuucuccgaggucuccuccuccuccaaggacgucgagaacggcggcaaggacaagcccccccagcccggcgccaagaccuccucccgcaacgacuacauccacuccggccucuacuccuccuucacccucaacucccucaacuccuccaacgucaagcucuucaagcucaucaagaccgagaaccccgccgagaagcucgccgagaagaaguccccccaggagcccacccccuccgucaucaaguucgucaccacccccuccaagaagccccccgucgagcccgucgccgccaccaucuccaucggccccuccaucucccccuccuccgaggagaccauccaggcccucgagacccucgucucccccaagcuccccucccucgaggcccccaccuccgccuccaacgucaugaccgccuucgccaccaccccccccaucuccuccauccccccccuccaggagcccccccgcacccccucccccccccucuccucccaccccgacaucgacaccgacaucgacuccgucgccucccagcccauggagcuccccgagaaccucucccucgagcccaaggaccaggacuccguccuccucgagaaggacaaggucaacaacuccucccgcuccaagaagcccaagggccucgagcucgcccccacccucgucaucaccuccuccgaccccuccccccucggcauccucucccccucccuccccaccgccucccucacccccgccuucuucucccaggucgccugcucccucuucauggucuccccccuccucuccuucaucugccccuucaagcagauccagaaccucuacacccaggucugcuuccuccuccuccgcuucguccucgagcgccucugcgucaccgucauguga

SEQ ID NO: 42676 - RNA, 1923 nt, Artificial Sequence
  derived and/or modified sequence opt2 from ELL2__Homo_sapiens__NP_036213
auggccgccggcggcaccggcggccuccgcgaggagcagcgcuacggccucuccugcggccgccucggccaggacaacaucaccguccuccacgucaagcucaccgagaccgccauccgcgcccucgagaccuaccagucccacaagaaccucauccccuuccgccccuccauccaguuccagggccuccacggccucgucaagauccccaagaacgacccccucaacgagguccacaacuucaacuucuaccucuccaacgucggcaaggacaacccccagggcuccuucgacugcauccagcagaccuucuccuccuccggcgccucccagcucaacugccucggcuucauccaggacaagaucaccgucugcgccaccaacgacuccuaccagaugacccgcgagcgcaugacccaggccgaggaggagucccgcaaccgcuccaccaaggucaucaagcccggcggccccuacgucggcaagcgcguccagauccgcaaggccccccaggccgucuccgacaccguccccgagcgcaagcgcuccacccccaugaaccccgccaacaccauccgcaagacccacuccuccuccaccaucucccagcgccccuaccgcgaccgcgucauccaccuccucgcccucaaggccuacaagaagcccgagcuccucgcccgccuccagaaggacggcgucaaccagaaggacaagaacucccucggcgccauccuccagcaggucgccaaccucaacuccaaggaccucuccuacacccucaaggacuacgucuucaaggagcuccagcgcgacuggcccggcuacuccgagaucgaccgccgcucccucgaguccguccucucccgcaagcucaaccccucccagaacgccgccggcaccucccgcuccgagucccccgucugcuccucccgcgacgccgucuccuccccccagaagcgccuccucgacuccgaguucaucgacccccucaugaacaagaaggcccgcaucucccaccucaccaaccgcgucccccccacccucaacggccaccucaaccccaccuccgagaaguccgccgccggccucccccucccccccgccgccgccgccauccccaccccccccccccuccccuccaccuaccuccccaucucccaccccccccagaucgucaacuccaacuccaacucccccuccacccccgagggccgcggcacccaggaccuccccgucgacuccuucucccagaacgacuccaucuacgaggaccagcaggacaaguacaccucccgcaccucccucgagacccucccccccggcuccguccuccucaagugccccaagcccauggaggagaaccacuccaugucccacaagaaguccaagaagaaguccaagaagcacaaggagaaggaccagaucaagaagcacgacaucgagaccaucgaggagaaggaggaggaccucaagcgcgaggaggagaucgccaagcucaacaacuccucccccaacuccuccggcggcgucaaggaggacugcaccgccuccauggagcccuccgccaucgagcuccccgacuaccucaucaaguacaucgccaucgucuccuacgagcagcgccagaacuacaaggacgacuucaacgccgaguacgacgaguaccgcgcccuccacgcccgcauggagaccgucgcccgccgcuucaucaagcucgacgcccagcgcaagcgccucucccccggcuccaaggaguaccagaacguccacgaggagguccuccaggaguaccagaagaucaagcaguccucccccaacuaccacgaggagaaguaccgcugcgaguaccuccacaacaagcucgcccacaucaagcgccucaucggcgaguucgaccagcagcaggccgaguccugguccuga

SEQ ID NO: 42677 - RNA, 1866 nt, Artificial Sequence
  derived and/or modified sequence opt2 from ELL__Homo_sapiens__NP_006523
auggccgcccucaaggaggaccgcuccuacggccucuccugcggccgcgucuccgacggcuccaaggucuccgucuuccacgucaagcucaccgacuccgcccuccgcgccuucgaguccuaccgcgcccgccaggacuccgucucccuccgccccuccauccgcuuccagggcucccagggccacaucuccaucccccagcccgacugccccgccgaggcccgcaccuucuccuucuaccucuccaacaucggccgcgacaacccccagggcuccuucgacugcauccagcaguacgucuccucccacggcgagguccaccucgacugccucggcuccauccaggacaagaucaccgucugcgccaccgacgacuccuaccagaaggcccgccaguccauggcccaggccgaggaggagacccgcucccgcuccgccaucgucaucaaggccggcggccgcuaccucggcaagaagguccaguuccgcaagcccgcccccggcgccaccgacgccguccccucccgcaagcgcgccacccccaucaaccucgccuccgccauccgcaaguccggcgccuccgccgucuccggcggcuccggcgucucccagcgccccuuccgcgaccgcguccuccaccuccucgcccuccgccccuaccgcaaggccgagcuccuccuccgccuccagaaggacggccucacccaggccgacaaggacgcccucgacggccuccuccagcaggucgccaacauguccgccaaggacggcaccugcacccuccaggacugcauguacaaggacguccagaaggacuggcccggcuacuccgagggcgaccagcagcuccucaagcgcguccucguccgcaagcucugccagccccaguccaccggcucccuccucggcgaccccgccgccuccuccccccccggcgagcgcggccgcuccgccucccccccccagaagcgccuccagccccccgacuucaucgacccccucgccaacaagaagccccgcaucucccacuucacccagcgcgcccagcccgccgucaacggcaagcucggcguccccaacggccgcgaggcccuccuccccacccccggcccccccgccuccaccgacacccucuccuccuccacccaccuccccccccgccucgagcccccccgcgcccacgacccccucgccgacgucuccaacgaccucggccacuccggccgcgacugcgagcacggcgaggccgccgcccccgcccccaccguccgccucggccucccccuccucaccgacugcgcccagcccucccgcccccacggcucccccucccgcuccaagcccaagaagaaguccaagaagcacaaggacaaggagcgcgccgccgaggacaagccccgcgcccagcuccccgacugcgcccccgccacccacgccacccccggcgcccccgccgacacccccggccucaacggcaccugcuccgucuccuccguccccaccuccaccuccgagacccccgacuaccuccucaaguacgccgccaucuccuccuccgagcagcgccaguccuacaagaacgacuucaacgccgaguacuccgaguaccgcgaccuccacgcccgcaucgagcgcaucacccgccgcuucacccagcucgacgcccagcuccgccagcucucccagggcuccgaggaguacgagaccacccgcggccagauccuccaggaguaccgcaagaucaagaagaccaacaccaacuacucccaggagaagcaccgcugcgaguaccuccacuccaagcucgcccacaucaagcgccucaucgccgaguacgaccagcgccagcuccaggccuggcccuga

SEQ ID NO: 42678 - RNA, 744 nt, Artificial Sequence
  derived and/or modified sequence opt2 from ELMO1__Homo_sapiens__NP_569709
augcaggucgucaaggagcaggucaugcgcgcccucaccaccaagcccuccucccucgaccaguucaaguccaagcuccagaaccucuccuacaccgagauccucaagauccgccaguccgagcgcaugaaccaggaggacuuccagucccgccccauccucgagcucaaggagaagauccagcccgagauccucgagcucaucaagcagcagcgccucaaccgccucgucgagggcaccugcuuccgcaagcucaacgcccgccgccgccaggacaaguucugguacugccgccucucccccaaccacaagguccuccacuacggcgaccucgaggaguccccccagggcgaggucccccacgacucccuccaggacaagcuccccgucgccgacaucaaggccgucgucaccggcaaggacugcccccacaugaaggagaagggcgcccucaagcagaacaaggagguccucgagcucgccuucuccauccucuacgacuccaacugccagcucaacuucaucgcccccgacaagcacgaguacugcaucuggaccgacggccucaacgcccuccucggcaaggacaugauguccgaccucacccgcaacgaccucgacacccuccucuccauggagaucaagcuccgccuccucgaccucgagaacauccagauccccgacgcccccccccccauccccaaggagcccuccaacuacgacuucgucuacgacugcaacuga

SEQ ID NO: 42679 - RNA, 2163 nt, Artificial Sequence
  derived and/or modified sequence opt2 from ELMO2__Homo_sapiens__NP_877496
augcccccccccuccgacaucgucaaggucgccaucgaguggcccggcgccaacgcccagcuccucgagaucgaccagaagcgcccccucgccuccaucaucaaggaggucugcgacggcuggucccuccccaaccccgaguacuacacccuccgcuacgccgacggcccccagcucuacaucaccgagcagacccgcuccgacaucaagaacggcaccauccuccagcucgccaucucccccucccgcgccgcccgccagcucauggagcgcacccaguccuccaacauggagacccgccucgacgccaugaaggagcucgccaagcucuccgccgacgucaccuucgccaccgaguucaucaacauggacggcaucaucguccucacccgccucgucgaguccggcaccaagcuccucucccacuacuccgagaugcucgccuucacccucaccgccuuccucgagcucauggaccacggcaucgucuccugggacauggucuccaucaccuucaucaagcagaucgccggcuacgucucccagcccauggucgacgucuccauccuccagcgcucccucgccauccucgaguccaugguccucaacucccagucccucuaccagaagaucgccgaggagaucaccgucggccagcucaucucccaccuccaggucuccaaccaggagauccagaccuacgccaucgcccucaucaacgcccucuuccucaaggcccccgaggacaagcgccaggacauggccaacgccuucgcccagaagcaccuccgcuccaucauccucaaccacgucauccgcggcaaccgccccaucaagaccgagauggcccaccagcucuacguccuccagguccucaccuucaaccuccucgaggagcgcaugaugaccaagauggaccccaacgaccaggcccagcgcgacaucaucuucgagcuccgccgcaucgccuucgacgccgaguccgaccccuccaacgcccccggcuccggcaccgagaagcgcaaggccauguacaccaaggacuacaagaugcucggcuucaccaaccacaucaaccccgccauggacuucacccagaccccccccggcaugcucgcccucgacaacaugcucuaccucgccaagguccaccaggacaccuacauccgcaucguccucgagaacuccucccgcgaggacaagcacgagugccccuucggccgcuccgccaucgagcucaccaagaugcucugcgagauccuccaggucggcgagcuccccaacgagggccgcaacgacuaccaccccauguucuucacccacgaccgcgccuucgaggagcucuucggcaucugcauccagcuccucaacaagaccuggaaggagaugcgcgccaccgccgaggacuucaacaaggucaugcaggucguccgcgagcagaucacccgcgcccuccccuccaagcccaacucccucgaccaguucaaguccaagcuccgcucccucuccuacuccgagauccuccgccuccgccaguccgagcgcaugucccaggacgacuuccaguccccccccaucgucgagcuccgcgagaagauccagcccgagauccucgagcucaucaagcagcagcgccucaaccgccucugcgagggcuccuccuuccgcaagaucggcaaccgccgccgccaggagcgcuucugguacugccgccucgcccucaaccacaagguccuccacuacggcgaccucgacgacaacccccagggcgaggucaccuucgagucccuccaggagaagauccccgucgccgacaucaaggccaucgucaccggcaaggacugcccccacaugaaggagaaguccgcccucaagcagaacaaggagguccucgagcucgccuucuccauccucuacgaccccgacgagacccucaacuucaucgcccccaacaaguacgaguacugcaucuggaucgacggccucuccgcccuccucggcaaggacauguccuccgagcucaccaaguccgaccucgacacccuccucuccauggagaugaagcuccgccuccucgaccucgagaacauccagauccccgaggcccccccccccauccccaaggagcccuccuccuacgacuucgucuaccacuacggcuga

SEQ ID NO: 42680 - RNA, 981 nt, Artificial Sequence
  derived and/or modified sequence opt2 from ELMOD1__Homo_sapiens__NP_001123509
augaagcacuuccuccgcaugcucauccaggucugccucuacuucuacugcaaguuccucuggcgcugccucaaguucgucaugcgcaagcucaccggccgcugcgagcuccagcgcaucugcuacaacaccaagcccggcgccucccgcaccaugaagaucgagaccucccuccgcgacuccaaguccaagcuccuccagaccuccgucuccguccaccccgacgccaucgagaagaccaucgaggacaucauggagcucaagaagaucaaccccgacgucaacccccagcucggcaucucccuccaggccugccuccuccagaucgucggcuaccgcaaccucaucgccgacgucgagaagcuccgccgcgaggccuacgacuccgacaacccccagcacgaggagaugcuccucaagcucuggaaguuccucaagcccaacaccccccucgagucccgcaucuccaagcaguggugcgagaucggcuuccagggcgacgaccccaagaccgacuuccgcggcaugggccuccucggccucuacaaccuccaguacuucgccgagcgcgacgccaccgccgcccagcagguccucuccgacucccuccaccccaagugcuccaaguucuccaaggccgagugggagaagaagcgcauggacaaggccaucggcuacuccuucgccaucgucggcaucaacaucaccgaccucgccuacaaccuccucgucuccggcgcccucaagacccacuucuacaacaucgcccccgaggcccccacccucucccacuuccagcagaccuucugcuaccucaugcacgaguuccacaaguucuggaucgaggaggaccccauggacaucauggaguucaaccgcguccgcgagaaguuccgcaagcgcaucaucaagcagcuccagaaccccgacauggcccucugcccccacuucgccgccuccgagggccucaucaacauguga

SEQ ID NO: 42681 - RNA, 882 nt, Artificial Sequence
  derived and/or modified sequence opt2 from ELMOD2__Homo_sapiens__NP_714913
auguucaucucccucugggaguucuucuacggccacuucuuccgcuucuggaugaaguggcuccuccgccagaugaccggcaagugcgagcuccagcgcaucuucgacaccuacgucggcgcccagcgcacccaccgcaucgagaacucccucaccuacuccaagaacaagguccuccagaaggccacccacgucguccaguccgaggucgacaaguacgucgacgacaucaugaaggagaagaacaucaaccccgagaaggacgccuccuucaagaucugcaugaagaugugccuccuccagaucaccggcuacaagcagcucuaccucgacgucgaguccguccgcaagcgccccuacgacuccgacaaccuccagcacgaggagcuccucaugaagcucuggaaccuccucaugcccaccaagaagcucaacgcccgcaucuccaagcagugggccgagaucggcuuccagggcgacgaccccaagaccgacuuccgcggcaugggcauccucggccucaucaaccucgucuacuucuccgagaacuacaccuccgaggcccaccagauccucucccgcuccaaccaccccaagcucggcuacuccuacgccaucgucggcaucaaccucaccgagauggccuacucccuccucaaguccgaggcccucaaguuccaccucuacaaccucguccccggcauccccaccauggagcacuuccaccaguucuacugcuaccucgucuacgaguucgacaaguucugguucgaggaggagcccgaguccaucauguacuucaaccucuaccgcgagaaguuccacgagaagaucaagggccuccuccucgacugcaacgucgcccucacccucaaggucuga

SEQ ID NO: 42682 - RNA, 1146 nt, Artificial Sequence
  derived and/or modified sequence opt2 from ELMOD3__Homo_sapiens__NP_001128494
augaacgagaaguccugcuccuuccacuccaaggaggagcuccgcgacggccagggcgagcgccucuccgccggcuacucccccuccuacgacaaggacaaguccguccucgccuuccgcggcauccccaucuccgagcucaagaaccacggcauccuccaggcccucaccaccgaggccuacgagugggagccccgcgucgucuccaccgaggucguccgcgcccaggaggagugggaggccgucgacaccauccagcccgagaccggcucccaggccuccuccgagcagcccggccagcucaucuccuucuccgaggcccuccagcacuuccagaccgucgaccucucccccuucaagaagcgcauccagcccaccauccgccgcaccggccucgccgcccuccgccacuaccucuucggcccccccaagcuccaccagcgccuccgcgaggagcgcgaccucguccucaccaucgcccagugcggccucgacucccaggaccccguccacggccgcguccuccagaccaucuacaagaagcucaccggcuccaaguucgacugcgcccuccacggcaaccacugggaggaccucggcuuccagggcgccaaccccgccaccgaccuccgcggcgccggcuuccucgcccuccuccaccuccucuaccucgucauggacuccaagacccuccccauggcccaggagaucuuccgccucucccgccaccacauccagcaguuccccuucugccucauguccgucaacaucacccacaucgccauccaggcccuccgcgaggagugccucucccgcgagugcaaccgccagcagaaggucauccccgucgucaacuccuucuacgccgccaccuuccuccaccucgcccacgucuggcgcacccagcgcaagaccaucuccgacuccggcuucguccucaaggagcucgagguccucgccaagaaguccccccgccgccuccucaagacccucgagcucuaccucgcccgcgucuccaagggccaggccucccuccucggcgcccagaagugcuacggccccgaggccccccccuucaaggaccucaccuucaccggcgaguccgaccuccagucccacuccuccgagggcgucuggcucaucuga

SEQ ID NO: 42683 - RNA, 3138 nt, Artificial Sequence
  derived and/or modified sequence opt2 from ELMSAN1__Homo_sapiens__NP_919254
augaaccuccaggcccagcccaaggcccagaacaagcgcaagcgcugccucuucggcggccaggagcccgcccccaaggagcagccccccccccuccagcccccccagcaguccauccgcgucaaggaggagcaguaccucggccacgagggccccggcggcgccgucuccaccucccagcccgucgagcuccccccccccuccucccucgcccuccucaacuccgucgucuacggccccgagcgcaccuccgccgccaugcucucccagcaggucgccuccgucaaguggcccaacuccgucauggcccccggccgcggccccgagcgcggcggcggcggcggcgucuccgacuccuccuggcagcagcagcccggccagccccccccccacuccaccuggaacugccacucccucucccucuacuccgccaccaagggcuccccccaccccggcgucggcguccccaccuacuacaaccaccccgaggcccucaagcgcgagaaggccggcggcccccagcucgaccgcuacguccgccccaugaugccccagaagguccagcucgaggucggccgcccccaggccccccucaacuccuuccacgccgccaagaagccccccaaccagucccucccccuccagcccuuccagcucgccuucggccaccaggucaaccgccaggucuuccgccagggcccccccccccccaaccccgucgccgccuuccccccccagaagcagcagcagcagcagcagccccagcagcagcagcagcagcagcaggccgcccucccccagaugccccucuucgagaacuucuacuccaugccccagcagcccucccagcagccccaggacuucggccuccagcccgccggcccccucggccagucccaccucgcccaccacuccauggcccccuaccccuucccccccaaccccgacaugaaccccgagcuccgcaaggcccuccuccaggacuccgccccccagcccgcccucccccagguccagauccccuucccccgccgcucccgccgccucuccaaggagggcauccucccccccuccgcccucgacggcgccggcacccagcccggccaggaggccaccggcaaccucuuccuccaccacuggccccuccagcagcccccccccggcucccucggccagccccaccccgaggcccucggcuucccccucgagcuccgcgagucccagcuccuccccgacggcgagcgccucgcccccaacggccgcgagcgcgaggcccccgccaugggcuccgaggagggcaugcgcgccgucuccaccggcgacugcggccagguccuccgcggcggcgucauccaguccacccgccgccgccgccgcgccucccaggaggccaaccuccucacccucgcccagaaggccgucgagcucgccucccuccagaacgccaaggacggcuccggcuccgaggagaagcgcaaguccguccucgccuccaccaccaagugcggcgucgaguucuccgagcccucccucgccaccaagcgcgcccgcgaggacuccggcauggucccccucaucauccccgucuccguccccguccgcaccgucgaccccaccgaggccgcccaggccggcggccucgacgaggacggcaagggccccgagcagaaccccgccgagcacaagcccuccgucaucgucacccgccgccgcuccacccgcauccccggcaccgacgcccaggcccaggccgaggacaugaacgucaagcucgagggcgagcccuccguccgcaagcccaagcagcgcccccgccccgagccccucaucauccccaccaaggccggcaccuucaucgccccccccgucuacuccaacaucacccccuaccagucccaccuccgcucccccguccgccucgccgaccaccccuccgagcgcuccuucgagcucccccccuacacccccccccccauccucucccccguccgcgagggcuccggccucuacuucaacgccaucaucuccaccuccaccauccccgcccccccccccaucacccccaaguccgcccaccgcacccuccuccgcaccaacuccgccgaggucaccccccccguccucuccgucaugggcgaggccacccccgucuccaucgagccccgcaucaacgucggcucccgcuuccaggccgagaucccccucaugcgcgaccgcgcccucgccgccgccgacccccacaaggccgaccucgucuggcagcccugggaggaccucgaguccucccgcgagaagcagcgccaggucgaggaccuccucaccgccgccugcuccuccaucuuccccggcgccggcaccaaccaggagcucgcccuccacugccuccacgagucccgcggcgacauccucgagacccucaacaagcuccuccucaagaagccccuccgcccccacaaccacccccucgccaccuaccacuacaccggcuccgaccaguggaagauggccgagcgcaagcucuucaacaagggcaucgccaucuacaagaaggacuucuuccucguccagaagcucauccagaccaagaccgucgcccagugcgucgaguucuacuacaccuacaagaagcaggucaagaucggccgcaacggcacccucaccuucggcgacgucgacaccuccgacgagaaguccgcccaggaggaggucgaggucgacaucaagaccucccagaaguucccccgcgucccccucccccgccgcgagucccccuccgaggagcgccucgagcccaagcgcgaggucaaggagccccgcaaggagggcgaggaggagguccccgagauccaggagaaggaggagcaggaggagggccgcgagcgcucccgccgcgccgccgccgucaaggccacccagacccuccaggccaacgaguccgccuccgacauccucauccuccgcucccacgaguccaacgcccccggcuccgccggcggccaggccuccgagaagccccgcgagggcaccggcaagucccgccgcgcccuccccuucuccgagaagaagaagaagaccgagaccuucuccaagacccagaaccaggagaacaccuuccccugcaagaagugcggccgcuga

SEQ ID NO: 42684 - RNA, 2175 nt, Artificial Sequence
  derived and/or modified sequence opt2 from ELN__Homo_sapiens__NP_000492
auggccggccucaccgccgccgccccccgccccggcguccuccuccuccuccucuccauccuccaccccucccgccccggcggcguccccggcgccauccccggcggcguccccggcggcgucuucuaccccggcgccggccucggcgcccucggcggcggcgcccucggccccggcggcaagccccucaagcccguccccggcggccucgccggcgccggccucggcgccggccucggcgccuuccccgccgucaccuuccccggcgcccucguccccggcggcgucgccgacgccgccgccgccuacaaggccgccaaggccggcgccggccucggcggcguccccggcgucggcggccucggcgucuccgccggcgccgucgucccccagcccggcgccggcgucaagcccggcaagguccccggcgucggccuccccggcgucuaccccggcggcguccuccccggcgcccgcuuccccggcgucggcguccuccccggcguccccaccggcgccggcgucaagcccaaggcccccggcgucggcggcgccuucgccggcauccccggcgucggccccuucggcggcccccagcccggcgucccccucggcuaccccaucaaggcccccaagcuccccggcggcuacggccuccccuacaccaccggcaagcuccccuacggcuacggccccggcggcgucgccggcgccgccggcaaggccggcuaccccaccggcaccggcgucggcccccaggccgccgccgccgccgccgccaaggccgccgccaaguucggcgccggcgccgccggcguccuccccggcgucggcggcgccggcguccccggcguccccggcgccauccccggcaucggcggcaucgccggcgucggcacccccgccgccgccgccgccgccgccgccgccgccaaggccgccaaguacggcgccgccgccggccucguccccggcggccccggcuucggccccggcgucgucggcguccccggcgccggcguccccggcgucggcguccccggcgccggcauccccgucguccccggcgccggcauccccggcgccgccguccccggcgucgucucccccgaggccgccgccaaggccgccgccaaggccgccaaguacggcgcccgccccggcgucggcgucggcggcauccccaccuacggcgucggcgccggcggcuuccccggcuucggcgucggcgucggcggcauccccggcgucgccggcguccccggcgucggcggcguccccggcgucggcggcguccccggcgucggcaucucccccgaggcccaggccgccgccgccgccaaggccgccaaguacggcgucggcacccccgccgccgccgccgccaaggccgccgccaaggccgcccaguucggccucguccccggcgucggcgucgcccccggcgucggcgucgcccccggcgucggcgucgcccccggcgucggccucgcccccggcgucggcgucgcccccggcgucggcgucgcccccggcgucggcgucgcccccggcaucggccccggcggcgucgccgccgccgccaaguccgccgccaaggucgccgccaaggcccagcuccgcgccgccgccggccucggcgccggcauccccggccucggcgucggcgucggcguccccggccucggcgucggcgccggcguccccggccucggcgucggcgccggcguccccggcuucggcgccguccccggcgcccucgccgccgccaaggccgccaaguacggcgccgccguccccggcguccucggcggccucggcgcccucggcggcgucggcauccccggcggcgucgucggcgccggccccgccgccgccgccgccgccgccaaggccgccgccaaggccgcccaguucggccucgucggcgccgccggccucggcggccucggcgucggcggccucggcguccccggcgucggcggccucggcggcaucccccccgccgccgccgccaaggccgccaaguacggcgccgccggccucggcggcguccucggcggcgccggccaguucccccucggcggcgucgccgcccgccccggcuucggccucucccccaucuuccccggcggcgccugccucggcaaggccugcggccgcaagcgcaaguga

SEQ ID NO: 42685 - RNA, 252 nt, Artificial Sequence
  derived and/or modified sequence opt2 from ELOF1__Homo_sapiens__NP_115753
augggccgccgcaaguccaagcgcaagcccccccccaagaagaagaugaccggcacccucgagacccaguucaccugccccuucugcaaccacgagaaguccugcgacgucaagauggaccgcgcccgcaacaccggcgucaucuccugcaccgucugccucgaggaguuccagacccccaucaccuaccucuccgagcccgucgacgucuacuccgacuggaucgacgccugcgaggccgccaaccaguga

SEQ ID NO: 42686 - RNA, 891 nt, Artificial Sequence
  derived and/or modified sequence opt2 from ELOVL2__Homo_sapiens__NP_060240
auggagcaccucaaggccuucgacgacgagaucaacgccuuccucgacaacauguucggcccccgcgacucccgcguccgcggcugguucaugcucgacuccuaccuccccaccuucuuccucaccgucauguaccuccucuccaucuggcucggcaacaaguacaugaagaaccgccccgcccucucccuccgcggcauccucacccucuacaaccucggcaucacccuccucuccgccuacaugcucgccgagcucauccucuccaccugggagggcggcuacaaccuccagugccaggaccucaccuccgccggcgaggccgacauccgcgucgccaagguccucuggugguacuacuucuccaaguccgucgaguuccucgacaccaucuucuucguccuccgcaagaagaccucccagaucaccuuccuccacgucuaccaccacgccuccauguucaacaucugguggugcguccucaacuggauccccugcggccaguccuucuucggccccacccucaacuccuucauccacauccucauguacuccuacuacggccucuccgucuuccccuccaugcacaaguaccucugguggaagaaguaccucacccaggcccagcucguccaguucguccucaccaucacccacaccauguccgccgucgucaagcccugcggcuuccccuucggcugccucaucuuccaguccuccuacaugcucacccucgucauccucuuccucaacuucuacguccagaccuaccgcaagaagcccaugaagaaggacaugcaggagccccccgccggcaaggaggucaagaacggcuucuccaaggccuacuucaccgccgccaacggcgucaugaacaagaaggcccaguga

SEQ ID NO: 42687 - RNA, 945 nt, Artificial Sequence
  derived and/or modified sequence opt2 from ELOVL4__Homo_sapiens__NP_073563
augggccuccucgacuccgagcccggcuccguccucaacgucgucuccaccgcccucaacgacaccgucgaguucuaccgcuggaccugguccaucgccgacaagcgcgucgagaacuggccccucaugcagucccccuggcccacccucuccaucuccacccucuaccuccucuucgucuggcucggccccaaguggaugaaggaccgcgagcccuuccagaugcgccucguccucaucaucuacaacuucggcaugguccuccucaaccucuucaucuuccgcgagcucuucaugggcuccuacaacgccggcuacuccuacaucugccaguccgucgacuacuccaacaacguccacgagguccgcaucgccgccgcccucuggugguacuucgucuccaagggcgucgaguaccucgacaccgucuucuucauccuccgcaagaagaacaaccaggucuccuuccuccacgucuaccaccacugcaccauguucacccucugguggaucggcaucaagugggucgccggcggccaggccuucuucggcgcccagcucaacuccuucauccacgucaucauguacuccuacuacggccucaccgccuucggccccuggauccagaaguaccucugguggaagcgcuaccucaccaugcuccagcucauccaguuccacgucaccaucggccacaccgcccucucccucuacaccgacugccccuuccccaaguggaugcacugggcccucaucgccuacgccaucuccuucaucuuccucuuccucaacuucuacauccgcaccuacaaggagcccaagaagcccaaggccggcaagaccgccaugaacggcaucuccgccaacggcgucuccaaguccgagaagcagcucaugaucgagaacggcaagaagcagaagaacggcaaggccaagggcgacuga

SEQ ID NO: 42688 - RNA, 981 nt, Artificial Sequence
  derived and/or modified sequence opt2 from ELOVL5__Homo_sapiens__NP_001229757
auggagcacuucgacgccucccucuccaccuacuucaaggcccuccucggcccccgcgacacccgcgucaagggcugguuccuccucgacaacuacauccccaccuucaucugcuccgucaucuaccuccucaucgucuggcucggccccaaguacaugcgcaacaagcagcccuucuccugccgcggcauccucgucgucuacaaccucggccucacccuccucucccucuacauguucugcgaguccaagcgcgagcagccccgccgcuccgccugcgccucccgcaccgaccccuccacccagcagcagcuccccgagaaccgccucgucaccggcgucugggagggcaaguacaacuucuucugccagggcacccgcaccgccggcgaguccgacaugaagaucauccgcguccucuggugguacuacuucuccaagcucaucgaguucauggacaccuucuucuucauccuccgcaagaacaaccaccagaucaccguccuccacgucuaccaccacgccuccaugcucaacaucuggugguucgucaugaacuggguccccugcggccacuccuacuucggcgccacccucaacuccuucauccacguccucauguacuccuacuacggccucuccuccguccccuccaugcgccccuaccucugguggaagaaguacaucacccagggccagcuccuccaguucguccucaccaucauccagaccuccugcggcgucaucuggcccugcaccuucccccucggcuggcucuacuuccagaucggcuacaugaucucccucaucgcccucuucaccaacuucuacauccagaccuacaacaagaagggcgccucccgccgcaaggaccaccucaaggaccaccagaacggcuccauggccgccgucaacggccacaccaacuccuucuccccccucgagaacaacgucaagccccgcaagcuccgcaaggacuga

SEQ ID NO: 42689 - RNA, 798 nt, Artificial Sequence
  derived and/or modified sequence opt2 from ELOVL6__Homo_sapiens__XP_011530536
augaacauguccguccucacccuccaggaguacgaguucgagaagcaguucaacgagaacgaggccauccaguggaugcaggagaacuggaagaaguccuuccucuucuccgcccucuacgccgccuucaucuucggcggccgccaccucaugaacaagcgcgccaaguucgagcuccgcaagccccucguccucuggucccucacccucgccgucuucuccaucuucggcgcccuccgcaccggcgccuacauggucuacauccucaugaccaagggccucaagcaguccgucugcgaccagggcuucuacaacggccccgucuccaaguucugggccuacgccuucguccucuccaaggcccccgagcucggcgacaccaucuucaucauccuccgcaagcagaagcucaucuuccuccacugguaccaccacaucaccguccuccucuacuccugguacuccuacaaggacauggucgccggcggcggcugguucaugaccaugaacuacggcguccacgccgucauguacuccuacuacgcccuccgcgccgccggcuuccgcgucucccgcaaguucgccauguucaucacccucucccagaucacccagaugcucaugggcugcgucgucaacuaccucgucuucugcuggaugcagcacgaccagugccacucccacuuccagaacaucuucugguccucccucauguaccucuccuaccucguccucuucugccacuucuucuucgaggccuacaucggcaagaugcgcaagaccaccaaggccgaguga

SEQ ID NO: 42690 - RNA, 846 nt, Artificial Sequence
  derived and/or modified sequence opt2 from ELOVL7__Homo_sapiens__NP_001098028
auggccuucuccgaccucaccucccgcaccguccaccucuacgacaacuggaucaaggacgccgacccccgcgucgaggacuggcuccucauguccuccccccucccccagaccauccuccucggcuucuacgucuacuucgucaccucccucggccccaagcucauggagaaccgcaagcccuucgagcucaagaaggccaugaucaccuacaacuucuucaucguccucuucuccgucuacaugugcuacgaguucgucauguccggcuggggcaucggcuacuccuuccgcugcgacaucgucgacuacucccgcucccccaccgcccuccgcauggcccgcaccugcuggcucuacuacuucuccaaguucaucgagcuccucgacaccaucuucuucguccuccgcaagaagaacucccaggucaccuuccuccacgucuuccaccacaccaucaugcccuggaccuggugguucggcgucaaguucgccgccggcggccucggcaccuuccacgcccuccucaacaccgccguccacgucgucauguacuccuacuacggccucuccgcccucggccccgccuaccagaaguaccucugguggaagaaguaccucaccucccuccagcucguccaguucgucaucgucgccauccacaucucccaguucuucuucauggaggacugcaaguaccaguuccccgucuucgccugcaucaucauguccuacuccuucauguuccuccuccucuuccuccacuucugguaccgcgccuacaccaagggccagcgccuccccaagaccgucaagaacggcaccugcaagaacaaggacaacuga

SEQ ID NO: 42691 - RNA, 2676 nt, Artificial Sequence
  derived and/or modified sequence opt2 from ELP2__Homo_sapiens__NP_001229804
auggucgcccccguccucgagaccucccacgucuucugcugccccaaccgcguccgcggcguccucaacugguccuccggcccccgcggccuccucgccuucggcaccuccugcuccgucguccucuacgacccccucaagcgcgucgucgucaccaaccucaacggccacaccgcccgcgucaacugcauccaguggaucugcaagcaggacggcucccccuccaccgagcucgucuccggcggcuccgacaaccaggucauccacugggagaucgaggacaaccagcuccucaaggccguccaccuccagggccacgagggccccgucuacgccguccacgccgucuaccagcgccgcaccuccgaccccgcccucugcacccucaucgucuccgccgccgccgacuccgccguccgccucugguccaagaagggccccgaggucaugugccuccagacccucaacuucggcaacggcuucgcccucgcccucugccucuccuuccuccccaacaccgacgucaccuggaagaccggccaggucgagcgcggccgcgccuggaagccccccgccucccucgcccucugcucccgcuccugcgacuccauggucuccugcuacgccuccauccucugcaaggcccucuggaaggagaagcuccacaccuucuggcaccacaaccgcaucuccuuccuccccuccgccuuccgccccauccccauccucgccugcggcaacgacgacugccgcauccacaucuucgcccagcagaacgaccaguuccagaagguccucucccucugcggccacgaggacuggauccgcggcgucgagugggccgccuucggccgcgaccucuuccucgccuccugcucccaggacugccucauccgcaucuggaagcucuacaucaaguccaccucccucgagacccaggacgacgacaacauccgccucaaggagaacaccuucaccaucgagaacgaguccgucaagaucgccuucgccgucacccucgagaccguccucgccggccacgagaacugggucaacgccguccacuggcagcccgucuucuacaaggacggcguccuccagcagcccguccgccuccucuccgccuccauggacaagaccaugauccucugggcccccgacgaggaguccggcgucuggcucgagcagguccgcgucggcgaggucggcggcaacacccucggcuucuacgacugccaguucaacgaggacggcuccaugaucaucgcccacgccuuccacggcgcccuccaccucuggaagcagaacaccgucaacccccgcgaguggacccccgagaucgucaucuccggccacuucgacggcguccaggaccucgucugggaccccgagggcgaguucaucaucaccgucggcaccgaccagaccacccgccucuucgcccccuggaagcgcaaggaccagucccaggucaccuggcacgagaucgcccgcccccagauccacggcuacgaccucaagugccucgccaugaucaaccgcuuccaguucgucuccggcgccgacgagaagguccuccgcgucuucuccgccccccgcaacuucgucgagaacuucugcgccaucaccggccagucccucaaccacguccucugcaaccaggacuccgaccuccccgagggcgccaccguccccgcccucggccucuccaacaaggccgucuuccagggcgacaucgccucccagcccuccgacgaggaggagcuccucaccuccaccggcuucgaguaccagcaggucgccuuccagcccuccauccucaccgagccccccaccgaggaccaccuccuccagaacacccucuggcccgagguccagaagcucuacggccacggcuacgagaucuucugcgucaccugcaacuccuccaagacccuccucgccuccgccugcaaggccgccaagaaggagcacgccgccaucauccucuggaacaccaccuccuggaagcagguccagaaccucgucuuccacucccucaccgucacccagauggccuucucccccaacgagaaguuccuccucgccgucucccgcgaccgcaccuggucccucuggaagaagcaggacaccaucucccccgaguucgagcccgucuucucccucuucgccuucaccaacaagaucaccuccguccacucccgcaucaucugguccugcgacuggucccccgacuccaaguacuucuucaccggcucccgcgacaagaaggucgucgucuggggcgagugcgacuccaccgacgacugcaucgagcacaacaucggccccugcuccuccguccucgacgucggcggcgccgucaccgccgucuccgucugccccguccuccaccccucccagcgcuacgucgucgccgucggccucgagugcggcaagaucugccucuacaccuggaagaagaccgaccagguccccgagaucaacgacuggacccacugcgucgagaccucccagucccagucccacacccucgccauccgcaagcucugcuggaagaacugcuccggcaagaccgagcagaaggaggccgagggcgccgaguggcuccacuucgccuccugcggcgaggaccacaccgucaagauccaccgcgucaacaagugcgcccucuga

SEQ ID NO: 42692 - RNA, 1602 nt, Artificial Sequence
  derived and/or modified sequence opt2 from ELP3__Homo_sapiens__NP_001271151
augaugcucaccaucggcgacgucaucaagcagcucaucgaggcccacgagcagggcaaggacaucgaccucaacaaggucaagaccaagaccgccgccaaguacggccucuccgcccagccccgccucgucgacaucaucgccgccguccccccccaguaccgcaagguccucaugcccaagcucaaggccaagcccauccgcaccgccuccggcaucgccgucgucgccgucaugugcaagccccaccgcugcccccacaucuccuucaccggcaacaucugcgucuacugccccggcggccccgacuccgacuucgaguacuccacccaguccuacaccggcuacgagcccaccuccaugcgcgccauccgcgcccgcuacgaccccuuccuccagacccgccaccgcaucgagcagcucaagcagcucggccacuccgucgacaaggucgaguucaucgucaugggcggcaccuucauggcccuccccgaggaguaccgcgacuacuucauccgcaaccuccacgacgcccucuccggccacaccuccaacaacaucuacgaggccgucaaguacuccgagcgcucccucaccaagugcaucggcaucaccaucgagacccgccccgacuacugcaugaagcgccaccucuccgacaugcucaccuacggcugcacccgccucgagaucggcguccaguccgucuacgaggacgucgcccgcgacaccaaccgcggccacaccgucaaggccgucugcgaguccuuccaccucgccaaggacuccggcuucaaggucgucgcccacaugaugcccgaccuccccaacgucggccucgagcgcgacaucgagcaguucaccgaguucuucgagaaccccgccuuccgccccgacggccucaagcucuaccccacccucgucauccgcggcaccggccucuacgagcucuggaaguccggccgcuacaaguccuacucccccuccgaccucgucgagcucgucgcccgcauccucgcccucgucccccccuggacccgcgucuaccgcguccagcgcgacauccccaugccccucgucuccuccggcgucgagcacggcaaccuccgcgagcucgcccucgcccgcaugaaggaccucggcauccagugccgcgacguccgcacccgcgaggucggcauccaggagauccaccacaagguccgccccuaccaggucgagcucguccgccgcgacuacgucgccaacggcggcugggagaccuuccucuccuacgaggaccccgaccaggacauccucaucggccuccuccgccuccgcaagugcuccgaggagaccuuccgcuucgagcucggcggcggcgucuccaucguccgcgagcuccacgucuacggcuccgucguccccgucuccucccgcgaccccaccaaguuccagcaccagggcuucggcaugcuccucauggaggaggccgagcgcaucgcccgcgaggagcacggcuccggcaagaucgccgucaucuccggcgucggcacccgcaacuacuaccgcaagaucggcuaccgccuccagggccccuacauggucaagaugcucaaguga

SEQ ID NO: 42693 - RNA, 1431 nt, Artificial Sequence
  derived and/or modified sequence opt2 from ELP4__Homo_sapiens__NP_001275654
auggccgccgucgccaccugcggcuccgucgccgccuccaccggcuccgccgucgccaccgccuccaaguccaacgucaccuccuuccagcgccgcggcccccgcgccuccgucaccaacgacuccggcccccgccucgucuccaucgccggcacccgccccuccguccgcaacggccagcuccucgucuccaccggccuccccgcccucgaccagcuccucggcggcggccucgccgucggcaccguccuccucaucgaggaggacaaguacaacaucuacuccccccuccucuucaaguacuuccucgccgagggcaucgucaacggccacacccuccucgucgccuccgccaaggaggaccccgccaacauccuccaggagcuccccgccccccuccucgacgacaagugcaagaaggaguucgacgaggacgucuacaaccacaagacccccgaguccaacaucaagaugaagaucgccuggcgcuaccagcuccuccccaagauggagcagaucggccccgucuccuccucccgcuucggccacuacuacgacgccuccaagcgcaugccccaggagcucaucgaggccuccaacuggcacggcuucuuccuccccgagaagaucuccuccacccucaaggucgagcccugcucccucacccccggcuacaccaagcuccuccaguucauccagaacaucaucuacgaggagggcuucgacggcuccaacccccagaagaagcagcgcaacauccuccgcaucggcauccagaaccucggcuccccccucuggggcgacgacaucugcugcgccgagaacggcggcaacucccacucccucaccaaguuccucuacguccuccgcggccuccuccgcaccucccucuccgccugcaucaucaccaugcccacccaccucauccagaacaaggccaucaucgcccgcgucaccacccucuccgacgucgucgucggccucgaguccuucaucggcuccgagcgcgagaccaacccccucuacaaggacuaccacggccucauccacauccgccagaucccccgccucaacaaccucaucugcgacgaguccgacgucaaggaccucgccuucaagcucaagcgcaagcucuucaccaucgaguggguccaggacaacuaccuccgccaggagcgcaacaucuacccccccggcuucuccuaccuccucaagcagaaggacuccgccuggggcgagggcucccuccagcacuccaccuuccucauguccuuccucgccaaggccaccgccuucgccucccgccucguccgccacuccgagccccucaagcagaacggcuccggccgcauccgccaggccgccggcccccgccucuggcacgacggccgccgccaggaggcccccggccuccucggcaucccccccuga

SEQ ID NO: 42694 - RNA, 801 nt, Artificial Sequence
  derived and/or modified sequence opt2 from ELP6__Homo_sapiens__NP_001026873
auguucgucgagcucaacaaccuccucaacaccacccccgaccgcgccgagcagggcaagcucacccuccucugcgacgccaagaccgacggcuccuuccucguccaccacuuccucuccuucuaccucaaggccaacugcaaggucugcuucgucgcccucauccaguccuucucccacuacuccaucgucggccagaagcucggcgucucccucaccauggcccgcgagcgcggccagcucgucuuccucgagggccucaaguccgccgucgacgucgucuuccaggcccagaaggagccccacccccuccaguuccuccgcgaggccaacgccggcaaccucaagccccucuucgaguucguccgcgaggcccucaagcccgucgacuccggcgaggcccgcuggaccuaccccguccuccucgucgacgaccucuccguccuccucucccucggcaugggcgccgucgccguccucgacuucauccacuacugccgcgccaccgucugcugggagcucaagggcaacauggucguccucguccacgacuccggcgacgccgaggacgaggagaacgacauccuccucaacggccucucccaccagucccaccucauccuccgcgccgagggccucgccaccggcuucugccgcgacguccacggccagcuccgcauccucuggcgccgccccucccagcccgccguccaccgcgaccaguccuucaccuaccaguacaagauccaggacaaguccgucuccuucuucgccaagggcaugucccccgccguccucuga

SEQ ID NO: 42695 - RNA, 672 nt, Artificial Sequence
  derived and/or modified sequence opt2 from ELSPBP1__Homo_sapiens__NP_071425
augacccgcugguccuccuaccuccucggcuggaccaccuuccuccucuacuccuacgaguccuccggcggcaugcacgaggagugcgucuuccccuucaccuacaagggcuccgucuacuucaccugcacccacauccacucccucucccccuggugcgccacccgcgccgucuacaacggccaguggaaguacugccaguccgaggacuacccccgcugcaucuuccccuucaucuaccgcggcaaggccuacaacuccugcaucucccagggcuccuuccucggcucccucuggugcuccgucaccuccgucuucgacgagaagcagcaguggaaguucugcgagaccaacgaguacggcggcaacucccuccgcaagcccugcaucuuccccuccaucuaccgcaacaacgucgucuccgacugcauggaggacgaguccaacaagcucuggugccccaccaccgagaacauggacaaggacggcaagugguccuucugcgccgacacccgcaucuccgcccucguccccggcuuccccugccacuuccccuucaacuacaagaacaagaacuacuucaacugcaccaacgagggcuccaaggagaaccucgucuggugcgccaccuccuacaacuacgaccaggaccacaccugggucuacugcuga

SEQ ID NO: 42696 - RNA, 984 nt, Artificial Sequence
  derived and/or modified sequence opt2 from EMB__Homo_sapiens__NP_940851
augcgcgcccuccccggccuccucgaggcccgcgcccgcaccccccgccuccuccuccuccagugccuccucgccgccgcccgccccuccuccgccgacggcuccgcccccgacucccccuucaccucccccccccuccgcgaggagaucauggccaacaacuucucccucgagucccacaacaucucccucaccgagcacuccuccaugcccgucgagaagaacaucacccucgagcgccccuccaacgucaaccucaccugccaguucaccaccuccggcgaccucaacgccgucaacgucaccuggaagaaggacggcgagcagcucgagaacaacuaccucgucuccgccaccggcuccacccucuacacccaguaccgcuucaccaucaucaacuccaagcagaugggcuccuacuccugcuucuuccgcgaggagaaggagcagcgcggcaccuucaacuucaagguccccgagcuccacggcaagaacaagccccucaucuccuacgucggcgacuccaccguccucaccugcaagugccagaacugcuucccccucaacuggaccugguacuccuccaacggcuccgucaagguccccgucggcguccagaugaacaaguacgucaucaacggcaccuacgccaacgagaccaagcucaagaucacccagcuccucgaggaggacggcgaguccuacuggugccgcgcccucuuccagcucggcgaguccgaggagcacaucgagcucgucguccucuccuaccucgucccccucaagcccuuccucgucaucgucgccgaggucauccuccucgucgccaccauccuccucugcgagaaguacacccagaagaagaagaagcacuccgacgagggcaaggaguucgagcagaucgagcagcucaaguccgacgacuccaacggcaucgagaacaacgucccccgccaccgcaagaacgagucccucggccaguga

SEQ ID NO: 42697 - RNA, 765 nt, Artificial Sequence
  derived and/or modified sequence opt2 from EMC10__Homo_sapiens__NP_778233
auggccgccgccuccgccggcgccacccgccuccuccuccuccuccucauggccgucgccgcccccucccgcgcccgcggcuccggcugccgcgccggcaccggcgcccgcggcgccggcgccgagggccgcgagggcgaggccugcggcaccgucggccuccuccucgagcacuccuucgagaucgacgacuccgccaacuuccgcaagcgcggcucccuccucuggaaccagcaggacggcacccucucccucucccagcgccagcucuccgaggaggagcgcggccgccuccgcgacgucgccgcccucaacggccucuaccgcguccgcaucccccgccgccccggcgcccucgacggccucgaggccggcggcuacgucuccuccuucguccccgccugcucccucgucgagucccaccucuccgaccagcucacccuccacgucgacgucgccggcaacgucgucggcgucuccgucgucacccaccccggcggcugccgcggccacgaggucgaggacgucgaccucgagcucuucaacaccuccguccagcuccagccccccaccaccgcccccggccccgagaccgccgccuucaucgagcgccucgagauggagcaggcccagaaggccaagaacccccaggagcagaaguccuucuucgccaaguacuggcacaucauccucggcggcgccguccuccucaccgcccuccgccccgccgcccccggccccgccccccccccccaggaggccuga

SEQ ID NO: 42698 - RNA, 894 nt, Artificial Sequence
  derived and/or modified sequence opt2 from EMC2__Homo_sapiens__NP_055488
auggccaaggucuccgagcucuacgacgucaccugggaggagaugcgcgacaagaugcgcaaguggcgcgaggagaacucccgcaacuccgagcagaucgucgaggucggcgaggagcucaucaacgaguacgccuccaagcucggcgacgacaucuggaucaucuacgagcaggucaugaucgccgcccucgacuacggccgcgacgaccucgcccucuucugccuccaggagcuccgccgccaguuccccggcucccaccgcgucaagcgccucaccggcaugcgcuucgaggccauggagcgcuacgacgacgccauccagcucuacgaccgcauccuccaggaggaccccaccaacaccgccgcccgcaagcgcaagaucgccauccgcaaggcccagggcaagaacgucgaggccauccgcgagcucaacgaguaccucgagcaguucgucggcgaccaggaggccuggcacgagcucgccgagcucuacaucaacgagcacgacuacgccaaggccgccuucugccucgaggagcucaugaugaccaacccccacaaccaccucuacugccagcaguacgccgaggucaaguacacccagggcggccucgagaaccucgagcucucccgcaaguacuucgcccaggcccucaagcucaacaaccgcaacaugcgcgcccucuucggccucuacauguccgccucccacaucgccuccaaccccaaggccuccgccaagaccaagaaggacaacaugaaguacgccuccugggccgccucccagaucaaccgcgccuaccaguucgccggccgcuccaagaaggagaccaaguacucccucaaggccgucgaggacaugcucgagacccuccagaucacccaguccuga

SEQ ID NO: 42699 - RNA, 786 nt, Artificial Sequence
  derived and/or modified sequence opt2 from EMC3__Homo_sapiens__NP_060917
auggccggccccgagcuccuccucgacuccaacauccgccucugggucguccuccccaucgucaucaucaccuucuucgucggcaugauccgccacuacgucuccauccuccuccaguccgacaagaagcucacccaggagcaggucuccgacucccagguccucauccgcucccgcguccuccgcgagaacggcaaguacauccccaagcaguccuuccucacccgcaaguacuacuucaacaaccccgaggacggcuucuucaagaagaccaagcgcaaggucgucccccccucccccaugaccgaccccaccaugcucaccgacaugaugaagggcaacgucaccaacguccuccccaugauccucaucggcggcuggaucaacaugaccuucuccggcuucgucaccaccaagguccccuucccccucacccuccgcuucaagcccaugcuccagcagggcaucgagcuccucacccucgacgccuccugggucuccuccgccuccugguacuuccucaacgucuucggccuccgcuccaucuacucccucauccucggccaggacaacgccgccgaccagucccgcaugaugcaggagcagaugaccggcgccgccauggccaugcccgccgacaccaacaaggccuucaagaccgagugggaggcccucgagcucaccgaccaccagugggcccucgacgacgucgaggaggagcucauggccaaggaccuccacuucgagggcauguucaagaaggagcuccagaccuccaucuucuga

SEQ ID NO: 42700 - RNA, 729 nt, Artificial Sequence
  derived and/or modified sequence opt2 from EMC7__Homo_sapiens__NP_064539
auggccgccgcccucuggggcuucuuccccguccuccuccuccuccuccucuccggcgacguccaguccuccgagguccccggcgccgccgccgagggcuccggcggcuccggcgucggcaucggcgaccgcuucaagaucgagggccgcgccgucguccccggcgucaagccccaggacuggaucuccgccgcccgcguccucgucgacggcgaggagcacgucggcuuccucaagaccgacggcuccuucgucguccacgacauccccuccggcuccuacgucgucgaggucgucucccccgccuaccgcuucgaccccguccgcgucgacaucaccuccaagggcaagaugcgcgcccgcuacgucaacuacaucaagaccuccgaggucguccgccuccccuacccccuccagaugaaguccuccggcccccccuccuacuucaucaagcgcgaguccuggggcuggaccgacuuccucaugaaccccauggucaugaugaugguccucccccuccucaucuucguccuccuccccaaggucgucaacaccuccgaccccgacaugcgccgcgagauggagcaguccaugaacaugcucaacuccaaccacgagcuccccgacgucuccgaguucaugacccgccucuucuccuccaaguccuccggcaaguccuccuccggcuccuccaagaccggcaaguccggcgccggcaagcgccgcuga

SEQ ID NO: 42701 - RNA, 381 nt, Artificial Sequence
  derived and/or modified sequence opt2 from EMC8__Homo_sapiens__NP_001135760
augcccggcgucaagcucaccacccaggccuacugcaagaugguccuccacggcgccaaguacccccacugcgccgucaacggccuccucgucgccgagaagcagaagccccgcaaggagcaccucccccucggcggccccggcgcccaccacacccucuucgucgacugcaucccccucuuccacggcacccucgcccucgcccccaugcucgaggucgcccucacccucaucgacuccuggugcaaggaccacuccuacgucaucgccggcuacuaccaggccaacgagcgcgucaaggacgccucccccaaccaggucgccgagaaggucgccucccgcaucgccgagggcuucuccgacaccgcccucaucauguga

SEQ ID NO: 42702 - RNA, 747 nt, Artificial Sequence
  derived and/or modified sequence opt2 from EMCN__Homo_sapiens__NP_001153166
auggagcuccuccaggucaccauccucuuccuccuccccuccaucugcuccuccaacuccaccggcguccucgaggccgccaacaacucccucgucgucaccaccaccaagcccuccaucaccacccccaacaccgagucccuccagaagaacgucgucacccccaccaccggcaccacccccaagggcaccaucaccaacgagcuccucaagaugucccucauguccaccgccaccuuccucaccuccaaggacgagggccucaaggccaccaccaccgacguccgcaagaacgacuccaucaucuccaacgucaccgucaccuccgucacccuccccaacgccgucuccacccuccaguccuccaagcccaaguccuccguccuccagcccgacgccucccccuccaagaccggcacccucaccuccauccccgucaccauccccgagaacaccucccagucccaggucaucggcaccgagggcggcaagaacgccuccaccuccgccaccucccgcuccuacuccuccaucauccuccccgucgucaucgcccucaucgucaucacccucuccgucuucguccucgucggccucuaccgcaugugcuggaaggccgaccccggcacccccgagaacggcaacgaccagccccaguccgacaaggaguccgucaagcuccucaccgucaagaccaucucccacgaguccggcgagcacuccgcccagggcaagaccaagaacuga

SEQ ID NO: 42703 - RNA, 765 nt, Artificial Sequence
  derived and/or modified sequence opt2 from EMD__Homo_sapiens__NP_000108
auggacaacuacgccgaccucuccgacaccgagcucaccacccuccuccgccgcuacaacaucccccacggccccgucgucggcuccacccgccgccucuacgagaagaagaucuucgaguacgagacccagcgccgccgccucuccccccccuccuccuccgccgccuccuccuacuccuucuccgaccucaacuccacccgcggcgacgccgacauguacgaccuccccaagaaggaggacgcccuccucuaccaguccaagggcuacaacgacgacuacuacgaggaguccuacuucaccacccgcaccuacggcgagcccgaguccgccggccccucccgcgccguccgccaguccgucaccuccuuccccgacgccgacgccuuccaccaccagguccacgacgacgaccuccucuccuccuccgaggaggagugcaaggaccgcgagcgccccauguacggccgcgacuccgccuaccaguccaucacccacuaccgccccgucuccgccucccgcuccucccucgaccucuccuacuaccccaccuccuccuccaccuccuucauguccuccuccuccuccuccuccuccuggcucacccgccgcgccauccgccccgagaaccgcgcccccggcgccggccucggccaggaccgccaggucccccucuggggccagcuccuccucuuccucgucuucgucaucguccucuucuucaucuaccacuucaugcaggccgaggagggcaaccccuucuga

SEQ ID NO: 42704 - RNA, 1713 nt, Artificial Sequence
  derived and/or modified sequence opt2 from EME1__Homo_sapiens__NP_689676
auggcccucaagaaguccucccccucccucgacuccggcgacuccgacuccgaggagcuccccaccuucgccuuccucaagaaggagcccuccuccaccaagcgccgccagcccgagcgcgaggagaagaucgucgucgucgacaucuccgacugcgaggccuccugcccccccgcccccgagcucuucuccccccccguccccgagaucgccgagaccgucacccagacccagcccguccgccuccucuccuccgaguccgaggacgaggaggaguucaucccccucgcccagcgccucaccugcaaguuccucacccacaagcagcucucccccgaggacuccuccucccccgucaaguccguccucgaccaccagaacaacgagggcgccuccugcgacuggaagaagcccuuccccaagauccccgaggucccccuccacgacacccccgagcgcuccgccgccgacaacaaggaccucauccucgaccccugcugccagcuccccgccuaccucuccaccugccccggccaguccuccucccucgccgucaccaagaccaacuccgacauccuccccccccagaagaagaccaagcccucccagaagguccagggccgcggcucccacggcugccgccagcagcgccaggcccgccagaaggaguccacccuccgccgccaggagcgcaagaacgccgcccucgucacccgcaugaaggcccagcgccccgaggagugccucaagcacaucaucgucguccucgaccccguccuccuccagauggagggcggcggccagcuccucggcgcccuccagaccauggagugccgcugcgucaucgaggcccaggccguccccugcuccgucaccuggcgccgccgcgccggccccuccgaggaccgcgaggacugggucgaggagcccaccguccucguccuccuccgcgccgaggccuucgucuccaugaucgacaacggcaagcagggcucccucgacuccaccaugaagggcaaggagacccuccagggcuucgucaccgacaucaccgccaagaccgccggcaaggcccucucccucgucaucgucgaccaggagaagugcuucuccgcccagaaccccccccgccgcggcaagcagggcgccaacaagcagaccaagaagcagcagcagcgccagcccgaggccuccaucggcuccauggucucccgcgucgacgccgaggaggcccucgucgaccuccagcuccacaccgaggcccaggcccagaucguccaguccuggaaggagcucgccgacuucaccugcgccuucaccaaggccgucgccgaggcccccuucaagaagcuccgcgacgagaccaccuucuccuucugccucgaguccgacugggccggcggcgucaaggucgaccucgccggccgcggccucgcccucgucuggcgccgccagauccagcagcucaaccgcgucucccucgagauggccuccgccgucgucaacgccuaccccuccccccagcuccucguccaggccuaccagcagugcuucuccgacaaggagcgccagaaccuccucgccgacauccagguccgccgcggcgagggcgucaccuccaccucccgccgcaucggccccgagcucucccgccgcaucuaccuccagaugaccacccuccagccccaccucucccucgacuccgccgacuga

SEQ ID NO: 42705 - RNA, 735 nt, Artificial Sequence
  derived and/or modified sequence opt2 from EMG1__Homo_sapiens__NP_006322
auggccgcccccuccgacggcuucaagccccgcgagcgcuccggcggcgagcaggcccaggacugggacgcccucccccccaagcgcccccgccucggcgccggcaacaagaucggcggccgccgccucaucgucguccucgagggcgccucccucgagaccgucaaggucggcaagaccuacgagcuccucaacugcgacaagcacaaguccauccuccucaagaacggccgcgaccccggcgaggcccgccccgacaucacccaccagucccuccucaugcucauggacuccccccucaaccgcgccggccuccuccaggucuacauccacacccagaagaacguccucaucgaggucaacccccagacccgcaucccccgcaccuucgaccgcuucugcggccucaugguccagcuccuccacaagcucuccguccgcgccgccgacggcccccagaagcuccucaaggucaucaagaaccccgucuccgaccacuuccccgucggcugcaugaaggucggcaccuccuucuccauccccgucgucuccgacguccgcgagcucguccccuccuccgaccccaucgucuucgucgucggcgccuucgcccacggcaaggucuccgucgaguacaccgagaagauggucuccaucuccaacuacccccucuccgccgcccucaccugcgccaagcucaccaccgccuucgaggaggucuggggcgucaucuga

SEQ ID NO: 42706 - RNA, 3051 nt, Artificial Sequence
  derived and/or modified sequence opt2 from EMILIN1__Homo_sapiens__NP_008977
auggccccccgcacccucugguccugcuaccucugcugccuccucaccgccgccgccggcgccgccuccuaccccccccgcggcuucucccucuacaccggcuccuccggcgcccucucccccggcggcccccaggcccagaucgccccccgccccgccucccgccaccgcaacuggugcgccuacgucgucacccgcaccgucuccugcguccucgaggacggcgucgagaccuacgucaaguaccagcccugcgccuggggccagccccagugcccccaguccaucauguaccgccgcuuccuccgcccccgcuaccgcgucgccuacaagaccgucaccgacauggaguggcgcugcugccagggcuacggcggcgacgacugcgccgagucccccgcccccgcccucggccccgccuccuccaccccccgcccccucgcccgccccgcccgccccaaccucuccggcuccuccgccggcuccccccucuccggccucggcggcgagggccccggcgaguccgagaagguccagcagcucgaggagcagguccagucccucaccaaggagcuccagggccuccgcggcguccuccagggccucuccggccgccucgccgaggacguccagcgcgccgucgagaccgccuucaacggccgccagcagcccgccgacgccgccgcccgccccggcguccacgagacccucaacgagauccagcaccagcuccagcuccucgacacccgcgucuccacccacgaccaggagcucggccaccucaacaaccaccacggcggcuccuccuccuccggcggcucccgcgcccccgcccccgccuccgccccccccggccccuccgaggagcuccuccgccagcucgagcagcgccuccaggaguccugcuccgucugccucgccggccucgacggcuuccgccgccagcagcaggaggaccgcgagcgccuccgcgccauggagaagcuccucgccuccgucgaggagcgccagcgccaccucgccggccucgccgucggccgccgccccccccaggagugcugcucccccgagcucggccgccgccucgccgagcucgagcgccgccucgacgucgucgccggcuccgucaccguccucuccggccgccgcggcaccgagcucggcggcgccgccggccagggcggccacccccccggcuacaccucccucgccucccgccucucccgccucgaggaccgcuucaacuccacccucggccccuccgaggagcaggaggaguccuggcccggcgcccccggcggccucucccacuggcuccccgccgcccgcggccgccucgagcagcucggcggccuccucgccaacgucuccggcgagcucggcggccgccucgaccuccucgaggagcaggucgccggcgccaugcaggccugcggccagcucugcuccggcgcccccggcgagcaggacucccaggucuccgagauccucuccgcccucgagcgccgcguccucgacuccgagggccagcuccgccucgucggcuccggccuccacaccgucgaggccgccggcgaggcccgccaggccacccucgagggccuccaggaggucgucggccgccuccaggaccgcgucgacgcccaggacgagaccgccgccgaguucacccuccgccucaaccucaccgccgcccgccucggccagcucgagggccuccuccaggcccacggcgacgagggcugcggcgccugcggcggcguccaggaggagcucggccgccuccgcgacggcgucgagcgcugcuccugcccccuccuccccccccgcggccccggcgccggccccggcgucggcggccccucccgcggcccccucgacggcuucuccgucuucggcggcuccuccggcuccgcccuccaggcccuccagggcgagcucuccgaggucauccucuccuucuccucccucaacgacucccucaacgagcuccagaccaccgucgagggccagggcgccgaccucgccgaccucggcgccaccaaggaccgcaucaucuccgagaucaaccgccuccagcaggaggccaccgagcacgccaccgaguccgaggagcgcuuccgcggccucgaggagggccaggcccaggccggccagugccccucccucgagggccgccucggccgccucgagggcgucugcgagcgccucgacaccgucgccggcggccuccagggccuccgcgagggccucucccgccacgucgccggccucugggccggccuccgcgagaccaacaccaccucccagaugcaggccgcccuccucgagaagcucgucggcggccaggccggccucggccgccgccucggcgcccucaacuccucccuccagcuccucgaggaccgccuccaccagcucucccucaaggaccucaccggccccgccggcgaggccggcccccccggcccccccggccuccagggcccccccggccccgccggcccccccggcucccccggcaaggacggccaggagggccccaucggcccccccggcccccagggcgagcagggcgucgagggcgcccccgccgcccccgucccccaggucgccuucuccgccgcccucucccucccccgcuccgagcccggcaccguccccuucgaccgcguccuccucaacgacggcggcuacuacgaccccgagaccggcgucuucaccgccccccucgccggccgcuaccuccucuccgccguccucaccggccaccgccacgagaaggucgaggccguccucucccgcuccaaccagggcgucgcccgcgucgacuccggcggcuacgagcccgagggccucgagaacaagcccgucgccgagucccagcccucccccggcacccucggcgucuucucccucauccucccccuccaggccggcgacaccgucugcgucgaccucgucaugggccagcucgcccacuccgaggagccccucaccaucuucuccggcgcccuccucuacggcgaccccgagcucgagcacgccuga

SEQ ID NO: 42707 - RNA, 3162 nt, Artificial Sequence
  derived and/or modified sequence opt2 from EMILIN2__Homo_sapiens__NP_114437
auguggcagccccgccgccccuggccccgcguccccuggcgcugggcccucgcccuccucgcccucgucggcgccggccucugccacgccggcccccagcccggcuaccccgcccgccccuccgcccgcaacaagaacuggugcgccuacaucgucaacaagaacgucuccugcuccguccucgagggcuccgaguccuucauccaggcccaguacaacugcgccuggaaccagaugcccugccccuccgcccucgucuaccgcgucaacuuccgcccccgcuacgucacccgcuacaagaccgucacccagcucgaguggcgcugcugccccggcuuccgcggcggcgacugccaggagggccccaaggaccccgucaagacccuccgccccacccccgcccgcccccgcaacucccucaagaaggccaccgacaacgagcccucccaguucuccgagccccgcaagacccucucccccaccggcaccgcccagcccuccuggggcgucgaccccaaggagggcccccaggagcuccaggagaagaagauccagguccucgaggagaagguccuccgccucacccgcaccguccucgaccuccaguccucccucgccggcgucuccgagaaccucaagcacgccacccaggacgacgccucccgcacccgcgcccccggccucuccucccagcaccccaagcccgacaccaccgucuccggcgacaccgagaccggccagucccccggcgucuucaacaccaaggaguccggcaugaaggacaucaaguccgagcucgccgaggucaaggacacccucaagaacaaguccgacaagcucgaggagcucgacggcaaggucaagggcuacgagggccagcuccgccagcuccaggaggccgcccagggccccaccgucaccaugaccaccaacgagcucuaccaggccuacgucgacuccaagaucgacgcccuccgcgaggagcucauggagggcauggaccgcaagcucgccgaccucaagaacuccugcgaguacaagcucaccggccuccagcagcagugcgacgacuacggcuccuccuaccucggcgucaucgagcucaucggcgagaaggagaccucccuccgcaaggagaucaacaaccuccgcgcccgccuccaggagcccuccgcccaggccaacugcugcgacuccgagaagaacggcgacaucggccagcagaucaagacccucgaccagaagaucgagcgcgucgccgaggccacccgcaugcucaacggccgccucgacaacgaguucgaccgccucaucguccccgagcccgacgucgacuucgacgccaaguggaacgagcucgacgcccgcaucaacgucaccgagaagaacgccgaggagcacugcuucuacaucgaggagacccuccgcggcgccaucaacggcgaggucggcgaccucaagcagcucgucgaccagaagauccagucccucgaggaccgccucggcuccguccuccuccagaugaccaacaacaccggcgccgagcucuccccccccggcgccgccgcccuccccggcgucuccggcuccggcgacgagcgcgucaugauggagcucaaccaccucaaggacaagguccaggucgucgaggacaucugccuccucaacauccagggcaagccccacggcauggagggcgcccuccccaaccgcgaggaccgcgccguccgcgacucccuccaccuccucaagucccucaacgacaccaugcaccgcaaguuccaggagaccgagcagaccauccagaagcuccagcaggacuucuccuuccucuacucccagcucaaccacaccgagaacgacgucacccaccuccagaaggagauguccaacugccgcgccggcgagaacgccggcaugggccgcuucaccaaggucggcgagcaggagcgcaccgucgacacccuccccuccccccagcaccccgucgcccacugcugcucccagcucgaggagcgcuggcagcgccuccagucccaggucaucuccgagcucgacgccugcaaggagugcacccagggcguccagcgcgaggucuccauggucgagggccgcgucucccacauggagaagaccugcuccaagcucgacuccaucuccggcaaccuccagcgcaucaaggagggccucaacaagcacgucuccucccucuggaacugcguccgccagaugaacggcacccuccgcucccacucccgcgacaucuccggccucaagaacuccguccagcaguucuacucccacgucuuccagaucuccaccgaccuccaggaccucgucaaguuccagcccuccgccaaggcccccuccccccccccccccgccgaggcccccaaggagccccuccagcccgagcccgcccccccccgccccuccggccccgccaccgccgaggaccccggccgccgccccguccucccccagcgcccccccgaggagcgccccccccagccccccggcuccaccggcgucaucgccgagaccggccaggccggcccccccgccggcgccggcgucuccggccgcggccucccccgcggcgucgacggccagaccggcuccggcaccguccccggcgccgagggcuucgccggcgcccccggcuaccccaaguccccccccgucgccucccccggcgcccccguccccucccucgucuccuucuccgccggccucacccagaagcccuuccccuccgacggcggcgucguccucuucaacaagguccucgucaacgacggcgacgucuacaaccccuccaccggcgucuucaccgcccccuacgacggccgcuaccucaucaccgccacccucacccccgagcgcgacgccuacgucgaggccguccucuccgucuccaacgccuccgucgcccagcuccacaccgccggcuaccgccgcgaguuccucgaguaccaccgcccccccggcgcccuccacaccugcggcggccccggcgccuuccaccucaucguccaccucaaggccggcgacgccgucaacgucgucgucaccggcggcaagcucgcccacaccgacuucgacgagauguacuccaccuucuccggcgucuuccucuaccccuuccucucccaccucuga

SEQ ID NO: 42708 - RNA, 2301 nt, Artificial Sequence
  derived and/or modified sequence opt2 from EMILIN3__Homo_sapiens__NP_443078
augggccgccgccgccuccucgucuggcucugcgccgucgccgcccuccucuccggcgcccaggcccgcggcaccccccuccucgcccgccccgccccccccggcgccucccgcuacucccucuacaccaccggcuggcgcccccgccuccgccccggcccccacaaggcccucugcgccuacgucguccaccgcaacgucaccugcauccuccaggagggcgccgaguccuacgucaaggccgaguaccgccagugccgcuggggccccaagugccccggcaccgucaccuaccgcaccguccuccgccccaaguacaaggucggcuacaagaccgucaccgaccucgccuggcgcugcugccccggcuucaccggcaagcgcugccccgagcaccucaccgaccacggcgccgccuccccccagcucgagcccgagccccagauccccuccggccagcucgaccccggcccccgcccccccuccuacucccgcgccgcccccuccccccacggccgcaagggccccggccucuucggcgagcgccucgagcgccucgagggcgacguccagcgccucgcccagaccuacggcacccucuccggccucgucgccucccacgaggaccccaaccgcaugaccggcggcccccgcgcccccgccguccccgucggcuucggcgucauccccgagggccucgucggccccggcgaccgcgcccgcggcccccucacccccccccucgacgagauccucuccaaggucaccgaggucuccaacacccuccagaccaagguccagcuccucgacaagguccacggccucgcccucggccacgaggcccaccuccagcgccuccgcgaggccccccccuccccccucaccucccucgcccuccucgaggaguacgucgaccgccgccuccaccgccucuggggcucccuccucgacggcuucgagcagaagcuccagggcguccaguccgagugcgaccuccgcguccaggagguccgccgccagugcgaggagggccaggccgccucccgccgccuccaccagucccucgacggccgcgagcucgcccuccgccaggagcucucccagcucggcucccagcuccagggccucuccgucuccggccgcggcuccugcugcggccagcucgcccucaucaacgcccgcauggacggccucgagcgcgcccuccaggccgucaccgagacccagcgcggccccggcgcccccgccggcgacgagcucacccgccucuccgccgccaugcucgagggcggcgucgacggccuccucgagggccucgagacccucaacggcaccgagggcggcgcccgcggcugcugccuccgccucgacaugggcggcuggggcgucggcggcuucggcaccaugcucgaggagcgcguccagucccucgaggagcgccucgccacccucgccggcgagcucucccacgacuccgccucccccggccgcuccgcccgcccccucguccagaccgagcucgccguccucgagcagcgccucgucucccucgagaccuccugcacccccuccaccaccuccgccauccucgacucccucgucgccgaggucaaggccuggcagucccgcuccgaggcccuccuccgccaggucgccucccacgccgcccuccuccagcagcucaacggcaccgucgccgagguccagggccagcucgccgagggcaccggcuccucccuccagggcgagaucacccuccucaaggucaaccucaacuccgucuccaagucccucaccggccucuccgacuccgucucccaguacuccgacgccuuccucgccgccaacaccucccucgacgagcgcgagcgcaaggucgaggccgagguccaggccauccaggagcaggucuccucccagggcucccgccuccaggccggccaccgccagguccucaaccuccgcggcgagcucgagcagcucaaggccggcgucgccaaggucgccuccggccucucccgcugccaggacaccgcccagaagcuccagcacaccgucggccacuucgaccagcgcgucgcccaggucgagggcgccugccgccgccucggccuccucgccgccggccucgacucccuccccaccgagccccuccgcccccgcgagggccucuggucccacgucgaccagcucaaccgcacccucgcccagcacacccaggacaucgcccgccuccgcgacgaccuccucgacugccaggcccagcucgccgagcagguccgccccggccaggccaacuga

SEQ ID NO: 42709 - RNA, 2505 nt, Artificial Sequence
  derived and/or modified sequence opt2 from EML1__Homo_sapiens__NP_001008707
auggaggacggcuucuccuccuacuccucccucuacgacaccuccucccuccuccaguucugcaacgacgacuccgccuccgccgccuccuccauggaggucaccgaccgcaucgccucccucgagcagcgcguccagaugcaggaggacgacauccagcuccucaaguccgcccucgccgacgucguccgccgccucaacaucaccgaggagcagcaggccguccucaaccgcaagggccccaccaaggcccgcccccucaugcagacccucccccuccgcaccaccgucaacaacggcaccguccuccccaagaagcccaccggcucccuccccucccccuccggcguccgcaaggagaccgccguccccgccaccaagcgccucaaccgcuccgucucccuccucaacgccugcaagcucaaccgcuccacccccuccaacaucaagcgcaccuccuccuccgagcgcgucucccccggcggccgccgcgaguccaacggcgacucccgcggcaaccgcaaccgcaccggcuccaccuccuccuccuccuccggcaagaagaacuccgaguccaagcccaaggagcccgucuucuccgccgaggagggcuacgucaagauguuccuccgcggccgccccgucaccauguacaugcccaaggaccaggucgacuccuacucccucgaggccaaggucgagcuccccaccaagcgccucaagcucgagugggucuacggcuaccgcggccgcgacugccgcaacaaccucuaccuccuccccaccggcgagaccgucuacuucaucgccuccgucgucguccucuacaacgucgaggagcagcuccagcgccacuacgccggccacaacgacgacgucaagugccucgccguccaccccgaccgcaucaccaucgccaccggccaggucgccggcaccuccaaggacggcaagcagcuccccccccacguccgcaucugggacuccgucacccucaacacccuccacgucaucggcaucggcuucuucgaccgcgccgucaccugcaucgccuucuccaaguccaacggcggcaccaaccucugcgccgucgacgacuccaacgaccacguccucuccgucugggacuggcagaaggaggagaagcucgccgacgucaagugcuccaacgaggccgucuucgccgccgacuuccaccccaccgacaccaacaucaucgucaccugcggcaagucccaccucuacuucuggacccucgagggcuccucccucaacaagaagcagggccucuucgagaagcaggagaagcccaaguucguccucugcgucaccuucuccgagaacggcgacaccaucaccggcgacuccuccggcaacauccucgucuggggcaagggcaccaaccgcaucuccuacgccguccagggcgcccacgagggcggcaucuucgcccucugcaugcuccgcgacggcacccucgucuccggcggcggcaaggaccgcaagcucaucuccugguccggcaacuaccagaagcuccgcaagaccgagauccccgagcaguucggccccauccgcaccgucgccgagggcaagggcgacgucauccucaucggcaccacccgcaacuucguccuccagggcacccucuccggcgacuucacccccaucacccagggccacaccgacgagcucuggggccucgccauccacgccuccaagucccaguuccucaccugcggccacgacaagcacgccacccucugggacgccgucggccaccgccccgucugggacaagaucaucgaggaccccgcccaguccuccggcuuccaccccuccggcuccgucgucgccgucggcacccucaccggccgcugguucgucuucgacaccgagaccaaggaccucgucaccguccacaccgacggcaacgagcagcucuccgucaugcgcuacucccccgacggcaacuuccucgccaucggcucccacgacaacugcaucuacaucuacggcgucuccgacaacggccgcaaguacacccgcgucggcaagugcuccggccacuccuccuucaucacccaccucgacugguccgucaacucccaguuccucgucuccaacuccggcgacuacgagauccucuacuggguccccuccgccugcaagcaggucgucuccgucgagaccacccgcgacaucgagugggccaccuacaccugcacccucggcuuccacgucuucggcgucuggcccgagggcuccgacggcaccgacaucaacgccgucugccgcgcccacgagaagaagcuccucuccaccggcgacgacuucggcaagguccaccucuucuccuaccccugcucccaguuccgcgcccccucccacaucuacggcggccacuccucccacgucaccaacgucgacuuccucugcgaggacucccaccucaucuccaccggcggcaaggacaccuccaucaugcaguggcgcgucaucuga

SEQ ID NO: 42710 - RNA, 2553 nt, Artificial Sequence
  derived and/or modified sequence opt2 from EML2__Homo_sapiens__NP_001180197
augcucgagcgccgcgcccuccucuggcagcgcgaggccggccccggcuggggcgaccgcgcccgcgccggcaccggcggcgccggcggcggcugcggcggcgccauggccgagcgcggccccgccuucugcggccucuacgacaccuccucccuccuccgcuacugcaacgacgacaaccucuccggcaccuccggcauggaggucgacgaccgcgucuccgcccucgagcagcgccuccagcuccaggaggacgagcucgccguccucaaggccgcccucgccgacgcccuccgccgccuccgcgccugcgaggagcagggcgccgcccuccgcgcccgcggcacccccaagggccgcgcccccccccgccucggcaccaccgccuccgucugccagcuccucaagggccuccccacccgcaccccccucaacggcuccggccccccccgccgcgucggcggcuacgccaccucccccuccucccccaagaaggaggccaccuccggccgcuccuccguccgccgcuaccucucccccgagcgccucgccuccguccgccgcgaggacccccgcucccgcaccaccuccuccuccuccaacugcuccgccaagaaggagggcaagaccaaggaggucaucuucuccgucgaggacggcuccgucaagauguuccuccgcggccgccccguccccaugaugauccccgacgagcucgcccccaccuacucccucgacacccgcuccgagcuccccuccugccgccucaagcucgagugggucuacggcuaccgcggccgcgacugccgcgccaaccucuaccuccuccccaccggcgagaucgucuacuucgucgccuccgucgccguccucuacuccgucgaggagcagcgccagcgccacuaccucggccacaacgacgacaucaagugccucgccauccaccccgacauggucaccaucgccaccggccaggucgccggcaccaccaaggagggcaagccccuccccccccacguccgcaucugggacuccgucucccucuccacccuccacguccucggccucggcgucuucgaccgcgccgucugcugcgucggcuucuccaaguccaacggcggcaaccuccucugcgccgucgacgaguccaacgaccacaugcucuccgucugggacugggccaaggagaccaaggucgucgacgucaagugcuccaacgaggccguccucgucgccaccuuccaccccaccgaccccaccguccucaucaccugcggcaagucccacaucuacuucuggacccucgagggcggcucccucuccaagcgccagggccucuucgagaagcacgagaagcccaaguacguccucugcgucaccuuccucgagggcggcgacgucgucaccggcgacuccggcggcaaccucuacgucuggggcaagggcggcaaccgcaucacccaggccguccucggcgcccacgacggcggcgucuucggccucugcgcccuccgcgacggcacccucgucuccggcggcggccgcgaccgccgcgucguccucuggggcuccgacuacuccaagcuccaggaggucgagguccccgaggacuucggccccguccgcaccgucgccgagggccacggcgacacccucuacgucggcaccacccgcaacuccauccuccagggcuccguccacaccggcuucucccuccucguccagggccacgucgaggagcucuggggccucgccacccaccccucccgcgcccaguucgucaccugcggccaggacaagcucguccaccucugguccuccgacucccaccagccccucuggucccgcaucaucgaggaccccgcccgcuccgccggcuuccaccccuccggcuccguccucgccgucggcaccgucaccggccgcuggcuccuccucgacaccgagacccacgaccucgucgccauccacaccgacggcaacgagcagaucuccgucgucuccuucucccccgacggcgccuaccucgccgucggcucccacgacaaccucgucuacgucuacaccgucgaccagggcggccgcaaggucucccgccucggcaagugcuccggccacuccuccuucaucacccaccucgacugggcccaggacuccuccugcuucgucaccaacuccggcgacuacgagauccucuacugggaccccgccaccugcaagcagaucaccuccgccgacgccguccgcaacauggagugggccaccgccaccugcguccucggcuucggcgucuucggcaucugguccgagggcgccgacggcaccgacaucaacgccgucgcccgcucccacgacggcaagcuccucgccuccgccgacgacuucggcaagguccaccucuucuccuaccccugcugccagccccgcgcccucucccacaaguacggcggccacuccucccacgucaccaacgucgccuuccucugggacgacuccauggcccucaccaccggcggcaaggacaccuccguccuccaguggcgcgucgucuga

SEQ ID NO: 42711 - RNA, 2772 nt, Artificial Sequence
  derived and/or modified sequence opt2 from EML4__Homo_sapiens__NP_001138548
auggacggcuucgccggcucccucgacgacuccaucuccgccgccuccaccuccgacguccaggaccgccucuccgcccucgagucccgcguccagcagcaggaggacgagaucaccguccucaaggccgcccucgccgacguccuccgccgccucgccaucuccgaggaccacgucgccuccgucaagaaguccgucuccuccaagggccagcccuccccccgcgccgucauccccauguccugcaucaccaacggcuccggcgccaaccgcaagcccucccacaccuccgccgucuccaucgccggcaaggagacccucuccuccgccgccaaguccaucaagcgccccucccccgccgagaagucccacaacuccugggagaacuccgacgacucccgcaacaagcucuccaagauccccuccacccccaagcucauccccaaggucaccaagaccgccgacaagcacaaggacgucaucaucaaccaggagggcgaguacaucaagauguucaugcgcggccgccccaucaccauguucauccccuccgacgucgacaacuacgacgacauccgcaccgagcucccccccgagaagcucaagcucgagugggccuacggcuaccgcggcaaggacugccgcgccaacgucuaccuccuccccaccggcgagaucgucuacuucaucgccuccgucgucguccucuucaacuacgaggagcgcacccagcgccacuaccucggccacaccgacugcgucaagugccucgccauccaccccgacaagauccgcaucgccaccggccagaucgccggcgucgacaaggacggccgcccccuccagccccacguccgcgucugggacuccgucacccucuccacccuccagaucaucggccucggcaccuucgagcgcggcgucggcugccucgacuucuccaaggccgacuccggcguccaccucugcgucaucgacgacuccaacgagcacaugcucaccgucugggacuggcagaagaaggccaagggcgccgagaucaagaccaccaacgaggucguccucgccgucgaguuccaccccaccgacgccaacaccaucaucaccugcggcaagucccacaucuucuucuggaccugguccggcaacucccucacccgcaagcagggcaucuucggcaaguacgagaagcccaaguucguccagugccucgccuuccucggcaacggcgacguccucaccggcgacuccggcggcgucaugcucaucugguccaagaccaccgucgagcccacccccggcaagggccccaagggcgucuaccagaucuccaagcagaucaaggcccacgacggcuccgucuucacccucugccagaugcgcaacggcaugcuccucaccggcggcggcaaggaccgcaagaucauccucugggaccacgaccucaaccccgagcgcgagaucgagguccccgaccaguacggcaccauccgcgccgucgccgagggcaaggccgaccaguuccucgucggcaccucccgcaacuucauccuccgcggcaccuucaacgacggcuuccagaucgagguccagggccacaccgacgagcucuggggccucgccacccaccccuucaaggaccuccuccucaccugcgcccaggaccgccaggucugccucuggaacuccauggagcaccgccucgaguggacccgccucgucgacgagcccggccacugcgccgacuuccaccccuccggcaccgucgucgccaucggcacccacuccggccgcugguucguccucgacgccgagacccgcgaccucgucuccauccacaccgacggcaacgagcagcucuccgucaugcgcuacuccaucgacggcaccuuccucgccgucggcucccacgacaacuucaucuaccucuacgucgucuccgagaacggccgcaaguacucccgcuacggccgcugcaccggccacuccuccuacaucacccaccucgacuggucccccgacaacaaguacaucauguccaacuccggcgacuacgagauccucuacugggacauccccaacggcugcaagcucauccgcaaccgcuccgacugcaaggacaucgacuggaccaccuacaccugcguccucggcuuccaggucuucggcgucuggcccgagggcuccgacggcaccgacaucaacgcccucguccgcucccacaaccgcaaggucaucgccgucgccgacgacuucugcaagguccaccucuuccaguaccccugcuccaaggccaaggcccccucccacaaguacuccgcccacuccucccacgucaccaacgucuccuucacccacaacgacucccaccucaucuccaccggcggcaaggacauguccaucauccaguggaagcucgucgagaagcucucccucccccagaacgagaccgucgccgacaccacccucaccaaggcccccgucuccuccaccgaguccgucauccaguccaacacccccacccccccccccucccagccccucaacgagaccgccgaggaggagucccgcaucuccuccucccccacccuccucgagaacucccucgagcagaccgucgagcccuccgaggaccacuccgaggaggaguccgaggagggcuccggcgaccucggcgagccccucuacgaggagcccugcaacgagaucuccaaggagcaggccaaggccacccuccucgaggaccagcaggaccccucccccuccuccuga

SEQ ID NO: 42712 - RNA, 5934 nt, Artificial Sequence
  derived and/or modified sequence opt2 from EML5__Homo_sapiens__NP_899243
auggccgcccgcuccgcccccuccugccaccuccgccucgagugggucuacggcuaccgcggccaccagugccgcaacaaccucuacuacaccgccgccaaggagaucgucuacuucgucgccggcgucggcgucgucuacuccccccgcgagcaccgccagaaguucuaccgcggccacuccgacgacaucaucucccucgcccuccaccccgagcgcguccucgucgccaccggccaggucggcaaggagcccuacaucugcaucugggacuccuacaccguccagaccaucuccguccucaaggacguccacacccacggcaucgccugccucgccuucgaccucgacggccagcgccucgucuccgucggccucgacuccaagaacgccgucugcgucugggacuggaagcgcggcaagaugcucuccauggcccccggccacaccgaccgcaucuucgacaucuccugggaccucuaccagcccaacaagcucgucuccugcggcgucaagcacaucaaguucuggucccucugcggcaacgcccucacccccaagcgcggcgucuucggcaagaccggcgaccuccagaccauccucugccucgccugcgcccgcgacgagcucaccuacuccggcgcccucaacggcgacaucuacgucuggaagggcaucaaccucauccgcaccauccagggcgcccacgccgccggcaucuucuccaugaacgccugcgaggagggcuucgccaccggcggccgcgacggcugcauccgccucugggaccucaccuucaagcccaucaccgucaucgaccuccgcgagaccgaccagggcuacaagggccucuccguccgcuccgucugcuggcgcggcgaccacauccucgucggcacccaggacuccgagaucuucgagaucgucguccaggagcgcaacaagcccuuccucaucaugcagggccacugcgagggcgagcucugggcccucgccguccaccccaccaagccccucgccgucaccggcuccgacgaccgcuccguccgcaucuggucccucgucgaccacgcccucaucgcccgcugcaacauggaggagcccauccgcugcgccgccgucaacgccgacggcauccaccucgcccucggcaugaaggacggcuccuucaccguccuccgcguccgcgacaugaccgaggucguccacaucaaggaccgcaaggaggccauccacgagcucaaguacucccccgacggcaccuaccucgccgucggcugcaacgacuccuccgucgacaucuacggcgucgcccagcgcuacaagaaggucggcgagugccucggcucccucuccuucaucacccaccucgacugguccuccgacucccgcuaccuccagaccaacgacggcaacggcaagcgccucuucuaccgcaugcccggcggcaaggaggucaccuccaccgaggagaucaagggcguccacugggccuccuggaccugcgucuccggccucgaggucaacggcaucuggcccaaguacuccgacaucaacgacaucaacuccgucgacggcaacuacaucggccagguccucgucaccgccgacgacuacggcaucaucaagcucuuccgcuaccccugccuccgcaagggcgccaaguuccgcaaguacaucggccacuccgcccacgucaccaacguccgcuggucccacgacuaccagugggucaucuccaucggcggcgccgaccacuccgucuuccaguggaaguucauccccgagcgcaagcucaaggacgccguccacaucgccccccaggagucccucgccgacucccacuccgacgaguccgacuccgaccucuccgacguccccgagcucgacuccgagaucgagcaggagacccagcucaccuaccgccgccaggucuacaaggaggaccucccccagcucaaggagcagugcaaggagaagcagaaguccgccaccuccaagcgccgcgagcgcgcccccggcaacuccauccgccuccacuucguccacggcuaccgcggcuacgacugccgcuccaaccucuucuacacccagaucggcgagaucgucuaccacgucgccgccgucggcgucaucuacaaccgccagcagaacacccagcgcuucuaccucggccacgacgacgacauccucugccucaccauccacccccucaaggacuacgucgccaccggccaggucggccgcgaccccuccauccacaucugggacaccgagaccaucaagccccucuccauccucaagggccaccaccaguacggcgucuccgccgucgacuucuccgccgacggcaagcgccucgccuccgucggcaucgacgacucccacaccgucguccucugggacuggaagaagggcgagaagcucuccaucgcccgcggcuccaaggacaagaucuucgucgucaagaugaaccccuacguccccgacaagcucaucaccgccggcaucaagcacaugaaguucuggcgcaaggccggcggcggccucaucggccgcaagggcuacaucggcacccucggcaagaacgacaccaugaugugcgccgucuacggcuggaccgaggagauggccuucuccggcaccuccaccggcgacgucugcaucuggcgcgacaucuuccucgucaagaccgucaaggcccacgacggccccgucuucuccaugcacgcccucgagaagggcuucgucaccggcggcaaggacggcaucgucgcccucugggacgacuccuucgagcgcugccucaagaccuacgccaucaagcgcgccgcccucgcccccggcuccaagggccuccuccucgaggacaaccccuccauccgcgccaucucccucggccacggccacauccucgucggcaccaagaacggcgagauccucgaggucgacaaguccggccccaucacccuccucguccagggccacauggagggcgaggucuggggccucgccacccaccccuaccuccccaucugcgccaccgucuccgacgacaagacccuccgcaucugggaccucucccccucccacugcaugcucgccguccgcaagcucaagaagggcggccgcugcugcugcuucucccccgacggcaaggcccucgccgucggccucaacgacggcuccuuccucauggccaacgccgacacccucgaggaccucgucuccuuccaccaccgcaaggacaugaucuccgacauccgcuucucccccggcuccggcaaguaccucgccgucgccucccacgacuccuucaucgacaucuacaacgucauguccuccaagcgcgucggcaucugcaagggcgccaccuccuacaucacccacaucgacugggacauccgcggcaagcuccuccaggucaacaccggcgccaaggagcagcucuucuucgaggccccccgcggcaagaagcagaccauccccuccgucgaggucgagaagaucgccugggccuccuggaccuccguccucggccucugcugcgagggcaucuggcccgucaucggcgaggucaccgacgucaccgccuccugccucaccuccgacaagaugguccucgccaccggcgacgaccucggcuucgucaagcucuuccgcuaccccaccaagggcaaguucggcaaguucaagcgcuacgucgcccacuccacccacgucaccaacguccgcuggaccuacgacgacuccaugcucgucacccucggcggcaccgacaugucccucauggucuggaccaacgagauggagggcuaccgcgagaagcgccccugcgacuccgaggaguccgacaucgacuccgaggaggacggcggcuacgacuccgacgucacccgcgagaacgagaucuccuacaccauccgcgcccucuccaccaacauccgccccaugcucggcaucaagccccaccuccagcagaaggagcccuccaucgacgagcgccagggcgucguccgcggcucccgcccccccgucucccgcgcccccccccagcccgagaagcuccagaccaacaacgucggcaagaagaagcgccccaucgaggaccucguccucgagcucaucuucggcuaccgcggccgcgacugccgcaacaacguccacuaccucaacgacggcgacgacaucaucuaccacaccgccuccgucggcauccuccacaacgucgccaccggcucccaguccuucuaccaggagcacaacgacgacauccucugccucaccgucaaccagcaccccaaguucaucaacaucgucgccaccggccaggucggcgacuccgccgacauguccgccaccgcccccuccauccacaucugggacgccaugaacaagcagacccucuccauccuccgcugcuaccacuccaagggcgucugcuccgucuccuucuccgccaccggcaagcuccuccucuccgucggccucgaccccgagcacaccaucaccaucuggcgcuggcaggagggcgccaagaucgccucccgcgccggccacaaccagcgcaucuucgucgccgaguuccgccccgacuccgacacccaguucgucuccgucggcgucaagcacgucaaguucuggacccucgccggccgcgcccuccucuccaagaagggccuccucuccacccucgaggacgcccgcaugcagaccaugcucgccaucgccuucggcgccaacaaccucaccuucaccggcaccaucuccggcgacgucugcgucuggaaggaccacauccucugccgcaucgucgcccgcgcccacaacggccccgucuucgccauguacaccacccuccgcgacggccucaucgucaccggcggcaaggagcgccccuccaaggagggcggcgccgucaagcucugggaccaggagcuccgccgcugccgcgccuuccgccucgagaccggccaggccaccgacugcguccgcuccgucugccgcggcaagggcaagauccucgucggcacccgcaacgccgagaucaucgaggucggcgagaagaacgccgccugcaacauccucgucaacggccacgucgacggccccaucuggggccucgccacccaccccucccgcgacuucuuccucuccgccgccgaggacggcaccguccgccucugggacaucgccgacaagaagaugcucaacaaggucaaccucggccacgccgcccgcaccgucugcuacucccccgagggcgacauggucgccaucggcaugaagaacggcgaguucaucauccuccucgucuccucccucaagaucuggggcaagaagcgcgaccgccgcugcgccauccacgacauccgcuucucccccgacucccgcuaccucgccgucggcuccuccgagaacuccgucgacuucuacgaccucacccucggccccacccucaaccgcaucuccuacugcaaggacauccccuccuucgucauccagauggacuucuccgccgacuccuccuaccuccaggucuccuccggcugcuacaagcgccacgucuacgagguccccuccggcaagcaccucauggaccacgccgccaucgaccgcaucaccugggccaccuggaccuccauccucggcgacgagguccucggcaucuggucccgccacgccgagaaggccgacgucaacugcgccugcgucucccacuccggcaucucccucgucaccggcgacgacuucggcauggucaagcucuucgacuuccccugccccgagaaguucgccaagcacaagcgcuuccucggccacuccccccacgucaccaacauccgcuucaccuccggcgaccgccacgucgucuccgccggcggcgacgacugcucccucuucgucuggaagugcguccacaccccccacuga

SEQ ID NO: 42713 - RNA, 5877 nt, Artificial Sequence
  derived and/or modified sequence opt2 from EML6__Homo_sapiens__NP_001034842
auggccgaccgcaccgccccccgcugccagcuccgccucgagugggucuacggcuaccgcggccaccagugccgcaacaaccucuacuacaccgccggcaaggaggucgucuacuucgucgccggcgucggcgucgucuacaacacccgcgagcacucccagaaguucuuccucggccacaacgacgacaucaucucccucgcccuccaccccgacaagacccucgucgccaccggccaggucggcaaggagcccuacaucugcaucugggacuccuacaacguccagaccgucucccuccucaaggacguccacacccacggcgucgccugccucgccuucgacuccgacggccagcgccucgccuccgucggccucgacgccaagaacaccgucugcaucugggacuggcgcaagggcaagcuccucgccuccgccaccggccacuccgaccgcaucuucgacaucuccugggaccccuaccagcccaaccgcgucgucuccugcggcgucaagcacaucaaguucuggacccucugcggcaacgcccucaccgccaagcgcggcaucuucggcaagaccggcgaccuccagaccauccucugccucgccugcgccaaggaggacaucaccuacuccggcgcccucaacggcgacaucuacgucuggaagggccucaaccucguccgcaccauccagggcgcccacuccgccggcaucuucuccauguacgccugcgaggagggcuucgccaccggcggccgcgacggcugcauccgccucugggacaccgacuucaagcccaucaccaagaucgaccuccgcgagaccgagcagggcuacaagggccucuccauccgcuccgucugcuggaaggccgaccgccuccucgccggcacccaggacuccgagaucuucgaggucaucguccgcgagcgcgacaagcccaugcucauccuccagggccacugcgagggcgagcucugggcccucgcccuccaccccaagaagccccucgccgucaccggcuccgacgaccgcuccguccgccucuggucccucgccgaccacgcccucaucgcccgcugcaacauggaggaggccguccgcuccgucgccuucucccccgacggcucccagcucgcccucggcaugaaggacggcuccuucaucguccuccgcguccgcgacaugaccgaggucguccacaucaaggaccgcaaggaggucauccacgagaugaaguucucccccgacggcuccuaccucgccgucggcuccaacgacggccccgucgacgucuacgccgucgcccagcgcuacaagaagaucggcgagugcuccaagucccucuccuucaucacccacaucgacuggucccucgacuccaaguaccuccagaccaacgacggcgccggcgagcgccucuucuaccgcaugcccuccggcaagccccucaccuccaaggaggagaucaagggcauccccugggccuccuggaccugcgucaagggccccgaggucuccggcaucuggcccaaguacaccgaggucaccgacaucaacuccgucgacgccaacuacaacuccuccguccucgucuccggcgacgacuucggccucgucaagcucuucaaguuccccugccucaagcgcggcgccaaguuccgcaaguacgucggccacuccgcccacgucaccaacguccgcuggucccacgacuuccaguggguccucuccaccggcggcgccgaccacuccgucuuccaguggcgcuucauccccgagggcgucuccaacggcaugcucgagaccgccccccaggagggcggcgccgacuccuacuccgaggaguccgacuccgaccucuccgacguccccgagcucgacuccgacaucgagcaggaggcccagaucaacuacgaccgccaggucuacaaggaggaccucccccagcucaagcagcaguccaaggagaagaaccacgccguccccuuccucaagcgcgagaaggcccccgaggacucccucaagcuccaguucauccacggcuaccgcggcuacgacugccgcaacaaccucuucuacacccaggccggcgaggucgucuaccacaucgccgccgucgccgucgucuacaaccgccagcagcacucccagcgccucuaccucggccacgacgacgacauccucucccucaccauccaccccgucaaggacuacgucgccaccggccaggucggccgcgacgccgccauccacgucugggacacccagacccucaagugccucucccuccucaagggccagcaccagcgcggcgucugcgcccucgacuucuccgccgacggcaagugccucgucuccgucggccucgacgacuuccacuccaucgucuucugggacuggaagaagggcgagaagaucgccaccacccgcggccacaaggacaagaucuucgucgucaagugcaacccccaccacgucgacaagcucgucaccgucggcaucaagcacaucaaguucuggcagcaggccggcggcggcuucaccuccaagcgcggcaccuucggcuccgucggcaagcucgagaccaugaugugcgucuccuacggccgcauggaggaccucgucuucuccggcgccgccaccggcgacaucuucaucuggaaggacauccuccuccucaagaccgucaaggcccacgacggccccgucuucgccauguacgcccucgacaagggcuucgucaccggcggcaaggacggcaucgucgagcucugggacgacauguucgagcgcugccucaagaccuacgccaucaagcgcuccgcccucuccaccuccuccaagggccuccuccucgaggacaaccccuccauccgcgccaucacccucggccacggccacauccucgucggcaccaagaacggcgagauccucgagaucgacaaguccggccccaugacccuccucguccagggccacauggagggcgaggucuggggccucgccgcccacccccuccuccccaucugcgccaccgucuccgacgacaagacccuccgcaucugggagcucuccgcccagcaccgcaugcucgccguccgcaagcucaagaagggcggccgcugcugcgccuucucccccgacggcaaggcccucgccgucggccucaacgacggcuccuuccucgucgucaacgccgacaccgucgaggacauggucuccuuccaccaccgcaaggagaugaucuccgacaucaaguucuccaaggacaccggcaaguaccucgccgucgccucccacgacaacuucgucgacaucuacaacguccucaccuccaagcgcgucggcaucugcaagggcgccuccuccuacaucacccacaucgacugggacucccgcggcaagcuccuccaggucaacuccggcgcccgcgagcagcucuucuucgaggccccccgcggcaagcgccacaucauccgccccuccgagaucgagaagaucgagugggacaccuggaccugcguccucggccccaccugcgagggcaucuggcccgcccacuccgacaucaccgacgucaacgccgccucccucaccaaggacugcucccuccucgccaccggcgacgacuucggcuucgucaagcucuucuccuaccccgucaagggccagcacgcccgcuucaagaaguacgucggccacuccgcccacgucaccaacguccgcuggcuccacaacgacuccguccuccucaccgucggcggcgccgacaccgcccucaugaucuggacccgcgaguucgucggcacccaggaguccaagcucgucgacuccgaggaguccgacaccgacgucgaggaggacggcggcuacgacuccgacgucgcccgcgagaaggccaucgacuacaccaccaagaucuacgccgucuccauccgcgagauggagggcaccaagccccaccagcagcucaaggaggucuccgucgaggagcgcccccccgucucccgcgccgccccccagcccgagaagcuccagaagaacaacaucaccaagaagaagaagcucgucgaggagcucgcccucgaccacgucuucggcuaccgcggcuucgacugccgcaacaaccuccacuaccucaacgacggcgccgacaucaucuuccacaccgccgccgccggcaucguccagaaccucuccaccggcucccaguccuucuaccucgagcacaccgacgacauccucugccucaccgucaaccagcaccccaaguaccgcaacgucgucgccaccucccagaucggcaccacccccuccauccacaucugggacgccaugaccaagcacacccucuccaugcuccgcugcuuccacuccaagggcgucaacuacaucaacuucuccgccaccggcaagcuccucgucuccgucggcgucgaccccgagcacaccaucaccgucuggcgcuggcaggagggcgccaaggucgccucccgcggcggccaccucgagcgcaucuucgucgucgaguuccgccccgacuccgacacccaguucgucuccgucggcgucaagcacaugaaguucuggacccucgccggcuccgcccuccucuacaagaagggcgucaucggcucccucggcgccgccaagaugcagaccaugcucuccgucgccuucggcgccaacaaccucaccuucaccggcgccaucaacggcgacgucuacgucuggaaggaccacuuccucauccgccucgucgccaaggcccacaccggccccgucuucaccauguacaccacccuccgcgacggccucaucgucaccggcggcaaggagcgccccaccaaggagggcggcgccgucaagcucugggaccaggagaugaagcgcugccgcgccuuccagcucgagaccggccagcucgucgagugcguccgcuccgucugccgcggcaagggcaagauccucgucggcaccaaggacggcgagaucaucgaggucggcgagaagaacgccgccuccaacauccucaucgacggccacauggagggcgagaucuggggccucgccacccaccccuccaaggaccucuucaucuccgccuccaacgacggcaccgcccgcaucugggaccucgccgacaagaagcuccucaacaaggucucccucggccacgccgcccgcugcgccgccuacucccccgacggcgagauggucgccaucggcaugaagaacggcgaguucgucauccuccucgucaacucccucaaggucuggggcaagaagcgcgaccgcaaguccgccauccaggacauccgcaucucccccgacaaccgcuuccucgccgucggcuccuccgagcacaccgucgacuucuacgaccucacccagggcaccaaccucaaccgcaucggcuacugcaaggacauccccuccuucgucauccagauggacuucuccgccgacggcaaguacauccaggucuccaccggcgccuacaagcgccagguccacgaggucccccucggcaagcaggucaccgaggccgucgucaucgagaagaucaccugggccuccuggaccuccguccucggcgacgaggucaucggcaucuggccccgcaacgccgacaaggccgacgucaacugcgccugcgucacccacgccggccucaacaucgucaccggcgacgacuucggccucgucaagcucuucgacuuccccugcaccgagaaguucgccaagcacaagcgcuacuucggccacuccgcccacgucaccaacauccgcuucuccuacgacgacaaguacgucgucuccaccggcggcgacgacugcuccgucuucgucuggcgcugccucuga

SEQ ID NO: 42714 - RNA, 474 nt, Artificial Sequence
  derived and/or modified sequence opt2 from EMP1__Homo_sapiens__NP_001414
augcucguccuccucgccggcaucuucgucguccacaucgccaccgucaucaugcucuucgucuccaccaucgccaacgucuggcucgucuccaacaccgucgacgccuccgucggccucuggaagaacugcaccaacaucuccugcuccgacucccucuccuacgccuccgaggacgcccucaagaccguccaggccuucaugauccucuccaucaucuucugcgucaucgcccuccucgucuucgucuuccagcucuucaccauggagaagggcaaccgcuucuuccucuccggcgccaccacccucgucugcuggcucugcauccucgucggcgucuccaucuacaccucccacuacgccaaccgcgacggcacccaguaccaccacggcuacuccuacauccucggcuggaucugcuucugcuucuccuucaucaucggcguccucuaccucguccuccgcaagaaguga

SEQ ID NO: 42715 - RNA, 504 nt, Artificial Sequence
  derived and/or modified sequence opt2 from EMP2__Homo_sapiens__XP_006720927
augcucguccuccucgccuucaucaucgccuuccacaucaccuccgccgcccuccucuucaucgccaccgucgacaacgccuggugggucggcgacgaguucuucgccgacgucuggcgcaucugcaccaacaacaccaacugcaccgucaucaacgacuccuuccaggaguacuccacccuccaggccguccaggccaccaugauccucuccaccauccucugcugcaucgccuucuucaucuucguccuccagcucuuccgccucaagcagggcgagcgcuucguccucaccuccaucauccagcucauguccugccucugcgucaugaucgccgccuccaucuacaccgaccgccgcgaggacauccacgacaagaacgccaaguucuaccccgucacccgcgagggcuccuacggcuacuccuacauccucgccugggucgccuucgccugcaccuucaucuccggcaugauguaccucauccuccgcaagcgcaaguga

SEQ ID NO: 42716 - RNA, 873 nt, Artificial Sequence
  derived and/or modified sequence opt2 from EMX1__Homo_sapiens__NP_004088
augugccucgccggcugcaccccccgcaaggccgccgcccccggccgcggcgcccucccccgcgcccgccucccccgcaccgcccccgccgccgccaccauguuccagcccgccgccaagcgcggcuucaccaucgagucccucgucgccaaggacggcggcaccggcggcggcaccggcggcggcggcgccggcucccaccuccucgccgccgccgccuccgaggagccccuccgccccaccgcccucaacuacccccaccccuccgccgccgaggccgccuucgucuccggcuuccccgccgccgccgccgccggcgccggccgcucccucuacggcggccccgagcucgucuuccccgaggccaugaaccaccccgcccucaccguccaccccgcccaccagcucggcgccuccccccuccagcccccccacuccuucuucggcgcccagcaccgcgacccccuccacuucuaccccuggguccuccgcaaccgcuucuucggccaccgcuuccaggccuccgacgucccccaggacggccuccuccuccacggccccuucgcccgcaagcccaagcgcauccgcaccgccuucucccccucccagcuccuccgccucgagcgcgccuucgagaagaaccacuacgucgucggcgccgagcgcaagcagcucgccggcucccucucccucuccgagacccaggucaaggucugguuccagaaccgccgcaccaaguacaagcgccagaagcucgaggaggagggccccgaguccgagcagaagaagaagggcucccaccacaucaaccgcuggcgcaucgccaccaagcaggccaacggcgaggacaucgacgucaccuccaacgacuga

SEQ ID NO: 42717 - RNA, 510 nt, Artificial Sequence
  derived and/or modified sequence opt2 from EMX2__Homo_sapiens__NP_001159396
auguuccagcccgcccccaagcgcugcuucaccaucgagucccucgucgccaaggacuccccccuccccgccucccgcuccgaggaccccauccgccccgccgcccucuccuacgccaacuccucccccaucaaccccuuccucaacggcuuccacuccgccgccgccgccgccgccggccgcggcgucuacuccaaccccgaccucgucuucgccgaggccgucucccacccccccaaccccgccguccccguccaccccgucccccccccccacgcccucgccgcccacccccuccccuccucccacuccccccacccccucuucgccucccagcagcgcgaccccuccaccuucuaccccuggcucauccaccgcuaccgcuaccucggccaccgcuuccagggcaaguccauggucuccgagcccaagaacaagguccagaaggccgaggccggcggccgccgccuccgcuucgccaccaaggagaagcgcgacgcccccuacuga

SEQ ID NO: 42718 - RNA, 1179 nt, Artificial Sequence
  derived and/or modified sequence opt2 from EN1__Homo_sapiens__NP_001417
auggaggagcagcagcccgagcccaagucccagcgcgacuccgcccucggcgccgccgccgccgccacccccggcggccucucccucucccucucccccggcgccuccggcuccuccggcuccggcuccgacggcgacuccguccccgucuccccccagcccgccccccccuccccccccgccgcccccugccuccccccccucgcccaccacccccaccuccccccccaccccccccccccccccccccagcaccucgccgcccccgcccaccagccccagcccgccgcccagcuccaccgcaccaccaacuucuucaucgacaacauccuccgccccgacuucggcugcaagaaggagcagccccccccccagcuccucgucgccgccgccgcccgcggcggcgccggcggcggcggccgcgucgagcgcgaccgcggccagaccgccgccggccgcgaccccguccacccccucggcacccgcgcccccggcgccgccucccuccucugcgcccccgacgccaacugcggcccccccgacggcucccagcccgccgccgccggcgccggcgccuccaaggccggcaaccccgccgccgccgccgccgccgccgccgccgccgucgccgccgccgccgccgccgccgccgccaagcccuccgacaccggcggcggcggcuccggcggcggcgccggcucccccggcgcccagggcaccaaguaccccgagcacggcaaccccgccauccuccucaugggcuccgccaacggcggccccgucgucaagaccgacucccagcagccccucgucuggcccgccugggucuacugcacccgcuacuccgaccgccccuccuccggcccccgcacccgcaagcucaagaagaagaagaacgagaaggaggacaagcgcccccgcaccgccuucaccgccgagcagcuccagcgccucaaggccgaguuccaggccaaccgcuacaucaccgagcagcgccgccagacccucgcccaggagcucucccucaacgagucccagaucaagaucugguuccagaacaagcgcgccaagaucaagaaggccaccggcaucaagaacggccucgcccuccaccucauggcccagggccucuacaaccacuccaccaccaccguccaggacaaggacgaguccgaguga

SEQ ID NO: 42719 - RNA, 1002 nt, Artificial Sequence
  derived and/or modified sequence opt2 from EN2__Homo_sapiens__NP_001418
auggaggagaacgaccccaagcccggcgaggccgccgccgccgucgagggccagcgccagcccgaguccucccccggcggcggcuccggcggcggcggcggcuccucccccggcgaggccgacaccggccgccgccgcgcccucaugcuccccgccguccuccaggcccccggcaaccaccagcacccccaccgcaucaccaacuucuucaucgacaacauccuccgccccgaguucggccgccgcaaggacgccggcaccugcugcgccggcgccggcggcggccgcggcggcggcgccggcggcgagggcggcgccuccggcgccgagggcggcggcggcgccggcggcuccgagcagcuccucggcuccggcucccgcgagccccgccagaacccccccugcgcccccggcgccggcggcccccuccccgccgccggcuccgacucccccggcgacggcgagggcggcuccaagacccucucccuccacggcggcgccaagaagggcggcgaccccggcggcccccucgacggcucccucaaggcccgcggccucggcggcggcgaccucuccgucuccuccgacuccgacuccucccaggccggcgccaaccucggcgcccagcccaugcucuggcccgccugggucuacugcacccgcuacuccgaccgccccuccuccggcccccgcucccgcaagcccaagaagaagaaccccaacaaggaggacaagcgcccccgcaccgccuucaccgccgagcagcuccagcgccucaaggccgaguuccagaccaaccgcuaccucaccgagcagcgccgccagucccucgcccaggagcucucccucaacgagucccagaucaagaucugguuccagaacaagcgcgccaagaucaagaaggccaccggcaacaagaacacccucgccguccaccucauggcccagggccucuacaaccacuccaccaccgccaaggagggcaaguccgacuccgaguga

SEQ ID NO: 42720 - RNA, 1776 nt, Artificial Sequence
  derived and/or modified sequence opt2 from ENAH__Homo_sapiens__NP_001008493
auguccgagcaguccaucugccaggcccgcgccgccgucauggucuacgacgacgccaacaagaaguggguccccgccggcggcuccaccggcuucucccgcguccacaucuaccaccacaccggcaacaacaccuuccgcgucgucggccgcaagauccaggaccaccaggucgucaucaacugcgccauccccaagggccucaaguacaaccaggccacccagaccuuccaccaguggcgcgacgcccgccaggucuacggccucaacuucggcuccaaggaggacgccaacgucuucgccuccgccaugaugcacgcccucgagguccucaacucccaggagaccggccccacccucccccgccagaacucccagcuccccgcccagguccagaacggccccucccaggaggagcucgagauccagcgccgccagcuccaggagcagcagcgccagaaggagcucgagcgcgagcgccucgagcgcgagcgcauggagcgcgagcgccucgagcgcgagcgccucgagcgcgagcgccucgagcgcgagcgccucgagcaggagcagcucgagcgcgagcgccaggagcgcgagcgccaggagcgccucgagcgccaggagcgccucgagcgccaggagcgccucgagcgccaggagcgccucgaccgcgagcgccaggagcgccaggagcgcgagcgccucgagcgccucgagcgcgagcgccaggagcgcgagcgccaggagcagcucgagcgcgagcagcucgagugggagcgcgagcgccgcaucuccuccgccgccgcccccgccuccgucgagaccccccucaacuccguccucggcgacuccuccgccuccgagcccggccuccaggccgccucccagcccgccgagacccccucccagcagggcaucguccucggcccccucgcccccccccccccccccccccucccccccggccccgcccaggccuccgucgcccucccccccccccccggccccccccccccccccccccuccccuccaccggcccccccccccccccccccccccccccccuccccaaccaggucccccccccccccccccccccccccgcccccccccuccccgccuccggcuucuuccucgccuccauguccgaggacaaccgcccccucaccggccucgccgccgccaucgccggcgccaagcuccgcaaggucucccgcauggaggacaccuccuuccccuccggcggcaacgccaucggcgucaacuccgccuccuccaagaccgacaccggccgcggcaacggcccccucccccucggcggcuccggccucauggaggagauguccgcccuccucgcccgccgccgccgcaucgccgagaagggcuccaccaucgagaccgagcagaaggaggacaagggcgaggacuccgagcccgucaccuccaaggccuccuccaccuccacccccgagcccacccgcaagcccugggagcgcaccaacaccaugaacggcuccaagucccccgucaucucccgccgcgacuccccccgcaagaaccagaucgucuucgacaaccgcuccuacgacucccuccaccgccccaaguccaccccccucucccagcccuccgccaacggcguccagaccgagggccucgacuacgaccgccucaagcaggacauccucgacgagaugcgcaaggagcucaccaagcucaaggaggagcucaucgacgccauccgccaggagcucuccaaguccaacaccgccuga

SEQ ID NO: 42721 - RNA, 3429 nt, Artificial Sequence
  derived and/or modified sequence opt2 from ENAM__Homo_sapiens__NP_114095
augcucguccuccgcugccgccucggcaccuccuuccccaagcucgacaaccucguccccaagggcaagaugaagauccuccucgucuuccucggccuccucggcaacuccgucgccaugcccaugcacaugccccgcaugcccggcuucuccuccaaguccgaggagaugaugcgcuacaaccaguucaacuucaugaacggcccccacauggcccaccucggccccuucuucggcaacggccucccccagcaguucccccaguaccagaugcccauguggccccagcccccccccaacaccuggcacccccgcaaguccuccgcccccaagcgccacaacaagaccgaccagacccaggagacccagaagcccaaccagacccaguccaagaagcccccccagaagcgcccccucaagcagcccucccacaaccagccccagcccgaggaggaggcccagcccccccaggccuucccccccuucggcaacggccucuuccccuaccagcagccccccuggcagaucccccagcgccuccccccccccggcuacggccgcccccccaucuccaacgaggagggcggcaaccccuacuucggcuacuucggcuaccacggcuucggcggccgcccccccuacuacuccgaggagauguucgagcaggacuucgagaagcccaaggaggaggacccccccaaggccgagucccccggcaccgagcccaccgccaacuccaccgucaccgagaccaacuccacccagcccaaccccaagggcucccagggcggcaacgacaccucccccaccggcaacuccacccccggccucaacaccggcaacaacccccccgcccagaacggcaucggcccccuccccgccgucaacgccuccggccagggcggccccggcucccagauccccuggcgccccucccagcccaacauccgcgagaaccaccccuaccccaacauccgcaacuuccccuccggccgccagugguacuucaccggcaccgucaugggccaccgccagaaccgccccuucuaccgcaaccagcagguccagcgcggcccccgcuggaacuucuucgccugggagcgcaagcaggucgcccgccccggcaaccccgucuaccacaaggccuacccccccaccucccgcggcaacuaccccaacuacgccggcaaccccgccaaccuccgccgcaagccccagggccccaacaagcaccccgucggcaccaccgucgccccccucggccccaagcccggccccgucguccgcaacgagaagauccagaaccccaaggagaagccccucggccccaaggagcagaucaucguccccaccaagaaccccaccucccccuggcgcaacucccagcaguacgaggucaacaaguccaacuacaagcucccccacuccgagggcuacaugcccguccccaacuucaacuccgucgaccagcacgagaacuccuacuacccccgcggcgacucccgcaagguccccaacuccgacggccagacccagucccagaaccuccccaagggcaucguccucggcucccgccgcaugcccuacgaguccgagaccaaccaguccgagcucaagcacuccuccuaccagcccgccgucuaccccgaggagauccccucccccgccaaggagcacuuccccgccggccgcaacaccugggaccaccaggagaucuccccccccuucaaggaggaccccggccgccaggaggagcaccucccccaccccucccacggcucccgcggcuccgucuucuaccccgaguacaaccccuacgacccccgcgagaacucccccuaccuccgcggcaacaccugggacgagcgcgacgacucccccaacaccaugggccagaaggaguccccccucuaccccaucaacacccccgaccagaaggagaucguccccuacaacgaggaggaccccgucgaccccaccggcgacgaggucuuccccggccagaaccgcuggggcgaggagcucuccuucaagggcggccccaccguccgccacuacgagggcgagcaguacaccuccaaccagcccaaggaguaccuccccuacucccucgacaaccccuccaagccccgcgaggacuucuacuacuccgaguucuaccccuggucccccgacgagaacuuccccuccuacaacaccgccuccaccaugcccccccccaucgagucccgcggcuacuacgucaacaacgccgccggccccgaggaguccacccucuuccccucccgcaacuccugggaccaccgcauccaggcccagggccagcgcgagcgccgccccuacuucaaccgcaacaucugggaccaggccacccaccuccagaaggcccccgcccgcccccccgaccagaagggcaaccagcccuacuacuccaacacccccgccggccuccagaagaaccccaucuggcacgagggcgagaaccucaacuacggcaugcagaucacccgcaugaacucccccgagcgcgagcacuccuccuuccccaacuucaucccccccuccuaccccuccggccagaaggaggcccaccucuuccaccucucccagcgcggcuccugcugcgccggcuccuccaccggccccaaggacaacccccucgcccuccaggacuacacccccuccuacggccucgcccccggcgagaaccaggacaccuccccccucuacaccgacggcucccacaccaagcagacccgcgacaucaucucccccaccuccauccuccccggccagcgcaacuccuccgagaagcgcgagucccagaaccccuuccgcgacgacgucuccacccuccgccgcaacacccccugcuccaucaagaaccagcucggccagaaggagaucaugcccuuccccgaggccuccucccuccaguccaagaacacccccugccucaagaacgaccucggcggcgacggcaacaacauccucgagcaggucuucgaggacaaccagcucaacgagcgcaccgucgaccucacccccgagcagcucgucaucggcacccccgacgagggcuccaaccccgagggcauccagucccagguccaggagaacgaguccgagcgccagcagcagcgccccuccaacauccuccaccuccccugcuucggcuccaagcucgccaagcaccacuccuccaccaccggcacccccuccuccgacggccgccagucccccuucgacggcgacuccaucacccccaccgagaaccccaacacccucgucgagcucgccaccgaggagcaguucaaguccaucaacgucgacccccucgacgccgacgagcacucccccuucgaguuccuccagcgcggcaccaacguccaggaccagguccaggacugccuccuccuccaggccuga

SEQ ID NO: 42722 - RNA, 1770 nt, Artificial Sequence
  derived and/or modified sequence opt2 from ENC1__Homo_sapiens__XP_011541999
auguccgucuccguccacgagaaccgcaagucccgcgccuccuccggcuccaucaacaucuaccucuuccacaaguccuccuacgccgacuccguccucacccaccucaaccuccuccgccagcagcgccucuucaccgacguccuccuccacgccggcaaccgcaccuuccccugccaccgcgccguccucgccgccugcucccgcuacuucgaggccauguucuccggcggccucaaggagucccaggacuccgaggucaacuucgacaacuccauccaccccgagguccucgagcuccuccucgacuacgccuacuccucccgcgucaucaucaacgaggagaacgccgagucccuccucgaggccggcgacaugcucgaguuccaggacauccgcgacgccugcgccgaguuccucgagaagaaccuccaccccaccaacugccucggcaugcuccuccucuccgacgcccaccagugcaccaagcucuacgagcucuccuggcgcaugugccucuccaacuuccagaccauccgcaagaacgaggacuuccuccagcucccccaggacauggucguccagcuccucuccuccgaggagcucgagaccgaggacgagcgccucgucuacgaguccgccaucaacuggaucuccuacgaccucaagaagcgcuacugcuaccuccccgagcuccuccagaccguccgccucgcccuccuccccgccaucuaccucauggagaacgucgccauggaggagcucaucaccaagcagcgcaaguccaaggagaucgucgaggaggccauccgcugcaagcucaagauccuccagaacgacggcgucgucaccucccucugcgcccgcccccgcaagaccggccacgcccucuuccuccucggcggccagaccuucaugugcgacaagcucuaccucgucgaccagaaggccaaggagaucauccccaaggccgacauccccuccccccgcaaggaguucuccgccugcgccaucggcugcaaggucuacaucaccggcggccgcggcuccgagaacggcgucuccaaggacgucugggucuacgacacccuccacgaggagugguccaaggccgcccccaugcucgucgcccgcuucggccacggcuccgccgagcucaagcacugccucuacgucgucggcggccacaccgccgccaccggcugccuccccgccucccccuccgucucccucaagcaggucgagcacuacgaccccaccaucaacaaguggaccauggucgccccccuccgcgagggcgucuccaacgccgccgucgucuccgccaagcucaagcucuucgccuucggcggcaccuccgucucccacgacaagcuccccaagguccagugcuacgaccagugcgagaaccgcuggaccguccccgccaccugcccccagcccuggcgcuacaccgccgccgccguccucggcaaccagaucuucaucaugggcggcgacaccgaguucuccgccugcuccgccuacaaguucaacuccgagaccuaccaguggaccaaggucggcgacgucaccgccaagcgcauguccugccacgccgucgccuccggcaacaagcucuacgucgucggcggcuacuucggcauccagcgcugcaagacccucgacugcuacgaccccacccucgacgucuggaacuccaucaccaccguccccuacucccucauccccaccgccuucgucuccaccuggaagcaccuccccuccuga

SEQ ID NO: 42723 - RNA, 894 nt, Artificial Sequence
  derived and/or modified sequence opt2 from ENDOG__Homo_sapiens__NP_004426
augcgcgcccuccgcgccggccucacccucgccuccggcgccggccucggcgccgucgucgagggcuggcgccgccgccgcgaggacgcccgcgccgcccccggccuccucggccgccuccccguccuccccgucgccgccgccgccgagcucccccccguccccggcggcccccgcggccccggcgagcucgccaaguacggccuccccggccucgcccagcucaagucccgcgaguccuacguccucugcuacgacccccgcacccgcggcgcccucugggucgucgagcagcuccgccccgagcgccuccgcggcgacggcgaccgccgcgagugcgacuuccgcgaggacgacuccguccacgccuaccaccgcgccaccaacgccgacuaccgcggcuccggcuucgaccgcggccaccucgccgccgccgccaaccaccgcuggucccagaaggccauggacgacaccuucuaccucuccaacgucgccccccaggucccccaccucaaccagaacgccuggaacaaccucgagaaguacucccgcucccucacccgcuccuaccagaacgucuacgucugcaccggcccccucuuccucccccgcaccgaggccgacggcaaguccuacgucaaguaccaggucaucggcaagaaccacgucgccguccccacccacuucuucaagguccucauccucgaggccgccggcggccagaucgagcuccgcaccuacgucaugcccaacgcccccgucgacgaggccaucccccucgagcgcuuccucguccccaucgaguccaucgagcgcgccuccggccuccucuucguccccaacauccucgcccgcgccggcucccucaaggccaucaccgccggcuccaaguga

SEQ ID NO: 42724 - RNA, 1233 nt, Artificial Sequence
  derived and/or modified sequence opt2 from ENDOU__Homo_sapiens__NP_001165910
augcgcgccugcaucucccucguccucgccguccucugcggccucgccugggccggcaagaucgaguccugcgccucccgcugcaacgagaaguucaaccgcgacgccgccugccagugcgaccgccgcugccucuggcacggcaacugcugcgaggacuacgagcaccucugcaccgaggaccacaaggaguccgagccccucccccagcucgaggaggagaccgaggaggcccucgccuccaaccucuacuccgcccccaccuccugccagggccgcugcuacgaggccuucgacaagcaccaccagugccacugcaacgcccgcugccaggaguucggcaacugcugcaaggacuucgagucccucugcuccgaccacgaggucucccacuccuccgacgccaucaccaaggaggagauccaguccaucuccgagaagaucuaccgcgccgacaccaacaaggcccagaaggaggacaucguccucaacucccagaacugcaucucccccuccgagacccgcaaccaggucgaccgcugccccaagccccucuucaccuacgucaacgagaagcucuucuccaagcccaccuacgccgccuucaucaaccuccucaacaacuaccagcgcgccaccggccacggcgagcacuucuccgcccaggagcucgccgagcaggacgccuuccuccgcgagaucaugaagaccgccgucaugaaggagcucuacuccuuccuccaccaccagaaccgcuacggcuccgagcaggaguucgucgacgaccucaagaacaugugguucggccucuacucccgcggcaacgaggagggcgacuccuccggcuucgagcacgucuucuccggcgaggucaagaagggcaaggucaccggcuuccacaacuggauccgcuucuaccucgaggagaaggagggccucgucgacuacuacucccacaucuacgacggccccugggacuccuaccccgacguccucgccaugcaguucaacugggacggcuacuacaaggaggucggcuccgccuucaucggcuccucccccgaguucgaguucgcccucuacucccucugcuucaucgcccgccccggcaaggucugccagcucucccucggcggcuacccccucgccguccgcaccuacaccugggacaaguccaccuacggcaacggcaagaaguacaucgccaccgccuacaucgucuccuccaccuga

SEQ ID NO: 42725 - RNA, 714 nt, Artificial Sequence
  derived and/or modified sequence opt2 from ENDOV__Homo_sapiens__NP_001158109
auggcccucgaggccgccggcggcccccccgaggagacccucucccucuggaagcgcgagcaggcccgccucaaggcccacgucgucgaccgcgacaccgaggccuggcagcgcgaccccgccuucuccggccuccagcgcgucggcggcgucgacgucuccuucgucaagggcgacuccguccgcgccugcgccucccucgucguccucuccuuccccgagcucgagguccuccucgucgacggcaacggcguccuccaccaccgcggcuucggcgucgccugccaccucggcguccucaccgaccuccccugcgucggcgucgccaagaagcuccuccaggucgacggccucgagaacaacgcccuccacaaggagaagauccgccuccuccagacccgcggcgacuccuucccccuccucggcgacuccggcaccguccucggcauggcccuccgcucccacgaccgcuccacccgcccccucuacaucuccgucggccaccgcaugucccucgaggccgccguccgccucaccugcugcugcugccgcuuccgcauccccgagcccguccgccaggccgacaucugcucccgcgagcacauccgcaagucccucggccuccccggcccccccaccccccgcucccccaaggcccagcgccccgucgccugccccaagggcgacuccggcgaguccuccgcccucugcuga

SEQ ID NO: 42726 - RNA, 2232 nt, Artificial Sequence
  derived and/or modified sequence opt2 from ENGASE__Homo_sapiens__NP_001036038
auggaggccgccgccgucaccgucacccgcuccgccacccgccgccgccgccgccagcuccagggccucgccgcccccgaggccggcacccaggaggagcaggaggaccaggagccccgcccccgccgccgccgccccggccgcuccaucaaggacgaggaggaggagaccgucuuccgcgaggucgucuccuucucccccgacccccuccccguccgcuacuacgacaaggacaccaccaagcccaucuccuucuaccucuccucccucgaggagcuccucgccuggaagccccgccucgaggacggcuucaacgucgcccucgagccccucgccugccgccagcccccccucuccucccagcgcccccgcacccuccucugccacgacaugaugggcggcuaccucgacgaccgcuucauccagggcuccgucguccagacccccuacgccuucuaccacuggcagugcaucgacgucuucgucuacuucucccaccacaccgucaccaucccccccgucggcuggaccaacaccgcccaccgccacggcgucugcguccucggcaccuucaucaccgaguggaacgagggcggccgccucugcgaggccuuccucgccggcgacgagcgcuccuaccaggccgucgccgaccgccucguccagaucacccaguucuuccgcuucgacggcuggcucaucaacaucgagaacucccucucccucgccgccgucggcaacaugccccccuuccuccgcuaccucaccacccagcuccaccgccagguccccggcggccucguccucugguacgacuccgucguccaguccggccagcucaaguggcaggacgagcucaaccagcacaaccgcgucuucuucgacuccugcgacggcuucuucaccaacuacaacuggcgcgaggagcaccucgagcgcaugcucggccaggccggcgagcgccgcgccgacgucuacgucggcgucgacgucuucgcccgcggcaacgucgucggcggccgcuucgacaccgacaagucccucgagcucauccgcaagcacggcuucuccgucgcccucuucgcccccggcugggucuacgagugccucgagaagaaggacuucuuccagaaccaggacaaguucuggggccgccucgagcgcuaccuccccacccacuccaucugcucccuccccuucgucaccuccuucugccucggcaugggcgcccgccgcgucugcuacggccaggaggaggccgucggccccugguaccaccucuccgcccaggagauccagccccucuucggcgagcaccgccucggcggcgacggccgcggcuggguccgcacccacugcugccucgaggacgccuggcacggcggcuccucccuccucguccgcggcgucaucccccccgaggucggcaacgucgccguccgccucuucucccuccaggcccccgucccccccaagaucuaccucuccauggucuacaagcucgagggccccaccgacgucaccgucgcccucgagcucaccaccggcgacgccggcuccugccacaucggcggcaucuccguccucaacgccgagaccuccucccgccacucccuccgcccccuccgcgucccccccaccaagcucgcccgcugggucggccgcugcggccgccagcucuccggcggcuggguccagcacugcuacgaggucucccuccgcggcugccuccuccucgaccuccucgucugcuucucccgcccccccggcucccgcgaggaggaguccuucaccugccgccucggcgagauccaggucgucgacgccgccucccuccucgccccccucccccagguccaggccgucaccaucucccacauccgcuggcagcccuccgccuccgagcgcgagggcccccccgcccuccuccagcucuccugcacccuccacugguccuuccuccucucccagguccgcugcuuccgcauccacugcuggggcggcauguccgacgacucccccggccgcgagcucccccgccccgagaugcccauguuccucggccucgccuucgccacccaguaccgcaucgucgaccuccucgucgaggccgccggccccggccaggaccgccgcauggaguuccucgucgagcccguccccaaggagggcuuccgcgucccccaggccgaguggggccgcgccguccuccucuacuccgcccccgccuga

SEQ ID NO: 42727 - RNA, 1878 nt, Artificial Sequence
  derived and/or modified sequence opt2 from ENG__Homo_sapiens__NP_000109
auggaccgcggcacccucccccucgccgucgcccuccuccucgccuccugcucccucucccccaccucccucgccgagaccguccacugcgaccuccagcccgucggccccgagcgcggcgaggucaccuacaccaccucccaggucuccaagggcugcgucgcccaggcccccaacgccauccucgagguccacguccucuuccucgaguuccccaccggccccucccagcucgagcucacccuccaggccuccaagcagaacggcaccuggccccgcgagguccuccucguccucuccgucaacuccuccgucuuccuccaccuccaggcccucggcaucccccuccaccucgccuacaacuccucccucgucaccuuccaggagccccccggcgucaacaccaccgagcuccccuccuuccccaagacccagauccucgagugggccgccgagcgcggccccaucaccuccgccgccgagcucaacgacccccaguccauccuccuccgccucggccaggcccagggcucccucuccuucugcaugcucgaggccucccaggacaugggccgcacccucgaguggcgcccccgcacccccgcccucguccgcggcugccaccucgagggcgucgccggccacaaggaggcccacauccuccgcguccuccccggccacuccgccggcccccgcaccgucaccgucaaggucgagcucuccugcgcccccggcgaccucgacgccguccucauccuccagggcccccccuacgucuccuggcucaucgacgccaaccacaacaugcagaucuggaccaccggcgaguacuccuucaagaucuuccccgagaagaacauccgcggcuucaagcuccccgacaccccccagggccuccucggcgaggcccgcaugcucaacgccuccaucgucgccuccuucgucgagcucccccucgccuccaucgucucccuccacgccuccuccugcggcggccgccuccagaccucccccgcccccauccagaccaccccccccaaggacaccugcucccccgagcuccucaugucccucauccagaccaagugcgccgacgacgccaugacccucguccucaagaaggagcucgucgcccaccucaagugcaccaucaccggccucaccuucugggaccccuccugcgaggccgaggaccgcggcgacaaguucguccuccgcuccgccuacuccuccugcggcaugcaggucuccgccuccaugaucuccaacgaggccgucgucaacauccucuccuccuccuccccccagcgcaagaagguccacugccucaacauggacucccucuccuuccagcucggccucuaccucuccccccacuuccuccaggccuccaacaccaucgagcccggccagcaguccuucguccagguccgcgucucccccuccgucuccgaguuccuccuccagcucgacuccugccaccucgaccucggccccgagggcggcaccgucgagcucauccagggccgcgccgccaagggcaacugcgucucccuccucucccccucccccgagggcgacccccgcuucuccuuccuccuccacuucuacaccguccccauccccaagaccggcacccucuccugcaccgucgcccuccgccccaagaccggcucccaggaccaggagguccaccgcaccgucuucaugcgccucaacaucaucucccccgaccucuccggcugcaccuccaagggccucguccuccccgccguccucggcaucaccuucggcgccuuccucaucggcgcccuccucaccgccgcccucugguacaucuacucccacacccgcgaguacccccgccccccccaguga

SEQ ID NO: 42728 - RNA, 231 nt, Artificial Sequence
  derived and/or modified sequence opt2 from ENHO__Homo_sapiens__NP_940975
augggcgccgccaucucccagggcgcccucaucgccaucgucugcaacggccucgucggcuuccuccuccuccuccucugggucauccucugcugggccugccacucccgcuccgccgacgucgacucccucuccgaguccucccccaacuccucccccggccccugccccgagaaggccccccccccccagaagcccucccacgagggcuccuaccuccuccagcccuga

SEQ ID NO: 42729 - RNA, 1305 nt, Artificial Sequence
  derived and/or modified sequence opt2 from ENO2__Homo_sapiens__NP_001966
auguccaucgagaagaucugggcccgcgagauccucgacucccgcggcaaccccaccgucgaggucgaccucuacaccgccaagggccucuuccgcgccgccguccccuccggcgccuccaccggcaucuacgaggcccucgagcuccgcgacggcgacaagcagcgcuaccucggcaagggcguccucaaggccgucgaccacaucaacuccaccaucgcccccgcccucaucuccuccggccucuccgucgucgagcaggagaagcucgacaaccucaugcucgagcucgacggcaccgagaacaaguccaaguucggcgccaacgccauccucggcgucucccucgccgucugcaaggccggcgccgccgagcgcgagcucccccucuaccgccacaucgcccagcucgccggcaacuccgaccucauccuccccguccccgccuucaacgucaucaacggcggcucccacgccggcaacaagcucgccaugcaggaguucaugauccuccccgucggcgccgaguccuuccgcgacgccaugcgccucggcgccgaggucuaccacacccucaagggcgucaucaaggacaaguacggcaaggacgccaccaacgucggcgacgagggcggcuucgcccccaacauccucgagaacuccgaggcccucgagcucgucaaggaggccaucgacaaggccggcuacaccgagaagaucgucaucggcauggacgucgccgccuccgaguucuaccgcgacggcaaguacgaccucgacuucaagucccccaccgaccccucccgcuacaucaccggcgaccagcucggcgcccucuaccaggacuucguccgcgacuaccccgucgucuccaucgaggaccccuucgaccaggacgacugggccgccugguccaaguucaccgccaacgucggcauccagaucgucggcgacgaccucaccgucaccaaccccaagcgcaucgagcgcgccgucgaggagaaggccugcaacugccuccuccucaaggucaaccagaucggcuccgucaccgaggccauccaggccugcaagcucgcccaggagaacggcuggggcgucauggucucccaccgcuccggcgagaccgaggacaccuucaucgccgaccucgucgucggccucugcaccggccagaucaagaccggcgcccccugccgcuccgagcgccucgccaaguacaaccagcucaugcgcaucgaggaggagcucggcgacgaggcccgcuucgccggccacaacuuccgcaaccccuccguccucuga

SEQ ID NO: 42730 - RNA, 1176 nt, Artificial Sequence
  derived and/or modified sequence opt2 from ENO3__Homo_sapiens__NP_001180432
auggccaugcagaagaucuucgcccgcgagauccucgacucccgcggcaaccccaccgucgaggucgaccuccacaccgccaagggccgcuuccgcgccgccguccccuccggcgccuccaccggcaucuacgaggcccucgagcuccgcgacggcgacaagggccgcuaccucggcaaggccaaguucggcgccaacgccauccucggcgucucccucgccgucugcaaggccggcgccgccgagaagggcgucccccucuaccgccacaucgccgaccucgccggcaaccccgaccucauccuccccguccccgccuucaacgucaucaacggcggcucccacgccggcaacaagcucgccaugcaggaguucaugauccuccccgucggcgccuccuccuucaaggaggccaugcgcaucggcgccgaggucuaccaccaccucaagggcgucaucaaggccaaguacggcaaggacgccaccaacgucggcgacgagggcggcuucgcccccaacauccucgagaacaacgaggcccucgagcuccucaagaccgccauccaggccgccggcuaccccgacaaggucgucaucggcauggacgucgccgccuccgaguucuaccgcaacggcaaguacgaccucgacuucaagucccccgacgaccccgcccgccacaucaccggcgagaagcucggcgagcucuacaaguccuucaucaagaacuaccccgucgucuccaucgaggaccccuucgaccaggacgacugggccaccuggaccuccuuccucuccggcgucaacauccagaucgucggcgacgaccucaccgucaccaaccccaagcgcaucgcccaggccgucgagaagaaggccugcaacugccuccuccucaaggucaaccagaucggcuccgucaccgaguccauccaggccugcaagcucgcccaguccaacggcuggggcgucauggucucccaccgcuccggcgagaccgaggacaccuucaucgccgaccucgucgucggccucugcaccggccagaucaagaccggcgcccccugccgcuccgagcgccucgccaaguacaaccagcucaugcgcaucgaggaggcccucggcgacaaggccaucuucgccggccgcaaguuccgcaaccccaaggccaaguga

SEQ ID NO: 42731 - RNA, 1878 nt, Artificial Sequence
  derived and/or modified sequence opt2 from ENO4__Homo_sapiens__NP_001229628
auggaggaggagggcggcggccgcuccugcggcaccacccgcgagcuccagaagcucaagcagcaggccauggaguacuaccgcgagaacgacgucccccgccgccucgaggagcuccucaacuccaccuucuaccuccagcccgccgacgucuacggccaccucgccaacugcuucuccaagcucgccaagccccccaccaucugcaagaucgucggcaaggacguccucgacggccucggccuccccacccuccaggucgacaucuucugcaccauccagaacuuccccaagaacgucugcuccgucgucaucuccacccacuucgagguccacgagaacgcccuccccgagcucgccaaggccgaggaggccgagcgcgccuccgccgucuccaccgccguccagugggucaacuccaccaucacccacgagcuccagggcauggcccccuccgaccaggccgaggucgaccaccuccuccgcaucuucuucgccuccaagguccaggaggacaagggccgcaaggagcucgagaagucccucgaguacuccaccguccccaccccccucccccccguccccccccccccccccccccccccccccaccaagaagaagggccagaagcccggccgcaaggacaccaucaccgagaagcccaucgcccccgccgagcccgucgagcccguccucuccggcuccauggccaucggcgccgucucccucgccgucgccaaggccugcgccaugcuccucaacaagccccucuaccucaacaucgcccuccucaagcacaaccaggagcagcccaccacccucuccaugccccuccucauggucucccucgucuccugcggcaaguccuccuccggcaagcucaaccucaugaaggaggucaucugcaucccccaccccgagcucaccaccaagcagggcgucgagaugcucauggagaugcagaagcacaucaacaagaucaucgagaugcccuccccccccaaggccgagaccaagaagggccacgacggcuccaagcgcggccagcagcagaucaccggcaagaugucccaccucggcugccucaccaucaacugcgacuccaucgagcagccccuccuccucauccaggagaucugcgccaaccucggccucgagcucggcaccaaccuccaccucgccaucaacugcgccggccacgagcucauggacuacaacaagggcaaguacgaggucaucaugggcaccuacaagaacgccgccgagauggucgaccucuacgucgaccucaucaacaaguaccccuccaucaucgcccucaucgaccccuuccgcaaggaggacuccgagcagugggacuccaucuaccacgcccucggcucccgcugcuacaucaucgccggcaccgccuccaaguccaucuccaagcuccucgagcagggcaacaucuccauccccaaguccaacggccucaucaucaagcacaccaaccagaccaccauguccgaccucgucgagaucaccaaccucaucgacuccaagaagcacaucaccgucuucggcuccaccgagggcgaguccuccgacgacucccucgucgaccucgccgucggccucggcguccgcuucaucaagcucggcggccucucccgcggcgagcgcgucaccaaguacaaccgccuccucaccaucgaggaggagcucguccagaacggcacccucggcuucaaggaggagcacaccuucuucuacuucaacgaggaggccgagaaggccgccgaggcccucgaggccgccgccgcccgcgagccccucguccccaccuuccccacccagggcgucgaggaguccgccgagaccggcgccuccuccggcuga

SEQ ID NO: 42732 - RNA, 786 nt, Artificial Sequence
  derived and/or modified sequence opt2 from ENOPH1__Homo_sapiens__NP_067027
auggucguccucuccguccccgccgaggucaccgucauccuccucgacaucgagggcaccaccacccccaucgccuucgucaaggacauccucuuccccuacaucgaggagaacgucaaggaguaccuccagacccacugggaggaggaggagugccagcaggacgucucccuccuccgcaagcaggccgaggaggacgcccaccucgacggcgccguccccauccccgccgccuccggcaacggcgucgacgaccuccagcagaugauccaggccgucgucgacaacgucugcuggcagaugucccucgaccgcaagaccaccgcccucaagcagcuccagggccacauguggcgcgccgccuucaccgccggccgcaugaaggccgaguucuucgccgacgucguccccgccguccgcaaguggcgcgaggccggcaugaaggucuacaucuacuccuccggcuccgucgaggcccagaagcuccucuucggccacuccaccgagggcgacauccucgagcucgucgacggccacuucgacaccaagaucggccacaaggucgaguccgaguccuaccgcaagaucgccgacuccaucggcugcuccaccaacaacauccucuuccucaccgacgucacccgcgaggccuccgccgccgaggaggccgacguccacgucgccgucgucguccgccccggcaacgccggccucaccgacgacgagaagaccuacuacucccucaucaccuccuucuccgagcucuaccuccccuccuccaccuga

SEQ ID NO: 42733 - RNA, 1086 nt, Artificial Sequence
  derived and/or modified sequence opt2 from ENOSF1__Homo_sapiens__NP_001119595
augcagaagauggagucccgcggcgucgagcuccccucccucugggagaaggcccucaagcucaucggccccgagaagggcgucguccaccucgccaccgccgccguccucaacgccgucugggaccucugggccaagcaggagggcaagcccgucuggaagcuccucgucgacauggacccccgcaugcucgucuccugcaucgacuuccgcuacaucaccgacguccucaccgaggaggacgcccucgagauccuccagaagggccagaucggcaagaaggagcgcgagaagcagaugcucgcccagggcuaccccgccuacaccaccuccugcgccuggcucggcuacuccgacgacacccucaagcagcucugcgcccaggcccucaaggacggcuggacccgcuucaaggucaaggucggcgccgaccuccaggacgacaugcgccgcugccagaucauccgcgacaugaucggccccgagaagacccucaugauggacgccaaccagcgcugggacguccccgaggccgucgaguggauguccaagcucgccaaguucaagccccucuggaucgaggagcccaccucccccgacgacauccucggccacgccaccaucuccaaggcccucgucccccucggcaucggcaucgccaccggcgagcagugccacaaccgcgucaucuucaagcagcuccuccaggccaaggcccuccaguuccuccagaucgacuccugccgccucggcuccgucaacgagaaccucuccguccuccucauggccaagaaguucgagauccccgucugcccccacgccggcggcgucggccucugcgagcucguccagcaccucaucaucuucgacuacaucuccgucuccgccucccucgagaaccgcgucugcgaguacgucgaccaccuccacgagcacuucaaguaccccgucaugauccagcgcgccuccuacaugccccccaaggaccccggcuacuccaccgagaugaaggaggaguccgucaagaagcaccaguaccccgacggcgaggucuggaagaagcuccuccccgcccaggagaacuga

SEQ ID NO: 42734 - RNA, 1932 nt, Artificial Sequence
  derived and/or modified sequence opt2 from ENOX1__Homo_sapiens__NP_001121087
auggucgacgccggcggcgucgagaacaucacccagcucccccaggagcucccccagaugauggccgccgccgccgacggccucggcuccaucgccaucgacaccacccagcucaacauguccgucaccgaccccaccgccugggccaccgccaugaacaaccucggcaugguccccgucggccuccccggccagcagcucgucuccgacuccaucugcguccccggcuucgaccccucccucaacaugaugaccggcaucacccccaucaaccccaugauccccggccucggccucguccccccccccccccccaccgaggucgccgucgucaaggagaucauccacugcaaguccugcacccucuucccccagaaccccaaccuccccccccccuccacccgcgagcgcccccccggcugcaagaccgucuucgucggcggccuccccgagaacgccaccgaggagaucauccaggaggucuucgagcagugcggcgacaucaccgccauccgcaaguccaagaagaacuucugccacauccgcuucgccgaggaguucauggucgacaaggccaucuaccucuccggcuaccgcaugcgccucggcuccuccaccgacaagaaggacuccggccgccuccacgucgacuucgcccaggcccgcgacgacuucuacgagugggagugcaagcagcgcaugcgcgcccgcgaggagcgccaccgccgcaagcucgaggaggaccgccuccgcccccccuccccccccgccaucaugcacuacuccgagcacgaggccgcccuccucgccgagaagcucaaggacgacuccaaguucuccgaggccaucaccguccuccucuccuggaucgagcgcggcgaggucaaccgccgcuccgccaaccaguucuacuccaugguccaguccgccaacucccacguccgccgccucaugaacgagaaggccacccacgagcaggagauggaggaggccaaggagaacuucaagaacgcccucaccggcauccucacccaguucgagcagaucgucgccgucuucaacgccuccacccgccagaaggccugggaccacuucuccaaggcccagcgcaagaacaucgacaucuggcgcaagcacuccgaggagcuccgcaacgcccaguccgagcagcucaugggcauccgccgcgaggaggagauggagauguccgacgacgagaacugcgacucccccaccaagaagaugcgcgucgacgaguccgcccucgccgcccaggccuacgcccucaaggaggagaacgacucccuccgcuggcagcucgacgccuaccgcaacgaggucgagcuccucaagcaggagaaggagcagcucuuccgcaccgaggagaaccucaccaaggaccagcagcuccaguuccuccagcagaccaugcagggcaugcagcagcagcuccucaccauccaggaggagcucaacaacaagaaguccgagcucgagcaggccaaggaggagcagucccacacccaggcccuccucaagguccuccaggagcagcucaagggcaccaaggagcucgucgagaccaacggccacucccacgaggacuccaacgagaucaacguccucaccgucgcccucgucaaccaggaccgcgagaacaacaucgagaagcgcucccagggccucaaguccgagaaggaggcccuccucaucggcaucaucuccaccuuccuccacguccaccccuucggcgccaacaucgaguaccucugguccuacaugcagcagcucgacuccaagaucuccgccaacgagaucgagaugcuccucaugcgccucccccgcauguucaagcaggaguucaccggcgucggcgccacccucgagaagcgcuggaagcucugcgccuucgagggcaucaagaccaccuga

SEQ ID NO: 42735 - RNA, 2022 nt, Artificial Sequence
  derived and/or modified sequence opt2 from ENOX2__Homo_sapiens__XP_011529546
augcuccacaucaaccagcuccuccucugcaacggcaccgccuccgccgccaccaacaaggacgagaccaacugcaacuuccucaucuccuccggccucaaccagcuccccuucgaccccgccaacaacaacgagccccuccaguucggcuccgccuccggcccccucgucaccgagggccucaucgagaacggcggcgaguccuccaagaagcgcaagcgcaccaacacccccuccgccgacaacucccgcacccucaacgucgacuccaccgccaugacccuccccauguccgaccccaccgccugggccaccgccaugaacaaccucggcauggccccccucggcaucgccggccagcccauccuccccgacuucgaccccgcccucggcaugaugaccggcaucccccccaucacccccaugaugcccggccucggcaucguccccccccccaucccccccgacaugcccgucgucaaggagaucauccacugcaaguccugcacccucuucccccccaaccccaaccuccccccccccgccacccgcgagcgcccccccggcugcaagaccgucuucgucggcggccuccccgagaacggcaccgagcagaucaucgucgaggucuucgagcagugcggcgagaucaucgccauccgcaaguccaagaagaacuucugccacauccgcuucgccgaggaguacauggucgacaaggcccucuaccucuccggcuaccgcauccgccucggcuccuccaccgacaagaaggacaccggccgccuccacgucgacuucgcccaggcccgcgacgaccucuacgagugggagugcaagcagcgcaugcucgcccgcgaggagcgccaccgccgccgcauggaggaggagcgccuccgcccccccucccccccccccgucguccacuacuccgaccacgagugcuccaucgucgccgagaagcucaaggacgacuccaaguucuccgaggccguccagacccuccucaccuggaucgagcgcggcgaggucaaccgccgcuccgccaacaacuucuacuccaugauccaguccgccaacucccacguccgccgccucgucaacgagaaggccgcccacgagaaggacauggaggaggccaaggagaaguucaagcaggcccucuccggcauccucauccaguucgagcagaucgucgccgucuaccacuccgccuccaagcagaaggccugggaccacuucaccaaggcccagcgcaagaacaucuccgucuggugcaagcaggccgaggagauccgcaacauccacaacgacgagcucaugggcauccgccgcgaggaggagauggagauguccgacgacgagaucgaggagaugaccgagaccaaggagaccgaggaguccgcccucgucucccaggccgaggcccucaaggaggagaacgacucccuccgcuggcagcucgacgccuaccgcaacgaggucgagcuccucaagcaggagcagggcaagguccaccgcgaggacgaccccaacaaggagcagcagcucaagcuccuccagcaggcccuccagggcaugcagcagcaccuccucaagguccaggaggaguacaagaagaaggaggccgagcucgagaagcucaaggacgacaagcuccaggucgagaagaugcucgagaaccucaaggagaaggaguccugcgccucccgccucugcgccuccaaccaggacuccgaguacccccucgagaagaccaugaacuccucccccaucaaguccgagcgcgaggcccuccucgucggcaucaucuccaccuuccuccacguccaccccuucggcgccuccaucgaguacaucugcuccuaccuccaccgccucgacaacaagaucugcaccuccgacgucgagugccucaugggccgccuccagcacaccuucaagcaggagaugaccggcgucggcgccucccucgagaagcgcuggaaguucugcggcuucgagggccucaagcucaccuga

SEQ ID NO: 42736 - RNA, 2874 nt, Artificial Sequence
  derived and/or modified sequence opt2 from ENPEP__Homo_sapiens__NP_001968
augaacuucgccgagcgcgagggcuccaagcgcuacugcauccagaccaagcacgucgccauccucugcgccgucgucgucggcgucggccucaucgucggccucgccgucggccucacccgcuccugcgacuccuccggcgacggcggccccggcaccgcccccgcccccucccaccuccccuccuccaccgccucccccuccggcccccccgcccaggaccaggacaucugccccgccuccgaggacgaguccggccaguggaagaacuuccgccuccccgacuucgucaaccccguccacuacgaccuccacgucaagccccuccucgaggaggacaccuacaccggcaccgucuccaucuccaucaaccucuccgcccccacccgcuaccucuggcuccaccuccgcgagacccgcaucacccgccuccccgagcucaagcgccccuccggcgaccagguccagguccgccgcugcuucgaguacaagaagcaggaguacgucgucgucgaggccgaggaggagcucacccccuccuccggcgacggccucuaccuccucaccauggaguucgccggcuggcucaacggcucccucgucggcuucuaccgcaccaccuacaccgagaacggccaggucaaguccaucgucgccaccgaccacgagcccaccgacgcccgcaaguccuuccccugcuucgacgagcccaacaagaaggccaccuacaccaucuccaucacccaccccaaggaguacggcgcccucuccaacaugcccgucgccaaggaggaguccgucgacgacaaguggacccgcaccaccuucgagaaguccguccccauguccaccuaccucgucugcuucgccguccaccaguucgacuccgucaagcgcaucuccaacuccggcaagccccucaccaucuacguccagcccgagcagaagcacaccgccgaguacgccgccaacaucaccaaguccgucuucgacuacuucgaggaguacuucgccaugaacuacucccuccccaagcucgacaagaucgccauccccgacuucggcaccggcgccauggagaacuggggccucaucaccuaccgcgagaccaaccuccucuacgaccccaaggaguccgccuccuccaaccagcagcgcgucgccaccgucgucgcccacgagcucguccaccagugguucggcaacaucgucaccauggacuggugggaggaccucuggcucaacgagggcuucgccuccuucuucgaguuccucggcgucaaccacgccgagaccgacuggcagaugcgcgaccagaugcuccucgaggacguccuccccguccaggaggacgacucccucauguccucccaccccaucaucgucaccgucaccacccccgacgagaucaccuccgucuucgacggcaucuccuacuccaagggcuccuccauccuccgcaugcucgaggacuggaucaagcccgagaacuuccagaagggcugccagauguaccucgagaaguaccaguucaagaacgccaagaccuccgacuucugggccgcccucgaggaggccucccgccuccccgucaaggaggucauggacaccuggacccgccagaugggcuaccccguccucaacgucaacggcgucaagaacaucacccagaagcgcuuccuccucgacccccgcgccaaccccucccagccccccuccgaccucggcuacaccuggaacauccccgucaaguggaccgaggacaacaucaccuccuccguccucuucaaccgcuccgagaaggagggcaucacccucaacuccuccaaccccuccggcaacgccuuccucaagaucaaccccgaccacaucggcuucuaccgcgucaacuacgaggucgccaccugggacuccaucgccaccgcccucucccucaaccacaagaccuucuccuccgccgaccgcgccucccucaucgacgacgccuucgcccucgcccgcgcccagcuccucgacuacaaggucgcccucaaccucaccaaguaccucaagcgcgaggagaacuuccuccccuggcagcgcgucaucuccgccgucaccuacaucaucuccauguucgaggacgacaaggagcucuaccccaugaucgaggaguacuuccagggccaggucaagcccaucgccgacucccucggcuggaacgacgccggcgaccacgucaccaagcuccuccgcuccuccguccucggcuucgccugcaagaugggcgaccgcgaggcccucaacaacgccuccucccucuucgagcaguggcucaacggcaccgucucccuccccgucaaccuccgccuccucgucuaccgcuacggcaugcagaacuccggcaacgagaucuccuggaacuacacccucgagcaguaccagaagaccucccucgcccaggagaaggagaagcuccucuacggccucgccuccgucaagaacgucacccuccucucccgcuaccucgaccuccucaaggacaccaaccucaucaagacccaggacgucuucaccgucauccgcuacaucuccuacaacuccuacggcaagaacauggccuggaacuggauccagcucaacugggacuaccucgucaaccgcuacacccucaacaaccgcaaccucggccgcaucgucaccaucgccgagcccuucaacaccgagcuccagcucuggcagauggaguccuucuucgccaaguacccccaggccggcgccggcgagaagccccgcgagcagguccucgagaccgucaagaacaacaucgaguggcucaagcagcaccgcaacaccauccgcgagugguucuucaaccuccucgaguccggcuga

SEQ ID NO: 42737 - RNA, 2778 nt, Artificial Sequence
  derived and/or modified sequence opt2 from ENPP1__Homo_sapiens__NP_006199
auggagcgcgacggcugcgccggcggcggcucccgcggcggcgagggcggccgcgccccccgcgagggccccgccggcaacggccgcgaccgcggccgcucccacgccgccgaggcccccggcgacccccaggccgccgccucccuccucgcccccauggacgucggcgaggagccccucgagaaggccgcccgcgcccgcaccgccaaggaccccaacaccuacaagguccucucccucguccucuccgucugcguccucaccaccauccucggcugcaucuucggccucaagcccuccugcgccaaggaggucaaguccugcaagggccgcugcuucgagcgcaccuucggcaacugccgcugcgacgccgccugcgucgagcucggcaacugcugccucgacuaccaggagaccugcaucgagcccgagcacaucuggaccugcaacaaguuccgcugcggcgagaagcgccucacccgcucccucugcgccugcuccgacgacugcaaggacaagggcgacugcugcaucaacuacuccuccgucugccagggcgagaaguccugggucgaggagcccugcgaguccaucaacgagccccagugccccgccggcuucgagaccccccccacccuccucuucucccucgacggcuuccgcgccgaguaccuccacaccuggggcggccuccuccccgucaucuccaagcucaagaagugcggcaccuacaccaagaacaugcgccccgucuaccccaccaagaccuuccccaaccacuacuccaucgucaccggccucuaccccgagucccacggcaucaucgacaacaagauguacgaccccaagaugaacgccuccuucucccucaaguccaaggagaaguucaaccccgagugguacaagggcgagcccaucugggucaccgccaaguaccagggccucaaguccggcaccuucuucuggcccggcuccgacgucgagaucaacggcaucuuccccgacaucuacaagauguacaacggcuccguccccuucgaggagcgcauccucgccguccuccaguggcuccagcuccccaaggacgagcgcccccacuucuacacccucuaccucgaggagcccgacuccuccggccacuccuacggccccgucuccuccgaggucaucaaggcccuccagcgcgucgacggcauggucggcaugcucauggacggccucaaggagcucaaccuccaccgcugccucaaccucauccucaucuccgaccacggcauggagcagggcuccugcaagaaguacaucuaccucaacaaguaccucggcgacgucaagaacaucaaggucaucuacggccccgccgcccgccuccgccccuccgacguccccgacaaguacuacuccuucaacuacgagggcaucgcccgcaaccucuccugccgcgagcccaaccagcacuucaagcccuaccucaagcacuuccuccccaagcgccuccacuucgccaaguccgaccgcaucgagccccucaccuucuaccucgacccccaguggcagcucgcccucaaccccuccgagcgcaaguacugcggcuccggcuuccacggcuccgacaacgucuucuccaacaugcaggcccucuucgucggcuacggccccggcuucaagcacggcaucgaggccgacaccuucgagaacaucgaggucuacaaccucaugugcgaccuccucaaccucacccccgcccccaacaacggcacccacggcucccucaaccaccuccucaagaaccccgucuacacccccaagcaccccaaggagguccacccccucguccagugccccuucacccgcaacccccgcgacaaccucggcugcuccugcaaccccuccauccuccccaucgaggacuuccagacccaguucaaccucaccgucgccgaggagaagaucaucaagcacgagacccuccccuacggccgcccccgcguccuccagaaggagaacaccaucugccuccucucccagcaccaguucauguccggcuacucccaggacauccucaugccccucuggaccuccuacaccgucgaccgcaacgacuccuucuccaccgaggacuucuccaacugccucuaccaggacuuccgcaucccccucucccccguccacaagugcuccuucuacaagaacaacaccaaggucuccuacggcuuccucucccccccccagcucaacaagaacuccuccggcaucuacuccgaggcccuccucaccaccaacaucguccccauguaccaguccuuccaggucaucuggcgcuacuuccacgacacccuccuccgcaaguacgccgaggagcgcaacggcgucaacgucgucuccggccccgucuucgacuucgacuacgacggccgcugcgacucccucgagaaccuccgccagaagcgccgcgucauccgcaaccaggagauccucauccccacccacuucuucaucguccucaccuccugcaaggacaccucccagaccccccuccacugcgagaaccucgacacccucgccuucauccucccccaccgcaccgacaacuccgaguccugcguccacggcaagcacgacuccuccugggucgaggagcuccucaugcuccaccgcgcccgcaucaccgacgucgagcacaucaccggccucuccuucuaccagcagcgcaaggagcccgucuccgacauccucaagcucaagacccaccuccccaccuucucccaggaggacuga

SEQ ID NO: 42738 - RNA, 2592 nt, Artificial Sequence
  derived and/or modified sequence opt2 from ENPP2__Homo_sapiens__NP_001035181
auggcccgccgcuccuccuuccaguccugccagaucaucucccucuucaccuucgccgucggcgucaacaucugccucggcuucaccgcccaccgcaucaagcgcgccgagggcugggaggagggcccccccaccguccucuccgacucccccuggaccaacaucuccggcuccugcaagggccgcugcuucgagcuccaggaggccggcccccccgacugccgcugcgacaaccucugcaaguccuacaccuccugcugccacgacuucgacgagcucugccucaagaccgcccgcggcugggagugcaccaaggaccgcugcggcgagguccgcaacgaggagaacgccugccacugcuccgaggacugccucgcccgcggcgacugcugcaccaacuaccaggucgucugcaagggcgagucccacugggucgacgacgacugcgaggagaucaaggccgccgagugccccgccggcuucguccgccccccccucaucaucuucuccgucgacggcuuccgcgccuccuacaugaagaagggcuccaaggucaugcccaacaucgagaagcuccgcuccugcggcacccacucccccuacaugcgccccgucuaccccaccaagaccuuccccaaccucuacacccucgccaccggccucuaccccgagucccacggcaucgucggcaacuccauguacgaccccgucuucgacgccaccuuccaccuccgcggccgcgagaaguucaaccaccgcugguggggcggccagccccucuggaucaccgccaccaagcagggcgucaaggccggcaccuucuucugguccgucgucaucccccacgagcgccgcauccucaccauccuccaguggcucacccuccccgaccacgagcgccccuccgucuacgccuucuacuccgagcagcccgacuucuccggccacaaguacggccccuucggccccgagaugaccaacccccuccgcgagaucgacaagaucgucggccagcucauggacggccucaagcagcucaagcuccaccgcugcgucaacgucaucuucgucggcgaccacggcauggaggacgucaccugcgaccgcaccgaguuccucuccaacuaccucaccaacgucgacgacaucacccucguccccggcacccucggccgcauccgcuccaaguucuccaacaacgccaaguacgaccccaaggccaucaucgccaaccucaccugcaagaagcccgaccagcacuucaagcccuaccucaagcagcaccuccccaagcgccuccacuacgccaacaaccgccgcaucgaggacauccaccuccucgucgagcgccgcuggcacgucgcccgcaagccccucgacgucuacaagaagcccuccggcaagugcuucuuccagggcgaccacggcuucgacaacaaggucaacuccaugcagaccgucuucgucggcuacggcuccaccuucaaguacaagaccaaggucccccccuucgagaacaucgagcucuacaacgucaugugcgaccuccucggccucaagcccgcccccaacaacggcacccacggcucccucaaccaccuccuccgcaccaacaccuuccgccccaccaugcccgaggaggucacccgccccaacuaccccggcaucauguaccuccaguccgacuucgaccucggcugcaccugcgacgacaaggucgagcccaagaacaagcucgacgagcucaacaagcgccuccacaccaagggcuccaccgaggagcgccaccuccucuacggccgccccgccguccucuaccgcacccgcuacgacauccucuaccacaccgacuucgaguccggcuacuccgagaucuuccucaugccccucuggaccuccuacaccgucuccaagcaggccgaggucuccuccguccccgaccaccucaccuccugcguccgccccgacguccgcgucucccccuccuucucccagaacugccucgccuacaagaacgacaagcagauguccuacggcuuccucuucccccccuaccucuccuccucccccgaggccaaguacgacgccuuccucgucaccaacaugguccccauguaccccgccuucaagcgcgucuggaacuacuuccagcgcguccucgucaagaaguacgccuccgagcgcaacggcgucaacgucaucuccggccccaucuucgacuacgacuacgacggccuccacgacaccgaggacaagaucaagcaguacgucgagggcuccuccauccccguccccacccacuacuacuccaucaucaccuccugccucgacuucacccagcccgccgacaagugcgacggcccccucuccgucuccuccuucauccucccccaccgccccgacaacgaggaguccugcaacuccuccgaggacgaguccaagugggucgaggagcucaugaagaugcacaccgcccgcguccgcgacaucgagcaccucaccucccucgacuucuuccgcaagaccucccgcuccuaccccgagauccucacccucaagaccuaccuccacaccuacgaguccgagaucuga

SEQ ID NO: 42739 - RNA, 2628 nt, Artificial Sequence
  derived and/or modified sequence opt2 from ENPP3__Homo_sapiens__NP_005012
auggaguccacccucacccucgccaccgagcagcccgucaagaagaacacccucaagaaguacaagaucgccugcaucguccuccucgcccuccucgucaucaugucccucggccucggccucggccucggccuccgcaagcucgagaagcagggcuccugccgcaagaagugcuucgacgccuccuuccgcggccucgagaacugccgcugcgacgucgccugcaaggaccgcggcgacugcugcugggacuucgaggacaccugcgucgaguccacccgcaucuggaugugcaacaaguuccgcugcggcgagacccgccucgaggccucccucugcuccugcuccgacgacugccuccagcgcaaggacugcugcgccgacuacaaguccgucugccagggcgagaccuccuggcucgaggagaacugcgacaccgcccagcagucccagugccccgagggcuucgaccucccccccgucauccucuucuccauggacggcuuccgcgccgaguaccucuacaccugggacacccucaugcccaacaucaacaagcucaagaccugcggcauccacuccaaguacaugcgcgccauguaccccaccaagaccuuccccaaccacuacaccaucgucaccggccucuaccccgagucccacggcaucaucgacaacaacauguacgacgucaaccucaacaagaacuucucccucuccuccaaggagcagaacaaccccgccugguggcacggccagcccauguggcucaccgccauguaccagggccucaaggccgccaccuacuucuggcccggcuccgaggucgccaucaacggcuccuuccccuccaucuacaugcccuacaacggcuccguccccuucgaggagcgcaucuccacccuccucaaguggcucgaccuccccaaggccgagcgcccccgcuucuacaccauguacuucgaggagcccgacuccuccggccacgccggcggccccgucuccgcccgcgucaucaaggcccuccaggucgucgaccacgccuucggcaugcucauggagggccucaagcagcgcaaccuccacaacugcgucaacaucauccuccucgccgaccacggcauggaccagaccuacugcaacaagauggaguacaugaccgacuacuucccccgcaucaacuucuucuacauguacgagggccccgccccccgcauccgcgcccacaacaucccccacgacuucuucuccuucaacuccgaggagaucguccgcaaccucuccugccgcaagcccgaccagcacuucaagcccuaccucacccccgaccuccccaagcgccuccacuacgccaagaacguccgcaucgacaagguccaccucuucgucgaccagcaguggcucgccguccgcuccaaguccaacaccaacugcggcggcggcaaccacggcuacaacaacgaguuccgcuccauggaggccaucuuccucgcccacggccccuccuucaaggagaagaccgaggucgagcccuucgagaacaucgaggucuacaaccucaugugcgaccuccuccgcauccagcccgcccccaacaacggcacccacggcucccucaaccaccuccucaagguccccuucuacgagcccucccacgccgaggaggucuccaaguucuccgucugcggcuucgccaacccccuccccaccgagucccucgacugcuucugcccccaccuccagaacuccacccagcucgagcaggucaaccagaugcucaaccucacccaggaggagaucaccgccaccgucaaggucaaccuccccuucggccgcccccgcguccuccagaagaacgucgaccacugccuccucuaccaccgcgaguacgucuccggcuucggcaaggccaugcgcaugcccaugugguccuccuacaccgucccccagcucggcgacaccuccccccucccccccaccguccccgacugccuccgcgccgacguccgcgucccccccuccgagucccagaagugcuccuucuaccucgccgacaagaacaucacccacggcuuccucuacccccccgccuccaaccgcaccuccgacucccaguacgacgcccucaucaccuccaaccucguccccauguacgaggaguuccgcaagaugugggacuacuuccacuccguccuccucaucaagcacgccaccgagcgcaacggcgucaacgucgucuccggccccaucuucgacuacaacuacgacggccacuucgacgcccccgacgagaucaccaagcaccucgccaacaccgacguccccauccccacccacuacuucgucguccucaccuccugcaagaacaagucccacacccccgagaacugccccggcuggcucgacguccuccccuucaucaucccccaccgccccaccaacgucgaguccugccccgagggcaagcccgaggcccucugggucgaggagcgcuucaccgcccacaucgcccgcguccgcgacgucgagcuccucaccggccucgacuucuaccaggacaagguccagcccgucuccgagauccuccagcucaagaccuaccuccccaccuucgagaccaccaucuga

SEQ ID NO: 42740 - RNA, 1434 nt, Artificial Sequence
  derived and/or modified sequence opt2 from ENPP5__Homo_sapiens__XP_005249317
augaccuccaaguuccuccucgucuccuucauccucgccgcccucucccucuccaccaccuucucccuccagcccgaccagcagaagguccuccucgucuccuucgacggcuuccgcugggacuaccucuacaagguccccaccccccacuuccacuacaucaugaaguacggcguccacgucaagcaggucaccaacgucuucaucaccaagaccuaccccaaccacuacacccucgucaccggccucuucgccgagaaccacggcaucgucgccaacgacauguucgaccccauccgcaacaaguccuucucccucgaccacaugaacaucuacgacuccaaguucugggaggaggccacccccaucuggaucaccaaccagcgcgccggccacaccuccggcgccgccauguggcccggcaccgacgucaagauccacaagcgcuuccccacccacuacaugcccuacaacgaguccgucuccuucgaggaccgcgucgccaagaucaucgagugguucaccuccaaggagcccaucaaccucggccuccucuacugggaggaccccgacgacaugggccaccaccucggccccgacuccccccucaugggccccgucaucuccgacaucgacaagaagcucggcuaccucauccagaugcucaagaaggccaagcucuggaacacccucaaccucaucaucaccuccgaccacggcaugacccagugcuccgaggagcgccucaucgagcucgaccaguaccucgacaaggaccacuacacccucaucgaccagucccccgucgccgccauccuccccaaggagggcaaguucgacgaggucuacgaggcccucacccacgcccaccccaaccucaccgucuacaagaaggaggacguccccgagcgcuggcacuacaaguacaacucccgcauccagcccaucaucgccgucgccgacgagggcuggcacauccuccagaacaaguccgacgacuuccuccucggcaaccacggcuacgacaacgcccucgccgacaugcaccccaucuuccucgcccacggccccgccuuccgcaagaacuucuccaaggaggccaugaacuccaccgaccucuacccccuccucugccaccuccucaacaucaccgccaugccccacaacggcuccuucuggaacguccaggaccuccucaacuccgccaugccccgcgucguccccuacacccaguccaccauccuccuccccggcuccgucaagcccgccgaguacgaccaggagggcuccuaccccuacuucaucggcgucucccucggcuccaucaucgucaucgucuucuucgucaucuucaucaagcaccucauccacucccagauccccgcccuccaggacaugcacgccgagaucgcccagccccuccuccaggccuga

SEQ ID NO: 42741 - RNA, 1377 nt, Artificial Sequence
  derived and/or modified sequence opt2 from ENPP7__Homo_sapiens__NP_848638
augcgcggccccgccguccuccucaccgucgcccucgccacccuccucgcccccggcgccggcgcccccguccagucccagggcucccagaacaagcuccuccucgucuccuucgacggcuuccgcuggaacuacgaccaggacgucgacacccccaaccucgacgccauggcccgcgacggcgucaaggcccgcuacaugacccccgccuucgucaccaugaccucccccugccacuucacccucgucaccggcaaguacaucgagaaccacggcgucguccacaacauguacuacaacaccaccuccaaggucaagcuccccuaccacgccacccucggcauccagcgcuggugggacaacggcuccguccccaucuggaucaccgcccagcgccagggccuccgcgccggcuccuucuucuaccccggcggcaacgucaccuaccagggcgucgccgucacccgcucccgcaaggagggcaucgcccacaacuacaagaacgagaccgaguggcgcgccaacaucgacaccgucauggccugguucaccgaggaggaccucgaccucgucacccucuacuucggcgagcccgacuccaccggccaccgcuacggccccgagucccccgagcgccgcgagaugguccgccaggucgaccgcaccgucggcuaccuccgcgaguccaucgcccgcaaccaccucaccgaccgccucaaccucaucaucaccuccgaccacggcaugaccaccgucgacaagcgcgccggcgaccucgucgaguuccacaaguuccccaacuucaccuuccgcgacaucgaguucgagcuccucgacuacggccccaacggcaugcuccuccccaaggagggccgccucgagaaggucuacgacgcccucaaggacgcccaccccaagcuccacgucuacaagaaggaggccuuccccgaggccuuccacuacgccaacaacccccgcgucaccccccuccucauguacuccgaccucggcuacgucauccacggccgcaucaacguccaguucaacaacggcgagcacggcuucgacaacaaggacauggacaugaagaccaucuuccgcgccgucggccccuccuuccgcgccggccucgaggucgagcccuucgaguccguccacgucuacgagcucaugugccgccuccucggcaucguccccgaggccaacgacggccaccucgccacccuccuccccaugcuccacaccgaguccgcccucccccccgacggccgccccacccuccuccccaagggccgcuccgcccucccccccuccucccgcccccuccucgucaugggccuccucggcaccgucauccuccucuccgaggucgccuga

SEQ ID NO: 42742 - RNA, 1578 nt, Artificial Sequence
  derived and/or modified sequence opt2 from ENTHD2__Homo_sapiens__NP_653280
auggccgccgcccccccccuccgcgaccgccucuccuuccuccaccgccuccccauccuccucaagggcaccuccgacgacgacguccccugccccggcuaccucuucgaggagaucgccaagaucucccacgagucccccggcuccucccagugccuccucgaguaccuccucucccgccuccacuccuccuccggccacggcaagcucaagguccucaagauccuccucuaccucugcucccacggcuccuccuucuuccuccucauccucaagcgcaacuccgccuucauccaggaggccgccgccuucgccggcccccccgacccccuccacggcaacucccucuaccagaagguccgcgccgccgcccaggaccucggcuccacccucuucuccgacaccguccucccccucgcccccucccagccccucggcaccccccccgccaccggcaugggcucccaggcccgcccccacuccacccuccagggcuucggcuacuccaaggagcacggccgcaccgccguccgccaccagcccggccaggccggcggcggcugggacgagcucgacuccggccccuccucccagaacuccucccagaacuccgaccucucccgcgucuccgacuccggcucccacuccggcuccgacucccacuccggcgccucccgcgagcccggcgaccucgccgagcgcgucgaggucgucgcccucuccgacugccagcaggagcucucccucguccgcaccgucacccgcggcccccgcgccuuccucucccgcgaggaggcccagcacuucaucaaggccugcggccuccucaacugcgaggccguccuccagcuccucaccugccaccuccgcggcaccuccgagugcacccagcuccgcgcccucugcgccaucgccucccucggcuccuccgaccuccucccccaggagcacauccuccuccgcacccgccccuggcuccaggagcucuccaugggcucccccggccccgucaccaacaaggccaccaagauccuccgccacuucgaggccuccugcggccagcucucccccgcccgcggcaccuccgccgagcccggccccaccgccgcccuccccggccccuccgaccuccucaccgacgccgucccccuccccggcucccaggucuuccuccagccccucuccuccacccccgucuccucccgcucccccgcccccuccuccggcaugcccuccucccccguccccacccccccccccgacgccucccccauccccgcccccggcgaccccuccgaggccgaggcccgccucgccgagucccgccgcuggcgccccgagcgcauccccggcggcaccgacucccccaagcgcggccccuccuccugcgccuggucccgcgacucccucuucgccggcauggagcucgucgccugcccccgccucgucggcgccggcgccgccgccggcgaguccugccccgacgccccccgcgccccccagaccuccucccagcgcaccgccgccaaggagccccccggcuccgagcccuccgccuucgccuuccucaacgccuga

SEQ ID NO: 42743 - RNA, 1554 nt, Artificial Sequence
  derived and/or modified sequence opt2 from ENTPD1__Homo_sapiens__NP_001091645
augaagggcaccaaggaccucaccucccagcagaaggaguccaacgucaagaccuucugcuccaagaacauccucgccauccucggcuucuccuccaucaucgccgucaucgcccuccucgccgucggccucacccagaacaaggcccuccccgagaacgucaaguacggcaucguccucgacgccggcuccucccacaccucccucuacaucuacaaguggcccgccgagaaggagaacgacaccggcgucguccaccaggucgaggagugccgcgucaagggccccggcaucuccaaguucguccagaaggucaacgagaucggcaucuaccucaccgacugcauggagcgcgcccgcgaggucaucccccgcucccagcaccaggagacccccgucuaccucggcgccaccgccggcaugcgccuccuccgcauggaguccgaggagcucgccgaccgcguccucgacgucgucgagcgcucccucuccaacuaccccuucgacuuccagggcgcccgcaucaucaccggccaggaggagggcgccuacggcuggaucaccaucaacuaccuccucggcaaguucucccagaagacccgcugguucuccaucguccccuacgagaccaacaaccaggagaccuucggcgcccucgaccucggcggcgccuccacccaggucaccuucgucccccagaaccagaccaucgagucccccgacaacgcccuccaguuccgccucuacggcaaggacuacaacgucuacacccacuccuuccucugcuacggcaaggaccaggcccucuggcagaagcucgccaaggacauccaggucgccuccaacgagauccuccgcgaccccugcuuccaccccggcuacaagaaggucgucaacgucuccgaccucuacaagacccccugcaccaagcgcuucgagaugacccuccccuuccagcaguucgagauccagggcaucggcaacuaccagcagugccaccaguccauccucgagcucuucaacaccuccuacugccccuacucccagugcgccuucaacggcaucuuccuccccccccuccagggcgacuucggcgccuucuccgccuucuacuucgucaugaaguuccucaaccucaccuccgagaaggucucccaggagaaggucaccgagaugaugaagaaguucugcgcccagcccugggaggagaucaagaccuccuacgccggcgucaaggagaaguaccucuccgaguacugcuucuccggcaccuacauccucucccuccuccuccagggcuaccacuucaccgccgacuccugggagcacauccacuucaucggcaagauccagggcuccgacgccggcuggacccucggcuacaugcucaaccucaccaacaugauccccgccgagcagccccucuccaccccccucucccacuccaccuacgucuuccucaugguccucuucucccucguccucuucaccgucgccaucaucggccuccucaucuuccacaagcccuccuacuucuggaaggacauggucuga

SEQ ID NO: 42744 - RNA, 1419 nt, Artificial Sequence
  derived and/or modified sequence opt2 from ENTPD2__Homo_sapiens__NP_001237
auggccggcaagguccgcucccuccuccccccccuccuccucgccgccgccggccucgccggccuccuccuccucugcguccccacccgcgacguccgcgagccccccgcccucaaguacggcaucguccucgacgccggcuccucccacaccuccauguucaucuacaaguggcccgccgacaaggagaacgacaccggcaucgucggccagcacuccuccugcgacguccccggcggcggcaucuccuccuacgccgacaaccccuccggcgccucccagucccucgucggcugccucgagcaggcccuccaggacguccccaaggagcgccacgccggcaccccccucuaccucggcgccaccgccggcaugcgccuccucaaccucaccaaccccgaggccuccaccuccguccucauggccgucacccacacccucacccaguaccccuucgacuuccgcggcgcccgcauccucuccggccaggaggagggcgucuucggcugggucaccgccaacuaccuccucgagaacuucaucaaguacggcugggucggccgcugguuccgcccccgcaagggcacccucggcgccauggaccucggcggcgccuccacccagaucaccuucgagaccaccucccccgccgaggaccgcgccuccgagguccagcuccaccucuacggccagcacuaccgcgucuacacccacuccuuccucugcuacggccgcgaccagguccuccagcgccuccucgccuccgcccuccagacccacggcuuccaccccugcuggccccgcggcuucuccacccagguccuccucggcgacgucuaccagucccccugcaccauggcccagcgcccccagaacuucaacuccuccgcccgcgucucccucuccggcuccuccgacccccaccucugccgcgaccucgucuccggccucuucuccuucuccuccugccccuucucccgcugcuccuucaacggcgucuuccagccccccgucgccggcaacuucgucgccuucuccgccuucuucuacaccgucgacuuccuccgcaccuccaugggccuccccgucgccacccuccagcagcucgaggccgccgccgucaacgucugcaaccagaccugggcccagcagcuccucucccgcggcuacggcuucgacgagcgcgccuucggcggcgucaucuuccagaagaaggccgccgacaccgccgucggcugggcccucggcuacaugcucaaccucaccaaccucauccccgccgacccccccggccuccgcaagggcaccgacuucuccuccugggucguccuccuccuccucuucgccuccgcccuccucgccgcccucguccuccuccuccgccagguccacuccgccaagcuccccuccaccaucuga

SEQ ID NO: 42745 - RNA, 1827 nt, Artificial Sequence
  derived and/or modified sequence opt2 from ENTPD4__Homo_sapiens__NP_001122402
augggccgcaucggcaucuccugccucuuccccgccuccuggcacuucuccaucucccccgucggcugcccccgcauccucaacaccaaccuccgccagaucauggucaucuccguccucgccgccgccgucucccuccucuacuucuccgucgucaucauccgcaacaaguacggccgccucacccgcgacaagaaguuccagcgcuaccucgcccgcgucaccgacaucgaggccaccgacaccaacaaccccaacgucaacuacggcaucgucgucgacugcggcuccuccggcucccgcgucuucgucuacugcuggccccgccacaacggcaacccccacgaccuccucgacauccgccagaugcgcgacaagaaccgcaagcccgucgucaugaagaucaagcccggcaucuccgaguucgccaccucccccgagaaggucuccgacuacaucuccccccuccucaacuucgccgccgagcacgucccccgcgccaagcacaaggagaccccccucuacauccucugcaccgccggcaugcgcauccuccccgagucccagcagaaggccauccucgaggaccuccucaccgacauccccguccacuucgacuuccucuucuccgacucccacgccgaggucaucuccggcaagcaggagggcgucuacgccuggaucggcaucaacuucguccucggccgcuucgagcacaucgaggacgacgacgaggccgucgucgaggucaacauccccggcuccgaguccuccgaggccaucguccgcaagcgcaccgccggcauccucgacaugggcggcgucuccacccagaucgccuacgagguccccaagaccgaggaggucgccaagaaccuccucgccgaguucaaccucggcugcgacguccaccagaccgagcacgucuaccgcgucuacgucgccaccuuccucggcuucggcggcaacgccgcccgccagcgcuacgaggaccgcaucuucgccaacaccauccagaagaaccgccuccucggcaagcagaccggccucacccccgacaugcccuaccucgaccccugccucccccucgacaucaaggacgagauccagcagaacggccagaccaucuaccuccgcggcaccggcgacuucgaccucugccgcgagaccauccagcccuucaugaacaagaccaacgagacccagaccucccucaacggcgucuaccagccccccauccacuuccagaacuccgaguucuacggcuucuccgaguucuacuacugcaccgaggacguccuccgcaugggcggcgacuacaacgccgccaaguucaccaaggccgccaaggacuacugcgccaccaagugguccauccuccgcgagcgcuucgaccgcggccucuacgccucccacgccgaccuccaccgccucaaguaccagugcuucaaguccgccuggauguucgaggucuuccaccgcggcuucuccuuccccgucaacuacaagucccucaagaccgcccuccaggucuacgacaaggagguccaguggacccucggcgccauccucuaccgcacccgcuuccucccccuccgcgacauccagcaggaggccuuccgcgccucccacacccacuggcgcggcgucuccuucgucuacaaccacuaccucuucuccggcugcuuccucgucguccuccucgccauccuccucuaccuccuccgccuccgccgcauccaccgccgcaccccccgcuccuccuccgccgccgcccucuggauggaggagggccuccccgcccagaacgcccccggcacccucuga

SEQ ID NO: 42746 - RNA, 1287 nt, Artificial Sequence
  derived and/or modified sequence opt2 from ENTPD5__Homo_sapiens__XP_006720387
auggccaccuccuggggcaccgucuucuucaugcucgucgucuccugcgucugcuccgccgucucccaccgcaaccagcagaccugguucgagggcaucuuccucuccuccaugugccccaucaacgucuccgccuccacccucuacggcaucauguucgacgccggcuccaccggcacccgcauccacgucuacaccuucguccagaagaugcccggccagcuccccauccucgagggcgaggucuucgacuccgucaagcccggccucuccgccuucgucgaccagcccaagcagggcgccgagaccguccagggccuccucgaggucgccaaggacuccaucccccgcucccacuggaagaagacccccgucguccucaaggccaccgccggccuccgccuccuccccgagcacaaggccaaggcccuccucuucgaggucaaggagaucuuccgcaagucccccuuccucguccccaagggcuccgucuccaucauggacggcuccgacgagggcauccucgccugggucaccgucaacuuccucaccggccagcuccacggccaccgccaggagaccgucggcacccucgaccucggcggcgccuccacccagaucaccuuccucccccaguucgagaagacccucgagcagaccccccgcggcuaccucaccuccuucgagauguucaacuccaccuacaagcucuacacccacuccuaccucggcuucggccucaaggccgcccgccucgccacccucggcgcccucgagaccgagggcaccgacggccacaccuuccgcuccgccugccucccccgcuggcucgaggccgaguggaucuucggcggcgucaaguaccaguacggcggcaaccaggagggcgaggucggcuucgagcccugcuacgccgagguccuccgcgucguccgcggcaagcuccaccagcccgaggagguccagcgcggcuccuucuacgccuucuccuacuacuacgaccgcgccgucgacaccgacaugaucgacuacgagaagggcggcauccucaaggucgaggacuucgagcgcaaggcccgcgaggucugcgacaaccucgagaacuucaccuccggcucccccuuccucugcauggaccucuccuacaucaccgcccuccucaaggacggcuucggcuucgccgacuccaccguccuccagcucaccaagaaggucaacaacaucgagaccggcugggcccucggcgccaccuuccaccuccuccagucccucggcaucucccacuga

SEQ ID NO: 42747 - RNA, 1404 nt, Artificial Sequence
  derived and/or modified sequence opt2 from ENTPD6__Homo_sapiens__NP_001107561
augcagccccagcacggccccuggcagacccgcaugcgcaagaucuccaaccacggcucccuccgcgucgccaaggucgccuacccccucggccucugcgucggcgucuucaucuacgucgccuacaucaaguggcaccgcgccaccgccacccaggccuucuucuccaucacccgcgccgcccccggcgcccgcuggggccagcaggcccacuccccccucggcaccgccgccgacggccacgaggucuucuacggcaucauguucgacgccggcuccaccggcacccgcguccacgucuuccaguucacccgccccccccgcgagacccccacccucacccacgagaccuucaaggcccucaagcccggccucuccgccuacgccgacgacgucgagaaguccgcccagggcauccgcgagcuccucgacgucgccaagcaggacauccccuucgacuucuggaaggccaccccccucguccucaaggccaccgccggccuccgccuccuccccggcgagaaggcccagaagcuccuccagaaggucaaggaggucuucaaggccucccccuuccucgucggcgacgacugcgucuccaucaugaacggcaccgacgagggcgucuccgccuggaucaccaucaacuuccucaccggcucccucaagacccccggcggcuccuccgucggcaugcucgaccucggcggcggcuccacccagaucgccuuccucccccgcgucgagggcacccuccaggccuccccccccggcuaccucaccgcccuccgcauguucaaccgcaccuacaagcucuacuccuacuccuaccucggccucggccucauguccgcccgccucgccauccucggcggcgucgagggccagcccgccaaggacggcaaggagcucgucucccccugccucucccccuccuucaagggcgagugggagcacgccgaggucaccuaccgcgucuccggccagaaggccgccgccucccuccacgagcucugcgccgcccgcgucuccgagguccuccagaaccgcguccaccgcaccgaggaggucaagcacgucgacuucuacgccuucuccuacuacuacgaccucgccgccggcgucggccucaucgacgccgagaagggcggcucccucgucgucggcgacuucgagaucgccgccaaguacgucugccgcacccucgagacccagccccaguccucccccuucuccugcauggaccucaccuacgucucccuccuccuccaggaguucggcuucccccgcuccaagguccucaagcucacccgcaagaucgacaacgucgagaccuccugggcccucggcgccaucuuccacuacaucgacucccucaaccgccagaagucccccgccuccuga

SEQ ID NO: 42748 - RNA, 1815 nt, Artificial Sequence
  derived and/or modified sequence opt2 from ENTPD7__Homo_sapiens__NP_065087
auggcccgcaucuccuucuccuaccucugccccgccuccugguacuucaccguccccaccgucucccccuuccuccgccagcgcgucgccuuccucggccucuucuucaucuccugccuccuccuccucaugcucaucaucgacuuccgccacugguccgccucccucccccgcgaccgccaguacgagcgcuaccucgcccgcgucggcgagcucgaggccaccgacaccgaggaccccaaccucaacuacggccucgucgucgacugcggcuccuccggcucccgcaucuucgucuacuucuggccccgccacaacggcaacccccacgaccuccucgacaucaagcagaugcgcgaccgcaacucccagcccgucgucaagaagaucaagcccggcaucuccgccauggccgacacccccgagcacgccuccgacuaccuccgcccccuccucuccuucgccgccgcccacguccccgucaagaagcacaaggagaccccccucuacauccucugcaccgccggcaugcgccuccuccccgagcgcaagcagcucgccauccucgccgaccucgucaaggaccucccccucgaguucgacuuccucuucucccagucccaggccgaggucaucuccggcaagcaggagggcgucuacgccuggaucggcaucaacuucguccucggccgcuucgaccacgaggacgaguccgacgccgaggccacccaggagcucgccgccggccgccgccgcaccgucggcauccucgacaugggcggcgccucccuccagaucgccuacgagguccccaccuccaccuccguccuccccgccaagcaggaggaggccgccaagauccuccucgccgaguucaaccucggcugcgacguccagcacaccgagcacgucuaccgcgucuacgucaccaccuuccucggcuucggcggcaacuucgcccgccagcgcuacgaggaccucguccucaacgagacccucaacaagaaccgccuccucggccagaagaccggccucucccccgacaaccccuuccucgaccccugccuccccgucggccucaccgacgucgucgagcgcaacucccagguccuccacguccgcggccgcggcgacugggucuccugcggcgccaugcucuccccccuccucgcccgcuccaacaccucccaggccucccucaacggcaucuaccagucccccaucgacuucaacaacuccgaguucuacggcuucuccgaguucuucuacugcaccgaggacguccuccgcaucggcggccgcuaccacggccccaccuucgccaaggccgcccaggacuacugcggcauggccugguccguccucacccagcgcuucaagaacggccucuucuccucccacgccgacgagcaccgccucaaguaccagugcuucaaguccgccuggauguaccagguccuccacgagggcuuccacuuccccuacgacuaccccaaccuccgcaccgcccagcucgucuacgaccgcgagguccaguggacccucggcgccauccucuacaagacccgcuuccucccccuccgcgaccuccgccaggagggcguccgccaggcccacggcuccugguuccgccucuccuucgucuacaaccacuaccucuucuucgccugcauccucgucguccuccucgccaucuuccucuaccuccuccgccuccgccgcauccaccaccgccagacccgcgccuccgccccccucgaccuccucuggcucgaggaggucguccccaugaugggcguccaggucggccccuga

SEQ ID NO: 42749 - RNA, 1584 nt, Artificial Sequence
  derived and/or modified sequence opt2 from EOGT__Homo_sapiens__NP_001265618
augcucaugcucuucgucuucggcguccuccuccacgaggucucccucuccggccagaacgaggccccccccaacacccacuccauccccggcgagccccucuacaacuacgccuccauccgccuccccgaggagcacauccccuucuuccuccacaacaaccgccacaucgccaccgucugccgcaaggacucccucugccccuacaagaagcaccucgagaagcucaaguacugcuggggcuacgagaaguccugcaagcccgaguuccgcuucggcuaccccgucugcuccuacgucgacaugggcuggaccgacacccucgaguccgccgaggacaucuucuggaagcaggccgacuucggcuacgcccgcgagcgccucgaggagaugcacguccucugccagcccaaggagaccuccgacuccucccucgucugcucccgcuaccuccaguacugccgcgccaccaaccucuaccucgaccuccgcaacaucaagcgcaaccacgaccgcuucaaggaggacuucuuccaguccggcgagaucggcggccacugcaagcucgacauccgcacccucaccuccgagggccagcgcaaguccccccuccaguccugguucgccgagcuccaguccuacacccagcucaacuuccgccccaucgaggacgccaagugcgacaucgucaucgagaagcccaccuacuucaugaagcucgacgccggcgucaacauguaccaccacuucugcgacuucaucaaccucuacaucacccagcacgucaacaacuccuucuccaccgacgucuacaucgucaugugggacaccuccuccuacggcuacggcgaccucuucuccgacaccuggaacgccuucaccgacuacgacgucauccaccucaagaccuacgacuccaagcgcgucugcuucaaggaggccgucuucucccuccucccccgcaugcgcuacggccucuucuacaacaccccccucaucuccggcugccagaacaccggccucuuccgcgccuucgcccagcacguccuccaccgccucaacaucacccaggagggccccaaggacggcaagauccgcgucaccauccucgcccgcuccaccgaguaccgcaagauccucaaccagaacgagcucgucaacgcccucaagaccgucuccaccuucgagguccagaucgucgacuacaaguaccgcgagcucggcuuccucgaccagcuccgcaucacccacaacaccgacaucuucaucggcaugcacggcgccggccucacccaccuccucuuccuccccgacugggccgccgucuucgagcucuacaacugcgaggacgagcgcugcuaccucgaccucgcccgccuccgcggcguccacuacaucaccuggcgccgccagaacaaggucuucccccaggacaagggccaccaccccacccucggcgagcaccccaaguucaccaacuacuccuucgacgucgaggaguucauguaccucguccuccaggccgccgaccacguccuccagcaccccaaguggcccuucaagaagaagcacgacgagcucuga

SEQ ID NO: 42750 - RNA, 2118 nt, Artificial Sequence
  derived and/or modified sequence opt2 from EOMES__Homo_sapiens__NP_001265111
augcagcucggcgagcagcuccucgucuccuccgucaaccuccccggcgcccacuucuacccccucgaguccgcccgcggcggcuccggcggcuccgccggccaccuccccuccgccgcccccuccccccagaagcucgaccucgacaaggccuccaagaaguucuccggcucccucuccugcgaggccgucuccggcgagcccgccgccgccuccgccggcgcccccgccgccaugcucuccgacaccgacgccggcgacgccuucgccuccgccgccgccgucgccaagcccggcccccccgacggccgcaagggcucccccugcggcgaggaggagcuccccuccgccgccgccgccgccgccgccgccgccgccgccgccgccgccaccgcccgcuacuccauggacucccucuccuccgagcgcuacuaccuccagucccccggcccccagggcuccgagcucgccgcccccugcucccucuuccccuaccaggccgccgccggcgccccccacggccccgucuaccccgcccccaacggcgcccgcuaccccuacggcuccaugcucccccccggcggcuuccccgccgccgucugcccccccggccgcgcccaguucggccccggcgccggcgccggcuccggcgccggcggcuccuccggcggcggcggcggccccggcaccuaccaguacucccagggcgccccccucuacggccccuaccccggcgccgccgccgccggcuccugcggcggccucggcggccucggcguccccggcuccggcuuccgcgcccacgucuaccucugcaaccgcccccucuggcucaaguuccaccgccaccagaccgagaugaucaucaccaagcagggccgccgcauguuccccuuccucuccuucaacaucaacggccucaaccccaccgcccacuacaacgucuucgucgaggucguccucgccgaccccaaccacuggcgcuuccagggcggcaagugggucaccugcggcaaggccgacaacaacaugcagggcaacaagauguacguccaccccgagucccccaacaccggcucccacuggaugcgccaggagaucuccuucggcaagcucaagcucaccaacaacaagggcgccaacaacaacaacacccagaugaucguccuccagucccuccacaaguaccagccccgccuccacaucgucgaggucaccgaggacggcgucgaggaccucaacgagcccuccaagacccagaccuucaccuucuccgagacccaguucaucgccgucaccgccuaccagaacaccgacaucacccagcucaagaucgaccacaaccccuucgccaagggcuuccgcgacaacuacgacuccauguacaccgccuccgagaacgaccgccucacccccucccccaccgacuccccccgcucccaccagaucguccccggcggccgcuacggcguccaguccuucuuccccgagcccuucgucaacacccucccccaggcccgcuacuacaacggcgagcgcaccgucccccagaccaacggccuccucuccccccagcaguccgaggaggucgccaaccccccccagcgcuggcucgucacccccguccagcagcccggcaccaacaagcucgacaucuccuccuacgaguccgaguacaccuccuccacccuccuccccuacggcaucaagucccucccccuccagaccucccacgcccucggcuacuaccccgaccccaccuuccccgccauggccggcuggggcggccgcggcuccuaccagcgcaagauggccgccggccuccccuggaccucccgcaccucccccaccgucuucuccgaggaccagcucuccaaggagaaggucaaggaggagaucggcuccuccuggaucgagaccccccccuccaucaagucccucgacuccaacgacuccggcgucuacaccuccgccugcaagcgccgccgccucucccccuccaacuccuccaacgagaacucccccuccaucaagugcgaggacaucaacgccgaggaguacuccaaggacaccuccaagggcaugggcggcuacuacgccuucuacaccacccccuga

SEQ ID NO: 42751 - RNA, 7245 nt, Artificial Sequence
  derived and/or modified sequence opt2 from EP300__Homo_sapiens__NP_001420
auggccgagaacgucgucgagcccggcccccccuccgccaagcgccccaagcucuccucccccgcccucuccgccuccgccuccgacggcaccgacuucggcucccucuucgaccucgagcacgaccuccccgacgagcucaucaacuccaccgagcucggccucaccaacggcggcgacaucaaccagcuccagaccucccucggcaugguccaggacgccgccuccaagcacaagcagcucuccgagcuccuccgcuccggcuccucccccaaccucaacaugggcgucggcggccccggccaggucauggccucccaggcccagcaguccucccccggccucggccucaucaacuccauggucaagucccccaugacccaggccggccucaccucccccaacaugggcaugggcaccuccggccccaaccagggccccacccaguccaccggcaugaugaacucccccgucaaccagcccgccaugggcaugaacaccggcaugaacgccggcaugaaccccggcaugcucgccgccggcaacggccagggcaucaugcccaaccaggucaugaacggcuccaucggcgccggccgcggccgccagaacaugcaguaccccaaccccggcaugggcuccgccggcaaccuccucaccgagccccuccagcagggcuccccccagaugggcggccagaccggccuccgcggcccccagccccucaagaugggcaugaugaacaaccccaaccccuacggcucccccuacacccagaaccccggccagcagaucggcgccuccggccucggccuccagauccagaccaagaccguccucuccaacaaccucucccccuucgccauggacaagaaggccguccccggcggcggcaugcccaacaugggccagcagcccgccccccagguccagcagcccggccucgucacccccgucgcccagggcaugggcuccggcgcccacaccgccgaccccgagaagcgcaagcucauccagcagcagcucguccuccuccuccacgcccacaagugccagcgccgcgagcaggccaacggcgagguccgccagugcaaccucccccacugccgcaccaugaagaacguccucaaccacaugacccacugccaguccggcaaguccugccaggucgcccacugcgccuccucccgccagaucaucucccacuggaagaacugcacccgccacgacugccccgucugccucccccucaagaacgccggcgacaagcgcaaccagcagcccauccucaccggcgcccccgucggccucggcaaccccuccucccucggcgucggccagcaguccgcccccaaccucuccaccgucucccagaucgaccccuccuccaucgagcgcgccuacgccgcccucggccuccccuaccaggucaaccagaugcccacccagccccagguccaggccaagaaccagcagaaccagcagcccggccaguccccccagggcaugcgccccauguccaacauguccgccucccccaugggcgucaacggcggcgucggcguccagacccccucccuccucuccgacuccaugcuccacuccgccaucaacucccagaaccccaugauguccgagaacgccuccguccccucccucggccccaugcccaccgccgcccagcccuccaccaccggcauccgcaagcaguggcacgaggacaucacccaggaccuccgcaaccaccucguccacaagcucguccaggccaucuuccccacccccgaccccgccgcccucaaggaccgccgcauggagaaccucgucgccuacgcccgcaaggucgagggcgacauguacgaguccgccaacaaccgcgccgaguacuaccaccuccucgccgagaagaucuacaagauccagaaggagcucgaggagaagcgccgcacccgccuccagaagcagaacaugcuccccaacgccgccggcaugguccccgucuccaugaaccccggccccaacaugggccagccccagcccggcaugaccuccaacggcccccuccccgaccccuccaugauccgcggcuccguccccaaccagaugaugccccgcaucaccccccaguccggccucaaccaguucggccagauguccauggcccagccccccaucgucccccgccagacccccccccuccagcaccacggccagcucgcccagcccggcgcccucaacccccccaugggcuacggcccccgcaugcagcagcccuccaaccagggccaguuccucccccagacccaguuccccucccagggcaugaacgucaccaacaucccccucgcccccuccuccggccaggcccccgucucccaggcccagauguccuccuccuccugccccgucaacucccccaucaugccccccggcucccagggcucccacauccacugcccccagcucccccagcccgcccuccaccagaacucccccucccccguccccucccgcacccccaccccccaccacaccccccccuccaucggcgcccagcagccccccgccaccaccauccccgcccccguccccaccccccccgccaugccccccggcccccagucccaggcccuccacccccccccccgccagacccccaccccccccaccacccagcucccccagcagguccagcccucccuccccgccgcccccuccgccgaccagccccagcagcagccccgcucccagcaguccaccgccgccuccguccccacccccaccgccccccuccuccccccccagcccgccaccccccucucccagcccgccgucuccaucgagggccaggucuccaacccccccuccaccuccuccaccgaggucaacucccaggccaucgccgagaagcagcccucccaggaggucaagauggaggccaagauggaggucgaccagcccgagcccgccgacacccagcccgaggacaucuccgaguccaaggucgaggacugcaagauggaguccaccgagaccgaggagcgcuccaccgagcucaagaccgagaucaaggaggaggaggaccagcccuccaccuccgccacccaguccucccccgcccccggccaguccaagaagaagaucuucaagcccgaggagcuccgccaggcccucaugcccacccucgaggcccucuaccgccaggaccccgagucccuccccuuccgccagcccgucgacccccagcuccucggcauccccgacuacuucgacaucgucaagucccccauggaccucuccaccaucaagcgcaagcucgacaccggccaguaccaggagcccuggcaguacgucgacgacaucuggcucauguucaacaacgccuggcucuacaaccgcaagaccucccgcgucuacaaguacugcuccaagcucuccgaggucuucgagcaggagaucgaccccgucaugcagucccucggcuacugcugcggccgcaagcucgaguucuccccccagacccucugcugcuacggcaagcagcucugcaccaucccccgcgacgccaccuacuacuccuaccagaaccgcuaccacuucugcgagaagugcuucaacgagauccagggcgaguccgucucccucggcgacgaccccucccagccccagaccaccaucaacaaggagcaguucuccaagcgcaagaacgacacccucgaccccgagcucuucgucgagugcaccgagugcggccgcaagaugcaccagaucugcguccuccaccacgagaucaucuggcccgccggcuucgucugcgacggcugccucaagaaguccgcccgcacccgcaaggagaacaaguucuccgccaagcgccuccccuccacccgccucggcaccuuccucgagaaccgcgucaacgacuuccuccgccgccagaaccaccccgaguccggcgaggucaccguccgcgucguccacgccuccgacaagaccgucgaggucaagcccggcaugaaggcccgcuucgucgacuccggcgagauggccgaguccuuccccuaccgcaccaaggcccucuucgccuucgaggagaucgacggcgucgaccucugcuucuucggcaugcacguccaggaguacggcuccgacugccccccccccaaccagcgccgcgucuacaucuccuaccucgacuccguccacuucuuccgccccaagugccuccgcaccgccgucuaccacgagauccucaucggcuaccucgaguacgucaagaagcucggcuacaccaccggccacaucugggccugcccccccuccgagggcgacgacuacaucuuccacugccacccccccgaccagaagauccccaagcccaagcgccuccaggagugguacaagaagaugcucgacaaggccgucuccgagcgcaucguccacgacuacaaggacaucuucaagcaggccaccgaggaccgccucaccuccgccaaggagcuccccuacuucgagggcgacuucuggcccaacguccucgaggaguccaucaaggagcucgagcaggaggaggaggagcgcaagcgcgaggagaacaccuccaacgaguccaccgacgucaccaagggcgacuccaagaacgccaagaagaagaacaacaagaagaccuccaagaacaaguccucccucucccgcggcaacaagaagaagcccggcaugcccaacgucuccaacgaccucucccagaagcucuacgccaccauggagaagcacaaggaggucuucuucgucauccgccucaucgccggccccgccgccaacucccucccccccaucgucgaccccgacccccucauccccugcgaccucauggacggccgcgacgccuuccucacccucgcccgcgacaagcaccucgaguucuccucccuccgccgcgcccagugguccaccaugugcaugcucgucgagcuccacacccagucccaggaccgcuucgucuacaccugcaacgagugcaagcaccacgucgagacccgcuggcacugcaccgucugcgaggacuacgaccucugcaucaccugcuacaacaccaagaaccacgaccacaagauggagaagcucggccucggccucgacgacgaguccaacaaccagcaggccgccgccacccagucccccggcgacucccgccgccucuccauccagcgcugcauccagucccucguccacgccugccagugccgcaacgccaacugcucccuccccuccugccagaagaugaagcgcgucguccagcacaccaagggcugcaagcgcaagaccaacggcggcugccccaucugcaagcagcucaucgcccucugcugcuaccacgccaagcacugccaggagaacaagugccccguccccuucugccucaacaucaagcagaagcuccgccagcagcagcuccagcaccgccuccagcaggcccagaugcuccgccgccgcauggccuccaugcagcgcaccggcgucgucggccagcagcagggccuccccucccccacccccgccacccccaccacccccaccggccagcagcccaccaccccccagaccccccagcccaccucccagccccagcccaccccccccaacuccaugccccccuaccucccccgcacccaggccgccggccccgucucccagggcaaggccgccggccaggucaccccccccacccccccccagaccgcccagcccccccuccccggccccccccccgccgccgucgagauggccaugcagauccagcgcgccgccgagacccagcgccagauggcccacguccagaucuuccagcgccccauccagcaccagaugccccccaugacccccauggcccccaugggcaugaaccccccccccaugacccgcggccccuccggccaccucgagcccggcaugggccccaccggcaugcagcagcagccccccuggucccagggcggccucccccagccccagcagcuccaguccggcaugccccgccccgccaugauguccgucgcccagcacggccagccccucaacauggccccccagcccggccucggccaggucggcaucuccccccucaagcccggcaccgucucccagcaggcccuccagaaccuccuccgcacccuccgcucccccuccuccccccuccagcagcagcagguccucuccauccuccacgccaacccccagcuccucgccgccuucaucaagcagcgcgccgccaaguacgccaacuccaacccccagcccauccccggccagcccggcaugccccagggccagcccggccuccagccccccaccaugcccggccagcagggcguccacuccaaccccgccaugcagaacaugaaccccaugcaggccggcguccagcgcgccggccucccccagcagcagccccagcagcagcuccagccccccaugggcggcauguccccccaggcccagcagaugaacaugaaccacaacaccaugcccucccaguuccgcgacauccuccgccgccagcagaugaugcagcagcagcagcagcagggcgccggccccggcaucggccccggcauggccaaccacaaccaguuccagcagccccagggcgucggcuaccccccccagcagcagcagcgcaugcagcaccacaugcagcagaugcagcagggcaacaugggccagaucggccagcucccccaggcccucggcgccgaggccggcgccucccuccaggccuaccagcagcgccuccuccagcagcagaugggcucccccguccagcccaaccccauguccccccagcagcacaugcuccccaaccaggcccaguccccccaccuccagggccagcagauccccaacucccucuccaaccagguccgcuccccccagcccguccccuccccccgcccccagucccagcccccccacuccucccccuccccccgcaugcagccccagcccuccccccaccacgucuccccccagaccuccuccccccaccccggccucgucgccgcccaggccaaccccauggagcagggccacuucgccucccccgaccagaacuccaugcucucccagcucgccuccaaccccggcauggccaaccuccacggcgccuccgccaccgaccucggccucuccaccgacaacuccgaccucaacuccaaccucucccaguccacccucgacauccacuga

SEQ ID NO: 42752 - RNA, 9372 nt, Artificial Sequence
  derived and/or modified sequence opt2 from EP400__Homo_sapiens__NP_056224
augcaccacggcaccggcccccagaacguccagcaccagcuccagcgcucccgcgccugccccggcuccgagggcgaggagcagcccgcccaccccaaccccccccccucccccgccgcccccuucgcccccuccgccucccccuccgccccccagucccccuccuaccagauccagcagcucaugaaccgcucccccgccaccggccagaacgucaacaucacccuccaguccgucggccccgucgucggcggcaaccagcagaucacccucgccccccucccccuccccucccccaccucccccggcuuccaguucuccgcccagccccgccgcuucgagcacggcucccccuccuacauccaggucaccuccccccucucccagcagguccagacccagucccccacccagcccucccccggccccggccaggcccuccagaacguccgcgccggcgcccccggccccggccucggccucugcuccuccucccccaccggcggcuucgucgacgccuccguccucguccgccagaucucccucucccccuccuccggcggccacuucgucuuccaggacggcuccggccucacccagaucgcccagggcgcccagguccagcuccagcaccccggcacccccaucaccguccgcgagcgccgccccucccagccccacacccaguccggcggcaccauccaccaccucggcccccagucccccgccgccgccggcggcgccggccuccagccccucgccucccccucccacaucaccaccgccaaccuccccccccagaucuccuccaucauccagggccagcucguccagcagcagcagguccuccagggccccccccucccccgcccccucggcuucgagcgcacccccggcguccuccuccccggcgccggcggcgccgccggcuucggcaugaccuccccccccccccccaccucccccucccgcaccgccgucccccccggccucuccucccucccccucaccuccgucggcaacaccggcaugaagaagguccccaagaagcucgaggagaucccccccgccucccccgagauggcccagaugcgcaagcagugccucgacuaccacuaccaggagaugcaggcccucaaggaggucuucaaggaguaccucaucgagcucuucuuccuccagcacuuccagggcaacaugauggacuuccucgccuucaagaagaagcacuacgccccccuccaggccuaccuccgccagaacgaccucgacaucgaggaggaggaggaggaggaggaggaggaggaggagaaguccgaggucaucaacgacgagcagcaggcccucgccggcucccucgucgccggcgccggcuccaccgucgagaccgaccucuucaagcgccagcaggccaugcccuccaccggcauggccgagcaguccaagcgcccccgccucgaggucggccaccagggcgucgucuuccagcaccccggcgccgacgccggcgucccccuccagcagcucaugcccaccgcccagggcggcaugccccccaccccccaggccgcccagcucgccggccagcgccagucccagcagcaguacgaccccuccaccggcccccccguccagaacgccgccucccuccacaccccccucccccagcuccccggccgccucccccccgccggcguccccaccgccgcccucuccuccgcccuccaguucgcccagcagccccaggucgucgaggcccagacccagcuccagauccccgucaagacccagcagcccaacguccccauccccgccccccccuccucccagcuccccaucccccccucccagcccgcccagcucgcccuccacguccccacccccggcaagguccagguccaggccucccagcucuccucccucccccagauggucgccuccacccgccuccccgucgaccccgccccccccugcccccgcccccuccccaccuccuccaccuccucccucgcccccgucuccggcuccggccccggccccucccccgcccgcuccucccccgucaaccgccccuccuccgccaccaacaaggcccucucccccgucaccucccgcacccccggcgucgucgccuccgcccccaccaagccccagucccccgcccagaacgccaccuccucccaggacuccucccaggacacccucaccgagcagaucacccucgagaaccagguccaccagcgcaucgccgagcuccgcaaggccggccucuggucccagcgccgccuccccaagcuccaggaggccccccgccccaagucccacugggacuaccuccucgaggagaugcaguggauggccaccgacuucgcccaggagcgccgcuggaaggucgccgccgccaagaagcucguccgcaccgucguccgccaccacgaggagaagcagcuccgcgaggagcgcggcaagaaggaggagcagucccgccuccgccgcaucgccgccuccaccgcccgcgagaucgagugcuucugguccaacaucgagcaggucgucgagaucaagcuccgcgucgagcucgaggagaagcgcaagaaggcccucaaccuccagaaggucucccgccgcggcaaggagcuccgccccaagggcuucgacgcccuccaggaguccucccucgacuccggcauguccggccgcaagcgcaaggccuccaucucccucaccgacgacgaggucgacgacgaggaggagaccaucgaggaggaggaggccaacgagggcgucgucgaccaccagaccgagcucuccaaccucgccaaggaggccgagcucccccuccucgaccucaugaagcucuacgagggcgccuuccuccccuccucccaguggccccgccccaagcccgacggcgaggacaccuccggcgaggaggacgccgacgacugccccggcgaccgcgagucccgcaaggaccucguccucaucgacucccucuucaucauggaccaguucaaggccgccgagcgcaugaacaucggcaagcccaacgccaaggacaucgccgacgucaccgccgucgccgaggccauccuccccaagggcuccgcccgcgucaccaccuccgucaaguucaacgcccccucccuccucuacggcgcccuccgcgacuaccagaagaucggccucgacuggcucgccaagcucuaccgcaagaaccucaacggcauccucgccgacgaggccggccucggcaagaccguccagaucaucgccuucuucgcccaccucgccugcaacgagggcaacuggggcccccaccucgucgucguccgcuccugcaacauccucaagugggagcucgagcucaagcgcuggugccccggccucaagauccucuccuacaucggcucccaccgcgagcucaaggccaagcgccaggagugggccgagcccaacuccuuccacgucugcaucaccuccuacacccaguucuuccgcggccucaccgccuucacccgcguccgcuggaagugccucgucaucgacgagaugcagcgcgucaagggcaugaccgagcgccacugggaggccgucuucacccuccagucccagcagcgccuccuccucaucgacuccccccuccacaacaccuuccucgagcucuggaccaugguccacuuccucguccccggcaucucccgccccuaccucuccuccccccuccgcgcccccuccgaggagucccaggacuacuaccacaaggucgucauccgccuccaccgcgucacccagcccuucauccuccgccgcaccaagcgcgacgucgagaagcagcucaccaagaaguacgagcacguccucaagugccgccucuccaaccgccagaaggcccucuacgaggacgucauccuccagcccggcacccaggaggcccucaaguccggccacuucgucaacguccucuccauccucguccgccuccagcgcaucugcaaccaccccggccucgucgagccccgccaccccggcuccuccuacgucgccggcccccucgaguaccccuccgccucccucauccucaaggcccucgagcgcgacuucuggaaggaggccgaccucuccauguucgaccucaucggccucgagaacaagaucacccgccacgaggccgagcuccucuccaagaagaagaucccccgcaagcucauggaggagaucuccaccuccgccgcccccgccgcccgccccgccgccgccaagcucaaggccucccgccucuuccagcccguccaguacggccagaagcccgagggccgcaccgucgccuuccccuccacccaccccccccgcaccgccgcccccaccaccgccuccgccgccccccagggcccccuccgcggccgcccccccaucgccaccuucuccgccaaccccgaggccaaggccgccgccgcccccuuccagaccucccaggccuccgccuccgccccccgccaccagcccgccuccgccuccuccaccgccgccucccccgcccaccccgccaagcuccgcgcccagaccaccgcccaggccuccacccccggccagccccccccccagccccaggcccccucccacgccgccggccaguccgcccucccccagcgccucguccuccccucccaggcccaggcccgccuccccuccggcgaggucgucaagaucgcccagcucgccuccaucaccggcccccagucccgcgucgcccagcccgagacccccgucacccuccaguuccagggcuccaaguucacccucucccacucccagcuccgccagcucaccgccggccagccccuccagcuccagggcuccguccuccagaucgucuccgcccccggccagcccuaccuccgcgcccccggccccgucgucaugcagaccgucucccaggccggcgccguccacggcgcccucggcuccaagccccccgccggcggccccucccccgccccccucaccccccaggucggcguccccggccgcgucgccgucaacgcccucgccgucggcgagcccggcaccgccuccaagcccgccucccccaucggcggccccacccaggaggagaagacccgccuccucaaggagcgccucgaccagaucuaccucgucaacgagcgccgcugcucccaggcccccgucuacggccgcgaccuccuccgcaucugcgcccuccccucccacggccgcguccaguggcgcggcucccucgacggccgccgcggcaaggaggccggccccgcccacuccuacaccuccuccuccgagucccccuccgagcucaugcucacccucugccgcugcggcgagucccuccaggacgucaucgaccgcgucgccuucgucaucccccccgucgucgccgccccccccucccuccgcgucccccgcccccccccccucuacucccaccgcaugcgcauccuccgccagggccuccgcgagcacgccgcccccuacuuccagcagcuccgccagaccaccgccccccgccuccuccaguuccccgagcuccgccucguccaguucgacuccggcaagcucgaggcccucgccauccuccuccagaagcucaaguccgagggccgccgcguccucauccucucccagaugauccucaugcucgacauccucgagauguuccucaacuuccacuaccucaccuacguccgcaucgacgagaacgccuccuccgagcagcgccaggagcucaugcgcuccuucaaccgcgaccgccgcaucuucugcgccauccucuccacccacucccgcaccaccggcaucaaccucgucgaggccgacaccgucgucuucuacgacaacgaccucaaccccgucauggacgccaaggcccaggaguggugcgaccgcaucggccgcugcaaggacauccacaucuaccgccucgucuccggcaacuccaucgaggagaagcuccucaagaacggcaccaaggaccucauccgcgaggucgccgcccagggcaacgacuacuccauggccuuccucacccagcgcaccauccaggagcucuucgaggucuacucccccauggacgacgccggcuuccccgucaaggccgaggaguucgucguccucucccaggagcccuccgucaccgagaccaucgcccccaagaucgcccgccccuucaucgaggcccucaaguccaucgaguaccucgaggaggacgcccagaaguccgcccaggagggcguccucggcccccacaccgacgcccucuccuccgacuccgagaacaugcccugcgacgaggagcccucccagcucgaggagcucgccgacuucauggagcagcucacccccaucgagaaguacgcccucaacuaccucgagcucuuccacaccuccaucgagcaggagaaggagcgcaacuccgaggacgccgucaugaccgccguccgcgccugggaguucuggaaccucaagacccuccaggagcgcgaggcccgccuccgccucgagcaggaggaggccgagcuccucaccuacacccgcgaggacgccuacuccauggaguacgucuacgaggacgucgacggccagaccgaggucaugccccucuggaccccccccacccccccccaggacgacuccgacaucuaccucgacuccgucaugugccucauguacgaggccacccccauccccgaggccaagcucccccccgucuacguccgcaaggagcgcaagcgccacaagaccgaccccuccgccgccggccgcaagaagaagcagcgccacggcgaggccgucguccccccccgcucccucuucgaccgcgccacccccggccuccucaagauccgccgcgagggcaaggagcagaagaagaacauccuccucaagcagcagguccccuucgccaagccccuccccaccuucgccaagcccaccgccgagcccggccaggacaaccccgaguggcucaucuccgaggacugggcccuccuccaggccgucaagcagcuccucgagcucccccucaaccucaccaucgucucccccgcccacacccccaacugggaccucgucuccgacgucgucaacuccugcucccgcaucuaccgcuccuccaagcagugccgcaaccgcuacgagaacgucaucaucccccgcgaggagggcaaguccaagaacaaccgcccccuccgcaccucccagaucuacgcccaggacgagaacgccacccacacccagcucuacaccucccacuucgaccucaugaagaugaccgccggcaagcgcuccccccccaucaagccccuccucggcaugaaccccuuccagaagaaccccaagcacgccuccguccucgccgaguccggcaucaacuacgacaagccccucccccccauccaggucgccucccuccgcgccgagcgcaucgccaaggagaagaaggcccucgccgaccagcagaaggcccagcagcccgccgucgcccagcccccccccccccagccccagccccccccccccccccagcagcccccccccccccucccccagccccaggccgccggcucccagccccccgccggcccccccgccguccagccccagccccagccccagccccagacccagccccagcccguccaggcccccgccaaggcccagcccgccaucaccaccggcggcuccgccgccguccucgccggcaccaucaagaccuccgucaccggcaccuccaugcccaccggcgccgucuccggcaacgucaucgucaacaccaucgccggcguccccgccgccaccuuccaguccaucaacaagcgccucgccucccccgucgcccccggcgcccucaccacccccggcggcuccgcccccgcccaggucguccacacccagccccccccccgcgccgucggcucccccgccaccgccacccccgaccucgucuccauggccaccacccagggcguccgcgccgucaccuccgucaccgccuccgccgucgucaccaccaaccucacccccguccagacccccgcccgcucccucgucccccaggucucccaggccaccggcguccagcuccccggcaagaccaucacccccgcccacuuccagcuccuccgccagcagcagcagcagcagcagcagcagcagcagcagcagcagcagcagcagcagcagcagcagcagcagcagcagcagcagcagcagaccaccaccaccucccagguccaggucccccagauccagggccaggcccagucccccgcccagaucaaggccgucggcaagcucacccccgagcaccucaucaagaugcagaagcagaagcuccagaugcccccccagcccccccccccccaggcccaguccgcccccccccagcccaccgcccagguccagguccagaccucccagcccccccagcagcaguccccccagcucaccaccgucaccgccccccgccccggcgcccuccucaccggcaccaccgucgccaaccuccaggucgcccgccucacccgcguccccaccucccagcuccaggcccagggccagaugcagacccaggccccccagcccgcccaggucgcccucgccaagccccccgucgucuccguccccgccgccgucgucuccucccccggcgucaccacccuccccaugaacgucgccggcaucuccgucgccaucggccagccccagaaggccgccggccagaccgucgucgcccagcccguccacaugcagcagcuccucaagcucaagcagcaggccguccagcagcagaaggccauccagccccaggccgcccagggccccgccgccguccagcagaagaucaccgcccagcagaucaccacccccggcgcccagcagaaggucgccuacgccgcccagcccgcccucaagacccaguuccucaccacccccaucucccaggcccagaagcucgccggcgcccagcagguccagacccagauccaggucgccaagcucccccaggucguccagcagcagacccccgucgccuccauccagcaggucgccuccgccucccagcaggccuccccccagaccgucgcccucacccaggccaccgccgccggccagcagguccagaugauccccgccgucaccgccaccgcccaggucguccagcagaagcucauccagcagcaggucgucaccaccgccuccgccccccuccagacccccggcgcccccaaccccgcccagguccccgccuccuccgacucccccucccagcagcccaagcuccagaugcgcguccccgccguccgccucaagacccccaccaagccccccugccaguga

SEQ ID NO: 42753 - RNA, 2613 nt, Artificial Sequence
  derived and/or modified sequence opt2 from EPAS1__Homo_sapiens__NP_001421
augaccgccgacaaggagaagaagcgcuccuccuccgagcgccgcaaggagaagucccgcgacgccgcccgcugccgccgcuccaaggagaccgaggucuucuacgagcucgcccacgagcucccccucccccacuccgucuccucccaccucgacaaggccuccaucaugcgccucgccaucuccuuccuccgcacccacaagcuccucuccuccgucugcuccgagaacgaguccgaggccgaggccgaccagcagauggacaaccucuaccucaaggcccucgagggcuucaucgccgucgucacccaggacggcgacaugaucuuccucuccgagaacaucuccaaguucaugggccucacccaggucgagcucaccggccacuccaucuucgacuucacccaccccugcgaccacgaggagauccgcgagaaccucucccucaagaacggcuccggcuucggcaagaaguccaaggacauguccaccgagcgcgacuucuucaugcgcaugaagugcaccgucaccaaccgcggccgcaccgucaaccucaaguccgccaccuggaagguccuccacugcaccggccaggucaaggucuacaacaacugccccccccacaacucccucugcggcuacaaggagccccuccucuccugccucaucaucaugugcgagcccauccagcaccccucccacauggacaucccccucgacuccaagaccuuccucucccgccacuccauggacaugaaguucaccuacugcgacgaccgcaucaccgagcucaucggcuaccaccccgaggagcuccucggccgcuccgccuacgaguucuaccacgcccucgacuccgagaacaugaccaagucccaccagaaccucugcaccaagggccaggucgucuccggccaguaccgcaugcucgccaagcacggcggcuacgucuggcucgagacccagggcaccgucaucuacaacccccgcaaccuccagccccagugcaucaugugcgucaacuacguccucuccgagaucgagaagaacgacgucgucuucuccauggaccagaccgagucccucuucaagccccaccucauggccaugaacuccaucuucgacuccuccggcaagggcgccgucuccgagaaguccaacuuccucuucaccaagcucaaggaggagcccgaggagcucgcccagcucgcccccacccccggcgacgccaucaucucccucgacuucggcaaccagaacuucgaggaguccuccgccuacggcaaggccauccucccccccucccagcccugggccaccgagcuccgcucccacuccacccaguccgaggccggcucccuccccgccuucaccgucccccaggccgccgcccccggcuccaccacccccuccgccaccuccuccuccuccuccugcuccacccccaacucccccgaggacuacuacaccucccucgacaacgaccucaagaucgaggucaucgagaagcucuucgccauggacaccgaggccaaggaccagugcuccacccagaccgacuucaacgagcucgaccucgagacccucgcccccuacauccccauggacggcgaggacuuccagcucucccccaucugccccgaggagcgccuccucgccgagaacccccaguccaccccccagcacugcuucuccgccaugaccaacaucuuccagccccucgcccccgucgccccccacucccccuuccuccucgacaaguuccagcagcagcucgaguccaagaagaccgagcccgagcaccgccccauguccuccaucuucuucgacgccggcuccaaggccucccucccccccugcugcggccaggccuccaccccccucuccuccaugggcggccgcuccaacacccaguggccccccgaccccccccuccacuucggccccaccaagugggccgucggcgaccagcgcaccgaguuccucggcgccgccccccucggcccccccgucucccccccccacgucuccaccuucaagacccgcuccgccaagggcuucggcgcccgcggccccgacguccucucccccgccauggucgcccucuccaacaagcucaagcucaagcgccagcucgaguacgaggagcaggccuuccaggaccucuccggcggcgacccccccggcggcuccaccucccaccucauguggaagcgcaugaagaaccuccgcggcggcuccugcccccucaugcccgacaagccccucuccgccaacguccccaacgacaaguucacccagaaccccaugcgcggccucggccacccccuccgccaccucccccucccccagccccccuccgccaucucccccggcgagaacuccaagucccgcuuccccccccagugcuacgccacccaguaccaggacuacucccucuccuccgcccacaaggucuccggcauggccucccgccuccucggccccuccuucgaguccuaccuccuccccgagcucacccgcuacgacugcgaggucaacguccccguccucggcuccuccacccuccuccagggcggcgaccuccuccgcgcccucgaccaggccaccuga

SEQ ID NO: 42754 - RNA, 2643 nt, Artificial Sequence
  derived and/or modified sequence opt2 from EPB41L1__Homo_sapiens__NP_001245258
augaccaccgagaccggccccgacuccgaggucaagaaggcccaggaggaggccccccagcagcccgaggccgccgccgccgucaccacccccgucacccccgccggccacggccaccccgaggccaacuccaacgagaagcaccccucccagcaggacacccgccccgccgagcagucccucgacauggaggagaaggacuacuccgaggccgacggccucuccgagcgcaccacccccuccaaggcccagaaguccccccagaagaucgccaagaaguacaaguccgccaucugccgcgucacccuccucgacgccuccgaguacgagugcgaggucgagaagcacggccgcggccagguccucuucgaccucgucugcgagcaccucaaccuccucgagaaggacuacuucggccucaccuucugcgacgccgacucccagaagaacuggcucgaccccuccaaggagaucaagaagcagauccgcuccucccccuggaacuucgccuucaccgucaaguucuacccccccgaccccgcccagcucaccgaggacaucacccgcuacuaccucugccuccagcuccgcgccgacaucaucaccggccgccuccccugcuccuucgucacccacgcccuccucggcuccuacgccguccaggccgagcucggcgacuacgacgccgaggagcacgucggcaacuacgucuccgagcuccgcuucgcccccaaccagacccgcgagcucgaggagcgcaucauggagcuccacaagaccuaccgcggcaugacccccggcgaggccgagauccacuuccucgagaacgccaagaagcucuccauguacggcgucgaccuccaccacgccaaggacuccgagggcaucgacaucaugcucggcgucugcgccaacggccuccucaucuaccgcgaccgccuccgcaucaaccgcuucgccuggcccaagauccucaagaucuccuacaagcgcuccaacuucuacaucaagauccgccccggcgaguacgagcaguucgaguccaccaucggcuucaagcuccccaaccaccgcuccgccaagcgccucuggaaggucugcaucgagcaccacaccuucuuccgccucgucucccccgagcccccccccaagggcuuccucgucaugggcuccaaguuccgcuacuccggccgcacccaggcccagacccgccaggccuccgcccucaucgaccgccccgcccccuucuucgagcgcuccuccuccaagcgcuacaccaugucccgcucccucgacggcgccgaguucucccgccccgccuccgucuccgagaaccacgacgccggccccgacggcgacaagcgcgacgaggacggcgaguccggcggccagcgcuccgaggccgaggagggcgagguccgcacccccaccaagaucaaggagcucaagcccgagcaggagaccaccccccgccacaagcaggaguuccucgacaagcccgaggacguccuccucaagcaccaggccuccaucaacgagcucaagcgcacccucaaggagcccaacuccaagcucauccaccgcgaccgcgacugggagcgcgagcgccgccuccccuccucccccgccucccccucccccaagggcacccccgagaaggccaacgagcgcgccggccuccgcgagggcuccgaggagaaggucaagcccccccgcccccgcgcccccgaguccgacaccggcgacgaggaccaggaccaggagcgcgacaccgucuuccucaaggacaaccaccucgccaucgagcgcaagugcuccuccaucaccgucuccuccaccuccucccucgaggccgaggucgacuucaccgucaucggcgacuaccacggcuccgccuucgaggacuucucccgcucccuccccgagcucgaccgcgacaaguccgacuccgacaccgagggccuccucuucucccgcgaccucaacaagggcgcccccucccaggacgacgaguccggcggcaucgaggacucccccgaccgcggcgccugcuccacccccgacaugccccaguucgagcccgucaagaccgagaccaugaccgucuccucccucgccauccgcaagaagaucgagcccgaggccguccuccagacccgcgucuccgccauggacaacacccaggucgacggcuccgccuccgucggccgcgaguucaucgccaccacccccuccaucaccaccgagaccaucuccaccaccauggagaacucccucaaguccggcaagggcgccgccgccaugauccccggcccccagaccgucgccaccgagauccgcucccucucccccaucaucggcaaggacguccucaccuccaccuacggcgccaccgccgagacccucuccaccuccaccaccacccacgucaccaagaccgucaagggcggcuucuccgagacccgcaucgagaagcgcaucaucaucaccggcgacgaggacgucgaccaggaccaggcccucgcccucgccaucaaggaggccaagcuccagcaccccgacaugcucgucaccaaggccgucgucuaccgcgagaccgaccccucccccgaggagcgcgacaagaagccccaggaguccuga

SEQ ID NO: 42755 - RNA, 2022 nt, Artificial Sequence
  derived and/or modified sequence opt2 from EPB41L2__Homo_sapiens__NP_001129026
augaccaccgaggucggcuccgucuccgaggucaagaaggacuccucccagcucggcaccgacgccaccaaggagaagcccaaggaggucgccgagaaccagcagaaccaguccuccgaccccgaggaggagaagggcucccagcccccccccgccgccgagucccaguccucccuccgccgccagaagcgcgagaaggagaccuccgagucccgcggcaucucccgcuucaucccccccuggcucaagaagcagaaguccuacacccucgucgucgccaaggacggcggcgacaagaaggagcccacccaggccgucgucgaggagcagguccucgacaaggaggagccccuccccgaggagcagcgccaggccaagggcgacgccgaggagauggcccagaagaagcaggagaucaaggucgaggucaaggaggagaagcccuccgucuccaaggaggagaagcccuccgucuccaaggucgagaugcagcccaccgagcucgucuccaaggagcgcgaggagaaggucaaggagacccaggaggacaagcucgagggcggcgccgccaagcgcgagaccaaggagguccagaccaacgagcucaaggccgagaaggccucccagaaggucaccaagaagaccaagaccguccagugcaaggucacccuccucgacggcaccgaguacuccugcgaccucgagaagcacgccaagggccagguccucuucgacaaggucugcgagcaccucaaccuccucgagaaggacuacuucggccuccucuuccaggagucccccgagcagaagaacuggcucgaccccgccaaggagaucaagcgccagcuccgcaaccuccccuggcucuucaccuucaacgucaaguucuacccccccgaccccucccagcucaccgaggacaucacccgcuacuuccucugccuccagcuccgccaggacaucgccuccggccgccuccccugcuccuucgucacccacgcccuccucggcuccuacacccuccaggccgagcucggcgacuacgaccccgaggagcacggcuccaucgaccucuccgaguuccaguucgcccccacccagaccaaggagcucgaggagaaggucgccgagcuccacaagacccaccgcggccucucccccgcccaggccgacucccaguuccucgagaacgccaagcgccucuccauguacggcgucgaccuccaccacgccaaggacuccgagggcgucgacaucaagcucggcgucugcgccaacggccuccucaucuacaaggaccgccuccgcaucaaccgcuucgccuggcccaagauccucaagaucuccuacaagcgcuccaacuucuacaucaagguccgccccgccgagcucgagcaguucgaguccaccaucggcuucaagcuccccaaccaccgcgccgccaagcgccucuggaaggucugcgucgagcaccacaccuucuaccgccucgucucccccgagcagccccccaaggccaaguuccucacccucggcuccaaguuccgcuacuccggccgcacccaggcccagacccgccaggccuccacccucaucgaccgccccgccccccacuucgagcgcaccuccuccaagcgcgucucccgcucccucgacggcgcccccaucggcgucauggaccagucccucaugaaggacuuccccggcgccgccggcgagaucuccgccuacggccccggccucgucuccaucgccgucguccaggacggcgacggccgccgcgagguccgcucccccaccaaggccccccaccuccagcucaucgagggcaagaccgucaagggcggcaucuccgagacccgcaucgagaagcgcaucgucaucaccggcgacggcgacaucgaccacgaccaggcccucgcccaggccauccgcgaggcccgcgagcagcaccccgacauguccgucacccgcgucgucguccacaaggagaccgagcucgccgaggagggcgaggacuga

SEQ ID NO: 42756 - RNA, 2652 nt, Artificial Sequence
  derived and/or modified sequence opt2 from EPB41L3__Homo_sapiens__NP_001268462
augaccaccgaguccggcuccgacuccgaguccaagcccgaccaggaggccgagccccaggaggccgccggcgcccagggccgcgccggcgcccccguccccgagccccccaaggaggagcagcagcaggcccucgagcaguucgccgccgccgccgcccacuccacccccguccgccgcgaggucaccgacaaggagcaggaguucgccgcccgcgccgccaagcagcucgaguaccagcagcucgaggacgacaagcucucccagaaguccuccuccuccaagcucucccgcuccccccucaagaucgucaagaagcccaaguccaugcagugcaaggucauccuccucgacggcuccgaguacaccugcgacgucgagaagcgcucccgcggccagguccucuucgacaaggucugcgagcaccucaaccuccucgagaaggacuacuucggccucaccuaccgcgacgccgagaaccagaagaacuggcucgaccccgccaaggagaucaagaagcagguccgcuccggcgccuggcacuucuccuucaacgucaaguucuacccccccgaccccgcccagcucuccgaggacaucacccgcuacuaccucugccuccagcuccgcgacgacaucgucuccggccgccuccccugcuccuucgucacccucgcccuccucggcuccuacaccguccaguccgagcucggcgacuacgaccccgacgagugcggcuccgacuacaucuccgaguuccgcuucgcccccaaccacaccaaggagcucgaggacaaggucaucgagcuccacaagucccaccgcggcaugacccccgccgaggccgagaugcacuuccucgagaacgccaagaagcucuccauguacggcgucgaccuccaccacgccaaggacuccgagggcgucgagaucaugcucggcgucugcgccuccggccuccucaucuaccgcgaccgccuccgcaucaaccgcuucgccuggcccaagguccucaagaucuccuacaagcgcaacaacuucuacaucaagauccgccccggcgaguucgagcaguucgaguccaccaucggcuucaagcuccccaaccaccgcgccgccaagcgccucuggaaggucugcgucgagcaccacaccuucuuccgccuccuccuccccgaggccccccccaagaaguuccucacccucggcuccaaguuccgcuacuccggccgcacccaggcccagacccgccgcgccuccgcccucaucgaccgccccgcccccuacuucgagcgcuccuccuccaagcgcuacaccaugucccgcucccucgacggcgccuccgucaacgagaaccacgagaucuacaugaaggacuccauguccgccgccgaggucggcaccggccaguacgccaccaccaagggcaucucccagaccaaccucaucaccaccgucacccccgagaagaaggccgaggaggagcgcgacgaggaggaggacaagcgccgcaagggcgaggaggucacccccaucuccgccauccgccacgagggcaagaccgacuccgagcgcaccgacaccgccgccgacggcgagaccaccgccaccgaguccgaccaggaggaggacgccgagcucaaggcccaggagcucgagaagacccaggacgaccucaugaagcaccagaccaacaucuccgagcucaagcgcaccuuccucgagaccuccaccgacaccgccgucaccaacgagugggagaagcgccucuccaccucccccguccgccucgccgcccgccaggaggacgcccccaugaucgagccccucguccccgaggagaccaagcaguccuccggcgagaagcucauggacggcuccgagaucuucucccuccucgaguccgcccgcaagcccaccgaguucaucggcggcgucaccuccaccucccaguccuggguccagaagauggagaccaagaccgaguccuccggcaucgagaccgagcccaccguccaccaccucccccucuccaccgagaaggucguccaggagaccguccucgucgaggagcgccgcgucguccacgccuccggcgacgccuccuacuccgccggcgacuccggcgacgccgccgcccagcccgccuucaccggcaucaagggcaaggagggcuccgcccucaccgagggcgccaaggaggagggcggcgaggaggucgccaaggccguccucgagcaggaggagaccgccgccgccucccgcgagcgccaggaggagcaguccgccgccauccacaucuccgagacccucgagcagaagccccacuucgaguccuccaccgucaagaccgagaccaucuccuucggcuccgucucccccggcggcgucaagcucgagaucuccaccaaggagguccccgucguccacaccgagaccaagaccaucaccuacgaguccucccaggucgaccccggcaccgaccucgagcccggcguccucauguccgcccagaccaucaccuccgagaccaccuccaccaccaccaccacccacaucaccaagaccgucaagggcggcaucuccgagacccgcaucgagaagcgcaucgucaucaccggcgacgccgacaucgaccacgaccaggaguga

SEQ ID NO: 42757 - RNA, 2061 nt, Artificial Sequence
  derived and/or modified sequence opt2 from EPB41L4A__Homo_sapiens__NP_071423
augggcugcuucugcgccguccccgaggaguucuacugcgagguccuccuccucgacgaguccaagcucacccucaccacccagcagcagggcaucaagaaguccaccaagggcuccgucguccucgaccacgucuuccaccacgucaaccucgucgagaucgacuacuucggccuccgcuacugcgaccgcucccaccagaccuacuggcucgaccccgccaagacccucgccgagcacaaggagcucaucaacaccggcccccccuacacccucuacuucggcaucaaguucuacgccgaggaccccugcaagcucaaggaggagaucacccgcuaccaguucuuccuccaggucaagcaggacguccuccagggccgccuccccugccccgucaacaccgccgcccagcucggcgccuacgccauccaguccgagcucggcgacuacgaccccuacaagcacaccgccggcuacgucuccgaguaccgcuucguccccgaccagaaggaggagcucgaggaggccaucgagcgcauccacaagacccucaugggccagauccccuccgaggccgagcucaacuaccuccgcaccgccaagucccucgagauguacggcgucgaccuccaccccgucuacggcgagaacaaguccgaguacuuccucggccucacccccgucggcgucgucgucuacaagaacaagaagcaggucggcaaguacuucuggccccgcaucaccaagguccacuucaaggagacccaguucgagcuccgcguccucggcaaggacugcaacgagaccuccuucuucuucgaggcccgcuccaagaccgccugcaagcaccucuggaagugcuccgucgagcaccacaccuucuuccgcaugcccgagaacgaguccaacucccucucccgcaagcucuccaaguucggcuccauccgcuacaagcaccgcuacuccggccgcaccgcccuccagaugucccgcgaccucuccauccagcucccccgccccgaccagaacgucacccgcucccgcuccaagaccuaccccaagcgcaucgcccagacccagcccgccgaguccaacuccaucucccgcaucaccgccaacauggagaacggcgagaacgagggcaccaucaagaucaucgcccccucccccgucaaguccuucaagaaggccaagaacgagaacucccccgacacccagcgcuccaagucccacgcccccugggaggagaacggcccccaguccggccucuacaacucccccuccgaccgcaccaagucccccaaguuccccuacacccgccgccgcaaccccuccugcggcuccgacaacgacuccguccagcccguccgccgccgcaaggcccacaacuccggcgaggacuccgaccucaagcagcgccgccgcucccgcucccgcugcaacaccuccuccggcuccgaguccgagaacuccaaccgcgaguaccgcaagaagcgcaaccgcauccgccaggagaacgacauggucgacuccgccccccagugggaggccguccuccgccgccagaaggagaagaaccaggccgaccccaacaaccgccgcucccgccaccgcucccgcucccgcucccccgacauccaggccaaggaggagcucuggaagcacauccagaaggagcucgucgaccccuccggccucuccgaggagcagcucaaggagauccccuacaccaagaucgagacccagggcgaccccauccgcauccgccacucccacuccccccgcuccuaccgccaguaccgccgcucccagugcuccgacggcgagcgcuccguccucuccgaggucaacuccaagaccgaccucguccccccccuccccgucacccacuccuccgacgcccagggcuccggcgacgccaccguccaccagcgccgcaacggcuccaaggacucccucauggaggagaagccccagaccuccaccaacaaccucgccggcaagcacaccgccaagaccaucaagaccauccaggccucccgccucaagaccgagaccuga

SEQ ID NO: 42758 - RNA, 1557 nt, Artificial Sequence
  derived and/or modified sequence opt2 from EPB41L4B__Homo_sapiens__NP_060894
augcuccgcuuccuccgccgcaccuucggccgccgcuccaugcagcgcuacgcccgcggcgccgccggccgcggcgccgccggccucggcgacgagcgcgacggcggcccccgcggcggccccgccgccgccgccuccuccuccgcccuccccgccgcccccggcggcuccgucuuccccgccggcggcggcccccuccucaccggcggcgccgccguccacaucuccgccgccggcgccgccaaggccacccucuacugccgcgucuuccuccucgacggcaccgaggucuccgucgaccuccccaagcacgccaagggccaggaccucuucgaccagaucgucuaccaccucgaccucgucgagaccgacuacuucggccuccaguuccucgacuccgcccaggucgcccacuggcucgaccacgccaagcccaucaagaagcagaugaagaucggccccgccuacgcccuccacuuccgcgucaaguacuacuccuccgagcccaacaaccuccgcgaggaguucacccgcuaccucuucguccuccagcuccgccacgacauccucuccggcaagcucaagugccccuacgagaccgccgucgagcucgccgcccucugccuccaggccgagcucggcgagugcgagcuccccgagcacacccccgagcucgucuccgaguuccgcuucauccccaaccagaccgaggccauggaguucgacaucuuccagcgcuggaaggagugccgcggcaagucccccgcccaggccgagcucuccuaccucaacaaggccaaguggcucgagauguacggcgucgacaugcacgucguccgcggccgcgacggcugcgaguacucccucggccucacccccaccggcauccucaucuucgagggcgccaacaagaucggccucuucuucuggcccaagaucaccaagauggacuucaagaaguccaagcucacccucgucgucgucgaggacgacgaccagggccgcgagcaggagcacaccuucgucuuccgccucgacuccgcccgcaccugcaagcaccucuggaagugcgccgucgagcaccacgccuucuuccgccuccgcacccccggcaacuccaaguccaaccgcuccgacuucauccgccucggcucccgcuuccgcuucuccggccgcaccgaguaccaggccacccacggcucccgccuccgccgcaccuccaccuucgagcgcaagcccuccaagcgcuaccccucccgccgccacuccaccuucaaggccuccaaccccgucaucgccgcccagcucugcuccaagaccaaccccgagguccacaacuaccagccccaguaccaccccaacauccaccccucccagccccgcuggcacccccacucccccaacguccgccccuccuuccaggacgaccgcucccacuggaaggccuccgccuccggcgacgacucccacuucgacuacguccacgaccagaaccagaagaaccucggcggcaugcaguccaugauguaccgcgacaagcucaugaccgcccucuga

SEQ ID NO: 42759 - RNA, 2076 nt, Artificial Sequence
  derived and/or modified sequence opt2 from EPB42__Homo_sapiens__NP_001107606
augggccaggcccucggcaucaaguccugcgacuuccaggccgcccgcaacaacgaggagcaccacaccaaggcccucuccucccgccgccucuucguccgccgcggccagcccuucaccaucauccucuacuuccgcgcccccguccgcgccuuccuccccgcccucaagaaggucgcccucaccgcccagaccggcgagcagcccuccaagaucaaccgcacccaggccaccuuccccaucuccucccucggcgaccgcaaguggugguccgccgucgucgaggagcgcgacgcccaguccuggaccaucuccgucaccacccccgccgacgccgucaucggccacuacucccuccuccuccaggucuccggccgcaagcagcuccuccucggccaguucacccuccucuucaaccccuggaaccgcgaggacgccgucuuccucaagaacgaggcccagcgcauggaguaccuccucaaccagaacggccucaucuaccucggcaccgccgacugcauccaggccgaguccugggacuucggccaguucgagggcgacgucaucgaccucucccuccgccuccucuccaaggacaagcaggucgagaaguggucccagcccguccacgucgcccgcguccucggcgcccuccuccacuuccucaaggagcagcgcguccuccccaccccccagacccaggccacccaggagggcgcccuccucaacaagcgccgcggcuccguccccauccuccgccaguggcucaccggccgcggccgccccgucuacgacggccaggccuggguccucgccgccgucgccugcaccguccuccgcugccucggcauccccgcccgcgucgucaccaccuucgccuccgcccagggcaccggcggccgccuccucaucgacgaguacuacaacgaggagggccuccagaacggcgagggccagcgcggccgcaucuggaucuuccagaccuccaccgagugcuggaugacccgccccgcccucccccagggcuacgacggcuggcagauccuccaccccuccgcccccaacggcggcggcguccucggcuccugcgaccucguccccguccgcgccgucaaggagggcacccucggccucacccccgccgucuccgaccucuucgccgccaucaacgccuccugcgucgucuggaagugcugcgaggacggcacccucgagcucaccgacuccaacaccaaguacgucggcaacaacaucuccaccaagggcgucggcuccgaccgcugcgaggacaucacccagaacuacaaguaccccgagggcucccuccaggagaaggagguccucgagcgcgucgagaaggagaagauggagcgcgagaaggacaacggcauccgcccccccucccucgagaccgccuccccccucuaccuccuccucaaggcccccuccucccucccccuccgcggcgacgcccagaucuccgucacccucgucaaccacuccgagcaggagaaggccguccagcucgccaucggcguccaggccguccacuacaacggcguccucgccgccaagcucuggcgcaagaagcuccaccucacccucuccgccaaccucgagaagaucaucaccaucggccucuucuucuccaacuucgagcgcaacccccccgagaacaccuuccuccgccucaccgccauggccacccacuccgaguccaaccucuccugcuucgcccaggaggacaucgccaucugccgcccccaccucgccaucaagaugcccgagaaggccgagcaguaccagccccucaccgccuccgucucccuccagaacucccucgacgcccccauggaggacugcgucaucuccauccucggccgcggccucauccaccgcgagcgcuccuaccgcuuccgcuccgucuggcccgagaacaccaugugcgccaaguuccaguucacccccacccacgucggccuccagcgccucaccgucgaggucgacugcaacauguuccagaaccucaccaacuacaaguccgucaccgucgucgcccccgagcucuccgccuga

SEQ ID NO: 42760 - RNA, 2442 nt, Artificial Sequence
  derived and/or modified sequence opt2 from EPC1__Homo_sapiens__NP_001258933
auguccaagcucuccuuccgcgcccgcgcccucgacgccuccaagccccuccccgucuuccgcugcgaggaccuccccgaccuccacgaguacgccuccaucaaccgcgccgucccccagaugcccaccggcauggagaaggaggaggaguccgagcaccaccuccagcgcgccaucuccgcccagcaggucuacggcgagaagcgcgacaacauggucauccccguccccgaggccgaguccaacaucgccuacuacgaguccaucuaccccggcgaguucaagaugcccaagcagcucauccacauccagcccuucucccucgacgccgagcagcccgacuacgaccucgacuccgaggacgaggucuucgucaacaagcucaagaagaagauggacaucugcccccuccaguucgaggagaugaucgaccgccucgagaagggcuccggccagcagcccgucucccuccaggaggccaagcuccuccucaaggaggacgacgagcucauccgcgaggucuacgaguacuggaucaagaagcgcaagaacugccgcggccccucccucauccccuccgucaagcaggagaagcgcgacggcuccuccaccaacgaccccuacgucgccuuccgccgccgcaccgagaagaugcagacccgcaagaaccgcaagaacgacgaggccuccuacgagaagaugcucaagcuccgccgcgaccucucccgcgccgucaccauccucgagaugaucaagcgccgcgagaaguccaagcgcgagcuccuccaccucacccucgagaucauggagaagcgcuacaaccucggcgacuacaacggcgagaucauguccgaggucauggcccagcgccagcccaugaagcccaccuacgccauccccaucauccccaucaccaacuccucccaguucaagcaccaggaggccauggacgucaaggaguucaaggucaacaagcaggacaaggccgaccucauccgccccaagcgcaaguacgagaagaagcccaagguccuccccuccuccgccgccgccaccccccagcagaccucccccgccgcccuccccgucuucaacgccaaggaccucaaccaguacgacuuccccuccuccgacgaggagccccucucccagguccucuccggcuccuccgaggccgaggaggacaacgaccccgacggccccuucgccuuccgccgcaaggccggcugccaguacuacgccccccaccucgaccagaccggcaacuggcccuggaccucccccaaggacggcggccucggcgacguccgcuaccgcuacugccucaccacccucaccgucccccagcgcugcaucggcuucgcccgccgccgcgucggccgcggcggccgcguccuccucgaccgcgcccacuccgacuacgacuccgucuuccaccaccucgaccucgagaugcucuccuccccccagcacucccccgucaaccaguucgccaacaccuccgagaccaacaccuccgacaaguccuucuccaaggaccucucccagauccucgucaacaucaaguccugccgcuggcgccacuuccgcccccgcacccccucccuccacgacuccgacaacgacgagcucuccugccgcaagcucuaccgcuccaucaaccgcaccggcaccgcccagcccggcacccagaccugcuccaccuccacccaguccaaguccuccuccggcuccgcccacuucgccuucaccgccgagcaguaccagcagcaccagcagcagcucgcccucaugcagaagcagcagcucgcccagauccagcagcagcaggccaacuccaacuccuccaccaacaccucccagggcuucgucuccaagacccucgacuccgccuccgcccaguucgccgccuccgcccucgucaccuccgagcagcucaugggcuucaagaugaaggacgacgucguccucggcaucggcgucaacggcguccuccccgccuccggcgucuacaagggccuccaccucuccuccaccacccccaccgcccucguccacaccucccccuccaccgccggcuccgcccuccuccagcccuccaacaucacccagaccuccuccucccacuccgcccucucccaccaggucaccgccgccaacuccgccaccacccagguccucaucggcaacaacauccgccucaccguccccuccuccgucgccaccgucaacuccaucgcccccaucaacgcccgccacaucccccgcacccucuccgccguccccuccuccgcccucaagcucgccgccgccgccaacugccaggucuccaagguccccuccuccuccuccgucgacuccgucccccgcgagaaccacgaguccgagaagcccgcccucaacaacaucgccgacaacaccgucgccauggaggucaccuga

SEQ ID NO: 42761 - RNA, 2424 nt, Artificial Sequence
  derived and/or modified sequence opt2 from EPC2__Homo_sapiens__NP_056445
auguccaagcucuccuuccgcgcccgcgcccucgacgccgccaagccccuccccaucuaccgcggcaaggacaugcccgaccucaacgacugcgucuccaucaaccgcgccgucccccagaugcccaccggcauggagaaggaggaggaguccgagcaccaccuccagcgcgccaucuccgcccagcaggucuuccgcgagaagaaggaguccauggucauccccguccccgaggccgaguccaacgucaacuacuacaaccgccucuacaagggcgaguucaagcagcccaagcaguucauccacauccagcccuucaaccucgacaacgagcagcccgacuacgacauggacuccgaggacgagacccuccucaaccgccucaaccgcaagauggagaucaagccccuccaguucgagaucaugaucgaccgccucgagaaggccuccuccaaccagcucgucacccuccaggaggccaagcuccuccucaacgaggacgacuaccucaucaaggccgucuacgacuacuggguccgcaagcgcaagaacugccgcggccccucccucaucccccagaucaagcaggagaagcgcgacggcuccaccaacaacgaccccuacgucgccuuccgccgccgcaccgagaagaugcagacccgcaagaaccgcaagaacgacgaggccuccuacgagaagaugcucaagcuccgccgcgaguucucccgcgccaucaccauccucgagaugaucaagcgccgcgagaagaccaagcgcgagcuccuccaccucacccucgaggucgucgagaagcgcuaccaccucggcgacuacggcggcgagauccucaacgaggucaagaucucccgcuccgagaaggagcucuacgccacccccgccacccuccacaacggcaaccaccacaagguccaggagugcaagaccaagcacccccaccaccucucccucaaggaggaggccuccgacgucguccgccagaagaagaaguaccccaagaagcccaaggccgaggcccucaucaccucccagcagcccacccccgagacccuccccgucaucaacaaguccgacaucaagcaguacgacuuccacuccuccgacgaggacgaguucccccagguccucucccccgucuccgagcccgaggaggagaacgaccccgacggccccugcgccuuccgccgccgcgccggcugccaguacuacgccccccgccucgaccaggccaaccacuccugcgagaacuccgagcucgccgaccucgacaagcuccgcuaccgccacugccucaccacccucaccgucccccgccgcugcaucggcuucgcccgccgccgcaucggccgcggcggccgcgucaucauggaccgcaucuccaccgagcacgaccccguccucaagcagaucgaccccgagaugcucaacuccuucuccuccuccucccagaccaucgacuucuccuccaacuucucccgcaccaacgccuccuccaagcacugcgagaaccgccucucccucuccgagauccucuccaacauccgcuccugccgccuccagugcuuccagccccgccuccucaaccuccaggacuccgacuccgaggagugcaccucccgcaagcccggccagaccgucaacaacaagcgcgucuccgccgccuccgucgcccuccucaacaccuccaagaacggcaucuccgucaccggcggcaucaccgaggagcaguuccagacccaccagcagcagcucguccagaugcagcgccagcagcucgcccagcuccagcagaagcagcagucccagcacuccucccagcagacccaccccaaggcccagggcuccuccaccuccgacugcauguccaagacccucgacuccgccuccgcccacuucgccgccuccgccgucgucuccgcccccguccccucccgcuccgaggucgccaaggagcagaacaccggccacaacaacaucaacggcgucguccagcccuccggcaccuccaagacccucuacuccaccaacauggcccucuccuccucccccggcaucuccgccguccagcucguccgcaccgucggccacaccaccaccaaccaccucauccccgcccucugcaccuccuccccccagacccuccccaugaacaacuccugccucaccaacgccguccaccucaacaacgucuccgucgucucccccgucaacguccacaucaacacccgcaccuccgcccccucccccaccgcccucaagcucgccaccgucgccgccuccauggaccgcguccccaaggucacccccuccuccgccaucuccuccaucgcccgcgagaaccacgagcccgagcgccucggccucaacggcaucgccgagaccaccgucgccauggaggucaccuga

SEQ ID NO: 42762 - RNA, 945 nt, Artificial Sequence
  derived and/or modified sequence opt2 from EPCAM__Homo_sapiens__NP_002345
auggcccccccccagguccucgccuucggccuccuccucgccgccgccaccgccaccuucgccgccgcccaggaggagugcgucugcgagaacuacaagcucgccgucaacugcuucgucaacaacaaccgccagugccagugcaccuccgucggcgcccagaacaccgucaucugcuccaagcucgccgccaagugccucgucaugaaggccgagaugaacggcuccaagcucggccgccgcgccaagcccgagggcgcccuccagaacaacgacggccucuacgaccccgacugcgacgaguccggccucuucaaggccaagcagugcaacggcaccuccaugugcuggugcgucaacaccgccggcguccgccgcaccgacaaggacaccgagaucaccugcuccgagcgcguccgcaccuacuggaucaucaucgagcucaagcacaaggcccgcgagaagcccuacgacuccaagucccuccgcaccgcccuccagaaggagaucaccacccgcuaccagcucgaccccaaguucaucaccuccauccucuacgagaacaacgucaucaccaucgaccucguccagaacuccucccagaagacccagaacgacgucgacaucgccgacgucgccuacuacuucgagaaggacgucaagggcgagucccucuuccacuccaagaagauggaccucaccgucaacggcgagcagcucgaccucgaccccggccagacccucaucuacuacgucgacgagaaggcccccgaguucuccaugcagggccucaaggccggcgucaucgccgucaucgucgucgucgucaucgccgucgucgccggcaucgucguccucgucaucucccgcaagaagcgcauggccaaguacgagaaggccgagaucaaggagaugggcgagaugcaccgcgagcucaacgccuga

SEQ ID NO: 42763 - RNA, 675 nt, Artificial Sequence
  derived and/or modified sequence opt2 from EPDR1__Homo_sapiens__NP_060019
augcccggccgcgccccccuccgcaccguccccggcgcccucggcgccuggcuccucggcggccucugggccuggacccucugcggccucugcucccucggcgccgucggcgccccccgccccugccaggccccccagcagugggagggccgccaggucauguaccagcaguccuccggccgcaacucccgcgcccuccucuccuacgacggccucaaccagcgcguccgcguccucgacgagcgcaaggcccucauccccugcaagcgccucuucgaguacauccuccucuacaaggacggcgucauguuccagaucgaccaggccaccaagcagugcuccaagaugacccucacccagcccugggacccccucgacaucccccagaacuccaccuucgaggaccaguacuccaucggcggcccccaggagcagaucaccguccaggagugguccgaccgcaaguccgcccgcuccuacgagaccuggaucggcaucuacaccgucaaggacugcuaccccguccaggagaccuucaccaucaacuacuccgucauccucuccacccgcuucuucgacauccagcucggcaucaaggaccccuccgucuucaccccccccuccaccugccagauggcccagcucgagaagauguccgaggacugcuccugguga

SEQ ID NO: 42764 - RNA, 7740 nt, Artificial Sequence
  derived and/or modified sequence opt2 from EPG5__Homo_sapiens__NP_066015
auggccgaggccgucaagccccagcgccgcgccaaggccaaggccucccgcaccaagaccaaggagaagaagaaguacgagaccccccagcgcgaggaguccuccgaggucucccuccccaagaccucccgcgagcaggagauccccucccucgccugcgaguucaagggcgaccaccucaaggucgucaccgacucccagcuccaggacgacgccuccggccagaacgaguccgagauguucgacgucccccucaccucccucaccaucuccaacgaggagucccucaccugcaacaccgagccccccaaggagggcggcgaggcccgccccugcgucggcgacuccgccgucacccccaagguccaccccggcgacaacgucggcaccaaggucgagacccccaagaacuucaccgaggucgaggagaacauguccguccagggcggccucuccgaguccgccccccaguccaacuucuccuacacccagcccgccauggagaacauccagguccgcgagacccagaacuccaaggaggacaagcagggccucgucugcuccuccgaggucccccagaacgucggccuccaguccuccugccccgccaagcacggcuuccagaccccccgcgucaagaagcucuacccccagcuccccgccgagaucgccggcgaggcccccgcccucgucgccgucaagccccuccuccgcuccgagcgccucuaccccgagcuccccucccagcucgagcucguccccuucaccaaggagcagcucaagauccucgagcccggcuccuggcucgagaacgucgaguccuaccucgaggaguucgacuccauggcccaccaggaccgccacgaguucuacgagcuccuccucaacuacucccgcugccgcaagcagcuccuccucgccgaggccgagcuccucacccucaccuccgacugccagaacgccaagucccgccucuggcaguucaaggaggagcagauguccguccagggcaucugcgccgaccaggucaaggucuucuccuaccaccgcuaccagcgcgucgagaugaacgagaacgcccucgucgagcucaagaagcucuucgacgccaaguccgagcaccuccaccagacccucgcccuccacuccuacaccuccguccucucccgccuccaggucgaguccuacaucuacgcccuccucuccuccuccgccguccuccgcuccuccgccauccaccagcagggccgcgccuccaagcagaccgaguccauccccuccgaccucugccagcucaaggagugcaucuccguccucuucauguucacccgccgcgucaacgaggacacccaguuccacgacgacauccuccucuggcuccagaagcucgucuccguccuccagcgcgucggcugccccggcgaccaccucuuccuccucaaccacauccuccgcugccccgccggcgucuccaagugggccguccccuucauccagaucaagguccuccacaaccccuccggcgucuuccacuucaugcagucccucgcccuccucaugucccccgucaagaaccgcgccgaguucaugugccacaugaagcccuccgagcgcaagcccuccuccuccggccccggcuccggcaccuggacccucgucgacgagggcggcgaggaggacgaggaccccgagaccuccuggauccuccucaacgaggacgaccucgucaccauccucgcccaguuccccuuccacgagcucuuccagcaccuccucggcuucaaggccaagggcgacuaccuccccgagaccacccgcccccaggagaugaugaagaucuucgccuucgccaacucccucgucgagcuccucgccgucggccucgagaccuucaaccgcgcccgcuaccgccaguucgucaagcgcaucggcuacaugauccgcaugacccucggcuacgucuccgaccacugggcccaguacgucucccacaaccagggcuccggccucgcccagcagcccuacuccauggagaagcuccaggucgaguucgacgagcucuuccuccgcgccguccuccacguccucaaggccaagcgccucggcaucuggcucuucauguccgagaugcccuucggcacccucuccguccagaugcucuggaagcucuucuaccucaugcaccaggucgaguccgagaaccuccagcagcucuccuccucccuccagcccgcccagugcaagcagcagcuccaggaccccgagcacuucaccaacuucgagaagugccucuccuccaugaacuccuccgaggagaucugccuccucaccaccuucgcccagauggcccaggcccgccgcaccaacgucgacgaggacuucaucaagaucaucguccucgagaucuacgaggucuccuacgucacccucuccacccgcgagaccuucuccaaggucggccgcgagcuccucggcaccaucaccgccguccaccccgagaucaucuccguccuccucgaccgcguccaggagaccaucgaccaggucggcauggucucccucuaccucuucaaggagcucccccucuaccucuggcagcccuccgccuccgagaucgccgucauccgcgacuggcuccucaacuacaaccucaccgucgucaagaacaagcucgccugcgucauccucgagggccucaacuggggcuucgccaagcaggccacccuccaccucgaccaggccguccacgccgaggucgcccucaugguccucgaggccuaccagaaguaccucgcccagaagcccuacgccggcauccucuccgaguccaugaagcaggucuccuaccucgccuccaucguccgcuacggcgagacccccgagaccuccuucaaccagugggccuggaaccucauccuccgccucaagcuccacaagaacgacuacggcauccagcccaacugccccgccguccccuucuccgucaccguccccgacaugaccgagucccccaccuuccacccccuccucaaggccgucaaggccggcaugcccaucggcugcuaccucgcccucuccaugaccgccgucggccacuccaucgagaaguucugcgccgagggcaucccccuccucggcauccucguccagucccgccaccuccgcaccgucguccacguccucgacaagauccucccccucuucuaccccugccaguacuaccuccucaagaacgagcaguuccucucccaccuccuccucuuccuccaccucgacuccggcgucccccagggcgucacccagcaggucacccacaaggucgcccagcaccucaccggcgccucccacggcgacaacgucaagcuccucaacuccaugauccaggcccacaucuccgucuccacccagcccaacgaggucggccccgucgccguccucgaguucuggguccaggcccucaucucccagcaccucugguaccgcgagcagcccauccucuuccucauggaccaccucugcaaggccgccuuccagcucaugcaggaggacugcauccagaagcuccucuaccagcagcacaagaacgcccucggcuaccacugcgaccgcucccuccucuccucccucgucuccuggaucgucgccggcaacaucacccccuccuucgucgagggccucgccacccccacccaggucugguucgccuggaccguccucaacauggaguccaucuucgaggaggacucccagcuccgccgcgucaucgagggcgagcucgucaucaacuccgccuucacccccgaccaggcccucaagaaggcccagacccagcucaagcuccccaucguccccucccuccagcgccuccucaucuaccgcugggcccaccaggcccucgucacccccuccgaccacccccuccucccccucaucuggcagaaguucuuccuccucuaccuccaccgccccggcccccaguacggccuccccaucgacggcugcaucggccgccgcuucuuccagucccccgcccacaucaaccuccucaaggagaugaagcgccgccucaccgaggucgccgacuuccaccacgccgccuccaaggcccuccgcguccccgccgagggcuccgagggccuccccgagucccacuccggcacccccggcuaccucaccucccccgagcuccacaaggagcucguccgccucuucaacgucuacauccucuggcucgaggacgagaacuuccagaagggcgacaccuacauccccucccuccccaagcacuacgacauccaccgccucgccaaggucaugcagaaccagcaggaccucuggauggaguaccucaacauggagcgcaucuaccacgaguuccaggagaccgucggccucuggacccaggccaagcucgagucccacuccacccccugcucccucuccguccagcucgacuucaccgacccccuccucgccaaggagcgcguccucuccaaccuccgcaagcacgaggccccccagcccccccucgcccuccaccccaccaagccccccguccccgucaucuccuccgccguccuccucucccagaaggacgccacccagcucgucugcaccgaccucaaccuccuccagcagcaggcccgcaccgccgcccuccgcgagucccagcaggucgcccucgacggcgagcuccucgacaccaugcccaagcaguacgucaaccgcgaggagcagaccacccuccaccucgagugccgcggcuccuccggcaagaagugccagggcgccgccgucgucaccguccaguucgagggcaugcacaagaacgaggccaucucccagcagcuccacguccuccgcaaggaggucaagcagcuccaggccgaggccgccaagccccccucccucaacaucgucgaggccgccguccacgccgagaaccucaucaccgcccucgucaacgccuacaagcuccagcccacccccggcauccagaaggucggcaucucccucuucuucaccaucgucgacuacgucuccgacgagacccagcgccacccccccacccgccaguucuucaccuccugcaucgagauccucggccaggucuucaucuccggcaucaaguccgagugccgcaagguccucgagaccauccucaagaacucccgccucugcucccuccucucccccuucuucacccccaacgccgcccccgccgaguucauccagcucuacgagcaggucgucaaguuccucuccgaggacaacuccgacaugaucuucaugcuccucaccaaguucgaccucaagcaguggcucuccgccaccaagcccccccucuccgaccgcacccgccuccucgaguccauccaccucgcccucaccgccuggggccucgagcccgacgaggacauccucaugcccuucaaccucuucugcaagcacuggaccuaccuccuccucuaccaguuccccgaccaguacuccgacauccuccgccuccucaugcaguccuccgccgagcagcuccucucccccgagugcuggaaggccacccuccgcgcccucggcugcugcgcccccuccugccagcagggcgccgccuccaccgagggcgccguccuccccuccuccuccgacgcccuccucuccgacaagcaggucauggagaccauccaguggcucuccgacuucuucuacaagcuccgccucuccaagauggacuucaaguccuucggccucuucuccaaguggucccccuacauggccgacgucaagaccuuccucggcuaccucgucaagcgccucaucgaccucgagaugaccugccucgcccaggaccccaccgccucccgcaagaccguccucaagucccuccacuccgucaucauccagcucuucaagcccuggauccucguccucgaggacaacgaguccucccagcagcgccacuaccccuggcucgaguccgacaccgucgucgccuccuccaucguccagcucuucaccgacugcaucgacucccuccacgaguccuucaaggacaagcuccuccccggcgacgccggcgcccucuggcuccaccucaugcacuacugcgaggccugcaccgcccccaagaugcccgaguucauccucuacgccuuccacuccaccuaccgcaagcuccccuggaaggaccuccaccccgaccagaugcucauggaggccuucuucaaggucgagcgcggcucccccaaguccugcuuccucuuccucggcuccguccucugcgaggucaacugggucuccguccucuccgacgccuggaacuccuccccccaccccgagacccgcuccaugaucgucugccuccucuucaugaugauccuccucgccaaggagguccagcucgucgaccagaccgacuccccccuccucucccuccucggccagaccuccucccucuccuggcaccucgucgacaucgucuccuaccaguccguccucuccuacuucuccucccacuacccccccuccaucauccucgccaaggaguccuacgccgagcucaucaugaagcuccucaaggucuccgccggccucuccauccccaccgacucccagaagcaccucgacgccguccccaagugccaggccuucacccaccagaugguccaguuccucuccacccucgagcagaacggcaagaucacccucgccguccucgagcaggagauguccaagcuccucgacgacaucaucgucuucaacccccccgacauggacucccagacccgccacauggcccucuccucccucuucauggagguccucaugaugaugaacaacgccaccauccccaccgccgaguuccuccgcggcuccauccgcaccuggaucggccagaagaugcacggccucgucguccucccccuccucaccgccgccugccagucccucgccuccguccgccacauggccgagaccaccgaggccugcaucaccgccuacuucaaggaguccccccucaaccagaacuccggcuggggccccauccucgucucccuccagguccccgagcucaccauggaggaguuccuccaggagugccucacccucggcuccuaccucacccucuacgucuaccuccuccagugccucaacuccgagcagacccuccgcaacgagaugaagguccuccucauccucuccaaguggcucgagcaggucuaccccuccuccgucgaggaggaggccaagcucuuccucugguggcaccagguccuccagcucucccucauccagaccgagcagaacgacuccguccucaccgaguccgucauccgcauccuccuccucguccagucccgccagaaccucgucgccgaggagcgccucuccuccggcauccucggcgccaucggcuucggccgcaaguccccccucuccaaccgcuuccgcgucgucgcccgcuccauggccgccuuccucuccguccagguccccauggaggaccagauccgccuccgccccggcuccgagcuccaccucacccccaaggcccagcaggcccucaacgcccucgaguccauggccuccuccaagcaguacgucgaguaccaggaccagauccuccaggccacccaguucauccgccaccccggccacugccuccaggacggcaaguccuuccucgcccuccucgucaacugccucuaccccgagguccacuaccucgaccacauccgcuga

SEQ ID NO: 42765 - RNA, 465 nt, Artificial Sequence
  derived and/or modified sequence opt2 from EPGN__Homo_sapiens__NP_001257918
auggcccucggcguccccaucuccgucuaccuccucuucaacgccaugaccgcccucaccgaggaggccgccgucaccgucaccccccccaucaccgcccagcagggcaacuggaccgucaacaagaccgaggccgacaacaucgagggccccaucgcccucaaguucucccaccucugccucgaggaccacaacuccuacugcaucaacggcgccugcgccuuccaccacgagcucgagaaggccaucugccgcugcuucaccggcuacaccggcgagcgcugcgagcaccucacccucaccuccuacgccgucgacuccuacgagaaguacaucgccaucggcaucggcgucggccuccuccucuccggcuuccucgucaucuucuacugcuacauccgcaagcgcugccucaagcucaagucccccuacaacgucugcuccggcgagcgccgcccccucuga

SEQ ID NO: 42766 - RNA, 2931 nt, Artificial Sequence
  derived and/or modified sequence opt2 from EPHA1__Homo_sapiens__NP_005223
auggagcgccgcuggccccucggccucggccucguccuccuccucugcgccccccucccccccggcgcccgcgccaaggaggucacccucauggacaccuccaaggcccagggcgagcucggcuggcuccucgacccccccaaggacggcugguccgagcagcagcagauccucaacggcaccccccucuacauguaccaggacugccccaugcagggccgccgcgacaccgaccacuggcuccgcuccaacuggaucuaccgcggcgaggaggccucccgcguccacgucgagcuccaguucaccguccgcgacugcaaguccuuccccggcggcgccggcccccucggcugcaaggagaccuucaaccuccucuacauggaguccgaccaggacgucggcauccagcuccgccgcccccucuuccagaaggucaccaccgucgccgccgaccaguccuucaccauccgcgaccucgucuccggcuccgucaagcucaacgucgagcgcugcucccucggccgccucacccgccgcggccucuaccucgccuuccacaaccccggcgccugcgucgcccucgucuccguccgcgucuucuaccagcgcugccccgagacccucaacggccucgcccaguuccccgacacccuccccggccccgccggccucgucgaggucgccggcaccugccucccccacgcccgcgccuccccccgccccuccggcgccccccgcaugcacugcucccccgacggcgaguggcucguccccgucggccgcugccacugcgagcccggcuacgaggagggcggcuccggcgaggccugcgucgccugccccuccggcuccuaccgcauggacauggacaccccccacugccucaccugcccccagcaguccaccgccgaguccgagggcgccaccaucugcaccugcgaguccggccacuaccgcgcccccggcgagggcccccaggucgccugcaccggcccccccuccgccccccgcaaccucuccuucuccgccuccggcacccagcucucccuccgcugggagccccccgccgacaccggcggccgccaggacguccgcuacuccguccgcugcucccagugccagggcaccgcccaggacggcggccccugccagcccugcggcgucggcguccacuucucccccggcgcccgcggccucaccacccccgccguccacgucaacggccucgagcccuacgccaacuacaccuucaacgucgaggcccagaacggcgucuccggccucggcuccuccggccacgccuccaccuccgucuccaucuccaugggccacgccgagucccucuccggccucucccuccgccucgucaagaaggagccccgccagcucgagcucaccugggccggcucccgcccccgcucccccggcgccaaccucaccuacgagcuccacguccucaaccaggacgaggagcgcuaccagaugguccucgagccccgcguccuccucaccgagcuccagcccgacaccaccuacaucguccgcguccgcaugcucaccccccucggccccggccccuucucccccgaccacgaguuccgcaccuccccccccgucucccgcggccucaccggcggcgagaucgucgccgucaucuucggccuccuccucggcgccgcccuccuccucggcauccucgucuuccgcucccgccgcgcccagcgccagcgccagcagcgccagcgcgaccgcgccaccgacgucgaccgcgaggacaagcucuggcucaagcccuacgucgaccuccaggccuacgaggaccccgcccagggcgcccucgacuucacccgcgagcucgaccccgccuggcucauggucgacaccgucaucggcgagggcgaguucggcgaggucuaccgcggcacccuccgccuccccucccaggacugcaagaccgucgccaucaagacccucaaggacaccucccccggcggccagugguggaacuuccuccgcgaggccaccaucaugggccaguucucccacccccacauccuccaccucgagggcgucgucaccaagcgcaagcccaucaugaucaucaccgaguucauggagaacggcgcccucgacgccuuccuccgcgagcgcgaggaccagcucguccccggccagcucgucgccaugcuccagggcaucgccuccggcaugaacuaccucuccaaccacaacuacguccaccgcgaccucgccgcccgcaacauccucgucaaccagaaccucugcugcaaggucuccgacuucggccucacccgccuccucgacgacuucgacggcaccuacgagacccagggcggcaagauccccauccgcuggaccgcccccgaggccaucgcccaccgcaucuucaccaccgccuccgacgucugguccuucggcaucgucaugugggagguccucuccuucggcgacaagcccuacggcgagauguccaaccaggaggucaugaaguccaucgaggacggcuaccgccuccccccccccgucgacugccccgccccccucuacgagcucaugaagaacugcugggccuacgaccgcgcccgccgcccccacuuccagaagcuccaggcccaccucgagcagcuccucgccaacccccacucccuccgcaccaucgccaacuucgacccccgcaugacccuccgccuccccucccucuccggcuccgacggcauccccuaccgcaccgucuccgaguggcucgaguccauccgcaugaagcgcuacauccuccacuuccacuccgccggccucgacaccauggagugcguccucgagcucaccgccgaggaccucacccagaugggcaucacccuccccggccaccagaagcgcauccucugcuccauccagggcuucaaggacuga

SEQ ID NO: 42767 - RNA, 2952 nt, Artificial Sequence
  derived and/or modified sequence opt2 from EPHA3__Homo_sapiens__NP_005224
auggacugccagcucuccauccuccuccuccucuccugcuccguccucgacuccuucggcgagcucaucccccagcccuccaacgaggucaaccuccucgacuccaagaccauccagggcgagcucggcuggaucuccuaccccucccacggcugggaggagaucuccggcgucgacgagcacuacacccccauccgcaccuaccaggucugcaacgucauggaccacucccagaacaacuggcuccgcaccaacugggucccccgcaacuccgcccagaagaucuacgucgagcucaaguucacccuccgcgacugcaacuccaucccccucguccucggcaccugcaaggagaccuucaaccucuacuacauggaguccgacgacgaccacggcgucaaguuccgcgagcaccaguucaccaagaucgacaccaucgccgccgacgaguccuucacccagauggaccucggcgaccgcauccucaagcucaacaccgagauccgcgaggucggccccgucaacaagaagggcuucuaccucgccuuccaggacgucggcgccugcgucgcccucgucuccguccgcgucuacuucaagaagugccccuucaccgucaagaaccucgccauguuccccgacaccguccccauggacucccagucccucgucgagguccgcggcuccugcgucaacaacuccaaggaggaggaccccccccgcauguacugcuccaccgagggcgaguggcucguccccaucggcaagugcuccugcaacgccggcuacgaggagcgcggcuucaugugccaggccugccgccccggcuucuacaaggcccucgacggcaacaugaagugcgccaagugccccccccacuccuccacccaggaggacggcuccaugaacugccgcugcgagaacaacuacuuccgcgccgacaaggacccccccuccauggccugcacccgcccccccuccuccccccgcaacgucaucuccaacaucaacgagaccuccgucauccucgacugguccuggccccucgacaccggcggccgcaaggacgucaccuucaacaucaucugcaagaagugcggcuggaacaucaagcagugcgagcccugcucccccaacguccgcuuccucccccgccaguucggccucaccaacaccaccgucaccgucaccgaccuccucgcccacaccaacuacaccuucgagaucgacgccgucaacggcgucuccgagcucuccucccccccccgccaguucgccgccgucuccaucaccaccaaccaggccgcccccucccccguccucaccaucaagaaggaccgcaccucccgcaacuccaucucccucuccuggcaggagcccgagcaccccaacggcaucauccucgacuacgaggucaaguacuacgagaagcaggagcaggagaccuccuacaccauccuccgcgcccgcggcaccaacgucaccaucuccucccucaagcccgacaccaucuacgucuuccagauccgcgcccgcaccgccgccggcuacggcaccaacucccgcaaguucgaguucgagaccucccccgacuccuucuccaucuccggcgaguccucccaggucgucaugaucgccaucuccgccgccgucgccaucauccuccucaccgucgucaucuacguccucaucggccgcuucugcggcuacaaguccaagcacggcgccgacgagaagcgccuccacuucggcaacggccaccucaagcuccccggccuccgcaccuacgucgacccccacaccuacgaggaccccacccaggccguccacgaguucgccaaggagcucgacgccaccaacaucuccaucgacaaggucgucggcgccggcgaguucggcgaggucugcuccggccgccucaagcuccccuccaagaaggagaucuccgucgccaucaagacccucaaggucggcuacaccgagaagcagcgccgcgacuuccucggcgaggccuccaucaugggccaguucgaccaccccaacaucauccgccucgagggcgucgucaccaaguccaagcccgucaugaucgucaccgaguacauggagaacggcucccucgacuccuuccuccgcaagcacgacgcccaguucaccgucauccagcucgucggcaugcuccgcggcaucgccuccggcaugaaguaccucuccgacaugggcuacguccaccgcgaccucgccgcccgcaacauccucaucaacuccaaccucgucugcaaggucuccgacuucggccucucccgcguccucgaggacgaccccgaggccgccuacaccacccgcggcggcaagauccccauccgcuggaccucccccgaggccaucgccuaccgcaaguucaccuccgccuccgacgucugguccuacggcaucguccucugggaggucauguccuacggcgagcgccccuacugggagauguccaaccaggacgucaucaaggccgucgacgagggcuaccgccuccccccccccauggacugccccgccgcccucuaccagcucaugcucgacugcuggcagaaggaccgcaacaaccgccccaaguucgagcagaucgucuccauccucgacaagcucauccgcaaccccggcucccucaagaucaucaccuccgccgccgcccgccccuccaaccuccuccucgaccaguccaacgucgacaucaccaccuuccgcaccaccggcgacuggcucaacggcgucuggaccgcccacugcaaggagaucuucaccggcgucgaguacuccuccugcgacaccaucgccaagaucuccaccgacgacaugaagaaggucggcgucaccgucgucggcccccagaagaagaucaucuccuccaucaaggcccucgagacccaguccaagaacggccccguccccgucuga

SEQ ID NO: 42768 - RNA, 2961 nt, Artificial Sequence
  derived and/or modified sequence opt2 from EPHA4__Homo_sapiens__NP_001291465
auggccggcaucuucuacuucgcccucuucuccugccucuucggcaucugcgacgccgucaccggcucccgcgucuaccccgccaacgaggucacccuccucgacucccgcuccguccagggcgagcucggcuggaucgccuccccccucgagggcggcugggaggaggucuccaucauggacgagaagaacacccccauccgcaccuaccaggucugcaacgucauggagcccucccagaacaacuggcuccgcaccgacuggaucacccgcgagggcgcccagcgcgucuacaucgagaucaaguucacccuccgcgacugcaacucccuccccggcgucaugggcaccugcaaggagaccuucaaccucuacuacuacgaguccgacaacgacaaggagcgcuucauccgcgagaaccaguucgucaagaucgacaccaucgccgccgacgaguccuucacccaggucgacaucggcgaccgcaucaugaagcucaacaccgagauccgcgacgucggcccccucuccaagaagggcuucuaccucgccuuccaggacgucggcgccugcaucgcccucgucuccguccgcgucuucuacaagaagugcccccucaccguccgcaaccucgcccaguuccccgacaccaucaccggcgccgacaccuccucccucgucgagguccgcggcuccugcgucaacaacuccgaggagaaggacguccccaagauguacugcggcgccgacggcgaguggcucguccccaucggcaacugccucugcaacgccggccacgaggagcgcuccggcgagugccaggccugcaagaucggcuacuacaaggcccucuccaccgacgccaccugcgccaagugccccccccacuccuacuccgucugggagggcgccaccuccugcaccugcgaccgcggcuucuuccgcgccgacaacgacgccgccuccaugcccugcacccgcccccccuccgccccccucaaccucaucuccaacgucaacgagaccuccgucaaccucgagugguccuccccccagaacaccggcggccgccaggacaucuccuacaacgucgucugcaagaagugcggcgccggcgaccccuccaagugccgccccugcggcuccggcguccacuacaccccccagcagaacggccucaagaccaccaaggucuccaucaccgaccuccucgcccacaccaacuacaccuucgagaucugggccgucaacggcgucuccaaguacaaccccaaccccgaccaguccgucuccgucaccgucaccaccaaccaggccgcccccuccuccaucgcccucguccaggccaaggaggucacccgcuacuccgucgcccucgccuggcucgagcccgaccgccccaacggcgucauccucgaguacgaggucaaguacuacgagaaggaccagaacgagcgcuccuaccgcaucguccgcaccgccgcccgcaacaccgacaucaagggccucaacccccucaccuccuacgucuuccacguccgcgcccgcaccgccgccggcuacggcgacuucuccgagccccucgaggucaccaccaacaccguccccucccgcaucaucggcgacggcgccaacuccaccguccuccucgucuccgucuccggcuccgucguccucgucgucauccucaucgccgccuucgucaucucccgccgccgcuccaaguacuccaaggccaagcaggaggccgacgaggagaagcaccucaaccagggcguccgcaccuacgucgaccccuucaccuacgaggaccccaaccaggccguccgcgaguucgccaaggagaucgacgccuccugcaucaagaucgagaaggucaucggcgucggcgaguucggcgaggucugcuccggccgccucaagguccccggcaagcgcgagaucugcgucgccaucaagacccucaaggccggcuacaccgacaagcagcgccgcgacuuccucuccgaggccuccaucaugggccaguucgaccaccccaacaucauccaccucgagggcgucgucaccaagugcaagcccgucaugaucaucaccgaguacauggagaacggcucccucgacgccuuccuccgcaagaacgacggccgcuucaccgucauccagcucgucggcaugcuccgcggcaucggcuccggcaugaaguaccucuccgacauguccuacguccaccgcgaccucgccgcccgcaacauccucgucaacuccaaccucgucugcaaggucuccgacuucggcaugucccgcguccucgaggacgaccccgaggccgccuacaccacccgcggcggcaagauccccauccgcuggaccgcccccgaggccaucgccuaccgcaaguucaccuccgccuccgacgucugguccuacggcaucgucaugugggaggucauguccuacggcgagcgccccuacugggacauguccaaccaggacgucaucaaggccaucgaggagggcuaccgccuccccccccccauggacugccccaucgcccuccaccagcucaugcucgacugcuggcagaaggagcgcuccgaccgccccaaguucggccagaucgucaacaugcucgacaagcucauccgcaaccccaacucccucaagcgcaccggcaccgaguccucccgccccaacaccgcccuccucgaccccuccucccccgaguucuccgccgucgucuccgucggcgacuggcuccaggccaucaagauggaccgcuacaaggacaacuucaccgccgccggcuacaccacccucgaggccgucguccacgucaaccaggaggaccucgcccgcaucggcaucaccgccaucacccaccagaacaagauccucuccuccguccaggccaugcgcacccagaugcagcagaugcacggccgcaugguccccgucuga

SEQ ID NO: 42769 - RNA, 3117 nt, Artificial Sequence
  derived and/or modified sequence opt2 from EPHA5__Homo_sapiens__NP_001268694
augcgcggcuccggcccccgcggcgccggccgccgccgcccccccuccggcggcggcgacacccccaucacccccgccucccucgccggcugcuacuccgccccccgccgcgccccccucuggaccugccuccuccucugcgccgcccuccgcacccuccucgccucccccuccaacgaggucaaccuccucgacucccgcaccgucaugggcgaccucggcuggaucgccuuccccaagaacggcugggaggagaucggcgaggucgacgagaacuacgcccccauccacaccuaccaggucugcaaggucauggagcagaaccagaacaacuggcuccucaccuccuggaucuccaacgagggcgccucccgcaucuucaucgagcucaaguucacccuccgcgacugcaacucccuccccggcggccucggcaccugcaaggagaccuucaacauguacuacuucgaguccgacgaccagaacggccgcaacaucaaggagaaccaguacaucaagaucgacaccaucgccgccgacgaguccuucaccgagcucgaccucggcgaccgcgucaugaagcucaacaccgagguccgcgacgucggcccccucuccaagaagggcuucuaccucgccuuccaggacgucggcgccugcaucgcccucgucuccguccgcgucuacuacaagaagugccccuccgucguccgccaccucgccgucuuccccgacaccaucaccggcgccgacuccucccagcuccucgaggucuccggcuccugcgucaaccacuccgucaccgacgagccccccaagaugcacugcuccgccgagggcgaguggcucguccccaucggcaagugcaugugcaaggccggcuacgaggagaagaacggcaccugccaggucugccgccccggcuucuucaaggccuccccccacauccaguccugcggcaagugccccccccacuccuacacccacgaggaggccuccaccuccugcgucugcgagaaggacuacuuccgccgcgaguccgacccccccaccauggccugcacccgcccccccuccgccccccgcaacgccaucuccaacgucaacgagaccuccgucuuccucgaguggaucccccccgccgacaccggcggccgcaaggacgucuccuacuacaucgccugcaagaagugcaacucccacgccggcgucugcgaggagugcggcggccacguccgcuaccucccccgccaguccggccucaagaacaccuccgucaugauggucgaccuccucgcccacaccaacuacaccuucgagaucgaggccgucaacggcgucuccgaccucucccccggcgcccgccaguacgucuccgucaacgucaccaccaaccaggccgcccccucccccgucaccaacgucaagaagggcaagaucgccaagaacuccaucucccucuccuggcaggagcccgaccgccccaacggcaucauccucgaguacgagaucaaguacuucgagaaggaccaggagaccuccuacaccaucaucaaguccaaggagaccaccaucaccgccgagggccucaagcccgccuccgucuacgucuuccagauccgcgcccgcaccgccgccggcuacggcgucuucucccgccgcuucgaguucgagaccacccccgucuccgucgccgccuccuccgaccagucccagauccccgucaucgccgucuccgucaccgucggcgucauccuccucgccgucgucaucggcguccuccucuccggcuccugcugcgagugcggcugcggccgcgccuccucccucugcgccgucgcccaccccucccucaucuggcgcugcggcuacuccaaggccaagcaggaccccgaggaggagaagaugcacuuccacaacggccacaucaagcuccccggcguccgcaccuacaucgacccccacaccuacgaggaccccaaccaggccguccacgaguucgccaaggagaucgaggccuccugcaucaccaucgagcgcgucaucggcgccggcgaguucggcgaggucugcuccggccgccucaagcuccccggcaagcgcgagcuccccgucgccaucaagacccucaaggucggcuacaccgagaagcagcgccgcgacuuccucggcgaggccuccaucaugggccaguucgaccaccccaacaucauccaccucgagggcgucgucaccaaguccaagcccgucaugaucgucaccgaguacauggagaacggcucccucgacaccuuccucaagaagaacgacggccaguucaccgucauccagcucgucggcaugcuccgcggcaucuccgccggcaugaaguaccucuccgacaugggcuacguccaccgcgaccucgccgcccgcaacauccucaucaacuccaaccucgucugcaaggucuccgacuucggccucucccgcguccucgaggacgaccccgaggccgccuacaccacccgcggcggcaagauccccauccgcuggaccgcccccgaggccaucgccuuccgcaaguucaccuccgccuccgacgucugguccuacggcaucgucaugugggaggucgucuccuacggcgagcgccccuacugggagaugaccaaccaggacgucaucaaggccgucgaggagggcuaccgccuccccucccccauggacugccccgccgcccucuaccagcucaugcucgacugcuggcagaaggagcgcaacucccgccccaaguucgacgagaucgucaacaugcucgacaagcucauccgcaaccccuccucccucaagacccucgucaacgccuccugccgcgucuccaaccuccucgccgagcacuccccccucggcuccggcgccuaccgcuccgucggcgaguggcucgaggccaucaagaugggccgcuacaccgagaucuucauggagaacggcuacuccuccauggacgccgucgcccaggucacccucgaggaccuccgccgccucggcgucacccucgucggccaccagaagaagaucaugaacucccuccaggagaugaagguccagcucgucaacggcauggucccccucuga

SEQ ID NO: 42770 - RNA, 3393 nt, Artificial Sequence
  derived and/or modified sequence opt2 from EPHA6__Homo_sapiens__NP_001073917
augcaguuccccuccccccccgccgcccgcuccucccccgccccccaggccgccuccuccuccgaggccgccgcccccgccaccggccagcccggccccuccugccccguccccggcaccucccgccgcggccgccccggcaccccccccgccggccgcgucgaggaggaggaggaggaggaggaggaggacgucgacaaggacccccaccccacccagaacaccugccuccgcugccgccacuucucccuccgcgagcgcaagcgcgagccccgccgcaccaugggcggcugcgagguccgcgaguuccuccuccaguucggcuucuuccucccccuccucaccgccuggcccggcgacugcucccacgucuccaacaaccaggucguccuccucgacaccaccaccguccucggcgagcucggcuggaagaccuacccccucaacggcugggacgccaucaccgagauggacgagcacaaccgccccauccacaccuaccaggucugcaacgucauggagcccaaccagaacaacuggcuccgcaccaacuggaucucccgcgacgccgcccagaagaucuacgucgagaugaaguucacccuccgcgacugcaacuccauccccuggguccucggcaccugcaaggagaccuucaaccucuucuacauggaguccgacgagucccacggcaucaaguucaagcccaaccaguacaccaagaucgacaccaucgccgccgacgaguccuucacccagauggaccucggcgaccgcauccucaagcucaacaccgagauccgcgaggucggccccaucgagcgcaagggcuucuaccucgccuuccaggacaucggcgccugcaucgcccucgucuccguccgcgucuucuacaagaagugccccuucaccguccgcaaccucgccauguuccccgacaccaucccccgcgucgacuccuccucccucgucgagguccgcggcuccugcgucaaguccgccgaggagcgcgacacccccaagcucuacugcggcgccgacggcgacuggcucgucccccucggccgcugcaucugcuccaccggcuacgaggagaucgagggcuccugccacgccugccgccccggcuucuacaaggccuucgccggcaacaccaagugcuccaagugccccccccacucccucaccuacauggaggccaccuccgucugccagugcgagaagggcuacuuccgcgccgagaaggacccccccuccauggccugcacccgcccccccuccgccccccgcaacgucgucuucaacaucaacgagaccgcccucauccucgagugguccccccccuccgacaccggcggccgcaaggaccucaccuacuccgucaucugcaagaagugcggccucgacaccucccagugcgaggacugcggcggcggccuccgcuucaucccccgccacaccggccucaucaacaacuccgucaucguccucgacuucgucucccacgucaacuacaccuucgagaucgaggccaugaacggcgucuccgagcucuccuucucccccaagcccuucaccgccaucaccgucaccaccgaccaggacgcccccucccucaucggcgucguccgcaaggacugggccucccagaacuccaucgcccucuccuggcaggcccccgccuucuccaacggcgccauccucgacuacgagaucaaguacuacgagaaggagcacgagcagcucaccuacuccuccacccgcuccaaggcccccuccgucaucaucaccggccucaagcccgccaccaaguacgucuuccacauccgcguccgcaccgccaccggcuacuccggcuacucccagaaguucgaguucgagaccggcgacgagaccuccgacauggccgccgagcagggccagauccucgucaucgccaccgccgccgucggcggcuucacccuccucgucauccucacccucuucuuccucaucaccggccgcugccagugguacaucaaggccaagaugaaguccgaggagaagcgccgcaaccaccuccagaacggccaccuccgcuuccccggcaucaagaccuacaucgaccccgacaccuacgaggaccccucccucgccguccacgaguucgccaaggagaucgaccccucccgcauccgcaucgagcgcgucaucggcgccggcgaguucggcgaggucugcuccggccgccucaagacccccggcaagcgcgagauccccgucgccaucaagacccucaagggcggccacauggaccgccagcgccgcgacuuccuccgcgaggccuccaucaugggccaguucgaccaccccaacaucauccgccucgagggcgucgucaccaagcgcuccuuccccgccaucggcgucgaggccuucugccccuccuuccuccgcgccggcuuccucaacuccauccaggccccccaccccguccccggcggcggcucccuccccccccgcauccccgccggccgccccgucaugaucgucgucgaguacauggagaacggcucccucgacuccuuccuccgcaagcacgacggccacuucaccgucauccagcucgucggcaugcuccgcggcaucgccuccggcaugaaguaccucuccgacaugggcuacguccaccgcgaccucgccgcccgcaacauccucgucaacuccaaccucgucugcaaggucuccgacuucggccucucccgcguccucgaggacgaccccgaggccgccuacaccaccaccggcggcaagauccccauccgcuggaccgcccccgaggccaucgccuaccgcaaguucuccuccgccuccgacgccugguccuacggcaucgucaugugggaggucauguccuacggcgagcgccccuacugggagauguccaaccaggacgucauccucuccaucgaggagggcuaccgccuccccgcccccaugggcugccccgccucccuccaccagcucaugcuccacugcuggcagaaggagcgcaaccaccgccccaaguucaccgacaucgucuccuuccucgacaagcucauccgcaaccccuccgcccuccacacccucgucgaggacauccucgucaugcccgagucccccggcgagguccccgaguacccccucuucgucaccgucggcgacuggcucgacuccaucaagaugggccaguacaagaacaacuucgucgccgccggcuucaccaccuucgaccucaucucccgcauguccaucgacgacauccgccgcaucggcgucauccucaucggccaccagcgccgcaucgucuccuccauccagacccuccgccuccacaugaugcacauccaggagaagggcuuccacgucuga

SEQ ID NO: 42771 - RNA, 840 nt, Artificial Sequence
  derived and/or modified sequence opt2 from EPHA7__Homo_sapiens__NP_001275559
auggucuuccagacccgcuaccccuccuggaucauccucugcuacaucuggcuccuccgcuucgcccacaccggcgaggcccaggccgccaaggagguccuccuccucgacuccaaggcccagcagaccgagcucgaguggaucuccuccccccccaacggcugggaggagaucuccggccucgacgagaacuacacccccauccgcaccuaccaggucugccaggucauggagcccaaccagaacaacuggcuccgcaccaacuggaucuccaagggcaacgcccagcgcaucuucgucgagcucaaguucacccuccgcgacugcaacucccuccccggcguccucggcaccugcaaggagaccuucaaccucuacuacuacgagaccgacuacgacaccggccgcaacauccgcgagaaccucuacgucaagaucgacaccaucgccgccgacgaguccuucacccagggcgaccucggcgagcgcaagaugaagcucaacaccgagguccgcgagaucggcccccucuccaagaagggcuucuaccucgccuuccaggacgucggcgccugcaucgcccucgucuccgucaaggucuacuacaagaagugcugguccaucaucgagaaccucgccaucuuccccgacaccgucaccggcuccgaguucuccucccucgucgagguccgcggcaccugcgucuccuccgccgaggaggaggccgagaacgccccccgcaugcacugcuccgccgagggcgaguggcucguccccaucggcaagugcaucugcaaggccggcuaccagcagaagggcgacaccugcgagcgcaaguga

SEQ ID NO: 42772 - RNA, 2955 nt, Artificial Sequence
  derived and/or modified sequence opt2 from EPHB1__Homo_sapiens__NP_004432
auggcccucgacuaccuccuccuccuccuccucgccuccgccgucgccgccauggaggagacccucauggacacccgcaccgccaccgccgagcucggcuggaccgccaaccccgccuccggcugggaggaggucuccggcuacgacgagaaccucaacaccauccgcaccuaccaggucugcaacgucuucgagcccaaccagaacaacuggcuccucaccaccuucaucaaccgccgcggcgcccaccgcaucuacaccgagaugcgcuucaccguccgcgacugcuccucccuccccaacguccccggcuccugcaaggagaccuucaaccucuacuacuacgagaccgacuccgucaucgccaccaagaaguccgccuucugguccgaggcccccuaccucaaggucgacaccaucgccgccgacgaguccuucucccaggucgacuucggcggccgccucaugaaggucaacaccgagguccgcuccuucggcccccucacccgcaacggcuucuaccucgccuuccaggacuacggcgccugcaugucccuccucuccguccgcgucuucuucaagaagugccccuccaucguccagaacuucgccgucuuccccgagaccaugaccggcgccgaguccaccucccucgucaucgcccgcggcaccugcauccccaacgccgaggaggucgacguccccaucaagcucuacugcaacggcgacggcgaguggaugguccccaucggccgcugcaccugcaagcccggcuacgagcccgagaacuccgucgccugcaaggccugccccgccggcaccuucaaggccucccaggaggccgagggcugcucccacugccccuccaacucccgcucccccgccgaggccucccccaucugcaccugccgcaccggcuacuaccgcgccgacuucgacccccccgaggucgccugcaccuccguccccuccggcccccgcaacgucaucuccaucgucaacgagaccuccaucauccucgaguggcaccccccccgcgagaccggcggccgcgacgacgucaccuacaacaucaucugcaagaagugccgcgccgaccgccgcuccugcucccgcugcgacgacaacgucgaguucgucccccgccagcucggccucaccgagugccgcgucuccaucuccucccucugggcccacacccccuacaccuucgacauccaggccaucaacggcgucuccuccaagucccccuuccccccccagcacgucuccgucaacaucaccaccaaccaggccgcccccuccaccguccccaucaugcaccaggucuccgccaccaugcgcuccaucacccucuccuggccccagcccgagcagcccaacggcaucauccucgacuacgagauccgcuacuacgagaaggagcacaacgaguucaacuccuccauggcccgcucccagaccaacaccgcccgcaucgacggccuccgccccggcauggucuacgucguccagguccgcgcccgcaccgucgccggcuacggcaaguucuccggcaagaugugcuuccagacccucaccgacgacgacuacaaguccgagcuccgcgagcagcucccccucaucgccggcuccgccgccgccggcgucgucuucgucgucucccucgucgccaucuccaucgucugcucccgcaagcgcgccuacuccaaggaggccgucuacuccgacaagcuccagcacuacuccaccggccgcggcucccccggcaugaagaucuacaucgaccccuucaccuacgaggaccccaacgaggccguccgcgaguucgccaaggagaucgacgucuccuucgucaagaucgaggaggucaucggcgccggcgaguucggcgaggucuacaagggccgccucaagcuccccggcaagcgcgagaucuacgucgccaucaagacccucaaggccggcuacuccgagaagcagcgccgcgacuuccucuccgaggccuccaucaugggccaguucgaccaccccaacaucauccgccucgagggcgucgucaccaagucccgccccgucaugaucaucaccgaguucauggagaacggcgcccucgacuccuuccuccgccagaacgacggccaguucaccgucauccagcucgucggcaugcuccgcggcaucgccgccggcaugaaguaccucgccgagaugaacuacguccaccgcgaccucgccgcccgcaacauccucgucaacuccaaccucgucugcaaggucuccgacuucggccucucccgcuaccuccaggacgacaccuccgaccccaccuacaccuccucccucggcggcaagauccccguccgcuggaccgcccccgaggccaucgccuaccgcaaguucaccuccgccuccgacgucugguccuacggcaucgucaugugggaggucauguccuucggcgagcgccccuacugggacauguccaaccaggacgucaucaacgccaucgagcaggacuaccgccuccccccccccauggacugccccgccgcccuccaccagcucaugcucgacugcuggcagaaggaccgcaacucccgcccccgcuucgccgagaucgucaacacccucgacaagaugauccgcaaccccgccucccucaagaccgucgccaccaucaccgccguccccucccagccccuccucgaccgcuccauccccgacuucaccgccuucaccaccgucgacgacuggcucuccgccaucaagaugguccaguaccgcgacuccuuccucaccgccggcuucaccucccuccagcucgucacccagaugaccuccgaggaccuccuccgcaucggcaucacccucgccggccaccagaagaagauccucaacuccauccacuccaugcgcguccagaucucccagucccccaccgccauggccuga

SEQ ID NO: 42773 - RNA, 2997 nt, Artificial Sequence
  derived and/or modified sequence opt2 from EPHB3__Homo_sapiens__NP_004434
auggcccgcgcccgccccccccccccccccucccccccccccggccuccucccccuccuccccccccuccuccuccucccccuccuccuccuccccgccggcugccgcgcccucgaggagacccucauggacaccaagugggucaccuccgagcucgccuggaccucccaccccgaguccggcugggaggaggucuccggcuacgacgaggccaugaaccccauccgcaccuaccaggucugcaacguccgcgaguccucccagaacaacuggcuccgcaccggcuucaucuggcgccgcgacguccagcgcgucuacgucgagcucaaguucaccguccgcgacugcaacuccauccccaacauccccggcuccugcaaggagaccuucaaccucuucuacuacgaggccgacuccgacgucgccuccgccuccucccccuucuggauggagaaccccuacgucaaggucgacaccaucgcccccgacgaguccuucucccgccucgacgccggccgcgucaacaccaagguccgcuccuucggcccccucuccaaggccggcuucuaccucgccuuccaggaccagggcgccugcaugucccucaucuccguccgcgccuucuacaagaagugcgccuccaccaccgccggcuucgcccucuuccccgagacccucaccggcgccgagcccaccucccucgucaucgcccccggcaccugcauccccaacgccgucgaggucuccgucccccucaagcucuacugcaacggcgacggcgaguggaugguccccgucggcgccugcaccugcgccaccggccacgagcccgccgccaaggagucccagugccgccccugcccccccggcuccuacaaggccaagcagggcgagggccccugccuccccugcccccccaacucccgcaccaccucccccgccgccuccaucugcaccugccacaacaacuucuaccgcgccgacuccgacuccgccgacuccgccugcaccaccguccccucccccccccgcggcgucaucuccaacgucaacgagaccucccucauccucgagugguccgagccccgcgaccucggcggccgcgacgaccuccucuacaacgucaucugcaagaagugccacggcgccggcggcgccuccgccugcucccgcugcgacgacaacgucgaguucgucccccgccagcucggccucaccgagcgccgcguccacaucucccaccuccucgcccacacccgcuacaccuucgagguccaggccgucaacggcgucuccggcaaguccccccuccccccccgcuacgccgccgucaacaucaccaccaaccaggccgcccccuccgagguccccacccuccgccuccacuccuccuccggcuccucccucacccucuccugggccccccccgagcgccccaacggcgucauccucgacuacgagaugaaguacuucgagaaguccgagggcaucgccuccaccgucaccucccagaugaacuccguccagcucgacggccuccgccccgacgcccgcuacgucguccagguccgcgcccgcaccgucgccggcuacggccaguacucccgccccgccgaguucgagaccaccuccgagcgcggcuccggcgcccagcagcuccaggagcagcucccccucaucgucggcuccgccaccgccggccucgucuucgucgucgccgucgucgucaucgccaucgucugccuccgcaagcagcgccacggcuccgacuccgaguacaccgagaagcuccagcaguacaucgcccccggcaugaaggucuacaucgaccccuucaccuacgaggaccccaacgaggccguccgcgaguucgccaaggagaucgacgucuccugcgucaagaucgaggaggucaucggcgccggcgaguucggcgaggucugccgcggccgccucaagcagcccggccgccgcgaggucuucgucgccaucaagacccucaaggucggcuacaccgagcgccagcgccgcgacuuccucuccgaggccuccaucaugggccaguucgaccaccccaacaucauccgccucgagggcgucgucaccaagucccgccccgucaugauccucaccgaguucauggagaacugcgcccucgacuccuuccuccgccucaacgacggccaguucaccgucauccagcucgucggcaugcuccgcggcaucgccgccggcaugaaguaccucuccgagaugaacuacguccaccgcgaccucgccgcccgcaacauccucgucaacuccaaccucgucugcaaggucuccgacuucggccucucccgcuuccucgaggacgaccccuccgaccccaccuacaccuccucccucggcggcaagauccccauccgcuggaccgcccccgaggccaucgccuaccgcaaguucaccuccgccuccgacgucugguccuacggcaucgucaugugggaggucauguccuacggcgagcgccccuacugggacauguccaaccaggacgucaucaacgccgucgagcaggacuaccgccuccccccccccauggacugccccaccgcccuccaccagcucaugcucgacugcuggguccgcgaccgcaaccuccgccccaaguucucccagaucgucaacacccucgacaagcucauccgcaacgccgccucccucaaggucaucgccuccgcccaguccggcaugucccagccccuccucgaccgcaccguccccgacuacaccaccuucaccaccgucggcgacuggcucgacgccaucaagaugggccgcuacaaggaguccuucgucuccgccggcuucgccuccuucgaccucgucgcccagaugaccgccgaggaccuccuccgcaucggcgucacccucgccggccaccagaagaagauccucuccuccauccaggacaugcgccuccagaugaaccagacccuccccguccaggucuga

SEQ ID NO: 42774 - RNA, 2964 nt, Artificial Sequence
  derived and/or modified sequence opt2 from EPHB4__Homo_sapiens__NP_004435
auggagcuccgcguccuccucugcugggccucccucgccgccgcccucgaggagacccuccucaacaccaagcucgagaccgccgaccucaagugggucaccuucccccaggucgacggccagugggaggagcucuccggccucgacgaggagcagcacuccguccgcaccuacgaggucugcgacguccagcgcgcccccggccaggcccacuggcuccgcaccggcugggucccccgccgcggcgccguccacgucuacgccacccuccgcuucaccaugcucgagugccucucccucccccgcgccggccgcuccugcaaggagaccuucaccgucuucuacuacgaguccgacgccgacaccgccaccgcccucacccccgccuggauggagaaccccuacaucaaggucgacaccgucgccgccgagcaccucacccgcaagcgccccggcgccgaggccaccggcaaggucaacgucaagacccuccgccucggcccccucuccaaggccggcuucuaccucgccuuccaggaccagggcgccugcauggcccuccucucccuccaccucuucuacaagaagugcgcccagcucaccgucaaccucacccgcuuccccgagaccgucccccgcgagcucgucguccccgucgccggcuccugcgucgucgacgccguccccgcccccggccccucccccucccucuacugccgcgaggacggccagugggccgagcagcccgucaccggcugcuccugcgcccccggcuucgaggccgccgagggcaacaccaagugccgcgccugcgcccagggcaccuucaagccccucuccggcgagggcuccugccagcccugccccgccaacucccacuccaacaccaucggcuccgccgucugccagugccgcgucggcuacuuccgcgcccgcaccgacccccgcggcgcccccugcaccaccccccccuccgccccccgcuccgucgucucccgccucaacggcuccucccuccaccucgagugguccgccccccucgaguccggcggccgcgaggaccucaccuacgcccuccgcugccgcgagugccgccccggcggcuccugcgcccccugcggcggcgaccucaccuucgaccccggcccccgcgaccucgucgagcccugggucgucguccgcggccuccgccccgacuucaccuacaccuucgaggucaccgcccucaacggcgucuccucccucgccaccggccccguccccuucgagcccgucaacgucaccaccgaccgcgaggucccccccgccgucuccgacauccgcgucacccgcuccucccccuccucccucucccucgccugggccgucccccgcgcccccuccggcgccguccucgacuacgaggucaaguaccacgagaagggcgccgagggccccuccuccguccgcuuccucaagaccuccgagaaccgcgccgagcuccgcggccucaagcgcggcgccuccuaccucguccagguccgcgcccgcuccgaggccggcuacggccccuucggccaggagcaccacucccagacccagcucgacgaguccgagggcuggcgcgagcagcucgcccucaucgccggcaccgccgucgucggcgucguccucguccucgucgucaucgucgucgccguccucugccuccgcaagcaguccaacggccgcgaggccgaguacuccgacaagcacggccaguaccucaucggccacggcaccaaggucuacaucgaccccuucaccuacgaggaccccaacgaggccguccgcgaguucgccaaggagaucgacgucuccuacgucaagaucgaggaggucaucggcgccggcgaguucggcgaggucugccgcggccgccucaaggcccccggcaagaaggaguccugcgucgccaucaagacccucaagggcggcuacaccgagcgccagcgccgcgaguuccucuccgaggccuccaucaugggccaguucgagcaccccaacaucauccgccucgagggcgucgucaccaacuccaugcccgucaugauccucaccgaguucauggagaacggcgcccucgacuccuuccuccgccucaacgacggccaguucaccgucauccagcucgucggcaugcuccgcggcaucgccuccggcaugcgcuaccucgccgagauguccuacguccaccgcgaccucgccgcccgcaacauccucgucaacuccaaccucgucugcaaggucuccgacuucggccucucccgcuuccucgaggagaacuccuccgaccccaccuacaccuccucccucggcggcaagauccccauccgcuggaccgcccccgaggccaucgccuuccgcaaguucaccuccgccuccgacgccugguccuacggcaucgucaugugggaggucauguccuucggcgagcgccccuacugggacauguccaaccaggacgucaucaacgccaucgagcaggacuaccgccucccccccccccccgacugccccaccucccuccaccagcucaugcucgacugcuggcagaaggaccgcaacgcccgcccccgcuucccccaggucgucuccgcccucgacaagaugauccgcaaccccgccucccucaagaucgucgcccgcgagaacggcggcgccucccacccccuccucgaccagcgccagccccacuacuccgccuucggcuccgucggcgaguggcuccgcgccaucaagaugggccgcuacgaggaguccuucgccgccgccggcuucggcuccuucgagcucgucucccagaucuccgccgaggaccuccuccgcaucggcgucacccucgccggccaccagaagaagauccucgccuccguccagcacaugaagucccaggccaagcccggcacccccggcggcaccggcggccccgccccccaguacuga

SEQ ID NO: 42775 - RNA, 2190 nt, Artificial Sequence
  derived and/or modified sequence opt2 from EPHB6__Homo_sapiens__NP_001267724
auggucgccgucggcggcugccgcugccagcccggcuaccagcccgcccgcggcgacaaggccugccaggccugcccccgcggccucuacaaggccuccgccggcaacgcccccugcucccccugccccgcccgcucccacgcccccaaccccgccgcccccgucugccccugccucgagggcuucuaccgcgccuccuccgacccccccgaggcccccugcaccggcccccccuccgccccccaggagcucugguucgagguccagggcuccgcccucaugcuccacuggcgccucccccgcgagcucggcggccgcggcgaccuccucuucaacgucgucugcaaggagugcgagggccgccaggagcccgccuccggcggcggcggcaccugccaccgcugccgcgacgagguccacuucgacccccgccagcgcggccucaccgagucccgcguccucgucggcggccuccgcgcccacguccccuacauccucgagguccaggccgucaacggcgucuccgagcucucccccgaccccccccaggccgccgccaucaacgucuccaccucccacgagguccccuccgccguccccgucguccaccaggucucccgcgccuccaacuccaucaccgucuccuggccccagcccgaccagaccaacggcaacauccucgacuaccagcuccgcuacuacgaccaggccgaggacgagucccacuccuucacccucaccuccgagaccaacaccgccaccgucacccagcucucccccggccacaucuacggcuuccagguccgcgcccgcaccgccgccggccacggccccuacggcggcaaggucuacuuccagacccucccccagggcgagcucuccucccagcuccccgagcgccucucccucgucaucggcuccauccucggcgcccucgccuuccuccuccucgccgccaucaccguccucgccgucgucuuccagcgcaagcgccgcggcaccggcuacaccgagcagcuccagcaguacuccucccccggccucggcgucaaguacuacaucgaccccuccaccuacgaggaccccugccaggccauccgcgagcucgcccgcgaggucgaccccgccuacaucaagaucgaggaggucaucggcaccggcuccuucggcgagguccgccagggccgccuccagccccgcggccgccgcgagcagaccgucgccauccaggcccucugggccggcggcgccgagucccuccagaugaccuuccucggccgcgccgccguccucggccaguuccagcaccccaacauccuccgccucgagggcgucgucaccaagucccgcccccucaugguccucaccgaguucauggagcucggcccccucgacuccuuccuccgccagcgcgagggccaguucuccucccuccagcucgucgccaugcagcgcggcgucgccgccgccaugcaguaccucuccuccuucgccuucguccaccgcucccucuccgcccacuccguccucgucaacucccaccucgucugcaaggucgcccgccucggccacuccccccagggccccuccugccuccuccgcugggccgcccccgaggucaucgcccacggcaagcacaccaccuccuccgacgucugguccuucggcauccucaugugggaggucauguccuacggcgagcgccccuacugggacauguccgagcaggagguccucaacgccaucgagcaggaguuccgccucccccccccccccggcugcccccccggccuccaccuccucaugcucgacaccuggcagaaggaccgcgcccgccgcccccacuucgaccagcucgucgccgccuucgacaagaugauccgcaagcccgacacccuccaggccggcggcgaccccggcgagcgccccucccaggcccuccucacccccgucgcccucgacuuccccugccucgacuccccccaggccuggcucuccgccaucggccucgagugcuaccaggacaacuucuccaaguucggccucugcaccuucuccgacgucgcccagcucucccucgaggaccuccccgcccucggcaucacccucgccggccaccagaagaagcuccuccaccacauccagcuccuccagcagcaccuccgccagcagggcuccgucgaggucuga

SEQ ID NO: 42776 - RNA, 1368 nt, Artificial Sequence
  derived and/or modified sequence opt2 from EPHX1__Homo_sapiens__NP_000111
auguggcucgagauccuccucaccuccguccucggcuucgccaucuacugguucaucucccgcgacaaggaggagacccucccccucgaggacggcugguggggccccggcacccgcuccgccgcccgcgaggacgacuccauccgccccuucaaggucgagaccuccgacgaggagauccacgaccuccaccagcgcaucgacaaguuccgcuucacccccccccucgaggacuccugcuuccacuacggcuucaacuccaacuaccucaagaaggucaucuccuacuggcgcaacgaguucgacuggaagaagcaggucgagauccucaaccgcuacccccacuucaagaccaagaucgagggccucgacauccacuucauccacgucaagcccccccagcuccccgccggccacacccccaagccccuccucaugguccacggcuggcccggcuccuucuacgaguucuacaagaucaucccccuccucaccgaccccaagaaccacggccucuccgacgagcacgucuucgaggucaucugccccuccauccccggcuacggcuucuccgaggccuccuccaagaagggcuucaacuccgucgccaccgcccgcaucuucuacaagcucaugcuccgccucggcuuccaggaguucuacauccagggcggcgacuggggcucccucaucugcaccaacauggcccagcucguccccucccacgucaagggccuccaccucaacauggcccucguccucuccaacuucuccacccucacccuccuccucggccagcgcuucggccgcuuccucggccucaccgagcgcgacgucgagcuccucuaccccgucaaggagaaggucuucuacucccucaugcgcgaguccggcuacaugcacauccagugcaccaagcccgacaccgucggcuccgcccucaacgacucccccgucggccucgccgccuacauccucgagaaguucuccaccuggaccaacaccgaguuccgcuaccucgaggacggcggccucgagcgcaaguucucccucgacgaccuccucaccaacgucaugcucuacuggaccaccggcaccaucaucuccucccagcgcuucuacaaggagaaccucggccagggcuggaugacccagaagcacgagcgcaugaaggucuacguccccaccggcuucuccgccuuccccuucgagcuccuccacacccccgagaaguggguccgcuucaaguaccccaagcucaucuccuacuccuacaugguccgcggcggccacuucgccgccuucgaggagcccgagcuccucgcccaggacauccgcaaguuccucuccguccucgagcgccaguga

SEQ ID NO: 42777 - RNA, 1509 nt, Artificial Sequence
  derived and/or modified sequence opt2 from EPHX2__Homo_sapiens__NP_001243411
augaagggcgagaucacccucucccaguggaucccccucauggaggagaacugccgcaagugcuccgagaccgccaaggucugccuccccaagaacuucuccaucaaggagaucuucgacaaggccaucuccgcccgcaagaucaaccgccccaugcuccaggccgcccucaugcuccgcaagaagggcuucaccaccgccauccucaccaacaccuggcucgacgaccgcgccgagcgcgacggccucgcccagcucaugugcgagcucaagaugcacuucgacuuccucaucgaguccugccaggucggcauggucaagcccgagccccagaucuacaaguuccuccucgacacccucaaggccucccccuccgaggucgucuuccucgacgacaucggcgccaaccucaagcccgcccgcgaccucggcauggucaccauccucguccaggacaccgacaccgcccucaaggagcucgagaaggucaccggcauccagcuccucaacacccccgccccccuccccaccuccugcaaccccuccgacaugucccacggcuacgucaccgucaagccccgcguccgccuccacuucgucgagcucggcuccggccccgccgucugccucugccacggcuuccccgaguccugguacuccuggcgcuaccagauccccgcccucgcccaggccggcuaccgcguccucgccauggacaugaagggcuacggcgaguccuccgccccccccgagaucgaggaguacugcauggagguccucugcaaggagauggucaccuuccucgacaagcucggccucucccaggccgucuucaucggccacgacuggggcggcaugcucgucugguacauggcccucuucuaccccgagcgcguccgcgccgucgccucccucaacacccccuucauccccgccaaccccaacauguccccccucgaguccaucaaggccaaccccgucuucgacuaccagcucuacuuccaggagcccggcgucgccgaggccgagcucgagcagaaccucucccgcaccuucaagucccucuuccgcgccuccgacgaguccguccucuccaugcacaaggucugcgaggccggcggccucuucgucaacucccccgaggagcccucccucucccgcauggucaccgaggaggagauccaguucuacguccagcaguucaagaaguccggcuuccgcggcccccucaacugguaccgcaacauggagcgcaacuggaagugggccugcaagucccucggccgcaagauccucauccccgcccucauggucaccgccgagaaggacuucguccucgucccccagaugucccagcacauggaggacuggaucccccaccucaagcgcggccacaucgaggacugcggccacuggacccagauggacaagcccaccgaggucaaccagauccucaucaaguggcucgacuccgacgcccgcaacccccccgucgucuccaagauguga

SEQ ID NO: 42778 - RNA, 1083 nt, Artificial Sequence
  derived and/or modified sequence opt2 from EPHX3__Homo_sapiens__NP_001136358
augcccgagcucgucgucaccgcccuccucgcccccucccgccucucccucaagcuccuccgcgccuucauguggucccucgucuucuccgucgcccucgucgccgccgccgucuacggcugcaucgcccucacccacguccucugccgcccccgccgcggcugcugcggccgccgccgcuccgccucccccgccugccucuccgaccccucccucggcgagcacggcuuccucaaccucaaguccuccggccuccgccuccacuacgucuccgccggccgcggcaacggcccccucaugcucuuccuccacggcuuccccgagaacugguucuccuggcgcuaccagcuccgcgaguuccagucccgcuuccacgucgucgccgucgaccuccgcggcuacggccccuccgacgccccccgcgacgucgacugcuacaccaucgaccuccuccucgucgacaucaaggacgucauccucggccucggcuacuccaagugcauccucgucgcccacgacuggggcgcccuccucgccuggcacuucuccaucuacuaccccucccucgucgagcgcauggucgucgucuccggcgcccccauguccgucuaccaggacuacucccuccaccacaucucccaguucuuccgcucccacuacauguuccucuuccagcuccccuggcuccccgagaagcuccucuccauguccgacuuccagauccucaagaccacccucacccaccgcaagaccggcauccccugccucacccccuccgagcucgaggccuuccucuacaacuucucccagcccggcggccucaccggcccccucaacuacuaccgcaaccucuuccgcaacuucccccucgagccccaggagcucaccacccccacccuccuccucuggggcgagaaggacaccuaccucgagcucggccucgucgaggccaucggcucccgcuucguccccggccgccucgaggcccacauccuccccggcaucggccacuggaucccccaguccaacccccaggagaugcaccaguacaugugggccuuccuccaggaccuccucgacuga

SEQ ID NO: 42779 - RNA, 954 nt, Artificial Sequence
  derived and/or modified sequence opt2 from EPM2A__Homo_sapiens__NP_001018051
augcgcuuccgcuucggcgucgucgucccccccgccgucgccggcgcccgccccgagcuccucgucgucggcucccgccccgagcucggccgcugggagccccgcggcgccguccgccuccgccccgccggcaccgccgccggcgacggcgcccucgcccuccaggagcccggccucuggcucggcgaggucgagcucgccgccgaggaggccgcccaggacggcgccgagcccggccgcgucgacaccuucugguacaaguuccucaagcgcgagcccggcggcgagcucuccugggagggcaacggcccccaccacgaccgcugcugcaccuacaacgagaacaaccucgucgacggcgucuacugccuccccaucggccacuggaucgaggccaccggccacaccaacgagaugaagcacaccaccgacuucuacuucaacaucgccggccaccaggccaugcacuacucccgcauccuccccaacaucuggcucggcuccugcccccgccaggucgagcacgucaccaucaagcucaagcacgagcucggcaucaccgccgucaugaacuuccagaccgagugggacaucguccagaacuccuccggcugcaaccgcuaccccgagcccaugacccccgacaccaugaucaagcucuaccgcgaggagggccucgccuacaucuggaugcccacccccgacauguccaccgagggccgcguccagaugcucccccaggccgucugccuccuccacgcccuccucgagaagggccacaucgucuacguccacugcaacgccggcgucggccgcuccaccgccgccgucugcggcuggcuccaguacgucaugggcuggaaccuccgcaagguccaguacuuccucauggccaagcgccccgccgucuacaucgacgaggaggccgccucccaggacaccuucccccucuga

SEQ ID NO: 42780 - RNA, 1824 nt, Artificial Sequence
  derived and/or modified sequence opt2 from EPM2AIP1__Homo_sapiens__NP_055620
auguggaugacccccaagcgcuccaagauggaggucgacgaggcccucgucuuccgccccgaguggacccagcgcuaccucgucgucgagccccccgagggcgacggcgcccucugccucgucugccgccgccucaucgucgccacccgcgagcgcgacguccgccgccacuacgaggccgagcacgaguacuacgagcgcuacgucgccgacggcgagcgcgccgcccucgucgagcgccuccgccagggcgaccuccccgucgccuccuucacccccgaggagcgcgccgcccgcgccggccucggccucugccgccuccucgcccucaagggccgcggcuggggcgagggcgacuucgucuaccagugcauggagguccuccuccgcgagguccuccccgagcacgucuccguccuccagggcgucgaccucucccccgacaucacccgccagcgcauccucuccaucgaccgcaaccuccgcaaccagcucuucaaccgcgcccgcgacuucaaggccuacucccucgcccucgacgaccaggccuucgucgccuacgagaacuaccuccucgucuucauccgcggcgucggccccgagcucgagguccaggaggaccuccucaccaucaucaaccucacccaccacuucuccgucggcgcccucauguccgccauccucgagucccuccagaccgccggccucucccuccagcgcauggucggccucaccaccacccacacccuccgcaugaucggcgagaacuccggccucgucuccuacaugcgcgagaaggccgucucccccaacugcuggaacgucauccacuacuccggcuuccuccaccucgagcuccucuccuccuacgacgucgacgucaaccagaucaucaacaccaucuccgaguggaucguccucaucaagacccgcggcguccgccgccccgaguuccagacccuccucaccgaguccgaguccgagcacggcgagcgcgucaacggccgcugccucaacaacuggcuccgccgcggcaagacccucaagcucaucuucucccuccgcaaggagauggaggccuuccucgucuccgucggcgccaccaccguccacuucuccgacaagcaguggcucugcgacuucggcuuccucgucgacaucauggagcaccuccgcgagcucuccgaggagcuccgcgucuccaaggucuucgccgccgccgccuucgaccacaucugcaccuucgaggucaagcucaaccucuuccagcgccacaucgaggagaagaaccucaccgacuuccccgcccuccgcgaggucgucgacgagcucaagcagcagaacaaggaggacgagaagaucuucgaccccgaccgcuaccagauggucaucugccgccuccagaaggaguucgagcgccacuucaaggaccuccgcuucaucaagaaggaccucgagcucuucuccaaccccuucaacuucaagcccgaguacgcccccaucuccguccgcgucgagcucaccaagcuccaggccaacaccaaccucuggaacgaguaccgcaucaaggaccucggccaguucuacgccggccucuccgccgaguccuaccccaucaucaagggcgucgccugcaaggucgccucccucuucgacuccaaccagaucugcgagaaggccuucuccuaccucacccgcaaccagcacacccucucccagccccucaccgacgagcaccuccaggcccucuuccgcgucgccaccaccgagauggagcccggcugggacgaccucguccgcgagcgcaacgaguccaaccccuga

SEQ ID NO: 42781 - RNA, 1989 nt, Artificial Sequence
  derived and/or modified sequence opt2 from EPN1__Homo_sapiens__NP_001123543
augggcgaccaguccuggcucuggaaccaggccgcccccggcguccgcucccccgucuucgccugcuccgucgagaagggcaacgucccccucguccucuccgagcaccucgcccacucccgcgaccccggcuccggcgccguccgcuuccucaucucccccgagcccugggccuccgccauccucggcaccuccggccuccucgccucccccguccuccccgccgcccucgacgccgucaccugccagcaccucccccagcccuccuccggcucccgccccaucuccccccgcaucggcgcccucugcccccuccuccuccagcccggcaccauguccaccuccucccuccgccgccagaugaagaacaucguccacaacuacuccgaggccgagaucaagguccgcgaggccaccuccaacgaccccuggggccccuccuccucccucauguccgagaucgccgaccucaccuacaacgucgucgccuucuccgagaucauguccaugaucuggaagcgccucaacgaccacggcaagaacuggcgccacgucuacaaggccaugacccucauggaguaccucaucaagaccggcuccgagcgcgucucccagcagugcaaggagaacauguacgccguccagacccucaaggacuuccaguacgucgaccgcgacggcaaggaccagggcgucaacguccgcgagaaggccaagcagcucgucgcccuccuccgcgacgaggaccgccuccgcgaggagcgcgcccacgcccucaagaccaaggagaagcucgcccagaccgccaccgccuccuccgccgccgucggcuccggccccccccccgaggccgagcaggccuggccccaguccuccggcgaggaggagcuccagcuccagcucgcccucgccauguccaaggaggaggccgaccaggaggagcgcauccgccgcggcgacgaccuccgccuccagauggccaucgaggaguccaagcgcgagaccggcggcaaggaggaguccucccucauggaccucgccgacgucuucaccgcccccgcccccgcccccaccaccgaccccuggggcggccccgcccccauggccgccgccguccccaccgccgcccccaccuccgaccccuggggcggcccccccgucccccccgccgccgaccccuggggcggccccgcccccacccccgccuccggcgaccccuggcgccccgccgcccccgccggccccuccgucgaccccuggggcggcacccccgcccccgccgccggcgagggccccacccccgaccccuggggcuccuccgacggcggcguccccgucuccggccccuccgccuccgaccccuggacccccgcccccgccuucuccgaccccuggggcggcucccccgccaagcccuccaccaacggcaccaccgccgccggcggcuucgacaccgagcccgacgaguucuccgacuucgaccgccuccgcaccgcccuccccaccuccggcuccuccgccggcgagcucgagcuccucgccggcgagguccccgcccgcucccccggcgccuucgacauguccggcguccgcggcucccucgccgaggccgucggcucccccccccccgccgccacccccacccccaccccccccacccgcaagacccccgaguccuuccucggccccaacgccgcccucgucgaccucgacucccucgucucccgccccggccccaccccccccggcgccaaggccuccaaccccuuccuccccggcggcggccccgccaccggccccuccgucaccaaccccuuccagcccgccccccccgccacccucacccucaaccagcuccgccucucccccgucccccccguccccggcgccccccccaccuacaucuccccccucggcggcggccccggccucccccccaugaugccccccggcccccccgcccccaacaccaaccccuuccuccucuga

SEQ ID NO: 42782 - RNA, 582 nt, Artificial Sequence
  derived and/or modified sequence opt2 from EPO__Homo_sapiens__NP_000790
augggcguccacgagugccccgccuggcucuggcuccuccucucccuccucucccucccccucggccuccccguccucggcgcccccccccgccucaucugcgacucccgcguccucgagcgcuaccuccucgaggccaaggaggccgagaacaucaccaccggcugcgccgagcacugcucccucaacgagaacaucaccguccccgacaccaaggucaacuucuacgccuggaagcgcauggaggucggccagcaggccgucgaggucuggcagggccucgcccuccucuccgaggccguccuccgcggccaggcccuccucgucaacuccucccagcccugggagccccuccagcuccacgucgacaaggccgucuccggccuccgcucccucaccacccuccuccgcgcccucggcgcccagaaggaggccaucuccccccccgacgccgccuccgccgccccccuccgcaccaucaccgccgacaccuuccgcaagcucuuccgcgucuacuccaacuuccuccgcggcaagcucaagcucuacaccggcgaggccugccgcaccggcgaccgcuga

SEQ ID NO: 42783 - RNA, 1527 nt, Artificial Sequence
  derived and/or modified sequence opt2 from EPOR__Homo_sapiens__NP_000112
auggaccaccucggcgccucccucuggccccaggucggcucccucugccuccuccucgccggcgccgccugggcccccccccccaaccuccccgaccccaaguucgaguccaaggccgcccuccucgccgcccgcggccccgaggagcuccucugcuucaccgagcgccucgaggaccucgucugcuucugggaggaggccgccuccgccggcgucggccccggcaacuacuccuucuccuaccagcucgaggacgagcccuggaagcucugccgccuccaccaggcccccaccgcccgcggcgccguccgcuucuggugcucccuccccaccgccgacaccuccuccuucgucccccucgagcuccgcgucaccgccgccuccggcgccccccgcuaccaccgcgucauccacaucaacgaggucguccuccucgacgcccccgucggccucgucgcccgccucgccgacgaguccggccacgucguccuccgcuggcuccccccccccgagacccccaugaccucccacauccgcuacgaggucgacgucuccgccggcaacggcgccggcuccguccagcgcgucgagauccucgagggccgcaccgagugcguccucuccaaccuccgcggccgcacccgcuacaccuucgccguccgcgcccgcauggccgagcccuccuucggcggcuucugguccgccugguccgagcccgucucccuccucacccccuccgaccucgacccccucauccucacccucucccucauccucgucgucauccucguccuccucaccguccucgcccuccucucccaccgccgcgcccucaagcagaagaucuggcccggcauccccucccccgaguccgaguucgagggccucuucaccacccacaagggcaacuuccagcucuggcucuaccagaacgacggcugccucugguggucccccugcacccccuucaccgaggacccccccgccucccucgagguccucuccgagcgcugcuggggcaccaugcaggccgucgagcccggcaccgacgacgagggcccccuccucgagcccgucggcuccgagcacgcccaggacaccuaccucguccucgacaaguggcuccucccccgcaacccccccuccgaggaccuccccggccccggcggcuccgucgacaucgucgccauggacgagggcuccgaggccuccuccugcuccuccgcccucgccuccaagcccucccccgagggcgccuccgccgccuccuucgaguacaccauccucgaccccuccucccagcuccuccgccccuggacccucugccccgagcucccccccacccccccccaccucaaguaccucuaccucgucgucuccgacuccggcaucuccaccgacuacuccuccggcgacucccagggcgcccagggcggccucuccgacggccccuacuccaaccccuacgagaacucccucauccccgccgccgagccccucccccccuccuacgucgccugcuccuga

SEQ ID NO: 42784 - RNA, 384 nt, Artificial Sequence
  derived and/or modified sequence opt2 from EPPIN__Homo_sapiens__NP_001289790
augggcuccuccggccuccucucccuccucguccucuucguccuccucgccaacguccagggccccggccucaccgacuggcucuucccccgccgcugccccaagauccgcgaggagugcgaguuccaggagcgcgacgucugcaccaaggaccgccagugccaggacaacaagaagugcugcgucuucuccugcggcaagaagugccucgaccucaagcaggucucccuccagauguacgccaagugccagaagaagcucgcccccgccuggcucaucuucuucaucggcggcaugacccgcaagaucauccucgcccccugccucuccauggucgccgcccgcgagaccaucaccaccuccaaccccaagcccaccgccuga

SEQ ID NO: 42785 - RNA, 540 nt, Artificial Sequence
  derived and/or modified sequence opt2 from EPPIN-WFDC6__Homo_sapiens__NP_001185915
augggcuccuccggccuccucucccuccucguccucuucguccuccucgccaacguccagggccccggccucaccgacuggcucuucccccgccgcugccccaagauccgcgaggagugcgaguuccaggagcgcgacgucugcaccaaggaccgccagugccaggacaacaagaagugcugcgucuucuccugcggcaagaagugccucgaccucaagcaggacgucugcgagaugcccaaggagaccggccccugccucgccuacuuccuccacuggugguacgacaagaaggacaacaccugcuccauguucgucuacggcggcugccagggcaacaacaacaacuuccaguccaaggccaacugccucaacaccugcaagaacaagcagcccugccccaagaucaaggucgagugcgaggucgaggagaucgaccagugcaccaagccccgcgacugccccgagaacaugaagugcugccccuucucccgcggcaagaagugccucgacuuccgcaaggccucccucuccaccuga

SEQ ID NO: 42786 - RNA, 15267 nt, Artificial Sequence
  derived and/or modified sequence opt2 from EPPK1__Homo_sapiens__XP_011515627
auguccggccacacccuccccccccuccccguccccggcaccaacuccaccgagcaggccuccgucccccgcgccauggccgccacccucggcgccggcacccccccccgcccccaggcccgcuccaucgccggcgucuacgucgaggccuccggccaggcccaguccgucuacgccgccauggagcagggccuccuccccgccggccucggccaggcccuccucgaggcccaggccgccaccggcggccucgucgaccucgcccgcggccagcuccuccccgucuccaaggcccuccagcagggccucgucggccucgagcucaaggagaagcuccucgccgccgagcgcgccaccaccggcuaccccgaccccuacggcggcgagaagcucgcccucuuccaggccaucggcaaggaggucgucgaccgcgcccucggccaguccuggcucgagguccagcucgccaccggcggccucgucgaccccgcccagggcguccucgucgcccccgagcccgccugccaccagggccuccucgaccgcgagaccuggcacaagcucuccgagcucgagcccggcaccggcgaccuccgcuuccucgaccccaacacccucgagcgccucaccuaccaccagcuccucgagcgcugcguccgcgcccccggcuccggccucgcccuccucccccucaagaucaccuuccgcuccaugggcggcgccgucuccgccgccgagcuccucgaggucggcauccucgacgagcaggccguccagggccuccgcgagggccgccucgccgccgucgacgucuccgcccgcgccgagguccgccgcuaccucgagggcaccggcuccgucgccggcgucguccuccuccccgagggccacaagaaguccuucuuccaggccgccaccgagcaccuccuccccaugggcaccgcccucccccuccucgaggcccaggccgccacccacacccucgucgaccccaucaccggccagcgccucugggucgacgaggccguccgcgccggccucgucucccccgagcuccacgagcagcuccucgucgccgagcaggccgucaccggccaccacgaccccuucuccggcucccagaucccccucuuccaggccaugaagaagggccucgucgaccgcccccucgcccuccgccuccucgacgcccagcucgccaccggcggccucgucugccccgcccgccgccuccgccucccccucgaggccgcccuccgcugcggcugccucgacgaggacacccagcgccagcucucccaggccggcuccuucuccgacggcacccacggcggccuccgcuacgagcagcuccucgcccucugcgucaccgaccccgagaccggccucgccuuccucccccucuccggcggcccccgcggcggcgagccccagggcccccccuucaucaaguacuccacccgccaggcccucuccaccgccaccgccaccgucuccgucggcaaguuccgcggccgccccgucucccucugggagcuccucuucuccgaggccaucuccuccgagcagcgcgccaugcucgcccagcaguaccaggagggcacccucuccgucgagaagcucgccgccaagcucuccgccacccucgagcaggccgccgccaccgcccgcgucaccuucuccggccuccgcgacaccgucacccccggcgagcuccucaaggccgagaucaucgaccaggaccucuacgagcgccucgagcacggccaggccaccgccaaggacgucggcucccucgccuccguccagcgcuaccuccagggcaccggcugcaucgccggccuccuccuccccggcucccaggagcgccucuccaucuacgaggcccgcugcaagggccuccuccgccccggcaccgcccucauccuccucgaggcccaggccgccaccggcuucaucaucgaccccaaggccaacaagggccacuccgucgaggaggcccuccgcgccgccgucaucggccccgacgucuucgccaagcuccucuccgccgagcgcgccgucaccggcuacaccgaccccuacaccggccagcagaucucccucuuccaggccaugcagaagggccucaucguccgcgagcacggcauccgccuccucgaggcccagaucgccaccggcggcgucaucgaccccguccacucccaccgcguccccgucgacgucgccuaccgccgcggcuacuucgaccagaugcucaaccucauccuccucgaccccuccgacgacaccaagggcuucuucgaccccaacacccacgagaaccucaccuaccuccagcuccucgagcgcugcguccgcgaccccgagaccggccucuaccuccucccccucuccuccacccaguccccccucgucgacuccgccacccagcaggccuuccagaaccuccuccucuccgucaaguacggccgcuuccagggccagcgcgucuccgccugggagcucaucaacuccgaguacuucuccgagggccgccgccgccagcuccuccgccgcuaccgccagcgcgaggucacccucggccaggucgccaagcuccucgaggccgagacccagcgccaggccgacaucaugcuccccgcccuccgcucccgcgucaccguccaccagcuccucgaggccggcaucaucgaccagcagcuccucgaccagguccucgccggcaccaucucccccgaggcccuccuccucauggacggcguccgccgcuaccucugcggccucggcgccgucggcggcguccgccuccuccccuccggccagcgccucucccucuaccaggccaugcgccagaagcuccucggcccccgcgucgcccucgcccuccucgaggcccaggccgccaccggcaccaucauggacccccacucccccgagucccucuccgucgacgaggccguccgccgcggcgucgucggccccgagcucuacggccgccucaagcgcgccgagggcgccaucgccggcuuccgcgaccccuucuccggcaagcaggucuccgucuuccaggccaugaagaagggccucauccccugggagcaggccgcccgccuccucgaggcccaggucgccaccggcggcaucaucgaccccaccucccaccaccaccuccccaugcccgucgccauccagcgcggcuacgucgaccaggagauggagaccgcccucuccuccuccuccgagaccuuccccacccccgacggccagggccgcaccuccuacgcccagcuccucgaggagugcccccgcgacgagaccuccggccuccaccuccucccccuccccgaguccgcccccgcccuccccaccgaggagcagguccagcgcucccuccaggccguccccggcgccaaggacggcaccucccucugggaccuccucuccuccugccacuucaccgaggagcagcgccgcggccuccucgaggacguccaggagggccgcaccaccgucccccagcuccucgccuccguccagcgcuggguccaggagaccaagcuccucgcccaggcccgcgucaugguccccggcccccgcggcgagguccccgccgucuggcuccucgacgccggcaucaucacccaggagacccucgaggcccucgcccagggcacccagucccccgcccaggucgccgagcagcccgccgucaaggccugccucuggggcaccggcugcgucgccggcguccuccuccagcccuccggcgccaaggccuccaucgcccaggccguccgcgacggccuccuccccaccggccucggccagcgccuccucgaggcccaggucgccuccggcuuccucgucgacccccucaacaaccagcgccucuccgucgaggacgccgucaaggucggccucgucggccgcgagcucuccgagcagcucggccaggccgagcgcgccgccgccggcuaccccgaccccuacucccgcgccucccucucccucuggcaggccauggagaagggccucgucccccagaacgagggccucccccuccuccagguccagcucgccaccggcggcgucgucgaccccguccacggcguccaccucccccaggccgccgccugccgccucggccuccucgacacccagaccucccagguccucaccgccgucgacaaggacaacaaguucuucuucgaccccuccgcccgcgaccaggucaccuaccagcagcuccgcgagcgcugcgucugcgacuccgagaccggccuccuccuccucccccuccccuccgacaccguccucgaggucgacgaccacaccgccgucgcccuccgcgccaugaagguccccgucuccaccggccgcuucaagggcugcuccgucucccucugggaccuccuccucuccgaguacgucggcgccgacaagcgccgcgagcucgucgcccucugccgcuccggccgcgccgccgcccuccgccaggucgucuccgccgucaccacccucgucgaggccgccgagcgccagccccuccaggccaccuuccgcggccuccgcaagcaggucuccgcccgcgaccucuuccgcgcccagcucaucucccgcaagacccucgacgagcucucccagggcaccaccaccgucaaggaggucgccgagauggacuccgucaagcgcucccucgagggcggcaacuucaucgccggcguccucauccagggcacccaggagcgcauguccauccccgaggcccuccgccgccacauccuccgccccggcaccgcccucguccuccucgaggcccaggccgccaccggcuucaucaucgaccccgucgagaaccgcaagcucaccgucgaggaggccuucaaggccggcauguucggcaaggagaccuacgucaagcuccucuccgccgagcgcgccgucaccggcuacaccgaccccuacaccggccagcagaucucccucuuccaggccaugcagaaggaccucaucguccgcgagcacggcauccgccuccucgaggcccagaucgccaccggcggcaucaucgaccccguccacucccaccgcguccccgucgacgucgccuaccgcugcggcuacuucgacgaggagaugaaccgcauccucgccgaccccuccgacgacaccaagggcuucuucgaccccaacacccacgagaaccucaccuaccuccagcuccucgagcgcugcgucgaggaccccgagaccggccucuaccuccuccagaucaucaagaagggcgagaacuacgucuacaucaacgaggccacccgccacguccuccagucccgcaccgccaagaugcgcgucggccgcuucgccgaccaggucgucuccuucugggaccuccucuccucccccuacuucaccgaggaccgcaagcgcgagcucauccaggaguacggcgcccaguccggcggccucgagaagcuccucgagaucaucaccaccaccaucgaggagaccgagacccagaaccagggcaucaaggucgccgccauccgcggcgaggucaccgccgccgaccucuucaacucccgcgucaucgaccagaagacccuccacacccuccgcgucggccgcaccggcggccaggcccucuccacccucgagugcgucaagcccuaccucgagggcuccggcugcaucgccggcgucaccguccccuccacccgcgaggucaugucccuccacgaggccucccgcaaggagcucauccccgccgccuucgccaccuggcuccucgaggcccaggccgccaccggcuuccuccucgaccccugcacccgccagaagcucuccgucgacgaggccgucgacgucggccucgucaacgaggagcuccgcgagcgccuccucaaggccgagcgcgccgccaccggcuaccgcgaccccgccaccggcgacaccaucccccucuuccaggccaugcagaagcagcucaucgagaaggccgaggcccuccgccuccucgagguccaggucgccaccggcggcgucaucgacccccagcaccaccaccgccucccccucgagaccgccuaccgccgcggcugccuccacaaggacaucuacgcccucaucuccgaccagaagcacaugcgcaagcgcuucgucgaccccaacacccaggagaaggucuccuaccgcgagcuccaggagcgcugccgcccccaggaggacaccggcuggcuccucuuccccgucaacaaggccgcccgcgacuccgagcacaucgacgacgagacccgccgcgcccucgaggccgagcaggucgagaucaccgucggccgcuuccgcggccagaagcccacccucugggcccuccucaacuccgaguacgucaccgaggagaagaagcuccagcucguccgcauguaccgcacccacacccgccgcgcccuccagaccgucgcccagcucauccucgagcucaucgagaagcaggagaccuccaacaagcaccucugguuccagggcauccgccgccagaucaccgccuccgagcuccucuccuccgccaucaucaccgaggagaugcuccaggaccucgagaccggccgcuccaccacccaggagcucauggaggacgaccgcgucaagcgcuaccucgagggcaccuccugcaucgccggcguccucguccccgccaaggaccagcccggccgccaggagaagauguccaucuaccaggccauguggaagggcguccuccgccccggcaccgcccucguccuccucgaggcccaggccgccaccggcuucgucaucgaccccguccgcaaccuccgccucuccgucgaggaggccgucgccgccggcgucgucggcggcgagauccaggagaagcuccucuccgccgagcgcgccgucaccggcuacaccgaccccuacaccggccagcagaucucccucuuccaggccaugcagaaggaccucaucguccgcgagcacggcauccgccuccucgaggcccagaucgccaccggcggcgucaucgaccccguccacucccaccgcguccccgucgacgucgccuaccgccgcggcuacuucgacgaggagaugaaccgcguccucgccgaccccuccgacgacaccaagggcuucuucgaccccaacacccacgagaaccucaccuacguccagcuccuccgccgcugcguccccgaccccgacaccggccucuacaugcuccagcucgccggccgcggcuccgccguccaccagcucuccgaggagcuccgcugcgcccuccgcgacgcccgcgucacccccggcuccggcgcccuccagggccaguccgucuccgucugggagcuccucuucuaccgcgaggucuccgaggaccgccgccaggaccuccucucccgcuaccgcgccggcacccucaccgucgaggagcucggcgccacccucaccucccuccucgcccaggcccaggcccaggcccgcgccgaggccgaggccggcuccccccgccccgacccccgcgaggcccuccgcgccgccaccauggaggucaaggucggccgccuccgcggccgcgccguccccgucugggacguccucgccuccggcuacgucucccgcgccgcccgcgaggagcuccucgccgaguucggcuccggcacccucgaccuccccgcccucacccgccgccucaccgccaucaucgaggaggccgaggaggcccccggcgcccgcccccagcuccaggacgccuggcgcggcccccgcgagcccggccccgccggccgcggcgacggcgacuccggccgcucccagcgcgagggccagggcgagggcgagacccaggaggccgccgccgccgccgccgccgccgccgcccgccgccaggagcagacccuccgcgacgccaccauggagguccagcgcggccaguuccagggccgccccgucuccgucugggacguccucuucuccuccuaccucuccgaggcccgccgcgacgagcuccucgcccagcacgccgccggcgcccucggccuccccgaccucgucgccguccucacccgcgucaucgaggagaccgaggagcgccucuccaaggucuccuuccgcggccuccgccgccaggucuccgccuccgagcuccacaccuccggcauccucggccccgagacccuccgcgaccucgcccagggcaccaagacccuccaggaggucaccgagauggacuccgucaagcgcuaccucgagggcaccuccugcaucgccggcguccucguccccgccaaggaccagcccggccgccaggagaagauguccaucuaccaggccauguggaagggcguccuccgccccggcaccgcccucguccuccucgaggcccaggccgccaccggcuucgucaucgaccccguccgcaaccuccgccucuccgucgaggaggccgucgccgccggcgucgucggcggcgagauccaggagaagcuccucuccgccgagcgcgccgucaccggcuacaccgaccccuacaccggccagcagaucucccucuuccaggccaugcagaaggaccucaucguccgcgagcacggcauccgccuccucgaggcccagaucgccaccggcggcgucaucgaccccguccacucccaccgcguccccgucgacgucgccuaccagcgcggcuacuucgacgaggagaugaaccgcguccucgccgaccccuccgacgacaccaagggcuucuucgaccccaacacccacgagaaccucaccuacguccagcuccuccgccgcugcguccccgaccccgacaccggccucuacaugcuccagcucgccggccgcggcuccgccguccaccagcucuccgaggagcuccgcugcgcccuccgcgacgcccgcgucacccccggcuccggcgcccuccagggccaguccgucuccgucugggagcuccucuucuaccgcgaggucuccgaggaccgccgccaggaccuccucucccgcuaccgcgccggcacccucaccgucgaggagcucggcgccacccucaccucccuccucgcccaggcccaggcccaggcccgcgccgaggccgaggccggcuccccccgccccgacccccgcgaggcccuccgcgccgccaccauggaggucaaggucggccgccuccgcggccgcgccguccccgucugggacguccucgccuccggcuacgucucccgcgccgcccgcgaggagcuccucgccgaguucggcuccggcacccucgaccuccccgcccucacccgccgccucaccgccaucaucgaggaggccgaggaggcccccggcgcccgcccccagcuccaggacgccuggcgcggcccccgcgagcccggccccgccggccgcggcgacggcgacuccggccgcucccagcgcgagggccagggcgagggcgagacccaggaggccgccgccgccgcccgccgccaggagcagacccuccgcgacgccaccauggagguccagcgcggccaguuccagggccgccccgucuccgucugggacguccucuucuccuccuaccucuccgaggcccgccgcgacgagcuccucgcccagcacgccgccggcgcccucggccuccccgaccucgucgccguccucacccgcgucaucgaggagaccgaggagcgccucuccaaggucuccuuccgcggccuccgcugccaggucuccgccuccgagcuccacaccuccggcauccucggccccgagacccuccgcgaccucgcccagggcaccaagacccuccaggaggucaccgagauggacuccgucaagcgcuaccucgagggcaccuccugcaucgccggcguccucguccccgccaaggaccagcccggccgccaggagaagauguccaucuaccaggccauguggaagggcguccuccgccccggcaccgcccucguccuccucgaggcccaggccgccaccggcuucgucaucgaccccguccgcaaccuccgccucuccgucgaggaggccgucgccgccggcgucgucggcggcgagauccaggagaagcuccucuccgccgagcgcgccgucaccggcuacaccgaccccuacaccggccagcagaucucccucuuccaggccaugcagaaggaccucaucguccgcgagcacggcauccgccuccucgaggcccagaucgccaccggcggcgucaucgaccccguccacucccaccgcguccccgucgacgucgccuaccgccgcggcuacuucgacgaggagaugaaccgcguccucgccgaccccuccgacgacaccaagggcuucuucgaccccaacacccacgagaaccucaccuacguccagcuccuccgccgcugcguccccgaccccgacaccggccucuacaugcuccagcucgccggccgcggcuccgccguccaccagcucuccgaggagcuccgcugcgcccuccgcgacgcccgcgucacccccggcuccggcgcccuccagggccaguccgucuccgucugggagcuccucuucuaccgcgaggucuccgaggaccgccgccaggaccuccucucccgcuaccgcgccggcacccucaccgucgaggagcucggcgccacccucaccucccuccucgcccaggcccaggcccaggcccgcgccgaggccgaggccggcuccccccgccccgacccccgcgaggcccuccgcgccgccaccauggaggucaaggucggccgccuccgcggccgcgccguccccgucugggacguccucgccuccggcuacgucucccgcgccgcccgcgaggagcuccucgccgaguucggcuccggcacccucgaccuccccgcccucacccgccgccucaccgccaucaucgaggaggccgaggaggcccccggcgcccgcccccagcuccaggacgccuggcgcggcccccgcgagcccggccccgccggccgcggcgacggcgacuccggccgcucccagcgcgagggccagggcgagggcgagacccaggaggccgccgccgccaccgccgccgcccgccgccaggagcagacccuccgcgacgccaccauggagguccagcgcggccaguuccagggccgccccgucuccgucugggacguccucuucuccuccuaccucuccgaggcccgccgcgacgagcuccucgcccagcacgccgccggcgcccucggccuccccgaccucgucgccguccucacccgcgucaucgaggagaccgaggagcgccucuccaaggucuccuuccgcggccuccgccgccaggucuccgccuccgagcuccacaccuccggcauccucggccccgagacccuccgcgaccucgcccagggcaccaagacccuccaggaggucaccgagauggacuccgucaagcgcuaccucgagggcaccuccugcaucgccggcguccucguccccgccaaggaccagcccggccgccaggagaagauguccaucuaccaggccauguggaagggcguccuccgccccggcaccgcccucguccuccucgaggcccaggccgccaccggcuucgucaucgaccccguccgcaaccuccgccucuccgucgaggaggccgucgccgccggcgucgucggcggcgagauccaggagaagcuccucuccgccgagcgcgccgucaccggcuacaccgaccccuacaccggccagcagaucucccucuuccaggccaugcagaaggaccucaucguccgcgagcacggcauccgccuccucgaggcccagaucgccaccggcggcgucaucgaccccguccacucccaccgcguccccgucgacgucgccuaccgccgcggcuacuucgacgaggagaugaaccgcguccucgccgaccccuccgacgacaccaagggcuucuucgaccccaacacccacgagaaccucaccuacguccagcuccuccgccgcugcguccccgaccccgacaccggccucuacaugcuccagcucgccggccgcggcuccgccguccaccagcucuccgaggagcuccgcugcgcccuccgcgacgcccgcgucacccccggcuccggcgcccuccagggccaguccgucuccgucugggagcuccucuucuaccgcgaggucuccgaggaccgccgccaggaccuccucucccgcuaccgcgccggcacccucaccgucgaggagcucggcgccacccucaccucccuccucgcccaggcccaggcccaggcccgcgccgaggccgaggccggcuccccccgccccgacccccgcgaggcccuccgcgccgccaccauggaggucaaggucggccgccuccgcggccgcgccguccccgucugggacguccucgccuccggcuacgucucccgcgccgcccgcgaggagcuccucgccgaguucggcuccggcacccucgaccuccccgcccucacccgccgccucaccgccaucaucgaggaggccgaggaggcccccggcgcccgcccccagcuccaggacgccuggcgcggcccccgcgagcccggccccgccggccgcggcgacggcgacuccggccgcucccagcgcgagggccagggcgagggcgagacccaggaggccgccgccgccaccgccgccgcccgccgccaggagcagacccuccgcgacgccaccauggagguccagcgcggccaguuccagggccgccccgucuccgucugggacguccucuucuccuccuaccucuccgaggcccgccgcgacgagcuccucgcccagcacgccgccggcgcccucggccuccccgaccucgucgccguccucacccgcgucaucgaggagaccgaggagcgccucuccaaggucuccuuccgcggccuccgccgccaggucuccgccuccgagcuccacaccuccggcauccucggccccgagacccuccgcgaccucgcccagggcaccaagacccuccaggaggucaccgagauggacuccgucaagcgcuaccucgagggcaccuccugcaucgccggcguccucguccccgccaaggaccagcccggccaccaggagaagauguccaucuaccaggccauguggaagggcguccuccgccccggcaccgcccucguccuccucgaggcccaggccgccaccggcuucgucaucgaccccguccgcaaccuccgccucuccgucgaggaggccgucgccgccggcgucgucggcggcgagauccaggagaagcuccucuccgccgagcgcgccgucaccggcuacaccgaccccuacaccggccagcagaucucccucuuccaggccaugcagaaggaccucaucguccgcgagcacggcauccgccuccucgaggcccagaucgccaccggcggcgucaucgaccccguccacucccaccgcguccccgucgacgucgccuaccgccgcggcuacuucgacgaggagaugaaccgcguccucgcccaccccuccgacgacaccaagggcuucuucgaccccaacacccacgagaaccucaccuacguccagcuccuccgccgcugcguccccgaccccgacaccggccucuacaugcuccagcucgccggccgcggcuccgccguccaccagcucuccgaggagcuccgcugcgcccuccgcgacgcccgcgucaugcccggcuccggcgcccuccagggccaguccgucuccgucugggagcuccucuucuaccgcgaggucuccgaggaccgccgccaggaccuccucucccgcuaccgcgccggcacccucaccgucgaggagcucggcgccacccucaccucccuccucgcccaggcccaggcccaggcccgcgccgaggccgaggccgaggccggcuccccccgccccgacccccgcgaggcccuccgcgccgccaccauggaggucaaggucggccgccuccgcggccgcgccguccccgucugggacguccucgccuccggcuacgucuccggcgccgcccgcgaggagcuccucgccgaguucggcuccggcacccucgaccuccccgcccucacccgccgccucaccgccaucaucgaggaggccgaggaggcccccggcgcccgcccccagcuccaggacgccuggcgcggcccccgcgagcccggccccgccggccgcggcgacggcgacuccggccgcucccagcgcgagggccagggcgagggcgagacccaggaggccgccgccgccgcccgccgccaggagcagacccuccgcgacgccaccauggagguccagcgcggccaguuccagggccgccccgucuccgucugggacguccucuucuccuccuaccucuccgaggcccaccgcgacgagcuccucgcccagcacgccgccggcgcccucggccuccccgaccucgucgccguccucacccgcgucaucgaggagaccgaggagcgccucuccaaggucuccuuccgcggccuccgccgccaggucuccgccuccgagcuccacaccuccggcauccucggccccgagacccuccgcgaccucgcccagggcaccaagacccuccaggaggucaccgagauggacuccgucaagcgcuaccucgagggcaccuccugcaucgccggcguccucguccccgccaaggaccagcccggccgccaggagaagauguccaucuaccaggccauguggaagggcguccuccgccccggcaccgcccucguccuccucgaggcccaggccgccaccggcuucgucaucgaccccguccgcaaccuccgccucuccgucgaggaggccgucgccgccggcgucgucggcggcgagauccaggagaagcuccucuccgccgagcgcgccgucaccggcuacaccgaccccuacaccggccagcagaucucccucuuccaggccaugcagaaggaccucaucguccgcgagcacggcauccgccuccucgaggcccagaucgccaccggcggcgucaucgaccccguccacucccaccgcguccccgucgacgucgccuaccgccgcggcuacuucgacgaggagaugaaccgcguccucgccgaccccuccgacgacaccaagggcuucuucgaccccaacacccacgagaaccucaccuaccuccagcuccuccagcgcgccacccucgaccccgagaccggccuccucuuccucucccucucccuccaguga

SEQ ID NO: 42787 - RNA, 4539 nt, Artificial Sequence
  derived and/or modified sequence opt2 from EPRS__Homo_sapiens__NP_004437
auggccacccucucccucaccgucaacuccggcgaccccccccucggcgcccuccucgccgucgagcacgucaaggacgacgucuccaucuccgucgaggagggcaaggagaacauccuccacgucuccgagaacgucaucuucaccgacgucaacuccauccuccgcuaccucgcccgcgucgccaccaccgccggccucuacggcuccaaccucauggagcacaccgagaucgaccacuggcucgaguucuccgccaccaagcucuccuccugcgacuccuucaccuccaccaucaacgagcucaaccacugccucucccuccgcaccuaccucgucggcaacucccucucccucgccgaccucugcgucugggccacccucaagggcaacgccgccuggcaggagcagcucaagcagaagaaggcccccguccacgucaagcgcugguucggcuuccucgaggcccagcaggccuuccaguccgucggcaccaagugggacgucuccaccaccaaggcccgcgucgcccccgagaagaagcaggacgucggcaaguucgucgagcuccccggcgccgagaugggcaaggucaccguccgcuucccccccgaggccuccggcuaccuccacaucggccacgccaaggccgcccuccucaaccagcacuaccaggucaacuucaagggcaagcucaucaugcgcuucgacgacaccaaccccgagaaggagaaggaggacuucgagaaggucauccucgaggacgucgccaugcuccacaucaagcccgaccaguucaccuacaccuccgaccacuucgagaccaucaugaaguacgccgagaagcucauccaggagggcaaggccuacgucgacgacacccccgccgagcagaugaaggccgagcgcgagcagcgcaucgacuccaagcaccgcaagaaccccaucgagaagaaccuccagaugugggaggagaugaagaagggcucccaguucggccaguccugcugccuccgcgccaagaucgacauguccuccaacaacggcugcaugcgcgaccccacccucuaccgcugcaagauccagccccacccccgcaccggcaacaaguacaacgucuaccccaccuacgacuucgccugccccaucgucgacuccaucgagggcgucacccacgcccuccgcaccaccgaguaccacgaccgcgacgagcaguucuacuggaucaucgaggcccucggcauccgcaagcccuacaucugggaguacucccgccucaaccucaacaacaccguccucuccaagcgcaagcucaccugguucgucaacgagggccucgucgacggcugggacgacccccgcuuccccaccguccgcggcguccuccgccgcggcaugaccgucgagggccucaagcaguucaucgccgcccagggcuccucccgcuccgucgucaacauggagugggacaagaucugggccuucaacaagaaggucaucgaccccgucgccccccgcuacgucgcccuccucaagaaggaggucauccccgucaacguccccgaggcccaggaggagaugaaggaggucgccaagcaccccaagaaccccgaggucggccucaagcccgucugguacucccccaaggucuucaucgagggcgccgacgccgagaccuucuccgagggcgagauggucaccuucaucaacuggggcaaccucaacaucaccaagauccacaagaacgccgacggcaagaucaucucccucgacgccaagcucaaccucgagaacaaggacuacaagaagaccaccaaggucaccuggcucgccgagaccacccacgcccuccccauccccgucaucugcgucaccuacgagcaccucaucaccaagcccguccucggcaaggacgaggacuucaagcaguacgucaacaagaacuccaagcacgaggagcucaugcucggcgaccccugccucaaggaccucaagaagggcgacaucauccagcuccagcgccgcggcuucuucaucugcgaccagcccuacgagcccgucucccccuacuccugcaaggaggcccccugcguccucaucuacauccccgacggccacaccaaggagaugcccaccuccggcuccaaggagaagaccaaggucgaggccaccaagaacgagaccuccgcccccuucaaggagcgccccacccccucccucaacaacaacugcaccaccuccgaggacucccucguccucuacaaccgcgucgccguccagggcgacgucguccgcgagcucaaggccaagaaggcccccaaggaggacgucgacgccgccgucaagcagcuccucucccucaaggccgaguacaaggagaagaccggccaggaguacaagcccggcaacccccccgccgagaucggccagaacaucuccuccaacuccuccgccuccauccucgaguccaagucccucuacgacgaggucgccgcccagggcgaggucguccgcaagcucaaggccgagaagucccccaaggccaagaucaacgaggccgucgagugccuccucucccucaaggcccaguacaaggagaagaccggcaaggaguacauccccggccagcccccccucucccaguccuccgacuccucccccacccgcaacuccgagcccgccggccucgagacccccgaggccaagguccucuucgacaaggucgccucccagggcgaggucguccgcaagcucaagaccgagaaggcccccaaggaccaggucgacaucgccguccaggagcuccuccagcucaaggcccaguacaagucccucaucggcgucgaguacaagcccgucuccgccaccggcgccgaggacaaggacaagaagaagaaggagaaggagaacaaguccgagaagcagaacaagccccagaagcagaacgacggccagcgcaaggaccccuccaagaaccagggcggcggccucuccuccuccggcgccggcgagggccagggccccaagaagcagacccgccucggccucgaggccaagaaggaggagaaccucgccgacugguacucccaggucaucaccaaguccgagaugaucgaguaccacgacaucuccggcugcuacauccuccgccccugggccuacgccaucugggaggccaucaaggacuucuucgacgccgagaucaagaagcucggcgucgagaacugcuacuuccccauguucgucucccaguccgcccucgagaaggagaagacccacgucgccgacuucgcccccgaggucgccugggucacccgcuccggcaagaccgagcucgccgagcccaucgccauccgccccaccuccgagaccgucauguaccccgccuacgccaaguggguccagucccaccgcgaccuccccaucaagcucaaccaguggugcaacgucguccgcugggaguucaagcacccccagcccuuccuccgcacccgcgaguuccucuggcaggagggccacuccgccuucgccaccauggaggaggccgccgaggagguccuccagauccucgaccucuacgcccaggucuacgaggagcuccucgccauccccgucgucaagggccgcaagaccgagaaggagaaguucgccggcggcgacuacaccaccaccaucgaggccuucaucuccgccuccggccgcgccauccagggcggcaccucccaccaccucggccagaacuucuccaagauguucgagaucgucuucgaggaccccaagauccccggcgagaagcaguucgccuaccagaacuccuggggccucaccacccgcaccaucggcgucaugaccaugguccacggcgacaacaugggccucguccuccccccccgcgucgccugcguccaggucgucaucauccccugcggcaucaccaacgcccucuccgaggaggacaaggaggcccucaucgccaagugcaacgacuaccgccgccgccuccucuccgucaacauccgcguccgcgccgaccuccgcgacaacuacucccccggcuggaaguucaaccacugggagcucaagggcguccccauccgccucgaggucggcccccgcgacaugaaguccugccaguucgucgccguccgccgcgacaccggcgagaagcucaccgucgccgagaacgaggccgagaccaagcuccaggccauccucgaggacauccaggucacccucuucacccgcgccuccgaggaccucaagacccacauggucgucgccaacaccauggaggacuuccagaagauccucgacuccggcaagaucguccagauccccuucugcggcgagaucgacugcgaggacuggaucaagaagaccaccgcccgcgaccaggaccucgagcccggcgcccccuccaugggcgccaagucccucugcauccccuucaagccccucugcgagcuccagcccggcgccaagugcgucugcggcaagaaccccgccaaguacuacacccucuucggccgcuccuacuga

SEQ ID NO: 42788 - RNA, 2733 nt, Artificial Sequence
  derived and/or modified sequence opt2 from EPS15L1__Homo_sapiens__NP_001245303
auggccgccccccucaucccccucucccagcagauccccaccggcaacucccucuacgaguccuacuacaagcaggucgaccccgccuacaccggccgcgucggcgccuccgaggccgcccucuuccucaagaaguccggccucuccgacaucauccucggcaagaucugggaccucgccgaccccgagggcaagggcuuccucgacaagcagggcuucuacgucgcccuccgccucgucgccugcgcccaguccggccacgaggucacccucuccaaccucaaccucuccaugcccccccccaaguuccacgacaccuccuccccccucauggucaccccccccuccgccgaggcccacugggccguccgcgucgaggagaaggccaaguucgacggcaucuucgagucccuccuccccaucaacggccuccucuccggcgacaaggucaagcccguccucaugaacuccaagcucccccucgacguccucggccgcgucugggaccucuccgacaucgacaaggacggccaccucgaccgcgacgaguucgccgucgccaugcaccucgucuaccgcgcccucgagaaggagcccguccccuccgcccucccccccucccucaucccccccuccaagcgcaagaagaccgucuuccccggcgccguccccguccuccccgccucccccccccccaaggacucccuccgcuccacccccucccacggcuccgucuccucccucaacuccaccggcucccucucccccaagcacucccucaagcagacccagcccaccgucaacugggucguccccgucgccgacaagaugcgcuucgacgagaucuuccucaagaccgaccucgaccucgacggcuacgucuccggccaggaggucaaggagaucuucaugcacuccggccucacccagaaccuccucgcccacaucugggcccucgccgacacccgccagaccggcaagcucuccaaggaccaguucgcccucgccauguacuucauccagcagaaggucuccaagggcaucgaccccccccagguccucucccccgacauggucccccccuccgagcgcggcacccccggccccgacuccuccggcucccucggcuccggcgaguucaccggcgucaaggagcucgacgacaucucccaggagaucgcccagcuccagcgcgagaaguacucccucgagcaggacauccgcgagaaggaggaggccauccgccagaagaccuccgagguccaggagcuccagaacgaccucgaccgcgagaccuccucccuccaggagcucgaggcccagaagcaggacgcccaggaccgccucgacgagauggaccagcagaaggccaagcuccgcgacaugcucuccgacguccgccagaagugccaggacgagacccagaugaucuccucccucaagacccagauccagucccaggaguccgaccucaagucccaggaggacgaccucaaccgcgccaaguccgagcucaaccgccuccagcaggaggagacccagcucgagcaguccauccaggccggccgcguccagcucgagaccaucaucaagucccucaaguccacccaggacgagaucaaccaggcccgcuccaagcucucccagcuccacgagucccgccaggaggcccaccgcucccucgagcaguacgaccagguccucgacggcgcccacggcgccucccucaccgaccucgccaaccucuccgagggcgucucccucgccgagcgcggcuccuucggcgccauggacgaccccuucaagaacaaggcccuccucuucuccaacaacacccaggagcuccaccccgaccccuuccagaccgaggaccccuucaaguccgaccccuucaagggcgccgaccccuucaagggcgaccccuuccagaacgaccccuucgccgagcagcagaccaccuccaccgaccccuucggcggcgaccccuucaaggaguccgaccccuuccgcggcuccgccaccgacgacuucuucaagaagcagaccaagaacgaccccuucaccuccgaccccuucaccaagaaccccucccuccccuccaagcucgaccccuucgaguccuccgaccccuucuccuccuccuccgucuccuccaagggcuccgaccccuucggcacccucgaccccuucggcuccggcuccuucaacuccgccgagggcuucgccgacuucucccagauguccaagcccccccccuccggccccuucaccuccucccucggcggcgccggcuucuccgacgaccccuucaaguccaagcaggacacccccgcccucccccccaagaagcccgcccccccccgccccaagccccccuccggcaaguccacccccgucucccagcucggcuccgccgacuuccccgaggcccccgaccccuuccagccccucggcgccgacuccggcgaccccuuccaguccaagaagggcuucggcgaccccuucuccggcaaggaccccuucguccccuccuccgccgccaagcccuccaaggccuccgccuccggcuucgccgacuucaccuccuucggcaacgaggagcagcagcucgccugggccaagcgcgaguccgagaaggccgagcaggagcgccucgcccgccuccgccgccaggagcaggaggaccucgagcucgccaucgcccucuccaaggccgacaugcccgccgccuga

SEQ ID NO: 42789 - RNA, 2502 nt, Artificial Sequence
  derived and/or modified sequence opt2 from EPS8__Homo_sapiens__XP_005253396
auguccaaccucaacacccaggucaaggacaccaugaacggccacaucuccaaccaccccuccuccuucggcauguaccccucccagaugaacggcuacggcuccucccccaccuucucccagaccgaccgcgagcacggcuccaagaccuccgccaaggcccucuacgagcagcgcaagaacuacgcccgcgacuccgucuccuccgucuccgacaucucccaguaccgcgucgagcaccucaccaccuucguccucgaccgcaaggacgccaugaucaccgucgacgacggcauccgcaagcucaagcuccucgacgccaagggcaaggucuggacccaggacaugauccuccaggucgacgaccgcgccgucucccucaucgaccucgaguccaagaacgagcucgagaacuucccccucaacaccauccagcacugccaggccgucaugcacuccugcuccuacgacuccguccucgcccucgucugcaaggagcccacccagaacaagcccgaccuccaccucuuccagugcgacgaggucaaggccaaccucaucuccgaggacaucgaguccgccaucuccgacuccaagggcggcaagcagaagcgccgccccgacgcccuccgcaugaucuccaacgccgaccccuccauccccccccccccccgcgcccccgcccccgccccccccggcaccgucacccaggucgacguccgcucccgcgucgccgccugguccgccugggccgccgaccagggcgacuucgagaagccccgccaguaccacgagcaggaggagacccccgagaugauggccgcccgcaucgaccgcgacguccagauccucaaccacauccucgacgacaucgaguucuucaucaccaagcuccagaaggccgccgaggccuucuccgagcucuccaagcgcaagaagaacaagaagggcaagcgcaagggccccggcgagggcguccucacccuccgcgccaagccccccccccccgacgaguuccucgacugcuuccagaaguucaagcacggcuucaaccuccucgccaagcucaagucccacauccagaaccccuccgccgccgaccucguccacuuccucuucaccccccucaacauggucguccaggccaccggcggccccgagcucgccuccuccguccucuccccccuccucaacaaggacaccaucgacuuccucaacuacaccgucaacggcgacgagcgccagcucuggaugucccucggcggcaccuggaugaaggcccgcgccgaguggcccaaggagcaguucaucccccccuacgucccccgcuuccgcaacggcugggagccccccaugcucaacuucaugggcgccaccauggagcaggaccucuaccagcucgccgaguccgucgccaacgucgccgagcaccagcgcaagcaggagaucaagcgccucuccaccgagcacuccuccgucuccgaguaccaccccgccgacggcuacgccuucuccuccaacaucuacacccgcggcucccaccucgaccagggcgaggccgccgucgccuucaagcccaccuccaaccgccacaucgaccgcaacuacgagccccucaagacccagcccaagaaguacgccaaguccaaguacgacuucgucgcccgcaacaacuccgagcucuccguccucaaggacgacauccucgagauccucgacgaccgcaagcagugguggaagguccgcaacgccuccggcgacuccggcuucguccccaacaacauccucgacaucguccgcccccccgaguccggccucggccgcgccgacccccccuacacccacaccauccagaagcagcgcauggaguacggcccccgccccgccgacaccccccccgcccccucccccccccccacccccgcccccguccccgucccccucccccccuccacccccgcccccguccccgucuccaagguccccgccaacaucacccgccagaacuccuccuccuccgacuccggcggcuccaucguccgcgacucccagcgccacaagcagcuccccgucgaccgccgcaagucccagauggaggagguccaggacgagcucauccaccgccucaccaucggccgcuccgccgcccagaagaaguuccacgucccccgccagaacguccccgucaucaacaucaccuacgacuccacccccgaggacgucaagaccuggcuccaguccaagggcuucaaccccgucaccgucaacucccucggcguccucaacggcgcccagcucuucucccucaacaaggacgagcuccgcaccgucugccccgagggcgcccgcgucuacucccagaucaccguccagaaggccgcccucgaggacuccuccggcuccuccgagcuccaggagaucaugcgccgccgccaggagaagaucuccgccgccgccuccgacuccggcgucgaguccuucgacgagggcuccucccacuga

SEQ ID NO: 42790 - RNA, 2148 nt, Artificial Sequence
  derived and/or modified sequence opt2 from EPS8L2__Homo_sapiens__NP_073609
augucccaguccggcgccgucuccugcugccccggcgccaccaacggcucccucggccgcuccgacggcgucgccaagaugucccccaaggaccucuucgagcagcgcaagaaguacuccaacuccaacgucaucaugcacgagaccucccaguaccacguccagcaccucgccaccuucaucauggacaaguccgaggccaucaccuccgucgacgacgccauccgcaagcucguccagcucuccuccaaggagaagaucuggacccaggagaugcuccuccaggucaacgaccagucccuccgccuccucgacaucgagucccaggaggagcucgaggacuucccccuccccaccguccagcgcucccagaccguccucaaccagcuccgcuaccccuccguccuccuccucgucugccaggacuccgagcaguccaagcccgacguccacuucuuccacugcgacgaggucgaggccgagcucguccacgaggacaucgaguccgcccucgccgacugccgccucggcaagaagaugcgcccccagacccucaagggccaccaggagaagauccgccagcgccaguccauccucccccccccccagggccccgcccccauccccuuccagcaccgcggcggcgacucccccgaggccaagaaccgcgucggcccccaggucccccucuccgagcccggcuuccgccgccgcgagucccaggaggagccccgcgccguccucgcccagaagaucgagaaggagacccagauccucaacugcgcccucgacgacaucgagugguucgucgcccgccuccagaaggccgccgaggccuucaagcagcucaaccagcgcaagaagggcaagaagaagggcaagaaggcccccgccgagggcguccucacccuccgcgcccgcccccccuccgagggcgaguucaucgacugcuuccagaagaucaagcucgccaucaaccuccucgccaagcuccagaagcacauccagaaccccuccgccgccgagcucguccacuuccucuucggcccccucgaccucaucgucaacaccugcuccggccccgacaucgcccgcuccgucuccugcccccuccucucccgcgacgccgucgacuuccuccgcggccaccucguccccaaggagaugucccucugggagucccucggcgaguccuggaugcgcccccgcuccgaguggccccgcgagccccaggucccccucuacguccccaaguuccacuccggcugggagccccccgucgacguccuccaggaggcccccugggaggucgagggccucgccuccgcccccaucgaggaggucucccccgucucccgccaguccauccgcaacucccagaagcacucccccaccuccgagcccaccccccccggcgacgcccucccccccgucuccuccccccacacccaccgcggcuaccagcccacccccgccauggccaaguacgucaagauccucuacgacuucaccgcccgcaacgccaacgagcucuccguccucaaggacgagguccucgagguccucgaggacggccgccagugguggaagcuccgcucccgcuccggccaggccggcuacguccccugcaacauccucggcgaggcccgccccgaggacgccggcgcccccuucgagcaggccggccagaaguacuggggccccgccucccccacccacaagcucccccccuccuuccccggcaacaaggacgagcucaugcagcacauggacgaggucaacgacgagcucauccgcaagaucuccaacauccgcgcccagccccagcgccacuuccgcgucgagcgcucccagcccgucucccagccccucaccuacgaguccggccccgacgagguccgcgccuggcucgaggccaaggccuucuccccccgcaucgucgagaaccucggcauccucaccggcccccagcucuucucccucaacaaggaggagcucaagaaggucugcggcgaggagggcguccgcgucuacucccagcucaccaugcagaaggccuuccucgagaagcagcaguccggcuccgagcucgaggagcucaugaacaaguuccacuccaugaaccagcgccgcggcgaggacuccuga

SEQ ID NO: 42791 - RNA, 1233 nt, Artificial Sequence
  derived and/or modified sequence opt2 from EPSTI1__Homo_sapiens__NP_001002264
augaacacccgcaaccgcgucgucaacuccggccucggcgccucccccgccucccgccccacccgcgacccccaggaccccuccggccgccagggcgagcucucccccgucgaggaccagcgcgagggccucgaggccgcccccaagggccccucccgcgaguccgucguccacgccggccagcgccgcaccuccgccuacacccucaucgcccccaacaucaaccgccgcaacgagauccagcgcaucgccgagcaggagcucgccaaccucgagaaguggaaggagcagaaccgcgccaagcccguccaccucgucccccgccgccucggcggcucccaguccgagaccgagguccgccagaagcagcagcuccagcucaugcaguccaaguacaagcagaagcucaagcgcgaggaguccguccgcaucaagaaggaggccgaggaggccgagcuccagaagaugaaggccauccagcgcgagaaguccaacaagcucgaggagaagaagcgccuccaggagaaccuccgccgcgaggccuuccgcgagcaccagcaguacaagaccgccgaguuccucuccaagcucaacaccgagucccccgaccgcuccgccugccaguccgccgucugcggcccccaguccuccaccuggaagcuccccauccucccccgcgaccacuccugggcccgcuccugggccuaccgcgacucccucaaggccgaggagaaccgcaagcuccagaagaugaaggacgagcagcaccagaaguccgagcuccucgagcucaagcgccagcagcaggagcaggagcgcgccaagauccaccagaccgagcaccgccgcgucaacaacgccuuccucgaccgccuccagggcaagucccagcccggcggccucgagcaguccggcggcugcuggaacaugaacuccggcaacuccuggggcucccuccucgucuucucccgccaccuccgcgucuacgagaagauccucacccccaucuggcccuccuccaccgaccucgagaagccccacgagaugcucuuccucaacgucauccucuucucccucaccgucuucacccucaucuccaccgcccacacccucgaccgcgccguccgcuccgacuggcuccuccucguccucaucuacgccugccucgaggagcucauccccgagcucaucuucaaccucuacugccagggcaacgccacccucuucuucuga

SEQ ID NO: 42792 - RNA, 2148 nt, Artificial Sequence
  derived and/or modified sequence opt2 from EPX__Homo_sapiens__NP_000493
augcaccuccuccccgcccucgccggcguccucgccacccucguccucgcccagcccugcgagggcaccgaccccgccucccccggcgccgucgagaccuccguccuccgcgacugcaucgccgaggccaagcuccucgucgacgccgccuacaacuggacccagaaguccaucaagcagcgccuccgcuccggcuccgccucccccauggaccuccucuccuacuucaagcagcccgucgccgccacccgcaccgucguccgcgccgccgacuacaugcacgucgcccucggccuccucgaggagaagcuccagccccagcgcuccggccccuucaacgucaccgacguccucaccgagccccagcuccgccuccucucccaggccuccggcugcgcccuccgcgaccaggccgagcgcugcuccgacaaguaccgcaccaucaccggccgcugcaacaacaagcgccgcccccuccucggcgccuccaaccaggcccucgcccgcuggcuccccgccgaguacgaggacggccucucccuccccuucggcuggacccccucccgccgccgcaacggcuuccuccucccccucguccgcgccgucuccaaccagaucguccgcuuccccaacgagcgccucaccuccgaccgcggccgcgcccucauguucaugcaguggggccaguucaucgaccacgaccucgacuucucccccgagucccccgcccgcgucgccuucaccgccggcgucgacugcgagcgcaccugcgcccagcucccccccugcuuccccaucaagaucccccccaacgacccccgcaucaagaaccagcgcgacugcauccccuucuuccgcuccgcccccuccugcccccagaacaagaaccgcguccgcaaccagaucaacgcccucaccuccuucgucgacgccuccauggucuacggcuccgaggucucccucucccuccgccuccgcaaccgcaccaacuaccucggccuccucgccaucaaccagcgcuuccaggacaacggccgcgcccuccuccccuucgacaaccuccacgacgaccccugccuccucaccaaccgcuccgcccgcauccccugcuuccucgccggcgacacccgcuccaccgagacccccaagcucgccgccaugcacacccucuucaugcgcgagcacaaccgccucgccaccgagcuccgccgccucaacccccgcuggaacggcgacaagcucuacaacgaggcccgcaagaucaugggcgccaugguccagaucaucaccuaccgcgacuuccucccccucguccucggcaaggcccgcgcccgccgcacccucggccacuaccgcggcuacugcuccaacgucgacccccgcgucgccaacgucuucacccucgccuuccgcuucggccacaccaugcuccagcccuucauguuccgccucgacucccaguaccgcgccuccgcccccaacucccacgucccccucuccuccgccuucuucgccuccuggcgcaucgucuacgagggcggcaucgaccccauccuccgcggccucauggccacccccgccaagcucaaccgccaggacgccaugcucgucgacgagcuccgcgaccgccucuuccgccagguccgccgcaucggccucgaccucgccgcccucaacaugcagcgcucccgcgaccacggccuccccggcuacaacgccuggcgccgcuucugcggccucucccagccccgcaaccucgcccagcucucccgcguccucaagaaccaggaccucgcccgcaaguuccucaaccucuacggcacccccgacaacaucgacaucuggaucggcgccaucgccgagccccuccuccccggcgcccgcgucggcccccuccucgccugccucuucgagaaccaguuccgccgcgcccgcgacggcgaccgcuucugguggcagaagcgcggcgucuucaccaagcgccagcgcaaggcccucucccgcaucucccucucccgcaucaucugcgacaacaccggcaucaccaccgucucccgcgacaucuuccgcgccaacaucuacccccgcggcuucgucaacugcucccgcaucccccgccucaaccucuccgccuggcgcggcaccuga

SEQ ID NO: 42793 - RNA, 969 nt, Artificial Sequence
  derived and/or modified sequence opt2 from EPYC__Homo_sapiens__NP_004941
augaagacccucgccggccucguccucggccucgucaucuucgacgccgccgucaccgcccccacccucgaguccaucaacuacgacuccgagaccuacgacgccacccucgaggaccucgacaaccucuacaacuacgagaacauccccgucgacaaggucgagaucgagaucgccaccgucaugcccuccggcaaccgcgagcuccucaccccccccccccagcccgagaaggcccaggaggaggaggaggaggaggaguccaccccccgccucaucgacggcuccuccccccaggagcccgaguucaccggcguccucggcccccacaccaacgaggacuuccccaccugccuccucugcaccugcaucuccaccaccgucuacugcgacgaccacgagcucgacgccauccccccccuccccaagaacaccgccuacuucuacucccgcuucaaccgcaucaagaagaucaacaagaacgacuucgccucccucuccgaccucaagcgcaucgaccucaccuccaaccucaucuccgagaucgacgaggacgccuuccgcaagcucccccagcuccgcgagcucguccuccgcgacaacaagauccgccagcuccccgagcuccccaccacccucaccuucaucgacaucuccaacaaccgccucggccgcaagggcaucaagcaggaggccuucaaggacauguacgaccuccaccaccucuaccucaccgacaacaaccucgaccacaucccccucccccuccccgagaaccuccgcgcccuccaccuccagaacaacaacauccucgagaugcacgaggacaccuucugcaacgucaagaaccucaccuacauccgcaaggcccucgaggacauccgccucgacggcaaccccaucaaccucuccaagaccccccaggccuacaugugccucccccgccuccccgucggcucccucgucuga

SEQ ID NO: 42794 - RNA, 1314 nt, Artificial Sequence
  derived and/or modified sequence opt2 from ERAL1__Homo_sapiens__NP_005693
auggccgcccccuccuggcgcggcgcccgccucguccaguccguccuccgcgucuggcaggucggcccccacgucgcccgcgagcgcgucauccccuucuccucccuccucggcuuccagcgccgcugcgucuccugcgucgccggcuccgccuucuccggcccccgccucgccuccgccucccgcuccaacggccagggcuccgcccucgaccacuuccucggcuucucccagcccgacuccuccgucacccccugcguccccgccgucuccaugaaccgcgacgagcaggacguccuccucguccaccaccccgacaugcccgagaacucccgcguccuccgcgucguccuccucggcgcccccaacgccggcaaguccacccucuccaaccagcuccucggccgcaaggucuuccccgucucccgcaagguccacaccacccgcugccaggcccucggcgucaucaccgagaaggagacccaggucauccuccucgacacccccggcaucaucucccccggcaagcagaagcgccaccaccucgagcucucccuccucgaggaccccuggaaguccauggaguccgccgaccucgucgucguccucgucgacgucuccgacaaguggacccgcaaccagcucuccccccagcuccuccgcugccucaccaaguacucccagauccccuccguccucgucaugaacaaggucgacugccucaagcagaaguccguccuccucgagcucaccgccgcccucaccgagggcgucgucaacggcaagaagcucaagaugcgccaggccuuccacucccaccccggcacccacugccccucccccgccgucaaggaccccaacacccaguccgucggcaacccccagcgcaucggcuggccccacuucaaggagaucuucaugcucuccgcccucucccaggaggacgucaagacccucaagcaguaccuccucacccaggcccagcccggccccugggaguaccacuccgccguccucaccucccagacccccgaggagaucugcgccaacaucauccgcgagaagcuccucgagcaccucccccaggagguccccuacaacguccagcagaagaccgccgucugggaggagggccccggcggcgagcucgucauccagcagaagcuccucguccccaaggaguccuacgucaagcuccucaucggccccaagggccacgucaucucccagaucgcccaggaggccggccacgaccucauggacaucuuccucugcgacgucgacauccgccucuccgucaagcuccucaaguga

SEQ ID NO: 42795 - RNA, 2826 nt, Artificial Sequence
  derived and/or modified sequence opt2 from ERAP1__Homo_sapiens__NP_001185470
auggucuuccucccccucaaguggucccucgccaccauguccuuccuccucuccucccuccucgcccuccucaccgucuccacccccuccuggugccaguccaccgaggccucccccaagcgcuccgacggcacccccuuccccuggaacaagauccgccuccccgaguacgucauccccguccacuacgaccuccucauccacgccaaccucaccacccucaccuucuggggcaccaccaaggucgagaucaccgccucccagcccaccuccaccaucauccuccacucccaccaccuccagaucucccgcgccacccuccgcaagggcgccggcgagcgccucuccgaggagccccuccagguccucgagcacccccgccaggagcagaucgcccuccucgcccccgagccccuccucgucggccuccccuacaccgucgucauccacuacgccggcaaccucuccgagaccuuccacggcuucuacaaguccaccuaccgcaccaaggagggcgagcuccgcauccucgccuccacccaguucgagcccaccgccgcccgcauggccuuccccugcuucgacgagcccgccuucaaggccuccuucuccaucaagauccgccgcgagccccgccaccucgccaucuccaacaugccccucgucaaguccgucaccgucgccgagggccucaucgaggaccacuucgacgucaccgucaagauguccaccuaccucgucgccuucaucaucuccgacuucgaguccgucuccaagaucaccaaguccggcgucaaggucuccgucuacgccguccccgacaagaucaaccaggccgacuacgcccucgacgccgccgucacccuccucgaguucuacgaggacuacuucuccauccccuacccccuccccaagcaggaccucgccgccauccccgacuuccaguccggcgccauggagaacuggggccucaccaccuaccgcgaguccgcccuccucuucgacgccgagaaguccuccgccuccuccaagcucggcaucaccaugaccgucgcccacgagcucgcccaccagugguucggcaaccucgucaccauggagugguggaacgaccucuggcucaacgagggcuucgccaaguucauggaguucgucuccgucuccgucacccaccccgagcucaaggucggcgacuacuucuucggcaagugcuucgacgccauggaggucgacgcccucaacuccucccaccccgucuccacccccgucgagaaccccgcccagauccgcgagauguucgacgacgucuccuacgacaagggcgccugcauccucaacaugcuccgcgaguaccucuccgccgacgccuucaaguccggcaucguccaguaccuccagaagcacuccuacaagaacaccaagaacgaggaccucugggacuccauggccuccaucugccccaccgacggcgucaagggcauggacggcuucugcucccgcucccagcacuccuccuccuccucccacuggcaccaggagggcgucgacgucaagaccaugaugaacaccuggacccuccagaagggcuucccccucaucaccaucaccguccgcggccgcaacguccacaugaagcaggagcacuacaugaagggcuccgacggcgcccccgacaccggcuaccucuggcacgucccccucaccuucaucaccuccaaguccgacaugguccaccgcuuccuccucaagaccaagaccgacguccucauccuccccgaggaggucgaguggaucaaguucaacgucggcaugaacggcuacuacaucguccacuacgaggacgacggcugggacucccucaccggccuccucaagggcacccacaccgccgucuccuccaacgaccgcgccucccucaucaacaacgccuuccagcucgucuccaucggcaagcucuccaucgagaaggcccucgaccucucccucuaccucaagcacgagaccgagaucaugcccgucuuccagggccucaacgagcucauccccauguacaagcucauggagaagcgcgacaugaacgaggucgagacccaguucaaggccuuccucauccgccuccuccgcgaccucaucgacaagcagaccuggaccgacgagggcuccgucuccgagcgcaugcuccgcucccagcuccuccuccucgccugcguccacaacuaccagcccugcguccagcgcgccgagggcuacuuccgcaaguggaaggaguccaacggcaaccucucccuccccgucgacgucacccucgccgucuucgccgucggcgcccaguccaccgagggcugggacuuccucuacuccaaguaccaguucucccucuccuccaccgagaagucccagaucgaguucgcccucugccgcacccagaacaaggagaagcuccaguggcuccucgacgaguccuucaagggcgacaagaucaagacccaggaguucccccagauccucacccucaucggccgcaaccccgucggcuacccccucgccuggcaguuccuccgcaagaacuggaacaagcucguccagaaguucgagcucggcuccuccuccaucgcccacauggucaugggcaccaccaaccaguucuccacccgcacccgccucgaggaggucaagggcuucuucuccucccucaaggagaacggcucccagcuccgcugcguccagcagaccaucgagaccaucgaggagaacaucggcuggauggacaagaacuucgacaagauccgcgucuggcuccaguccgagaagcucgagcgcauguga

SEQ ID NO: 42796 - RNA, 2883 nt, Artificial Sequence
  derived and/or modified sequence opt2 from ERAP2__Homo_sapiens__NP_001123612
auguuccacuccuccgccauggucaacucccaccgcaagcccauguucaacauccaccgcggcuucuacugccucaccgccauccucccccagaucugcaucugcucccaguucuccguccccuccuccuaccacuucaccgaggaccccggcgccuuccccgucgccaccaacggcgagcgcuuccccuggcaggagcuccgccuccccuccgucgucaucccccuccacuacgaccucuucguccaccccaaccucaccucccucgacuucgucgccuccgagaagaucgagguccucgucuccaacgccacccaguucaucauccuccacuccaaggaccucgagaucaccaacgccacccuccaguccgaggaggacucccgcuacaugaagcccggcaaggagcucaagguccucuccuaccccgcccacgagcagaucgcccuccucguccccgagaagcucaccccccaccucaaguacuacgucgccauggacuuccaggccaagcucggcgacggcuucgagggcuucuacaaguccaccuaccgcacccucggcggcgagacccgcauccucgccgucaccgacuucgagcccacccaggcccgcauggccuuccccugcuucgacgagccccucuucaaggccaacuucuccaucaagauccgccgcgagucccgccacaucgcccucuccaacaugcccaaggucaagaccaucgagcucgagggcggccuccucgaggaccacuucgagaccaccgucaagauguccaccuaccucgucgccuacaucgucugcgacuuccacucccucuccggcuucaccuccuccggcgucaaggucuccaucuacgccucccccgacaagcgcaaccagacccacuacgcccuccaggccucccucaagcuccucgacuucuacgagaaguacuucgacaucuacuacccccucuccaagcucgaccucaucgccauccccgacuucgcccccggcgccauggagaacuggggccucaucaccuaccgcgagaccucccuccucuucgaccccaagaccuccuccgccuccgacaagcucugggucacccgcgucaucgcccacgagcucgcccaccagugguucggcaaccucgucaccauggagugguggaacgacaucuggcucaaggagggcuucgccaaguacauggagcucaucgccgucaacgccaccuaccccgagcuccaguucgacgacuacuuccucaacgucugcuucgaggucaucaccaaggacucccucaacuccucccgccccaucuccaagcccgccgagacccccacccagauccaggagauguucgacgaggucuccuacaacaagggcgccugcauccucaacaugcucaaggacuuccucggcgaggagaaguuccagaagggcaucauccaguaccucaagaaguucuccuaccgcaacgccaagaacgacgaccucugguccucccucuccaacuccugccucgaguccgacuucaccuccggcggcgucugccacuccgaccccaagaugaccuccaacaugcucgccuuccucggcgagaacgccgaggucaaggagaugaugaccaccuggacccuccagaagggcaucccccuccucgucgucaagcaggacggcugcucccuccgccuccagcaggagcgcuuccuccagggcgucuuccaggaggaccccgaguggcgcgcccuccaggagcgcuaccucuggcacaucccccucaccuacuccaccuccuccuccaacgucauccaccgccacauccucaaguccaagaccgacacccucgaccuccccgagaagaccuccugggucaaguucaacgucgacuccaacggcuacuacaucguccacuacgagggccacggcugggaccagcucaucacccagcucaaccagaaccacacccuccuccgccccaaggaccgcgucggccucauccacgacgucuuccagcucgucggcgccggccgccucacccucgacaaggcccucgacaugaccuacuaccuccagcacgagaccuccucccccgcccuccucgagggccucuccuaccucgaguccuucuaccacaugauggaccgccgcaacaucuccgacaucuccgagaaccucaagcgcuaccuccuccaguacuucaagcccgucaucgaccgccaguccugguccgacaagggcuccgucugggaccgcaugcuccgcuccgcccuccucaagcucgccugcgaccucaaccacgcccccugcauccagaaggccgccgagcucuucucccaguggauggaguccuccggcaagcucaacauccccaccgacguccucaagaucgucuacuccgucggcgcccagaccaccgccggcuggaacuaccuccucgagcaguacgagcucuccauguccuccgccgagcagaacaagauccucuacgcccucuccaccuccaagcaccaggagaagcuccucaagcucaucgagcucggcauggagggcaaggucaucaagacccagaaccucgccgcccuccuccacgccaucgcccgccgccccaagggccagcagcucgccugggacuucguccgcgagaacuggacccaccuccucaagaaguucgaccucggcuccuacgacauccgcaugaucaucuccggcaccaccgcccacuucuccuccaaggacaagcuccaggaggucaagcucuucuucgagucccucgaggcccagggcucccaccucgacaucuuccagaccguccucgagaccaucaccaagaacaucaaguggcucgagaagaaccuccccacccuccgcaccuggcucauggucaacaccuga

SEQ ID NO: 42797 - RNA, 702 nt, Artificial Sequence
  derived and/or modified sequence opt2 from ERAS__Homo_sapiens__NP_853510
auggagcuccccaccaagcccggcaccuucgaccucggccucgccaccuggucccccuccuuccagggcgagacccaccgcgcccaggcccgccgccgcgacgucggccgccagcuccccgaguacaaggccgucgucgucggcgccuccggcgucggcaaguccgcccucaccauccagcucaaccaccagugcuucgucgaggaccacgaccccaccauccaggacuccuacuggaaggagcucacccucgacuccggcgacugcauccucaacguccucgacaccgccggccaggccauccaccgcgcccuccgcgaccagugccucgccgucugcgacggcguccucggcgucuucgcccucgacgaccccuccucccucauccagcuccagcagaucugggccaccuggggcccccaccccgcccagccccucguccucgucggcaacaagugcgaccucgucaccaccgccggcgacgcccacgccgccgccgccgcccucgcccacuccuggggcgcccacuucgucgagaccuccgccaagacccgccagggcgucgaggaggccuucucccuccucguccacgagauccagcgcguccaggaggccauggccaaggagcccauggcccgcuccugccgcgagaagacccgccaccagaaggccaccugccacugcggcugcuccgucgccuga

SEQ ID NO: 42798 - RNA, 3678 nt, Artificial Sequence
  derived and/or modified sequence opt2 from ERBB2__Homo_sapiens__NP_001005862
augaagcuccgccuccccgccucccccgagacccaccucgacaugcuccgccaccucuaccagggcugccaggucguccagggcaaccucgagcucaccuaccuccccaccaacgccucccucuccuuccuccaggacauccaggagguccagggcuacguccucaucgcccacaaccagguccgccaggucccccuccagcgccuccgcaucguccgcggcacccagcucuucgaggacaacuacgcccucgccguccucgacaacggcgacccccucaacaacaccacccccgucaccggcgccucccccggcggccuccgcgagcuccagcuccgcucccucaccgagauccucaagggcggcguccucauccagcgcaacccccagcucugcuaccaggacaccauccucuggaaggacaucuuccacaagaacaaccagcucgcccucacccucaucgacaccaaccgcucccgcgccugccaccccugcucccccaugugcaagggcucccgcugcuggggcgaguccuccgaggacugccagucccucacccgcaccgucugcgccggcggcugcgcccgcugcaagggcccccuccccaccgacugcugccacgagcagugcgccgccggcugcaccggccccaagcacuccgacugccucgccugccuccacuucaaccacuccggcaucugcgagcuccacugccccgcccucgucaccuacaacaccgacaccuucgaguccaugcccaaccccgagggccgcuacaccuucggcgccuccugcgucaccgccugccccuacaacuaccucuccaccgacgucggcuccugcacccucgucugcccccuccacaaccaggaggucaccgccgaggacggcacccagcgcugcgagaagugcuccaagcccugcgcccgcgucugcuacggccucggcauggagcaccuccgcgagguccgcgccgucaccuccgccaacauccaggaguucgccggcugcaagaagaucuucggcucccucgccuuccuccccgaguccuucgacggcgaccccgccuccaacaccgccccccuccagcccgagcagcuccaggucuucgagacccucgaggagaucaccggcuaccucuacaucuccgccuggcccgacucccuccccgaccucuccgucuuccagaaccuccaggucauccgcggccgcauccuccacaacggcgccuacucccucacccuccagggccucggcaucuccuggcucggccuccgcucccuccgcgagcucggcuccggccucgcccucauccaccacaacacccaccucugcuucguccacaccguccccugggaccagcucuuccgcaacccccaccaggcccuccuccacaccgccaaccgccccgaggacgagugcgucggcgagggccucgccugccaccagcucugcgcccgcggccacugcuggggccccggccccacccagugcgucaacugcucccaguuccuccgcggccaggagugcgucgaggagugccgcguccuccagggccucccccgcgaguacgucaacgcccgccacugccuccccugccaccccgagugccagccccagaacggcuccgucaccugcuucggccccgaggccgaccagugcgucgccugcgcccacuacaaggacccccccuucugcgucgcccgcugccccuccggcgucaagcccgaccucuccuacaugcccaucuggaaguuccccgacgaggagggcgccugccagcccugccccaucaacugcacccacuccugcgucgaccucgacgacaagggcugccccgccgagcagcgcgccuccccccucaccuccaucaucuccgccgucgucggcauccuccucgucgucguccucggcgucgucuucggcauccucaucaagcgccgccagcagaagauccgcaaguacaccaugcgccgccuccuccaggagaccgagcucgucgagccccucacccccuccggcgccaugcccaaccaggcccagaugcgcauccucaaggagaccgagcuccgcaaggucaagguccucggcuccggcgccuucggcaccgucuacaagggcaucuggauccccgacggcgagaacgucaagauccccgucgccaucaagguccuccgcgagaacaccucccccaaggccaacaaggagauccucgacgaggccuacgucauggccggcgucggcucccccuacgucucccgccuccucggcaucugccucaccuccaccguccagcucgucacccagcucaugcccuacggcugccuccucgaccacguccgcgagaaccgcggccgccucggcucccaggaccuccucaacuggugcaugcagaucgccaagggcauguccuaccucgaggacguccgccucguccaccgcgaccucgccgcccgcaacguccucgucaagucccccaaccacgucaagaucaccgacuucggccucgcccgccuccucgacaucgacgagaccgaguaccacgccgacggcggcaagguccccaucaaguggauggcccucgaguccauccuccgccgccgcuucacccaccaguccgacgucugguccuacggcgucaccgucugggagcucaugaccuucggcgccaagcccuacgacggcauccccgcccgcgagauccccgaccuccucgagaagggcgagcgccucccccagccccccaucugcaccaucgacgucuacaugaucauggucaagugcuggaugaucgacuccgagugccgcccccgcuuccgcgagcucgucuccgaguucucccgcauggcccgcgacccccagcgcuucgucgucauccagaacgaggaccucggccccgccuccccccucgacuccaccuucuaccgcucccuccucgaggacgacgacaugggcgaccucgucgacgccgaggaguaccucgucccccagcagggcuucuucugccccgaccccgcccccggcgccggcggcaugguccaccaccgccaccgcuccuccuccacccgcuccggcggcggcgaccucacccucggccucgagcccuccgaggaggaggccccccgcuccccccucgcccccuccgagggcgccggcuccgacgucuucgacggcgaccucggcaugggcgccgccaagggccuccagucccuccccacccacgaccccuccccccuccagcgcuacuccgaggaccccaccgucccccuccccuccgagaccgacggcuacgucgccccccucaccugcuccccccagcccgaguacgucaaccagcccgacguccgcccccagccccccuccccccgcgagggcccccuccccgccgcccgccccgccggcgccacccucgagcgccccaagacccucucccccggcaagaacggcgucgucaaggacgucuucgccuucggcggcgccgucgagaaccccgaguaccucaccccccagggcggcgccgccccccagccccaccccccccccgccuucucccccgccuucgacaaccucuacuacugggaccaggacccccccgagcgcggcgccccccccuccaccuucaagggcacccccaccgccgagaaccccgaguaccucggccucgacguccccgucuga

SEQ ID NO: 42799 - RNA, 3909 nt, Artificial Sequence
  derived and/or modified sequence opt2 from ERBB2IP__Homo_sapiens__NP_001006600
augaccaccaagcgcucccucuucguccgccucguccccugccgcugccuccgcggcgaggaggagaccgucaccacccucgacuacucccacugcucccucgagcagguccccaaggagaucuucaccuucgagaagacccucgaggagcucuaccucgacgccaaccagaucgaggagcuccccaagcagcucuucaacugccagucccuccacaagcucucccuccccgacaacgaccucaccacccuccccgccuccaucgccaaccucaucaaccuccgcgagcucgacgucuccaagaacggcauccaggaguuccccgagaacaucaagaacugcaagguccucaccaucgucgaggccuccgucaaccccaucuccaagcuccccgacggcuucucccagcuccucaaccucacccagcucuaccucaacgacgccuuccucgaguuccuccccgccaacuucggccgccucaccaagcuccagauccucgagcuccgcgagaaccagcucaagaugcuccccaagaccaugaaccgccucacccagcucgagcgccucgaccucggcuccaacgaguucaccgagguccccgagguccucgagcagcucuccggccucaaggaguucuggauggacgccaaccgccucaccuucauccccggcuucaucggcucccucaagcagcucaccuaccucgacgucuccaagaacaacaucgagauggucgaggagggcaucuccaccugcgagaaccuccaggaccuccuccucuccuccaacucccuccagcagcuccccgagaccaucggcucccucaagaacaucaccacccucaagaucgacgagaaccagcucauguaccuccccgacuccaucggcggccucaucuccgucgaggagcucgacugcuccuucaacgaggucgaggcccuccccuccuccaucggccagcucaccaaccuccgcaccuucgccgccgaccacaacuaccuccagcagcucccccccgagaucggcuccuggaagaacaucaccguccucuuccuccacuccaacaagcucgagacccuccccgaggagaugggcgacaugcagaagcucaaggucaucaaccucuccgacaaccgccucaagaaccuccccuucuccuucaccaagcuccagcagcucaccgccauguggcucuccgacaaccaguccaagccccucaucccccuccagaaggagaccgacuccgagacccagaagaugguccucaccaacuacauguucccccagcagccccgcaccgaggacgucauguucaucuccgacaacgaguccuucaaccccucccucugggaggagcagcgcaagcagcgcgcccaggucgccuucgagugcgacgaggacaaggacgagcgcgaggcccccccccgcgagggcaaccucaagcgcuaccccacccccuaccccgacgagcucaagaacauggucaagaccguccagaccaucguccaccgccucaaggacgaggagaccaacgaggacuccggccgcgaccucaagccccacgaggaccagcaggacaucaacaaggacgucggcgucaagaccuccgaguccaccaccaccgucaaguccaaggucgacgagcgcgagaaguacaugaucggcaacuccguccagaagaucuccgagcccgaggccgagaucucccccggcucccuccccgucaccgccaacaugaaggccuccgagaaccucaagcacaucgucaaccacgacgacgucuucgaggaguccgaggagcucuccuccgacgaggagaugaagauggccgagaugcgccccccccucaucgagaccuccaucaaccagcccaaggucgucgcccucuccaacaacaagaaggacgacaccaaggagaccgacucccucuccgacgaggucacccacaacuccaaccagaacaacuccaacugcuccucccccucccgcauguccgacuccgucucccucaacaccgacuccucccaggacaccucccucugcucccccgucaagcagacccacaucgacaucaacuccaagauccgccaggaggacgagaacuucaacucccuccuccagaacggcgacauccucaacuccuccaccgaggagaaguucaaggcccacgacaagaaggacuucaaccuccccgaguacgaccucaacgucgaggagcgccucguccucaucgagaaguccgucgacuccaccgccaccgccgacgacacccacaagcucgaccacaucaacaugaaccucaacaagcucaucaccaacgacaccuuccagcccgagaucauggagcgcuccaagacccaggacaucguccucggcaccuccuuccucuccaucaacuccaaggaggagaccgagcaccucgagaacggcaacaaguaccccaaccucgaguccgucaacaaggucaacggccacuccgaggagaccucccagucccccaaccgcaccgagccccacgacuccgacugcuccgucgaccucggcaucuccaaguccaccgaggaccucuccccccagaaguccggccccgucggcuccgucgucaagucccacuccaucaccaacauggagaucggcggccucaagaucuacgacauccucuccgacaacggcccccagcagcccuccaccaccgucaagaucaccuccgccgucgacggcaagaacaucguccgcuccaaguccgccacccuccucuacgaccagccccuccaggucuucaccggcuccuccuccuccuccgaccucaucuccggcaccaaggccaucuucaaguucgacuccaaccacaaccccgaggagcccaacaucauccgcggccccaccuccggcccccaguccgccccccagaucuacggccccccccaguacaacauccaguacuccuccuccgccgccgucaaggacacccucuggcacuccaagcagaacccccagaucgaccacgccuccuuccccccccagcuccucccccgcuccgaguccaccgagaaccaguccuacgccaagcacuccgccaacaugaacuucuccaaccacaacaacguccgcgccaacaccgccuaccaccuccaccagcgccucggccccgcccgccacggcgagaugugggccaucucccccaacgaccgccucauccccgccgucacccgcuccaccauccagcgccaguccuccgucuccuccaccgccuccgucaaccucggcgaccccggcuccacccgccgcgcccagauccccgagggcgacuaccucuccuaccgcgaguuccacuccgccggccgcaccccccccaugaugcccggcucccagcgcccccucuccgcccgcaccuacuccaucgacggccccaacgccucccgcccccaguccgcccgccccuccaucaacgagauccccgagcgcaccauguccgucuccgacuucaacuacucccgcaccucccccuccaagcgccccaacgcccgcgucggcuccgagcacucccuccucgacccccccggcaaguccaaggucccccgcgacuggcgcgagcagguccuccgccacaucgaggccaagaagcucgagaagauccgcguccgcgucgagaaggaccccgagcucggcuucuccaucuccggcggcgucggcggccgcggcaaccccuuccgccccgacgacgacggcaucuucgucacccgcguccagcccgagggccccgccuccaagcuccuccagcccggcgacaagaucauccaggccaacggcuacuccuucaucaacaucgagcacggccaggccgucucccuccucaagaccuuccagaacaccgucgagcucaucaucguccgcgaggucuccuccuga

SEQ ID NO: 42800 - RNA, 552 nt, Artificial Sequence
  derived and/or modified sequence opt2 from ERBB3__Homo_sapiens__NP_001005915
augcgcgccaacgacgcccuccagguccucggccuccucuucucccucgcccgcggcuccgaggucggcaacucccaggccgucugccccggcacccucaacggccucuccgucaccggcgacgccgagaaccaguaccagacccucuacaagcucuacgagcgcugcgaggucgucaugggcaaccucgagaucguccucaccggccacaacgccgaccucuccuuccuccaguggauccgcgaggucaccggcuacguccucgucgccaugaacgaguucuccacccucccccuccccaaccuccgcgucguccgcggcacccaggucuacgacggcaaguucgccaucuucgucaugcucaacuacaacaccaacuccucccacgcccuccgccagcuccgccucacccagcucaccggccaguuccccaugguccccuccggccucaccccccagcccgcccaggacugguaccuccucgacgacgacccccgccuccucacccucuccgccuccuccaagguccccgucacccucgccgccgucuga

SEQ ID NO: 42801 - RNA, 3879 nt, Artificial Sequence
  derived and/or modified sequence opt2 from ERBB4__Homo_sapiens__NP_001036064
augaagcccgccaccggccucugggucugggucucccuccucgucgccgccggcaccguccagcccuccgacucccaguccgucugcgccggcaccgagaacaagcucuccucccucuccgaccucgagcagcaguaccgcgcccuccgcaaguacuacgagaacugcgaggucgucaugggcaaccucgagaucaccuccaucgagcacaaccgcgaccucuccuuccuccgcuccguccgcgaggucaccggcuacguccucgucgcccucaaccaguuccgcuaccucccccucgagaaccuccgcaucauccgcggcaccaagcucuacgaggaccgcuacgcccucgccaucuuccucaacuaccgcaaggacggcaacuucggccuccaggagcucggccucaagaaccucaccgagauccucaacggcggcgucuacgucgaccagaacaaguuccucugcuacgccgacaccauccacuggcaggacaucguccgcaaccccuggcccuccaaccucacccucgucuccaccaacggcuccuccggcugcggccgcugccacaaguccugcaccggccgcugcuggggccccaccgagaaccacugccagacccucacccgcaccgucugcgccgagcagugcgacggccgcugcuacggccccuacgucuccgacugcugccaccgcgagugcgccggcggcugcuccggccccaaggacaccgacugcuucgccugcaugaacuucaacgacuccggcgccugcgucacccagugcccccagaccuucgucuacaaccccaccaccuuccagcucgagcacaacuucaacgccaaguacaccuacggcgccuucugcgucaagaagugcccccacaacuucgucgucgacuccuccuccugcguccgcgccugccccuccuccaagauggaggucgaggagaacggcaucaagaugugcaagcccugcaccgacaucugccccaaggccugcgacggcaucggcaccggcucccucauguccgcccagaccgucgacuccuccaacaucgacaaguucaucaacugcaccaagaucaacggcaaccucaucuuccucgucaccggcauccacggcgaccccuacaacgccaucgaggccaucgaccccgagaagcucaacgucuuccgcaccguccgcgagaucaccggcuuccucaacauccaguccuggccccccaacaugaccgacuucuccgucuucuccaaccucgucaccaucggcggccgcguccucuacuccggccucucccuccucauccucaagcagcagggcaucaccucccuccaguuccagucccucaaggagaucuccgccggcaacaucuacaucaccgacaacuccaaccucugcuacuaccacaccaucaacuggaccacccucuucuccaccaucaaccagcgcaucgucauccgcgacaaccgcaaggccgagaacugcaccgccgagggcauggucugcaaccaccucugcuccuccgacggcugcuggggccccggccccgaccagugccucuccugccgccgcuucucccgcggccgcaucugcaucgaguccugcaaccucuacgacggcgaguuccgcgaguucgagaacggcuccaucugcgucgagugcgacccccagugcgagaagauggaggacggccuccucaccugccacggccccggccccgacaacugcaccaagugcucccacuucaaggacggccccaacugcgucgagaagugccccgacggccuccagggcgccaacuccuucaucuucaaguacgccgaccccgaccgcgagugccaccccugccaccccaacugcacccagggcugcaacggccccaccucccacgacugcaucuacuaccccuggaccggccacuccacccucccccagcacgcccgcaccccccucaucgccgccggcgucaucggcggccucuucauccucgucaucgucggccucaccuucgccgucuacguccgccgcaaguccaucaagaagaagcgcgcccuccgccgcuuccucgagaccgagcucgucgagccccucacccccuccggcaccgcccccaaccaggcccagcuccgcauccucaaggagaccgagcucaagcgcgucaagguccucggcuccggcgccuucggcaccgucuacaagggcaucuggguccccgagggcgagaccgucaagauccccgucgccaucaagauccucaacgagaccaccggccccaaggccaacgucgaguucauggacgaggcccucaucauggccuccauggaccacccccaccucguccgccuccucggcgucugccucucccccaccauccagcucgucacccagcucaugccccacggcugccuccucgaguacguccacgagcacaaggacaacaucggcucccagcuccuccucaacuggugcguccagaucgccaagggcaugauguaccucgaggagcgccgccucguccaccgcgaccucgccgcccgcaacguccucgucaagucccccaaccacgucaagaucaccgacuucggccucgcccgccuccucgagggcgacgagaaggaguacaacgccgacggcggcaagaugcccaucaaguggauggcccucgagugcauccacuaccgcaaguucacccaccaguccgacgucugguccuacggcgucaccaucugggagcucaugaccuucggcggcaagcccuacgacggcauccccacccgcgagauccccgaccuccucgagaagggcgagcgccucccccagccccccaucugcaccaucgacgucuacauggucauggucaagugcuggaugaucgacgccgacucccgccccaaguucaaggagcucgccgccgaguucucccgcauggcccgcgacccccagcgcuaccucgucauccagggcgacgaccgcaugaagcuccccucccccaacgacuccaaguucuuccagaaccuccucgacgaggaggaccucgaggacaugauggacgccgaggaguaccucgucccccaggccuucaacauccccccccccaucuacaccucccgcgcccgcaucgacuccaaccgcaaccaguucgucuaccgcgacggcggcuucgccgccgagcagggcgucuccguccccuaccgcgcccccaccuccaccauccccgaggcccccgucgcccagggcgccaccgccgagaucuucgacgacuccugcugcaacggcacccuccgcaagcccgucgccccccacguccaggaggacuccuccacccagcgcuacuccgccgaccccaccgucuucgcccccgagcgcuccccccgcggcgagcucgacgaggagggcuacaugacccccaugcgcgacaagcccaagcaggaguaccucaaccccgucgaggagaaccccuucgucucccgccgcaagaacggcgaccuccaggcccucgacaaccccgaguaccacaacgccuccaacggcccccccaaggccgaggacgaguacgucaacgagccccucuaccucaacaccuucgccaacacccucggcaaggccgaguaccucaagaacaacauccucuccaugcccgagaaggccaagaaggccuucgacaaccccgacuacuggaaccacucccuccccccccgcuccacccuccagcaccccgacuaccuccaggaguacuccaccaaguacuucuacaagcagaacggccgcauccgccccaucgucgccgagaaccccgaguaccucuccgaguucucccucaagcccggcaccguccucccccccccccccuaccgccaccgcaacaccgucgucuga

SEQ ID NO: 42802 - RNA, 3456 nt, Artificial Sequence
  derived and/or modified sequence opt2 from ERC1__Homo_sapiens__XP_011519238
auguacggcuccgcccgcuccgucggcaaggucgagcccuccucccagucccccggccgcuccccccgccucccccgcuccccccgccucggccaccgccgcaccaacuccaccggcggcuccuccggcuccuccgucggcggcggcuccggcaagacccucuccauggagaacauccagucccucaacgccgccuacgccaccuccggccccauguaccucuccgaccacgagaacgucggcuccgagacccccaaguccaccaugacccucggccgcuccggcggccgccuccccuacggcguccgcaugaccgccaugggcuccucccccaacaucgccuccuccggcgucgccuccgacaccaucgccuucggcgagcaccaccucccccccgucuccauggccuccaccgucccccacucccuccgccaggcccgcgacaacaccaucauggaccuccagacccagcucaaggagguccuccgcgagaacgaccuccuccgcaaggacgucgaggucaaggaguccaagcucuccuccuccaugaacuccaucaagaccuucuggucccccgagcucaagaaggagcgcgcccuccgcaaggacgaggccuccaagaucaccaucuggaaggagcaguaccgcgucguccaggaggagaaccagcacaugcagaugaccauccaggcccuccaggacgagcuccgcauccagcgcgaccucaaccagcucuuccagcaggacuccuccucccgcaccggcgagcccugcgucgccgagcucaccgaggagaacuuccagcgccuccacgccgagcacgagcgccaggccaaggagcucuuccuccuccgcaagacccucgaggagauggagcuccgcaucgagacccagaagcagacccucaacgcccgcgacgaguccaucaagaagcuccucgagaugcuccaguccaagggccucuccgccaaggccaccgaggaggaccacgagcgcacccgccgccucgccgaggccgagaugcacguccaccaccucgagucccuccucgagcagaaggagaaggagaacuccaugcuccgcgaggagaugcaccgccgcuucgagaacgcccccgacuccgccaagaccaaggcccuccagaccgucaucgagaugaaggacuccaagaucuccuccauggagcgcggccuccgcgaccucgaggaggagauccagaugcucaaguccaacggcgcccucuccaccgaggagcgcgaggaggagaugaagcagauggaggucuaccgcucccacuccaaguucaugaagaacaagaucggccaggucaagcaggagcucucccgcaaggacaccgagcuccucgcccuccagaccaagcucgagacccucaccaaccaguucuccgacuccaagcagcacaucgagguccucaaggagucccucaccgccaaggagcagcgcgccgccauccuccagaccgaggucgacgcccuccgccuccgccucgaggagaaggagaccaugcucaacaagaagaccaagcagauccaggacauggccgaggagaagggcacccaggccggcgagauccacgaccucaaggacaugcucgacgucaaggagcgcaaggucaacguccuccagaagaagaucgagaaccuccaggagcagcuccgcgacaaggagaagcagauguccucccucaaggagcgcgucaagucccuccaggccgacaccaccaacaccgacaccgcccucaccacccucgaggaggcccucgccgagaaggagcgcaccaucgagcgccucaaggagcagcgcgaccgcgacgagcgcgagaagcaggaggagaucgacaacuacaagaaggaccucaaggaccucaaggagaaggucucccuccuccagggcgaccucuccgagaaggaggccucccuccucgaccucaaggagcacgccuccucccucgccuccuccggccucaagaaggacucccgccucaagacccucgagaucgcccucgagcagaagaaggaggagugccucaagauggagucccagcucaagaaggcccacgaggccgcccucgaggcccgcgccucccccgagauguccgaccgcauccagcaccucgagcgcgagaucacccgcuacaaggacgaguccuccaaggcccaggccgaggucgaccgccuccucgagauccucaaggaggucgagaacgagaagaacgacaaggacaagaagaucgccgagcucgagucccucaccucccgccaggucaaggaccagaacaagaaggucgccaaccucaagcacaaggagcaggucgagaagaagaaguccgcccagaugcucgaggaggcccgccgccgcgaggacaaccucaacgacuccucccagcagcuccaggacucccuccgcaagaaggacgaccgcaucgaggagcucgaggaggcccuccgcgaguccguccagaucaccgccgagcgcgagaugguccucgcccaggaggaguccgcccgcaccaacgccgagaagcaggucgaggagcuccucauggccauggagaaggucaagcaggagcucgaguccaugaaggccaagcucuccuccacccagcagucccucgccgagaaggagacccaccucaccaaccuccgcgccgagcgccgcaagcaccucgaggagguccucgagaugaagcaggaggcccuccucgccgccaucuccgagaaggacgccaacaucgcccuccucgagcucuccuccuccaagaagaagacccaggaggaggucgccgcccucaagcgcgagaaggaccgccucguccagcagcucaagcagcagacccagaaccgcaugaagcucauggccgacaacuacgaggacgaccacuucaaguccucccacuccaaccagaccaaccacaagcccucccccgaccagaucauccagccccuccucgagcucgaccagaaccgcuccaagcucaagcucuacaucggccaccucaccacccucugccacgaccgcgacccccucauccuccgcggccucaccccccccgccuccuacaaccucgacgacgaccaggccgccugggagaacgagcuccagaagaugacccgcggccagaacaccccccacuuccucaagcccgccuccgccaaccucuggcccgacaaggacuuccagucccccuccguccaccuccuccuccaggacugcaccuccuccaagcacuccacccagaaggaguccgucgccucccagucccacggcaagaccgccuucuuccacgucaugcucaugcuccaggacgagcucgagaagggcgagcgcgacaacgccgagcuccaggaguucgccaacgccauccuccagcagaucgccgaccacugccccgacauccucgagcaggucgucaacgcccucgaggaguccuccuga

SEQ ID NO: 42803 - RNA, 2874 nt, Artificial Sequence
  derived and/or modified sequence opt2 from ERC2__Homo_sapiens__NP_056391
auguacggcuccgcccgcaccaucaccaaccucgagggcucccccucccgcuccccccgccucccccgcuccccccgccucggccaccgccgcaccuccuccggcggcggcggcggcaccggcaagacccucuccauggagaacauccagucccucaacgccgccuacgccaccuccggccccauguaccucuccgaccacgagggcgucgccuccaccaccuaccccaagggcaccaugacccucggccgcgccaccaaccgcgccgucuacggcggccgcgucaccgccaugggcuccucccccaacaucgccuccgccggccucucccacaccgacguccucuccuacaccgaccagcacggcggccucaccggcuccucccaccaccaccaccaccagguccccuccaugcuccgccagguccgcgacuccaccaugcucgaccuccaggcccagcucaaggagcuccagcgcgagaacgaccuccuccgcaaggagcucgacaucaaggacuccaagcucggcuccuccaugaacuccaucaagaccuucuggucccccgagcucaagaaggagcgcguccuccgcaaggaggaggccgcccgcauguccguccucaaggagcagaugcgcgucucccacgaggagaaccagcaccuccagcucaccauccaggcccuccaggacgagcuccgcacccagcgcgaccucaaccaccuccuccagcaggaguccggcaaccgcggcgccgagcacuucaccaucgagcucaccgaggagaacuuccgccgccuccaggccgagcacgaccgccaggccaaggagcucuuccuccuccgcaagacccucgaggagauggagcuccgcaucgagacccagaagcagacccucaacgcccgcgacgaguccaucaagaagcuccucgagaugcuccaguccaagggccuccccuccaagucccucgaggacgacaacgagcgcacccgccgcauggccgaggccgagucccaggucucccaccucgaggucauccucgaccagaaggagaaggagaacauccaccuccgcgaggagcuccaccgccgcucccagcuccagcccgagcccgccaagaccaaggcccuccagaccgucaucgagaugaaggacaccaagaucgccucccucgagcgcaacauccgcgaccucgaggacgagauccagaugcucaaggccaacggcguccucaacaccgaggaccgcgaggaggagaucaagcagaucgaggucuacaagucccacuccaaguucaugaagaccaagaucgaccagcucaagcaggagcucuccaagaaggaguccgagcuccucgcccuccagaccaagcucgagacccucuccaaccagaacuccgacugcaagcagcacaucgagguccucaaggagucccucaccgccaaggagcagcgcgccgccauccuccagaccgaggucgacgcccuccgccuccgccucgaggagaaggaguccuuccucaacaagaagaccaagcagcuccaggaccucaccgaggagaagggcacccucgccggcgagauccgcgacaugaaggacaugcucgaggucaaggagcgcaagaucaacguccuccagaagaagaucgagaaccuccaggagcagcuccgcgacaaggacaagcagcucaccaaccucaaggaccgcgucaagucccuccagaccgacuccuccaacaccgacaccgcccucgccacccucgaggaggcccucuccgagaaggagcgcaucaucgagcgccucaaggagcagcgcgagcgcgacgaccgcgagcgccucgaggagaucgaguccuuccgcaaggagaacaaggaccucaaggagaaggucaacgcccuccaggccgagcucaccgagaaggaguccucccucaucgaccucaaggagcacgccuccucccucgccuccgccggccucaagcgcgacuccaagcucaagucccucgagaucgccaucgagcagaagaaggaggagugcuccaagcucgaggcccagcucaagaaggcccacaacaucgaggacgacucccgcaugaaccccgaguucgccgaccagaucaagcagcucgacaaggaggccuccuacuaccgcgacgagugcggcaaggcccaggccgaggucgaccgccuccucgagauccucaaggaggucgagaacgagaagaacgacaaggacaagaagaucgccgagcucgagucccucacccuccgccacaugaaggaccagaacaagaaggucgccaaccucaagcacaaccagcagcucgagaagaagaagaacgcccagcuccucgaggagguccgccgccgcgaggacuccauggccgacaacucccagcaccuccagaucgaggagcucaugaacgcccucgagaagacccgccaggagcucgacgccaccaaggcccgccucgccuccacccagcagucccucgccgagaaggaggcccaccucgccaaccuccgcaucgagcgccgcaagcagcucgaggagauccucgagaugaagcaggaggcccuccucgccgccaucuccgagaaggacgccaacaucgcccuccucgagcucuccgccuccaagaagaagaagacccaggaggaggucauggcccucaagcgcgagaaggaccgccucguccaccagcucaagcagcagacccagaaccgcaugaagcucauggccgacaacuacgacgacgaccaccaccacuaccaccaccaccaccaccaccaccaccaccgcucccccggccgcucccagcacuccaaccaccgccccucccccgaccaggacgacgaggagggcaucugggccuga

SEQ ID NO: 42804 - RNA, 822 nt, Artificial Sequence
  derived and/or modified sequence opt2 from ERCC1__Homo_sapiens__NP_001159521
auggaccccggcaaggacaaggagggcgucccccagcccuccggcccccccgcccgcaagaaguucgucaucccccucgacgaggacgaggucccccccggcgucgccaagccccucuuccgcuccacccagucccuccccaccgucgacaccuccgcccaggccgccccccagaccuacgccgaguacgccaucucccagccccucgagggcgccggcgccaccugccccaccggcuccgagccccucgccggcgagacccccaaccaggcccucaagcccggcgccaaguccaacuccaucaucgucuccccccgccagcgcggcaaccccguccucaaguucguccgcaacguccccugggaguucggcgacgucauccccgacuacguccucggccaguccaccugcgcccucuuccucucccuccgcuaccacaaccuccaccccgacuacauccacggccgccuccagucccucggcaagaacuucgcccuccgcguccuccucguccaggucgacgucaaggacccccagcaggcccucaaggagcucgccaagaugugcauccucgccgacugcacccucauccucgccuggucccccgaggaggccggccgcuaccucgagaccuacaaggccuacgagcagaagcccgccgaccuccucauggagaagcucgagcaggacuucgucucccgcucccucgagcagcucaucgccgccucccgcgaggaccucgcccucugccccggccucggcccccagaaggcccgccgccucuucgacguccuccacgagcccuuccucaagguccccuga

SEQ ID NO: 42805 - RNA, 2283 nt, Artificial Sequence
  derived and/or modified sequence opt2 from ERCC2__Homo_sapiens__NP_000391
augaagcucaacgucgacggccuccucgucuacuuccccuacgacuacaucuaccccgagcaguucuccuacaugcgcgagcucaagcgcacccucgacgccaagggccacggcguccucgagaugcccuccggcaccggcaagaccgucucccuccucgcccucaucauggccuaccagcgcgccuacccccucgaggucaccaagcucaucuacugcucccgcaccguccccgagaucgagaaggucaucgaggagcuccgcaagcuccucaacuucuacgagaagcaggagggcgagaagcuccccuuccucggccucgcccucuccucccgcaagaaccucugcauccaccccgaggucaccccccuccgcuucggcaaggacgucgacggcaagugccacucccucaccgccuccuacguccgcgcccaguaccagcacgacaccucccucccccacugccgcuucuacgaggaguucgacgcccacggccgcgaggucccccuccccgccggcaucuacaaccucgacgaccucaaggcccucggccgccgccagggcuggugccccuacuuccucgcccgcuacuccauccuccacgccaacgucgucgucuacuccuaccacuaccuccucgaccccaagaucgccgaccucgucuccaaggagcucgcccgcaaggccgucgucgucuucgacgaggcccacaacaucgacaacgucugcaucgacuccauguccgucaaccucacccgccgcacccucgaccgcugccagggcaaccucgagacccuccagaagaccguccuccgcaucaaggagaccgacgagcagcgccuccgcgacgaguaccgccgccucgucgagggccuccgcgaggccuccgccgcccgcgagaccgacgcccaccucgccaaccccguccuccccgacgagguccuccaggaggccguccccggcuccauccgcaccgccgagcacuuccucggcuuccuccgccgccuccucgaguacgucaaguggcgccuccgcguccagcacgucguccaggaguccccccccgccuuccucuccggccucgcccagcgcgucugcauccagcgcaagccccuccgcuucugcgccgagcgccuccgcucccuccuccacacccucgagaucaccgaccucgccgacuucuccccccucacccuccucgccaacuucgccacccucgucuccaccuacgccaagggcuucaccaucaucaucgagcccuucgacgaccgcacccccaccaucgccaaccccauccuccacuucuccugcauggacgccucccucgccaucaagcccgucuucgagcgcuuccaguccgucaucaucaccuccggcacccucuccccccucgacaucuaccccaagauccucgacuuccaccccgucaccauggccaccuucaccaugacccucgcccgcgucugccucugccccaugaucaucggccgcggcaacgaccaggucgccaucuccuccaaguucgagacccgcgaggacaucgccgucauccgcaacuacggcaaccuccuccucgagauguccgccgucguccccgacggcaucgucgccuucuucaccuccuaccaguacauggaguccaccgucgccuccugguacgagcagggcauccucgagaacauccagcgcaacaagcuccucuucaucgagacccaggacggcgccgagaccuccgucgcccucgagaaguaccaggaggccugcgagaacggccgcggcgccauccuccucuccgucgcccgcggcaaggucuccgagggcaucgacuucguccaccacuacggccgcgccgucaucauguucggcguccccuacgucuacacccagucccgcauccucaaggcccgccucgaguaccuccgcgaccaguuccagauccgcgagaacgacuuccucaccuucgacgccaugcgccacgccgcccagugcgucggccgcgccauccgcggcaagaccgacuacggccucauggucuucgccgacaagcgcuucgcccgcggcgacaagcgcggcaagcucccccgcuggauccaggagcaccucaccgacgccaaccucaaccucaccgucgacgagggcguccaggucgccaaguacuuccuccgccagauggcccagcccuuccaccgcgaggaccagcucggccucucccuccucucccucgagcagcucgaguccgaggagacccucaagcgcaucgagcagaucgcccagcagcucuga

SEQ ID NO: 42806 - RNA, 2349 nt, Artificial Sequence
  derived and/or modified sequence opt2 from ERCC3__Homo_sapiens__NP_000113
augggcaagcgcgaccgcgccgaccgcgacaagaagaagucccgcaagcgccacuacgaggacgaggaggacgacgaggaggacgcccccggcaacgacccccaggaggccguccccuccgccgccggcaagcaggucgacgaguccggcaccaaggucgacgaguacggcgccaaggacuaccgccuccagaugccccucaaggacgaccacaccucccgcccccucugggucgcccccgacggccacaucuuccucgaggccuucucccccgucuacaaguacgcccaggacuuccucgucgccaucgccgagcccgucugccgccccacccacguccacgaguacaagcucaccgccuacucccucuacgccgccgucuccgucggccuccagaccuccgacaucaccgaguaccuccgcaagcucuccaagaccggcguccccgacggcaucaugcaguucaucaagcucugcaccgucuccuacggcaaggucaagcucguccucaagcacaaccgcuacuucgucgaguccugccaccccgacgucauccagcaccuccuccaggaccccgucauccgcgagugccgccuccgcaacuccgagggcgaggccaccgagcucaucaccgagaccuucaccuccaaguccgccaucuccaagaccgccgaguccuccggcggccccuccaccucccgcgucaccgacccccagggcaaguccgacauccccauggaccucuucgacuucuacgagcagauggacaaggacgaggaggaggaggaggagacccagaccgucuccuucgaggucaagcaggagaugaucgaggagcuccagaagcgcugcauccaccucgaguacccccuccucgccgaguacgacuuccgcaacgacuccgucaaccccgacaucaacaucgaccucaagcccaccgccguccuccgccccuaccaggagaagucccuccgcaagauguucggcaacggccgcgcccgcuccggcgucaucguccuccccugcggcgccggcaagucccucgucggcgucaccgccgccugcaccguccgcaagcgcugccucguccucggcaacuccgccgucuccgucgagcaguggaaggcccaguucaagaugugguccaccaucgacgacucccagaucugccgcuucaccuccgacgccaaggacaagcccaucggcugcuccgucgccaucuccaccuacuccaugcucggccacaccaccaagcgcuccugggaggccgagcgcgucauggaguggcucaagacccaggaguggggccucaugauccucgacgagguccacaccauccccgccaagauguuccgccgcguccucaccaucguccaggcccacugcaagcucggccucaccgccacccucguccgcgaggacgacaagaucgucgaccucaacuuccucaucggccccaagcucuacgaggccaacuggauggagcuccagaacaacggcuacaucgccaagguccagugcgccgaggucuggugccccaugucccccgaguucuaccgcgaguacgucgccaucaagaccaagaagcgcauccuccucuacaccaugaaccccaacaaguuccgcgccugccaguuccucaucaaguuccacgagcgccgcaacgacaagaucaucgucuucgccgacaacgucuucgcccucaaggaguacgccauccgccucaacaagcccuacaucuacggccccaccucccagggcgagcgcaugcagauccuccagaacuucaagcacaaccccaagaucaacaccaucuucaucuccaaggucggcgacaccuccuucgaccuccccgaggccaacguccucauccagaucuccucccacggcggcucccgccgccaggaggcccagcgccucggccgcguccuccgcgccaagaagggcauggucgccgaggaguacaacgccuucuucuacucccucgucucccaggacacccaggagauggccuacuccaccaagcgccagcgcuuccucgucgaccagggcuacuccuucaaggucaucaccaagcucgccggcauggaggaggaggaccucgccuucuccaccaaggaggagcagcagcagcuccuccagaagguccucgccgccaccgaccucgacgccgaggaggaggucgucgccggcgaguucggcucccgcuccucccaggccucccgccgcuucggcaccauguccuccauguccggcgccgacgacaccgucuacauggaguaccacuccucccgcuccaaggcccccuccaagcacguccacccccucuucaagcgcuuccgcaaguga

SEQ ID NO: 42807 - RNA, 2751 nt, Artificial Sequence
  derived and/or modified sequence opt2 from ERCC4__Homo_sapiens__NP_005227
auggaguccggccagcccgcccgccgcaucgccauggccccccuccucgaguacgagcgccagcucguccucgagcuccucgacaccgacggccucgucgucugcgcccgcggccucggcgccgaccgccuccucuaccacuuccuccagcuccacugccaccccgccugccucguccucguccucaacacccagcccgccgaggaggaguacuucaucaaccagcucaagaucgagggcgucgagcaccucccccgccgcgucaccaacgagaucaccuccaacucccgcuacgaggucuacacccagggcggcgucaucuucgccaccucccgcauccucgucgucgacuuccucaccgaccgcauccccuccgaccucaucaccggcauccucgucuaccgcgcccaccgcaucaucgaguccugccaggaggccuucauccuccgccucuuccgccagaagaacaagcgcggcuucaucaaggccuucaccgacaacgccgucgccuucgacaccggcuucugccacgucgagcgcgucaugcgcaaccucuucguccgcaagcucuaccucuggccccgcuuccacgucgccgucaacuccuuccucgagcagcacaagcccgaggucgucgagauccacgucuccaugacccccaccaugcucgccauccagaccgccauccucgacauccucaacgccugccucaaggagcucaagugccacaaccccucccucgaggucgaggaccucucccucgagaacgccaucggcaagcccuucgacaagaccauccgccacuaccucgacccccucuggcaccagcucggcgccaagaccaagucccucguccaggaccucaagauccuccgcacccuccuccaguaccucucccaguacgacugcgucaccuuccucaaccuccucgagucccuccgcgccaccgagaaggccuucggccagaacuccggcuggcucuuccucgacuccuccaccuccauguucaucaacgcccgcgcccgcgucuaccaccuccccgacgccaagauguccaagaaggagaagaucuccgagaagauggagaucaaggagggcgaggagaccaagaaggagcucguccucgaguccaaccccaagugggaggcccucaccgagguccucaaggagaucgaggccgagaacaaggaguccgaggcccucggcggccccggccagguccucaucugcgccuccgacgaccgcaccugcucccagcuccgcgacuacaucacccucggcgccgaggccuuccuccuccgccucuaccgcaagaccuucgagaaggacuccaaggccgaggaggucuggaugaaguuccgcaaggaggacuccuccaagcgcauccgcaagucccacaagcgccccaaggacccccagaacaaggagcgcgccuccaccaaggagcgcacccucaagaagaagaagcgcaagcucacccucacccagauggucggcaagcccgaggagcucgaggaggagggcgacgucgaggagggcuaccgccgcgagaucuccuccucccccgaguccugccccgaggagaucaagcacgaggaguucgacgucaaccucuccuccgacgccgccuucggcauccucaaggagccccucaccaucauccacccccuccucggcugcuccgaccccuacgcccucacccgcguccuccacgaggucgagccccgcuacgucguccucuacgacgccgagcucaccuucguccgccagcucgagaucuaccgcgccucccgccccggcaagccccuccgcgucuacuuccucaucuacggcggcuccaccgaggagcagcgcuaccucaccgcccuccgcaaggagaaggaggccuucgagaagcucauccgcgagaaggccuccauggucguccccgaggagcgcgagggccgcgacgagaccaaccucgaccucguccgcggcaccgccuccgccgacgucuccaccgacacccgcaaggccggcggccaggagcagaacggcacccagcaguccaucgucgucgacaugcgcgaguuccgcuccgagcuccccucccucauccaccgccgcggcaucgacaucgagcccgucacccucgaggucggcgacuacauccucacccccgagaugugcgucgagcgcaaguccaucuccgaccucaucggcucccucaacaacggccgccucuacucccagugcaucuccaugucccgcuacuacaagcgccccguccuccucaucgaguucgaccccuccaagcccuucucccucaccucccgcggcgcccucuuccaggagaucuccuccaacgacaucuccuccaagcucacccuccucacccuccacuucccccgccuccgcauccucuggugccccuccccccacgccaccgccgagcucuucgaggagcucaagcaguccaagccccagcccgacgccgccaccgcccucgccaucaccgccgacuccgagacccuccccgaguccgagaaguacaaccccggcccccaggacuuccuccucaagaugcccggcgucaacgccaagaacugccgcucccucaugcaccacgucaagaacaucgccgagcucgccgcccucucccaggacgagcucaccuccauccucggcaacgccgccaacgccaagcagcucuacgacuucauccacaccuccuucgccgaggucgucuccaagggcaagggcaagaaguga

SEQ ID NO: 42808 - RNA, 3561 nt, Artificial Sequence
  derived and/or modified sequence opt2 from ERCC5__Homo_sapiens__NP_000114
augggcguccagggccucuggaagcuccucgagugcuccggccgccaggucucccccgaggcccucgagggcaagauccucgccgucgacaucuccaucuggcucaaccaggcccucaagggcguccgcgaccgccacggcaacuccaucgagaacccccaccuccucacccucuuccaccgccucugcaagcuccucuucuuccgcauccgccccaucuucgucuucgacggcgacgccccccuccucaagaagcagacccucgucaagcgccgccagcgcaaggaccucgccuccuccgacucccgcaagaccaccgagaagcuccucaagaccuuccucaagcgccaggccaucaagaccgccuuccgcuccaagcgcgacgaggcccuccccucccucacccagguccgccgcgagaacgaccucuacguccuccccccccuccaggaggaggagaagcacuccuccgaggaggaggacgagaaggaguggcaggagcgcaugaaccagaagcaggcccuccaggaggaguucuuccacaacccccaggccaucgacaucgaguccgaggacuucuccucccucccccccgaggucaagcacgagauccucaccgacaugaaggaguucaccaagcgccgccgcacccucuucgaggccaugcccgaggaguccgacgacuucucccaguaccagcucaagggccuccucaagaagaacuaccucaaccagcacaucgagcacguccagaaggagaugaaccagcagcacuccggccacauccgccgccaguacgaggacgagggcggcuuccucaaggaggucgagucccgccgcgucgucuccgaggacaccucccacuacauccucaucaagggcauccaggccaagaccgucgccgaggucgacuccgagucccuccccuccuccuccaagaugcacggcauguccuucgacgucaaguccucccccugcgagaagcucaagaccgagaaggagcccgacgccaccccccccuccccccgcacccuccucgccaugcaggccgcccuccucggcuccuccuccgaggaggagcucgaguccgagaaccgccgccaggcccgcggccgcaacgcccccgccgccgucgacgagggcuccaucuccccccgcacccucuccgccaucaagcgcgcccucgacgacgacgaggacgucaaggucugcgccggcgacgacguccagaccggcggccccggcgccgaggagaugcgcaucaacuccuccaccgagaacuccgacgagggccucaagguccgcgacggcaagggcauccccuucaccgccacccucgccuccuccuccgucaacuccgccgaggagcacgucgccuccaccaacgagggccgcgagcccaccgacuccguccccaaggagcagaugucccucguccacgucggcaccgaggccuuccccaucuccgacgaguccaugaucaaggaccgcaaggaccgccucccccucgaguccgccgucguccgccacuccgacgcccccggccuccccaacggccgcgagcucacccccgccucccccaccugcaccaacuccgucuccaagaacgagacccacgccgagguccucgagcagcagaacgagcucugccccuacgaguccaaguucgacuccucccuccucuccuccgacgacgagaccaagugcaagcccaacuccgccuccgaggucaucggccccgucucccuccaggagaccuccuccaucgucuccguccccuccgaggccgucgacaacgucgagaacgucgucuccuucaacgccaaggagcacgagaacuuccucgagaccauccaggagcagcagaccaccgaguccgccggccaggaccucaucuccauccccaaggccgucgagcccauggagaucgacuccgaggaguccgaguccgacggcuccuucaucgagguccaguccgucaucuccgacgaggagcuccaggccgaguuccccgagaccuccaagccccccuccgagcagggcgaggaggagcucgucggcacccgcgagggcgaggcccccgccgaguccgagucccuccuccgcgacaacuccgagcgcgacgacgucgacggcgagccccaggaggccgagaaggacgccgaggacucccuccacgaguggcaggacaucaaccucgaggagcucgagacccucgaguccaaccuccucgcccagcagaacucccucaaggcccagaagcagcagcaggagcgcaucgccgccaccgucaccggccagauguuccucgagucccaggagcuccuccgccucuucggcauccccuacauccaggcccccauggaggccgaggcccagugcgccauccucgaccucaccgaccagaccuccggcaccaucaccgacgacuccgacaucuggcucuucggcgcccgccacgucuaccgcaacuucuucaacaagaacaaguucgucgaguacuaccaguacgucgacuuccacaaccagcucggccucgaccgcaacaagcucaucaaccucgccuaccuccucggcuccgacuacaccgagggcauccccaccgucggcugcgucaccgccauggagauccucaacgaguuccccggccacggccucgagccccuccucaaguucuccgagugguggcacgaggcccagaagaaccccaagauccgccccaacccccacgacaccaaggucaagaagaagcuccgcacccuccagcucacccccggcuuccccaaccccgccgucgccgaggccuaccucaagcccgucgucgacgacuccaagggcuccuuccucuggggcaagcccgaccucgacaagauccgcgaguucugccagcgcuacuucggcuggaaccgcaccaagaccgacgagucccucuuccccguccucaagcagcucgacgcccagcagacccagcuccgcaucgacuccuucuuccgccucgcccagcaggagaaggaggacgccaagcgcaucaagucccagcgccucaaccgcgccgucaccugcaugcuccgcaaggagaaggaggccgccgccuccgagaucgaggccgucuccgucgccauggagaaggaguucgagcuccucgacaaggccaagcgcaagacccagaagcgcggcaucaccaacacccucgaggaguccuccucccucaagcgcaagcgccucuccgacuccaagcgcaagaacaccugcggcggcuuccucggcgagaccugccucuccgaguccuccgacggcuccuccuccgaggacgccgaguccuccucccucaugaacguccagcgccgcaccgccgccaaggagcccaagaccuccgccuccgacucccagaacuccgucaaggaggcccccgucaagaacggcggcgccaccaccuccuccuccuccgacuccgacgacgacggcggcaaggagaagaugguccucgucaccgcccgcuccgucuucggcaagaagcgccgcaagcuccgccgcgcccgcggccgcaagcgcaagaccuga

SEQ ID NO: 42809 - RNA, 4482 nt, Artificial Sequence
  derived and/or modified sequence opt2 from ERCC6__Homo_sapiens__NP_000115
augcccaacgagggcaucccccacuccucccagacccaggagcaggacugccuccagucccagcccgucuccaacaacgaggagauggccaucaagcaggaguccggcggcgacggcgaggucgaggaguaccucuccuuccgcuccgucggcgacggccucuccaccuccgccgucggcugcgccuccgccgccccccgccgcggccccgcccuccuccacaucgaccgccaccagauccaggccgucgagcccuccgcccaggcccucgagcuccagggccucggcgucgacgucuacgaccaggacguccucgagcagggcguccuccagcaggucgacaacgccauccacgaggccucccgcgccucccagcucgucgacgucgagaaggaguaccgcuccguccucgacgaccucaccuccugcaccaccucccuccgccagaucaacaagaucaucgagcagcucuccccccaggccgccaccucccgcgacaucaaccgcaagcucgacuccgucaagcgccagaaguacaacaaggagcagcagcucaagaagaucaccgccaagcagaagcaccuccaggccauccucggcggcgccgaggucaagaucgagcucgaccacgccucccucgaggaggacgccgagcccggccccuccucccucggcuccaugcucaugcccguccaggagaccgccugggaggagcucauccgcaccggccagaugacccccuucggcacccagaucccccagaagcaggagaagaagccccgcaagaucaugcucaacgaggccuccggcuucgagaaguaccucgccgaccaggccaagcucuccuucgagcgcaagaagcagggcugcaacaagcgcgccgcccgcaaggcccccgcccccgucaccccccccgcccccguccagaacaagaacaagcccaacaagaaggcccgcguccucuccaagaaggaggagcgccucaagaagcacaucaagaagcuccagaagcgcgcccuccaguuccagggcaaggucggccuccccaaggcccgccgccccugggaguccgacaugcgccccgaggccgagggcgacuccgagggcgaggaguccgaguacuuccccaccgaggaggaggaggaggaggaggacgacgaggucgagggcgccgaggccgaccucuccggcgacggcaccgacuacgagcucaagccccuccccaagggcggcaagcgccagaagaagguccccguccaggagaucgacgacgacuucuuccccuccuccggcgaggaggccgaggccgccuccgucggcgagggcggcggcggcggccgcaaggucggccgcuaccgcgacgacggcgacgaggacuacuacaagcagcgccuccgccgcuggaacaagcuccgccuccaggacaaggagaagcgccucaagcucgaggacgacuccgaggaguccgacgccgaguucgacgagggcuucaagguccccggcuuccucuucaagaagcucuucaaguaccagcagaccggcguccgcuggcucugggagcuccacugccagcaggccggcggcauccucggcgacgagaugggccucggcaagaccauccagaucaucgccuuccucgccggccucuccuacuccaagauccgcacccgcggcuccaacuaccgcuucgagggccucggccccaccgucaucgucugccccaccaccgucaugcaccagugggucaaggaguuccacaccugguggccccccuuccgcgucgccauccuccacgagaccggcuccuacacccacaagaaggagaagcucauccgcgacgucgcccacugccacggcauccucaucaccuccuacuccuacauccgccucaugcaggacgacaucucccgcuacgacuggcacuacgucauccucgacgagggccacaagauccgcaaccccaacgccgccgucacccucgccugcaagcaguuccgcaccccccaccgcaucauccucuccggcucccccaugcagaacaaccuccgcgagcucuggucccucuucgacuucaucuuccccggcaagcucggcacccuccccgucuucauggagcaguucuccguccccaucaccaugggcggcuacuccaacgccucccccguccaggucaagaccgccuacaagugcgccugcguccuccgcgacaccaucaaccccuaccuccuccgccgcaugaaguccgacgucaagaugucccucucccuccccgacaagaacgagcagguccucuucugccgccucaccgacgagcagcacaaggucuaccagaacuucgucgacuccaaggaggucuaccgcauccucaacggcgagaugcagaucuucuccggccucaucgcccuccgcaagaucugcaaccaccccgaccucuucuccggcggccccaagaaccucaagggccuccccgacgacgagcucgaggaggaccaguucggcuacuggaagcgcuccggcaagaugaucgucgucgagucccuccucaagaucuggcacaagcagggccagcgcguccuccucuucucccagucccgccagaugcucgacauccucgaggucuuccuccgcgcccagaaguacaccuaccucaagauggacggcaccaccaccaucgccucccgccagccccucaucacccgcuacaacgaggacaccuccaucuucgucuuccuccucaccacccgcgucggcggccucggcgucaaccucaccggcgccaaccgcgucgucaucuacgaccccgacuggaaccccuccaccgacacccaggcccgcgagcgcgccuggcgcaucggccagaagaagcaggucaccgucuaccgccuccucaccgccggcaccaucgaggagaagaucuaccaccgccagaucuucaagcaguuccucaccaaccgcguccucaaggaccccaagcagcgccgcuucuucaaguccaacgaccucuacgagcucuucacccucaccucccccgacgccucccaguccaccgagaccuccgccaucuucgccggcaccggcuccgacguccagacccccaagugccaccucaagcgccgcauccagcccgccuucggcgccgaccacgacguccccaagcgcaagaaguuccccgccuccaacaucuccgucaacgacgccaccuccuccgaggagaaguccgaggccaagggcgccgaggucaacgccgucaccuccaaccgcuccgacccccucaaggacgacccccacauguccuccaacgucaccuccaacgaccgccucggcgaggagaccaacgccgucuccggccccgaggagcucuccgucaucuccggcaacggcgagugcuccaacuccuccggcaccggcaagaccuccaugcccuccggcgacgaguccaucgacgagaagcucggccucuccuacaagcgcgagcgccccucccaggcccagaccgaggccuucugggagaacaagcagauggagaacaacuucuacaagcacaaguccaagaccaagcaccacuccgucgccgaggaggagacccucgagaagcaccuccgccccaagcagaagcccaagaacuccaagcacugccgcgacgccaaguucgagggcacccgcaucccccaccucgucaagaagcgccgcuaccagaagcaggacuccgagaacaaguccgaggccaaggagcaguccaacgacgacuacguccucgagaagcucuucaagaaguccgucggcguccacuccgucaugaagcacgacgccaucauggacggcgccucccccgacuacguccucgucgaggccgaggccaaccgcgucgcccaggacgcccucaaggcccuccgccucucccgccagcgcugccucggcgccgucuccggcguccccaccuggaccggccaccgcggcaucuccggcgcccccgccggcaagaagucccgcuucggcaagaagcgcaacuccaacuucuccguccagcaccccuccuccaccucccccaccgagaagugccaggacggcaucaugaagaaggagggcaaggacaacguccccgagcacuucuccggccgcgccgaggacgccgacuccuccuccggcccccucgccuccuccucccuccucgccaagaugcgcgcccgcaaccaccucauccuccccgagcgccucgaguccgaguccggccaccuccaggaggccuccgcccuccuccccaccaccgagcacgacgaccuccucgucgagaugcgcaacuucaucgccuuccaggcccacaccgacggccaggccuccacccgcgagauccuccaggaguucgaguccaagcucuccgccucccaguccugcgucuuccgcgagcuccuccgcaaccucugcaccuuccaccgcaccuccggcggcgagggcaucuggaagcucaagcccgaguacugcuga

SEQ ID NO: 42810 - RNA, 2139 nt, Artificial Sequence
  derived and/or modified sequence opt2 from ERCC6L2__Homo_sapiens__NP_001010895
augcagcccggcuccgcccccccccccggccgcauggaccccuccgccccccagccccgcgccgagaccuccggcaaggacaucuggcaccccggcgagcgcugccucgcccccucccccgacaacggcaagcucugcgaggccuccaucaaguccaucaccgucgacgagaacggcaaguccuucgccgucguccucuacgccgacuuccaggagcgcaagaucccccucaagcagcuccaggaggucaaguucgucaaggacugcccccgcaaccucaucuucgacgacgaggaccucgagaagcccuacuuccccaaccgcaaguuccccuccuccuccgucgccuucaagcucuccgacaacggcgacuccauccccuacaccaucaaccgcuaccuccgcgacuaccagcgcgagggcacccgcuuccucuacggccacuacauccacggcggcggcugcauccucggcgacgacaugggccucggcaagaccguccaggucaucuccuuccucgccgccguccuccacaagaagggcacccgcgaggacaucgagaacaacaugcccgaguuccuccuccgcuccaugaagaaggagccccucuccuccaccgccaagaagauguuccucaucgucgccccccucuccguccucuacaacuggaaggacgagcucgacaccuggggcuacuuccgcgucaccguccuccacggcaaccgcaaggacaacgagcucauccgcgucaagcagcgcaagugcgagaucgcccucaccaccuacgagacccuccgccucugccucgacgagcucaacucccucgagugguccgccgucaucgucgacgaggcccaccgcaucaagaaccccaaggcccgcgucaccgaggucaugaaggcccucaagugcaacguccgcaucggccucaccggcaccauccuccagaacaacaugaaggagcucuggugcgucauggacugggccguccccggccuccucggcuccggcaccuacuucaagaagcaguucuccgaccccgucgagcacggccagcgccacaccgccaccaagcgcgagcucgccaccggccgcaaggccaugcagcgccucgccaagaagauguccggcugguuccuccgccgcaccaagacccucaucaaggaccagcuccccaagaaggaggaccgcauggucuacugcucccucaccgacuuccagaaggccgucuaccagaccguccucgagaccgaggacgucacccucauccuccaguccuccgagcccugcaccugccgcuccggccagaagcgccgcaacugcugcuacaagaccaacucccacggcgagaccgucaagacccucuaccucuccuaccucaccguccuccagaaggucgccaaccacgucgcccuccuccaggccgccuccaccuccaagcagcaggagacccucaucaagcgcaucugcgaccaggucuucucccgcuuccccgacuucguccagaaguccaaggacgccgccuucgagacccucuccgaccccaaguacuccggcaagaugaagguccuccagcagcuccucaaccacugccgcaagaaccgcgacaagguccuccucuucuccuucuccaccaagcuccucgacguccuccagcaguacugcauggccuccggccucgacuaccgccgccucgacggcuccaccaaguccgaggagcgccucaagaucgucaaggaguucaacuccacccaggacgucaacaucugccucgucuccaccauggccggcggccucggccucaacuucgucggcgccaacgucgucguccucuucgaccccaccuggaaccccgccaacgaccuccaggccaucgaccgcgccuaccgcaucggccagugccgcgacgucaagguccuccgccucaucucccucggcaccgucgaggagaucauguaccuccgccagaucuacaagcagcagcuccacugcgucgucgucggcuccgagaacgccaagcgcuacuucgaggccguccagggcuccaaggagcaccagggcgagcucuucggcauccacaaccucuucaaguuccgcucccagggcuccugccucaccaaggacauccucgaggucuga

SEQ ID NO: 42811 - RNA, 3186 nt, Artificial Sequence
  derived and/or modified sequence opt2 from ERCC6-PGBD3__Homo_sapiens__NP_001263988
augcccaacgagggcaucccccacuccucccagacccaggagcaggacugccuccagucccagcccgucuccaacaacgaggagauggccaucaagcaggaguccggcggcgacggcgaggucgaggaguaccucuccuuccgcuccgucggcgacggccucuccaccuccgccgucggcugcgccuccgccgccccccgccgcggccccgcccuccuccacaucgaccgccaccagauccaggccgucgagcccuccgcccaggcccucgagcuccagggccucggcgucgacgucuacgaccaggacguccucgagcagggcguccuccagcaggucgacaacgccauccacgaggccucccgcgccucccagcucgucgacgucgagaaggaguaccgcuccguccucgacgaccucaccuccugcaccaccucccuccgccagaucaacaagaucaucgagcagcucuccccccaggccgccaccucccgcgacaucaaccgcaagcucgacuccgucaagcgccagaaguacaacaaggagcagcagcucaagaagaucaccgccaagcagaagcaccuccaggccauccucggcggcgccgaggucaagaucgagcucgaccacgccucccucgaggaggacgccgagcccggccccuccucccucggcuccaugcucaugcccguccaggagaccgccugggaggagcucauccgcaccggccagaugacccccuucggcacccagaucccccagaagcaggagaagaagccccgcaagaucaugcucaacgaggccuccggcuucgagaaguaccucgccgaccaggccaagcucuccuucgagcgcaagaagcagggcugcaacaagcgcgccgcccgcaaggcccccgcccccgucaccccccccgcccccguccagaacaagaacaagcccaacaagaaggcccgcguccucuccaagaaggaggagcgccucaagaagcacaucaagaagcuccagaagcgcgcccuccaguuccagggcaaggucggccuccccaaggcccgccgccccugggaguccgacaugcgccccgaggccgagggcgacuccgagggcgaggaguccgaguacuuccccaccgaggaggaggaggaggaggaggacgacgaggucgagggcgccgaggccgaccucuccggcgacggcaccgacuacgagcucaagccccuccccaagggcggcaagcgccagaagaagguccccguccaggagaucgacgacgacuucuuccccuccuccggcgaggaggccgaggccgccuccgucggcgagggcggcggcggcggccgcaaggucggccgcuaccgcgacgacggcgacgaggacuacuacaagcagcgccucucccccaagaugccccgcacccucucccuccacgagaucaccgaccuccucgagaccgacgacuccaucgaggccuccgccaucgucauccagccccccgagaacgccaccgcccccgucuccgacgaggaguccggcgacgaggagggcggcaccaucaacaaccuccccggcucccuccuccacaccgccgccuaccucauccaggacggcuccgacgccgaguccgacuccgacgaccccuccuacgcccccaaggacgacucccccgacgagguccccuccaccuucaccguccagcagcccccccccucccgccgccgcaagaugaccaagauccucugcaaguggaagaaggccgaccucaccguccagcccgucgccggccgcgucaccgccccccccaacgacuucuucaccgucaugcgcacccccaccgagauccucgagcucuuccucgacgacgaggucaucgagcucaucgucaaguacuccaaccucuacgccugcuccaagggcguccaccucggccucaccuccuccgaguucaagugcuuccucggcaucaucuuccucuccggcuacgucuccgucccccgccgccgcauguucugggagcagcgcaccgacguccacaacguccucgucuccgccgccaugcgccgcgaccgcuucgagaccaucuucuccaaccuccacgucgccgacaacgccaaccucgaccccgucgacaaguucuccaagcuccgcccccucaucuccaagcucaacgagcgcugcaugaaguucguccccaacgagaccuacuucuccuucgacgaguucaugguccccuacuucggccgccacggcugcaagcaguucauccgcggcaagcccauccgcuucggcuacaaguucuggugcggcgccaccugccucggcuacaucugcugguuccagcccuaccagggcaagaaccccaacaccaagcacgaggaguacggcgucggcgccucccucguccuccaguucuccgaggcccucaccgaggcccaccccggccaguaccacuucgucuucaacaacuucuucaccuccaucgcccuccucgacaagcucuccuccaugggccaccaggccaccggcaccguccgcaaggaccacaucgaccgcgucccccucgaguccgacgucgcccucaagaagaaggagcgcggcaccuucgacuaccgcaucgacggcaagggcaacaucgucugccgcuggaacgacaacuccgucgucaccgucgccuccuccggcgccggcauccacccccucugccucgucucccgcuacucccagaagcucaagaagaagauccagguccagcagcccaacaugaucaaggucuacaaccaguucaugggcggcgucgaccgcgccgacgagaacaucgacaaguaccgcgccuccauccgcggcaagaagugguacuccuccccccuccucuucugcuucgagcucguccuccagaacgccuggcagcuccacaagaccuacgacgagaagcccgucgacuuccucgaguuccgccgccgcgucgucugccacuaccucgagacccacggccacccccccgagcccggccagaagggccgcccccagaagcgcaacaucgacucccgcuacgacggcaucaaccacgucaucgucaagcagggcaagcagacccgcugcgccgagugccacaagaacaccaccuuccgcugcgagaagugcgacgucgcccuccacgucaagugcuccgucgaguaccacaccgaguga

SEQ ID NO: 42812 - RNA, 1191 nt, Artificial Sequence
  derived and/or modified sequence opt2 from ERCC8__Homo_sapiens__NP_000073
augcucggcuuccucuccgcccgccagaccggccucgaggacccccuccgccuccgccgcgccgaguccacccgccgcguccucggccucgagcucaacaaggaccgcgacgucgagcgcauccacggcggcggcaucaacacccucgacaucgagcccgucgagggccgcuacaugcucuccggcggcuccgacggcgucaucguccucuacgaccucgagaacuccucccgccaguccuacuacaccugcaaggccgucugcuccaucggccgcgaccaccccgacguccaccgcuacuccgucgagaccguccagugguacccccacgacaccggcauguucaccuccuccuccuucgacaagacccucaaggucugggacaccaacacccuccagaccgccgacgucuucaacuucgaggagaccgucuacucccaccacaugucccccgucuccaccaagcacugccucgucgccgucggcacccgcggccccaagguccagcucugcgaccucaaguccggcuccugcucccacauccuccagggccaccgccaggagauccucgccgucuccugguccccccgcuacgacuacauccucgccaccgccuccgccgacucccgcgucaagcucugggacguccgccgcgccuccggcugccucaucacccucgaccagcacaacggcaagaagucccaggccgucgaguccgccaacaccgcccacaacggcaaggucaacggccucugcuucaccuccgacggccuccaccuccucaccgucggcaccgacaaccgcaugcgccucuggaacuccuccaacggcgagaacacccucgucaacuacggcaaggucugcaacaacuccaagaagggccucaaguucaccgucuccugcggcugcuccuccgaguucgucuucguccccuacggcuccaccaucgccgucuacaccgucuacuccggcgagcagaucaccaugcucaagggccacuacaagaccgucgacugcugcgucuuccaguccaacuuccaggagcucuacuccggcucccgcgacugcaacauccucgccuggguccccucccucuacgagcccguccccgacgacgacgagaccaccaccaagucccagcucaaccccgccuucgaggacgccugguccuccuccgacgaggagggcuga

SEQ ID NO: 42813 - RNA, 510 nt, Artificial Sequence
  derived and/or modified sequence opt2 from EREG__Homo_sapiens__NP_001423
augaccgccggccgccgcauggagaugcucugcgccggccgcguccccgcccuccuccucugccucggcuuccaccuccuccaggccguccucuccaccaccgucauccccuccugcauccccggcgaguccuccgacaacugcaccgcccucguccagaccgaggacaacccccgcgucgcccaggucuccaucaccaagugcuccuccgacaugaacggcuacugccuccacggccagugcaucuaccucgucgacaugucccagaacuacugccgcugcgaggucggcuacaccggcguccgcugcgagcacuucuuccucaccguccaccagccccucuccaaggaguacgucgcccucaccgucauccucaucauccucuuccucaucaccgucgucggcuccaccuacuacuucugccgcugguaccgcaaccgcaaguccaaggagcccaagaaggaguacgagcgcgucaccuccggcgaccccgagcucccccaggucuga

SEQ ID NO: 42814 - RNA, 1422 nt, Artificial Sequence
  derived and/or modified sequence opt2 from ERF__Homo_sapiens__NP_001287964
augaacuacgacaagcucucccgcgcccuccgcuacuacuacaacaagcgcauccuccacaagaccaagggcaagcgcuucaccuacaaguucaacuucaacaagcucguccucgucaacuaccccuucaucgacgucggccucgccggcggcgccgucccccaguccgccccccccguccccuccggcggcucccacuuccgcuucccccccuccacccccuccgagguccucucccccaccgaggacccccgcuccccccccgccugcuccuccuccuccuccucccucuucuccgccgucgucgcccgccgccucggccgcggcuccgucuccgacugcuccgacggcaccuccgagcucgaggagccccucggcgaggacccccgcgcccgcccccccggcccccccgaccucggcgccuuccgcggccccccccucgcccgccucccccacgaccccggcgucuuccgcgucuacccccgcccccgcggcggccccgagccccucucccccuuccccgucuccccccucgccggccccggcucccuccuccccccccagcucucccccgcccuccccaugacccccacccaccucgccuacacccccucccccacccucucccccauguaccccuccggcggcggcggccccuccggcuccggcggcggcucccacuucuccuucucccccgaggacaugaagcgcuaccuccaggcccacacccaguccgucuacaacuaccaccucuccccccgcgccuuccuccacuaccccggccucgucgucccccagccccagcgccccgacaagugcccccucccccccauggcccccgagaccccccccguccccuccuccgccuccuccuccuccuccuccuccuccucccccuucaaguucaagcuccagccccccccccucggccgccgccagcgcgccgccggcgagaaggccgucgccggcgccgacaaguccggcggcuccgccggcggccucgccgagggcgccggcgcccucgcccccccccccccccccccccagaucaaggucgagcccaucuccgagggcgaguccgaggaggucgaggucaccgacaucuccgacgaggacgaggaggacggcgaggucuucaagaccccccgcgccccccccgccccccccaagcccgagcccggcgaggcccccggcgccucccagugcaugccccucaagcuccgcuucaagcgccgcugguccgaggacugccgccucgagggcggcggcggccccgccggcggcuucgaggacgagggcgaggacaagaagguccgcggcgagggccccggcgaggccggcggcccccucaccccccgccgcgucuccuccgaccuccagcacgccaccgcccagcucucccucgagcaccgcgacuccuga

SEQ ID NO: 42815 - RNA, 1461 nt, Artificial Sequence
  derived and/or modified sequence opt2 from ERG__Homo_sapiens__NP_001129626
augauccagaccguccccgaccccgccgcccacaucaaggaggcccucuccgucgucuccgaggaccagucccucuucgagugcgccuacggcaccccccaccucgccaagaccgagaugaccgccuccuccuccuccgacuacggccagaccuccaagauguccccccgcgucccccagcaggacuggcucucccagccccccgcccgcgucaccaucaagauggagugcaaccccucccaggucaacggcucccgcaacucccccgacgagugcuccgucgccaagggcggcaagauggucggcucccccgacaccgucggcaugaacuacggcuccuacauggaggagaagcacaugcccccccccaacaugaccaccaacgagcgccgcgucaucguccccgccgaccccacccucugguccaccgaccacguccgccaguggcucgagugggccgucaaggaguacggccuccccgacgucaacauccuccucuuccagaacaucgacggcaaggagcucugcaagaugaccaaggacgacuuccagcgccucacccccuccuacaacgccgacauccuccucucccaccuccacuaccuccgcgagaccccccucccccaccucaccuccgacgacgucgacaaggcccuccagaacuccccccgccucaugcacgcccgcaacaccggcggcgccgccuucaucuuccccaacaccuccgucuaccccgaggccacccagcgcaucaccacccgccccgaccuccccuacgagcccccccgccgcuccgccuggaccggccacggccaccccaccccccaguccaaggccgcccagcccucccccuccaccguccccaagaccgaggaccagcgcccccagcucgaccccuaccagauccucggccccaccuccucccgccucgccaaccccggcuccggccagauccagcucuggcaguuccuccucgagcuccucuccgacuccuccaacuccuccugcaucaccugggagggcaccaacggcgaguucaagaugaccgaccccgacgaggucgcccgccgcuggggcgagcgcaaguccaagcccaacaugaacuacgacaagcucucccgcgcccuccgcuacuacuacgacaagaacaucaugaccaagguccacggcaagcgcuacgccuacaaguucgacuuccacggcaucgcccaggcccuccagccccacccccccgaguccucccucuacaaguaccccuccgaccuccccuacaugggcuccuaccacgcccacccccagaagaugaacuucgucgccccccacccccccgcccuccccgucaccuccuccuccuucuucgccgcccccaaccccuacuggaacucccccaccggcggcaucuaccccaacacccgccuccccaccucccacaugcccucccaccucggcaccuacuacuga

SEQ ID NO: 42816 - RNA, 873 nt, Artificial Sequence
  derived and/or modified sequence opt2 from ERGIC1__Homo_sapiens__NP_001026881
augcccuucgacuuccgccgcuucgacaucuaccgcaagguccccaaggaccucacccagcccaccuacaccggcgccaucaucuccaucugcugcugccucuucauccucuuccucuuccucuccgagcucaccggcuucaucaccaccgaggucgucaacgagcucuacgucgacgaccccgacaaggacuccggcggcaagaucgacgucucccucaacaucucccuccccaaccuccacugcgagcucgucggccucgacauccaggacgagaugggccgccacgaggucggccacaucgacaacuccaugaagaucccccucaacaacggcgccggcugccgcuucgagggccaguucuccaucaacaagguccccggcaacuuccacgucuccacccacuccgccaccgcccagccccagaaccccgacaugacccacgucauccacaagcucuccuucggcgacacccuccagguccagaacauccacggcgccuucaacgcccucggcggcgccgaccgccucaccuccaacccccucgccucccacgacuacauccucaagaucguccccaccgucuacgaggacaaguccggcaagcagcgcuacuccuaccaguacaccgucgccaacaaggaguacgucgccuacucccacaccggccgcaucauccccgccaucugguuccgcuacgaccucucccccaucaccgucaaguacaccgagcgccgccagccccucuaccgcuucaucaccaccaucugcgccaucaucggcggcaccuucaccgucgccggcauccucgacuccugcaucuucaccgccuccgaggccuggaagaagauccagcucggcaagaugcacuga

SEQ ID NO: 42817 - RNA, 1134 nt, Artificial Sequence
  derived and/or modified sequence opt2 from ERGIC2__Homo_sapiens__NP_057654
augcgccgccucaaccgcaagaagacccucucccucgucaaggagcucgacgccuuccccaagguccccgaguccuacgucgagaccuccgccuccggcggcaccgucucccucaucgccuucaccaccauggcccuccucaccaucauggaguucuccgucuaccaggacaccuggaugaaguacgaguacgaggucgacaaggacuucuccuccaagcuccgcaucaacaucgacaucaccgucgccaugaagugccaguacgucggcgccgacguccucgaccucgccgagaccauggucgccuccgccgacggccucgucuacgagcccaccgucuucgaccucuccccccagcagaaggaguggcagcgcaugcuccagcucauccagucccgccuccaggaggagcacucccuccaggacgucaucuucaaguccgccuucaaguccaccuccaccgcccuccccccccgcgaggacgacuccucccagucccccaacgccugccgcauccacggccaccucuacgucaacaaggucgccggcaacuuccacaucaccgucggcaaggccaucccccacccccgcggccacgcccaccucgccgcccucgucaaccacgaguccuacaacuucucccaccgcaucgaccaccucuccuucggcgagcucguccccgccaucaucaacccccucgacggcaccgagaagaucgccaucgaccacaaccagauguuccaguacuucaucaccgucguccccaccaagcuccacaccuacaagaucuccgccgacacccaccaguucuccgucaccgagcgcgagcgcaucaucaaccacgccgccggcucccacggcgucuccggcaucuucaugaaguacgaccucuccucccucauggucaccgucaccgaggagcacaugcccuucuggcaguucuucguccgccucugcggcaucgucggcggcaucuucuccaccaccggcaugcuccacggcaucggcaaguucaucgucgagaucaucugcugccgcuuccgccucggcuccuacaagcccgucaacuccguccccuucgaggacggccacaccgacaaccaccucccccuccucgagaacaacacccacuga

SEQ ID NO: 42818 - RNA, 1152 nt, Artificial Sequence
  derived and/or modified sequence opt2 from ERGIC3__Homo_sapiens__NP_057050
auggaggcccucggcaagcucaagcaguucgacgccuaccccaagacccucgaggacuuccgcgucaagaccugcggcggcgccaccgucaccaucgucuccggccuccucaugcuccuccucuuccucuccgagcuccaguacuaccucaccaccgagguccaccccgagcucuacgucgacaagucccgcggcgacaagcucaagaucaacaucgacguccucuucccccacaugcccugcgccuaccucuccaucgacgccauggacgucgccggcgagcagcagcucgacgucgagcacaaccucuucaagcagcgccucgacaaggacggcauccccgucuccuccgaggccgagcgccacgagcucggcaaggucgaggucaccgucuucgaccccgacucccucgaccccgaccgcugcgaguccugcuacggcgccgaggccgaggacaucaagugcugcaacaccugcgaggacguccgcgaggccuaccgccgccgcggcugggccuucaagaaccccgacaccaucgagcagugccgccgcgagggcuucucccagaagaugcaggagcagaagaacgagggcugccaggucuacggcuuccucgaggucaacaaggucgccggcaacuuccacuucgcccccggcaaguccuuccagcagucccacguccacguccacgaccuccaguccuucggccucgacaacaucaacaugacccacuacauccagcaccucuccuucggcgaggacuaccccggcaucgucaacccccucgaccacaccaacgucaccgccccccaggccuccaugauguuccaguacuucgucaaggucguccccaccgucuacaugaaggucgacggcgagguccuccgcaccaaccaguucuccgucacccgccacgagaaggucgccaacggccuccucggcgaccagggccuccccggcgucuucguccucuacgagcucucccccaugauggucaagcucaccgagaagcaccgcuccuucacccacuuccucaccggcgucugcgccaucaucggcggcauguucaccgucgccggccucaucgacucccucaucuaccacuccgcccgcgccauccagaagaagaucgaccucggcaagaccaccuga

SEQ ID NO: 42819 - RNA, 780 nt, Artificial Sequence
  derived and/or modified sequence opt2 from ERI3__Homo_sapiens__NP_001288628
augcucgccccccuccagaccggcgccgcccgcuucuccuccuaccuccucucccgcgcccgcaagguccucggcucccaccucuucucccccugcggcguccccgaguucugcuccaucuccacccgcaagcucgccgcccacggcuucggcgccuccauggccgccauggucuccuuccccccccagcgcuaccacuacuuccucguccucgacuucgaggccaccugcgacaagccccagauccacccccaggagaucaucgaguuccccauccucaagcucaacggccgcaccauggagaucgaguccaccuuccacauguacguccagcccgucguccacccccagcucacccccuucugcaccgagcucaccggcaucauccaggccauggucgacggccagcccucccuccagcagguccucgagcgcgucgacgaguggauggccaaggagggccuccucgaccccaacgucaaguccaucuucgucaccugcggcgacugggaccucaaggucaugcuccccggccagugccaguaccucggccuccccgucgccgacuacuucaagcaguggaucaaccucaagaaggccuacuccuucgccaugggcugcuggcccaagaacggccuccucgacaugaacaagggccucucccuccagcacaucggccgcccccacuccggcaucgacgacugcaagaacaucgccaacaucaugaagacccucgccuaccgcggcuucaucuucaagcagaccuccaagcccuucuga

SEQ ID NO: 42820 - RNA, 171 nt, Artificial Sequence
  derived and/or modified sequence opt2 from ERICH5__Homo_sapiens__NP_001164277
augggcugcuccuccuccgcccucaacaaggccggcgacuccucccgcuuccccuccggcgagaccggcgagaaggucgagaccgacauggagaacgagaaggucuccgagggcgccgagaccaaggaggaggagaccggcgaggucgucgaccucuccgccgccaccuga

SEQ ID NO: 42821 - RNA, 2091 nt, Artificial Sequence
  derived and/or modified sequence opt2 from ERICH6B__Homo_sapiens__NP_872348
auguccgccgagaacaaccagcucuccggcgccucccccccccacccccccaccaccccccaguacuccacccagaaccuccccuccgagaaggaggacaccgaggucgagcucgacgaggagucccuccaggacgagucccccuucucccccgagggcgagucccucgaggacaaggaguaccucgaggaggaggaggaccucgaggaggaggaguaccucggcaaggaggaguaccucaaggaggaggaguaccucggcaaggaggagcaccucgaggaggaggaguaccucgagaaggccggcuaccucgaggaggaggaguacaucgaggaggaggaguaccucggcaaggagggcuaccucgaggaggaggaguaccucggcaaggaggagcaccucgaggaggaggaguaccucggcaaggagggcuaccucgagaaggaggacuacaucgaggaggucgacuaccucggcaagaaggccuaccucgaggaggaggaguaccucggcaagaaguccuaccucgaggaggagaaggcccucgagaaggaggagaaccucgaggaggaggaggcccucgagaaggaggagaaccucgacggcaaggagaaccucuacaagaaguaccucaaggagcccaaggccuccuacuccucccagaccaugcuccuccgcgacgcccgcucccccgacgccggccccucccaggucaccaccuuccucaccgucccccucaccuucgccacccccucccccgucuccgaguccgccaccgaguccuccgagcuccuccucacccucuaccgccgcucccaggccucccagaccgacuggugcuacgaccgcaccgccgucaagucccucaaguccaaguccgagaccgagcaggagaccaccaccaagcucgcccccgaggagcacgucaacaccaagguccagcagaagaaggaggagaacguccucgaguucgccuccaaggagaacuucugggacggcaucaccgacgaguccaucgacaagcucgaggucgaggaccucgacgagaacuuccucaacuccuccuaccagaccgucuucaagaccaucaucaaggagauggccgcccacaacgagcucgaggaggacuucgacaucccccucaccaagcuccucgaguccgagaaccgcuggaagcucgucaucaugcucaagaagaacuacgagaaguucaaggagaccauccuccgcaucaagcgccgccgcgaggcccagaagcucaccgagaugaccuccuucaccuuccaccucauguccaagcccacccccgagaagcccgagaccgaggagauccagaagccccagcgcgucguccaccaccgcaagaagcucgagcgcgacaaggaguggauccagaagaagaccgucguccaccagggcgacggcaagcucauccucuaccccaacaagaacgucuaccagauccucuuccccgacggcaccggccagauccacuaccccuccggcaaccucgccaugcucauccucuacgccaagaugaagaaguucaccuacaucauccucgaggacucccucgagggccgcauccgcgcccucaucaacaacuccggcaacgccaccuucuacgacgagaacuccgacaucuggcucaaccucuccuccaaccucggcuacuacuuccccaaggacaagcgccagaaggccuggaacugguggaaccucaacauccacguccacgccccccccguccagcccaucucccucaagaucaacgaguacauccagguccagauccgcucccaggacaagaucaucuucugcuucaccuacgagcagaagcagaucugccucaaccucggcacccgcuacaaguucgucauccccgagguccucuccgagaugaagaagaagaccauccucgaggccgagcccggccccaccgcccagaagauccgcguccuccucggcaagaugaaccgccuccucaacuacgccaccacccccgaccucgagaacuucaucgaggccgucuccaucucccucauggacaacaaguaccucaagaagaugcucuccaagcucugguucuga

SEQ ID NO: 42822 - RNA, 1374 nt, Artificial Sequence
  derived and/or modified sequence opt2 from ERLEC1__Homo_sapiens__NP_001120869
auggaggagggcggcggcggcguccgcucccucguccccggcggccccguccuccucguccucugcggccuccucgaggccuccggcggcggccgcgcccucccccagcucuccgacgacauccccuuccgcgucaacuggcccggcaccgaguucucccuccccaccaccggcguccucuacaaggaggacaacuacgucaucaugaccaccgcccacaaggagaaguacaagugcauccucccccucgucaccuccggcgacgaggaggaggagaaggacuacaagggccccaacccccgcgagcuccucgagccccucuucaagcaguccuccugcuccuaccgcaucgaguccuacuggaccuacgaggucugccacggcaagcacauccgccaguaccacgaggagaaggagaccggccagaagaucaacauccacgaguacuaccucggcaacaugcucgccaagaaccuccucuucgagaaggagcgcgaggccgaggagaaggagaaguccaacgagauccccaccaagaacaucgagggccagaugacccccuacuaccccgucggcaugggcaacggcacccccugcucccucaagcagaaccgcccccgcuccuccaccgucauguacaucugccaccccgaguccaagcacgagauccucuccgucgccgaggucaccaccugcgaguacgaggucgucauccucaccccccuccucugcucccaccccaaguaccgcuuccgcgccucccccgucaacgacaucuucugccagucccuccccggcucccccuucaagccccucacccuccgccagcucgagcagcaggaggagauccuccgcguccccuuccgccgcaacaaggaggaggaccuccaguccaccaaggaggagcgcuuccccgccauccacaaguccaucgccaucggcucccagcccguccucaccgucggcaccacccacaucuccaagcucaccgacgaccagcucaucaaggaguuccucuccggcuccuacugcuuccgcggcggcgucggcugguggaaguacgaguucugcuacggcaagcacguccaccaguaccacgaggacaaggacuccggcaagaccuccgucgucgucggcaccuggaaccaggaggagcacaucgagugggccaagaagaacaccgcccgcgccuaccaccuccaggacgacggcacccagaccguccgcugcaaggaguccgacuccccccacgccgucaccgucuacaugcucgagccccacuccugccaguacauccucggcgucgagucccccgucaucugcaagauccucgacaccgccgacgagaacggccuccucucccuccccaacuga

SEQ ID NO: 42823 - RNA, 1047 nt, Artificial Sequence
  derived and/or modified sequence opt2 from ERLIN1__Homo_sapiens__XP_005269499
augaacaugacccaggcccgcguccucgucgccgccgucgucggccucgucgccguccuccucuacgccuccauccacaagaucgaggagggccaccucgccgucuacuaccgcggcggcgcccuccucaccucccccuccggccccggcuaccacaucaugcuccccuucaucaccaccuuccgcuccguccagaccacccuccagaccgacgaggucaagaacguccccugcggcaccuccggcggcgucaugaucuacaucgaccgcaucgaggucgucaacaugcucgcccccuacgccgucuucgacaucguccgcaacuacaccgccgacuacgacaagacccucaucuucaacaagauccaccacgagcucaaccaguucugcuccgcccacacccuccaggaggucuacaucgagcucuucgaccagaucgacgagaaccucaagcaggcccuccagaaggaccucaaccucauggcccccggccucaccauccaggccguccgcgucaccaagcccaagauccccgaggccauccgccgcaacuucgagcucauggaggccgagaagaccaagcuccucaucgccgcccagaagcagaaggucgucgagaaggaggccgagaccgagcgcaagaaggccgucaucgaggccgagaagaucgcccaggucgccaagauccgcuuccagcagaaggucauggagaaggagaccgagaagcgcaucuccgagaucgaggacgccgccuuccucgcccgcgagaaggccaaggccgacgccgaguacuacgccgcccacaaguacgccaccuccaacaagcacaagcucacccccgaguaccucgagcucaagaaguaccaggccaucgccuccaacuccaagaucuacuucggcuccaacauccccaacauguucgucgacuccuccugcgcccucaaguacuccgacauccgcaccggccgcgaguccucccuccccuccaaggaggcccucgagcccuccggcgagaacgucauccagaacaaggaguccaccggcuga

SEQ ID NO: 42824 - RNA, 459 nt, Artificial Sequence
  derived and/or modified sequence opt2 from ERLIN2__Homo_sapiens__NP_001003791
auggcccagcucggcgccgucgucgccgucgccuccuccuucuucugcgccucccucuucuccgccguccacaagaucgaggagggccacaucggcgucuacuaccgcggcggcgcccuccucaccuccaccuccggccccggcuuccaccucaugcuccccuucaucaccuccuacaaguccguccagaccacccuccagaccgacgaggucaagaacguccccugcggcaccuccggcggcgucaugaucuacuucgaccgcaucgaggucgucaacuuccucguccccaacgccgucuacgacaucgucaagaacuacaccgccgacuacgacaaggcccucaucuucaacaagauccaccacgagcucaaccaguucugcuccguccacacccuccaggaggucuacaucgagcucuucggccucgagaacgacuucucccaggaguccuccuga

SEQ ID NO: 42825 - RNA, 1428 nt, Artificial Sequence
  derived and/or modified sequence opt2 from ERMAP__Homo_sapiens__XP_011538872
auggagauggccuccuccgccggcuccuggcucuccggcugccucaucccccucgucuuccuccgccucuccguccacgucuccggccacgccggcgacgccggcaaguuccacgucgcccuccucggcggcaccgccgagcuccucugcccccucucccucuggcccggcaccguccccaaggagguccgcuggcuccgcucccccuucccccagcgcucccaggccguccacaucuuccgcgacggcaaggaccaggacgaggaccucaugcccgaguacaagggccgcaccguccucguccgcgacgcccaggagggcuccgucacccuccagauccucgacguccgccucgaggaccagggcuccuaccgcugccucauccaggucggcaaccucuccaaggaggacaccgucauccuccaggucgccgcccccuccgucggcucccucucccccuccgccgucgcccucgccgucauccuccccguccucguccuccucaucauggucugccucugccucaucuggaagcagcgccgcgccaaggagaagcuccucuacgagcacgucaccgaggucgacaaccuccucuccgaccacgccaaggagaagggcaagcuccacaaggccgucaagaagcuccgcuccgagcucaagcucaagcgcgccgccgccaacuccggcuggcgccgcgcccgccuccacuucgucgccgucacccucgaccccgacaccgcccaccccaagcucauccucuccgaggaccagcgcugcguccgccucggcgaccgccgccagcccguccccgacaacccccagcgcuucgacuucgucgucuccauccucggcuccgaguacuucaccaccggcugccacuacugggaggucuacgucggcgacaagaccaaguggauccucggcgucugcuccgaguccgucucccgcaagggcaaggucaccgccucccccgccaacggccacuggcuccuccgccagucccgcggcaacgaguacgaggcccucaccuccccccagaccuccuuccgccucaaggagcccccccgcugcgucggcaucuuccucgacuacgaggccggcgucaucuccuucuacaacgucaccaacaagucccacaucuucaccuucacccacaacuucuccggcccccuccgccccuucuucgagcccugccuccacgacggcggcaagaacaccgccccccucgucaucugcuccgagcuccacaaguccgaggaguccaucgucccccgccccgagggcaagggccacgccaacggcgacgucucccucaaggucaacuccucccuccucccccccaaggcccccgagcucaaggacaucauccucucccucccccccgaccucggccccgcccuccaggagcucaaggcccccuccuucuga

SEQ ID NO: 42826 - RNA, 1896 nt, Artificial Sequence
  derived and/or modified sequence opt2 from ERMARD__Homo_sapiens__NP_001265460
auggagguccucaucggcgaccccaucaccaccugccucucccccuccgucuacgacaucaucugcaaccucggcuuccagcuccgcgagaacugcgacaucaacuccaucgucacccagaacggcgaggucugcuggaagaccaucaccgacugcgucuccuacaccgaguccgagcagggccucgacuacuggggcuccguccgccuccucggccccgucugcgaggccguccacucccacuuccucucccucaccaagggccaguucgagauccgcuacgcccccugguuccaguggaccuccuuccccgagcucuuccccgagaucuucgacgcccucgagucccuccagucccccgccaucucccucucccucaugaagcucaccuccugccucgagcgcgcccucggcgacgucuuccuccucaucggcaaggagugccccuuccuccuccgcgaccuccucuccuccgaggagcucgcccaggucuucucccaguccgucaugaacguccucaaggucuucgucggcucccccugcggccucaaccuccgcaacguccucuggcacggcuucgccucccccgaggagaucccccccaaguacugcuccaugaugauccuccucaccgccggccucggccagcuccucaaguccuaccuccagaacaccaagcucacccucgcccaccgcuccuucaucucccucaccaaccucgaggaccucaucgucuuccccgacgucaccuacgagguccucuccguccucgaggaggucaugaugaaguccgccuucauccucaagaucaugcuccccuacugggaggucgcccucgucaaguucaagucccaccgcuucgccgacugcgccauccuccuccucacccagcucgagaccggccuccgcaacgucuucgccacccucaaccgcugccccaagcgccuccucaccgccgaguccaccgcccucuacaccaccuucgaccagauccucgccaagcaccucaacgacggcaagaucaaccagcucccccucuuccucggcgagcccgccauggaguuccucugggacuuccucaaccaccaggagggcccccgcauccgcgaccaccucucccacggcgagaucaaccuccacgaguucuccaaggagaccaccaaccagcuccucgccuucucccucguccuccuccuccgcuucgucgacgacugccuccucuccgucuucaaggagaaguccgccgucgagcuccucaucucccucgccgagggcuacuccucccgcugccaccccgucuuccagcucaagaagcagguccucuccugcgaggaguccauccgcgucugggcccuccuccccuuccccgaggagcucacccgccaggccguccgccucgaggacaacuccgagaccaacgccugccacucccucaucaccaagaugaccgacgagcucuaccaccacaugcccgagaaccgcugcguccucaaggaccucgaccgccuccccaccgagacccccaccuccgacaccccccucgcccucgccccccgcaagccccagcccugccgcugccgccgccgcguccgccccuccauccgccuccucucccccguccucucccucauccuccuccucaucgcccucgagcucgucaacauccacgccgucugcggcaagaacgcccacgaguaccagcaguaccucaaguucgucaaguccauccuccaguacaccgagaaccucgucgccuacaccuccuacgagaagaacaaguggaacgagaccaucaaccucacccacaccgcccuccucaagauguggaccuucuccgagaagaagcagaugcucauccaccucgccaagaaguccaccuccaagguccuccucuga

SEQ ID NO: 42827 - RNA, 2715 nt, Artificial Sequence
  derived and/or modified sequence opt2 from ERMP1__Homo_sapiens__NP_079172
auggaguggggcuccgaguccgccgccguccgccgccaccgcgucggcgucgagcgccgcgagggcgccgccgccgcccccccccccgagcgcgaggcccgcgcccaggagccccucgucgacggcugcuccggcggcggccgcacccgcaagcgcucccccggcggcuccggcggcgccucccgcggcgccggcaccggccucuccgagguccgcgccgcccucggccucgcccucuaccucaucgcccuccgcacccucguccagcucucccuccagcagcucguccuccgcggcgccgccggccaccgcggcgaguucgacgcccuccaggcccgcgacuaccucgagcacaucaccuccaucggcccccgcaccaccggcucccccgagaacgagauccucaccguccacuaccuccucgagcagaucaagcucaucgagguccaguccaacucccuccacaagaucuccgucgacguccagcgccccaccggcuccuucuccaucgacuuccucggcggcuucaccuccuacuacgacaacaucaccaacgucgucgucaagcucgagccccgcgacggcgcccagcacgccguccucgccaacugccacuucgacuccgucgccaacucccccggcgccuccgacgacgccgucuccugcuccgucaugcucgagguccuccgcguccucuccaccuccuccgaggcccuccaccacgccgucaucuuccucuucaacggcgccgaggagaacguccuccaggccucccacggcuucaucacccagcaccccugggccucccucauccgcgccuucaucaaccucgaggccgccggcgucggcggcaaggagcucgucuuccagaccggccccgagaaccccuggcucguccaggccuacgucuccgccgccaagcaccccuucgccuccgucgucgcccaggaggucuuccaguccggcaucauccccuccgacaccgacuuccgcaucuaccgcgacuucggcaacauccccggcaucgaccucgccuucaucgagaacggcuacaucuaccacaccaaguacgacaccgccgaccgcauccucaccgacuccauccagcgcgccggcgacaacauccucgccguccucaagcaccucgccaccuccgacaugcucgccgccgccuccaaguaccgccacggcaacauggucuucuucgacguccucggccucuucgucaucgccuaccccucccgcaucggcuccaucaucaacuacauggucgucaugggcgucguccucuaccucggcaagaaguuccuccagcccaagcacaagaccggcaacuacaagaaggacuuccucugcggccucggcaucacccucaucuccugguucaccucccucgucaccguccucaucaucgccgucuucaucucccucaucggccagucccucuccugguacaaccacuucuacgucuccgucugccucuacggcaccgccaccgucgccaagaucauccucauccacacccucgccaagcgcuucuacuacaugaacgccuccgcccaguaccucggcgaggucuucuucgacaucucccucuucguccacugcugcuuccucgucacccucaccuaccagggccucugcuccgccuucaucuccgccgucugggucgccuucccccuccucaccaagcucugcguccacaaggacuucaagcagcacggcgcccagggcaaguucaucgccuucuaccuccucggcauguucauccccuaccucuacgcccucuaccucaucugggccgucuucgagauguucacccccauccucggccgcuccggcuccgagaucccccccgacgucguccucgccuccauccucgccggcugcaccaugauccucuccuccuacuucaucaacuucaucuaccucgccaaguccaccaagaagaccaugcucacccucacccucgucugcgccaucaccuuccuccucgucugcuccggcaccuucuuccccuacuccuccaaccccgccaaccccaagcccaagcgcgucuuccuccagcacaugacccgcaccuuccacgaccucgagggcaacgccgucaagcgcgacuccggcaucuggaucaacggcuucgacuacaccggcaucucccacaucaccccccacauccccgagaucaacgacuccauccgcgcccacugcgaggagaacgccccccucugcggcuuccccugguaccuccccguccacuuccucauccgcaagaacugguaccuccccgcccccgaggucuccccccgcaaccccccccacuuccgccucaucuccaaggagcagacccccugggacuccaucaagcucaccuucgaggccaccggccccucccacauguccuucuacguccgcgcccacaagggcuccacccucucccaguggucccucggcaacggcacccccgucaccuccaagggcggcgacuacuucgucuucuacucccacggccuccaggccuccgccuggcaguucuggaucgagguccaggucuccgaggagcaccccgagggcauggucaccgucgccaucgccgcccacuaccucuccggcgaggacaagcgcuccccccagcucgacgcccucaaggagaaguuccccgacuggaccuuccccuccgccugggucugcaccuacgaccucuucgucuucuga

SEQ ID NO: 42828 - RNA, 2934 nt, Artificial Sequence
  derived and/or modified sequence opt2 from ERN1__Homo_sapiens__NP_001424
augcccgcccgccgccuccuccuccuccucacccuccuccuccccggccucggcaucuucggcuccaccuccaccgucacccuccccgagacccuccucuucgucuccacccucgacggcucccuccacgccgucuccaagcgcaccggcuccaucaaguggacccucaaggaggaccccguccuccagguccccacccacgucgaggagcccgccuuccuccccgaccccaacgacggcucccucuacacccucggcuccaagaacaacgagggccucaccaagcuccccuucaccauccccgagcucguccaggccucccccugccgcuccuccgacggcauccucuacaugggcaagaagcaggacaucugguacgucaucgaccuccucaccggcgagaagcagcagacccucuccuccgccuucgccgacucccucugccccuccaccucccuccucuaccucggccgcaccgaguacaccaucaccauguacgacaccaagacccgcgagcuccgcuggaacgccaccuacuucgacuacgccgccucccuccccgaggacgacgucgacuacaagaugucccacuucgucuccaacggcgacggccucgucgucaccgucgacuccgaguccggcgacguccucuggauccagaacuacgccucccccgucgucgccuucuacgucuggcagcgcgagggccuccgcaaggucaugcacaucaacgucgccgucgagacccuccgcuaccucaccuucauguccggcgaggucggccgcaucaccaaguggaaguaccccuuccccaaggagaccgaggccaaguccaagcucacccccacccucuacgucggcaaguacuccaccucccucuacgccucccccuccaugguccacgagggcgucgccgucgucccccgcggcuccacccucccccuccucgagggcccccagaccgacggcgucaccaucggcgacaagggcgagugcgucaucacccccuccaccgacgucaaguucgaccccggccucaaguccaagaacaagcucaacuaccuccgcaacuacuggcuccucaucggccaccacgagaccccccucuccgccuccaccaagaugcucgagcgcuuccccaacaaccuccccaagcaccgcgagaacgucauccccgccgacuccgagaagaaguccuucgaggaggucaucaaccucgucgaccagaccuccgagaacgcccccaccaccgucucccgcgacgucgaggagaagcccgcccacgcccccgcccgccccgaggcccccgucgacuccaugcucaaggacauggccaccaucauccucuccaccuuccuccucaucggcugggucgccuucaucaucaccuacccccucuccaugcaccagcagcagcagcuccagcaccagcaguuccagaaggagcucgagaagauccagcuccuccagcagcagcagcagcagcuccccuuccacccccccggcgacaccgcccaggacggcgagcuccucgacaccuccggccccuacuccgaguccuccggcaccuccucccccuccaccuccccccgcgccuccaaccacucccucugcuccggcuccuccgccuccaaggccggcuccucccccucccucgagcaggacgacggcgacgaggagaccuccgucgucaucgucggcaagaucuccuucugccccaaggacguccucggccacggcgccgagggcaccaucgucuaccgcggcauguucgacaaccgcgacgucgccgucaagcgcauccuccccgagugcuucuccuucgccgaccgcgagguccagcuccuccgcgaguccgacgagcaccccaacgucauccgcuacuucugcaccgagaaggaccgccaguuccaguacaucgccaucgagcucugcgccgccacccuccaggaguacgucgagcagaaggacuucgcccaccucggccucgagcccaucacccuccuccagcagaccaccuccggccucgcccaccuccacucccucaacaucguccaccgcgaccucaagccccacaacauccucaucuccaugcccaacgcccacggcaagaucaaggccaugaucuccgacuucggccucugcaagaagcucgccgucggccgccacuccuucucccgccgcuccggcguccccggcaccgagggcuggaucgcccccgagaugcucuccgaggacugcaaggagaaccccaccuacaccgucgacaucuucuccgccggcugcgucuucuacuacgucaucuccgagggcucccaccccuucggcaagucccuccagcgccaggccaacauccuccucggcgccugcucccucgacugccuccaccccgagaagcacgaggacgucaucgcccgcgagcucaucgagaagaugaucgccauggacccccagaagcgccccuccgccaagcacguccucaagcaccccuucuucuggucccucgagaagcagcuccaguucuuccaggacgucuccgaccgcaucgagaaggagucccucgacggccccaucgucaagcagcucgagcgcggcggccgcgccgucgucaagauggacuggcgcgagaacaucaccgucccccuccagaccgaccuccgcaaguuccgcaccuacaagggcggcuccguccgcgaccuccuccgcgccaugcgcaacaagaagcaccacuaccgcgagcuccccgccgagguccgcgagacccucggcucccuccccgacgacuucgucugcuacuucaccucccgcuucccccaccuccucgcccacaccuaccgcgccauggagcucugcucccacgagcgccucuuccagcccuacuacuuccacgagccccccgagccccagccccccgucacccccgacgcccucuga

SEQ ID NO: 42829 - RNA, 2781 nt, Artificial Sequence
  derived and/or modified sequence opt2 from ERN2__Homo_sapiens__NP_150296
auggccuccgccguccgcggcucccgccccuggccccgccucggccuccagcuccaguucgccgcccuccuccucggcacccucuccccccagguccacacccuccgccccgagaaccuccuccucgucuccacccucgacggcucccuccacgcccucuccaagcagaccggcgaccucaaguggacccuccgcgacgaccccgucaucgagggccccauguacgucaccgagauggccuuccucuccgaccccgccgacggcucccucuacauccucggcacccagaagcagcagggccucaugaagcuccccuucaccauccccgagcucguccacgccucccccugccgcuccuccgacggcgucuucuacaccggccgcaagcaggacgccugguucgucgucgaccccgaguccggcgagacccagaugacccucaccaccgagggccccuccaccccccgccucuacaucggccgcacccaguacaccgucaccaugcacgacccccgcgcccccgcccuccgcuggaacaccaccuaccgccgcuacuccgccccccccauggacggcucccccggcaaguacaugucccaccucgccuccugcggcaugggccuccuccucaccgucgaccccggcuccggcaccguccucuggacccaggaccucggcguccccgucaugggcgucuacaccuggcaccaggacggccuccgccagcucccccaccucacccucgcccgcgacacccuccacuuccucgcccuccgcuggggccacauccgccuccccgccuccggcccccgcgacaccgccacccucuucuccacccucgacacccagcuccucaugacccucuacgucggcaaggacgagaccggcuucuacgucuccaaggcccucguccacaccggcgucgcccucgucccccgcggccucacccucgcccccgccgacggccccaccaccgacgaggucacccuccaggucuccggcgagcgcgagggcucccccuccaccgccguccgcuaccccuccggcuccgucgcccuccccucccaguggcuccucaucggccaccacgagcucccccccguccuccacaccaccaugcuccgcguccaccccacccucggcuccggcaccgccgagacccgcccccccgagaacacccaggcccccgccuucuuccucgagcuccucucccucucccgcgagaagcucugggacuccgagcuccaccccgaggagaagacccccgacuccuaccucggccucggcccccaggaccuccucgccgccucccucaccgccguccuccucggcggcuggauccucuucgucaugcgccagcagcagccccaggucgucgagaagcagcaggagaccccccucgcccccgccgacuucgcccacaucucccaggacgcccagucccuccacuccggcgccucccgccgcucccagaagcgccuccagucccccuccaagcaggcccagccccucgacgaccccgaggccgagcagcucaccgucgucggcaagaucuccuucaaccccaaggacguccucggccgcggcgccggcggcaccuucgucuuccgcggccaguucgagggccgcgccgucgccgucaagcgccuccuccgcgagugcuucggccucguccgccgcgagguccagcuccuccaggaguccgaccgccaccccaacguccuccgcuacuucugcaccgagcgcggcccccaguuccacuacaucgcccucgagcucugccgcgccucccuccaggaguacgucgagaaccccgaccucgaccgcggcggccucgagcccgaggucguccuccagcagcucauguccggccucgcccaccuccacucccuccacaucguccaccgcgaccucaagcccggcaacauccucaucaccggccccgacucccagggccucggccgcgucguccucuccgacuucggccucugcaagaagcuccccgccggccgcugcuccuucucccuccacuccggcauccccggcaccgagggcuggauggcccccgagcuccuccagcuccucccccccgacucccccaccuccgccgucgacaucuucuccgccggcugcgucuucuacuacguccucuccggcggcucccaccccuucggcgacucccucuaccgccaggccaacauccucaccggcgcccccugccucgcccaccucgaggaggagguccacgacaaggucgucgcccgcgaccucgucggcgccaugcucuccccccucccccagccccgccccuccgccccccagguccucgcccaccccuucuucuggucccgcgccaagcagcuccaguucuuccaggacgucuccgacuggcucgagaaggaguccgagcaggagccccucguccgcgcccucgaggccggcggcugcgccgucguccgcgacaacuggcacgagcacaucuccaugccccuccagaccgaccuccgcaaguuccgcuccuacaagggcaccuccguccgcgaccuccuccgcgccguccgcaacaagaagcaccacuaccgcgagcuccccgucgagguccgccaggcccucggccagguccccgacggcuucguccaguacuucaccaaccgcuucccccgccuccuccuccacacccaccgcgccaugcgcuccugcgccuccgagucccucuuccuccccuacuacccccccgacuccgaggcccgccgccccugccccggcgccaccggccgcuga

SEQ ID NO: 42830 - RNA, 1404 nt, Artificial Sequence
  derived and/or modified sequence opt2 from ERO1LB__Homo_sapiens__NP_063944
augucccagggcguccgccgcgccggcgccggccagggcgucgccgccgccguccagcuccucgucacccucuccuuccuccgcuccgucgucgaggcccaggucaccggcguccucgacgacugccucugcgacaucgacuccaucgacaacuucaacaccuacaagaucuuccccaagaucaagaagcuccaggagcgcgacuacuuccgcuacuacaaggucaaccucaagcgccccugccccuucugggccgaggacggccacugcuccaucaaggacugccacgucgagcccugccccgaguccaagauccccgucggcaucaaggccggccacuccaacaaguaccucaagauggccaacaacaccaaggagcucgaggacugcgagcaggccaacaagcucggcgccaucaacuccacccucuccaaccaguccaaggaggccuucaucgacugggcccgcuacgacgacucccgcgaccacuucugcgagcucgacgacgagcgcucccccgccgcccaguacgucgaccuccuccucaaccccgagcgcuacaccggcuacaagggcaccuccgccuggcgcgucuggaacuccaucuacgaggagaacugcuucaagccccgcuccgucuaccgcccccucaacccccucgcccccucccgcggcgaggacgacggcgaguccuucuacaccuggcucgagggccucugccucgagaagcgcgucuucuacaagcucaucuccggccuccacgccuccaucaaccuccaccucugcgccaacuaccuccucgaggagaccuggggcaagcccuccuggggccccaacaucaaggaguucaagcaccgcuucgaccccgucgagaccaagggcgagggcccccgccgccucaagaaccucuacuuccucuaccucaucgagcuccgcgcccucuccaaggucgcccccuacuucgagcgcuccaucgucgaccucuacaccggcaacgccgaggaggacgccgacaccaagacccuccuccucaacaucuuccaggacaccaaguccuuccccaugcacuucgacgagaaguccauguucgccggcgacaagaagggcgccaagucccucaaggaggaguuccgccuccacuucaagaacaucucccgcaucauggacugcgucggcugcgacaagugccgccucuggggcaagcuccagacccagggccucggcaccgcccucaagauccucuucuccgagaaggagauccagaagcuccccgagaacucccccuccaagggcuuccagcucacccgccaggagaucgucgcccuccucaacgccuucggccgccucuccaccuccauccgcgaccuccagaacuucaagguccuccuccagcacucccgcuga

SEQ ID NO: 42831 - RNA, 1407 nt, Artificial Sequence
  derived and/or modified sequence opt2 from ERO1L__Homo_sapiens__NP_055399
augggccgcggcuggggcuuccucuucggccuccucggcgccgucuggcuccucuccuccggccacggcgaggagcagccccccgagaccgccgcccagcgcugcuucugccaggucuccggcuaccucgacgacugcaccugcgacgucgagaccaucgaccgcuucaacaacuaccgccucuucccccgccuccagaagcuccucgaguccgacuacuuccgcuacuacaaggucaaccucaagcgccccugccccuucuggaacgacaucucccagugcggccgccgcgacugcgccgucaagcccugccaguccgacgagguccccgacggcaucaaguccgccuccuacaaguacuccgaggaggccaacaaccucaucgaggagugcgagcaggccgagcgccucggcgccgucgacgagucccucuccgaggagacccagaaggccguccuccaguggaccaagcacgacgacuccuccgacaacuucugcgaggccgacgacauccagucccccgaggccgaguacgucgaccuccuccucaaccccgagcgcuacaccggcuacaagggccccgacgccuggaagaucuggaacgucaucuacgaggagaacugcuucaagccccagaccaucaagcgcccccucaacccccucgccuccggccagggcaccuccgaggagaacaccuucuacuccuggcucgagggccucugcgucgagaagcgcgccuucuaccgccucaucuccggccuccacgccuccaucaacguccaccucuccgcccgcuaccuccuccaggagaccuggcucgagaagaaguggggccacaacaucaccgaguuccagcagcgcuucgacggcauccucaccgagggcgagggcccccgccgccucaagaaccucuacuuccucuaccucaucgagcuccgcgcccucuccaagguccuccccuucuucgagcgccccgacuuccagcucuucaccggcaacaagauccaggacgaggagaacaagaugcuccuccucgagauccuccacgagaucaaguccuucccccuccacuucgacgagaacuccuucuucgccggcgacaagaaggaggcccacaagcucaaggaggacuuccgccuccacuuccgcaacaucucccgcaucauggacugcgucggcugcuucaagugccgccucuggggcaagcuccagacccagggccucggcaccgcccucaagauccucuucuccgagaagcucaucgccaacaugcccgaguccggccccuccuacgaguuccaccucacccgccaggagaucgucucccucuucaacgccuucggccgcaucuccaccuccgucaaggagcucgagaacuuccgcaaccuccuccagaacauccacuga

SEQ ID NO: 42832 - RNA, 162 nt, Artificial Sequence
  derived and/or modified sequence opt2 from ERP29__Homo_sapiens__NP_001029197
auggccgccgccgucccccgcgccgccuuccucuccccccuccucccccuccuccucggcuuccuccuccucuccgccccccacggcggcuccggccuccacaccaagggcgcccucccccucgacaccgucaccuucuacaagaucauggucaccuccuga

SEQ ID NO: 42833 - RNA, 1221 nt, Artificial Sequence
  derived and/or modified sequence opt2 from ERP44__Homo_sapiens__NP_055866
augcaccccgccgucuuccucucccuccccgaccuccgcugcucccuccuccuccucgucaccugggucuucacccccgucaccaccgagaucaccucccucgacaccgagaacaucgacgagauccucaacaacgccgacgucgcccucgucaacuucuacgccgacuggugccgcuucucccagaugcuccaccccaucuucgaggaggccuccgacgucaucaaggaggaguuccccaacgagaaccaggucgucuucgcccgcgucgacugcgaccagcacuccgacaucgcccagcgcuaccgcaucuccaaguaccccacccucaagcucuuccgcaacggcaugaugaugaagcgcgaguaccgcggccagcgcuccgucaaggcccucgccgacuacauccgccagcagaaguccgaccccauccaggagauccgcgaccucgccgagaucaccacccucgaccgcuccaagcgcaacaucaucggcuacuucgagcagaaggacuccgacaacuaccgcgucuucgagcgcgucgccaacauccuccacgacgacugcgccuuccucuccgccuucggcgacgucuccaagcccgagcgcuacuccggcgacaacaucaucuacaagccccccggccacuccgcccccgacauggucuaccucggcgccaugaccaacuucgacgucaccuacaacuggauccaggacaagugcgucccccucguccgcgagaucaccuucgagaacggcgaggagcucaccgaggagggccuccccuuccucauccucuuccacaugaaggaggacaccgagucccucgagaucuuccagaacgaggucgcccgccagcucaucuccgagaagggcaccaucaacuuccuccacgccgacugcgacaaguuccgccacccccuccuccacauccagaagacccccgccgacugccccgucaucgccaucgacuccuuccgccacauguacgucuucggcgacuucaaggacguccucauccccggcaagcucaagcaguucgucuucgaccuccacuccggcaagcuccaccgcgaguuccaccacggccccgaccccaccgacaccgcccccggcgagcaggcccaggacgucgccuccuccccccccgaguccuccuuccagaagcucgcccccuccgaguaccgcuacacccuccuccgcgaccgcgacgagcucuga

SEQ ID NO: 42834 - RNA, 1815 nt, Artificial Sequence
  derived and/or modified sequence opt2 from ERV3-1__Homo_sapiens__NP_001007254
augcucggcaugaacaugcuccucaucacccucuuccuccuccucccccucuccaugcucaagggcgagcccugggagggcugccuccacugcacccacaccaccugguccggcaacaucaugaccaagacccuccucuaccacaccuacuacgagugcgccggcaccugccucggcaccugcacccacaaccagaccaccuacuccgucugcgaccccggccgcggccagcccuacgucugcuacgaccccaaguccucccccggcaccugguucgagauccacgucggcuccaaggagggcgaccuccucaaccagaccaaggucuuccccuccggcaaggacgucgucucccucuacuucgacgucugccagaucgucuccaugggcucccucuuccccgucaucuucuccuccauggaguacuacuccuccugccacaagaaccgcuacgcccaccccgccugcuccaccgacucccccgucaccaccugcugggacugcaccaccugguccaccaaccagcagucccucggccccaucaugcucaccaagaucccccucgagcccgacugcaagaccuccaccugcaacuccgucaaccucaccauccucgagcccgaccagcccaucuggaccaccggccucaaggccccccucggcgcccgcgucuccggcgaggagaucggccccggcgccuacgucuaccucuacaucaucaagaagacccgcacccgcuccacccagcaguuccgcgucuucgaguccuucuacgagcacgucaaccagaagcuccccgagccccccccccucgccuccaaccucuucgcccagcucgccgagaacaucgccuccucccuccacgucgccuccugcuacgucugcggcggcaugaacaugggcgaccaguggcccugggaggcccgcgagcucaugccccaggacaacuucacccucaccgccuccucccucgagcccgcccccuccucccaguccaucugguuccucaagaccuccaucaucggcaaguucugcaucgcccgcuggggcaaggccuucaccgaccccgucggcgagcucaccugccucggccagcaguacuacaacgagacccucggcaagacccucuggcgcggcaaguccaacaacuccgaguccccccaccccucccccuucucccgcuuccccucccucaaccacuccugguaccagcucgaggcccccaacaccuggcaggcccccuccggccucuacuggaucugcggcccccaggccuaccgccagcuccccgccaagugguccggcgccugcguccucggcaccauccgccccuccuucuuccucaugccccucaagcagggcgaggcccucggcuaccccaucuacgacgagaccaagcgcaaguccaagcgcggcaucaccaucggcgacuggaaggacaacgaguggccccccgagcgcaucauccaguacuacggccccgccaccugggccgaggacggcauguggggcuaccgcacccccgucuacaugcucaaccgcaucauccgccuccaggccguccucgagaucaucaccaacgagaccgccggcgcccucaaccuccucgcccagcaggccaccaagaugcgcaacgucaucuaccagaaccgccucgcccucgacuaccuccucgcccaggaggagggcgucugcggcaaguucaaccucaccaacugcugccucgagcucgacgacgagggcaaggucaucaaggagaucaccgccaagauccagaagcucgcccacauccccguccagaccuggaagggcuga

SEQ ID NO: 42835 - RNA, 1617 nt, Artificial Sequence
  derived and/or modified sequence opt2 from ERVW-1__Homo_sapiens__NP_055405
auggcccuccccuaccacaucuuccucuucaccguccuccuccccuccuucacccucaccgcccccccccccugccgcugcaugaccuccuccucccccuaccaggaguuccucuggcgcaugcagcgccccggcaacaucgacgcccccuccuaccgcucccucuccaagggcacccccaccuucaccgcccacacccacaugccccgcaacugcuaccacuccgccacccucugcaugcacgccaacacccacuacuggaccggcaagaugaucaaccccuccugccccggcggccucggcgucaccgucugcuggaccuacuucacccagaccggcauguccgacggcggcggcguccaggaccaggcccgcgagaagcacgucaaggaggucaucucccagcucacccgcguccacggcaccuccucccccuacaagggccucgaccucuccaagcuccacgagacccuccgcacccacacccgccucgucucccucuucaacaccacccucaccggccuccacgaggucuccgcccagaaccccaccaacugcuggaucugccucccccucaacuuccgccccuacgucuccauccccguccccgagcaguggaacaacuucuccaccgagaucaacaccaccuccguccucgucggcccccucgucuccaaccucgagaucacccacaccuccaaccucaccugcgucaaguucuccaacaccaccuacaccaccaacucccagugcauccgcugggucaccccccccacccagaucgucugccuccccuccggcaucuucuucgucugcggcaccuccgccuaccgcugccucaacggcuccuccgaguccaugugcuuccucuccuuccucgucccccccaugaccaucuacaccgagcaggaccucuacuccuacgucaucuccaagccccgcaacaagcgcguccccauccuccccuucgucaucggcgccggcguccucggcgcccucggcaccggcaucggcggcaucaccaccuccacccaguucuacuacaagcucucccaggagcucaacggcgacauggagcgcgucgccgacucccucgucacccuccaggaccagcucaacucccucgccgccgucguccuccagaaccgccgcgcccucgaccuccucaccgccgagcgcggcggcaccugccucuuccucggcgaggagugcugcuacuacgucaaccaguccggcaucgucaccgagaaggucaaggagauccgcgaccgcauccagcgccgcgccgaggagcuccgcaacaccggccccuggggccuccucucccaguggaugcccuggauccuccccuuccucggcccccucgccgccaucauccuccuccuccucuucggccccugcaucuucaaccuccucgucaacuucgucuccucccgcaucgaggccgucaagcuccagauggagcccaagaugcaguccaagaccaagaucuaccgccgcccccucgaccgccccgccuccccccgcuccgacgucaacgacaucaagggcaccccccccgaggagaucuccgccgcccagccccuccuccgccccaacuccgccggcuccuccuga

SEQ ID NO: 42836 - RNA, 1173 nt, Artificial Sequence
  derived and/or modified sequence opt2 from ESAM__Homo_sapiens__NP_620411
augaucucccuccccggcccccucgucaccaaccuccuccgcuuccucuuccucggccucuccgcccucgccccccccucccgcgcccagcuccagcuccaccuccccgccaaccgccuccaggccgucgagggcggcgaggucguccuccccgccugguacacccuccacggcgaggucuccuccucccagcccugggagguccccuucgucaugugguucuucaagcagaaggagaaggaggaccagguccucuccuacaucaacggcgucaccaccuccaagcccggcgucucccucgucuacuccaugcccucccgcaaccucucccuccgccucgagggccuccaggagaaggacuccggccccuacuccugcuccgucaacguccaggacaagcagggcaagucccgcggccacuccaucaagacccucgagcucaacguccucgucccccccgccccccccuccugccgccuccagggcgucccccacgucggcgccaacgucacccucuccugccaguccccccgcuccaagcccgccguccaguaccagugggaccgccagcuccccuccuuccagaccuucuucgcccccgcccucgacgucauccgcggcucccucucccucaccaaccucuccuccuccauggccggcgucuacgucugcaaggcccacaacgaggucggcaccgcccagugcaacgucacccucgaggucuccaccggccccggcgccgccgucgucgccggcgccgucgucggcacccucgucggccucggccuccucgccggccucguccuccucuaccaccgccgcggcaaggcccucgaggagcccgccaacgacaucaaggaggacgccaucgccccccgcacccuccccuggcccaaguccuccgacaccaucuccaagaacggcacccucuccuccgucaccuccgcccgcgcccuccgccccccccacggccccccccgccccggcgcccucacccccacccccucccucuccucccaggcccuccccuccccccgccuccccaccaccgacggcgcccacccccagcccaucucccccauccccggcggcgucuccuccuccggccucucccgcaugggcgccguccccgucaugguccccgcccagucccaggccggcucccucgucuga

SEQ ID NO: 42837 - RNA, 2523 nt, Artificial Sequence
  derived and/or modified sequence opt2 from ESCO1__Homo_sapiens__NP_443143
augauguccauccaggagaaguccaaggagaacuccuccaaggucaccaagaaguccgacgacaagaacuccgagaccgagauccaggacucccagaagaaccucgccaagaaguccggccccaaggagaccaucaagucccaggccaaguccuccuccgaguccaagaucaaccagcccgagcucgagacccgcauguccacccgcuccuccaaggccgccuccaacgacaaggccaccaaguccaucaacaagaacaccgucaccguccgcggcuacucccaggaguccaccaagaagaagcucucccagaagaagcucguccacgagaaccccaaggccaacgagcagcucaaccgccgcucccagcgccuccagcagcucaccgaggucucccgccgcucccuccgcucccgcgagauccagggccagguccaggccgucaagcagucccucccccccaccaagaaggagcagugcuccuccacccaguccaaguccaacaagaccucccagaagcacgucaagcgcaagguccucgaggucaaguccgacuccaaggaggacgagaaccucgucaucaacgaggucaucaacucccccaagggcaagaagcgcaaggucgagcaccagaccgccugcgccugcuccucccagugcacccagggcuccgagaagugcccccagaagaccacccgccgcgacgagaccaagcccguccccgucaccuccgaggucaagcgcuccaagauggccaccuccgucguccccaagaagaacgagaugaagaaguccguccacacccaggucaacaccaacaccacccuccccaaguccccccagcccuccguccccgagcaguccgacaacgagcucgagcaggccggcaaguccaagcgcggcuccauccuccagcucugcgaggagaucgccggcgagaucgaguccgacaacgucgaggucaagaaggaguccucccagauggaguccgucaaggaggagaagcccaccgagaucaagcucgaggagaccuccgucgagcgccagauccuccaccagaaggagaccaaccaggacguccagugcaaccgcuucuuccccucccgcaagaccaagcccgucaagugcauccucaacggcaucaacuccuccgccaagaagaacuccaacuggaccaagaucaagcucuccaaguucaacuccguccagcacaacaagcucgacucccaggucucccccaagcucggccuccuccgcaccuccuucuccccccccgcccucgagaugcaccaccccgucacccaguccaccuuccucggcaccaagcuccacgaccgcaacaucaccugccagcaggagaagaugaaggagaucaacuccgaggaggucaagaucaacgacaucaccgucgagaucaacaagaccaccgagcgcgcccccgagaacugccaccucgccaacgagaucaagcccuccgaccccccccucgacaaccagaugaagcacuccuucgacuccgccuccaacaagaacuucucccagugccucgaguccaagcucgagaacucccccgucgagaacgucaccgccgccuccacccuccucucccaggccaagaucgacaccggcgagaacaaguuccccggcuccgccccccagcagcacuccauccucuccaaccagaccuccaaguccuccgacaaccgcgagaccccccgcaaccacucccuccccaagugcaacucccaccucgagaucaccauccccaaggaccucaagcucaaggaggccgagaagaccgacgagaagcagcucaucaucgacgccggccagaagcgcuucggcgccgucuccugcaacgucugcggcaugcucuacaccgccuccaaccccgaggacgagacccagcaccuccucuuccacaaccaguucaucuccgccgucaaguacgucggcuggaagaaggagcgcauccucgccgaguaccccgacggccgcaucaucaugguccuccccgaggaccccaaguacgcccucaagaaggucgacgagauccgcgagauggucgacaacgaccucggcuuccagcaggccccccucaugugcuacucccgcaccaagacccuccucuucaucuccaacgacaagaaggucgucggcugccucaucgccgagcacauccaguggggcuaccgcgucaucgaggagaagcuccccgucauccgcuccgaggaggagaagguccgcuucgagcgccagaaggccuggugcugcuccacccuccccgagcccgccaucugcggcaucucccgcaucugggucuucuccaugaugcgccgcaagaagaucgccucccgcaugaucgagugccuccgcuccaacuucaucuacggcuccuaccucuccaaggaggagaucgccuucuccgaccccacccccgacggcaagcucuucgccacccaguacugcggcaccggccaguuccucgucuacaacuucaucaacggccagaacuccaccuga

SEQ ID NO: 42838 - RNA, 1806 nt, Artificial Sequence
  derived and/or modified sequence opt2 from ESCO2__Homo_sapiens__XP_011542723
auggccgcccucaccccccgcaagcgcaagcaggacucccucaagugcgacucccuccuccacuucaccgagaaccucuuccccucccccaacaagaagcacugcuucuaccagaacuccgacaagaacgaggagaaccuccacugcucccagcaggagcacuucguccucuccgcccucaagaccaccgagaucaaccgccuccccuccgccaaccagggcucccccuucaaguccgcccucuccaccgucuccuucuacaaccagaacaagugguaccucaacccccucgagcgcaagcucaucaaggagucccgcuccaccugccucaagaccaacgacgaggacaaguccuuccccaucgucaccgagaagaugcagggcaagcccgucugcuccaagaagaacaacaagaagccccagaagucccucaccgccaaguaccagcccaaguaccgccacaucaagcccgucucccgcaacucccgcaacuccaagcagaaccgcgucaucuacaagcccaucgucgagaaggagaacaacugccacuccgccgagaacaacuccaacgccccccgcguccucucccagaagaucaagccccaggucacccuccagggcggcgccgccuucuucguccgcaagaaguccucccuccgcaaguccucccucgagaacgagcccucccucggccgcacccagaaguccaaguccgaggucaucgaggacuccgacgucgagaccgucuccgagaagaagaccuucgccacccgccagguccccaagugccucguccucgaggagaagcucaagaucggccuccucuccgccuccuccaagaacaaggagaagcucaucaaggacuccuccgacgaccgcgucuccuccaaggagcacaaggucgacaagaacgaggccuucuccuccgaggacucccucggcgagaacaagaccaucucccccaaguccaccgucuaccccaucuucuccgccuccuccgucaacuccaagcgcucccucggcgaggagcaguucuccgucggcuccgucaacuucaugaagcagaccaacauccagaagaacaccaacacccgcgacaccuccaagaagaccaaggaccagcucaucaucgacgccggccagaagcacuucggcgccaccgucugcaaguccugcggcaugaucuacaccgccuccaaccccgaggacgagaugcagcacguccagcaccaccaccgcuuccucgagggcaucaaguacgucggcuggaagaaggagcgcgucgucgccgaguucugggacggcaagaucguccucguccucccccacgaccccuccuucgccaucaagaaggucgaggacguccaggagcucgucgacaacgagcucggcuuccagcaggucguccccaagugccccaacaagaucaagaccuuccucuucaucuccgacgagaagcgcgucgucggcugccucaucgccgagcccaucaagcaggccuuccgcguccucuccgagcccaucggccccgagucccccuccuccaccgagugcccccgcgccuggcagugcuccgacguccccgagcccgccgucugcggcaucucccgcaucugggucuuccgccucaagcgccgcaagcgcaucgcccgccgccucgucgacacccuccgcaacugcuucauguucggcugcuuccucuccaccgacgagaucgccuucuccgaccccacccccgacggcaagcucuucgccaccaaguacugcaacacccccaacuuccucgucuacaacuucaacuccuga

SEQ ID NO: 42839 - RNA, 849 nt, Artificial Sequence
  derived and/or modified sequence opt2 from ESD__Homo_sapiens__XP_011533256
auggcccucaagcagaucuccuccaacaagugcuucggcggccuccagaaggucuucgagcacgacuccgucgagcucaacugcaagaugaaguucgccgucuaccucccccccaaggccgagaccggcaagugccccgcccucuacuggcucuccggccucaccugcaccgagcagaacuucaucuccaaguccggcuaccaccaguccgccuccgagcacggccucgucgucaucgcccccgacaccuccccccgcggcugcaacaucaagggcgaggacgaguccugggacuucggcaccggcgccggcuucuacgucgacgccaccgaggaccccuggaagaccaacuaccgcauguacuccuacgucaccgaggagcucccccagcucaucaacgccaacuuccccgucgacccccagcgcauguccaucuucggccacuccaugggcggccacggcgcccucaucugcgcccucaagaaccccggcaaguacaaguccgucuccgccuucgcccccaucugcaaccccguccucugccccuggggcaagaaggccuucuccggcuaccucggcaccgaccaguccaaguggaaggccuacgacgccacccaccucgucaaguccuaccccggcucccagcucgacauccucaucgaccagggcaaggacgaccaguuccuccucgacggccagcuccuccccgacaacuucaucgccgccugcaccgagaagaagauccccgucgucuuccgccuccaggagggcuacgaccacuccuacuacuucaucgccaccuucaucaccgaccacauccgccaccacgccaaguaccucaacgccuga

SEQ ID NO: 42840 - RNA, 2556 nt, Artificial Sequence
  derived and/or modified sequence opt2 from ESF1__Homo_sapiens__NP_001263309
auguccuccaagcaggagaucauguccgaccagcgcuuccgccgcgucgccaaggacccccgcuucugggagaugcccgagaaggaccgcaaggucaagaucgacaagcgcuuccgcgccauguuccacgacaagaaguucaagcucaacuacgccgucgacaagcgcggccgccccaucucccacuccaccaccgaggaccucaagcgcuucuacgaccucuccgacuccgacuccaaccucuccggcgaggacuccaaggcccucucccagaagaagaucaagaagaagaagacccagaccaagaaggagaucgacuccaagaaccucgucgagaagaagaaggagaccaagaaggccaaccacaagggcuccgagaacaagaccgaccucgacaacuccaucggcaucaagaagaugaagaccuccugcaaguucaagaucgacuccaacaucucccccaagaaggacuccaaggaguucacccagaagaacaagaaggagaagaagaacaucguccagcacaccaccgacuccucccucgaggagaagcagcgcacccucgacuccggcaccuccgagaucgucaaguccccccgcaucgagugcuccaagacccgccgcgagaugcaguccgucguccagcucaucaugacccgcgacuccgacggcuacgagaacuccaccgacggcgagaugugcgacaaggacgcccucgaggaggacuccgaguccgucuccgagaucggcuccgacgaggaguccgagaacgagaucaccuccgucggccgcgccuccggcgacgacgacggcuccgaggacgacgaggaggaggacgaggacgaggaggaggacgaggacgaggacuccgaggacgacgacaaguccgacuccggccccgaccucgcccgcggcaagggcaacaucgagaccuccuccgaggacgaggacgacaccgccgaccucuuccccgaggaguccggcuucgagcacgccuggcgcgagcucgacaaggacgccccccgcgccgacgagaucacccgccgccucgccgucugcaacauggacugggaccgccucaaggccaaggaccuccucgcccucuucaacuccuucaagcccaagggcggcgucaucuucuccgucaagaucuaccccuccgaguucggcaaggagcgcaugaaggaggagcagguccagggccccgucgagcuccucuccauccccgaggacgcccccgagaaggacuggaccucccgcgagaagcuccgcgacuaccaguucaagcgccucaaguacuacuacgccgucgucgacugcgacucccccgagaccgccuccaagaucuacgaggacugcgacggccucgaguucgaguccuccugcuccuucaucgaccuccgcuucauccccgacgacaucaccuucgacgacgagcccaaggacgucgccuccgaggucaaccucaccgccuacaagcccaaguacuucaccuccgccgccaugggcaccuccaccgucgagaucaccugggacgagaccgaccacgagcgcaucaccaugcucaaccgcaaguucaagaaggaggagcuccucgacauggacuuccaggccuaccucgccuccuccuccgaggacgaggaggagaucgaggaggagcuccagggcgacgacggcgucaacgucgaggaggacggcaagaccaagaagucccagaaggacgacgaggagcagaucgccaaguaccgccagcuccuccaggucauccaggagaaggagaagaagggcaaggagaacgacauggagauggagaucaaguggguccccggccucaaggaguccgccgaggagauggucaagaacaagcucgagggcaaggacaagcucacccccugggagcaguuccucgagaagaagaaggagaagaagcgccucaagcgcaagcagaaggcccucgccgaggaggccuccgaggaggagcuccccuccgacgucgaccucaacgaccccuacuucgccgaggaggucaagcagaucggcaucaacaagaaguccgucaaguccgccaaggacggcaccucccccgaggaggagaucgagaucgagcgccagaaggccgagauggcccuccucaugauggacgaggacgaggacuccaagaagcacuucaacuacaacaagaucgucgagcaccagaaccucuccaagaagaagaagaagcagcucaugaagaagaaggagcucaucgaggacgacuucgaggucaacgucaacgacgcccgcuuccaggccauguacaccucccaccucuucaaccucgaccccuccgaccccaacuucaagaagaccaaggccauggagaagauccucgaggagaaggcccgccagcgcgagcgcaaggagcaggagcucacccaggccaucaagaagaaggaguccgagaucgagaaggagucccagcgcaaguccaucgaccccgcccucuccaugcucaucaaguccaucaagaccaagaccgagcaguuccaggcccgcaagaagcagaaggucaaguga

SEQ ID NO: 42841 - RNA, 405 nt, Artificial Sequence
  derived and/or modified sequence opt2 from ESM1__Homo_sapiens__NP_001129076
augaaguccguccuccuccucaccacccuccucguccccgcccaccucgucgccgccugguccaacaacuacgccgucgacugcccccagcacugcgacuccuccgagugcaaguccuccccccgcugcaagcgcaccguccucgacgacugcggcugcugccgcgucugcgccgccggccgcggcgagaccugcuaccgcaccgucuccggcauggacggcaugaagugcggccccggccuccgcugccagcccuccaacggcgaggaccccuucggcgaggaguucggcaucugcaaggagcacgacauggccuccggcgacggcaacaucguccgcgaggaggucgucaaggagaacgccgccggcucccccgucaugcgcaaguggcucaacccccgcuga

SEQ ID NO: 42842 - RNA, 6363 nt, Artificial Sequence
  derived and/or modified sequence opt2 from ESPL1__Homo_sapiens__NP_036423
augcgcuccuucaagcgcgucaacuucggcacccuccucuccucccagaaggaggccgaggagcuccuccccgcccucaaggaguuccucuccaacccccccgccggcuuccccuccucccgcuccgacgccgagcgccgccaggccugcgacgccauccuccgcgccugcaaccagcagcucaccgccaagcucgccugcccccgccaccucggcucccuccucgagcucgccgagcucgccugcgacggcuaccucgucuccaccccccagcgccccccccucuaccucgagcgcauccucuucguccuccuccgcaacgccgccgcccagggcucccccgaggccacccuccgccucgcccagccccuccacgccugccucguccagugcucccgcgaggccgccccccaggacuacgaggccgucgcccgcggcuccuucucccuccucuggaagggcgccgaggcccuccucgagcgccgcgccgccuucgccgcccgccucaaggcccucuccuuccucguccuccucgaggacgaguccacccccugcgaggucccccacuucgccucccccaccgccugccgcgccgucgccgcccaccagcucuucgacgccuccggccacggccucaacgaggccgacgccgacuuccucgacgaccuccucucccgccacgucauccgcgcccucgucggcgagcgcggcuccuccuccggccuccucuccccccagcgcgcccucugccuccucgagcucacccucgagcacugccgccgcuucugcuggucccgccaccacgacaaggccaucuccgccgucgagaaggcccacuccuaccuccgcaacaccaaccucgcccccucccuccagcucugccagcucggcgucaagcuccuccaggucggcgaggagggcccccaggccgucgccaagcuccucaucaaggccuccgccguccucuccaaguccauggaggcccccucccccccccuccgcgcccucuacgaguccugccaguucuuccucuccggccucgagcgcggcaccaagcgccgcuaccgccucgacgccauccucucccucuucgccuuccucggcggcuacugcucccuccuccagcagcuccgcgacgacggcgucuacggcggcuccuccaagcagcagcaguccuuccuccagauguacuuccagggccuccaccucuacaccgucgucgucuacgacuucgcccagggcugccagaucgucgaccucgccgaccucacccagcucgucgacuccugcaaguccaccgucgucuggaugcucgaggcccucgagggccucuccggccaggagcucaccgaccacaugggcaugaccgccuccuacaccuccaaccucgccuacuccuucuacucccacaagcucuacgccgaggccugcgccaucuccgagccccucugccagcaccucggccucgucaagcccggcaccuaccccgaggucccccccgagaagcuccaccgcugcuuccgccuccaggucgagucccucaagaagcucggcaagcaggcccagggcugcaagauggucauccucuggcucgccgcccuccagcccugcucccccgagcacauggccgagcccgucaccuucuggguccgcgucaagauggacgccgcccgcgccggcgacaaggagcuccagcucaagacccuccgcgacucccucuccggcugggaccccgagacccucgcccuccuccuccgcgaggagcuccaggccuacaaggccguccgcgccgacaccggccaggagcgcuucaacaucaucugcgaccuccucgagcucucccccgaggagacccccgccggcgccugggcccgcgccacccaccucgucgagcucgcccagguccucugcuaccacgacuucacccagcagaccaacugcuccgcccucgacgccauccgcgaggcccuccagcuccucgacuccguccgccccgaggcccaggcccgcgaccagcuccucgacgacaaggcccaggcccuccucuggcucuacaucugcacccucgaggccaagaugcaggagggcaucgagcgcgaccgccgcgcccaggcccccggcaaccucgaggaguucgaggucaacgaccucaacuacgaggacaagcuccaggaggaccgcuuccucuacuccaacaucgccuucaaccucgccgccgacgccgcccaguccaagugccucgaccaggcccucgcccucuggaaggagcuccucaccaagggccaggcccccgccguccgcugccuccagcagaccgccgccucccuccagauccucgccgcccucuaccagcucgucgccaagcccaugcaggcccucgagguccuccuccuccuccgcaucgucuccgagcgccucaaggaccacuccaaggccgccggcuccuccugccacaucacccagcuccuccucacccucggcugccccuccuacgcccagcuccaccucgaggaggccgccuccucccucaagcaccucgaccagaccaccgacaccuaccuccuccucucccucaccugcgaccuccuccgcucccagcucuacuggacccaccagaaggucaccaagggcgucucccuccuccucuccguccuccgcgaccccgcccuccagaaguccuccaaggccugguaccuccuccgcguccagguccuccagcucgucgccgccuaccucucccuccccuccaacaaccucucccacucccucugggagcagcucugcgcccagggcuggcagacccccgagaucgcccucaucgacucccacaagcuccuccgcuccaucauccuccuccucaugggcuccgacauccucuccacccagaaggccgccgucgagaccuccuuccucgacuacggcgagaaccucguccagaaguggcagguccucuccgagguccucuccugcuccgagaagcucgucugccaccucggccgccucggcuccgucuccgaggccaaggccuucugccucgaggcccucaagcucaccaccaagcuccagaucccccgccagugcgcccucuuccucguccucaagggcgagcucgagcucgcccgcaacgacaucgaccucugccaguccgaccuccagcagguccucuuccuccucgaguccugcaccgaguucggcggcgucacccagcaccucgacuccgucaagaagguccaccuccagaagggcaagcagcaggcccagguccccugccccccccagcuccccgaggaggagcucuuccuccgcggccccgcccucgagcucgucgccaccgucgccaaggagcccggccccaucgcccccuccaccaacuccucccccguccucaagaccaagccccagcccauccccaacuuccucucccacucccccaccugcgacugcucccucugcgccucccccguccucaccgccgucugccuccgcuggguccucgucaccgccggcguccgccucgccaugggccaccaggcccagggccucgaccuccuccaggucguccucaagggcugccccgaggccgccgagcgccucacccaggcccuccaggccucccucaaccacaagaccccccccucccucguccccucccuccucgacgagauccucgcccaggccuacacccuccucgcccucgagggccucaaccagcccuccaacgagucccuccagaagguccuccaguccggccucaaguucgucgccgcccgcaucccccaccucgagcccuggcgcgccucccuccuccucaucugggcccucaccaagcucggcggccucuccugcugcaccacccagcucuucgccuccuccuggggcuggcagcccccccucaucaaguccguccccggcuccgagcccuccaagacccagggccagaagcgcuccggccgcggccgccagaagcucgccuccgccccccuccgccucaacaacaccucccagaagggccucgagggccgcggccuccccugcacccccaagccccccgaccgcauccgccaggccggcccccacguccccuucaccgucuucgaggaggucugccccaccgaguccaagcccgaggucccccaggccccccgcguccagcagcgcguccagacccgccucaaggucaacuucuccgacgacuccgaccucgaggaccccgucuccgccgaggccuggcucgccgaggagcccaagcgccgcggcaccgccucccgcggccgcggccgcgcccgcaagggccucucccucaagaccgacgccgucgucgcccccggcuccgcccccggcaaccccggccucaacggccgcucccgccgcgccaagaaggucgccucccgccacugcgaggagcgccgcccccagcgcgccuccgaccaggcccgccccggccccgagaucaugcgcaccauccccgaggaggagcucaccgacaacuggcgcaagauguccuucgagauccuccgcggcuccgacggcgaggacuccgccuccggcggcaagacccccgcccccggccccgaggccgccuccggcgagugggagcuccuccgccucgacuccuccaagaagaagcuccccucccccugccccgacaaggaguccgacaaggaccucggcccccgccuccgccuccccuccgcccccgucgccaccggccucuccacccucgacuccaucugcgacucccucuccgucgccuuccgcggcaucucccacugcccccccuccggccucuacgcccaccucugccgcuuccucgcccucugccucggccaccgcgaccccuacgccaccgccuuccucgucaccgaguccgucuccaucaccugccgccaccagcuccucacccaccuccaccgccagcucuccaaggcccagaagcaccgcggcucccucgagaucgccgaccagcuccagggccucucccuccaggagaugcccggcgacgucccccucgcccgcauccagcgccucuucuccuuccgcgcccucgaguccggccacuucccccagcccgagaaggaguccuuccaggagcgccucgcccucauccccuccggcgucaccgucugcguccucgcccucgccacccuccagcccggcaccgucggcaacacccuccuccucacccgccucgagaaggacuccccccccgucuccguccagauccccaccggccagaacaagcuccaccuccgcuccguccucaacgaguucgacgccauccagaaggcccagaaggagaacuccuccugcaccgacaagcgcgagugguggaccggccgccucgcccucgaccaccgcauggagguccucaucgccucccucgagaaguccguccucggcugcuggaagggccuccuccuccccuccuccgaggagcccggccccgcccaggaggccucccgccuccaggagcuccuccaggacugcggcuggaaguaccccgaccgcacccuccucaagaucaugcucuccggcgccggcgcccucaccccccaggacauccaggcccucgccuacggccucugccccacccagcccgagcgcgcccaggagcuccucaacgaggccgucggccgccuccagggccucaccguccccuccaacucccaccucguccucguccucgacaaggaccuccagaagcuccccugggaguccaugcccucccuccaggcccuccccgucacccgccuccccuccuuccgcuuccuccucuccuacuccaucaucaaggaguacggcgccucccccguccucucccagggcgucgacccccgcuccaccuucuacguccucaacccccacaacaaccucuccuccaccgaggagcaguuccgcgccaacuucuccuccgaggccggcuggcgcggcgucgucggcgaggucccccgccccgagcagguccaggaggcccucaccaagcacgaccucuacaucuacgccggccacggcgccggcgcccgcuuccucgacggccaggccguccuccgccucuccugccgcgccgucgcccuccucuucggcugcuccuccgccgcccucgccguccgcggcaaccucgagggcgccggcaucguccucaaguacaucauggccggcugcccccucuuccucggcaaccucugggacgucaccgaccgcgacaucgaccgcuacaccgaggcccuccuccagggcuggcucggcgccggccccggcgccccccuccucuacuacgucaaccaggcccgccaggccccccgccucaaguaccucaucggcgccgcccccaucgccuacggccuccccgucucccuccgcuga

SEQ ID NO: 42843 - RNA, 2475 nt, Artificial Sequence
  derived and/or modified sequence opt2 from ESPN__Homo_sapiens__XP_011540537
auggcccucgagcaggcccuccaggccgcccgccagggcgagcucgacguccuccgcucccuccacgccgccggccuccucggccccucccuccgcgacccccucgacgcccuccccguccaccacgccgcccgcgccggcaagcuccacugccuccgcuuccucgucgaggaggccgcccuccccgccgccgcccgcgcccgcaacggcgccacccccgcccacgacgccuccgccaccggccaccucgccugccuccaguggcuccucucccagggcggcugccgcguccaggacaaggacaacuccggcgccaccguccuccaccucgccgcccgcuucggccaccccgaggucgucaacuggcuccuccaccacggcggcggcgaccccaccgccgccaccgacaugggcgcccuccccauccacuacgccgccgccaagggcgacuuccccucccuccgccuccucgucgagcacuaccccgagggcgucaacgcccagaccaagaacggcgccaccccccucuaccucgccugccaggagggccaccucgaggucacccaguaccucguccaggagugcggcgccgacccccacgcccgcgcccacgacggcaugaccccccuccacgccgccgcccagaugggccacucccccgucaucgucuggcucgucuccugcaccgacgucucccucuccgagcaggacaaggacggcgccaccgccaugcacuucgccgccucccgcggccacaccaagguccucuccuggcuccuccuccacggcggcgagaucuccgccgaccucuggggcggcaccccccuccacgacgccgccgagaacggcgagcucgagugcugccagauccucgucgucaacggcgccgagcucgacguccgcgaccgcgacggcuacaccgccgccgaccucuccgacuucaacggccacucccacugcacccgcuaccuccgcaccgucgagaaccucuccgucgagcaccgcguccucucccgcgaccccuccgccgagcucgaggccaagcagcccgacuccggcauguccucccccaacaccaccgucuccguccagccccucaacuucgaccucuccucccccaccuccacccucuccaacuacgacuccugcuccuccucccacuccuccaucaagggccagcacccccccugcggccucuccuccgcccgcgccgccgacauccaguccuacauggacaugcucaaccccgagcucggccucccccgcggcaccaucggcaagcccaccccccccccccccccccccuccuuccccccccccccccccccccccggcacccagcuccccccccccccccccggcuaccccgcccccaagccccccgucggcccccaggccgccgacaucuacaugcagaccaagaacaagcuccgccacgucgagaccgaggcccucaagaaggagcucuccuccugcgacggccacgacggccuccgccgccaggacuccucccgcaagccccgcgccuucuccaagcagcccuccaccggcgacuacuaccgccagcucggccgcugccccggcgagacccucgccgcccgccccggcauggcccacuccgaggaggccgcccuccuccccggcaaccacguccccaacggcugcgccgccgaccccaaggccucccgcgagcuccccccccccccccccccccccccccccccccuccccgaggccgccuccucccccccccccgcccccccccucccccucgaguccgccggccccggcugcggccagcgccgcuccuccuccuccaccggcuccaccaaguccuucaacaugaugucccccaccggcgacaacuccgagcuccucgccgagaucaaggccggcaagucccucaagcccaccccccaguccaagggccucaccaccgucuucuccggcaucggccagcccgccuuccagcccgacuccccccuccccuccgucucccccgcccucucccccguccgcucccccaccccccccgccgccggcuuccagccccuccucaacggcucccucguccccgucccccccaccacccccgcccccggcguccagcucgacgucgaggcccucauccccacccacgacgagcagggccgccccauccccgaguggaagcgccaggucaugguccgcaagaugcagcucaagaugcaggaggaggaggagcagcgccgcaaggaggaggaggaggaggcccgccucgccuccaugcccgccuggcgccgcgaccuccuccgcaagaagcucgaggaggagcgcgagcagaagcgcaaggaggaggagcgccagaagcaggaggagcuccgccgcgagaaggagcaguccgagaagcuccgcacccucggcuacgacgaguccaagcucgcccccuggcagcgccaggucauccucaagaagggcgacaucgccaaguacuga

SEQ ID NO: 42844 - RNA, 1794 nt, Artificial Sequence
  derived and/or modified sequence opt2 from ESR1__Homo_sapiens__NP_001278159
augaccaugacccuccacaccaaggccuccggcauggcccuccuccaccagauccagggcaacgagcucgagccccucaaccgcccccagcucaagaucccccucgagcgcccccucggcgaggucuaccucgacuccuccaagcccgccgucuacaacuaccccgagggcgccgccuacgaguucaacgccgccgccgccgccaacgcccaggucuacggccagaccggccuccccuacggccccggcuccgaggccgccgccuucggcuccaacggccucggcggcuuccccccccucaacuccgucucccccuccccccucaugcuccuccacccccccccccagcucucccccuuccuccagccccacggccagcagguccccuacuaccucgagaacgagcccuccggcuacaccguccgcgaggccggcccccccgccuucuaccgccccaacuccgacaaccgccgccagggcggccgcgagcgccucgccuccaccaacgacaagggcuccauggccauggaguccgccaaggagacccgcuacugcgccgucugcaacgacuacgccuccggcuaccacuacggcgucugguccugcgagggcugcaaggccuucuucaagcgcuccauccagggcaaccgccacaacgacuacaugugccccgccaccaaccagugcaccaucgacaagaaccgccgcaaguccugccaggccugccgccuccgcaagugcuacgaggucggcaugaugaagggcggcauccgcaaggaccgccgcggcggccgcaugcucaagcacaagcgccagcgcgacgacggcgagggccgcggcgaggucggcuccgccggcgacaugcgcgccgccaaccucuggcccuccccccucaugaucaagcgcuccaagaagaacucccucgcccucucccucaccgccgaccagauggucuccgcccuccucgacgccgagccccccauccucuacuccgaguacgaccccacccgccccuucuccgaggccuccaugaugggccuccucaccaaccucgccgaccgcgagcucguccacaugaucaacugggccaagcgcguccccggcuucgucgaccucacccuccacgaccagguccaccuccucgagugcgccuggcucgagauccucaugaucggccucgucuggcgcuccauggagcaccccggcaagcuccucuucgcccccaaccuccuccucgaccgcaaccagggcaagugcgucgagggcauggucgagaucuucgacaugcuccucgccaccuccucccgcuuccgcaugaugaaccuccagggcgaggaguucgucugccucaaguccaucauccuccucaacuccggcgucuacaccuuccucuccuccacccucaagucccucgaggagaaggaccacauccaccgcguccucgacaagaucaccgacacccucauccaccucauggccaaggccggccucacccuccagcagcagcaccagcgccucgcccagcuccuccucauccucucccacauccgccacauguccaacaagggcauggagcaccucuacuccaugaagugcaagaacgucgucccccucuacgaccuccuccucgagaugcucgacgcccaccgccuccacgcccccaccucccgcggcggcgccuccgucgaggagaccgaccagucccaccucgccaccgccggcuccaccuccucccacucccuccagaaguacuacaucaccggcgaggccgagggcuuccccgccaccgucuga

SEQ ID NO: 42845 - RNA, 1446 nt, Artificial Sequence
  derived and/or modified sequence opt2 from ESR2__Homo_sapiens__NP_001201831
auggacaucaagaacucccccuccucccucaacucccccuccuccuacaacugcucccaguccauccucccccucgagcacggcuccaucuacauccccuccuccuacgucgacucccaccacgaguaccccgccaugaccuucuacucccccgccgucaugaacuacuccauccccuccaacgucaccaaccucgagggcggccccggccgccagaccaccucccccaacguccucuggcccacccccggccaccucuccccccucgucguccaccgccagcucucccaccucuacgccgagccccagaagucccccuggugcgaggcccgcucccucgagcacacccuccccgucaaccgcgagacccucaagcgcaaggucuccggcaaccgcugcgccucccccgucaccggccccggcuccaagcgcgacgcccacuucugcgccgucugcuccgacuacgccuccggcuaccacuacggcgucugguccugcgagggcugcaaggccuucuucaagcgcuccauccagggccacaacgacuacaucugccccgccaccaaccagugcaccaucgacaagaaccgccgcaaguccugccaggccugccgccuccgcaagugcuacgaggucggcauggucaagugcggcucccgccgcgagcgcugcggcuaccgccucguccgccgccagcgcuccgccgacgagcagcuccacugcgccggcaaggccaagcgcuccggcggccacgccccccgcguccgcgagcuccuccucgacgcccucucccccgagcagcucguccucacccuccucgaggccgagcccccccacguccucaucucccgccccuccgcccccuucaccgaggccuccaugaugaugucccucaccaagcucgccgacaaggagcucguccacaugaucuccugggccaagaagauccccggcuucgucgagcucucccucuucgaccagguccgccuccucgaguccugcuggauggagguccucaugaugggccucauguggcgcuccaucgaccaccccggcaagcucaucuucgcccccgaccucguccucgaccgcgacgagggcaagugcgucgagggcauccucgagaucuucgacaugcuccucgccaccaccucccgcuuccgcgagcucaagcuccagcacaaggaguaccucugcgucaaggccaugauccuccucaacuccuccauguacccccucgucaccgccacccaggacgccgacuccucccgcaagcucgcccaccuccucaacgccgucaccgacgcccucgucugggucaucgccaaguccggcaucuccucccagcagcaguccaugcgccucgccaaccuccucaugcuccucucccacguccgccacgcccgcuggggcgagaagcaguucauccaccucaagcucuccuga

SEQ ID NO: 42846 - RNA, 2034 nt, Artificial Sequence
  derived and/or modified sequence opt2 from ESRP1__Homo_sapiens__NP_001030087
augaccgccucccccgacuaccucgucguccucuucggcaucaccgccggcgccaccggcgccaagcucggcuccgacgagaaggagcucauccuccucuucuggaaggucgucgaccucgccaacaagaaggucggccagcuccacgagguccucguccgccccgaccagcucgagcucaccgaggacugcaaggaggagaccaagaucgacgucgagucccucuccuccgccucccagcucgaccaggcccuccgccaguucaaccaguccgucuccaacgagcucaacaucggcgucggcaccuccuucugccucugcaccgacggccagcuccacguccgccagauccuccaccccgaggccuccaagaagaacguccuccuccccgagugcuucuacuccuucuucgaccuccgcaaggaguucaagaagugcugccccggcucccccgacaucgacaagcucgacgucgccaccaugaccgaguaccucaacuucgagaaguccuccuccgucucccgcuacggcgccucccaggucgaggacaugggcaacaucauccucgccaugaucuccgagcccuacaaccaccgcuucuccgaccccgagcgcgucaacuacaaguucgaguccggcaccugcuccaagauggagcucaucgacgacaacaccgucguccgcgcccgcggccuccccuggcaguccuccgaccaggacaucgcccgcuucuucaagggccucaacaucgccaagggcggcgccgcccucugccucaacgcccagggccgccgcaacggcgaggcccucguccgcuucgucuccgaggagcaccgcgaccucgcccuccagcgccacaagcaccacaugggcacccgcuacaucgaggucuacaaggccaccggcgaggacuuccucaagaucgccggcggcaccuccaacgaggucgcccaguuccucuccaaggagaaccaggucaucguccgcaugcgcggccuccccuucaccgccaccgccgaggaggucgucgccuucuucggccagcacugccccaucaccggcggcaaggagggcauccucuucgucaccuaccccgacggccgccccaccggcgacgccuucguccucuucgccugcgaggaguacgcccagaacgcccuccgcaagcacaaggaccuccucggcaagcgcuacaucgagcucuuccgcuccaccgccgccgagguccagcagguccucaaccgcuucuccuccgccccccucaucccccuccccaccccccccaucauccccguccucccccagcaguucgucccccccaccaacguccgcgacugcauccgccuccgcggccuccccuacgccgccaccaucgaggacauccucgacuuccucggcgaguucgccaccgacauccgcacccacggcguccacaugguccucaaccaccagggccgccccuccggcgacgccuucauccagaugaaguccgccgaccgcgccuucauggccgcccagaagugccacaagaagaacaugaaggaccgcuacgucgaggucuuccagugcuccgccgaggagaugaacuucguccucaugggcggcacccucaaccgcaacggccucucccccccccccugccucuccccccccuccuacaccuuccccgcccccgccgccgucauccccaccgaggccgccaucuaccagcccuccgucauccucaacccccgcgcccuccagcccuccaccgccuacuaccccgccggcacccagcucuucaugaacuacaccgccuacuaccccuccccccccggcucccccaacucccucggcuacuuccccaccgccgccaaccucuccggcguccccccccagcccggcaccgucguccgcaugcagggccucgccuacaacaccggcgucaaggagauccucaacuucuuccagggcuaccaguacgccaccgaggacggccucauccacaccaacgaccaggcccgcacccuccccaaggagugggucugcaucuga

SEQ ID NO: 42847 - RNA, 2154 nt, Artificial Sequence
  derived and/or modified sequence opt2 from ESRP2__Homo_sapiens__NP_079215
augacccccccccccccccccccccccccccccggccccgaccccgccgccgaccccgccgccgaccccugccccuggcccggcucccucgucguccucuucggcgccaccgccggcgcccucggccgcgaccucggcuccgacgagaccgaccucauccuccucgucuggcaggucgucgagccccgcucccgccaggucggcacccuccacaagucccucguccgcgccgaggccgccgcccucuccacccagugccgcgaggccuccggccucuccgccgacucccucgcccgcgccgagccccucgacaagguccuccagcaguucucccagcucgucaacggcgacgucgcccuccucggcggcggccccuacaugcucugcaccgacggccagcagcuccuccgccagguccuccaccccgaggccucccgcaagaaccucguccuccccgacauguucuucuccuucuacgaccuccgccgcgaguuccacaugcagcaccccuccaccugccccgcccgcgaccucaccgucgccaccauggcccagggccucggccucgagaccgacgccaccgaggacgacuucggcgucugggaggucaagaccauggucgccgucauccuccaccuccucaaggagcccuccucccagcucuucuccaagcccgaggucaucaagcagaaguacgagaccggccccugcuccaaggccgacgucgucgacuccgagaccgucguccgcgcccgcggccuccccuggcaguccuccgaccaggacgucgcccgcuucuucaagggccucaacgucgcccgcggcggcgucgcccucugccucaacgcccagggccgccgcaacggcgaggcccucauccgcuucgucgacuccgagcagcgcgaccucgcccuccagcgccacaagcaccacaugggcguccgcuacaucgaggucuacaaggccaccggcgaggaguucgucaagaucgccggcggcaccucccucgaggucgcccgcuuccucucccgcgaggaccaggucauccuccgccuccgcggccuccccuucuccgccggccccaccgacguccucggcuuccucggccccgagugccccgucaccggcggcaccgagggccuccucuucguccgccaccccgacggccgccccaccggcgacgccuucgcccucuucgccugcgaggagcucgcccaggccgcccuccgccgccacaagggcaugcucggcaagcgcuacaucgagcucuuccgcuccaccgccgccgagguccagcagguccucaaccgcuacgccuccggcccccuccuccccacccucaccgccccccuccuccccauccccuucccccucgcccccggcaccggccgcgacugcguccgccuccgcggccuccccuacaccgccaccaucgaggacauccucuccuuccucggcgaggccgccgccgacauccgcccccacggcguccacaugguccucaaccagcagggccgccccuccggcgacgccuucauccagaugaccuccgccgagcgcgcccucgccgccgcccagcgcugccacaagaaggucaugaaggagcgcuacgucgaggucguccccugcuccaccgaggagaugucccgcguccucaugggcggcacccucggccgcuccggcaugucccccccccccugcaagcuccccugccucuccccccccaccuacaccaccuuccaggccacccccacccucauccccaccgagaccgccgcccucuaccccuccuccgcccuccuccccgccgcccgcguccccgccgcccccacccccgucgccuacuaccccggccccgccacccagcucuaccucaacuacaccgccuacuaccccuccccccccgucucccccaccaccgucggcuaccucaccacccccaccgccgcccucgccuccgcccccaccuccguccucucccaguccggcgcccucguccgcaugcagggcguccccuacaccgccggcaugaaggaccuccucuccgucuuccaggccuaccagcuccccgccgacgacuacaccucccucaugcccgucggcgaccccccccgcaccguccuccaggcccccaaggagugggucugccucuga

SEQ ID NO: 42848 - RNA, 1272 nt, Artificial Sequence
  derived and/or modified sequence opt2 from ESRRA__Homo_sapiens__NP_001269379
auguccucccaggucgucggcaucgagccccucuacaucaaggccgagcccgccucccccgacucccccaagggcuccuccgagaccgagaccgagccccccgucgcccucgcccccggccccgcccccacccgcugccuccccggccacaaggaggaggaggacggcgagggcgccggccccggcgagcagggcggcggcaagcucguccucuccucccuccccaagcgccucugccucgucugcggcgacgucgccuccggcuaccacuacggcgucgccuccugcgaggccugcaaggccuucuucaagcgcaccauccagggcuccaucgaguacuccugccccgccuccaacgagugcgagaucaccaagcgccgccgcaaggccugccaggccugccgcuucaccaagugccuccgcgucggcaugcucaaggagggcguccgccucgaccgcguccgcggcggccgccagaaguacaagcgccgccccgaggucgacccccuccccuuccccggccccuuccccgccggcccccucgccgucgccggcggcccccgcaagaccgccgcccccgucaacgcccucgucucccaccuccucgucgucgagcccgagaagcucuacgccaugcccgaccccgccggccccgacggccaccuccccgccgucgccacccucugcgaccucuucgaccgcgagaucgucgucaccaucuccugggccaaguccauccccggcuucuccucccucucccucuccgaccagauguccguccuccaguccgucuggauggagguccucguccucggcgucgcccagcgcucccucccccuccaggacgagcucgccuucgccgaggaccucguccucgacgaggagggcgcccgcgccgccggccucggcgagcucggcgccgcccuccuccagcucguccgccgccuccaggcccuccgccucgagcgcgaggaguacguccuccucaaggcccucgcccucgccaacuccgacuccguccacaucgaggacgccgaggccgucgagcagcuccgcgaggcccuccacgaggcccuccucgaguacgaggccggccgcgccggccccggcggcggcgccgagcgccgccgcgccggccgccuccuccucacccucccccuccuccgccagaccgccggcaagguccucgcccacuucuacggcgucaagcucgagggcaagguccccaugcacaagcucuuccucgagaugcucgaggccaugauggacuga

SEQ ID NO: 42849 - RNA, 1527 nt, Artificial Sequence
  derived and/or modified sequence opt2 from ESRRB__Homo_sapiens__NP_004443
auguccuccgacgaccgccaccucggcuccuccugcggcuccuucaucaagaccgagcccuccucccccuccuccggcaucgacgcccucucccaccacucccccuccggcuccuccgacgccuccggcggcuucggccucgcccucggcacccacgccaacggccucgacuccccccccauguucgccggcgccggccucggcggcacccccugccgcaaguccuacgaggacugcgccuccggcaucauggaggacuccgccaucaagugcgaguacaugcucaacgccauccccaagcgccucugccucgucugcggcgacaucgccuccggcuaccacuacggcgucgccuccugcgaggccugcaaggccuucuucaagcgcaccauccagggcaacaucgaguacuccugccccgccaccaacgagugcgagaucaccaagcgccgccgcaaguccugccaggccugccgcuucaugaagugccucaaggucggcaugcucaaggagggcguccgccucgaccgcguccgcggcggccgccagaaguacaagcgccgccucgacuccgaguccucccccuaccucucccuccagaucuccccccccgccaagaagccccucaccaagaucgucuccuaccuccucgucgccgagcccgacaagcucuacgccaugcccccccccggcaugcccgagggcgacaucaaggcccucaccacccucugcgaccucgccgaccgcgagcucgucgucaucaucggcugggccaagcacauccccggcuucuccucccucucccucggcgaccagaugucccuccuccaguccgccuggauggagauccucauccucggcaucgucuaccgcucccuccccuacgacgacaagcucgucuacgccgaggacuacaucauggacgaggagcacucccgccucgccggccuccucgagcucuaccgcgccauccuccagcucguccgccgcuacaagaagcucaaggucgagaaggaggaguucgucacccucaaggcccucgcccucgccaacuccgacuccauguacaucgaggaccucgaggccguccagaagcuccaggaccuccuccacgaggcccuccaggacuacgagcucucccagcgccacgaggagcccuggcgcaccggcaagcuccuccucacccucccccuccuccgccagaccgccgccaaggccguccagcacuucuacuccgucaagcuccagggcaagguccccaugcacaagcucuuccucgagaugcucgaggccaaggucggccaggagcagcuccgcggcucccccaaggacgagcgcauguccucccacgacggcaagugccccuuccaguccgccgccuucaccucccgcgaccaguccaacucccccggcauccccaacccccgccccuccucccccaccccccucaacgagcgcggccgccagaucucccccuccacccgcacccccggcggccagggcaagcaccucuggcucaccauguga

SEQ ID NO: 42850 - RNA, 1191 nt, Artificial Sequence
  derived and/or modified sequence opt2 from ESRRG__Homo_sapiens__NP_001230436
auguccaacaaggaccgccacaucgacuccuccugcuccuccuucaucaagaccgagcccuccucccccgccucccucaccgacuccgucaaccaccacucccccggcggcuccuccgacgccuccggcuccuacuccuccaccaugaacggccaccagaacggccucgacucccccccccucuaccccuccgcccccauccucggcggcuccggccccguccgcaagcucuacgacgacugcuccuccaccaucgucgaggacccccagaccaagugcgaguacaugcucaacuccaugcccaagcgccucugccucgucugcggcgacaucgccuccggcuaccacuacggcgucgccuccugcgaggccugcaaggccuucuucaagcgcaccauccagggcguccgccucgaccgcguccgcggcggccgccagaaguacaagcgccgcaucgacgccgagaacucccccuaccucaacccccagcucguccagcccgccaagaagcccuacaacaagaucgucucccaccuccucgucgccgagcccgagaagaucuacgccaugcccgaccccaccguccccgacuccgacaucaaggcccucaccacccucugcgaccucgccgaccgcgagcucgucgucaucaucggcugggccaagcacauccccggcuucuccacccucucccucgccgaccagaugucccuccuccaguccgccuggauggagauccucauccucggcgucgucuaccgcucccucuccuucgaggacgagcucgucuacgccgacgacuacaucauggacgaggaccaguccaagcucgccggccuccucgaccucaacaacgccauccuccagcucgucaagaaguacaaguccaugaagcucgagaaggaggaguucgucacccucaaggccaucgcccucgccaacuccgacuccaugcacaucgaggacgucgaggccguccagaagcuccaggacguccuccacgaggcccuccaggacuacgaggccggccagcacauggaggacccccgccgcgccggcaagaugcucaugacccucccccuccuccgccagaccuccaccaaggccguccagcacuucuacaacaucaagcucgagggcaagguccccaugcacaagcucuuccucgagaugcucgaggccaaggucuga

SEQ ID NO: 42851 - RNA, 1221 nt, Artificial Sequence
  derived and/or modified sequence opt2 from ESX1__Homo_sapiens__NP_703149
auggagucccuccgcggcuacacccacuccgacaucggcuaccgcucccucgccgucggcgaggacaucgaggaggucaacgacgagaagcucaccgucaccucccucauggcccgcggcggcgaggacgaggagaacacccgcuccaagcccgaguacggcaccgaggccgagaacaacgucggcaccgagggcuccguccccuccgacgaccaggaccgcgagggcggcggcggccacgagcccgagcagcagcaggaggagcccccccucaccaagcccgagcagcagcaggaggagcccccccuccucgagcucaagcaggagcaggaggagcccccccagaccaccgucgagggcccccagcccgccgagggcccccagaccgccgagggcccccagccccccgagcgcaagcgccgccgccgcaccgccuucacccaguuccagcuccaggagcucgagaacuucuucgacgagucccaguaccccgacgucgucgcccgcgagcgccucgccgcccgccucaaccucaccgaggaccgcguccaggucugguuccagaaccgccgcgccaaguggaagcgcaaccagcgcguccucaugcuccgcaacaccgccaccgccgaccucgcccacccccucgacauguuccucggcggcgccuacuacgccgcccccgcccucgaccccgcccucugcguccaccucgucccccagcucccccgcccccccguccuccccgucccccccaugcccccccgcccccccaugguccccaugcccccccgcccccccaucgcccccaugccccccauggcccccgucccccccggcucccgcauggcccccgucccccccggcccccgcauggcccccgucccccccuggccccccauggcccccgucccccccuggccccccauggcccccguccccaccggcccccccauggcccccgucccccccggcccccccauggcccgcgucccccccggcccccccauggcccgcgucccccccggcccccccauggccccccucccccccggcccccccauggccccccucccccccggcccccccauggccccccucccccccggcccccccauggccccccuccccccccgcucccacgucccccacaccggccucgcccccguccacaucaccugggcccccgucaucaacuccuacuacgccugccccuucuucuga

SEQ ID NO: 42852 - RNA, 3345 nt, Artificial Sequence
  derived and/or modified sequence opt2 from ESYT1__Homo_sapiens__NP_001171725
auggagcgcucccccggcgagggccccucccccucccccauggaccagcccuccgcccccuccgaccccaccgaccagccccccgccgcccacgccaagcccgaccccggcuccggcggccagcccgccggccccggcgccgccggcgaggcccucgccguccucaccuccuucggccgccgccuccucguccucauccccgucuaccucgccggcgccgucggccucuccgucggcuucguccucuucggccucgcccucuaccucggcuggcgccgcguccgcgacgagaaggagcgcucccuccgcgccgcccgccagcuccucgacgacgaggagcagcucaccgccaagacccucuacaugucccaccgcgagcuccccgccugggucuccuuccccgacgucgagaaggccgaguggcucaacaagaucgucgcccaggucuggcccuuccucggccaguacauggagaagcuccucgccgagaccgucgcccccgccguccgcggcuccaacccccaccuccagaccuucaccuucacccgcgucgagcucggcgagaagccccuccgcaucaucggcgucaagguccaccccggccagcgcaaggagcagauccuccucgaccucaacaucuccuacgucggcgacguccagaucgacgucgaggucaagaaguacuucugcaaggccggcgucaagggcaugcagcuccacggcguccuccgcgucauccucgagccccucaucggcgaccuccccuucgucggcgccgucuccauguucuucauccgccgccccacccucgacaucaacuggaccggcaugaccaaccuccucgacauccccggccucuccucccucuccgacaccaugaucauggacuccaucgccgccuuccucguccuccccaaccgccuccucgucccccucguccccgaccuccaggacgucgcccagcuccgcuccccccucccccgcggcaucauccgcauccaccuccucgccgcccgcggccucuccuccaaggacaaguacgucaagggccucaucgagggcaaguccgaccccuacgcccucguccgccucggcacccagaccuucugcucccgcgucaucgacgaggagcucaacccccaguggggcgagaccuacgaggucaugguccacgagguccccggccaggagaucgaggucgaggucuucgacaaggaccccgacaaggacgacuuccucggccgcaugaagcucgacgucggcaagguccuccaggccuccguccucgacgacugguucccccuccagggcggccagggccagguccaccuccgccucgaguggcucucccuccucuccgacgccgagaagcucgagcagguccuccaguggaacuggggcgucuccucccgccccgacccccccuccgccgccauccucgucgucuaccucgaccgcgcccaggaccuccccauggucaccuccgagcucuaccccccccagcucaagaagggcaacaaggagcccaaccccaugguccagcucuccauccaggacgucacccaggaguccaaggccgucuacuccaccaacugccccgucugggaggaggccuuccgcuucuuccuccaggacccccagucccaggagcucgacguccaggucaaggacgacucccgcgcccucacccucggcgcccucacccucccccucgcccgccuccucaccgcccccgagcucauccucgaccagugguuccagcucuccuccuccggccccaacucccgccucuacaugaagcucgucaugcgcauccucuaccucgacuccuccgagaucugcuuccccaccguccccggcugccccggcgccugggacgucgacuccgagaacccccagcgcggcuccuccgucgacgcccccccccgccccugccacaccacccccgacucccaguucggcaccgagcacguccuccgcauccacguccucgaggcccaggaccucaucgccaaggaccgcuuccucggcggccucgucaagggcaaguccgaccccuacgucaagcucaagcucgccggccgcuccuuccgcucccacgucguccgcgaggaccucaacccccgcuggaacgaggucuucgaggucaucgucaccuccguccccggccaggagcucgaggucgaggucuucgacaaggaccucgacaaggacgacuuccucggccgcugcaagguccgccucaccaccguccucaacuccggcuuccucgacgaguggcucacccucgaggacguccccuccggccgccuccaccuccgccucgagcgccucaccccccgccccaccgccgccgagcucgaggagguccuccaggucaacucccucauccagacccagaaguccgccgagcucgccgccgcccuccucuccaucuacauggagcgcgccgaggaccucccccuccgcaagggcaccaagcaccucucccccuacgccacccucaccgucggcgacuccucccacaagaccaagaccaucucccagaccuccgcccccgucugggacgaguccgccuccuuccucauccgcaagccccacaccgagucccucgagcuccagguccgcggcgagggcaccggcguccucggcucccucucccucccccucuccgagcuccucgucgccgaccagcucugccucgaccgcugguucacccucuccuccggccagggccagguccuccuccgcgcccagcucggcauccucgucucccagcacuccggcgucgaggcccacucccacuccuacucccacuccuccuccucccucuccgaggagcccgagcucuccggcggccccccccacaucaccuccuccgcccccgagcuccgccagcgccucacccacgucgacuccccccucgaggcccccgccggcccccucggccaggucaagcucacccucugguacuacuccgaggagcgcaagcucgucuccaucguccacggcugccgcucccuccgccagaacggccgcgacccccccgaccccuacgucucccuccuccuccuccccgacaagaaccgcggcaccaagcgccgcaccucccagaagaagcgcacccucucccccgaguucaacgagcgcuucgagugggagcucccccucgacgaggcccagcgccgcaagcucgacgucuccgucaaguccaacuccuccuucaugucccgcgagcgcgagcuccucggcaagguccagcucgaccucgccgagaccgaccucucccagggcgucgcccgcugguacgaccucauggacaacaaggacaagggcuccuccuga

SEQ ID NO: 42853 - RNA, 2682 nt, Artificial Sequence
  derived and/or modified sequence opt2 from ESYT2__Homo_sapiens__NP_065779
augaccccccccucccgcgccgaggccggcguccgccgcucccgcguccccuccgagggccgcuggcgcggcgccgagccccccggcaucuccgccuccacccagcccgccuccgccggccgcgccgcccgccacugcggcgccauguccggcgcccgcggcgagggccccgaggccggcgccggcggcgccggcggccgcgccgcccccgagaaccccggcggcguccucuccgucgagcuccccggccuccucgcccagcucgcccgcuccuucgcccuccuccuccccgucuacgcccucggcuaccucggccucuccuucuccuggguccuccucgcccucgcccuccucgccuggugccgccgcucccgcggccucaaggcccuccgccucugccgcgcccucgcccuccucgaggacgaggagcgcgucguccgccucggcguccgcgccugcgaccuccccgccuggguccacuuccccgacaccgagcgcgccgaguggcucaacaagaccgucaagcacauguggcccuucaucugccaguucaucgagaagcucuuccgcgagaccaucgagcccgccguccgcggcgccaacacccaccucuccaccuucuccuucaccaaggucgacgucggccagcagccccuccgcaucaacggcgucaaggucuacaccgagaacgucgacaagcgccagaucauccucgaccuccagaucuccuucgucggcaacugcgagaucgaccucgagaucaagcgcuacuucugccgcgccggcgucaaguccauccagauccacggcaccaugcgcgucauccucgagccccucaucggcgacaugccccucgucggcgcccucuccaucuucuuccuccgcaagccccuccucgagaucaacuggaccggccucaccaaccuccucgacguccccggccucaacggccucuccgacaccaucauccucgacaucaucuccaacuaccucguccuccccaaccgcaucaccgucccccucgucuccgagguccagaucgcccagcuccgcuuccccguccccaagggcguccuccgcauccacuucaucgaggcccaggaccuccagggcaaggacaccuaccucaagggccucgucaagggcaaguccgaccccuacggcaucauccgcgucggcaaccagaucuuccagucccgcgucaucaaggagaaccucucccccaaguggaacgaggucuacgaggcccucgucuacgagcaccccggccaggagcucgagaucgagcucuucgacgaggaccccgacaaggacgacuuccucggcucccucaugaucgaccucaucgaggucgagaaggagcgccuccucgacgagugguucacccucgacgagguccccaagggcaagcuccaccuccgccucgaguggcucacccucaugcccaacgccuccaaccucgacaagguccucaccgacaucaaggccgacaaggaccaggccaacgacggccucuccuccgcccuccucauccucuaccucgacuccgcccgcaaccuccccuccggcaagaagaucuccuccaaccccaaccccgucguccagauguccgucggccacaaggcccaggaguccaagauccgcuacaagaccaacgagcccgucugggaggagaacuucaccuucuucauccacaaccccaagcgccaggaccucgaggucgagguccgcgacgagcagcaccagugcucccucggcaaccucaaggucccccucucccagcuccucaccuccgaggacaugaccgucucccagcgcuuccagcucuccaacuccggccccaacuccaccaucaagaugaagaucgcccuccgcguccuccaccucgagaagcgcgagcgcccccccgaccaccagcacuccgcccaggucaagcgccccuccgucuccaaggagggccgcaagaccuccaucaagucccacauguccggcucccccggccccggcggcuccaacaccgcccccuccacccccgucaucggcggcuccgacaagcccggcauggaggagaaggcccagccccccgaggccggcccccagggccuccacgaccucggccgcuccuccuccucccuccucgccucccccggccacaucuccgucaaggagcccacccccuccaucgccuccgacaucucccuccccaucgccacccaggagcuccgccagcgccuccgccagcucgagaacggcaccacccucggccaguccccccucggccagauccagcucaccauccgccacuccucccagcgcaacaagcucaucgucgucguccacgccugccgcaaccucaucgccuucuccgaggacggcuccgaccccuacguccgcauguaccuccuccccgacaagcgccgcuccggccgccgcaagacccacgucuccaagaagacccucaaccccgucuucgaccaguccuucgacuucuccgucucccuccccgagguccagcgccgcacccucgacgucgccgucaagaacuccggcggcuuccucuccaaggacaagggccuccucggcaagguccucgucgcccucgccuccgaggagcucgccaagggcuggacccagugguacgaccucaccgaggacggcacccgcccccaggccaugaccuga

SEQ ID NO: 42854 - RNA, 2661 nt, Artificial Sequence
  derived and/or modified sequence opt2 from ESYT3__Homo_sapiens__NP_114119
augcgcgccgaggagcccugcgcccccggcgcccccuccgcccucggcgcccagcgcacccccggccccgagcuccgccucuccucccagcuccuccccgagcucugcaccuucgucguccgcguccucuucuaccucggccccgucuaccucgccggcuaccucggccucuccaucaccuggcuccuccucggcgcccuccucuggaugugguggcgccgcaaccgccgcggcaagcucggccgccucgccgccgccuucgaguuccucgacaacgagcgcgaguucaucucccgcgagcuccgcggccagcaccuccccgccuggauccacuuccccgacgucgagcgcgucgagugggccaacaagaucaucucccagaccuggcccuaccucuccaugaucauggaguccaaguuccgcgagaagcucgagcccaagauccgcgagaaguccauccaccuccgcaccuucaccuucaccaagcucuacuucggccagaagugcccccgcgucaacggcgucaaggcccacaccaacaccugcaaccgccgccgcgucaccgucgaccuccagaucugcuacaucggcgacugcgagaucuccgucgagcuccagaagauccaggccggcgucaacggcauccagcuccagggcacccuccgcgucauccucgagccccuccucgucgacaagcccuucgucggcgccgucaccgucuucuuccuccagaagccccaccuccagaucaacuggaccggccucaccaaccuccucgacgcccccggcaucaacgacgucuccgacucccuccucgaggaccucaucgccacccaccucguccuccccaaccgcgucaccguccccgucaagaagggccucgaccucaccaaccuccgcuucccccuccccugcggcgucauccgcguccaccuccucgaggccgagcagcucgcccagaaggacaacuuccucggccuccgcggcaaguccgaccccuacgccaaggucuccaucggccuccagcacuuccgcucccgcaccaucuaccgcaaccucaaccccaccuggaacgaggucuucgaguucauggucuacgagguccccggccaggaccucgaggucgaccucuacgacgaggacaccgaccgcgacgacuuccucggcucccuccagaucugccucggcgacgucaugaccaaccgcgucgucgacgagugguucguccucaacgacaccaccuccggccgccuccaccuccgccucgaguggcucucccuccucaccgaccaggagguccucaccgaggaccacggcggccucuccaccgccauccucgucgucuuccucgaguccgccugcaaccucccccgcaaccccuucgacuaccucaacggcgaguaccgcgccaagaagcucucccgcuucgcccgcaacaaggucuccaaggaccccuccuccuacgucaagcucuccgucggcaagaagacccacaccuccaagaccugcccccacaacaaggaccccgucuggucccaggucuucuccuucuucguccacaacgucgccaccgagcgccuccaccucaagguccucgacgacgaccaggagugcgcccucggcaugcucgaggucccccucugccagauccuccccuacgccgaccucacccucgagcagcgcuuccagcucgaccacuccggccucgacucccucaucuccaugcgccucguccuccgcuuccuccaggucgaggagcgcgagcucggcucccccuacaccggccccgaggcccucaagaagggcccccuccucaucaagaaggucgccaccaaccagggccccaaggcccagccccaggaggagggccccaccgaccuccccugcccccccgaccccgccuccgacaccaaggacgucucccgcuccaccaccaccaccaccuccgccaccaccgucgccaccgagcccaccucccaggagaccggccccgagcccaagggcaaggacuccgccaagcgcuucugcgagcccaucggcgagaagaagucccccgccaccaucuuccucaccguccccggcccccacucccccggccccaucaaguccccccgccccaugaagugccccgccucccccuucgccuggccccccaagcgccucgcccccuccauguccucccucaacucccucgccuccuccugcuucgaccucgccgacaucucccucaacaucgagggcggcgaccuccgccgccgccagcucggcgagauccagcucaccguccgcuacgucugccuccgccgcugccucuccguccucaucaacggcugccgcaaccucacccccugcaccuccuccggcgccgaccccuacguccgcgucuaccuccuccccgagcgcaagugggccugccgcaagaagaccuccgucaagcgcaagacccucgagccccucuucgacgagaccuucgaguucuucguccccauggaggaggucaagaagcgcucccucgacgucgccgucaagaacucccgcccccucggcucccaccgccgcaaggagcucggcaagguccucaucgaccucuccaaggaggaccucaucaagggcuucucccagugguacgagcucacccccaacggccagccccgcuccuga

SEQ ID NO: 42855 - RNA, 2781 nt, Artificial Sequence
  derived and/or modified sequence opt2 from ETAA1__Homo_sapiens__NP_061875
augucccgccgccgcaagcacgacgacucccccucccccaagaagaccccccacaagaccgucgccgccgaggagugcggcuccgucgucgagcccggccgccgccgccuccgcuccgcccgcggcuccuggcccugcggcgcccgcgagggcccccccggccccguccgccagcgcgagcagccccccaccgccgcccucugcuccaaguccaaccccgaggagcgcuacgagacccccaagcgcgcccucaagauggacucccucuccuccuccuucuccucccccaacgaccccgacggccagaacgacaucuucugggaccagaacuccccccucaccaagcagcucggcaagggccgcaagaagcagaucuacaccaccgacuccgacgagaucucccacaucgucaaccgcaucgccccccaggacgagaagcccaccaccaacuccaugcucgacauguggaucggcgagaccgccauccccugcacccccuccgucgccaagggcaagucccgcgccaagaucuccugcaccaagcucaagacccagucccaggaggaggagcucaugaagcucgccaagcaguucgacaagaacauggaggagcucgacgucauccaggagcagaacaagcgcaacuacgacuucacccagaugaucuccgagaccgagauccucuccaacuacaaggacaacauccagauguggucccuccacaacaucguccccgagaucgacaacgccaccaagaagcccaucaagggcaacaccaagaucuccgucgccaacaaccagaacuccucccagaagcccuucgaccagaucgccgaggccgccuucaacgccaucuucgacggcuccacccagaagugcuccggccagcucucccaggagcuccccgaggccuucugguccaccuccaacaccaccuucgucaagaccaacgcccucaaggaggagaagaucaucaccaacgagacccucgucaucgagaagcucuccaacaagaccccccgcucccucuccucccaggucgacacccccaucaugaccaaguccugcgucaccuccugcaccaaggagcccgagaccuccaacaaguacaucgacgccuucaccaccuccgacuucgaggacgacugggagaaccuccucggcuccgagcccuucgccaugcagaacaucgacaugcccgagcucuuccccuccaagaccgcccacgucaccgaccagaaggagaucugcaccuucaacuccaagaccgucaagaacaccucccgcgccaacaccucccccgacgcccgccucggcgacuccaagguccuccaggaccucuccuccaagaccuacgaccgcgagcucaucgacgccgaguaccgcuucucccccaacuccaacaaguccaacaagcucuccaccggcaacaagaugaaguucgagaacuccuccaacaagaucgucauccaggacgagauccagaacugcaucgucaccuccaaccucaccaagaucaaggaggacauccucaccaacuccaccgaggccuccgagcgcaaguccgcccucaacacccgcuacuccaacgagcagaagaacaagugcauccucaaccaguccaucaaggcccccgucaacaccgaccucuucggcuccgccaaccucggcuccaagaccuccgucuccaaccccaaccagaccuccgccuccaaggucggcuccuucuucgacgacuggaacgaccccuccuucgccaacgagaucaucaaggccugccaccagcucgacaacaccugggaggccgacgacgucgacgacgaccuccucuaccaggccugcgacgacaucgagcgccucacccagcagcaggacauccgcaaggacuccaagaccuccgaguccaucugcgagaucaacaacaacuccgagcacggcgccaagcucacccagcagcaggacauccgcaaggacuccaagaccuccgaguccaucugcgagaucaacaacaacuccgagcacggcgccaagaacauguucgccaucuccaagcagggcuccaaccucguccaguccaagcaccucaaccccggcuccaucuccguccagaccucccucaccaacuccucccagaucgacaagcccaugaagauggagaagggcgagauguacggcaacuccccccgcuuccucggcgccaccaaccucaccauguacuccaagaucuccaacugccagaucaacaaccuccacgucuccuacaccaacaccgacguccccauccaggucaacuccuccaagcucguccuccccggcuccuccucccucaacgucaccuccgaccacaugaacaccgagaucaccaccuacaagaagaagcucuccaccaaccagcccugccacaagaccgucaccgacgaggcccaguccaaccucaacaccaccgucggcuucuccaaguucaccuucacccgcaugaagaacucccagauccucucccaguucaaccagaacugcaucaccggcuccauguccgacaccaagaucacccagggcgucgagaagaagaagggcgucaacccccuccucgaggaggccgucggccagcagucccucgucaagcucuccgagucccucaagcaguccuccaaggaggaggaggagaagaaccgcaagugcucccccgaggagauccagcgcaagcgccaggaggcccucguccgccgcauggccaaggcccgcgccuccuccgucaacgccgcccccaccuccuuccucuga

SEQ ID NO: 42856 - RNA, 1272 nt, Artificial Sequence
  derived and/or modified sequence opt2 from ETF1__Homo_sapiens__NP_001269114
augaagcaggacguccucaacugcaccgagggccccauccacuccaacggcaccuccaugaucucccucaucaucccccccaaggaccagaucucccgcgucgccaagaugcucgccgacgaguucggcaccgccuccaacaucaagucccgcgucaaccgccucuccguccucggcgccaucaccuccguccagcagcgccucaagcucuacaacaaggucccccccaacggccucgucgucuacugcggcaccaucgucaccgaggagggcaaggagaagaaggucaacaucgacuucgagcccuucaagcccaucaacaccucccucuaccucugcgacaacaaguuccacaccgaggcccucaccgcccuccucuccgacgacuccaaguucggcuucaucgucaucgacggcuccggcgcccucuucggcacccuccagggcaacacccgcgagguccuccacaaguucaccgucgaccuccccaagaagcacggccgcggcggccaguccgcccuccgcuucgcccgccuccgcauggagaagcgccacaacuacguccgcaaggucgccgagaccgccguccagcucuucaucuccggcgacaaggucaacgucgccggccucguccucgccggcuccgccgacuucaagaccgagcucucccaguccgacauguucgaccagcgccuccaguccaagguccucaagcucgucgacaucuccuacggcggcgagaacggcuucaaccaggccaucgagcucuccaccgagguccucuccaacgucaaguucauccaggagaagaagcucaucggccgcuacuucgacgagaucucccaggacaccggcaaguacugcuucggcgucgaggacacccucaaggcccucgagaugggcgccgucgagauccucaucgucuacgagaaccucgacaucaugcgcuacguccuccacugccagggcaccgaggaggagaagauccucuaccucacccccgagcaggagaaggacaagucccacuucaccgacaaggagaccggccaggagcacgagcucaucgaguccaugccccuccucgagugguucgccaacaacuacaagaaguucggcgccacccucgagaucgucaccgacaagucccaggagggcucccaguucgucaagggcuucggcggcaucggcggcauccuccgcuaccgcgucgacuuccagggcauggaguaccagggcggcgacgacgaguucuucgaccucgacgacuacuga

SEQ ID NO: 42857 - RNA, 1002 nt, Artificial Sequence
  derived and/or modified sequence opt2 from ETFA__Homo_sapiens__NP_000117
auguuccgcgccgccgcccccggccagcuccgccgcgccgccucccuccuccgcuuccaguccacccucgucaucgccgagcacgccaacgacucccucgcccccaucacccucaacaccaucaccgccgccacccgccucggcggcgaggucuccugccucgucgccggcaccaagugcgacaaggucgcccaggaccucugcaaggucgccggcaucgccaagguccucgucgcccagcacgacgucuacaagggccuccuccccgaggagcucaccccccucauccucgccacccagaagcaguucaacuacacccacaucugcgccggcgccuccgccuucggcaagaaccuccucccccgcgucgccgccaagcucgaggucgcccccaucuccgacaucaucgccaucaagucccccgacaccuucguccgcaccaucuacgccggcaacgcccucugcaccgucaagugcgacgagaaggucaaggucuucuccguccgcggcaccuccuucgacgccgccgccaccuccggcggcuccgccuccuccgagaaggccuccuccaccucccccgucgagaucuccgaguggcucgaccagaagcucaccaaguccgaccgccccgagcucaccggcgccaaggucgucgucuccggcggccgcggccucaaguccggcgagaacuucaagcuccucuacgaccucgccgaccagcuccacgccgccgucggcgccucccgcgccgccgucgacgccggcuucguccccaacgacaugcaggucggccagaccggcaagaucgucgcccccgagcucuacaucgccgucggcaucuccggcgccauccagcaccucgccggcaugaaggacuccaagaccaucgucgccaucaacaaggaccccgaggcccccaucuuccaggucgccgacuacggcaucgucgccgaccucuucaaggucguccccgagaugaccgagauccucaagaagaaguga

SEQ ID NO: 42858 - RNA, 1041 nt, Artificial Sequence
  derived and/or modified sequence opt2 from ETFB__Homo_sapiens__NP_001014763
auguaccucucccucugggucaccaucaacaccgucaaccuccgcaacacccucuccggccuccgcggcgccgucaccaccgucggcaugaucaaguccgacguccccggcacccaggaguggcucgacgagcgccgccgccagggcgaccucccccuccccaccaacuccaaccccguccucucccucgagcucugcgaccccggccagggccccgcccccuuccaggccgucgucguccucauccagcccggccgcggccucgcccuccgccccccccccuccugccucuucccccccgaccccacccccuccccccccgccggccagauccgcgucaagcccgaccgcaccggcgucgucaccgacggcgucaagcacuccaugaaccccuucugcgagaucgccgucgaggaggccguccgccucaaggagaagaagcucgucaaggaggucaucgccgucuccugcggccccgcccagugccaggagaccauccgcaccgcccucgccaugggcgccgaccgcggcauccacgucgaggucccccccgccgaggccgagcgccucggcccccuccaggucgcccgcguccucgccaagcucgccgagaaggagaaggucgaccucguccuccucggcaagcaggccaucgacgacgacugcaaccagaccggccagaugaccgccggcuuccucgacuggccccagggcaccuucgccucccaggucacccucgagggcgacaagcucaaggucgagcgcgagaucgacggcggccucgagacccuccgccucaagcuccccgccgucgucaccgccgaccuccgccucaacgagccccgcuacgccacccuccccaacaucaugaaggccaagaagaagaagaucgaggucaucaagcccggcgaccucggcgucgaccucaccuccaagcucuccgucaucuccgucgaggaccccccccagcgcaccgccggcgucaaggucgagaccaccgaggaccucgucgccaagcucaaggagaucggccgcaucuga

SEQ ID NO: 42859 - RNA, 1713 nt, Artificial Sequence
  derived and/or modified sequence opt2 from ETFDH__Homo_sapiens__NP_001268666
augcucgucccccucgccaagcucuccugccucggcgucaacauggagcgcuucgccgaggaggccgacgucgucaucgucggcgccggccccgccggccucuccgccgccguccgccucaagcagcucgccgucgcccacgagaaggacauccgcgucugccucgucgagaaggccgcccagaucggcgcccacacccucuccggcgccugccucgaccccggcgccuucaaggagcucuuccccgacuggaaggagaagggcgccccccucaacacccccgucaccgaggaccgcuucggcauccucaccgagaaguaccgcauccccguccccauccuccccggccuccccaugaacaaccacggcaacuacaucguccgccucggccaccucgucuccuggaugggcgagcaggccgaggcccucggcgucgaggucuaccccggcuacgccgccgccgagguccucuuccacgacgacggcuccgucaagggcaucgccaccaacgacgucggcauccagaaggacggcgcccccaaggccaccuucgagcgcggccucgagcuccacgccaaggucaccaucuucgccgagggcugccacggccaccucgccaagcagcucuacaagaaguucgaccuccgcgccaacugcgagccccagaccuacggcaucggccucaaggagcucugggucaucgacgagaagaacuggaagcccggccgcgucgaccacaccgucggcuggccccucgaccgccacaccuacggcggcuccuuccucuaccaccucaacgagggcgagccccucgucgcccucggccucgucgucggccucgacuaccagaaccccuaccucucccccuuccgcgaguuccagcgcuggaagcaccaccccuccauccgccccacccucgagggcggcaagcgcaucgccuacggcgcccgcgcccucaacgagggcggcuuccaguccauccccaagcucaccuuccccggcggccuccucaucggcugcucccccggcuucaugaacguccccaagaucaagggcacccacaccgccaugaaguccggcauccucgccgccgaguccaucuucaaccagcucaccuccgagaaccuccaguccaagaccaucggccuccacgucaccgaguacgaggacaaccucaagaacuccugggucuggaaggagcucuacuccguccgcaacauccgccccuccugccacggcguccucggcgucuacggcggcaugaucuacaccggcaucuucuacuggauccuccgcggcauggagcccuggacccucaagcacaagggcuccgacuucgagcgccucaagcccgccaaggacugcacccccaucgaguaccccaagcccgacggccagaucuccuucgaccuccucuccuccgucgcccucuccggcaccaaccacgagcacgaccagcccgcccaccucacccuccgcgacgacuccauccccgucaaccgcaaccucuccaucuacgacggccccgagcagcgcuucugccccgccggcgucuacgaguucguccccgucgagcagggcgacggcuuccgccuccagaucaacgcccagaacugcguccacugcaagaccugcgacaucaaggaccccucccagaacaucaacugggucguccccgagggcggcggcggccccgccuacaacggcauguga

SEQ ID NO: 42860 - RNA, 765 nt, Artificial Sequence
  derived and/or modified sequence opt2 from ETHE1__Homo_sapiens__NP_055112
auggccgaggccguccuccgcgucgcccgccgccagcucucccagcgcggcggcuccggcgcccccauccuccuccgccagauguucgagcccgucuccugcaccuucaccuaccuccucggcgaccgcgagucccgcgaggccguccucaucgaccccguccucgagaccgccccccgcgacgcccagcucaucaaggagcucggccuccgccuccucuacgccgucaacacccacugccacgccgaccacaucaccggcuccggccuccuccgcucccuccuccccggcugccaguccgucaucucccgccucuccggcgcccaggccgaccuccacaucgaggacggcgacuccauccgcuucggccgcuucgcccucgagacccgcgccucccccggccacacccccggcugcgucaccuucguccucaacgaccacuccauggccuucaccggcgacgcccuccucauccgcggcugcggccgcaccgacuuccagcagggcugcgccaagacccucuaccacuccguccacgagaagaucuucacccuccccggcgacugccucaucuaccccgcccacgacuaccacggcuucaccgucuccaccgucgaggaggagcgcacccucaacccccgccucacccucuccugcgaggaguucgucaagaucaugggcaaccucaaccuccccaagccccagcagaucgacuucgccguccccgccaacaugcgcugcggcguccagacccccaccgccuga

SEQ ID NO: 42861 - RNA, 777 nt, Artificial Sequence
  derived and/or modified sequence opt2 from ETNK1__Homo_sapiens__NP_001034570
augcucugcggccgcccccgcuccuccuccgacaaccgcaacuuccuccgcgagcgcgccggccucuccuccgccgccguccagacccgcaucggcaacuccgccgccucccgccgcucccccgccgcccgcccccccguccccgccccccccgcccucccccgcggccgccccggcaccgagggcuccaccucccucuccgcccccgccguccucgucgucgccgucgccgucgucgucgucgucgucuccgccgucgccugggccauggccaacuacauccacgucccccccggcucccccgagguccccaagcucaacgucaccguccaggaccaggaggagcaccgcugccgcgagggcgcccucucccuccuccagcaccuccgcccccacugggacccccaggaggucacccuccagcucuucaccgacggcaucaccaacaagcucaucggcugcuacgucggcaacaccauggaggacgucguccucguccgcaucuacggcaacaagaccgagcuccucgucgaccgcgacgaggaggucaaguccuuccgcguccuccaggcccacggcugcgccccccagcucuacugcaccuucaacaacggccucugcuacgaguucauccagggcgaggcccucgaccccaagcacgucugcaaccccgccaucuucucccucuccucccucacccucugcaagggcaagaccacccgcugcuucggccucaccggcugccgcggcucccgccuccuccucuccuucuucuga

SEQ ID NO: 42862 - RNA, 1185 nt, Artificial Sequence
  derived and/or modified sequence opt2 from ETNK2__Homo_sapiens__NP_001284689
auggccgucccccccuccgccccccagccccgcgccuccuuccaccuccgccgccacacccccugcccccagugcuccuggggcauggaggagaaggccgccgccuccgccuccugccgcgagccccccggccccccccgcgccgccgccgucgccuacuucggcaucuccgucgaccccgacgacauccuccccggcgcccuccgccucauccaggagcuccgcccccacuggaagcccgagcagguccgcaccaagcgcuucaccgacggcaucaccaacaagcucgucgccugcuacgucgaggaggacaugcaggacugcguccucguccgcgucuacggcgagcgcaccgagcuccucgucgaccgcgagaacgagguccgcaacuuccagcuccuccgcgcccacuccugcgcccccaagcucuacugcaccuuccagaacggccucugcuacgaguacaugcagggcgucgcccucgagcccgagcacauccgcgagccccgccucuuccgccucaucgcccucgagauggccaagauccacaccauccacgccaacggcucccuccccaagcccauccucuggcacaagaugcacaacuacuucacccucgucaagaacgagaucaaccccucccucuccgccgacguccccaaggucgagguccucgagcgcgagcucgccuggcucaaggagcaccucucccagcucgagucccccgucgucuucugccacaacgaccuccucugcaagaacaucaucuacgacuccaucaagggccacguccgcuucaucgacuacgaguacgccggcuacaacuaccaggccuucgacaucggcaaccacuucaacgaguucgccggcgucaacgaggucgacuacugccucuaccccgcccgcgagacccagcuccaguggcuccacuacuaccuccaggcccagaagggcauggccgucaccccccgcgagguccagcgccucuacguccaggucaacaaguucgcccucggccccuccugcgucuccuccaccaugaccgccucccuccagugcugccgcgucggcaaccgccacggcgagaucgcccgccucacccucuccggccucuuccccggcgucucccuccuccucggcucccucggcccccaccccgagcccguccuccaccaccgccucuga

SEQ ID NO: 42863 - RNA, 1482 nt, Artificial Sequence
  derived and/or modified sequence opt2 from ETNPPL__Homo_sapiens__NP_001140062
augugcgagcucuacuccaagcgcgacacccucggccuccgcaagaagcacaucggccccuccugcaaggucuucuucgccuccgaccccaucaagaucguccgcgcccagcgccaguacauguucgacgagaacggcgagcaguaccucgacugcaucaacaacgucgcccacggcgucgucaaggccgcccucaagcagauggagcuccucaacaccaacucccgcuuccuccacgacaacaucgucgaguacgccaagcgccucuccgccacccuccccgagaagcucuccgucugcuacuucaccaacuccggcuccgaggccaacgaccucgcccuccgccucgcccgccaguuccgcggccaccaggacgucaucacccucgaccacgccuaccacggccaccucuccucccucaucgagaucucccccuacaaguuccagaagggcaaggacgucaagaaggaguucguccacgucgcccccacccccgacaccuaccgcggcaaguaccgcgaggaccacgccgacuccgccuccgccuacgccgacgaggucaagaagaucaucgaggacgcccacaacuccggccgcaagaucgccgccuucaucgccgaguccaugcaguccugcggcggccagaucaucccccccgccggcuacuuccagaaggucgccgaguacguccacggcgccggcggcgucuucaucgccgacgagguccaggucggcuucggccgcgucggcaagcacuucugguccuuccagauguacggcgaggacuucguccccgacaucgucaccaugggcaagcccaugggcaacggccaccccgucgccugcgucgucaccaccaaggagaucgccgaggccuucuccuccuccggcauggaguacuucaacaccuacggcggcaaccccgucuccugcgccgucggccucgccguccucgacaucaucgagaacgaggaccuccagggcaacgccaagcgcgucggcaacuaccucaccgagcuccucaagaagcagaaggccaagcacacccucaucggcgacauccgcggcaucggccucuucaucggcaucgaccucgucaaggaccaccucaagcgcacccccgccaccgccgaggcccagcacaucaucuacaagaugaaggagaagcgcguccuccucuccgccgacggcccccaccgcaacguccucaagaucaagccccccaugugcuucaccgaggaggacgccaaguucauggucgaccagcucgaccgcauccucaccguccucgaggaggccaugggcaccaagaccgaguccgucaccuccgagaacacccccugcaagaccaagaugcucaaggaggcccacaucgagcuccuccgcgacuccaccaccgacuccaaggagaaccccucccgcaagcgcaacggcaugugcaccgacacccacucccuccucuccaagcgccucaagaccuga

SEQ ID NO: 42864 - RNA, 1458 nt, Artificial Sequence
  derived and/or modified sequence opt2 from ETS1__Homo_sapiens__NP_001137292
auguccuacuucgucgacuccgccggcuccucccccguccccuacuccgccccccgccccgccgucguccgccagggccccuccaacaccuacgaggacccccgcaugaacugcggcuuccaguccaacuaccaccagcagcgccccugcuaccccuucugggacgagauggccacccaggagguccccaccggccucgagcacugcgucuccgacauggagugcgccgacgucccccuccucacccccuccuccaaggagaugaugucccaggcccucaaggccaccuucuccggcuucaccaaggagcagcagcgccucggcauccccaaggacccccgccaguggaccgagacccacguccgcgacugggucaugugggccgucaacgaguucucccucaagggcgucgacuuccagaaguucugcaugaacggcgccgcccucugcgcccucggcaaggacugcuuccucgagcucgcccccgacuucgucggcgacauccucugggagcaccucgagauccuccagaaggaggacgucaagcccuaccaggucaacggcgucaaccccgccuaccccgagucccgcuacaccuccgacuacuucaucuccuacggcaucgagcacgcccagugcgucccccccuccgaguucuccgagcccuccuucaucaccgaguccuaccagacccuccaccccaucuccuccgaggagcuccucucccucaaguacgagaacgacuaccccuccgucauccuccgcgacccccuccagaccgacacccuccagaacgacuacuucgccaucaagcaggaggucgucacccccgacaacaugugcaugggccgcaccucccgcggcaagcucggcggccaggacuccuucgaguccaucgaguccuacgacuccugcgaccgccucacccaguccugguccucccaguccuccuucaacucccuccagcgcguccccuccuacgacuccuucgacuccgaggacuaccccgccgcccuccccaaccacaagcccaagggcaccuucaaggacuacguccgcgaccgcgccgaccucaacaaggacaagcccgucauccccgccgccgcccucgccggcuacaccggcuccggccccauccagcucuggcaguuccuccucgagcuccucaccgacaaguccugccaguccuucaucuccuggaccggcgacggcugggaguucaagcucuccgaccccgacgaggucgcccgccgcuggggcaagcgcaagaacaagcccaagaugaacuacgagaagcucucccgcggccuccgcuacuacuacgacaagaacaucauccacaagaccgccggcaagcgcuacgucuaccgcuucgucugcgaccuccagucccuccucggcuacacccccgaggagcuccacgccaugcucgacgucaagcccgacgccgacgaguga

SEQ ID NO: 42865 - RNA, 1830 nt, Artificial Sequence
  derived and/or modified sequence opt2 from ETS2__Homo_sapiens__NP_001243224
augggcuccgcccaguuccagggccucaucacccaggcccgccuccccuucggcgccaccuccaccaccgcccccucccuccgcaacuccaagggccgcuucggcguccgcgcccucgcccccgagcgcacccccuccgccccccgcaaggucuccgcccgccuccccggccgcacccucgcccgcaccuggggccgcggccccgcccccggcgccuccggccccgccggcgagggccccucccgcgucaccgccggcggcggcggcaagcuccgcgcccccggcgccgcccgccccgccuccggccuccccgaccgccucuggcccgcccccucccccucccccggcgcccaccgcgccgccgccggcgccgagcagccccccucccgccccuccgccggccccgcccgcuccggccgcaugaacgacuucggcaucaagaacauggaccaggucgcccccgucgccaacuccuaccgcggcacccucaagcgccagcccgccuucgacaccuucgacggcucccucuucgccgucuuccccucccucaacgaggagcagacccuccaggagguccccaccggccucgacuccaucucccacgacuccgccaacugcgagcucccccuccucacccccugcuccaaggccgucaugucccaggcccucaaggccaccuucuccggcuucaagaaggagcagcgccgccucggcauccccaagaaccccuggcucugguccgagcagcaggucugccaguggcuccucugggccaccaacgaguucucccucgucaacgucaaccuccagcgcuucggcaugaacggccagaugcucugcaaccucggcaaggagcgcuuccucgagcucgcccccgacuucgucggcgacauccucugggagcaccucgagcagaugaucaaggagaaccaggagaagaccgaggaccaguacgaggagaacucccaccucaccuccgucccccacuggaucaacuccaacacccucggcuucggcaccgagcaggcccccuacggcaugcagacccagaacuaccccaagggcggccuccucgacuccaugugccccgccuccacccccuccguccucuccuccgagcaggaguuccagauguuccccaagucccgccucuccuccgucuccgucaccuacugcuccgucucccaggacuuccccggcuccaaccucaaccuccucaccaacaacuccggcacccccaaggaccacgacucccccgagaacggcgccgacuccuucgaguccuccgacucccuccuccaguccuggaacucccaguccucccuccucgacguccagcgcguccccuccuucgaguccuucgaggacgacugcucccagucccucugccucaacaagcccaccauguccuucaaggacuacauccaggagcgcuccgaccccgucgagcagggcaagcccgucauccccgccgccguccucgccggcuucaccggcuccggccccauccagcucuggcaguuccuccucgagcuccucuccgacaaguccugccaguccuucaucuccuggaccggcgacggcugggaguucaagcucgccgaccccgacgaggucgcccgccgcuggggcaagcgcaagaacaagcccaagaugaacuacgagaagcucucccgcggccuccgcuacuacuacgacaagaacaucauccacaagaccuccggcaagcgcuacgucuaccgcuucgucugcgaccuccagaaccuccucggcuucacccccgaggagcuccacgccauccucggcguccagcccgacaccgaggacuga

SEQ ID NO: 42866 - RNA, 1365 nt, Artificial Sequence
  derived and/or modified sequence opt2 from ETV1__Homo_sapiens__NP_001156619
auggacggcuucuacgaccagcagguccccuacauggucaccaacucccagcgcggccgcaacugcaacgagaagcccaccaacguccgcaagcgcaaguucaucaaccgcgaccucgcccacgacuccgaggagcucuuccaggaccucucccagcuccaggagaccuggcucgccgaggcccagguccccgacaacgacgagcaguucguccccgacuaccaggccgagucccucgccuuccacggccucccccucaagaucaagaaggagccccacucccccugcuccgagaucuccuccgccugcucccaggagcagcccuucaaguucuccuacggcgagaagugccucuacaacgucuccgccuacgaccagaagccccaggucggcaugcgccccuccaacccccccacccccuccuccacccccgucuccccccuccaccacgccucccccaacuccacccacacccccaagcccgaccgcgccuuccccgcccaccucccccccucccaguccauccccgacuccuccuaccccauggaccaccgcuuccgccgccagcucuccgagcccugcaacuccuuccccccccuccccaccaugccccgcgagggccgccccauguaccagcgccagauguccgagcccaacauccccuuccccccccagggcuucaagcaggaguaccacgaccccgucuacgagcacaacaccauggucggcuccgccgccucccaguccuucccccccccccucaugaucaagcaggagccccgcgacuucgccuacgacuccggcugcauguucgagaagggcccccgccaguucuacgacgacaccugcgucguccccgagaaguucgacggcgacaucaagcaggagcccggcauguaccgcgagggccccaccuaccagcgccgcggcucccuccagcucuggcaguuccucgucgcccuccucgacgaccccuccaacucccacuucaucgccuggaccggccgcggcauggaguucaagcucaucgagcccgaggaggucgcccgccgcuggggcauccagaagaaccgccccgccaugaacuacgacaagcucucccgcucccuccgcuacuacuacgagaagggcaucaugcagaaggucgccggcgagcgcuacgucuacaaguucgucugcgaccccgaggcccucuucuccauggccuuccccgacaaccagcgcccccuccucaagaccgacauggagcgccacaucaacgaggaggacaccgucccccucucccacuucgacgaguccauggccuacaugcccgagggcggcugcugcaacccccaccccuacaacgagggcuacgucuacuga

SEQ ID NO: 42867 - RNA, 432 nt, Artificial Sequence
  derived and/or modified sequence opt2 from ETV3__Homo_sapiens__NP_005231
augaaggccggcugcuccaucgucgagaagcccgagggcggcggcggcuaccaguuccccgacugggccuacaagaccgaguccucccccggcucccgccagauccagcucuggcacuucauccucgagcuccuccagaaggaggaguuccgccacgucaucgccuggcagcagggcgaguacggcgaguucgucaucaaggaccccgacgaggucgcccgccucuggggccgccgcaagugcaagccccagaugaacuacgacaagcucucccgcgcccuccgcuacuacuacaacaagcgcauccuccacaagaccaagggcaagcgcuucaccuacaaguucaacuucaacaagcucgucaugcccaacuaccccuucaucaacauccgcuccuccggcaagauccagacccuccucgucggcaacuga

SEQ ID NO: 42868 - RNA, 1455 nt, Artificial Sequence
  derived and/or modified sequence opt2 from ETV4__Homo_sapiens__NP_001073143
auggagcgccgcaugaaggccggcuaccucgaccagcagguccccuacaccuucuccuccaagucccccggcaacggcucccuccgcgaggcccucaucggcccccucggcaagcucauggaccccggcucccuccccccccucgacuccgaggaccucuuccaggaccucucccacuuccaggagaccuggcucgccgaggcccagguccccgacuccgacgagcaguucguccccgacuuccacuccgagaaccucgccuuccacucccccaccacccgcaucaagaaggagccccaguccccccgcaccgaccccgcccucuccugcucccgcaagcccccccuccccuaccaccacggcgagcagugccucuacuccuccgccuacgaccccccccgccagaucgccaucaagucccccgcccccggcgcccucggccaguccccccuccagcccuucccccgcgccgagcagcgcaacuuccuccgcuccuccggcaccucccagccccaccccggccacggcuaccucggcgagcacuccuccgucuuccagcagccccucgacaucugccacuccuucaccucccagggcggcggccgcgagccccuccccgcccccuaccagcaccagcucuccgagcccugcccccccuacccccagcaguccuucaagcaggaguaccacgacccccucuacgagcaggccggccagcccgccgucgaccagggcggcgucaacggccaccgcuaccccggcgccggcgucgucaucaagcaggagcagaccgacuucgccuacgacuccgacgucaccggcugcgccuccauguaccuccacaccgagggcuucuccggccccucccccggcgacggcgccaugggcuacggcuacgagaagccccuccgccccuuccccgacgacgucugcgucguccccgagaaguucgagggcgacaucaagcaggagggcgucggcgccuuccgcgagggcccccccuaccagcgccgcggcgcccuccagcucuggcaguuccucgucgcccuccucgacgaccccaccaacgcccacuucaucgccuggaccggccgcggcauggaguucaagcucaucgagcccgaggaggucgcccgccucuggggcauccagaagaaccgccccgccaugaacuacgacaagcucucccgcucccuccgcuacuacuacgagaagggcaucaugcagaaggucgccggcgagcgcuacgucuacaaguucgucugcgagcccgaggcccucuucucccucgccuuccccgacaaccagcgccccgcccucaaggccgaguucgaccgccccgucuccgaggaggacaccgucccccucucccaccucgacgagucccccgccuaccuccccgagcucgccggccccgcccagcccuucggccccaagggcggcuacuccuacuga

SEQ ID NO: 42869 - RNA, 1533 nt, Artificial Sequence
  derived and/or modified sequence opt2 from ETV5__Homo_sapiens__NP_004445
auggacggcuucuacgaccagcagguccccuucaugguccccggcaagucccgcuccgaggagugccgcggccgccccgucaucgaccgcaagcgcaaguuccucgacaccgaccucgcccacgacuccgaggagcucuuccaggaccucucccagcuccaggaggccuggcucgccgaggcccagguccccgacgacgagcaguucguccccgacuuccaguccgacaaccucguccuccacgcccccccccccaccaagaucaagcgcgagcuccacucccccuccuccgagcucuccuccugcucccacgagcaggcccucggcgccaacuacggcgagaagugccucuacaacuacugcgccuacgaccgcaagccccccuccggcuucaagccccucaccccccccaccaccccccucucccccacccaccagaacccccucuucccccccccccaggccacccuccccaccuccggccacgcccccgccgccggccccguccagggcgucggccccgcccccgccccccacucccuccccgagcccggcccccagcagcagaccuucgccgucccccgccccccccaccagccccuccagaugcccaagaugaugcccgagaaccaguaccccuccgagcagcgcuuccagcgccagcucuccgagcccugccaccccuuccccccccagcccggcguccccggcgacaaccgccccuccuaccaccgccagauguccgagcccaucguccccgccgcccccccccccccccagggcuucaagcaggaguaccacgacccccucuacgagcacggcguccccggcaugcccggcccccccgcccacggcuuccagucccccaugggcaucaagcaggagccccgcgacuacugcgucgacuccgagguccccaacugccaguccuccuacaugcgcggcggcuacuucuccuccucccacgagggcuucuccuacgagaaggacccccgccucuacuucgacgacaccugcgucguccccgagcgccucgagggcaaggucaagcaggagcccaccauguaccgcgagggcccccccuaccagcgccgcggcucccuccagcucuggcaguuccucgucacccuccucgacgaccccgccaacgcccacuucaucgccuggaccggccgcggcauggaguucaagcucaucgagcccgaggaggucgcccgccgcuggggcauccagaagaaccgccccgccaugaacuacgacaagcucucccgcucccuccgcuacuacuacgagaagggcaucaugcagaaggucgccggcgagcgcuacgucuacaaguucgucugcgaccccgacgcccucuucuccauggccuuccccgacaaccagcgccccuuccucaaggccgaguccgagugccaccucuccgaggaggacacccucccccucacccacuucgaggacucccccgccuaccuccucgacauggaccgcugcuccucccuccccuacgccgagggcuucgccuacuga

SEQ ID NO: 42870 - RNA, 1359 nt, Artificial Sequence
  derived and/or modified sequence opt2 from ETV6__Homo_sapiens__NP_001978
auguccgagacccccgcccagugcuccaucaagcaggagcgcaucuccuacaccccccccgagucccccguccccuccuacgccuccuccaccccccuccacguccccgucccccgcgcccuccgcauggaggaggacuccauccgccuccccgcccaccuccgccuccagcccaucuacuggucccgcgacgacgucgcccaguggcucaagugggccgagaacgaguucucccuccgccccaucgacuccaacaccuucgagaugaacggcaaggcccuccuccuccucaccaaggaggacuuccgcuaccgcuccccccacuccggcgacguccucuacgagcuccuccagcacauccucaagcagcgcaagccccgcauccucuucucccccuucuuccaccccggcaacuccauccacacccagcccgaggucauccuccaccagaaccacgaggaggacaacugcguccagcgcaccccccgccccuccgucgacaacguccaccacaacccccccaccaucgagcuccuccaccgcucccgcucccccaucaccaccaaccaccgccccucccccgaccccgagcagcgcccccuccgcuccccccucgacaacaugauccgccgccucucccccgccgagcgcgcccagggcccccgcccccaccaggagaacaaccaccaggaguccuacccccucuccgucucccccauggagaacaaccacugccccgccuccuccgagucccaccccaagcccuccuccccccgccaggaguccacccgcgucauccagcucaugcccucccccaucaugcacccccucauccucaacccccgccacuccgucgacuucaagcagucccgccucuccgaggacggccuccaccgcgagggcaagcccaucaaccucucccaccgcgaggaccucgccuacaugaaccacaucauggucuccgucuccccccccgaggagcacgccaugcccaucggccgcaucgccgacugccgccuccucugggacuacgucuaccagcuccucuccgacucccgcuacgagaacuucauccgcugggaggacaaggaguccaagaucuuccgcaucgucgaccccaacggccucgcccgccucuggggcaaccacaagaaccgcaccaacaugaccuacgagaagaugucccgcgcccuccgccacuacuacaagcucaacaucauccgcaaggagcccggccagcgccuccucuuccgcuucaugaagacccccgacgagaucauguccggccgcaccgaccgccucgagcaccucgagucccaggagcucgacgagcagaucuaccaggaggacgagugcuga

SEQ ID NO: 42871 - RNA, 954 nt, Artificial Sequence
  derived and/or modified sequence opt2 from ETV7__Homo_sapiens__NP_001193964
augcaggagggcgagcucgccaucucccccaucucccccgucgccgccaugcccccccucggcacccacguccaggcccgcugcgaggcccagaucaaccuccucggcgagggcggcaucugcaagcuccccggccgccuccgcauccagcccgcccucuggucccgcgaggacguccuccacuggcuccgcugggccgagcaggaguacucccuccccugcaccgccgagcacggcuucgagaugaacggccgcgcccucugcauccucaccaaggacgacuuccgccaccgcgcccccuccuccggcgacguccucuacgagcuccuccaguacaucaagacccagcgccgcgcccucgucugcggccccuucuucggcggcaucuuccgccucaagacccccacccagcacucccccgucccccccgaggaggucaccggccccucccagauggacacccgccgcggccaccuccuccagccccccgaccccggccucaccuccaacuucggccaccucgacgaccccggccucgcccgcuggacccccggcaaggaggagucccucaaccucugccacugcgccgagcucggcugccgcacccagggcgucugcuccuuccccgccaugccccaggcccccaucgacggccgcaucgccgacugccgccuccucugggacuacgucuaccagcuccuccucgacacccgcuacgagcccuacaucaagugggaggacaaggacgccaagaucuuccgcgucgucgaccccaacggccucgcccgccucuggggcaaccacaagaaccgcgucaacaugaccuacgagaagaugucccgcgcccuccgccacuacuacaagcucaacaucaucaagaaggagcccggccagaagcuccucuuccgcaacggccuccagcucaucuucaucuucaucugguccuuccaguga

SEQ ID NO: 42872 - RNA, 459 nt, Artificial Sequence
  derived and/or modified sequence opt2 from EVA1A__Homo_sapiens__NP_115557
augcgccucccccucucccacucccccgagcacgucgagauggcccuccucuccaacauccucgccgccuacuccuucgucuccgagaaccccgagcgcgccgcccucuacuucgucuccggcgucugcaucggccucguccucacccucgccgcccucgucauccgcaucuccugccacaccgacugccgccgccgccccggcaagaaguuccuccaggaccgcgaguccuccuccgacuccuccgacuccgaggacggcuccgaggacaccgucuccgaccucuccguccgccgccaccgccgcuucgagcgcacccucaacaagaacgucuucaccuccgccgaggagcucgagcgcgcccagcgccucgaggagcgcgagcgcaucauccgcgagaucuggaugaacggccagcccgagguccccggcacccgcucccucaaccgcuacuacuga

SEQ ID NO: 42873 - RNA, 1326 nt, Artificial Sequence
  derived and/or modified sequence opt2 from EVA1C__Homo_sapiens__NP_478067
augcuccuccccggccgcgcccgccagccccccaccccccagcccguccagcaccccggccuccgccgccaggucgagccccccggccagcuccuccgccucuucuacugcaccguccucgucugcuccaaggagaucuccgcccucaccgacuucuccggcuaccucaccaagcuccuccagaaccacaccaccuacgccugcgacggcgacuaccucaaccuccagugcccccgccacuccaccaucuccguccaguccgccuucuacggccaggacuaccagaugugcuccucccagaagcccgccucccagcgcgaggacucccucaccugcgucgccgccaccaccuuccagaagguccucgacgagugccagaaccagcgcgccugccaccuccucgucaacucccgcgucuucggccccgaccucugccccggcuccuccaaguaccuccucgucuccuucaagugccagcccaacgagcucaagaacaagaccgucugcgaggaccaggagcucaagcuccacugccacgaguccaaguuccucaacaucuacuccgccaccuacggccgccgcacccaggagcgcgacaucugcuccuccaaggccgagcgccucccccccuucgacugccucuccuacuccgcccuccagguccucucccgccgcugcuacggcaagcagcgcugcaagaucaucgucaacaaccaccacuucggcucccccugccuccccggcgucaagaaguaccucaccgucaccuacgccugcguccccaagaacauccucaccgccaucgaccccgccaucgccaaccucaagcccucccucaagcagaaggacggcgaguacggcaucaacuucgaccccuccggcuccaagguccuccgcaaggacggcauccucgucuccaacucccucgccgccuucgccuacauccgcgcccaccccgagcgcgccgcccuccucuucgucuccuccgucugcaucggccucgcccucacccucugcgcccucgucauccgcgaguccugcgccaaggacuuccgcgaccuccagcucggccgcgagcagcucguccccggcuccgacaaggucgaggaggacuccgaggacgaggaggaggaggaggaccccuccgaguccgacuuccccggcgagcucuccggcuucugccgcaccuccuaccccaucuacuccuccaucgaggccgccgagcucgccgagcgcaucgagcgccgcgagcagaucauccaggagaucuggaugaacuccggccucgacaccucccucccccgcaacaugggccaguucuacuga

SEQ ID NO: 42874 - RNA, 3687 nt, Artificial Sequence
  derived and/or modified sequence opt2 from EVC2__Homo_sapiens__NP_001159608
augaucuggcccaaggucgagugcugccacuucaagaccgccgucgaggccccccucggcaugaagcucgacaagaagauggaggucuucaucccccucuccaccuccgccgccuccuccggccccugggcccacucccucuucgccuucauccccuccuggcccaagaagaaccucuucaagcgcgagucccccaucacccaccgccucuacggcgacaucucccgcgagguccagggcaccuccgagaacggcgucaucuuccagaagugcgcccucgucuccggcuccuccgaggcccagaccgcccgcaucuggcuccucgucaacaacaccaagaccaccuccuccgccaaccucuccgagcuccuccuccucgacuccaucgccggccucaccaucugggacuccgucggcaaccgcaccuccgagggcuuccaggccuucuccaagaaguuccuccaggucggcgacgccuucgccgucuccuacgccgccacccuccaggccggcgaccucggcaacggcgagucccucaagcuccccgcccagcucaccuuccaguccuccucccgcaaccgcacccagcucaagguccucuucuccaucaccgccgaggagaacgucaccguccucccccaccacggccuccacgccgccggcuucuucaucgccuuccuccucucccucguccucaccugggccgcccucuuccucaugguccgcuaccagugccucaagggcaacaugcucacccgccaccgcgucuggcaguacgaguccaagcucgagccccuccccuucaccuccgccgacggcgucaacgaggaccucucccucaacgaccagaugaucgacauccucuccuccgaggaccccggcuccaugcuccaggcccucgaggagcucgagaucgccacccucaaccgcgccgacgccgaccucgaggccugccgcacccagaucuccaaggacaucaucgcccuccuccucaagaaccucaccuccuccggccaccucuccccccaggucgagcgcaagauguccgccgucuucaagaagcaguuccuccuccucgagaacgagauccaggaggaguacgaccgcaagauggucgcccucaccgccgagugcgaccucgagacccgcaagaagauggagaaccaguaccagcgcgagaugauggccauggaggaggccgaggagcuccucaagcgcgccggcgagcgcuccgccgucgagugcuccaaccuccuccgcacccuccacggccucgagcaggagcaccuccgcaagucccucgcccuccagcaggaggaggacuucgccaaggcccaccgccagcucgccgucuuccagcgcaacgagcuccacuccaucuucuucacccagaucaaguccgccaucuucaagggcgagcucaagcccgaggccgccaagaugcuccuccagaacuacuccaagauccaggagaacgucgaggagcucauggacuucuuccaggccuccaagcgcuaccaccucuccaagcgcuucggccaccgcgaguaccucguccagaaccuccaguccuccgagacccgcguccagggccuccucuccaccgccgccgcccagcucacccaccucauccagaagcacgagcgcgccggcuaccucgacgaggaccagauggagaugcuccucgagcgcgcccagaccgaggucuucuccaucaagcagaagcucgacaacgaccucaagcaggagaagaagaagcuccaccagaagcucaucaccaagcgccgccgcgagcuccuccagaagcaccgcgagcagcgccgcgagcaggccuccgucggcgaggccuuccgcaccgucgaggacgccggccaguaccuccaccagaagcgcucccucauggaggagcacggcgccacccucgaggagcuccaggagcgccucgaccaggccgcccucgacgaccuccgcacccucacccucucccucuucgagaaggccaccgacgagcuccgccgccuccagaacuccgccaugacccaggagcuccucaagcgcggcguccccuggcucuuccuccagcagauccucgaggagcacggcaaggagauggccgcccgcgccgagcagcucgagggcgaggagcgcgaccgcgaccaggagggcguccaguccguccgccagcgccucaaggacgacgcccccgaggccgucaccgaggagcaggccgagcuccgccgcugggagcaccucaucuucaugaagcucugcuccuccgucuucucccucuccgaggaggagcuccuccgcaugcgccaggagguccacggcugcuucgcccagauggaccgcucccucgcccuccccaagauccgcgcccgcguccuccuccagcaguuccagaccgccuggcgcgaggccgaguucgucaagcucgaccaggccgucgccgcccccgagcuccagcagcaguccaagguccgcaagucccgcuccaaguccaaguccaagggcgagcuccucaagaagugcaucgaggacaagauccaccucugcgaggagcaggccuccgaggaccucgucgagaagguccgcggcgagcuccuccgcgagcgcguccagcgcauggaggcccaggagggcggcuucgcccagucccucgucgcccuccaguuccagaaggccucccgcgucaccgagacccucuccgccuacaccgcccuccucuccauccaggaccuccuccucgaggagcucuccgccuccgagaugcucaccaaguccgccugcacccagauccucgagucccacucccgcgagcuccaggagcucgagcgcaagcucgaggaccagcucguccagcaggaggccgcccagcagcagcaggcccucgccuccuggcagcagugggucgccgacggccccggcauccucaacgagcccggcgaggucgacuccgagcgccaggucuccaccguccuccaccaggcccucuccaagucccagacccuccucgagcagcaccagcagugccuccgcgaggagcagcagaacuccgucguccucgaggaccuccucgagaacauggaggccgacaccuucgccacccucugcucccaggagcuccgccucgccuccuaccucgcccgcauggccaugguccccggcgccacccuccgccgccuccucuccgucguccuccccaccgccucccagccccagcuccucgcccuccucgacuccgccaccgagcgccacgucgaccacgccgccgaguccgacggcggcgccgagcaggccgacgucggccgccgccgcaagcaccaguccugguggcaggcccucgacggcaagcuccgcggcgaccucaucucccgcggccucgagaagaugcucugggcccgcaagcgcaagcaguccauccucaagaagaccugccucccccuccgcgagcgcaugaucuucuccggcaagggcuccuggccccaccucucccucgagcccaucggcgagcucgcccccguccccaucgucggcgccgagaccaucgaccuccucaacaccggcgagaagcucuucaucuuccgcaaccccaaggagcccgagaucucccuccacguccccccccgcaagaagaagaacuuccucaacgccaagaaggccaugcgcgcccucggcauggacuga

SEQ ID NO: 42875 - RNA, 2979 nt, Artificial Sequence
  derived and/or modified sequence opt2 from EVC__Homo_sapiens__NP_714928
auggcccgcggcggcgccgccugcaaguccgacgcccgccuccuccucggccgcgacgcccuccgccccgcccccgcccuccucgcccccgccguccuccucggcgccgcccucggccucggccucggccucuggcucggcugccgcgccggccgccagcgcacccgccaccagaaggacgacacccagaaccuccucaagaaccucgaguccaacgcccagacccccuccgagaccggcucccccucccgccgccgcaagcgcgagguccagauguccaaggacaaggaggccgucgacgagugcgagccccccuccaacuccaacaucaccgccuucgcccucaaggccaaggucaucuaccccaucaaccagaaguuccgcccccucgccgacggcuccuccaaccccucccuccacgagaaccucaagcaggccguccucccccaccagcccgucgaggccucccccuccuccucccucggcucccucucccagggcgagaaggacgacugcuccuccuccuccuccguccacuccgccaccuccgacgaccgcuuccucucccgcaccuuccuccgcgucaacgccuuccccgagguccucgccugcgaguccgucgacgucgaccucugcaucuacucccuccaccucaaggaccuccuccaccucgacaccgcccuccgccaggagaagcacaugauguucauccagaucuucaagaugugccuccucgaccuccuccccaagaagaaguccgacgacgagcucuaccagaagauccucuccaagcaggagaaggaccucgaggagcucgagaagggccuccaggucaagcucuccaacaccgagauguccggcgccggcgacuccgaguacaucacccucgccgacgucgagaagaaggagcgcgaguacuccgagcagcucaucgacaacauggaggccuucuggaagcagauggccaacauccagcacuuccucgucgaccaguucaagugcuccuccuccaaggcccgccagcucaugaugacccucaccgagcgcaugaucgccgccgagggccuccucugcgacucccaggagcuccaggcccucgacgcccucgagcgcaccaugggccgcgcccacauggccaaggucaucgaguuccucaagcuccagguccaggaggagacccgcugccgccucgccgccaucucccacggccucgagcuccucgccggcgagggcaagcucuccggccgccagaaggaggagcuccucacccagcagcacaaggccuucuggcaggaggccgagcgcuucucccgcgaguucguccagcgcggcaaggaccucgucaccgccucccucgcccaccaggucgagggcaccgccaagcucacccucgcccaggaggaggagcagcgcuccuuccucgccgaggcccagcccaccgccgaccccgagaaguuccucgaggccuuccacgagguccucgagcgccagcgccucaugcagugcgaccucgaggaggaggagaacguccgcgccaccgaggccgucgucgcccucugccaggagcucuacuucuccaccgucgacaccuuccagaaguucgucgacgcccucuuccuccagacccuccccggcaugaccggccucccccccgaggagugcgacuaccuccgccaggagguccaggagaacgccgccuggcagcucggcaaguccaaccgcuuccgccgccagcaguggaagcucuuccaggagcuccucgagcaggaccagcaggucuggauggaggagugcgcccucuccuccguccuccagacccaccuccgcgaggaccacgagggcaccauccgcggcguccucggccgccucggcggccucaccgaggaguccacccgcugcguccuccagggccacgaccuccuccuccgcuccgcccuccgccgccucgcccuccgcggcaacgcccucgccacccucacccagaugcgccucuccggcaagaagcaccuccuccaggagcuccgcgagcagcgcgcccucgagcagggcuccucccagugccucgacgagcaccaguggcagcuccuccgcgcccucgaggcccgcguccucgaggaggccucccgccucgaggaggaggcccagcagacccgccuccagcuccagcagcgccuccucgccgaggcccaggaggucggccagcuccuccagcagcacauggagugcgccaucggccaggcccuccucguccacgcccgcaacgccgccaccaagucccgcgccaaggaccgcgacgacuucaagcgcacccucauggaggccgccgucgaguccgucuacgucaccuccgccggcgucucccgccucguccaggccuacuaccagcagaucggccgcaucauggaggaccacgaggagcgcaagcuccagcaccucaagacccuccagggcgagcgcauggagaacuacaagcuccgcaagaagcaggagcucuccaaccccuccuccggcucccgcaccgccggcggcgcccacgagaccucccaggccguccaccagcgcaugcucucccagcagaagcgcuuccucgcccaguuccccguccaccagcagaugcgccuccacgcccagcagcagcaggccggcgucauggaccuccucgaggcccagcucgagacccagcuccaggaggccgagcagaacuucaucuccgagcucgccgcccucgcccgcgucccccucgccgaguccaagcuccuccccgccaagcgcggccuccucgagaagccccuccgcaccaagcgcaagaagccccucccccaggagcgcggcgaccucggcguccccaacaacgaggaccucgccuccggcgaccagaccuccggcucccucuccuccaagcgccucucccagcaggaguccgaggccggcgacuccggcaacuccaagaagaugcucaagcgccgcuccaaccucuga

SEQ ID NO: 42876 - RNA, 780 nt, Artificial Sequence
  derived and/or modified sequence opt2 from EVI2A__Homo_sapiens__NP_001003927
augcuccuccgcuccugguucggcaacaaggacuuccaggcccuccccauccucgcccgccuccccuccaugcccaccgacauggagcacaccggccacuaccuccaccucgccuuccucaugaccaccgucuucucccucucccccggcaccaaggccaacuacacccgccucugggccaacuccaccuccuccugggacuccgucauccagaacaagaccggccgcaaccagaacgagaacaucaacaccaaccccaucacccccgaggucgacuacaagggcaacuccaccaacaugcccgagaccucccacaucgucgcccucaccuccaaguccgagcaggagcucuacauccccuccgucgucuccaacucccccuccaccguccaguccaucgagaacaccuccaagucccacggcgagaucuucaagaaggacgucugcgccgagaacaacaacaacauggccaugcucaucugccucaucaucaucgccguccucuuccucaucugcaccuuccucuuccucuccaccgucguccucgccaacaaggucuccucccuccgccgcuccaagcaggucggcaagcgccagccccgcuccaacggcgacuuccucgccuccggccucuggcccgccgaguccgacaccuggaagcgcaccaagcagcucaccggccccaaccucgucaugcaguccaccggcguccucaccgccacccgcgagcgcaaggacgaggagggcaccgagaagcucaccaacaagcagaucggcuga

SEQ ID NO: 42877 - RNA, 1347 nt, Artificial Sequence
  derived and/or modified sequence opt2 from EVI2B__Homo_sapiens__NP_006486
auggaccccaaguacuucauccucauccucuucugcggccaccucaacaacaccuucuucuccaagaccgagaccaucaccaccgagaagcagucccagcccacccucuucaccuccuccaugucccagguccucgccaacucccagaacaccaccggcaacccccucggccagcccacccaguucuccgacaccuucuccggccaguccaucucccccgccaaggucaccgccggccagcccacccccgccgucuacaccuccuccgagaagcccgaggcccacaccuccgccggccagccccucgccuacaacaccaagcagcccacccccaucgccaacaccuccucccagcaggccgucuucaccuccgcccgccagcuccccuccgcccgcaccuccaccacccagccccccaaguccuucgucuacaccuucacccagcaguccuccuccguccagauccccucccgcaagcagaucaccguccacaaccccuccacccagcccaccuccaccgucaagaacuccccccgcuccacccccggcuucauccucgacaccaccuccaacaagcagaccccccagaagaacaacuacaacuccaucgccgccauccucaucggcguccuccucaccuccaugcucgucgccaucaucaucaucguccucuggaagugccuccgcaagcccguccucaacgaccagaacugggccggccgcucccccuucgccgacggcgagacccccgacaucugcauggacaacauccgcgagaacgagaucuccaccaagcgcaccuccaucaucucccucacccccuggaagcccuccaaguccacccuccucgccgacgaccucgagaucaagcucuucgaguccuccgagaacaucgaggacuccaacaaccccaagaccgagaagaucaaggaccaggucaacggcaccuccgaggacuccgccgacggcuccaccgucggcaccgccgucuccuccuccgacgacgccgaccucccccccccccccccccuccucgaccucgagggccaggaguccaaccaguccgacaagcccaccaugaccaucgucuccccccuccccaacgacuccaccucccucccccccucccucgacugccucaaccaggacugcggcgaccacaaguccgagaucauccaguccuuccccccccucgacucccucaaccucccccucccccccgucgacuucaugaagaaccaggaggacuccaaccucgagauccagugccaggaguucuccaucccccccaacuccgaccaggaccucaacgagucccucccccccccccccgccgagcuccucuga

SEQ ID NO: 42878 - RNA, 2685 nt, Artificial Sequence
  derived and/or modified sequence opt2 from EVI5__Homo_sapiens__XP_011540402
augaccuccggcgccucccucaagcucaccuccggcuuccccgucgccaccgacaaggucgccgagaagcucuccuccacccucuccugggucaagaacaccgucucccacaccgucucccagauggccucccaggucgccucccccuccaccucccuccacaccaccuccuccuccaccacccucuccacccccgcccucucccccuccucccccucccagcucucccccgacgaccucgagcuccucgccaagcucgaggagcagaaccgccuccucgagaccgacuccaagucccuccgcuccgucaacggcucccgccgcaacuccggcuccucccucgucuccuccuccuccgccuccuccaaccucucccaccucgaggaggacuccuggauccucuggggccgcaucgucaacgagugggaggacguccgcaagaagaaggagaagcaggucaagcccuucgagugcuggguccucuaccaccacucccagcucugccgcuuccagguccacuaccucaagcgcucccacaccgaggagcucguccacaagggcaucccccaccacuuccgcgccaucgucuggcagcuccucugcuccgcccaguccaugcccaucaaggaccaguacuccgagcuccucaagaugaccucccccugcgagaagcucauccgccgcgacaucgcccgcaccuaccccgagcacaacuucuucaaggagaaggacucccucggccaggagguccucuucaacgucaugaaggccuacucccucgucgaccgcgaggucggcuacugccagggcuccgccuucaucgucggccuccuccucaugcagaugcccgaggaggaggccuucugcgucuucgucaagcucaugcaggacuaccgccuccgcgagcucuucaagcccuccauggccgagcucggccucugcauguaccaguucgagugcaugauccaggagcaccuccccgagcucuucguccacuuccagucccaguccuuccacaccuccauguacgccuccuccugguuccucaccaucuuccucaccaccuucccccuccccaucgccacccgcaucuucgacaucuucauguccgagggccucgagaucgucuuccgcgucggccucgcccuccuccagaugaaccaggccgagcucaugcagcucgacauggagggcaugcuccagcacuuccagaaggucaucccccaccaguucgacggcguccccgacaagcucauccaggccgccuaccaggucaaguacaacuccaagaagaugaagaagcucgagaaggaguacaccaccaucaagaccaaggagauggaggagcaggucgagaucaagcgccuccgcaccgagaaccgccuccucaagcagcgcaucgagacccucgagaaggaguccgccucccucgccgaccgccucauccagggccaggucacccgcgcccaggaggccgaggagaacuaccucaucaagcgcgagcucgccaccaucaagcagcaguccgacgaggccuccgccaagcucgagcaggccgagaacaccauccgcaagcuccagcaccagcagcaguggcacaagugcuccuccaacuacaacgaggacuucguccuccagcucgagaaggagcucguccaggcccgccucuccgaggccgagucccagugcgcccucaaggagaugcaggacaagguccucgacaucgagaagcgcaacaacucccuccccgacgagaacaacaucgcccgccuccaggaggagcucaucgccgucaagcuccgcgaggccgaggccaucaugggccucaaggagcuccgccagcaggucaaggaccucgaggagcacuggcagcgccaccucgcccgcaccaccggccgcuggaaggacccccccaagaagaacgccaugaacgagcuccaggacgagcucaugaccauccgccuccgcgaggccgagacccaggccgagauccgcgagaucaagcagcgcaugauggagauggagacccagaaccagaucaacuccaaccaccuccgccgcgccgagcaggaggucaucucccuccaggagaagguccaguaccucuccgcccagaacaagggccuccucacccagcucuccgaggccaagcgcaagcaggccgagaucgagugcaagaacaaggaggaggucauggccguccgccuccgcgaggccgacuccaucgccgccgucgccgagcuccgccagcacaucgccgagcucgagauccagaaggaggagggcaagcuccagggccagcucaacaaguccgacuccaaccaguacaucggcgagcucaaggaccagaucgccgagcucaaccacgagcuccgcugccucaagggccagcgcggcuucuccggccagccccccuucgacggcauccacaucgucaaccaccucaucggcgacgacgaguccuuccacuccuccgacgaggacuucaucgacaacucccuccaggagaccggcgucggcuucccccuccacggcaaguccggcuccaugucccucgaccccgccgucgccgacggcuccgaguccgagaccgaggacuccguccucgagacccgcgaguccaaccaggucguccagaaggagcgccccccccgccgccgcgaguccuacuccaccaccgucuga

SEQ ID NO: 42879 - RNA, 1257 nt, Artificial Sequence
  derived and/or modified sequence opt2 from EVL__Homo_sapiens__NP_057421
auggccaccuccgagcaguccaucugccaggcccgcgccuccgucauggucuacgacgacaccuccaagaaguggguccccaucaagcccggccagcagggcuucucccgcaucaacaucuaccacaacaccgccuccaacaccuuccgcgucgucggcgucaagcuccaggaccagcaggucgucaucaacuacuccaucgucaagggccucaaguacaaccaggccacccccaccuuccaccaguggcgcgacgcccgccaggucuacggccucaacuucgccuccaaggaggaggccaccaccuucuccaacgccaugcucuucgcccucaacaucaugaacucccaggagggcggccccuccucccagcgccagguccagaacggccccucccccgacgagauggacauccagcgccgccaggucauggagcagcaccagcagcagcgccaggagucccucgagcgccgcaccuccgccaccggccccauccucccccccggccaccccuccuccgccgccuccgcccccgucuccugcuccggcccccccccccccccccccccccccgucccccccccccccaccggcgccacccccccccccccccccccccuccccgccggcggcgcccagggcuccucccacgacgaguccuccauguccggccucgccgccgccaucgccggcgccaagcuccgccgcguccagcgccccgaggacgccuccggcggcuccucccccuccggcaccuccaaguccgacgccaaccgcgccuccuccggcggcggcggcggcggccucauggaggagaugaacaagcuccucgccaagcgccgcaaggccgccucccaguccgacaagcccgccgagaagaaggaggacgagucccagauggaggaccccuccaccucccccucccccggcacccgcgccgccucccagccccccaacuccuccgaggccggccgcaagcccugggagcgcuccaacuccgucgagaagcccgucuccuccauccucucccgcacccccuccgucgccaagucccccgaggccaaguccccccuccagucccagccccacucccgcaugaagcccgccggcuccgucaacgacauggcccucgacgccuucgaccucgaccgcaugaagcaggagauccucgaggaggucguccgcgagcuccacaaggucaaggaggagaucaucgacgccauccgccaggagcucuccggcaucuccaccaccuga

SEQ ID NO: 42880 - RNA, 6102 nt, Artificial Sequence
  derived and/or modified sequence opt2 from EVPL__Homo_sapiens__NP_001979
auguucaagggccucuccaagggcucccagggcaagggcucccccaagggcucccccgccaagggcucccccaagggcucccccucccgccacucccgcgccgccacccaggagcucgcccuccucaucucccgcaugcaggccaacgccgaccaggucgagcgcgacauccucgagacccagaagcgccuccagcaggaccgccucaacuccgagcagucccaggcccuccagcaccagcaggagaccggccgcucccucaaggaggccgagguccuccucaaggaccucuuccucgacgucgacaaggcccgccgccucaagcacccccaggccgaggagaucgagaaggacaucaagcagcuccacgagcgcgucacccaggagugcgccgaguaccgcgcccucuacgagaagaugguccucccccccgacgucggcccccgcgucgacugggcccgcguccucgagcagaagcagaagcaggucugcgccggccaguacggccccggcauggccgagcucgagcagcagaucgccgagcacaacauccuccagaaggagaucgacgccuacggccagcagcuccgcucccucgucggccccgacgccgccaccauccgcucccaguaccgcgaccuccucaaggccgccuccuggcgcggccagucccucggcucccucuacacccaccuccagggcugcacccgccagcucuccgcccucgccgagcagcagcgccgcauccuccagcaggacugguccgaccucauggccgaccccgccggcguccgccgcgaguacgagcacuucaagcagcacgagcuccucucccaggagcaguccgucaaccagcucgaggacgacggcgagcgcauggucgagcuccgccaccccgccgucggccccauccaggcccaccaggaggcccucaagauggaguggcagaacuuccucaaccucugcaucugccaggagacccagcuccagcacgucgaggacuaccgccgcuuccaggaggaggccgacuccgucucccagacccucgccaagcucaacuccaaccucgacgccaaguacucccccgcccccggcggcccccccggcgcccccaccgagcuccuccagcagcucgaggccgaggagaagcgccucgccgucaccgagcgcgccaccggcgaccuccagcgccgcucccgcgacgucgccccccucccccagcgccgcaaccccccccagcagccccuccacgucgacuccaucugcgacugggacuccggcgagguccagcuccuccagggcgagcgcuacaagcucgucgacaacaccgacccccacgccugggucguccagggccccggcggcgagaccaagcgcgcccccgccgccugcuucugcauccccgcccccgaccccgacgccgucgcccgcgccucccgccucgccuccgagcuccaggcccucaagcagaagcucgccaccguccagucccgccucaaggccuccgccgucgagucccuccgccccucccagcaggcccccuccggcuccgaccucgccaacccccaggcccagaagcuccucacccagaugacccgccucgacggcgaccucggccagaucgagcgccagguccucgccugggcccgcgccccccucucccgccccaccccccucgaggaccucgagggccgcauccacucccacgagggcaccgcccagcgccuccagucccucggcaccgagaaggagaccgcccagaaggagugcgaggccuuccucuccacccgccccgucggccccgccgcccuccagcuccccgucgcccucaacuccgucaagaacaaguucuccgacguccagguccucugcucccucuacggcgagaaggccaaggccgcccucgaccucgagcgccagauccaggacgccgaccgcgucauccgcggcuucgaggccacccucguccaggaggcccccauccccgccgagcccggcgcccuccaggagcgcgucuccgagcuccagcgccagcgccgcgagcuccucgagcagcagaccugcguccuccgccuccaccgcgcccucaaggccuccgagcacgccugcgccgcccuccagaacaacuuccaggaguucugccaggaccucccccgccagcagcgccagguccgcgcccucaccgaccgcuaccacgccgucggcgaccagcucgaccuccgcgagaaggucguccaggacgccgcccucaccuaccagcaguucaagaacugcaaggacaaccucuccuccuggcucgagcaccucccccgcucccagguccgccccuccgacggccccucccagaucgccuacaagcuccaggcccagaagcgccucacccaggagauccagucccgcgagcgcgaccgcgccaccgccucccaccucucccaggcccuccaggccgcccuccaggacuacgagcuccaggccgacaccuaccgcugcucccucgagcccacccucgccgucuccgcccccaagcgcccccgcgucgccccccuccaggaguccauccaggcccaggagaagaaccucgccaaggccuacaccgaggucgccgccgcccagcagcagcuccuccagcagcucgaguucgcccgcaagaugcucgagaagaaggagcucuccgaggacauccgccgcacccacgacgccaagcagggcuccgagucccccgcccaggccggccgcgaguccgaggcccucaaggcccagcucgaggaggagcgcaagcgcgucgcccgcguccagcacgagcucgaggcccagcgcucccagcuccuccagcuccgcacccagcgcccccucgagcgccucgaggagaaggaggucgucgaguucuaccgcgacccccagcucgagggcucccucucccgcgucaaggcccaggucgaggaggagggcaagcgccgcgccggccuccaggccgaccucgaggucgccgcccagaaggucguccagcucgaguccaagcgcaagaccaugcagccccaccuccucaccaaggaggucacccaggucgagcgcgaccccggccucgacucccaggccgcccagcuccgcauccagauccagcagcuccgcggcgaggacgccgucaucuccgcccgccucgagggccucaagaaggagcuccucgcccucgagaagcgcgaggucgacgucaaggagaaggucgucgucaaggaggucgucaaggucgagaagaaccucgagauggucaaggccgcccaggcccuccgccuccagauggaggaggacgccgcccgccgcaagcaggccgaggaggccgucgccaagcuccaggcccgcaucgaggaccucgagcgcgccaucuccuccgucgagcccaaggucaucgucaaggaggucaagaaggucgagcaggaccccggccuccuccaggaguccucccgccuccgcucccuccucgaggaggagcgcaccaagaacgccacccucgcccgcgagcucuccgaccuccacuccaaguacuccgucgucgagaagcagcgccccaagguccagcuccaggagcgcguccacgagaucuuccaggucgaccccgagaccgagcaggagaucacccgccucaaggccaagcuccaggagauggccggcaagcgcuccggcgucgagaaggaggucgagaagcuccuccccgaccucgagguccuccgcgcccagaagcccaccgucgaguacaaggaggucacccaggaggucguccgccacgagcgcucccccgagguccuccgcgagaucgaccgccucaaggcccagcucaacgagcucgucaacucccacggccgcucccaggagcagcucauccgccuccagggcgagcgcgacgaguggcgccgcgagcgcgccaaggucgagaccaagaccgucuccaaggaggucguccgccacgagaaggaccccguccucgagaaggaggccgagcgccuccgccaggagguccgcgaggccgcccagaagcgccgcgccgccgaggacgccgucuacgagcuccaguccaagcgccuccuccucgagcgccgcaagcccgaggagaaggucgucguccaggaggucgucgucacccagaaggaccccaagcuccgcgaggagcacucccgccucuccggcucccucgacgaggaggucggccgccgccgccagcucgagcucgagguccagcagcuccgcgccggcgucgaggagcaggagggccuccucuccuuccaggaggaccgcuccaagaagcucgccgucgagcgcgagcuccgccagcucacccuccgcauccaggagcucgagaagcgcccccccaccguccaggagaagaucaucauggaggaggucgucaagcucgagaaggaccccgaccucgagaaguccaccgaggcccuccgcugggaccucgaccaggagaagacccaggucaccgagcucaaccgcgagugcaagaaccuccagguccagaucgacguccuccagaaggccaagucccaggagaagaccaucuacaaggaggucauccgcguccagaaggaccgcguccucgaggacgagcgcgcccgcgucugggagaugcucaaccgcgagcgcaccgcccgccaggcccgcgaggaggaggcccgccgccuccgcgagcgcaucgaccgcgccgagacccucggccgcaccuggucccgcgaggaguccgagcuccagcgcgcccgcgaccaggccgaccaggagugcggccgccuccagcaggagcuccgcgcccucgagcgccagaagcagcagcagacccuccagcuccaggaggaguccaagcuccucucccagaagaccgaguccgagcgccagaaggccgcccagcgcggccaggagcucucccgccucgaggccgccauccuccgcgagaaggaccagaucuacgagaaggagcgcacccuccgcgaccuccacgccaaggucucccgcgaggagcucucccaggagacccagacccgcgagaccaaccucuccaccaagaucuccauccucgagcccgagaccggcaaggacaugucccccuacgaggccuacaagcgcggcaucaucgaccgcggccaguaccuccagcuccaggagcucgagugcgacugggaggaggucaccaccuccggccccugcggcgaggaguccguccuccucgaccgcaaguccggcaagcaguacuccaucgaggccgcccuccgcugccgccgcaucuccaaggaggaguaccaccucuacaaggacggccaccuccccaucuccgaguucgcccuccucgucgccggcgagaccaagcccuccuccucccucuccaucggcuccaucaucuccaaguccccccucgccucccccgccccccaguccaccuccuucuucucccccuccuucucccucggccucggcgacgacuccuuccccaucgccggcaucuacgacaccaccaccgacaacaagugcuccaucaagaccgccgucgccaagaacaugcucgaccccaucaccggccagaagcuccucgaggcccaggccgccaccggcggcaucgucgaccuccucucccgcgagcgcuacuccguccacaaggccauggagcgcggccucaucgagaacaccuccacccagcgccuccucaacgcccagaaggccuucaccggcaucgaggaccccgucaccaagaagcgccucuccgucggcgaggccguccagaagggcuggaugccccgcgaguccguccucccccaccuccagguccagcaccucaccggcggccucaucgaccccaagcgcaccggccgcauccccauccagcaggcccuccucuccggcaugaucuccgaggagcucgcccagcuccuccaggacgaguccuccuacgagaaggaccucaccgaccccaucuccaaggagcgccucuccuacaaggaggccaugggccgcugccgcaaggacccccucuccggccuccuccuccuccccgccgcccucgagggcuaccgcugcuaccgcuccgccucccccaccgucccccgcucccuccgcuga

SEQ ID NO: 42881 - RNA, 678 nt, Artificial Sequence
  derived and/or modified sequence opt2 from EVX1__Homo_sapiens__NP_001291449
augcgccgcuaccgcaccgccuucacccgcgagcagaucgcccgccucgagaaggaguucuaccgcgagaacuacgucucccgcccccgccgcugcgagcucgccgccgcccucaaccuccccgagaccaccaucaaggucugguuccagaaccgccgcaugaaggacaagcgccagcgccucgccaugaccuggccccaccccgccgaccccgccuucuacaccuacaugaugucccacgccgccgccgccggcggccuccccuaccccuuccccucccaccucccccuccccuacuacucccccgucggccucggcgccgccuccgccgccuccgccgccgccucccccuucuccggcucccuccgcccccucgacaccuuccgcguccucucccagcccuacccccgccccgagcuccucugcgccuuccgccaccccccccucuaccccggccccgcccacggccucggcgccuccgccggcggccccugcuccugccucgccugccacuccggccccgccaacggccucgccccccgcgccgccgccgccuccgacuucaccugcgccuccaccucccgcuccgacuccuuccucaccuucgcccccuccguccucuccaaggccuccuccgucgcccucgaccagcgcgaggaggucccccucacccgcuga

SEQ ID NO: 42882 - RNA, 1431 nt, Artificial Sequence
  derived and/or modified sequence opt2 from EVX2__Homo_sapiens__XP_011509410
augauggagcgcauccgcaaggagaugauccucauggagcgcggccuccacucccccaccgccggcaagcgcuucuccaaccucuccaacuccgccggcaacgccguccucgaggcccucgagaacucccagcaccccgcccgccucuccccccgccuccccuccgccccccuccacuccgcccucggcgagcuccccgccaagggcaaguucgagaucgacacccucuucaaccuccagcacaccggcuccgaguccaccgucuccuccgagaucuccuccgccgccgagucccgcaagaagcccggccacuacuccgaggccgccgccgaggccgacauguccuccgacgucgaggucggcugcuccgcccuccgcucccccggcggccucggcgccgcccagcucaaggagaacaacggcaagggcuacgccgaguccggcuccgccgccggcaccaccaccuccgccuccggcuccggccucggcucccuccacggcggcuccggcggcuccggcggcuccgccgcccucggcggcuccggcuccggcgccgaccagguccgccgcuaccgcaccgccuucacccgcgagcagaucgcccgccucgagaaggaguucuaccgcgagaacuacgucucccgcccccgccgcugcgagcucgccgccgcccucaaccuccccgagaccaccaucaaggucugguuccagaaccgccgcaugaaggacaagcgccagcgccucgccauguccuggccccaccccgccgaccccuccuucuacaccuacaugaugacccacgccgccgccaccggcucccuccccuaccccuuccacucccacgucccccuccacuacuacccccacgucggcgucaccgccgccgccgccgccgccgccgccuccggcgccgccgccgccgccuccucccccuucgccaccuccauccgcccccucgacaccuuccgcgcccucucccaccccuacucccgccccgagcuccucugcuccuuccgccaccccggccucuaccaggcccccgccgccgccgccggccucaacuccgccgccuccgccgccgccgccgccgccgccgccgccgccgccgccuccuccgccgccgccgccggcgccccccccuccggcggcuccgcccccugcuccugccucuccugccacuccucccaguccgccgccgccgccgccgccgccgccgccgccgcccucggcucccgcggcggcggcggcggcggcggcggcggcggcggcggcggcggcggcggcgccggcgccggcggcggcuccgacuucggcugcuccgccgccgccccccgcuccgaguccggcuuccuccccuacuccgccgccguccucuccaagaccgccgucuccccccccgaccagcgcgacgaggccccccucacccgcuga

SEQ ID NO: 42883 - RNA, 1968 nt, Artificial Sequence
  derived and/or modified sequence opt2 from EWSR1__Homo_sapiens__NP_001156757
auggccuccaccgacuacuccaccuacucccaggccgccgcccagcagggcuacuccgccuacaccgcccagcccacccagggcuacgcccagaccacccaggccuacggccagcaguccuacggcaccuacggccagcccaccgacgucuccuacacccaggcccagaccaccgccaccuacggccagaccgccuacgccaccuccuacggccagccccccaccggcuacaccacccccaccgccccccaggccuacucccagcccguccagggcuacggcaccggcgccuacgacaccaccaccgccaccgucaccaccacccaggccuccuacgccgcccaguccgccuacggcacccagcccgccuaccccgccuacggccagcagcccgccgccaccgcccccacccgcccccaggacggcaacaagcccaccgagaccucccagccccaguccuccaccggcggcuacaaccagcccucccucggcuacggccaguccaacuacuccuacccccagguccccggcuccuaccccaugcagcccgucaccgccccccccuccuacccccccaccuccuacuccuccacccagcccaccuccuacgaccaguccuccuacucccagcagaacaccuacggccagcccuccuccuacggccagcaguccuccuacggccagcaguccuccuacggccagcagccccccaccuccuaccccccccagaccggcuccuacucccaggcccccucccaguacucccagcaguccuccuccuacggccagcaguccuccuuccgccaggaccaccccuccuccaugggcgucuacggccaggaguccggcggcuucuccggccccggcgagaaccgcuccauguccggccccgacaaccgcggccgcggccgcggcggcuucgaccgcggcggcaugucccgcggcggccgcggcggcggccgcggcggcaugggcgccggcgagcgcggcggcuucaacaagcccggcggccccauggacgagggccccgaccucgaccucggcccccccgucgaccccgacgaggacuccgacaacuccgccaucuacguccagggccucaacgacuccgucacccucgacgaccucgccgacuucuucaagcagugcggcgucgucaagaugaacaagcgcaccggccagcccaugauccacaucuaccucgacaaggagaccggcaagcccaagggcgacgccaccgucuccuacgaggacccccccaccgccaaggccgccgucgagugguucgacggcaaggacuuccagggcuccaagcucaaggucucccucgcccgcaagaagccccccaugaacuccaugcgcggcggccuccccccccgcgagggccgcggcaugccccccccccuccgcggcggccccggcggccccggcggccccggcggccccaugggccgcaugggcggccgcggcggcgaccgcggcggcuuccccccccgcggcccccgcggcucccgcggcaaccccuccggcggcggcaacguccagcaccgcgccggcgacuggcagugccccaaccccggcugcggcaaccagaacuucgccuggcgcaccgagugcaaccagugcaaggcccccaagcccgagggcuuccuccccccccccuuccccccccccggcggcgaccgcggccgcggcggccccggcggcaugcgcggcggccgcggcggccucauggaccgcggcggccccggcggcauguuccgcggcggccgcggcggcgaccgcggcggcuuccgcggcggccgcggcauggaccgcggcggcuucggcggcggccgccgcggcggccccggcggcccccccggcccccucauggagcagaugggcggccgccgcggcggccgcggcggccccggcaagauggacaagggcgagcaccgccaggagcgccgcgaccgccccuacuga

SEQ ID NO: 42884 - RNA, 1866 nt, Artificial Sequence
  derived and/or modified sequence opt2 from EXD2__Homo_sapiens__NP_001180292
augucccgccagaaccucgucgcccucaccgucaccacccuccucggcgucgccgucggcggcuucguccucuggaagggcauccagcgccgccgccgcuccaagaccucccccgucacccagcagccccagcagaagguccucggcucccgcgagcuccccccccccgaggacgaccagcuccacuccuccgccccccgcuccuccuggaaggagcgcauccucaaggccaaggucgucaccgucucccaggaggccgagugggaccagaucgagccccuccuccgcuccgagcucgaggacuuccccguccucggcaucgacugcgagugggucaaccucgagggcaaggccuccccccucucccuccuccagauggccucccccuccggccucugcguccucguccgccuccccaagcucaucugcggcggcaagacccucccccgcacccuccucgacauccucgccgacggcaccauccucaaggucggcgucggcugcuccgaggacgccuccaagcuccuccaggacuacggccucgucguccgcggcugccucgaccuccgcuaccucgccaugcgccagcgcaacaaccuccucugcaacggccucucccucaagucccucgccgagaccguccucaacuucccccucgacaagucccuccuccuccgcugcuccaacugggacgccgagacccucaccgaggaccaggucaucuacgccgcccgcgacgcccagaucuccgucgcccucuuccuccaccuccucggcuaccccuucucccgcaacucccccggcgagaagaacgacgaccacuccuccuggcgcaagguccucgagaagugccagggcgucgucgacauccccuuccgcuccaagggcaugucccgccucggcgaggaggucaacggcgaggccaccgagucccagcagaagccccgcaacaagaaguccaagauggacggcaugguccccggcaaccaccagggccgcgacccccgcaagcacaagcgcaagccccucggcgucggcuacuccgcccgcaaguccccccucuacgacaacugcuuccuccacgcccccgacggccagccccucugcaccugcgaccgccgcaaggcccagugguaccucgacaagggcaucggcgagcucgucuccgaggagcccuucgucgucaagcuccgcuucgagcccgccggccgccccgagucccccggcgacuacuaccucauggucaaggagaaccucugcgucgucugcggcaagcgcgacuccuacauccgcaagaacgucaucccccacgaguaccgcaagcacuuccccaucgagaugaaggaccacaacucccacgacguccuccuccucugcaccuccugccacgccaucuccaacuacuacgacaaccaccucaagcagcagcucgccaaggaguuccaggcccccaucggcuccgaggagggccuccgccuccucgaggaccccgagcgccgccagguccgcuccggcgcccgcgcccuccucaacgccgagucccuccccacccagcgcaaggaggagcuccuccaggcccuccgcgaguucuacaacaccgacgucgucaccgaggagaugcuccaggaggccgccucccucgagacccgcaucuccaacgagaacuacgucccccacggccucaaggucguccagugccacucccagggcggccuccgcucccucaugcagcucgagucccgcuggcgccagcacuuccucgacuccaugcagcccaagcaccucccccagcagugguccgucgaccacaaccaccagaagcuccuccgcaaguucggcgaggaccuccccauccagcucuccuga

SEQ ID NO: 42885 - RNA, 2631 nt, Artificial Sequence
  derived and/or modified sequence opt2 from EXD3__Homo_sapiens__NP_060290
auggaccccggcgaccccgccggcgaccccgccgccggcgagcgccaccgcaugggccgcgacccccuccuccuccuccaggcccuccagacccucugguccacccgcgagcgcaagcagcuccgcgaggaggccuggcgcggcuucgccgcccucgacgacccccucgccggccuccucgacaugcucgaguccugccgcggccagcgcggcgagggccccucccucgccgccuggaucucccaccagcuccagugcuggcuccaggcccagcccugccccucccucgcccagcacucccuccgccucaagcagcuccaggcccgcgccgucaagguccucaccgaguccccccccucccucgccgccccccucgccuccaucuuccagcuccaggacgccgaccgcuccugccuccucgcccacguccaccgccuccaccacgagggccgcuuccgcgaggccgccacccucggcgccacccucaagcuccaguccgagcucggcgucgagaagauguccaucccccuccuccuccaggacaaggucgcccucgucgagcgcuacgucgccggcuuccccgaccuccagcgccgccuccucguccucauggacuccuggugccagcccggcuucgacaucaaggacgucgcccgccgcuaccccgaggucaccucccucucccucgagaagcucucccccaaggcccucucccgccagguccuccgccuccaggagcgcuacggcgucgcccccgcccucugccccaacgccgccauccagcagcgccucgccgcccuccgccaccucugccacaagcgcuucgucgagaagucccucucccaggagaacuggaccgaccacguccagggccucgucggccagucccccuggcuccaggagcagcucucccagcuccucgucucccacuccgaccccgucaccgccgcccagugcgccauggagcuccuccuccccgaggagcgccuccccgccgccgucgccgucgagcuccgccgcuuccgccuccagggccgcgccaccgaggccgacucccgccucgaggucaaggacaugaaggaccgcuacuaccagcuccccaucccccgcgagaacguccaccuccucgccuccugggaggaccucacccgccacgagggcgcccuccuccagugccaccaggucgucggcgucgacgucgaguggacccccgucuucgucgccggcggccgcccccgccccucccuccuccaggucgccgucgagggccacgucuuccuccucgacguccucgcccucucccagccccccaccggccagggcgcccaggccuucucccgccucgucgcccagcuccucuccgaccccuccaucaccaagcucggcuacggcauggucggcgaccuccagaagcucggcaccuccugccccgcccucgcccacgucgagaagcagauccucggcggcauggaccuccuccucguccaccgccagaugcgcgucgccuccguccccgcccccgccgucgaccgcgcccgcgagcuccgcggccucucccuccucguccagcagguccucggcaccgcccucgacaagacccagcagcucuccaacugggaccgccgcccccucugcgaggagcaggucaucuacgccgccgccgacgccuacugccuccucgagguccaccaggcccucugccgcgagcccgcccgcuuccaccucuccgaggaccucgccggcucccgccgcccccgccaccgcgagcgccccggcgcccgcaagccccccggccuccagaaggccuccgcccccgccgccccccgccagguccccgucgccgucgccgucuccgagggcgccgccccccagauccccgcccgcgccuuccgcgucgucugcgacaacaugcuccagggccucgcccgcucccuccgcugccucggcgucgacgcccgcaugcucggcaacggcgaggaccaccgccgcgccgccgaggucgcccgccaggagggccgcaucauccucaccuccggccagcccuuccacaagcuccgcgcccaggucggcgccggccgcugccucuccgucgacugcucccucaaggcccagcagcaggccaaggccguccucaagcacuucaacguccgcgucacccacgccgacaucuucucccgcugccaggccugcaacugcgaccaguaccucaaggucucccgcgacaugaugaagcagcucauguggcucuccucccaccaggagggcccccgcuccuccggcgacgaggccacccagucccaggccguccaggagcccggccccgcccccgacgccgcccccgagggcugcaccuacgaccgccccugccgcuggcuccagauggccgaccuccgcgccgagacccccgacaugcucgccgacggcacccgccuccagcucgccggcguccccgucggcguccuccgcacccccggccuccgcugcuucuacugcugcaccggcugcggcaaggucuucugggacggcucccaccucggccgcgucgccacccacuuccgcgacaugcucgaguccgcccccucccccugcgagcccucccccgcccccucccccgccuccucccccuucuga

SEQ ID NO: 42886 - RNA, 2412 nt, Artificial Sequence
  derived and/or modified sequence opt2 from EXO1__Homo_sapiens__NP_003677
augggcauccagggccuccuccaguucaucaaggaggccuccgagcccauccacguccgcaaguacaagggccaggucgucgccgucgacaccuacugcuggcuccacaagggcgccaucgccugcgccgagaagcucgccaagggcgagcccaccgaccgcuacgucggcuucugcaugaaguucgucaacaugcuccucucccacggcaucaagcccauccucgucuucgacggcugcacccuccccuccaagaaggaggucgagcgcucccgccgcgagcgccgccaggccaaccuccucaagggcaagcagcuccuccgcgagggcaaggucuccgaggcccgcgagugcuucacccgcuccaucaacaucacccacgccauggcccacaaggucaucaaggccgcccgcucccagggcgucgacugccucgucgcccccuacgaggccgacgcccagcucgccuaccucaacaaggccggcaucguccaggccaucaucaccgaggacuccgaccuccucgccuucggcugcaagaaggucauccucaagauggaccaguucggcaacggccucgagaucgaccaggcccgccucggcaugugccgccagcucggcgacgucuucaccgaggagaaguuccgcuacaugugcauccucuccggcugcgacuaccucuccucccuccgcggcaucggccucgccaaggccugcaagguccuccgccucgccaacaaccccgacaucgucaaggucaucaagaagaucggccacuaccucaagaugaacaucaccguccccgaggacuacaucaacggcuucauccgcgccaacaacaccuuccucuaccagcucgucuucgaccccaucaagcgcaagcucaucccccucaacgccuacgaggacgacgucgaccccgagacccucuccuacgccggccaguacgucgacgacuccaucgcccuccagaucgcccucggcaacaaggacaucaacaccuucgagcagaucgacgacuacaaccccgacaccgccaugcccgcccacucccgcucccacuccugggacgacaagaccugccagaaguccgccaacgucuccuccaucuggcaccgcaacuacuccccccgccccgaguccggcaccgucuccgacgccccccagcucaaggagaaccccuccaccgucggcgucgagcgcgucaucuccaccaagggccucaaccucccccgcaaguccuccaucgucaagcgcccccgcuccgccgagcucuccgaggacgaccuccucucccaguacucccucuccuucaccaagaagaccaagaagaacuccuccgagggcaacaagucccucuccuucuccgaggucuucguccccgaccucgucaacggccccaccaacaagaaguccgucuccacccccccccgcacccgcaacaaguucgccaccuuccuccagcgcaagaacgaggaguccggcgccgucgucguccccggcacccgcucccgcuucuucugcuccuccgacuccaccgacugcgucuccaacaaggucuccauccagccccucgacgagaccgccgucaccgacaaggagaacaaccuccacgaguccgaguacggcgaccaggagggcaagcgccucgucgacaccgacgucgcccgcaacuccuccgacgacauccccaacaaccacauccccggcgaccacauccccgacaaggccaccgucuucaccgacgaggaguccuacuccuucgaguccuccaaguucacccgcaccaucuccccccccacccucggcacccuccgcuccugcuucuccugguccggcggccucggcgacuucucccgcacccccucccccucccccuccaccgcccuccagcaguuccgccgcaaguccgacucccccaccucccuccccgagaacaacauguccgacgucucccagcucaaguccgaggaguccuccgacgacgagucccacccccuccgcgaggaggccugcuccucccagucccaggaguccggcgaguucucccuccaguccuccaacgccuccaagcucucccagugcuccuccaaggacuccgacuccgaggaguccgacugcaacaucaagcuccucgacucccaguccgaccagaccuccaagcuccgccucucccacuucuccaagaaggacaccccccuccgcaacaagguccccggccucuacaaguccuccuccgccgacucccucuccaccaccaagaucaagccccucggccccgcccgcgccuccggccucuccaagaagcccgccuccauccagaagcgcaagcaccacaacgccgagaacaagcccggccuccagaucaagcucaacgagcucuggaagaacuucggcuucaagaaguucuga

SEQ ID NO: 42887 - RNA, 2685 nt, Artificial Sequence
  derived and/or modified sequence opt2 from EXOC1__Homo_sapiens__NP_001020095
augaccgccaucaagcacgcccuccagcgcgacaucuucacccccaacgacgagcgccuccucuccaucgucaacgucugcaaggccggcaagaagaagaagaacugcuuccucugcgccaccgucaccaccgagcgccccguccaggucaaggucgucaaggucaagaaguccgacaagggcgacuucuacaagcgccagaucgccugggcccuccgcgaccucgccgucgucgacgccaaggacgccaucaaggagaaccccgaguucgaccuccacuucgagaagaucuacaagugggucgccuccuccaccgccgagaagaacgccuucaucuccugcaucuggaagcucaaccagcgcuaccuccgcaagaagaucgacuucgucaacgucuccucccagcuccucgaggaguccguccccuccggcgagaaccaguccgucaccggcggcgacgaggaggucgucgacgaguaccaggagcucaacgcccgcgaggagcaggacaucgagaucaugauggagggcugcgaguacgccaucuccaacgccgaggccuucgccgagaagcucucccgcgagcuccagguccucgacggcgccaacauccaguccaucauggccuccgagaagcaggucaacauccucaugaagcuccucgacgaggcccucaaggaggucgaccagaucgagcucaagcucuccuccuacgaggagaugcuccaguccgucaaggagcagauggaccagaucuccgaguccaaccaccucauccaccucuccaacaccaacaacgucaagcuccucuccgagaucgaguuccucgucaaccacauggaccucgccaagggccacaucaaggcccuccaggagggcgaccucgccuccucccgcggcaucgaggccugcaccaacgccgccgacgcccuccuccagugcaugaacgucgcccuccgccccggccacgaccuccuccucgccgucaagcagcagcagcagcgcuucuccgaccuccgcgagcucuucgcccgccgccucgccucccaccucaacaacgucuucguccagcagggccacgaccaguccuccacccucgcccagcacuccgucgagcucacccuccccaaccaccaccccuuccaccgcgaccuccuccgcuacgccaagcucauggaguggcucaaguccaccgacuacggcaaguacgagggccucaccaagaacuacauggacuaccucucccgccucuacgagcgcgagaucaaggacuucuucgaggucgccaagaucaagaugaccggcaccaccaaggaguccaagaaguucgccacccucccccgcaaggaguccgccgucaagcaggagaccgagucccuccacggcuccuccggcaagcucaccggcuccaccuccucccucaacaagcucuccguccaguccuccggcaaccgccgcucccaguccuccucccuccucgacaugggcaacauguccgccuccgaccucgacgucgccgaccgcaccaaguucgacaagaucuucgagcagguccucuccgagcucgagccccucugccucgccgagcaggacuucaucuccaaguucuucaagcuccagcagcaccaguccaugcccggcaccauggccgaggccgaggaccucgacggcggcacccucucccgccagcacaacugcggcaccccccuccccgucuccuccgagaaggacaugauccgccagaugaugaucaagaucuuccgcugcaucgagcccgagcucaacaaccucaucgcccucggcgacaagaucgacuccuucaacucccucuacaugcucgucaagaugucccaccacgucuggaccgcccagaacgucgaccccgccuccuuccucuccaccacccucggcaacguccucgucaccgucaagcgcaacuucgacaagugcaucuccaaccagauccgccagauggaggaggucaagaucuccaagaaguccaaggucggcauccuccccuucgucgccgaguucgaggaguucgccggccucgccgaguccaucuucaagaacgccgagcgccgcggcgaccucgacaaggccuacaccaagcucauccgcggcgucuucgucaacgucgagaaggucgccaacgagucccagaagaccccccgcgacgucgucaugauggagaacuuccaccacaucuucgccacccucucccgccucaagaucuccugccucgaggccgagaagaaggaggccaagcagaaguacaccgaccaccuccaguccuacgucaucuacucccucggccagccccucgagaagcucaaccacuucuucgagggcgucgaggcccgcgucgcccagggcauccgcgaggaggaggucuccuaccagcucgccuucaacaagcaggagcuccgcaaggucaucaaggaguaccccggcaaggaggucaagaagggccucgacaaccucuacaagaaggucgacaagcaccucugcgaggaggagaaccuccuccaggucgucuggcacuccaugcaggacgaguucauccgccaguacaagcacuucgagggccucaucgcccgcugcuaccccggcuccggcgucaccauggaguucaccauccaggacauccucgacuacugcuccuccaucgcccagucccacuga

SEQ ID NO: 42888 - RNA, 2775 nt, Artificial Sequence
  derived and/or modified sequence opt2 from EXOC2__Homo_sapiens__NP_060773
augucccgcucccgccagcccccccucgucaccggcaucucccccaacgagggcauccccuggaccaaggucaccauccgcggcgagaaccucggcaccggccccaccgaccucaucggccucaccaucugcggccacaacugccuccucaccgccgaguggauguccgccuccaagaucgucugccgcgucggccaggccaagaacgacaagggcgacaucaucgucaccaccaaguccggcggccgcggcaccuccaccgucuccuucaagcuccucaagcccgagaagaucggcauccucgaccaguccgccgucugggucgacgagaugaacuacuacgacaugcgcaccgaccgcaacaagggcauccccccccucucccuccgccccgccaacccccucggcaucgagaucgagaaguccaaguucucccagaaggaccucgagaugcucuuccacggcauguccgccgacuucaccuccgagaacuucuccgccgccugguaccucaucgagaaccacuccaacaccuccuucgagcagcucaagauggccgucaccaaccucaagcgccaggccaacaagaaguccgagggcucccucgccuacgucaagggcggccucuccaccuucuucgaggcccaggacgcccucuccgccauccaccagaagcucgaggccgacggcaccgagaaggucgagggcuccaugacccagaagcucgagaacguccucaaccgcgccuccaacaccgccgacacccucuuccaggagguccucggccgcaaggacaaggccgacuccacccgcaacgcccucaacguccuccagcgcuucaaguuccucuucaaccucccccucaacaucgagcgcaacauccagaagggcgacuacgacgucgucaucaacgacuacgagaaggccaagucccucuucggcaagaccgagguccaggucuucaagaaguacuacgccgaggucgagacccgcaucgaggcccuccgcgagcuccuccucgacaagcuccucgagacccccuccacccuccacgaccagaagcgcuacauccgcuaccucuccgaccuccacgccuccggcgaccccgccuggcagugcaucggcgcccagcacaaguggauccuccagcucaugcacuccugcaaggagggcuacgucaaggaccucaagggcaaccccggccuccacucccccaugcucgaccucgacaacgacacccgccccuccguccucggccaccucucccagaccgccucccucaagcgcggcuccuccuuccaguccggccgcgacgacaccuggcgcuacaagaccccccaccgcgucgccuucgucgagaagcucaccaagcucguccucucccagcuccccaacuucuggaagcucuggaucuccuacgucaacggcucccucuucuccgagaccgccgagaaguccggccagaucgagcgcuccaagaacguccgccagcgccagaacgacuucaagaagaugauccaggaggucaugcacucccucgucaagcucacccgcggcgcccuccucccccucuccauccgcgacggcgaggccaagcaguacggcggcugggaggucaagugcgagcucuccggccaguggcucgcccacgccauccagaccguccgccucacccacgagucccucaccgcccucgagauccccaacgaccuccuccagaccauccaggaccucauccucgaccuccgcguccgcugcgucauggccacccuccagcacaccgccgaggagaucaagcgccucgccgagaaggaggacuggaucgucgacaacgagggccucaccucccuccccugccaguucgagcagugcaucgucugcucccuccagucccucaagggcguccucgagugcaagcccggcgaggccuccgucuuccagcagcccaagacccaggaggaggucugccagcucuccaucaacaucaugcaggucuucaucuacugccucgagcagcucuccaccaagcccgacgccgacaucgacaccacccaccucuccgucgacgucuccucccccgaccucuucggcuccauccacgaggacuucucccucaccuccgagcagcgccuccucaucguccucuccaacugcugcuaccucgagcgccacaccuuccucaacaucgccgagcacuucgagaagcacaacuuccagggcaucgagaagaucacccaggucuccauggccucccucaaggagcucgaccagcgccucuucgagaacuacaucgagcucaaggccgaccccaucgucggcucccucgagcccggcaucuacgccggcuacuucgacuggaaggacugccucccccccaccggcguccgcaacuaccucaaggaggcccucgucaacaucaucgccguccacgccgaggucuucaccaucuccaaggagcucgucccccgcguccucuccaaggucaucgaggccgucuccgaggagcucucccgccucaugcagugcgucuccuccuucuccaagaacggcgcccuccaggcccgccucgagaucugcgcccuccgcgacaccgucgccgucuaccucacccccgaguccaaguccuccuucaagcaggcccucgaggcccucccccagcucuccuccggcgccgacaagaagcuccucgaggagcuccucaacaaguucaaguccuccaugcaccuccagcucaccugcuuccaggccgccuccuccaccaugaugaagaccuga

SEQ ID NO: 42889 - RNA, 2241 nt, Artificial Sequence
  derived and/or modified sequence opt2 from EXOC3L1__Homo_sapiens__NP_848611
auggacuccgccgccaaggacgagaugcagcccgcccucucccccggccccgaguggcccgagcaggagcgcgccgagcagcucgcccgcggcgccgcccucaagugggccuccggcaucuucuaccgccccgagcagcucgcccgccucggccaguaccgcucccgcgagguccagcgcaccugcucccucgagucccgccucaaguccgucaugcaguccuaccucgagggcguccagaccggcgucuggcagcucgcccaggccaucgaggucguccagggcacccgcgaggcccucucccaggcccgcggccuccuccagggcaugucccaggcccuccagacccucgagccccuccgcgagcgcgucgcccagcacaagcagcuccaggcccucucccaccuccucccccgccuccgcgccguccccgccgccgucucccacacccagacccucaucgacggccagcaguuccucgaggccuacgucucccuccgcgagcucgagcagcuccgcgaggacaccugggccccccucggcggccucgagcuccccgucuuccagggccucgaccuccucuucgaggcccucggccaggccgucgaggccgccgccggcgccgccggcaagcucgcccgcgaggaccccgcccuccucgucgccgccguccgcgucgccgaggucgagaccggccgcaccaccccccucggccaggucccccgcgacuggcgccagcgcugccuccgcgcccuccaggagggccucgagcaggcccacuucggcuccccccuccuccccgcccccggcgcccuccccggcuggcucgaggcccuccgcgucgcccuccccgucgagcucgccaccgccgaggcccucgucgcccccugcugccccccccaguacaacgucguccagcucugggcccacacccuccacuccggccuccgccgcucccuccagaaccuccucgccggccccgagcucgaggccgccgacgccuucgcccuccuccacugggcccuccacgucuaccucggccaggagaugaugggcucccucgagcucggccccgaggccgacgucucccagcucgagccccuccucacccucgagaacaucgagcagcucgaggccaccuucgucgccaacauccaggccuccgucucccaguggcuccagaacgcccucgacggcgaggucgccgaguggggccgcgagcacggccccaacaccgaccccuccggcuccuacuacucccccaugcccgccaucguccuccagauccucgaggagaacauccgcgucgccucccucgucuccgagucccuccagcagcgcguccacggcauggcccucuccgagcucggcaccuuccuccgcuccuucuccgacgcccucauccgcuucucccgcgaccacuuccgcggcaaguccauggccccccacuacguccccuaccuccucgccgcccucaaccacaaguccgcccucuccuccuccgucuccguccuccagcucgacggcgcccccuccggcgcccucgcccccgucgaggccgcccucgacgagcuccagcgccgcaucuaccgccucguccucgaggcccuccaggccgagcuccagccccucuucgccgaccuccccucccgccaguggcucuccucccccgagcuccuccaguccgucugcgagcgcaccggccgcuucugccgcgacuucuggcgcguccgcaaccccaccguccagcuccuccucgccgaggccgagcgcgccgucguccuccaguaccucuccgcccucaugcagggccgccucgucugccgcggcgccgacgagcgcacccaggccgccgagcgccuccgccacgacgccgcccagcuccagcagcucuuccucucccucggccucgaggagaacgcccacugcgcccccguccuccucgcccuccgcgagcuccucaaccuccgcgaccccgcccuccucggccucgaggucgccggccuccgccagcaguuccccgacgucuccgaggaccacgucuccgcccuccucggccuccgcggcgaccucucccgcgagcagcaccucgccgcccucuccucccuccaggccgcccucccccccuccccccgcgccucccgccgcguccucuucucccucguccccgcccccgcccucgcccccgccuccugccuccccuccggcuccugcgcccgcgcccuccuccucgccgaguga

SEQ ID NO: 42890 - RNA, 1230 nt, Artificial Sequence
  derived and/or modified sequence opt2 from EXOC3L2__Homo_sapiens__NP_612635
auggccgcccucgagaacggcgagcucggcccccuccucucccccggcacccuccgcggccucgaggacgagugcgucaccgacgucaaggcccagacccgcgccgcccuccuccgcguccuccaggaggacgaggagcacuggggcucccucgaggaccagcccuccucccucgcccaggacgucugcgagcuccucgaggagcacaccgagcgcgccccccgcaucucccaggaguucggcgagcgcauggcccacugcugccucggcggccucgccgaguuccuccaguccuuccagcagcgcgucgagcgcuuccacgagaaccccgccguccgcgagaugcuccccgacaccuacaucuccaagaccaucgcccucgucaacugcggccccccccuccgcgcccucgccgagcgccucgcccgcgucggcccccccgaguccgagcccgcccgcgaggccuccgccuccgcccucgaccacgucacccgccucugccaccgcgucgucgccaaccuccucuuccaggagcuccagccccacuucaacaagcucaugcgccgcaaguggcucuccucccccgaggcccucgacggcaucgucggcacccucggcgcccaggcccucgcccuccgccgcaugcaggacgagcccuaccaggcccucgucgccgagcuccaccgccgcgcccucgucgaguacguccgcccccuccuccgcggccgccuccgcugcuccuccgcccgcacccgcucccgcgucgccggccgccuccgcgaggacgccgcccagcuccagcgccucuuccgccgccucgagucccaggccuccuggcucgacgccgucgucccccaccucgccgaggucaugcagcucgaggacacccccuccauccaggucgaggucggcguccucguccgcgacuaccccgacauccgccagaagcacgucgccgcccuccucgacauccgcggccuccgcaacaccgccgcccgccaggagauccucgccgucgcccgcgaccucgagcucuccgaggagggcgcccucucccccccccgcgaccgcgccuucuucgccgacauccccgucccccgccccuccuucugccucucccucccccucuuccucggccgccucccccucucccgccucgcccgccccucccucgccugccucccccgcccccgcccccccucccucgcccgcccccgcgcccagcgcuga

SEQ ID NO: 42891 - RNA, 1422 nt, Artificial Sequence
  derived and/or modified sequence opt2 from EXOC4__Homo_sapiens__NP_001032203
auggccgccgaggccgccggcggcaaguaccgcuccaccgucuccaaguccaaggaccccuccggccuccucaucuccgucauccgcacccucuccaccuccgacgacgucgaggaccgcgagaacgagaagggccgccucgaggaggccuacgagaagugcgaccgcgaccucgacgagcucaucguccagcacuacaccgagcucaccaccgccauccgcaccuaccaguccaucaccgagcgcaucaccaacucccgcaacaagaucaagcaggucaaggagaaccuccucuccugcaagaugcuccuccacugcaagcgcgacgagcuccgcaagcucuggaucgagggcaucgagcacaagcacguccucaaccuccucgacgagaucgagaacaucaagcaggucccccagaagcucgagcagugcauggccuccaagcacuaccucuccgccaccgacaugcucgucuccgccgucgagucccucgagggcccccuccuccaggucgagggccucuccgaccuccgccucgagcuccacuccaagaagaugaaccuccaccucguccucaucgacgagcuccaccgccaccucuacaucaaguccaccucccgcgucguccagcgcaacaaggagaagggcaagaucuccucccucgucaaggacgccuccgucccccucaucgacgucaccaaccuccccaccccccgcaaguuccucgacaccucccacuacuccaccgccggcuccuccuccguccgcgagaucaaccuccaggacaucaaggaggaccucgagcucgaccccgaggagaacuccacccucuucaugggcauccucaucaagggccucgccaagcucaagaagauccccgagaccgucaaggccaucaucgagcgccucgagcaggagcucaagcagaucgucaagcgcuccaccacccaggucgccgacuccggcuaccagcgcggcgagaacgucaccgucgagaaccagccccgccuccuccucgagcuccucgagcuccucuucgacaaguucaacgccgucgccgccgcccacuccgucguccucggcuaccuccaggacaccgucgucaccccccucacccagcaggaggacaucaagcucuacgacauggccgacgucugggucaagauccaggacguccuccagaugcuccucaccgaguaccucgacaugaagaacacccgcaccgccuccgagcccuccgcccagcucuccuacgccuccaccggccgcgaguucgccgccuucuucgccaagaagaagccccagcgccccaagaacucccucuucaaguucgaguccuccucccacgccaucuccauguccgccuaccuccgcgagcagcgccgcgagcucuacucccgcuccggcgagcuccagggcuga

SEQ ID NO: 42892 - RNA, 2127 nt, Artificial Sequence
  derived and/or modified sequence opt2 from EXOC5__Homo_sapiens__NP_006535
auggccaccaccgccgagcucuucgaggagcccuucgucgccgacgaguacaucgagcgccucgucuggcgcacccccggcggcggcucccgcggcggccccgaggccuucgaccccaagcgccuccucgaggaguucgucaaccacauccaggagcuccagaucauggacgagcgcauccagcgcaaggucgagaagcucgagcagcagugccagaaggaggccaaggaguucgccaagaagguccaggagcuccagaaguccaaccaggucgccuuccagcacuuccaggagcucgacgagcacaucuccuacgucgccaccaaggucugccaccucggcgaccagcucgagggcgucaacaccccccgccagcgcgccgucgaggcccagaagcucaugaaguacuucaacgaguuccucgacggcgagcucaaguccgacgucuucaccaacuccgagaagaucaaggaggccgccgacaucauccagaagcuccaccucaucgcccaggagcuccccuucgaccgcuucuccgaggucaaguccaagaucgccuccaaguaccacgaccucgagugccagcucauccaggaguucaccuccgcccagcgccgcggcgagaucucccgcaugcgcgaggucgccgccguccuccuccacuucaagggcuacucccacugcgucgacgucuacaucaagcagugccaggagggcgccuaccuccgcaacgacaucuucgaggacgccggcauccucugccagcgcgucaacaagcaggucggcgacaucuucuccaaccccgagaccguccucgccaagcucauccagaacgucuucgagaucaagcuccaguccuucgucaaggagcagcucgaggagugccgcaaguccgacgccgagcaguaccucaagaaccucuacgaccucuacacccgcaccaccaaccucuccuccaagcucauggaguucaaccucggcaccgacaagcagaccuuccucuccaagcucaucaaguccaucuucaucuccuaccucgagaacuacaucgaggucgagaccggcuaccucaagucccgcuccgccaugauccuccagcgcuacuacgacuccaagaaccaccagaagcgcuccaucggcaccggcggcauccaggaccucaaggagcgcauccgccagcgcaccaaccucccccucggccccuccaucgacacccacggcgagaccuuccucucccaggaggucgucgucaaccuccuccaggagaccaagcaggccuucgagcgcugccaccgccucuccgaccccuccgaccucccccgcaacgccuuccgcaucuucaccauccucgucgaguuccucugcaucgagcacaucgacuacgcccucgagaccggccucgccggcauccccuccuccgacucccgcaacgccaaccucuacuuccucgacgucguccagcaggccaacaccaucuuccaccucuucgacaagcaguucaacgaccaccucaugccccucaucuccuccucccccaagcucuccgagugccuccagaagaagaaggagaucaucgagcagauggagaugaagcucgacaccggcaucgaccgcacccucaacugcaugaucggccagaugaagcacauccucgccgccgagcagaagaagaccgacuucaagcccgaggacgagaacaacguccucauccaguacaccaacgccugcgucaaggucugcgccuacguccgcaagcaggucgagaagaucaagaacuccauggacggcaagaacgucgacaccguccucauggagcucggcguccgcuuccaccgccucaucuacgagcaccuccagcaguacuccuacuccugcaugggcggcaugcucgccaucugcgacgucgccgaguaccgcaagugcgccaaggacuucaagauccccaugguccuccaccucuucgacacccuccacgcccucugcaaccuccucgucgucgcccccgacaaccucaagcaggucugcuccggcgagcagcucgccaaccucgacaagaacauccuccacuccuucguccagcuccgcgccgacuaccgcuccgcccgccucgcccgccacuucuccuga

SEQ ID NO: 42893 - RNA, 2055 nt, Artificial Sequence
  derived and/or modified sequence opt2 from EXOC7__Homo_sapiens__NP_001013861
augauccccccccaggaggccuccgcccgccgccgcgagaucgaggacaagcucaagcaggaggaggagacccucuccuucauccgcgacucccucgagaaguccgaccagcucaccaagaacauggucuccauccucuccuccuucgagucccgccucaugaagcucgagaacuccaucauccccguccacaagcagaccgagaaccuccagcgccuccaggagaacgucgagaagacccucuccugccucgaccacgucaucuccuacuaccacgucgccuccgacaccgagaagaucauccgcgagggccccaccggccgccucgaggaguaccucggcuccauggccaagauccagaaggccgucgaguacuuccaggacaacucccccgacucccccgagcucaacaaggucaagcuccucuucgagcgcggcaaggaggcccucgaguccgaguuccgcucccucaugacccgccacuccaaggucgucucccccguccucauccucgaccucaucuccggcgacgacgaccucgaggcccaggaggacgucacccucgagcaccuccccgaguccguccuccaggacgucauccgcaucucccgcuggcucgucgaguacggccgcaaccaggacuucaugaacgucuacuaccagauccgcuccucccagcucgaccgcuccaucaagggccucaaggagcacuuccacaaguccuccuccuccuccggcguccccuacucccccgccauccccaacaagcgcaaggacacccccaccaagaagcccgucaagcgccccggcaccauccgcaaggcccagaaccuccucaagcaguacucccagcacggccucgacggcaagaagggcggcuccaaccucaucccccucgagggccgcgacgacaugcucgacgucgagaccgacgccuacauccacugcgucuccgccuucgucaagcucgcccaguccgaguaccagcuccucgccgacaucauccccgagcaccaccagaagaagaccuucgacucccucauccaggacgcccucgacggccucaugcucgagggcgagaacaucgucuccgccgcccgcaaggccaucguccgccacgacuucuccaccguccucaccgucuuccccauccuccgccaccucaagcagaccaagcccgaguucgaccagguccuccagggcaccgccgccuccaccaagaacaagcuccccggccucaucaccuccauggagaccaucggcgccaaggcccucgaggacuucgccgacaacaucaagaacgaccccgacaaggaguacaacaugcccaaggacggcaccguccacgagcucaccuccaacgccauccucuuccuccagcagcuccucgacuuccaggagaccgccggcgccaugcucgccucccaggagaccuccuccuccgccaccuccuacuccuccgaguucuccaagcgccuccucuccaccuacaucugcaagguccucggcaaccuccagcucaaccuccucuccaaguccaaggucuacgaggaccccgcccucuccgccaucuuccuccacaacaacuacaacuacauccucaagucccucgagaaguccgagcucauccagcucgucgccgucacccagaagaccgccgagcgcuccuaccgcgagcacaucgagcagcagauccagaccuaccagcgcuccuggcucaaggucaccgacuacaucgccgagaagaaccuccccgucuuccagcccggcgucaagcuccgcgacaaggagcgccagaucaucaaggagcgcuucaagggcuucaacgacggccucgaggagcucugcaagauccagaaggccugggccauccccgacaccgagcagcgcgaccgcauccgccaggcccagaagaccaucgucaaggagaccuacggcgccuuccuccagaaguucggcuccguccccuucaccaagaaccccgagaaguacaucaaguacggcgucgagcaggucggcgacaugaucgaccgccucuucgacaccuccgccuga

SEQ ID NO: 42894 - RNA, 957 nt, Artificial Sequence
  derived and/or modified sequence opt2 from EXOG__Homo_sapiens__NP_001138936
auggccaucaaguccaucgccucccgccuccgcggcucccgccgcuuccucuccggcuucgucgccggcgccgucgucggcgccgccggcgccggccucgccgcccuccaguucuuccgcucccagggcgccgagggcgcccucaccggcaagcagcccgacggcgacgccgaccgcaagcacugcaaguucaagcccgaccccaacaucccccccaccuucuccgccuucaacgaggacuacgucggcuccggcuggucccgcggccacauggcccccgccggcaacaacaaguucuccuccaaggccauggccgagaccuucuaccucuccaacaucgucccccaggacuucgacaacaacuccggcuacuggaaccgcaucgagauguacugccgcgagcucaccgagcgcuucgaggacgucugggucgucuccggcccccucacccucccccagacccgcggcgacggcaagaagaucgucuccuaccaggucaucggcgaggacaacgucgccguccccucccaccucuacaaggucauccucgcccgccgcuccuccgucuccaccgagccccucgcccucggcgccuucgucguccccaacgaggccaucggcuuccagccccagcucaccgaguuccaggucucccuccaggaccucgagaagcucuccggccucgucuucuucccccaccucgaccgcaccuccgacauccgcaacaucugcuccgucgacaccugcaagcuccucgacuuccaggaguucacccucuaccucuccacccgcaagaucgagggcgcccgcuccguccuccgccucgagaagaucauggagaaccucaagaacgccgagaucgagcccgacgacuacuucaugucccgcuacgagaagaagcucgaggagcucaaggccaaggagcaguccggcacccagauccgcaagcccuccuga

SEQ ID NO: 42895 - RNA, 588 nt, Artificial Sequence
  derived and/or modified sequence opt2 from EXOSC1__Homo_sapiens__NP_057130
auggccccccccguccgcuacugcauccccggcgagcgccucugcaaccucgaggagggcucccccggcuccggcaccuacacccgccacggcuacaucuucuccucccucgccggcugccucaugaaguccuccgagaacggcgcccuccccgucgucuccgucguccgcgagaccgagucccagcuccuccccgacgucggcgccaucgucaccugcaaggucuccuccaucaacucccgcuucgccaagguccacauccucuacgucggcuccaugccccucaagaacuccuuccgcggcaccauccgcaaggaggacguccgcgccaccgagaaggacaaggucgagaucuacaaguccuuccgccccggcgacaucguccucgccaaggucaucucccucggcgacgcccaguccaacuaccuccucaccaccgccgagaacgagcucggcgucgucgucgcccacuccgaguccggcauccagaugguccccaucuccuggugcgagaugcagugccccaagacccacaccaaggaguuccgcaaggucgcccgcguccagcccgaguuccuccagaccuga

SEQ ID NO: 42896 - RNA, 804 nt, Artificial Sequence
  derived and/or modified sequence opt2 from EXOSC2__Homo_sapiens__NP_001269637
auggccauggagaugcgccuccccgucgcccgcaagccccucuccgagcgccucggccgcgacaccaagaagcaccucgucguccccggcgacaccaucaccaccgacaccggcuucaugcgcggccacggcaccuacaugggcgaggagaagcucaucgccuccgucgccggcuccgucgagcgcgucaacaagcucaucugcgucaaggcccucaagacccgcuacaucggcgaggucggcgacaucgucgucggccgcaucaccgagguccagcagaagcgcuggaaggucgagaccaacucccgccucgacuccguccuccuccucuccuccaugaaccuccccggcggcgagcuccgccgccgcuccgccgaggacgagcucgccaugcgcggcuuccuccaggagggcgaccucaucuccggcguccucguccaggucucccccucccucgucaagcgccagaagacccacuuccacgaccuccccugcggcgccuccgucauccucggcaacaacggcuucaucuggaucuaccccacccccgagcacaaggaggaggaggccggcggcuucaucgccaaccucgagcccgucucccucgccgaccgcgaggucaucucccgccuccgcaacugcaucaucucccucgucacccagcgcaugaugcucuacgacaccuccauccucuacugcuacgaggccucccucccccaccagaucaaggacauccucaagcccgagaucauggaggagaucgucauggagacccgccagcgccuccucgagcaggagggcuga

SEQ ID NO: 42897 - RNA, 495 nt, Artificial Sequence
  derived and/or modified sequence opt2 from EXOSC3__Homo_sapiens__NP_001002269
auggccgagcccgccuccgucgccgccgagucccucgccggcucccgcgcccgcgccgcccgcaccguccucggccaggucguccuccccggcgaggagcuccuccuccccgagcaggaggacgccgagggccccggcggcgccgucgagcgcccccucucccucaacgcccgcgccugcucccgcguccgcgucgucugcggccccggccuccgccgcugcggcgaccgccuccucgucaccaagugcggccgccuccgccacaaggagcccggcuccggcuccggcggcggcgucuacugggucgacucccagcagaagcgcuacguccccgucaagggcgaccacgucaucggcaucgucaccgccaaguccggcgacaucuucaaggucgacgucggcggcuccgagcccgccucccucuccuaccucuccuucgagggcgccaccaagcgcaaccgccccaacguccaggccaucuccucccgccucuga

SEQ ID NO: 42898 - RNA, 738 nt, Artificial Sequence
  derived and/or modified sequence opt2 from EXOSC4__Homo_sapiens__NP_061910
auggccggccucgagcuccucuccgaccagggcuaccgcgucgacggccgccgcgccggcgagcuccgcaagauccaggcccgcaugggcgucuucgcccaggccgacggcuccgccuacaucgagcagggcaacaccaaggcccucgccgucgucuacggcccccacgagauccgcggcucccgcgcccgcgcccuccccgaccgcgcccucgucaacugccaguacuccuccgccaccuucuccaccggcgagcgcaagcgccgcccccacggcgaccgcaaguccugcgagaugggccuccagcuccgccagaccuucgaggccgccauccucacccagcuccacccccgcucccagaucgacaucuacguccagguccuccaggccgacggcggcaccuacgccgccugcgucaacgccgccacccucgccguccucgacgccggcauccccaugcgcgacuucgucugcgccugcuccgccggcuucgucgacggcaccgcccucgccgaccucucccacgucgaggaggccgccggcggcccccagcucgcccucgcccuccuccccgccuccggccagaucgcccuccucgagauggacgcccgccuccacgaggaccaccucgagcgcguccucgaggccgccgcccaggccgcccgcgacguccacacccuccucgaccgcgucguccgccagcacguccgcgaggccuccauccuccucggcgacuga

SEQ ID NO: 42899 - RNA, 708 nt, Artificial Sequence
  derived and/or modified sequence opt2 from EXOSC5__Homo_sapiens__NP_064543
auggaggaggagacccacaccgacgccaagauccgcgccgagaacggcaccggcuccuccccccgcggccccggcugcucccuccgccacuucgccugcgagcagaaccuccucucccgccccgacggcuccgccuccuuccuccagggcgacaccuccguccucgccggcgucuacggccccgccgaggucaaggucuccaaggagaucuucaacaaggccacccucgaggucauccuccgccccaagaucggccuccccggcgucgccgagaagucccgcgagcgccucauccgcaacaccugcgaggccgucguccucggcacccuccacccccgcaccuccaucaccgucguccuccaggucgucuccgacgccggcucccuccucgccugcugccucaacgccgccugcauggcccucgucgacgccggcguccccaugcgcgcccucuucugcggcgucgccugcgcccucgacuccgacggcacccucguccucgaccccaccuccaagcaggagaaggaggcccgcgccguccucaccuucgcccucgacuccgucgagcgcaagcuccucauguccuccaccaagggccucuacuccgacaccgagcuccagcagugccucgccgccgcccaggccgccucccagcacgucuuccgcuucuaccgcgagucccuccagcgccgcuacuccaaguccuga

SEQ ID NO: 42900 - RNA, 819 nt, Artificial Sequence
  derived and/or modified sequence opt2 from EXOSC6__Homo_sapiens__NP_478126
augcccggcgaccaccgccgcauccgcggccccgaggagucccagcccccccagcucuacgccgccgacgaggaggaggcccccggcacccgcgaccccacccgccuccgccccgucuacgcccgcgccggccuccucucccaggccaagggcuccgccuaccucgaggccggcggcaccaagguccucugcgccgucuccggcccccgccaggccgagggcggcgagcgcggcggcggccccgccggcgccggcggcgaggcccccgccgcccuccgcggccgccuccucugcgacuuccgccgcgcccccuucgccggccgccgccgccgcgccccccccggcggcugcgaggagcgcgagcucgcccucgcccuccaggaggcccucgagcccgccguccgccucggccgcuacccccgcgcccagcucgaggucuccgcccuccuccucgaggacggcggcuccgcccucgccgccgcccucaccgccgccgcccucgcccucgccgacgccggcgucgagauguacgaccucgucgucggcugcggccucucccucgcccccggccccgcccccaccuggcuccucgaccccacccgccucgaggaggagcgcgccgccgccggccucaccgucgcccucaugcccguccucaaccaggucgccggccuccucggcuccggcgagggcggccucaccgaguccugggccgaggccguccgccucggccucgagggcugccagcgccucuaccccguccuccagcagucccucguccgcgccgcccgccgccgcggcgccgccgcccagcccuga

SEQ ID NO: 42901 - RNA, 876 nt, Artificial Sequence
  derived and/or modified sequence opt2 from EXOSC7__Homo_sapiens__NP_055819
auggccuccgucacccucuccgaggccgagaaggucuacaucguccacggcguccaggaggaccuccgcgucgacggccgcggcugcgaggacuaccgcugcgucgaggucgagaccgacgucgucuccaacaccuccggcuccgcccgcgucaagcucggccacaccgacauccucgucggcgucaaggccgagaugggcacccccaagcucgagaagcccaacgagggcuaccucgaguucuucgucgacugcuccgccuccgccacccccgaguucgagggccgcggcggcgacgaccucggcaccgagaucgccaacacccucuaccgcaucuucaacaacaaguccuccgucgaccucaagacccucugcaucuccccccgcgagcacugcuggguccucuacgucgacguccuccuccucgagugcggcggcaaccucuucgacgccaucuccaucgccgucaaggccgcccucuucaacacccgcaucccccgcguccgcguccucgaggacgaggagggcuccaaggacaucgagcucuccgacgaccccuacgacugcauccgccucuccgucgagaacguccccugcaucgucacccucugcaagaucggcuaccgccacgucgucgacgccacccuccaggaggaggccugcucccucgccucccuccucgucuccgucaccuccaagggcgucgucaccugcaugcgcaaggucggcaagggcucccucgaccccgaguccaucuucgagaugauggagaccggcaagcgcgucggcaagguccuccacgccucccuccaguccgucguccacaaggaggagucccucggccccaagcgccagaaggucggcuuccucggcuga

SEQ ID NO: 42902 - RNA, 831 nt, Artificial Sequence
  derived and/or modified sequence opt2 from EXOSC8__Homo_sapiens__NP_852480
auggccgccggcuucaagaccgucgagccccucgaguacuaccgccgcuuccucaaggagaacugccgccccgacggccgcgagcucggcgaguuccgcaccaccaccgucaacaucggcuccaucuccaccgccgacggcuccgcccucgucaagcucggcaacaccaccgucaucugcggcgucaaggccgaguucgccgcccccuccaccgacgcccccgacaagggcuacgucguccccaacgucgaccuccccccccucugcuccucccgcuuccgcuccggcccccccggcgaggaggcccaggucgccucccaguucaucgccgacgucaucgagaacucccagaucauccagaaggaggaccucugcaucucccccggcaagcucgucuggguccucuacugcgaccucaucugccucgacuacgacggcaacauccucgacgccugcaccuucgcccuccucgccgcccucaagaacguccagcuccccgaggucaccaucaacgaggagaccgcccucgccgaggucaaccucaagaagaaguccuaccucaacauccgcacccaccccgucgccaccuccuucgccgucuucgacgacacccuccucaucgucgaccccaccggcgaggaggagcaccucgccaccggcacccucaccaucgucauggacgaggagggcaagcucugcugccuccacaagcccggcggcuccggccucaccggcgccaagcuccaggacugcaugucccgcgccgucacccgccacaaggaggucaagaagcucauggacgaggucaucaaguccaugaagcccaaguga

SEQ ID NO: 42903 - RNA, 5970 nt, Artificial Sequence
  derived and/or modified sequence opt2 from EXPH5__Homo_sapiens__NP_055880
augaccaaggucccccccgccuucgacuucuccuuccucaacgacgaggaggcccgcaagauccuccagguccucgagcgcaacgaggagcuccagcgcgccgagaaggaccgcaucuccaagcuccagaagaccaagcgcgacauccgcuggcuccagggcgucaccggcgagugguucgaggagauccagcgcaagaaguucugcaacgagaccgacgucucccagaugcucaagcagccccucaccuaccgccucuccaaggagauggccaagaacgaccccaucgagcuccccaccucccgcuccaagaacgucaccaaccagaagaagcccacccccuucuccucccgcauguccuuccgcuccuccuucgccucccucuucuccuuccgcaaguccggcaaggagaccuccaagcuccccucccucggccagaagggcugcgacggccacgccggcccccccaugcccguccgcggcgccgccguccaggccaagaucuacaacuccccccucgagaaccaccucgucgacuccaccuucguccccaagcccgccgucaugcgcgaggaguccggcaugcccccccccugggacgccucccuccucgagaacgaguucuuccagguccucgacgaccucgacuccaagcucgcccaggagcaguccgccuccuccgucaacacccgcaccccccucaacuacggcucccgcacccaguucggccacuucuacuccuccggcaaccgccacggcaacaucaccgagcgccacaagaagcacuacaacgagaccuccaacauguccaucuacgacauccuccgccccggcaccccccgcgagggcuucaagaccuucuccccccgcaccuccaccaucuacgacauguaccgcacccgcgagccccgcgucuucaaggaggacuacguccagaagaacaccuucggcuccaccucccucugcuucgacucccgccagcgcuccgcccuccccgccaccggccacuucaccgcccgcucccuccacuuccccgccaccacccaguccaaguccggcuucauccccccccgccaccagcagucccccaagcgcaccccccucuccuccaucaucuggaaccgcuccgacuccucccgcgaccgcgagaaccaggaggaguuccuccgcgcccccucccccauggagaucgaccccgccgacaaguacgucuacccccgcggcuuccaggagaacaagcgcuacgaguccuaccacucccagaacgucuaccagcgcgucucccucaacgcccccauggagaacgccaugucccccgacaccuucgagaacuccgagaacaugcccuucuaccaccaguccaacaccuucacccgcuccuucuucuccaacaccuucggccgcuccggcgagcagcgccgcuucggccagggccccuucuggggccaggagaagggccacuccuucugguccgacuuccaccgcucccgcaaguccuucuccuccuccgaccgcgacuucgagaugaucuccauggaggccaacuccgucuccgccauccacggccacaacgucuccuccgagcacugggaguccuucuccuccggcuacggcaccgacgucucccgcggccaggaggagccccaccccuggcaguucgacuuccagcgcuccacccucgacuccauggucgucucccacggcaacgagacccagcucaccccccacuucggcacccccaacgucugcuccaugaccggcuccuccuaccacgucaaguccuccgagcucgucucccagcaggacuccucccccgucgagguccacaucaacaaggaggccuccuccuucggcaucgcccagacccucgccuccuccuucaagaccuccuucucccagaucuccgacgaccgccgcaacccccagucccccaaccuccagaaccccaccgucacccuccagaagaucuuccccaacaagcccgccucccaccccaugcgcucccacaccgaggucaccgucaccuccuccaacuccgucgacucccucccccucgccaagucccagcccaacauccucgucaccgaggucaacaacgagaaggaccucaacgaguccaucuccgaggaggacaagcagcucuccaagauggaccagaccaacaaggccggcgagaucccccagcccgucucccagaccggcaucuccaacucccuccccgacuuccagaacccccucucccaggacuccgccaaguccaacggcuucggcuucaacgccuccaccaucaucuccuccaagaaguccccccgcgucuucucccgcaaggacaccuccaagauguacaucccccacaccgacaaguccaacgacaucaagcaggacaagcgcuucaccgagaaccgcaagcucggcuccaccgccucccuccccuucauccaggagcaccgcaccccccccuccuucccccgcaccgaccagggcugccaccaggagcucaccgucaacaacgaggacaucucccgcaucaucaccaacaaccacugguccuccgcccucaccgacacccagaacgcccaguacuccaagugcaagcucacccccggccacaagaccuccugcgacucccucgaccucuccuccgccgcccuccccgacuccucccccuccaagaacuccucccucgacgcccccgucguccccuccaccaccgucuucucccgccgcucccccuccgacaaggaccccucccucggcgagcgcgaggagaaggacaacgccggcaagaaccagaagaaccaguucaucgucucccacuccgagaaccaggagcgcaacgacucccccguccccacccacgacgaggucgucgacgucaagugccacucccacucccccuuccgcaacgagcgcggcaagggcaagauccgccaccacaucuccugcaucgagaagcucuccaagaccgaguccaucuccguccccaccuccgaccaccgcucccucaucgaggccaaccaguccaacuccaaggucuccgagcucgacaccaucuacugcacccucccccgcaaguccuccuccuuccucauccacggccgccaguccggcuccaagaucauggccgccucccuccgcaacggccccccccccuuccagaucaagaacaacgucgaggacgccaugggcaacuacaugcucaacaaguucucccccuccucccccgaguccgccaacgagugcuccaagguccucuccgacuccgcccucgaggcccccgaggccaccgagcgcaugaccaacgucaaguccuccggcuccaccuccguccgcaagggcccccuccccuuccucaucaaccgcgccauguccugccccuccggcgagccccacgccuccaccggccgcgagggccgcaagaagccccucaccuccggcauggacgccuccgagcucaccccccgcgccugggagcgcaucaucucccccgucgaguccgacuccuccguccgcgacugcucccucaccaagcgccagcaccagaaggagaacuuccaggaguacaccgagaaggagggcaagauggccgccucccgccgcuccgucuucgcccucuccaacgaggacccccuccccuucugcuccgaccucuccggcaaggagcgcggcaagacccuccacaaggucaagaccaccuccaccuucuccgucuccggcgacgaggacaacgucaagugccucgaggucgucuccaucuacuacacccucccccgcaagcccuccaagaaguucugcaaccuccuccagcaguacacccagaacaccaaccuccucaucgaguccccccaggucgagaccgagaccuuccccaacgcccucgagaaggacaagcagaacuacuccacccgcgagcaguccggcacccccuccugcgagaaccucaagauguccgucaacuccgaccagacccucaccaccgagaacaugaccgccuuccgccucuccaaccgcggcccccucgcccccacccuccaggagauggccuccgucgaggccgccgucucccuccccgaggaggaguccaaggcccgcgagaucuucuccgacaaccucgccaagaccccccucggcgacuccgagaacaagaaggagcgcggcaagaagcuccaguccgagacccuccacaccucccucaugcuccagcgcaagaacgucuccgaggagaaguccgagaacugccagcaguccaucaacuccuccaacuccggccccuccucccuccccgcccucuccgaggucaacaucggcaacucccagacccgccgcuccuccugggagugcaccggcuccggccgcgccauccccuucaccggcuccggcaagugcccccagaaggaccacaccuccaccgccgucggcgacggcuccuccggcucccagccccgcgagggccgcggcgacaucggcaccaacugccagaagaugaccaacaagacccucucccacuccgagucccaggucuucgcccucacccccgcccuccacaagcuccagcucggcgaggagacccaguccgacgagcccaaccucgagucccuccaguccgagccccgcgagcucccccagcgcucccaggaggccaacaugaccgagucccgcaaggccgaggacgagaugcagaaguccgccugggaccagcccucccuccccgagggcaacaagaacaagaccaaccucgacgaccucgucaagggcgagaaccgcuccuccgucaagcaccgccucgccgccauguccaaggccucccgcaaguuccccgccaaggacgucuccccccgccgccacgucgccaccaucuucccccaguccggcucccgcuccggcuucgaccaccucucccucggcaccgucgagugcaacccccucuuccccgagcccacccccaaguccgccgaguccaucggcgagucccgccucuccgagaacggcaagcacgucaagaaguccgagaaccuccuccccaucaccguccuccccaaccgcgagcccuccacccacgucuccaaccagaaguccaacuccaucucccagcgccaccagaacgaguucaagaacgucuccgagucccccuccaagcacgagaacuccaaggacgucaccgccgcccagaaccucguccgcgaguccggcgcccccucccccaucaccuucaccucccuccgcgaggccgaguucuccgacaaccagcgccgccucuccccccccuucccccucgagcccgcccagaagucccgcgucuccuccccccucgccuccuuccuccagcagcagcgcuccgccuccucccucgagugggagcccgagccccaccucuaccgcuccaagucccucaaguccaucaacguccacggcgaccuccuccgcaagucccacccccccaagguccgcgagcgccacuucuccgaguccaccuccaucgacaacgcccucucccgccucacccucggcaacgaguucuccgucaacaacggcuacucccgccgcuuccgcuccuucuccgagcuccccuccugcgacggcaacgaguccugggccuaccgcuccggcaccaagaccggcccccgcuccgccaucuccaucuaccgccccaucgacuacggcaucuucggcaaggagcagcagcucgccuuccucgagaacgucaagcgcucccucacccagggccgccucuggaagcccuccuuccucaagaaccccggcuuccucaaggacgaccuccgcaacccccccaaccccuccgagucccucuccuccaacucccccuccucccagguccccgaggacggccucucccccuccgagccccucaacaucuacgaggacgaccccgucgacuccgacugcgacaccgacaccaccaccgacgacgaguacuaccucgacgagaacgacaaggaguccgagcucuga

SEQ ID NO: 42904 - RNA, 2241 nt, Artificial Sequence
  derived and/or modified sequence opt2 from EXT1__Homo_sapiens__NP_000118
augcaggccaagaagcgcuacuucauccuccucuccgccggcuccugccucgcccuccucuucuacuucggcggccuccaguuccgcgccucccgcucccacucccgccgcgaggagcacuccggccgcaacggccuccaccaccccucccccgaccacuucuggccccgcuuccccgacgcccuccgccccuucguccccugggaccagcucgagaacgaggacuccuccguccacaucuccccccgccagaagcgcgacgccaacuccuccaucuacaagggcaagaagugccgcauggaguccugcuucgacuucacccucugcaagaagaacggcuucaaggucuacgucuacccccagcagaagggcgagaagaucgccgaguccuaccagaacauccucgccgccaucgagggcucccgcuucuacaccuccgaccccucccaggccugccucuucguccucucccucgacacccucgaccgcgaccagcucuccccccaguacguccacaaccuccgcuccaagguccagucccuccaccucuggaacaacggccgcaaccaccucaucuucaaccucuacuccggcaccuggcccgacuacaccgaggacgucggcuucgacaucggccaggccaugcucgccaaggccuccaucuccaccgagaacuuccgccccaacuucgacgucuccaucccccucuucuccaaggaccacccccgcaccggcggcgagcgcggcuuccucaaguucaacaccauccccccccuccgcaaguacaugcucgucuucaagggcaagcgcuaccucaccggcaucggcuccgacacccgcaacgcccucuaccacguccacaacggcgaggacgucguccuccucaccaccugcaagcacggcaaggacuggcagaagcacaaggacucccgcugcgaccgcgacaacaccgaguacgagaaguacgacuaccgcgagaugcuccacaacgccaccuucugccucgucccccgcggccgccgccucggcuccuuccgcuuccucgaggcccuccaggccgccugcguccccgucaugcucuccaacggcugggagcuccccuucuccgaggucaucaacuggaaccaggccgccgucaucggcgacgagcgccuccuccuccagauccccuccaccauccgcuccauccaccaggacaagauccucgcccuccgccagcagacccaguuccucugggaggccuacuucuccuccgucgagaagaucguccucaccacccucgagaucauccaggaccgcaucuucaagcacaucucccgcaacucccucaucuggaacaagcaccccggcggccucuucguccucccccaguacuccuccuaccucggcgacuuccccuacuacuacgccaaccucggccucaagccccccuccaaguucaccgccgucauccacgccgucaccccccucgucucccagucccagcccguccucaagcuccucgucgccgccgccaagucccaguacugcgcccagaucaucguccucuggaacugcgacaagccccuccccgccaagcaccgcuggcccgccaccgccguccccgucgucgucaucgagggcgaguccaaggucauguccucccgcuuccuccccuacgacaacaucaucaccgacgccguccucucccucgacgaggacaccguccucuccaccaccgaggucgacuucgccuucaccgucuggcaguccuuccccgagcgcaucgucggcuaccccgcccgcucccacuucugggacaacuccaaggagcgcuggggcuacaccuccaaguggaccaacgacuacuccaugguccucaccggcgccgccaucuaccacaaguacuaccacuaccucuacucccacuaccuccccgccucccucaagaacauggucgaccagcucgccaacugcgaggacauccucaugaacuuccucgucuccgccgucaccaagcucccccccaucaaggucacccagaagaagcaguacaaggagaccaugaugggccagaccucccgcgccucccgcugggccgaccccgaccacuucgcccagcgccaguccugcaugaacaccuucgccuccugguucggcuacaugccccucauccacucccagaugcgccucgaccccguccucuucaaggaccaggucuccauccuccgcaagaaguaccgcgacaucgagcgccucuga

SEQ ID NO: 42905 - RNA, 2256 nt, Artificial Sequence
  derived and/or modified sequence opt2 from EXT2__Homo_sapiens__NP_000392
auguccugcgccuccggcuccggcggcggccuccgccacccccuccgcugccagaagcccugggacgaggagugcgaggaggaggccgucugcgucaucaugugcgccuccgucaaguacaacauccgcggccccgcccucaucccccgcaugaagaccaagcaccgcaucuacuacaucacccucuucuccaucguccuccucggccucaucgccaccggcauguuccaguucuggccccacuccaucgaguccuccaacgacuggaacgucgagaagcgcuccauccgcgacguccccgucguccgccuccccgccgacucccccauccccgagcgcggcgaccucuccugccgcaugcacaccugcuucgacgucuaccgcugcggcuucaaccccaagaacaagaucaaggucuacaucuacgcccucaagaaguacgucgacgacuucggcgucuccgucuccaacaccaucucccgcgaguacaacgagcuccucauggccaucuccgacuccgacuacuacaccgacgacaucaaccgcgccugccucuucguccccuccaucgacguccucaaccagaacacccuccgcaucaaggagaccgcccaggccauggcccagcucucccgcugggaccgcggcaccaaccaccuccucuucaacaugcuccccggcggcccccccgacuacaacaccgcccucgacgucccccgcgaccgcgcccuccucgccggcggcggcuucuccaccuggaccuaccgccagggcuacgacgucuccauccccgucuacuccccccucuccgccgaggucgaccuccccgagaagggccccggcccccgccaguacuuccuccucuccucccaggucggccuccaccccgaguaccgcgaggaccucgaggcccuccaggucaagcacggcgaguccguccucguccucgacaagugcaccaaccucuccgagggcguccucuccguccgcaagcgcugccacaagcaccaggucuucgacuacccccagguccuccaggaggccaccuucugcgucguccuccgcggcgcccgccucggccaggccguccucuccgacguccuccaggccggcugcguccccgucgucaucgccgacuccuacauccuccccuucuccgagguccucgacuggaagcgcgccuccgucgucguccccgaggagaagauguccgacgucuacuccauccuccaguccaucccccagcgccagaucgaggagaugcagcgccaggcccgcugguucugggaggccuacuuccaguccaucaaggccaucgcccucgccacccuccagaucaucaacgaccgcaucuaccccuacgccgccaucuccuacgaggaguggaacgacccccccgccgucaaguggggcuccgucuccaacccccucuuccucccccucauccccccccagucccagggcuucaccgccaucguccucaccuacgaccgcgucgagucccucuuccgcgucaucaccgaggucuccaagguccccucccucuccaagcuccucgucgucuggaacaaccagaacaagaacccccccgaggacucccucuggcccaagauccgcgucccccucaaggucguccgcaccgccgagaacaagcucuccaaccgcuucuuccccuacgacgagaucgagaccgaggccguccucgccaucgacgacgacaucaucaugcucaccuccgacgagcuccaguucggcuacgaggucuggcgcgaguuccccgaccgccucgucggcuaccccggccgccuccaccucugggaccacgagaugaacaaguggaaguacgaguccgaguggaccaacgaggucuccaugguccucaccggcgccgccuucuaccacaaguacuucaacuaccucuacaccuacaagaugcccggcgacaucaagaacugggucgacgcccacaugaacugcgaggacaucgccaugaacuuccucgucgccaacgucaccggcaaggccgucaucaaggucaccccccgcaagaaguucaagugccccgagugcaccgccaucgacggccucucccucgaccagacccacauggucgagcgcuccgagugcaucaacaaguucgccuccgucuucggcaccaugccccucaaggucgucgagcaccgcgccgaccccguccucuacaaggacgacuuccccgagaagcucaaguccuuccccaacaucggcucccucuga

SEQ ID NO: 42906 - RNA, 1014 nt, Artificial Sequence
  derived and/or modified sequence opt2 from EXTL2__Homo_sapiens__XP_011539298
augcgcaccuggaacuccggcggcaccaagugcugccacaucugcaagcuccccggccgcgucaugggcauccgcguccuccgccucucccucgucgucauccucguccuccuccucgucgccggcgcccucaccgcccuccuccccuccgucaaggaggacaagaugcucaugcuccgccgcgagaucaagucccagggcaaguccaccauggacuccuucacccucaucaugcagaccuacaaccgcaccgaccuccuccucaagcuccucaaccacuaccaggccguccccaaccuccacaaggucaucgucgucuggaacaacaucggcgagaaggcccccgacgagcucuggaacucccucggcccccaccccauccccgucaucuucaagcagcagaccgccaaccgcaugcgcaaccgccuccaggucuuccccgagcucgagaccaacguccucauggucgacgacgacacccucaucuccacccccgaccucgucuucgccuucuccgucuggcagcaguuccccgaccagaucgucggcuucgucccccgcaagcacgucuccaccuccuccggcaucuacuccuacggcuccuucgagaugcaggcccccggcuccggcaacggcgaccaguacuccaugguccucaucggcgccuccuucuucaacuccaaguaccucgagcucuuccagcgccagcccgccgccguccacgcccucaucgacgacacccagaacugcgacgacaucgccaugaacuucaucaucgccaagcacaucggcaagaccuccggcaucuucgucaagcccgucaacauggacaaccucgagaaggagaccaacuccggcuacuccggcauguggcaccgcgccgagcacgcccuccagcgcuccuacugcaucaacaagcucgucaacaucuacgacuccaugccccuccgcuacuccaacaucaugaucucccaguucggcuuccccuacgccaacuacaagcgcaagaucuga

SEQ ID NO: 42907 - RNA, 2760 nt, Artificial Sequence
  derived and/or modified sequence opt2 from EXTL3__Homo_sapiens__NP_001431
augaccggcuacaccaugcuccgcaacggcggcgccggcaacggcggccagaccugcaugcuccgcugguccaaccgcauccgccucaccuggcucuccuucacccucuucgucauccucgucuucuucccccucaucgcccacuacuaccucaccacccucgacgaggccgacgaggccggcaagcgcaucuucggcccccgcgucggcaacgagcucugcgaggucaagcacguccucgaccucugccgcauccgcgaguccgucuccgaggagcuccuccagcucgaggccaagcgccaggagcucaacuccgagaucgccaagcucaaccucaagaucgaggccugcaagaaguccaucgagaacgccaagcaggaccuccuccagcucaagaacgucaucucccagaccgagcacuccuacaaggagcucauggcccagaaccagcccaagcucucccuccccauccgccuccuccccgagaaggacgacgccggccuccccccccccaaggccacccgcggcugccgccuccacaacugcuucgacuacucccgcugcccccucaccuccggcuuccccgucuacgucuacgacuccgaccaguucgucuucggcuccuaccucgacccccucgucaagcaggccuuccaggccaccgcccgcgccaacgucuacgucaccgagaacgccgacaucgccugccucuacgucauccucgucggcgagaugcaggagcccgucguccuccgccccgccgagcucgagaagcagcucuacucccucccccacuggcgcaccgacggccacaaccacgucaucaucaaccucucccgcaaguccgacacccagaaccuccucuacaacgucuccaccggccgcgccauggucgcccaguccaccuucuacaccguccaguaccgccccggcuucgaccucgucgucuccccccucguccacgccauguccgagcccaacuucauggagauccccccccagguccccgucaagcgcaaguaccucuucaccuuccagggcgagaagaucgagucccuccgcuccucccuccaggaggcccgcuccuucgaggaggagauggagggcgacccccccgccgacuacgacgaccgcaucaucgccacccucaaggccguccaggacuccaagcucgaccagguccucgucgaguucaccugcaagaaccagcccaagcccucccuccccaccgagugggcccucugcggcgagcgcgaggaccgccucgagcuccucaagcucuccaccuucgcccucaucaucacccccggcgacccccgccucgucaucuccuccggcugcgccacccgccucuucgaggcccucgaggucggcgccguccccgucguccucggcgagcagguccagcuccccuaccaggacaugcuccaguggaacgaggccgcccucgucguccccaagccccgcgucaccgagguccacuuccuccuccgcucccucuccgacuccgaccuccucgccaugcgccgccagggccgcuuccucugggagaccuacuucuccaccgccgacuccaucuucaacaccguccucgccaugauccgcacccgcauccagauccccgccgcccccauccgcgaggaggccgccgccgagaucccccaccgcuccggcaaggccgccggcaccgaccccaacauggccgacaacggcgaccucgaccucggccccgucgagaccgagccccccuacgccuccccccgcuaccuccgcaacuucacccucaccgucaccgacuucuaccgcuccuggaacugcgcccccggccccuuccaccucuucccccacacccccuucgaccccguccuccccuccgaggccaaguuccucggcuccggcaccggcuuccgccccaucggcggcggcgccggcggcuccggcaaggaguuccaggccgcccucggcggcaacgucccccgcgagcaguucaccgucgucaugcucaccuacgagcgcgaggagguccucaugaacucccucgagcgccucaacggccuccccuaccucaacaaggucgucgucgucuggaacucccccaagcuccccuccgaggaccuccucuggcccgacaucggcguccccaucauggucguccgcaccgagaagaacucccucaacaaccgcuuccuccccuggaacgagaucgagaccgaggccauccucuccaucgacgacgacgcccaccuccgccacgacgagaucauguucggcuuccgcgucuggcgcgaggcccgcgaccgcaucgucggcuuccccggccgcuaccacgccugggacaucccccaccaguccuggcucuacaacuccaacuacuccugcgagcucuccaugguccucaccggcgccgccuucuuccacaaguacuacgccuaccucuacuccuacgucaugccccaggccauccgcgacauggucgacgaguacaucaacugcgaggacaucgccaugaacuuccucgucucccacaucacccgcaagccccccaucaaggucaccucccgcuggaccuuccgcugccccggcugcccccaggcccucucccacgacgacucccacuuccacgagcgccacaagugcaucaacuucuucgucaaggucuacggcuacaugccccuccucuacacccaguuccgcgucgacuccguccucuucaagacccgccucccccacgacaagaccaagugcuucaaguucaucuga

SEQ ID NO: 42908 - RNA, 1779 nt, Artificial Sequence
  derived and/or modified sequence opt2 from EYA1__Homo_sapiens__NP_000494
auggagaugcaggaccucaccuccccccacucccgccucuccggcuccuccgagucccccuccggccccaagcucggcaacucccacaucaacuccaacuccaugacccccaacggcaccgaggucaagaccgagcccauguccuccuccgagaccgccuccaccaccgccgacggcucccucaacaacuucuccggcuccgccaucggcuccuccuccuucuccccccgccccacccaccaguucucccccccccagaucuaccccuccaaccgccccuacccccacauccuccccacccccuccucccagaccauggccgccuacggccagacccaguucaccaccggcaugcagcaggccaccgccuacgccaccuacccccagcccggccagcccuacggcaucuccuccuacggcgcccucugggccggcaucaagaccgagggcggccucucccagucccagucccccggccagaccggcuuccucuccuacggcaccuccuucuccaccccccagcccggccaggcccccuacuccuaccagaugcagggcuccuccuucaccaccuccuccggcaucuacaccggcaacaacucccucaccaacuccuccggcuucaacuccucccagcaggacuaccccuccuaccccuccuucggccagggccaguacgcccaguacuacaacuccucccccuaccccgcccacuacaugaccuccuccaacaccucccccaccacccccuccaccaacgccaccuaccagcuccaggagccccccuccggcaucaccucccaggccgucaccgaccccaccgccgaguacuccaccauccacucccccuccacccccaucaaggacuccgacuccgaccgccuccgccgcggcuccgacggcaagucccgcggccgcggccgccgcaacaacaaccccucccccccccccgacuccgaccucgagcgcgucuucaucugggaccucgacgagaccaucaucgucuuccacucccuccucaccggcuccuacgccaaccgcuacggccgcgacccccccaccuccgucucccucggccuccgcauggaggagaugaucuucaaccucgccgacacccaccucuucuucaacgaccucgaggagugcgaccagguccacaucgacgacgucuccuccgacgacaacggccaggaccucuccaccuacaacuucggcaccgacggcuuccccgccgccgccaccuccgccaaccucugccucgccaccggcguccgcggcggcgucgacuggaugcgcaagcucgccuuccgcuaccgccgcgucaaggagaucuacaacaccuacaagaacaacgucggcggccuccucggccccgccaagcgcgaggccuggcuccagcuccgcgccgagaucgaggcccucaccgacuccuggcucacccucgcccucaaggcccucucccucauccacucccgcaccaacugcgucaacauccucgucaccaccacccagcucauccccgcccucgccaagguccuccucuacggccucggcaucgucuuccccaucgagaacaucuacuccgccaccaagaucggcaaggaguccugcuucgagcgcaucauccagcgcuucggccgcaaggucgucuacgucgucaucggcgacggcgucgaggaggagcagggcgccaagaagcacgccaugcccuucuggcgcaucuccucccacuccgaccucauggcccuccaccacgcccucgagcucgaguaccucuga

SEQ ID NO: 42909 - RNA, 1617 nt, Artificial Sequence
  derived and/or modified sequence opt2 from EYA2__Homo_sapiens__NP_005235
auggucgagcucgucaucucccccucccucaccgucaacuccgacugccucgacaagcucaaguucaaccgcgccgacgccgccgucuggacccucuccgaccgccagggcaucaccaaguccgccccccuccgcgucucccagcucuucucccgcuccugcccccgcguccucccccgccagcccuccaccgccauggccgccuacggccagacccaguacuccgccggcauccagcaggccacccccuacaccgccuaccccccccccgcccaggccuacggcauccccuccuacuccaucaagaccgaggacucccucaaccacucccccggccaguccggcuuccucuccuacggcuccuccuucuccaccucccccaccggccagucccccuacaccuaccagaugcacggcaccaccggcuucuaccagggcggcaacggccucggcaacgccgccggcuucggcuccguccaccaggacuaccccuccuaccccggcuucccccagucccaguacccccaguacuacggcuccuccuacaacccccccuacguccccgccuccuccaucugccccuccccccucuccaccuccaccuacguccuccaggaggccucccacaacguccccaaccaguccuccgagucccucgccggcgaguacaacacccacaacggccccuccacccccgccaaggagggcgacaccgaccgcccccaccgcgccuccgacggcaagcuccgcggccgcuccaagcgcuccuccgaccccucccccgccggcgacaacgagaucgagcgcgucuucgucugggaccucgacgagaccaucaucaucuuccacucccuccucaccggcaccuucgccucccgcuacggcaaggacaccaccaccuccguccgcaucggccucaugauggaggagaugaucuucaaccucgccgacacccaccucuucuucaacgaccucgaggacugcgaccagauccacgucgacgacgucuccuccgacgacaacggccaggaccucuccaccuacaacuucuccgccgacggcuuccacuccuccgcccccggcgccaaccucugccucggcuccggcguccacggcggcgucgacuggaugcgcaagcucgccuuccgcuaccgccgcgucaaggagauguacaacaccuacaagaacaacgucggcggccucaucggcacccccaagcgcgagaccuggcuccagcuccgcgccgagcucgaggcccucaccgaccucuggcucacccacucccucaaggcccucaaccucaucaacucccgccccaacugcgucaacguccucgucaccaccacccagcucauccccgcccucgccaagguccuccucuacggccucggcuccgucuuccccaucgagaacaucuacuccgccaccaagaccggcaaggaguccugcuucgagcgcaucaugcagcgcuucggccgcaaggccgucuacgucgucaucggcgacggcgucgaggaggagcagggcgccaagaagcacaacaugcccuucuggcgcaucuccugccacgccgaccucgaggcccuccgccacgcccucgagcucgaguaccucuga

SEQ ID NO: 42910 - RNA, 1920 nt, Artificial Sequence
  derived and/or modified sequence opt2 from EYA4__Homo_sapiens__NP_004091
auggaggacucccaggaccucaacgagcaguccgucaagaagaccugcaccgaguccgacgucucccagucccagaacucccgcuccauggagaugcaggaccucgccuccccccacacccucgucggcggcggcgacacccccggcuccuccaagcucgagaaguccaaccucuccuccaccuccgucaccaccaacggcaccggcggcgagaacaugaccguccucaacaccgccgacuggcuccucuccugcaacacccccuccuccgccaccaugucccuccucgccgucaagaccgagccccucaacuccuccgagaccaccgccaccaccggcgacggcgcccucgacaccuucaccggcuccgucaucaccuccuccggcuacuccccccgcuccgcccaccaguacuccccccagcucuaccccuccaagcccuacccccacauccucuccacccccgccgcccagaccauguccgccuacgccggccagacccaguacuccggcaugcagcagcccgccgucuacaccgccuacucccagaccggccagcccuacucccuccccaccuacgaccucggcgucaugcuccccgccaucaagaccgaguccggccucucccagacccaguccccccuccaguccggcugccucuccuacucccccggcuucuccaccccccagcccggccagacccccuacuccuaccagaugcccggcuccuccuucgcccccuccuccaccaucuacgccaacaacuccgucuccaacuccaccaacuucuccggcucccagcaggacuaccccuccuacaccgccuucggccagaaccaguacgcccaguacuacuccgccuccaccuacggcgccuacaugaccuccaacaacaccgccgacggcacccccuccuccaccuccaccuaccagcuccaggagucccuccccggccucaccaaccagcccggcgaguucgacaccaugcagucccccuccacccccaucaaggaccucgacgagcgcaccugccgcuccuccggcuccaagucccgcggccgcggccgcaagaacaaccccucccccccccccgacuccgaccucgagcgcgucuucgucugggaccucgacgagaccaucaucgucuuccacucccuccucaccggcuccuacgcccagaaguacggcaaggacccccccauggccgucacccucggccuccgcauggaggagaugaucuucaaccucgccgacacccaccucuucuucaacgaccucgaggagugcgaccagguccacaucgacgacgucuccuccgacgacaacggccaggaccucuccaccuacuccuucgccaccgacggcuuccacgccgccgccuccuccgccaaccucugccuccccaccggcguccgcggcggcgucgacuggaugcgcaagcucgccuuccgcuaccgccgcgucaaggagcucuacaacaccuacaagaacaacgucggcggccuccucggccccgccaagcgcgacgccuggcuccagcuccgcgccgagaucgagggccucaccgacuccuggcucaccaacgcccucaagucccucuccaucaucuccacccgcuccaacugcaucaacguccucgucaccaccacccagcucauccccgcccucgccaagguccuccucuacucccucggcggcgccuuccccaucgagaacaucuacuccgccaccaagaucggcaaggaguccugcuucgagcgcaucaugcagcgcuucggccgcaaggucgucuacgucgucaucggcgacggcgucgaggaggagcaggccgccaagaagcacaacaugcccuucuggcgcaucuccucccacuccgaccuccucgcccuccaccaggcccucgagcucgaguaccucuga

SEQ ID NO: 42911 - RNA, 9435 nt, Artificial Sequence
  derived and/or modified sequence opt2 from EYS__Homo_sapiens__NP_001136272
augaccgacaaguccaucgucauccucucccucauggucuuccacuccuccuucaucaacggcaagaccugccgccgccagcucgucgaggaguggcacccccagcccuccuccuacgucgucaacuggacccucaccgagaacaucugccucgacuucuaccgcgacugcugguuccucggcgucaacaccaagaucgacaccuccggcaaccaggccgucccccagaucugcccccuccagauccagcucggcgacauccucgucaucuccuccgagcccucccuccaguuccccgagaucaaccucaugaacgucuccgagaccuccuucgucggcugcguccagaacaccaccaccgaggaccagcuccucuucggcugccgccucaagggcaugcacaccgucaacuccaaguggcucuccgucggcacccacuacuucaucaccgucauggccuccggccccucccccugcccccucggccuccgccucaacgucaccgucaagcagcaguucugccaggagucccucuccuccgaguucugcuccggccacggcaagugccucuccgaggccugguccaagaccuacuccugccacugccagccccccuucuccggcaaguacugccaggagcucgacgccugcuccuucaagcccugcaagaacaacggcuccugcaucaacaagcgcgagaacugggacgagcaggccuacgagugcgucugccacccccccuucaccggcaagaacugcuccgagaucaucggccagugccagccccacgucugcuuccacggcaacugcuccaacaucaccuccaacuccuucaucugcgagugcgacgagcaguucuccggccccuucugcgaggucuccgccaagcccugcgucucccuccucuucuggaagcgcggcaucugccccaacuccuccuccgccuacaccuacgagugccccaagggcuccuccucccagaacggcgagaccgacgucuccgaguucucccucguccccugccagaacggcaccgacugcaucaagaucuccaacgacgucaugugcaucugcucccccaucuucaccgaccuccucugcaaguccauccagaccuccugcgaguccuucccccuccgcaacaacgccaccugcaagaagugcgagaaggacuaccccugcuccugcaucuccggcuucaccgagaagaacugcgagaaggccaucgaccacugcaagcuccucuccaucaacugccucaacgaggaguggugcuucaacaucaucggccgcuucaaguacgucugcauccccggcugcaccaagaaccccugcugguuccucaagaacgucuaccucauccaccagcaccucugcuacugcggcgucaccuuccacggcaucugccaggacaagggccccgcccaguucgaguacgucuggcagcucggcuucgccggcuccgagggcgagaagugccagggcgucaucgacgccuacuucuuccucgccgccaacugcaccgaggacgccaccuacgucaacgaccccgaggacaacaacuccuccugcugguucccccacgagggcaccaaggagaucugcgccaacggcugcuccugccucuccgaggaggacucccaggaguaccgcuaccucugcuuccuccgcugggccggcaacauguaccucgagaacaccaccgacgaccaggagaacgagugccagcacgaggccgucugcaaggacgagaucaaccgcccccgcugcuccugcucccucuccuacaucggccgccucugcgucgucaacgucgacuacugccucggcaaccacuccaucuccguccacggccucugccucgcccucucccacaacugcaacugcuccggccuccagcgcuacgagcgcaacaucugcgagaucgacaccgaggacugcaaguccgccuccugcaagaacggcaccaccuccacccaccuccgcggcuacuucuuccgcaagugcguccccggcuucaagggcacccagugcgagaucgacaucgacgagugcgccucccaccccugcaagaacggcgccaccugcaucgaccagcccggcaacuacuucugccagugcgucccccccuucaaggucgucgacggcuucuccugccucugcaaccccggcuacgucggcauccgcugcgagcaggacaucgacgacugcauccucaacgccugcgagcacaacuccaccugcaaggaccuccaccucuccuaccagugcgucugccucuccgacugggagggcaacuucugcgagcaggaguccaacgagugcaagaugaaccccugcaagaacaacuccaccugcaccgaccucuacaaguccuaccgcugcgagugcaccuccggcuggaccggccagaacugcuccgaggagaucaacgagugcgacuccgaccccugcaugaacggcggccucugccacgaguccaccauccccggccaguucgucugccucugccccccccucuacaccggccaguucugccaccagcgcuacaaccucugcgaccuccuccacaaccccugccgcaacaacuccaccugccucgcccucgucgacgccaaccagcacugcaucugccgcgaggaguucgagggcaagaacugcgagaucgacgucaaggacugccucuuccucuccugccaggacuacggcgacugcgaggacauggucaacaacuuccgcugcaucugccgccccggcuucuccggcucccucugcgagaucgagaucaacgagugcuccuccgagcccugcaagaacaacggcaccugcgucgaccucaccaaccgcuucuucugcaacugcgagcccgaguaccacggccccuucugcgagcucgacgucaacaagugcaagaucucccccugccucgacgaggagaacugcgucuaccgcaccgacggcuacaacugccucugcgcccccggcuacaccggcaucaacugcgagaucaaccucgacgagugccucuccgagcccugccuccacgacggcgucugcaucgacggcaucaaccacuacaccugcgacugcaaguccggcuucuucggcacccacugcgagaccaacgccaacgacugccucuccaaccccugccuccacggccgcugcaccgagcucaucaacgaguaccccugcuccugcgacgccgacggcaccuccacccagugcaagaucaagaucaacgacugcaccuccauccccugcaugaacgagggcuucugccagaaguccgcccacggcuucaccugcaucugcccccgcggcuacaccggcgccuacugcgagaaguccaucgacaacugcgccgagcccgagcucaacuccgucaucugccucaacggcggcaucugcgucgacggccccggccacaccuucgacugccgcugccuccccggcuucuccggccaguucugcgagaucaacaucaacgagugcuccuccucccccugccuccacggcgccgacugcgaggaccacaucaacggcuacgucugcaagugccagcccggcugguccggccaccacugcgagaacgagcucgagugcauccccaacuccugcguccacgagcucugcauggagaacgagcccggcuccaccugccucugcacccccggcuucaugaccugcuccaucggccuccucugcggcgacgagauccgccgcaucaccugccucacccccaucuuccagcgcaccgaccccaucuccacccagaccuacaccaucccccccuccgagacccucgucuccuccuuccccuccaucaaggccacccgcauccccgccaucauggacaccuaccccgucgaccagggccccaagcagaccggcaucgucaagcacgacauccuccccaccaccggccucgccacccuccgcaucuccaccccccucgaguccuaccuccuccaggagcucaucgucacccgcgagcucuccgccaagcacucccuccucuccuccgccgacgucuccuccucccgcuuccucaacuucggcauccgcgaccccgcccagaucguccaggacaagaccuccgucucccacaugcccauccgcaccuccgccgccacccucggcuucuucuuccccgaccgccgcgcccgcacccccuucaucauguccucccucauguccgacuucaucuuccccacccagucccuccucuucgagaacugccagaccgucgcccucuccgccacccccaccaccuccgucauccgcuccauccccggcgccgacaucgagcucaaccgccagucccuccucucccgcggcuuccuccucaucgccgccuccaucuccgccacccccgucgucucccgcggcgcccaggaggacaucgaggaguacuccgccgacucccucaucucccgccgcgagcacuggcgccuccucucccccuccaugucccccaucuuccccgccaaggucaucaucuccaagcaggucaccauccucaacuccuccgcccuccaccgcuucuccaccaaggccuucaaccccuccgaguaccaggccaucaccgaggccuccuccaaccagcgccucaccaacaucaagucccaggccgccgacucccuccgcgagcucucccagaccugcgccaccugcuccaugaccgagaucaaguccucccgcgaguucuccgaccagguccuccacuccaagcagucccacuucuacgagaccuucuggaugaacuccgccauccucgccuccugguacgcccucaugggcgcccagaccaucaccuccggccacuccuucuccuccgccaccgagaucacccccuccgucgccuucaccgagguccccucccucuuccccuccaagaaguccgccaagcgcaccauccucuccuccucccucgaggaguccaucacccucuccuccaaccucgacgucaaccucugccucgacaagaccugccucuccaucguccccucccagaccaucuccuccgaccucaugaacuccgaccucaccuccaagaugaccaccgacgagcucuccgucuccgagaacauccucaagcuccucaagauccgccaguacggcaucaccaugggccccaccgagguccucaaccaggagucccuccucgacauggagaaguccaagggcucccacacccucuucaagcuccaccccuccgacuccucccucgacuucgagcucaaccuccagaucuaccccgacgucacccucaagaccuacuccgagaucacccacgccaacgacuucaagaacaaccuccccccccucaccggcuccguccccgacuucuccgaggucaccaccaacgucgccuucuacaccgucuccgccacccccgcccucuccauccagaccuccuccuccauguccgucauccgccccgacuggcccuacuucaccgacuacaugaccucccucaagaaggaggucaagaccuccuccgagugguccaagugggagcuccagcccuccguccaguaccaggaguuccccaccgccucccgccaccuccccuucacccgcucccucacccucuccucccucgaguccauccucgccccccagcgccucaugaucuccgacuucuccugcguccgcuacuacggcgacuccuaccucgaguuccagaacgucgcccucaacccccagaacaacaucucccucgaguuccagaccuucuccuccuacggccuccuccucuacgucaagcaggacuccaaccucgucgacggcuucuucauccagcucuucaucgagaacggcacccucaaguaccacuucuacugccccggcgaggccaaguucaaguccaucaacaccaccguccgcgucgacaacggccagaaguacacccuccucauccgccaggagcucgaccccugcaacgccgagcucaccauccucggccgcaacacccagaucugcgaguccaucaaccacguccucggcaagccccuccccaaguccggcuccgucuucaucggcggcuuccccgaccuccacggcaagauccagaugcccguccccgucaagaacuucaccggcugcaucgaggucaucgagaucaacaacuggcgcuccuucauccccuccaaggccgucaagaacuaccacaucaacaacugccgcucccagggcuucaugcucucccccaccgccuccuucgucgacgccuccgacgucacccagggcgucgacaccauguggaccuccgucucccccuccgucgccgcccccuccgucugccagcaggacgucugccacaacggcggcaccugccacgccaucuuccucuccuccggcaucgucuccuuccagugcgacugcccccuccacuucaccggccgcuucugcgagaaggacgccggccucuucuuccccuccuucaacggcaacuccuaccucgagcuccccuuccucaaguucguccucgagaaggagcacaaccgcaccgucaccaucuaccucaccaucaagaccaacucccucaacggcaccauccucuacuccaacggcaacaacugcggcaagcaguuccuccaccucuuccucgucgagggccgccccuccgucaaguacggcugcggcaacucccagaacauccucaccgucuccgccaacuacuccaucaacaccaacgccuucacccccaucaccauccgcuacaccacccccgucggcucccccggcgucgucugcaugaucgagaugaccgccgacggcaagccccccguccagaagaaggacaccgagaucucccacgccucccaggccuacuucgaguccauguuccucggccacauccccgccaacguccagauccacaagaaggccggccccgucuacggcuuccgcggcugcauccucgaccuccaggucaacaacaaggaguucuucaucaucgacgaggcccgccacggcaagaacaucgagaacugccacguccccuggugcgcccaccaccucugccgcaacaacggcaccugcaucuccgacaacgagaaccucuucugcgagugcccccgccucuacuccggcaagcucugccaguucgccuccugcgagaacaaccccugcggcaacggcgccaccugcguccccaaguccggcaccgacaucgucugccucugccccuacggccgcuccggcccccucugcaccgacgccaucaacaucacccagccccgcuucuccggcaccgacgccuucggcuacaccuccuuccucgccuacucccgcaucuccgacaucuccuuccacuacgaguuccaccucaaguuccagcucgccaacaaccacuccgcccuccagaacaaccucaucuucuucaccggccagaagggccacggccucaacggcgacgacuuccucgccgucggccuccucaacggcuccgucgucuacuccuacaaccucggcuccggcaucgccuccauccgcuccgagccccucaaccucucccucggcguccacaccguccaccucggcaaguucuuccaggagggcuggcucaaggucgacgaccacaagaacaaguccaucaucgcccccggccgccucgucggccucaacgucuucucccaguucuacgucggcggcuacuccgaguacacccccgaccuccuccccaacggcgccgacuucaagaacggcuuccagggcugcaucuucacccuccagguccgcaccgagaaggacggccacuuccgcggccucggcaaccccgagggccaccccaacgccggccgcuccgucggccagugccacgccucccccugcucccucaugaagugcggcaacggcggcaccugcaucgaguccggcaccuccgucuacugcaacugcaccaccggcuggaagggcuccuucugcaccgagaccgucuccaccugcgaccccgagcacgaccccccccaccacugcucccgcggcgccaccugcaucucccucccccacggcuacaccugcuucugcccccucggcaccaccggcaucuacugcgagcaggcccucuccaucuccgaccccuccuuccgcuccaacgagcucuccuggauguccuucgccuccuuccacguccgcaagaagacccacauccagcuccaguuccagccccucgccgccgacggcauccucuucuacgccgcccagcaccucaaggcccaguccggcgacuuccucugcaucucccucgucaacuccuccguccagcuccgcuacaaccucggcgaccgcaccaucauccucgagacccuccagaaggucaccaucaacggcuccaccuggcacaucaucaaggccggccgcgucggcgccgagggcuaccucgaccucgacggcaucaacgucaccgagaaggccuccaccaagauguccucccucgacaccaacaccgacuucuacaucggcggcgucuccucccucaaccucgucaaccccauggccaucgagaacgagcccgucggcuuccagggcugcauccgccaggucaucaucaacaaccaggagcuccagcucaccgaguucggcgccaagggcggcuccaacgucggcgacugcgacggcaccgccugcggcuacaacaccugccgcaacggcggcgagugcaccgucaacggcaccaccuucuccugccgcugccuccccgacugggccggcaacaccugcaaccaguccgucuccugccucaacaaccucugccuccaccagucccucugcauccccgaccaguccuucuccuacuccugccucugcacccucggcugggucggccgcuacugcgagaacaagaccuccuucuccaccgccaaguucaugggcaacuccuacaucaaguacaucgaccccaacuaccgcaugcgcaaccuccaguucaccaccaucucccucaacuucuccaccaccaagaccgagggccucaucgucuggaugggcaucgcccagaacgaggagaacgacuuccucgccaucggccuccacaaccagacccucaagaucgccgucaaccucggcgagcgcaucuccguccccauguccuacaacaacggcaccuucugcugcaacaaguggcaccacgucgucgucauccagaaccagacccucaucaaggccuacaucaacaacucccucauccucuccgaggacaucgacccccacaagaacuucgucgcccucaacuacgacggcaucugcuaccucggcggcuucgaguacggccgcaaggucaacaucgucacccaggagaucuucaagaccaacuucgucggcaagaucaaggacgucgucuucuuccaggagcccaagaacaucgagcucaucaagcucgagggcuacaacgucuacgacggcgacgagcagaacgaggucaccuga

SEQ ID NO: 42912 - RNA, 2244 nt, Artificial Sequence
  derived and/or modified sequence opt2 from EZH1__Homo_sapiens__NP_001982
auggagauccccaacccccccaccuccaagugcaucaccuacuggaagcgcaaggucaaguccgaguacaugcgccuccgccagcucaagcgccuccaggccaacaugggcgccaaggcccucuacgucgccaacuucgccaagguccaggagaagacccagauccucaacgaggaguggaagaagcuccgcguccagcccguccaguccaugaagcccgucuccggccaccccuuccucaagaagugcaccaucgaguccaucuuccccggcuucgccucccagcacaugcucaugcgcucccucaacaccgucgcccucguccccaucauguacuccugguccccccuccagcagaacuucauggucgaggacgagaccguccucugcaacauccccuacaugggcgacgaggucaaggaggaggacgagaccuucaucgaggagcucaucaacaacuacgacggcaagguccacggcgaggaggagaugauccccggcuccguccucaucuccgacgccgucuuccucgagcucgucgacgcccucaaccaguacuccgacgaggaggaggagggccacaacgacaccuccgacggcaagcaggacgacuccaaggaggaccuccccgucacccgcaagcgcaagcgccacgccaucgagggcaacaagaaguccuccaagaagcaguuccccaacgacaugaucuucuccgccaucgccuccauguuccccgagaacggcguccccgacgacaugaaggagcgcuaccgcgagcucaccgagauguccgaccccaacgcccuccccccccagugcacccccaacaucgacggccccaacgccaaguccguccagcgcgagcagucccuccacuccuuccacacccucuucugccgccgcugcuucaaguacgacugcuuccuccaccccuuccacgccacccccaacgucuacaagcgcaagaacaaggagaucaagaucgagcccgagcccugcggcaccgacugcuuccuccuccucgagggcgccaaggaguacgccaugcuccacaacccccgcuccaagugcuccggccgccgccgccgccgccaccacaucgucuccgccuccugcuccaacgccuccgccuccgccgucgccgagaccaaggagggcgacuccgaccgcgacaccggcaacgacugggccuccuccuccuccgaggccaacucccgcugccagacccccaccaagcagaaggccucccccgcccccccccagcucugcgucgucgaggcccccuccgagcccgucgaguggaccggcgccgaggagucccucuuccgcgucuuccacggcaccuacuucaacaacuucugcuccaucgcccgccuccucggcaccaagaccugcaagcaggucuuccaguucgccgucaaggagucccucauccucaagcuccccaccgacgagcucaugaaccccucccagaagaagaagcgcaagcaccgccucugggccgcccacugccgcaagauccagcucaagaaggacaacuccuccacccaggucuacaacuaccagcccugcgaccaccccgaccgccccugcgacuccaccugccccugcaucaugacccagaacuucugcgagaaguucugccagugcaaccccgacugccagaaccgcuuccccggcugccgcugcaagacccagugcaacaccaagcagugccccugcuaccucgccguccgcgagugcgaccccgaccucugccucaccugcggcgccuccgagcacugggacugcaaggucgucuccugcaagaacugcuccauccagcgcggccucaagaagcaccuccuccucgcccccuccgacgucgccggcuggggcaccuucaucaaggaguccguccagaagaacgaguucaucuccgaguacugcggcgagcucaucucccaggacgaggccgaccgccgcggcaaggucuacgacaaguacauguccuccuuccucuucaaccucaacaacgacuucgucgucgacgccacccgcaagggcaacaagauccgcuucgccaaccacuccgucaaccccaacugcuacgccaaggucgucauggucaacggcgaccaccgcaucggcaucuucgccaagcgcgccauccaggccggcgaggagcucuucuucgacuaccgcuacucccaggccgacgcccucaaguacgucggcaucgagcgcgagaccgacguccucuga

SEQ ID NO: 42913 - RNA, 2265 nt, Artificial Sequence
  derived and/or modified sequence opt2 from EZH2__Homo_sapiens__XP_005250019
augaucuacuucauccgcaucaucaugggccagaccggcaagaaguccgagaagggccccgucugcuggcgcaagcgcgucaaguccgaguacaugcgccuccgccagcucaagcgcuuccgccgcgccgacgaggucaaguccauguucuccuccaaccgccagaagauccucgagcgcaccgagauccucaaccaggaguggaagcagcgccgcauccagcccguccacauccucaccuccgucuccucccuccgcggcacccgcgagugcuccgucaccuccgaccucgacuuccccacccaggucaucccccucaagacccucaacgccgucgccuccguccccaucauguacuccugguccccccuccagcagaacuucauggucgaggacgagaccguccuccacaacauccccuacaugggcgacgagguccucgaccaggacggcaccuucaucgaggagcucaucaagaacuacgacggcaagguccacggcgaccgcgagugcggcuucaucaacgacgagaucuucgucgagcucgucaacgcccucggccaguacaacgacgacgacgacgacgacgacggcgacgaccccgaggagcgcgaggagaagcagaaggaccucgaggaccaccgcgacgacaaggagucccgccccccccgcaaguuccccuccgacaagaucuucgaggccaucuccuccauguuccccgacaagggcaccgccgaggagcucaaggagaaguacaaggagcucaccgagcagcagcuccccggcgcccucccccccgagugcacccccaacaucgacggccccaacgccaaguccguccagcgcgagcagucccuccacuccuuccacacccucuucugccgccgcugcuucaaguacgacugcuuccuccaccccuuccacgccacccccaacaccuacaagcgcaagaacaccgagaccgcccucgacaacaagcccugcggcccccagugcuaccagcaccucgagggcgccaaggaguucgccgccgcccucaccgccgagcgcaucaagaccccccccaagcgccccggcggccgccgccgcggccgccuccccaacaacuccucccgccccuccacccccaccaucaacguccucgaguccaaggacaccgacuccgaccgcgaggccggcaccgagaccggcggcgagaacaacgacaaggaggaggaggagaagaaggacgagaccuccuccuccuccgaggccaacucccgcugccagacccccaucaagaugaagcccaacaucgagccccccgagaacgucgagugguccggcgccgaggccuccauguuccgcguccucaucggcaccuacuacgacaacuucugcgccaucgcccgccucaucggcaccaagaccugccgccaggucuacgaguuccgcgucaaggaguccuccaucaucgcccccgcccccgccgaggacgucgacacccccccccgcaagaagaagcgcaagcaccgccucugggccgcccacugccgcaagauccagcucaagaaggacggcuccuccaaccacgucuacaacuaccagcccugcgaccacccccgccagcccugcgacuccuccugccccugcgucaucgcccagaacuucugcgagaaguucugccagugcuccuccgagugccagaaccgcuuccccggcugccgcugcaaggcccagugcaacaccaagcagugccccugcuaccucgccguccgcgagugcgaccccgaccucugccucaccugcggcgccgccgaccacugggacuccaagaacgucuccugcaagaacugcuccauccagcgcggcuccaagaagcaccuccuccucgcccccuccgacgucgccggcuggggcaucuucaucaaggaccccguccagaagaacgaguucaucuccgaguacugcggcgagaucaucucccaggacgaggccgaccgccgcggcaaggucuacgacaaguacaugugcuccuuccucuucaaccucaacaacgacuucgucgucgacgccacccgcaagggcaacaagauccgcuucgccaaccacuccgucaaccccaacugcuacgccaaggucaugauggucaacggcgaccaccgcaucggcaucuucgccaagcgcgccauccagaccggcgaggagcucuucuucgacuaccgcuacucccaggccgacgcccucaaguacgucggcaucgagcgcgagauggagauccccuga

SEQ ID NO: 42914 - RNA, 1761 nt, Artificial Sequence
  derived and/or modified sequence opt2 from EZR__Homo_sapiens__NP_001104547
augcccaagcccaucaacguccgcgucaccaccauggacgccgagcucgaguucgccauccagcccaacaccaccggcaagcagcucuucgaccaggucgucaagaccaucggccuccgcgaggucugguacuucggccuccacuacgucgacaacaagggcuuccccaccuggcucaagcucgacaagaaggucuccgcccaggagguccgcaaggagaacccccuccaguucaaguuccgcgccaaguucuaccccgaggacgucgccgaggagcucauccaggacaucacccagaagcucuucuuccuccaggucaaggagggcauccucuccgacgagaucuacugcccccccgagaccgccguccuccucggcuccuacgccguccaggccaaguucggcgacuacaacaaggagguccacaaguccggcuaccucuccuccgagcgccucaucccccagcgcgucauggaccagcacaagcucacccgcgaccagugggaggaccgcauccaggucuggcacgccgagcaccgcggcaugcucaaggacaacgccaugcucgaguaccucaagaucgcccaggaccucgagauguacggcaucaacuacuucgagaucaagaacaagaagggcaccgaccucuggcucggcgucgacgcccucggccucaacaucuacgagaaggacgacaagcucacccccaagaucggcuuccccugguccgagauccgcaacaucuccuucaacgacaagaaguucgucaucaagcccaucgacaagaaggcccccgacuucgucuucuacgccccccgccuccgcaucaacaagcgcauccuccagcucugcaugggcaaccacgagcucuacaugcgccgccgcaagcccgacaccaucgagguccagcagaugaaggcccaggcccgcgaggagaagcaccagaagcagcucgagcgccagcagcucgagaccgagaagaagcgccgcgagaccgucgagcgcgagaaggagcagaugaugcgcgagaaggaggagcucaugcuccgccuccaggacuacgaggagaagaccaagaaggccgagcgcgagcucuccgagcagauccagcgcgcccuccagcucgaggaggagcgcaagcgcgcccaggaggaggccgagcgccucgaggccgaccgcauggccgcccuccgcgccaaggaggagcucgagcgccaggccgucgaccagaucaagucccaggagcagcucgccgccgagcucgccgaguacaccgccaagaucgcccuccucgaggaggcccgccgccgcaaggaggacgaggucgaggaguggcagcaccgcgccaaggaggcccaggacgaccucgucaagaccaaggaggagcuccaccucgucaugaccgcccccccccccccccccccccccgucuacgagcccgucuccuaccacguccaggagucccuccaggacgagggcgccgagcccaccggcuacuccgccgagcucuccuccgagggcauccgcgacgaccgcaacgaggagaagcgcaucaccgaggccgagaagaacgagcgcguccagcgccagcuccucacccucuccuccgagcucucccaggcccgcgacgagaacaagcgcacccacaacgacaucauccacaacgagaacaugcgccagggccgcgacaaguacaagacccuccgccagauccgccagggcaacaccaagcagcgcaucgacgaguucgaggcccucuga

SEQ ID NO: 42915 - RNA, 1467 nt, Artificial Sequence
  derived and/or modified sequence opt2 from F10__Homo_sapiens__NP_000495
augggccgcccccuccaccucguccuccucuccgccucccucgccggccuccuccuccucggcgagucccucuucauccgccgcgagcaggccaacaacauccucgcccgcgucacccgcgccaacuccuuccucgaggagaugaagaagggccaccucgagcgcgagugcauggaggagaccugcuccuacgaggaggcccgcgaggucuucgaggacuccgacaagaccaacgaguucuggaacaaguacaaggacggcgaccagugcgagaccucccccugccagaaccagggcaagugcaaggacggccucggcgaguacaccugcaccugccucgagggcuucgagggcaagaacugcgagcucuucacccgcaagcucugcucccucgacaacggcgacugcgaccaguucugccacgaggagcagaacuccgucgucugcuccugcgcccgcggcuacacccucgccgacaacggcaaggccugcauccccaccggccccuaccccugcggcaagcagacccucgagcgccgcaagcgcuccgucgcccaggccaccuccuccuccggcgaggcccccgacuccaucaccuggaagcccuacgacgccgccgaccucgaccccaccgagaaccccuucgaccuccucgacuucaaccagacccagcccgagcgcggcgacaacaaccucacccgcaucgucggcggccaggagugcaaggacggcgagugccccuggcaggcccuccucaucaacgaggagaacgagggcuucugcggcggcaccauccucuccgaguucuacauccucaccgccgcccacugccucuaccaggccaagcgcuucaagguccgcgucggcgaccgcaacaccgagcaggaggagggcggcgaggccguccacgaggucgaggucgucaucaagcacaaccgcuucaccaaggagaccuacgacuucgacaucgccguccuccgccucaagacccccaucaccuuccgcaugaacgucgcccccgccugccuccccgagcgcgacugggccgaguccacccucaugacccagaagaccggcaucgucuccggcuucggccgcacccacgagaagggccgccaguccacccgccucaagaugcucgagguccccuacgucgaccgcaacuccugcaagcucuccuccuccuucaucaucacccagaacauguucugcgccggcuacgacaccaagcaggaggacgccugccagggcgacuccggcggcccccacgucacccgcuucaaggacaccuacuucgucaccggcaucgucuccuggggcgagggcugcgcccgcaagggcaaguacggcaucuacaccaaggucaccgccuuccucaaguggaucgaccgcuccaugaagacccgcggccuccccaaggccaagucccacgcccccgaggucaucaccuccuccccccucaaguga

SEQ ID NO: 42916 - RNA, 1878 nt, Artificial Sequence
  derived and/or modified sequence opt2 from F11__Homo_sapiens__NP_000119
augaucuuccucuaccaggucguccacuucauccucuucaccuccgucuccggcgagugcgucacccagcuccucaaggacaccugcuucgagggcggcgacaucaccaccgucuucacccccuccgccaaguacugccaggucgucugcaccuaccacccccgcugccuccucuucaccuucaccgccgagucccccuccgaggaccccacccgcugguucaccugcguccucaaggacuccgucaccgagacccucccccgcgucaaccgcaccgccgccaucuccggcuacuccuucaagcagugcucccaccagaucuccgccugcaacaaggacaucuacgucgaccucgacaugaagggcaucaacuacaacuccuccgucgccaaguccgcccaggagugccaggagcgcugcaccgacgacguccacugccacuucuucaccuacgccacccgccaguuccccucccucgagcaccgcaacaucugccuccucaagcacacccagaccggcacccccacccgcaucaccaagcucgacaaggucgucuccggcuucucccucaaguccugcgcccucuccaaccucgccugcauccgcgacaucuuccccaacaccgucuucgccgacuccaacaucgacuccgucauggcccccgacgccuucgucugcggccgcaucugcacccaccaccccggcugccucuucuucaccuucuucucccaggaguggcccaaggagucccagcgcaaccucugccuccucaagaccuccgaguccggccuccccuccacccgcaucaagaaguccaaggcccucuccggcuucucccuccaguccugccgccacuccauccccgucuucugccacuccuccuucuaccacgacaccgacuuccucggcgaggagcucgacaucgucgccgccaagucccacgaggccugccagaagcucugcaccaacgccguccgcugccaguucuucaccuacacccccgcccaggccuccugcaacgagggcaagggcaagugcuaccucaagcucuccuccaacggcucccccaccaagauccuccacggccgcggcggcaucuccggcuacacccuccgccucugcaagauggacaacgagugcaccaccaagaucaagccccgcaucgucggcggcaccgccuccguccgcggcgaguggcccuggcaggucacccuccacaccaccucccccacccagcgccaccucugcggcggcuccaucaucggcaaccaguggauccucaccgccgcccacugcuucuacggcgucgagucccccaagauccuccgcgucuacuccggcauccucaaccaguccgagaucaaggaggacaccuccuucuucggcguccaggagaucaucauccacgaccaguacaagauggccgaguccggcuacgacaucgcccuccucaagcucgagaccaccgucaacuacaccgacucccagcgccccaucugccuccccuccaagggcgaccgcaacgucaucuacaccgacugcugggucaccggcuggggcuaccgcaagcuccgcgacaagauccagaacacccuccagaaggccaagaucccccucgucaccaacgaggagugccagaagcgcuaccgcggccacaagaucacccacaagaugaucugcgccggcuaccgcgagggcggcaaggacgccugcaagggcgacuccggcggcccccucuccugcaagcacaacgaggucuggcaccucgucggcaucaccuccuggggcgagggcugcgcccagcgcgagcgccccggcgucuacaccaacgucgucgaguacgucgacuggauccucgagaagacccaggccgucuga

SEQ ID NO: 42917 - RNA, 900 nt, Artificial Sequence
  derived and/or modified sequence opt2 from F11R__Homo_sapiens__NP_058642
augggcaccaaggcccaggucgagcgcaagcuccucugccucuucauccucgccauccuccucugcucccucgcccucggcuccgucaccguccacuccuccgagcccgagguccgcauccccgagaacaaccccgucaagcucuccugcgccuacuccggcuucuccuccccccgcgucgaguggaaguucgaccagggcgacaccacccgccucgucugcuacaacaacaagaucaccgccuccuacgaggaccgcgucaccuuccuccccaccggcaucaccuucaaguccgucacccgcgaggacaccggcaccuacaccugcauggucuccgaggagggcggcaacuccuacggcgaggucaaggucaagcucaucguccucgucccccccuccaagcccaccgucaacauccccuccuccgccaccaucggcaaccgcgccguccucaccugcuccgagcaggacggcuccccccccuccgaguacaccugguucaaggacggcaucgucaugcccaccaaccccaaguccacccgcgccuucuccaacuccuccuacguccucaaccccaccaccggcgagcucgucuucgacccccucuccgccuccgacaccggcgaguacuccugcgaggcccgcaacggcuacggcacccccaugaccuccaacgccguccgcauggaggccgucgagcgcaacgucggcgucaucgucgccgccguccucgucacccucauccuccucggcauccucgucuucggcaucugguucgccuacucccgcggccacuucgaccgcaccaagaagggcaccuccuccaagaaggucaucuacucccagcccuccgcccgcuccgagggcgaguucaagcagaccuccuccuuccucgucuga

SEQ ID NO: 42918 - RNA, 1848 nt, Artificial Sequence
  derived and/or modified sequence opt2 from F12__Homo_sapiens__NP_000496
augcgcgcccuccuccuccucggcuuccuccucgucucccucgaguccacccucuccaucccccccugggaggcccccaaggagcacaaguacaaggccgaggagcacaccgucguccucaccgucaccggcgagcccugccacuuccccuuccaguaccaccgccagcucuaccacaagugcacccacaagggccgccccggcccccagcccuggugcgccaccacccccaacuucgaccaggaccagcgcuggggcuacugccucgagcccaagaaggucaaggaccacugcuccaagcacucccccugccagaagggcggcaccugcgucaacaugcccuccggcccccacugccucugcccccagcaccucaccggcaaccacugccagaaggagaagugcuucgagccccagcuccuccgcuucuuccacaagaacgagaucugguaccgcaccgagcaggccgccgucgcccgcugccagugcaagggccccgacgcccacugccagcgccucgccucccaggccugccgcaccaaccccugccuccacggcggccgcugccucgaggucgagggccaccgccucugccacugccccgucggcuacaccggcgccuucugcgacgucgacaccaaggccuccugcuacgacggccgcggccucuccuaccgcggccucgcccgcaccacccucuccggcgcccccugccagcccugggccuccgaggccaccuaccgcaacgucaccgccgagcaggcccgcaacuggggccucggcggccacgccuucugccgcaaccccgacaacgacauccgccccuggugcuucguccucaaccgcgaccgccucuccugggaguacugcgaccucgcccagugccagacccccacccaggccgccccccccacccccgucuccccccgccuccacgucccccucaugcccgcccagcccgccccccccaagccccagcccaccacccgcacccccccccagucccagacccccggcgcccuccccgccaagcgcgagcagccccccucccucacccgcaacggcccccucuccugcggccagcgccuccgcaagucccucuccuccaugacccgcgucgucggcggccucgucgcccuccgcggcgcccaccccuacaucgccgcccucuacuggggccacuccuucugcgccggcucccucaucgcccccugcuggguccucaccgccgcccacugccuccaggaccgccccgcccccgaggaccucaccgucguccucggccaggagcgccgcaaccacuccugcgagcccugccagacccucgccguccgcuccuaccgccuccacgaggccuucucccccgucuccuaccagcacgaccucgcccuccuccgccuccaggaggacgccgacggcuccugcgcccuccucucccccuacguccagcccgucugccuccccuccggcgccgcccgccccuccgagaccacccucugccaggucgccggcuggggccaccaguucgagggcgccgaggaguacgccuccuuccuccaggaggcccagguccccuuccucucccucgagcgcugcuccgcccccgacguccacggcuccuccauccuccccggcaugcucugcgccggcuuccucgagggcggcaccgacgccugccagggcgacuccggcggcccccucgucugcgaggaccaggccgccgagcgccgccucacccuccagggcaucaucuccuggggcuccggcugcggcgaccgcaacaagcccggcgucuacaccgacgucgccuacuaccucgccuggauccgcgagcacaccgucuccuga

SEQ ID NO: 42919 - RNA, 2199 nt, Artificial Sequence
  derived and/or modified sequence opt2 from F13A1__Homo_sapiens__NP_000120
auguccgagaccucccgcaccgccuucggcggccgccgcgccgucccccccaacaacuccaacgccgccgaggacgaccuccccaccgucgagcuccagggcgucgucccccgcggcgucaaccuccaggaguuccucaacgucaccuccguccaccucuucaaggagcgcugggacaccaacaaggucgaccaccacaccgacaaguacgagaacaacaagcucaucguccgccgcggccaguccuucuacguccagaucgacuucucccgccccuacgacccccgccgcgaccucuuccgcgucgaguacgucaucggccgcuacccccaggagaacaagggcaccuacauccccguccccaucgucuccgagcuccaguccggcaaguggggcgccaagaucgucaugcgcgaggaccgcuccguccgccucuccauccaguccucccccaagugcaucgucggcaaguuccgcauguacgucgccgucuggacccccuacggcguccuccgcaccucccgcaaccccgagaccgacaccuacauccucuucaaccccuggugcgaggacgacgccgucuaccucgacaacgagaaggagcgcgaggaguacguccucaacgacaucggcgucaucuucuacggcgaggucaacgacaucaagacccgcuccugguccuacggccaguucgaggacggcauccucgacaccugccucuacgucauggaccgcgcccagauggaccucuccggccgcggcaaccccaucaaggucucccgcgucggcuccgccauggucaacgccaaggacgacgagggcguccucgucggcuccugggacaacaucuacgccuacggcgucccccccuccgccuggaccggcuccgucgacauccuccucgaguaccgcuccuccgagaaccccguccgcuacggccagugcugggucuucgccggcgucuucaacaccuuccuccgcugccucggcauccccgcccgcaucgucaccaacuacuucuccgcccacgacaacgacgccaaccuccagauggacaucuuccucgaggaggacggcaacgucaacuccaagcucaccaaggacuccgucuggaacuaccacugcuggaacgaggccuggaugacccgccccgaccuccccgucggcuucggcggcuggcaggccgucgacuccaccccccaggagaacuccgacggcauguaccgcugcggccccgccuccguccaggccaucaagcacggccacgucugcuuccaguucgacgcccccuucgucuucgccgaggucaacuccgaccucaucuacaucaccgccaagaaggacggcacccacgucgucgagaacgucgacgccacccacaucggcaagcucaucgucaccaagcagaucggcggcgacggcaugauggacaucaccgacaccuacaaguuccaggagggccaggaggaggagcgccucgcccucgagaccgcccucauguacggcgccaagaagccccucaacaccgagggcgucaugaagucccgcuccaacgucgacauggacuucgaggucgagaacgccguccucggcaaggacuucaagcucuccaucaccuuccgcaacaacucccacaaccgcuacaccaucaccgccuaccucuccgccaacaucaccuucuacaccggcguccccaaggccgaguucaagaaggagaccuucgacgucacccucgagccccucuccuucaagaaggaggccguccucauccaggccggcgaguacaugggccagcuccucgagcaggccucccuccacuucuucgucaccgcccgcaucaacgagacccgcgacguccucgccaagcagaaguccaccguccucaccauccccgagaucaucaucaagguccgcggcacccaggucgucggcuccgacaugaccgucaccgucgaguucaccaacccccucaaggagacccuccgcaacgucuggguccaccucgacggccccggcgucacccgccccaugaagaagauguuccgcgagauccgccccaacuccaccguccagugggaggaggucugccgccccugggucuccggccaccgcaagcucaucgccuccauguccuccgacucccuccgccacgucuacggcgagcucgacguccagauccagcgccgccccuccauguga

SEQ ID NO: 42920 - RNA, 1986 nt, Artificial Sequence
  derived and/or modified sequence opt2 from F13B__Homo_sapiens__NP_001985
augcgccucaagaaccucaccuucaucaucauccucaucaucuccggcgagcucuacgccgaggagaagcccugcggcuucccccacgucgagaacggccgcaucgcccaguacuacuacaccuucaaguccuucuacuuccccauguccaucgacaagaagcucuccuucuucugccucgccggcuacaccaccgaguccggccgccaggaggagcagaccaccugcaccaccgagggcuggucccccgagccccgcugcuucaagaagugcaccaagcccgaccucuccaacggcuacaucuccgacgucaagcuccucuacaagauccaggagaacaugcgcuacggcugcgccuccggcuacaagaccaccggcggcaaggacgaggaggucguccagugccucuccgacggcugguccucccagcccaccugccgcaaggagcacgagaccugccucgcccccgagcucuacaacggcaacuacuccaccacccagaagaccuucaaggucaaggacaagguccaguacgagugcgccaccggcuacuacaccgccggcggcaagaagaccgaggaggucgagugccucaccuacggcuggucccucacccccaagugcaccaagcucaagugcuccucccuccgccucaucgagaacggcuacuuccaccccgucaagcagaccuacgaggagggcgacgucguccaguucuucugccacgagaacuacuaccucuccggcuccgaccucauccagugcuacaacuucggcugguaccccgagucccccgucugcgagggccgccgcaaccgcugccccccccccccccuccccaucaacuccaagauccagacccacuccaccaccuaccgccacggcgagaucguccacaucgagugcgagcucaacuucgagauccacggcuccgccgagauccgcugcgaggacggcaaguggaccgagccccccaagugcaucgagggccaggagaaggucgccugcgaggagccccccuucaucgagaacggcgccgccaaccuccacuccaagaucuacuacaacggcgacaaggucaccuacgccugcaaguccggcuaccuccuccacggcuccaacgagaucaccugcaaccgcggcaaguggacccucccccccgagugcgucgagaacaacgagaacugcaagcacccccccgucgucaugaacggcgccgucgccgacggcauccucgccuccuacgccaccggcuccuccgucgaguaccgcugcaacgaguacuaccuccuccgcggcuccaagaucucccgcugcgagcagggcaagugguccuccccccccgucugccucgagcccugcaccgucaacgucgacuacaugaaccgcaacaacaucgagaugaaguggaaguacgagggcaagguccuccacggcgaccucaucgacuucgucugcaagcagggcuacgaccucuccccccucaccccccucuccgagcucuccguccagugcaaccgcggcgaggucaaguacccccucugcacccgcaaggaguccaagggcaugugcaccucccccccccucaucaagcacggcgucaucaucuccuccaccgucgacaccuacgagaacggcuccuccgucgaguaccgcugcuucgaccaccacuuccucgagggcucccgcgaggccuacugccucgacggcauguggaccacccccccccucugccucgagcccugcacccucuccuucaccgagauggagaagaacaaccuccuccucaagugggacuucgacaaccgcccccacauccuccacggcgaguacaucgaguucaucugccgcggcgacaccuaccccgccgagcucuacaucaccggcuccauccuccgcaugcagugcgaccgcggccagcucaaguacccccgcugcaucccccgccaguccacccucuccuaccaggagccccuccgcaccuga

SEQ ID NO: 42921 - RNA, 1869 nt, Artificial Sequence
  derived and/or modified sequence opt2 from F2__Homo_sapiens__NP_000497
auggcccacguccgcggccuccagcuccccggcugccucgcccucgccgcccucugcucccucguccacucccagcacgucuuccucgccccccagcaggcccgcucccuccuccagcgcguccgccgcgccaacaccuuccucgaggagguccgcaagggcaaccucgagcgcgagugcgucgaggagaccugcuccuacgaggaggccuucgaggcccucgaguccuccaccgccaccgacgucuucugggccaaguacaccgccugcgagaccgcccgcaccccccgcgacaagcucgccgccugccucgagggcaacugcgccgagggccucggcaccaacuaccgcggccacgucaacaucacccgcuccggcaucgagugccagcucuggcgcucccgcuacccccacaagcccgagaucaacuccaccacccaccccggcgccgaccuccaggagaacuucugccgcaaccccgacuccuccaccaccggccccuggugcuacaccaccgaccccaccguccgccgccaggagugcuccauccccgucugcggccaggaccaggucaccgucgccaugaccccccgcuccgagggcuccuccgucaaccucucccccccccucgagcagugcguccccgaccgcggccagcaguaccagggccgccucgccgucaccacccacggccuccccugccucgccugggccuccgcccaggccaaggcccucuccaagcaccaggacuucaacuccgccguccagcucgucgagaacuucugccgcaaccccgacggcgacgaggagggcgucuggugcuacgucgccggcaagcccggcgacuucggcuacugcgaccucaacuacugcgaggaggccgucgaggaggagaccggcgacggccucgacgaggacuccgaccgcgccaucgagggccgcaccgccaccuccgaguaccagaccuucuucaacccccgcaccuucggcuccggcgaggccgacugcggccuccgcccccucuucgagaagaagucccucgaggacaagaccgagcgcgagcuccucgaguccuacaucgacggccgcaucgucgagggcuccgacgccgagaucggcaugucccccuggcaggucaugcucuuccgcaaguccccccaggagcuccucugcggcgccucccucaucuccgaccgcuggguccucaccgccgcccacugccuccucuacccccccugggacaagaacuucaccgagaacgaccuccucguccgcaucggcaagcacucccgcacccgcuacgagcgcaacaucgagaagaucuccaugcucgagaagaucuacauccacccccgcuacaacuggcgcgagaaccucgaccgcgacaucgcccucaugaagcucaagaagcccgucgccuucuccgacuacauccaccccgucugccuccccgaccgcgagaccgccgccucccuccuccaggccggcuacaagggccgcgucaccggcuggggcaaccucaaggagaccuggaccgccaacgucggcaagggccagcccuccguccuccaggucgucaaccuccccaucgucgagcgccccgucugcaaggacuccacccgcauccgcaucaccgacaacauguucugcgccggcuacaagcccgacgagggcaagcgcggcgacgccugcgagggcgacuccggcggccccuucgucaugaagucccccuucaacaaccgcugguaccagaugggcaucgucuccuggggcgagggcugcgaccgcgacggcaaguacggcuucuacacccacgucuuccgccucaagaaguggauccagaaggucaucgaccaguucggcgaguga

SEQ ID NO: 42922 - RNA, 1278 nt, Artificial Sequence
  derived and/or modified sequence opt2 from F2R__Homo_sapiens__NP_001983
augggcccccgccgccuccuccucgucgccgccugcuucucccucugcggcccccuccucuccgcccgcacccgcgcccgccgccccgaguccaaggccaccaacgccacccucgacccccgcuccuuccuccuccgcaaccccaacgacaaguacgagcccuucugggaggacgaggagaagaacgaguccggccucaccgaguaccgccucgucuccaucaacaaguccuccccccuccagaagcagcuccccgccuucaucuccgaggacgccuccggcuaccucaccuccuccuggcucacccucuucguccccuccgucuacaccggcgucuucgucgucucccucccccucaacaucauggccaucgucgucuucauccucaagaugaaggucaagaagcccgccgucgucuacaugcuccaccucgccaccgccgacguccucuucgucuccguccuccccuucaagaucuccuacuacuucuccggcuccgacuggcaguucggcuccgagcucugccgcuucgucaccgccgccuucuacugcaacauguacgccuccauccuccucaugaccgucaucuccaucgaccgcuuccucgccgucgucuaccccaugcagucccucuccuggcgcacccucggccgcgccuccuucaccugccucgccaucugggcccucgccaucgccggcgucgucccccuccuccucaaggagcagaccauccagguccccggccucaacaucaccaccugccacgacguccucaacgagacccuccucgagggcuacuacgccuacuacuucuccgccuucuccgccgucuucuucuucgucccccucaucaucuccaccgucugcuacgucuccaucauccgcugccucuccuccuccgccgucgccaaccgcuccaagaagucccgcgcccucuuccucuccgccgccgucuucugcaucuucaucaucugcuucggccccaccaacguccuccucaucgcccacuacuccuuccucucccacaccuccaccaccgaggccgccuacuucgccuaccuccucugcgucugcgucuccuccaucuccugcugcaucgacccccucaucuacuacuacgccuccuccgagugccagcgcuacgucuacuccauccucugcugcaaggaguccuccgaccccuccuccuacaacuccuccggccagcucauggccuccaagauggacaccugcuccuccaaccucaacaacuccaucuacaagaagcuccucaccuga

SEQ ID NO: 42923 - RNA, 1194 nt, Artificial Sequence
  derived and/or modified sequence opt2 from F2RL1__Homo_sapiens__NP_005233
augcgcucccccuccgccgccuggcuccucggcgccgccauccuccucgccgccucccucuccugcuccggcaccauccagggcaccaaccgcuccuccaagggccgcucccucaucggcaaggucgacggcaccucccacgucaccggcaagggcgucaccgucgagaccgucuucuccgucgacgaguucuccgccuccguccucaccggcaagcucaccaccgucuuccuccccaucgucuacaccaucgucuucgucgucggccuccccuccaacggcauggcccucugggucuuccucuuccgcaccaagaagaagcaccccgccgucaucuacauggccaaccucgcccucgccgaccuccucuccgucaucugguucccccucaagaucgccuaccacauccacggcaacaacuggaucuacggcgaggcccucugcaacguccucaucggcuucuucuacggcaacauguacugcuccauccucuucaugaccugccucuccguccagcgcuacugggucaucgucaaccccaugggccacucccgcaagaaggccaacaucgccaucggcaucucccucgccaucuggcuccucauccuccucgucaccaucccccucuacgucgucaagcagaccaucuucauccccgcccucaacaucaccaccugccacgacguccuccccgagcagcuccucgucggcgacauguucaacuacuuccucucccucgccaucggcgucuuccucuuccccgccuuccucaccgccuccgccuacguccucaugauccgcaugcuccgcuccuccgccauggacgagaacuccgagaagaagcgcaagcgcgccaucaagcucaucgucaccguccucgccauguaccucaucugcuucacccccuccaaccuccuccucgucguccacuacuuccucaucaagucccagggccagucccacgucuacgcccucuacaucgucgcccucugccucuccacccucaacuccugcaucgaccccuucgucuacuacuucgucucccacgacuuccgcgaccacgccaagaacgcccuccucugccgcuccguccgcaccgucaagcagaugcaggucucccucaccuccaagaagcacucccgcaaguccuccuccuacuccuccuccuccaccaccgucaagaccuccuacuga

SEQ ID NO: 42924 - RNA, 1059 nt, Artificial Sequence
  derived and/or modified sequence opt2 from F2RL2__Homo_sapiens__NP_001243495
auggagaacgacaccaacaaccucgccaagcccacccuccccaucaagaccuuccgcggcgccccccccaacuccuucgaggaguuccccuucuccgcccucgagggcuggaccggcgccaccaucaccgucaagaucaagugccccgaggaguccgccucccaccuccacgucaagaacgccaccaugggcuaccucaccuccucccucuccaccaagcucauccccgccaucuaccuccucgucuucgucgucggcguccccgccaacgccgucacccucuggaugcucuucuuccgcacccgcuccaucugcaccaccgucuucuacaccaaccucgccaucgccgacuuccucuucugcgucacccuccccuucaagaucgccuaccaccucaacggcaacaacugggucuucggcgagguccucugccgcgccaccaccgucaucuucuacggcaacauguacugcuccauccuccuccucgccugcaucuccaucaaccgcuaccucgccaucguccaccccuucaccuaccgcggccuccccaagcacaccuacgcccucgucaccugcggccucgucugggccaccgucuuccucuacaugcuccccuucuucauccucaagcaggaguacuaccucguccagcccgacaucaccaccugccacgacguccacaacaccugcgaguccuccucccccuuccagcucuacuacuucaucucccucgccuucuucggcuuccucauccccuucguccucaucaucuacugcuacgccgccaucauccgcacccucaacgccuacgaccaccgcuggcucugguacgucaaggccucccuccucauccucgucaucuucaccaucugcuucgcccccuccaacaucauccucaucauccaccacgccaacuacuacuacaacaacaccgacggccucuacuucaucuaccucaucgcccucugccucggcucccucaacuccugccucgaccccuuccucuacuuccucauguccaagacccgcaaccacuccaccgccuaccucaccaaguga

SEQ ID NO: 42925 - RNA, 1158 nt, Artificial Sequence
  derived and/or modified sequence opt2 from F2RL3__Homo_sapiens__NP_003941
auguggggccgccuccuccucuggccccucguccucggcuucucccucuccggcggcacccagacccccuccgucuacgacgaguccggcuccaccggcggcggcgacgacuccacccccuccauccuccccgccccccgcggcuaccccggccaggucugcgccaacgacuccgacacccucgagcuccccgacuccucccgcgcccuccuccucggcuggguccccacccgccucguccccgcccucuacggccucguccucgucgucggccuccccgccaacggccucgcccucuggguccucgccacccaggccccccgccuccccuccaccaugcuccucaugaaccucgccgccgccgaccuccuccucgcccucgcccuccccccccgcaucgccuaccaccuccgcggccagcgcuggcccuucggcgaggccgccugccgccucgccaccgccgcccucuacggccacauguacggcuccguccuccuccucgccgccgucucccucgaccgcuaccucgcccucguccacccccuccgcgcccgcgcccuccgcggccgccgccucgcccucggccucugcauggccgccuggcucauggccgccgcccucgcccucccccucacccuccagcgccagaccuuccgccucgcccgcuccgaccgcguccucugccacgacgcccucccccucgacgcccaggccucccacuggcagcccgccuucaccugccucgcccuccucggcugcuuccucccccuccucgccaugcuccucugcuacggcgccacccuccacacccucgccgccuccggccgccgcuacggccacgcccuccgccucaccgccgucguccucgccuccgccgucgccuucuucguccccuccaaccuccuccuccuccuccacuacuccgaccccucccccuccgccuggggcaaccucuacggcgccuacguccccucccucgcccucuccacccucaacuccugcgucgaccccuucaucuacuacuacgucuccgccgaguuccgcgacaagguccgcgccggccucuuccagcgcucccccggcgacaccgucgccuccaaggccuccgccgagggcggcucccgcggcaugggcacccacuccucccuccuccaguga

SEQ ID NO: 42926 - RNA, 6675 nt, Artificial Sequence
  derived and/or modified sequence opt2 from F5__Homo_sapiens__NP_000121
auguuccccggcugcccccgccucuggguccucgucguccucggcaccuccugggucggcuggggcucccagggcaccgaggccgcccagcuccgccaguucuacgucgccgcccagggcaucuccugguccuaccgccccgagcccaccaacuccucccucaaccucuccgucaccuccuucaagaagaucgucuaccgcgaguacgagcccuacuucaagaaggagaagccccaguccaccaucuccggccuccucggccccacccucuacgccgaggucggcgacaucaucaagguccacuucaagaacaaggccgacaagccccucuccauccacccccagggcauccgcuacuccaagcucuccgagggcgccuccuaccucgaccacaccuuccccgccgagaagauggacgacgccgucgcccccggccgcgaguacaccuacgagugguccaucuccgaggacuccggccccacccacgacgacccccccugccucacccacaucuacuacucccacgagaaccucaucgaggacuucaacuccggccucaucggcccccuccucaucugcaagaagggcacccucaccgagggcggcacccagaagaccuucgacaagcagaucguccuccucuucgccgucuucgacgaguccaaguccuggucccaguccuccucccucauguacaccgucaacggcuacgucaacggcaccaugcccgacaucaccgucugcgcccacgaccacaucuccuggcaccuccucggcauguccuccggccccgagcucuucuccauccacuucaacggccagguccucgagcagaaccaccacaaggucuccgccaucacccucgucuccgccaccuccaccaccgccaacaugaccgucggccccgagggcaaguggaucaucuccucccucacccccaagcaccuccaggccggcaugcaggccuacaucgacaucaagaacugccccaagaagacccgcaaccucaagaagaucacccgcgagcagcgccgccacaugaagcgcugggaguacuucaucgccgccgaggaggucaucugggacuacgcccccgucauccccgccaacauggacaagaaguaccgcucccagcaccucgacaacuucuccaaccagaucggcaagcacuacaagaaggucauguacacccaguacgaggacgaguccuucaccaagcacaccgucaaccccaacaugaaggaggacggcauccucggccccaucauccgcgcccagguccgcgacacccucaagaucgucuucaagaacauggccucccgccccuacuccaucuacccccacggcgucaccuucucccccuacgaggacgaggucaacuccuccuucaccuccggccgcaacaacaccaugauccgcgccguccagcccggcgagaccuacaccuacaaguggaacauccucgaguucgacgagcccaccgagaacgacgcccagugccucacccgccccuacuacuccgacgucgacaucaugcgcgacaucgccuccggccucaucggccuccuccucaucugcaagucccgcucccucgaccgccgcggcauccagcgcgccgccgacaucgagcagcaggccgucuucgccgucuucgacgagaacaaguccugguaccucgaggacaacaucaacaaguucugcgagaaccccgacgaggucaagcgcgacgaccccaaguucuacgaguccaacaucauguccaccaucaacggcuacguccccgaguccaucaccacccucggcuucugcuucgacgacaccguccaguggcacuucugcuccgucggcacccagaacgagauccucaccauccacuucaccggccacuccuucaucuacggcaagcgccacgaggacacccucacccucuuccccaugcgcggcgaguccgucaccgucaccauggacaacgucggcaccuggaugcucaccuccaugaacuccuccccccgcuccaagaagcuccgccucaaguuccgcgacgucaagugcauccccgacgacgacgaggacuccuacgagaucuucgagccccccgaguccaccgucauggccacccgcaagaugcacgaccgccucgagcccgaggacgaggaguccgacgccgacuacgacuaccagaaccgccucgccgccgcccucggcauccgcuccuuccgcaacuccucccucaaccaggaggaggaggaguucaaccucaccgcccucgcccucgagaacggcaccgaguucgucuccuccaacaccgacaucaucgucggcuccaacuacuccucccccuccaacaucuccaaguucaccgucaacaaccucgccgagccccagaaggcccccucccaccagcaggccaccaccgccggcuccccccuccgccaccucaucggcaagaacuccguccucaacuccuccaccgccgagcacuccucccccuacuccgaggaccccaucgaggacccccuccagcccgacgucaccggcauccgccuccucucccucggcgccggcgaguucaagucccaggagcacgccaagcacaagggccccaaggucgagcgcgaccaggccgccaagcaccgcuucuccuggaugaagcuccucgcccacaaggucggccgccaccucucccaggacaccggcucccccuccggcaugcgccccugggaggaccuccccucccaggacaccggcucccccucccgcaugcgccccuggaaggacccccccuccgaccuccuccuccucaagcaguccaacuccuccaagauccucgucggccgcuggcaccucgccuccgagaagggcuccuacgagaucauccaggacaccgacgaggacaccgccgucaacaacuggcucaucuccccccagaacgccucccgcgccuggggcgaguccaccccccucgccaacaagcccggcaagcaguccggccaccccaaguucccccgcguccgccacaagucccuccagguccgccaggacggcggcaagucccgccucaagaagucccaguuccucaucaagacccgcaagaagaagaaggagaagcacacccaccacgccccccucuccccccgcaccuuccacccccuccgcuccgaggccuacaacaccuucuccgagcgccgccucaagcacucccucguccuccacaaguccaacgagaccucccuccccaccgaccucaaccagacccuccccuccauggacuucggcuggaucgccucccuccccgaccacaaccagaacuccuccaacgacaccggccaggccuccugcccccccggccucuaccagaccgucccccccgaggagcacuaccagaccuuccccauccaggaccccgaccagaugcacuccaccuccgaccccucccaccgcuccuccucccccgagcucuccgagaugcucgaguacgaccgcucccacaaguccuuccccaccgacaucucccagaugucccccuccuccgagcacgaggucuggcagaccgucaucucccccgaccucucccaggucacccucucccccgagcucucccagaccaaccucucccccgaccucucccacaccacccucucccccgagcucauccagcgcaaccucucccccgcccucggccagaugcccaucucccccgaccucucccacaccacccucucccccgaccucucccacaccacccucucccucgaccucucccagaccaaccucucccccgagcucucccagaccaaccucucccccgcccucggccagaugccccucucccccgaccucucccacaccacccucucccucgacuucucccagaccaaccucucccccgagcucucccacaugacccucucccccgagcucucccagaccaaccucucccccgcccucggccagaugcccaucucccccgaccucucccacaccacccucucccucgacuucucccagaccaaccucucccccgagcucucccagaccaaccucucccccgcccucggccagaugccccucucccccgaccccucccacaccacccucucccucgaccucucccagaccaaccucucccccgagcucucccagaccaaccucucccccgaccucuccgagaugccccucuucgccgaccucucccagaucccccucacccccgaccucgaccagaugacccucucccccgaccucggcgagaccgaccucucccccaacuucggccagaugucccucucccccgaccucucccaggucacccucucccccgacaucuccgacaccacccuccuccccgaccucucccagaucucccccccccccgaccucgaccagaucuucuaccccuccgaguccucccagucccuccuccuccaggaguucaacgaguccuuccccuaccccgaccucggccagaugcccucccccuccucccccacccucaacgacaccuuccucuccaaggaguucaacccccucgucaucgucggccucuccaaggacggcaccgacuacaucgagaucauccccaaggaggagguccaguccuccgaggacgacuacgccgagaucgacuacguccccuacgacgaccccuacaagaccgacguccgcaccaacaucaacuccucccgcgaccccgacaacaucgccgccugguaccuccgcuccaacaacggcaaccgccgcaacuacuacaucgccgccgaggagaucuccugggacuacuccgaguucguccagcgcgagaccgacaucgaggacuccgacgacauccccgaggacaccaccuacaagaaggucgucuuccgcaaguaccucgacuccaccuucaccaagcgcgacccccgcggcgaguacgaggagcaccucggcauccucggccccaucauccgcgccgaggucgacgacgucauccagguccgcuucaagaaccucgccucccgccccuacucccuccacgcccacggccucuccuacgagaaguccuccgagggcaagaccuacgaggacgacucccccgagugguucaaggaggacaacgccguccagcccaacuccuccuacaccuacgucuggcacgccaccgagcgcuccggccccgagucccccggcuccgccugccgcgccugggccuacuacuccgccgucaaccccgagaaggacauccacuccggccucaucggcccccuccucaucugccagaagggcauccuccacaaggacuccaacaugcccauggacaugcgcgaguucguccuccucuucaugaccuucgacgagaagaaguccugguacuacgagaagaagucccgcuccuccuggcgccucaccuccuccgagaugaagaagucccacgaguuccacgccaucaacggcaugaucuacucccuccccggccucaagauguacgagcaggaguggguccgccuccaccuccucaacaucggcggcucccaggacauccacgucguccacuuccacggccagacccuccucgagaacggcaacaagcagcaccagcucggcgucuggccccuccuccccggcuccuucaagacccucgagaugaaggccuccaagcccggcugguggcuccucaacaccgaggucggcgagaaccagcgcgccggcaugcagacccccuuccucaucauggaccgcgacugccgcaugcccaugggccucuccaccggcaucaucuccgacucccagaucaaggccuccgaguuccucggcuacugggagccccgccucgcccgccucaacaacggcggcuccuacaacgccugguccgucgagaagcucgccgccgaguucgccuccaagcccuggauccaggucgacaugcagaaggaggucaucaucaccggcauccagacccagggcgccaagcacuaccucaaguccugcuacaccaccgaguucuacgucgccuacuccuccaaccagaucaacuggcagaucuucaagggcaacuccacccgcaacgucauguacuucaacggcaacuccgacgccuccaccaucaaggagaaccaguucgacccccccaucgucgcccgcuacauccgcaucucccccacccgcgccuacaaccgccccacccuccgccucgagcuccagggcugcgaggucaacggcugcuccaccccccucggcauggagaacggcaagaucgagaacaagcagaucaccgccuccuccuucaagaaguccugguggggcgacuacugggagcccuuccgcgcccgccucaacgcccagggccgcgucaacgccuggcaggccaaggccaacaacaacaagcaguggcucgagaucgaccuccucaagaucaagaagaucaccgccaucaucacccagggcugcaagucccucuccuccgagauguacgucaaguccuacaccauccacuacuccgagcagggcgucgaguggaagcccuaccgccucaaguccuccauggucgacaagaucuucgagggcaacaccaacaccaagggccacgucaagaacuucuucaacccccccaucaucucccgcuucauccgcgucauccccaagaccuggaaccaguccaucgcccuccgccucgagcucuucggcugcgacaucuacuga

SEQ ID NO: 42927 - RNA, 1401 nt, Artificial Sequence
  derived and/or modified sequence opt2 from F7__Homo_sapiens__NP_000122
auggucucccaggcccuccgccuccucugccuccuccucggccuccagggcugccucgccgccggcggcgucgccaaggccuccggcggcgagacccgcgacaugcccuggaagcccggcccccaccgcgucuucgucacccaggaggaggcccacggcguccuccaccgccgccgccgcgccaacgccuuccucgaggagcuccgccccggcucccucgagcgcgagugcaaggaggagcagugcuccuucgaggaggcccgcgagaucuucaaggacgccgagcgcaccaagcucuucuggaucuccuacuccgacggcgaccagugcgccuccucccccugccagaacggcggcuccugcaaggaccagcuccaguccuacaucugcuucugccuccccgccuucgagggccgcaacugcgagacccacaaggacgaccagcucaucugcgucaacgagaacggcggcugcgagcaguacugcuccgaccacaccggcaccaagcgcuccugccgcugccacgagggcuacucccuccucgccgacggcgucuccugcacccccaccgucgaguaccccugcggcaagauccccauccucgagaagcgcaacgccuccaagccccagggccgcaucgucggcggcaaggucugccccaagggcgagugccccuggcagguccuccuccucgucaacggcgcccagcucugcggcggcacccucaucaacaccaucugggucgucuccgccgcccacugcuucgacaagaucaagaacuggcgcaaccucaucgccguccucggcgagcacgaccucuccgagcacgacggcgacgagcagucccgccgcgucgcccaggucaucauccccuccaccuacguccccggcaccaccaaccacgacaucgcccuccuccgccuccaccagcccgucguccucaccgaccacgucgucccccucugccuccccgagcgcaccuucuccgagcgcacccucgccuucguccgcuucucccucgucuccggcuggggccagcuccucgaccgcggcgccaccgcccucgagcucaugguccucaacgucccccgccucaugacccaggacugccuccagcagucccgcaaggucggcgacucccccaacaucaccgaguacauguucugcgccggcuacuccgacggcuccaaggacuccugcaagggcgacuccggcggcccccacgccacccacuaccgcggcaccugguaccucaccggcaucgucuccuggggccagggcugcgccaccgucggccacuucggcgucuacacccgcgucucccaguacaucgaguggcuccagaagcucaugcgcuccgagccccgccccggcguccuccuccgcgcccccuuccccuga

SEQ ID NO: 42928 - RNA, 7056 nt, Artificial Sequence
  derived and/or modified sequence opt2 from F8__Homo_sapiens__NP_000123
augcagaucgagcucuccaccugcuucuuccucugccuccuccgcuucugcuucuccgccacccgccgcuacuaccucggcgccgucgagcucuccugggacuacaugcaguccgaccucggcgagcuccccgucgacgcccgcuuccccccccgcguccccaaguccuuccccuucaacaccuccgucgucuacaagaagacccucuucgucgaguucaccgaccaccucuucaacaucgccaagccccgcccccccuggaugggccuccucggccccaccauccaggccgaggucuacgacaccgucgucaucacccucaagaacauggccucccaccccgucucccuccacgccgucggcgucuccuacuggaaggccuccgagggcgccgaguacgacgaccagaccucccagcgcgagaaggaggacgacaaggucuuccccggcggcucccacaccuacgucuggcagguccucaaggagaacggccccauggccuccgacccccucugccucaccuacuccuaccucucccacgucgaccucgucaaggaccucaacuccggccucaucggcgcccuccucgucugccgcgagggcucccucgccaaggagaagacccagacccuccacaaguucauccuccucuucgccgucuucgacgagggcaaguccuggcacuccgagaccaagaacucccucaugcaggaccgcgacgccgccuccgcccgcgccuggcccaagaugcacaccgucaacggcuacgucaaccgcucccuccccggccucaucggcugccaccgcaaguccgucuacuggcacgucaucggcaugggcaccacccccgagguccacuccaucuuccucgagggccacaccuuccucguccgcaaccaccgccaggccucccucgagaucucccccaucaccuuccucaccgcccagacccuccucauggaccucggccaguuccuccucuucugccacaucuccucccaccagcacgacggcauggaggccuacgucaaggucgacuccugccccgaggagccccagcuccgcaugaagaacaacgaggaggccgaggacuacgacgacgaccucaccgacuccgagauggacgucguccgcuucgacgacgacaacucccccuccuucauccagauccgcuccgucgccaagaagcaccccaagaccuggguccacuacaucgccgccgaggaggaggacugggacuacgccccccucguccucgcccccgacgaccgcuccuacaagucccaguaccucaacaacggcccccagcgcaucggccgcaaguacaagaagguccgcuucauggccuacaccgacgagaccuucaagacccgcgaggccauccagcacgaguccggcauccucggcccccuccucuacggcgaggucggcgacacccuccucaucaucuucaagaaccaggccucccgccccuacaacaucuacccccacggcaucaccgacguccgcccccucuacucccgccgccuccccaagggcgucaagcaccucaaggacuuccccauccuccccggcgagaucuucaaguacaaguggaccgucaccgucgaggacggccccaccaaguccgacccccgcugccucacccgcuacuacuccuccuucgucaacauggagcgcgaccucgccuccggccucaucggcccccuccucaucugcuacaaggaguccgucgaccagcgcggcaaccagaucauguccgacaagcgcaacgucauccucuucuccgucuucgacgagaaccgcuccugguaccucaccgagaacauccagcgcuuccuccccaaccccgccggcguccagcucgaggaccccgaguuccaggccuccaacaucaugcacuccaucaacggcuacgucuucgacucccuccagcucuccgucugccuccacgaggucgccuacugguacauccucuccaucggcgcccagaccgacuuccucuccgucuucuucuccggcuacaccuucaagcacaagauggucuacgaggacacccucacccucuuccccuucuccggcgagaccgucuucauguccauggagaaccccggccucuggauccucggcugccacaacuccgacuuccgcaaccgcggcaugaccgcccuccucaaggucuccuccugcgacaagaacaccggcgacuacuacgaggacuccuacgaggacaucuccgccuaccuccucuccaagaacaacgccaucgagccccgcuccuucucccagaacucccgccaccccuccacccgccagaagcaguucaacgccaccaccauccccgagaacgacaucgagaagaccgaccccugguucgcccaccgcacccccaugcccaagauccagaacgucuccuccuccgaccuccucaugcuccuccgccagucccccaccccccacggccucucccucuccgaccuccaggaggccaaguacgagaccuucuccgacgaccccucccccggcgccaucgacuccaacaacucccucuccgagaugacccacuuccgcccccagcuccaccacuccggcgacauggucuucacccccgaguccggccuccagcuccgccucaacgagaagcucggcaccaccgccgccaccgagcucaagaagcucgacuucaaggucuccuccaccuccaacaaccucaucuccaccauccccuccgacaaccucgccgccggcaccgacaacaccuccucccucggcccccccuccaugcccguccacuacgacucccagcucgacaccacccucuucggcaagaaguccuccccccucaccgaguccggcggcccccucucccucuccgaggagaacaacgacuccaagcuccucgaguccggccucaugaacucccaggaguccuccuggggcaagaacgucuccuccaccgaguccggccgccucuucaagggcaagcgcgcccacggccccgcccuccucaccaaggacaacgcccucuucaaggucuccaucucccuccucaagaccaacaagaccuccaacaacuccgccaccaaccgcaagacccacaucgacggccccucccuccucaucgagaacucccccuccgucuggcagaacauccucgaguccgacaccgaguucaagaaggucaccccccucauccacgaccgcaugcucauggacaagaacgccaccgcccuccgccucaaccacauguccaacaagaccaccuccuccaagaacauggagaugguccagcagaagaaggagggccccaucccccccgacgcccagaaccccgacauguccuucuucaagaugcucuuccuccccgaguccgcccgcuggauccagcgcacccacggcaagaacucccucaacuccggccagggccccucccccaagcagcucgucucccucggccccgagaaguccgucgagggccagaacuuccucuccgagaagaacaaggucgucgucggcaagggcgaguucaccaaggacgucggccucaaggagauggucuuccccuccucccgcaaccucuuccucaccaaccucgacaaccuccacgagaacaacacccacaaccaggagaagaagauccaggaggagaucgagaagaaggagacccucauccaggagaacgucguccucccccagauccacaccgucaccggcaccaagaacuucaugaagaaccucuuccuccucuccacccgccagaacgucgagggcuccuacgacggcgccuacgcccccguccuccaggacuuccgcucccucaacgacuccaccaaccgcaccaagaagcacaccgcccacuucuccaagaagggcgaggaggagaaccucgagggccucggcaaccagaccaagcagaucgucgagaaguacgccugcaccacccgcaucucccccaacaccucccagcagaacuucgucacccagcgcuccaagcgcgcccucaagcaguuccgccucccccucgaggagaccgagcucgagaagcgcaucaucgucgacgacaccuccacccagugguccaagaacaugaagcaccucacccccuccacccucacccagaucgacuacaacgagaaggagaagggcgccaucacccaguccccccucuccgacugccucacccgcucccacuccaucccccaggccaaccgcuccccccuccccaucgccaaggucuccuccuuccccuccauccgccccaucuaccucacccgcguccucuuccaggacaacuccucccaccuccccgccgccuccuaccgcaagaaggacuccggcguccaggaguccucccacuuccuccagggcgccaagaagaacaaccucucccucgccauccucacccucgagaugaccggcgaccagcgcgaggucggcucccucggcaccuccgccaccaacuccgucaccuacaagaaggucgagaacaccguccuccccaagcccgaccuccccaagaccuccggcaaggucgagcuccuccccaagguccacaucuaccagaaggaccucuuccccaccgagaccuccaacggcucccccggccaccucgaccucgucgagggcucccuccuccagggcaccgagggcgccaucaaguggaacgaggccaaccgccccggcaagguccccuuccuccgcgucgccaccgaguccuccgccaagacccccuccaagcuccucgacccccucgccugggacaaccacuacggcacccagauccccaaggaggaguggaagucccaggagaagucccccgagaagaccgccuucaagaagaaggacaccauccucucccucaacgccugcgaguccaaccacgccaucgccgccaucaacgagggccagaacaagcccgagaucgaggucaccugggccaagcagggccgcaccgagcgccucugcucccagaacccccccguccucaagcgccaccagcgcgagaucacccgcaccacccuccaguccgaccaggaggagaucgacuacgacgacaccaucuccgucgagaugaagaaggaggacuucgacaucuacgacgaggacgagaaccaguccccccgcuccuuccagaagaagacccgccacuacuucaucgccgccgucgagcgccucugggacuacggcauguccuccuccccccacguccuccgcaaccgcgcccaguccggcuccgucccccaguucaagaaggucgucuuccaggaguucaccgacggcuccuucacccagccccucuaccgcggcgagcucaacgagcaccucggccuccucggccccuacauccgcgccgaggucgaggacaacaucauggucaccuuccgcaaccaggccucccgccccuacuccuucuacuccucccucaucuccuacgaggaggaccagcgccagggcgccgagccccgcaagaacuucgucaagcccaacgagaccaagaccuacuucuggaagguccagcaccacauggcccccaccaaggacgaguucgacugcaaggccugggccuacuucuccgacgucgaccucgagaaggacguccacuccggccucaucggcccccuccucgucugccacaccaacacccucaaccccgcccacggccgccaggucaccguccaggaguucgcccucuucuucaccaucuucgacgagaccaaguccugguacuucaccgagaacauggagcgcaacugccgcgcccccugcaacauccagauggaggaccccaccuucaaggagaacuaccgcuuccacgccaucaacggcuacaucauggacacccuccccggccucgucauggcccaggaccagcgcauccgcugguaccuccucuccaugggcuccaacgagaacauccacuccauccacuucuccggccacgucuucaccguccgcaagaaggaggaguacaagauggcccucuacaaccucuaccccggcgucuucgagaccgucgagaugcuccccuccaaggccggcaucuggcgcgucgagugccucaucggcgagcaccuccacgccggcauguccacccucuuccucgucuacuccaacaagugccagaccccccucggcauggccuccggccacauccgcgacuuccagaucaccgccuccggccaguacggccagugggcccccaagcucgcccgccuccacuacuccggcuccaucaacgccugguccaccaaggagcccuucuccuggaucaaggucgaccuccucgcccccaugaucauccacggcaucaagacccagggcgcccgccagaaguucuccucccucuacaucucccaguucaucaucauguacucccucgacggcaagaaguggcagaccuaccgcggcaacuccaccggcacccucauggucuucuucggcaacgucgacuccuccggcaucaagcacaacaucuucaacccccccaucaucgcccgcuacauccgccuccaccccacccacuacuccauccgcuccacccuccgcauggagcucaugggcugcgaccucaacuccugcuccaugccccucggcauggaguccaaggccaucuccgacgcccagaucaccgccuccuccuacuucaccaacauguucgccaccuggucccccuccaaggcccgccuccaccuccagggccgcuccaacgccuggcgcccccaggucaacaaccccaaggaguggcuccaggucgacuuccagaagaccaugaaggucaccggcgucaccacccagggcgucaagucccuccucaccuccauguacgucaaggaguuccucaucuccuccucccaggacggccaccaguggacccucuucuuccagaacggcaaggucaaggucuuccagggcaaccaggacuccuucacccccgucgucaacucccucgaccccccccuccucacccgcuaccuccgcauccacccccaguccuggguccaccagaucgcccuccgcauggagguccucggcugcgaggcccaggaccucuacuga

SEQ ID NO: 42929 - RNA, 1386 nt, Artificial Sequence
  derived and/or modified sequence opt2 from F9__Homo_sapiens__NP_000124
augcagcgcgucaacaugaucauggccgagucccccggccucaucaccaucugccuccucggcuaccuccucuccgccgagugcaccgucuuccucgaccacgagaacgccaacaagauccucaaccgccccaagcgcuacaacuccggcaagcucgaggaguucguccagggcaaccucgagcgcgagugcauggaggagaagugcuccuucgaggaggcccgcgaggucuucgagaacaccgagcgcaccaccgaguucuggaagcaguacgucgacggcgaccagugcgaguccaaccccugccucaacggcggcuccugcaaggacgacaucaacuccuacgagugcuggugccccuucggcuucgagggcaagaacugcgagcucgacgucaccugcaacaucaagaacggccgcugcgagcaguucugcaagaacuccgccgacaacaaggucgucugcuccugcaccgagggcuaccgccucgccgagaaccagaaguccugcgagcccgccguccccuuccccugcggccgcgucuccgucucccagaccuccaagcucacccgcgccgagaccgucuuccccgacgucgacuacgucaacuccaccgaggccgagaccauccucgacaacaucacccaguccacccaguccuucaacgacuucacccgcgucgucggcggcgaggacgccaagcccggccaguuccccuggcaggucguccucaacggcaaggucgacgccuucugcggcggcuccaucgucaacgagaaguggaucgucaccgccgcccacugcgucgagaccggcgucaagaucaccgucgucgccggcgagcacaacaucgaggagaccgagcacaccgagcagaagcgcaacgucauccgcaucaucccccaccacaacuacaacgccgccaucaacaaguacaaccacgacaucgcccuccucgagcucgacgagccccucguccucaacuccuacgucacccccaucugcaucgccgacaaggaguacaccaacaucuuccucaaguucggcuccggcuacgucuccggcuggggccgcgucuuccacaagggccgcuccgcccucguccuccaguaccuccgcgucccccucgucgaccgcgccaccugccuccgcuccaccaaguucaccaucuacaacaacauguucugcgccggcuuccacgagggcggccgcgacuccugccagggcgacuccggcggcccccacgucaccgaggucgagggcaccuccuuccucaccggcaucaucuccuggggcgaggagugcgccaugaagggcaaguacggcaucuacaccaaggucucccgcuacgucaacuggaucaaggagaagaccaagcucaccuga

SEQ ID NO: 42930 - RNA, 1119 nt, Artificial Sequence
  derived and/or modified sequence opt2 from FA2H__Homo_sapiens__NP_077282
auggcccccgcccccccccccgccgccuccuucucccccuccgagguccagcgccgccucgccgccggcgccugcuggguccgccgcggcgcccgccucuacgaccucuccuccuucguccgccaccaccccggcggcgagcagcuccuccgcgcccgcgccggccaggacaucuccgccgaccucgacggccccccccaccgccacuccgccaacgcccgccgcuggcucgagcaguacuacgucggcgagcuccgcggcgagcagcagggcuccauggagaacgagcccgucgcccucgaggagacccagaagaccgaccccgccauggagccccgcuucaaggucgucgacugggacaaggaccucgucgacuggcgcaagccccuccucuggcaggucggccaccucggcgagaaguacgacgaguggguccaccagcccgucacccgccccauccgccucuuccacuccgaccucaucgagggccucuccaagaccgucugguacuccguccccaucaucugggucccccucguccucuaccucuccugguccuacuaccgcaccuucgcccagggcaacguccgccucuucaccuccuucaccaccgaguacaccgucgccguccccaaguccauguuccccggccucuucaugcucggcaccuuccucuggucccucaucgaguaccucauccaccgcuuccucuuccacaugaagccccccuccgacuccuacuaccucaucaugcuccacuucgucaugcacggccagcaccacaaggcccccuucgacggcucccgccucgucuucccccccguccccgccucccucgucaucggcgucuucuaccucugcaugcagcucauccuccccgaggccgucggcggcaccgucuucgccggcggccuccucggcuacguccucuacgacaugacccacuacuaccuccacuucggcuccccccacaagggcuccuaccucuacucccucaaggcccaccacgucaagcaccacuucgcccaccagaaguccggcuucggcaucuccaccaagcucugggacuacugcuuccacacccucacccccgagaagccccaccucaagacccaguga

SEQ ID NO: 42931 - RNA, 1599 nt, Artificial Sequence
  derived and/or modified sequence opt2 from FAAH2__Homo_sapiens__NP_777572
auggcccccuccuucaccgcccgcauccagcucuuccuccuccgcgcccucggcuuccucaucggccucgucggccgcgccgcccucguccucggcggccccaaguucgccuccaagaccccccgccccgucaccgagccccuccuccuccucuccggcaugcagcucgccaagcucauccgccagcgcaaggucaagugcaucgacgucguccaggccuacaucaaccgcaucaaggacgucaaccccaugaucaacggcaucgucaaguaccgcuucgaggaggccaugaaggaggcccacgccgucgaccagaagcucgccgagaagcaggaggacgaggccacccucgagaacaaguggcccuuccucggcgucccccucaccgucaaggaggccuuccagcuccagggcaugcccaacuccuccggccucaugaaccgccgcgacgccaucgccaagaccgacgccaccgucgucgcccuccucaagggcgccggcgccaucccccucggcaucaccaacugcuccgagcucugcaugugguacgaguccuccaacaagaucuacggccgcuccaacaaccccuacgaccuccagcacaucgucggcggcuccuccggcggcgagggcugcacccucgccgccgccugcuccgucaucggcgucggcuccgacaucggcggcuccauccgcaugcccgccuucuucaacggcaucuucggccacaagcccucccccggcgucguccccaacaagggccaguucccccucgccgucggcgcccaggagcucuuccucugcaccggccccaugugccgcuacgccgaggaccucgcccccaugcucaaggucauggccggccccggcaucaagcgccucaagcucgacaccaagguccaccucaaggaccucaaguucuacuggauggagcacgacggcggcuccuuccucauguccaaggucgaccaggaccucaucaugacccagaagaaggucgucguccaccucgagaccauccucggcgccuccguccagcacgucaagcucaagaagaugaaguacuccuuccagcucuggaucgccaugauguccgccaagggccacgacggcaaggagcccgucaaguucgucgaccuccucggcgaccacggcaagcacgucuccccccucugggagcucaucaaguggugccucggccucuccgucuacaccauccccuccaucggccucgcccuccucgaggagaagcuccgcuacuccaacgagaaguaccagaaguucaaggccgucgaggagucccuccgcaaggagcucgucgacaugcucggcgacgacggcgucuuccucuaccccucccaccccaccgucgcccccaagcaccacgucccccucacccgccccuucaacuucgccuacaccggcgucuucuccgcccucggccuccccgucacccagugcccccucggccucaacgccaagggccucccccucggcauccaggucgucgccggccccuucaacgaccaccucacccucgccgucgcccaguaccucgagaagaccuucggcggcugggucugccccggcaaguucuga

SEQ ID NO: 42932 - RNA, 384 nt, Artificial Sequence
  derived and/or modified sequence opt2 from FABP1__Homo_sapiens__NP_001434
auguccuucuccggcaaguaccagcuccagucccaggagaacuucgaggccuucaugaaggccaucggccuccccgaggagcucauccagaagggcaaggacaucaagggcgucuccgagaucguccagaacggcaagcacuucaaguucaccaucaccgccggcuccaaggucauccagaacgaguucaccgucggcgaggagugcgagcucgagaccaugaccggcgagaaggucaagaccgucguccagcucgagggcgacaacaagcucgucaccaccuucaagaacaucaaguccgucaccgagcucaacggcgacaucaucaccaacaccaugacccucggcgacaucgucuucaagcgcaucuccaagcgcaucuga

SEQ ID NO: 42933 - RNA, 399 nt, Artificial Sequence
  derived and/or modified sequence opt2 from FABP2__Homo_sapiens__NP_000125
auggccuucgacuccaccuggaaggucgaccgcuccgagaacuacgacaaguucauggagaagaugggcgucaacaucgucaagcgcaagcucgccgcccacgacaaccucaagcucaccaucacccaggagggcaacaaguucaccgucaaggaguccuccaccuuccgcaacaucgaggucgucuucgagcucggcgucaccuucaacuacaaccucgccgacggcaccgagcuccgcggcaccuggucccucgagggcaacaagcucaucggcaaguucaagcgcaccgacaacggcaacgagcucaacaccguccgcgagaucaucggcgacgagcucguccagaccuacgucuacgagggcgucgaggccaagcgcaucuucaagaaggacuga

SEQ ID NO: 42934 - RNA, 399 nt, Artificial Sequence
  derived and/or modified sequence opt2 from FABP4__Homo_sapiens__NP_001433
augugcgacgccuucgucggcaccuggaagcucgucuccuccgagaacuucgacgacuacaugaaggaggucggcgucggcuucgccacccgcaaggucgccggcauggccaagcccaacaugaucaucuccgucaacggcgacgucaucaccaucaaguccgaguccaccuucaagaacaccgagaucuccuucauccucggccaggaguucgacgaggucaccgccgacgaccgcaaggucaaguccaccaucacccucgacggcggcguccucguccacguccagaagugggacggcaaguccaccaccaucaagcgcaagcgcgaggacgacaagcucgucgucgagugcgucaugaagggcgucaccuccacccgcgucuacgagcgcgccuga

SEQ ID NO: 42935 - RNA, 408 nt, Artificial Sequence
  derived and/or modified sequence opt2 from FABP5__Homo_sapiens__NP_001435
auggccaccguccagcagcucgagggccgcuggcgccucgucgacuccaagggcuucgacgaguacaugaaggagcucggcgucggcaucgcccuccgcaagaugggcgccauggccaagcccgacugcaucaucaccugcgacggcaagaaccucaccaucaagaccgaguccacccucaagaccacccaguucuccugcacccucggcgagaaguucgaggagaccaccgccgacggccgcaagacccagaccgucugcaacuucaccgacggcgcccucguccagcaccaggagugggacggcaaggaguccaccaucacccgcaagcucaaggacggcaagcucgucgucgagugcgucaugaacaacgucaccugcacccgcaucuacgagaaggucgaguga

SEQ ID NO: 42936 - RNA, 534 nt, Artificial Sequence
  derived and/or modified sequence opt2 from FABP6__Homo_sapiens__NP_001124430
augaagaccgucaccaugaugauggucgucgagaugcaggcccucacccagguccuccgcgccguccucuccgccugcaccugggucucccgcaagggcgaccuccagcgcaugaagcagacccacaagggcaagccccccuccuccauggccuucaccggcaaguucgagauggaguccgagaagaacuacgacgaguucaugaagcuccucggcaucuccuccgacgucaucgagaaggcccgcaacuucaagaucgucaccgagguccagcaggacggccaggacuucaccuggucccagcacuacuccggcggccacaccaugaccaacaaguucaccgucggcaaggaguccaacauccagaccaugggcggcaagaccuucaaggccaccguccagauggagggcggcaagcucgucgucaacuuccccaacuaccaccagaccuccgagaucgucggcgacaagcucgucgaggucuccaccaucggcggcgucaccuacgagcgcgucuccaagcgccucgccuga

SEQ ID NO: 42937 - RNA, 399 nt, Artificial Sequence
  derived and/or modified sequence opt2 from FABP7__Homo_sapiens__NP_001437
auggucgaggccuucugcgccaccuggaagcucaccaacucccagaacuucgacgaguacaugaaggcccucggcgucggcuucgccacccgccaggucggcaacgucaccaagcccaccgucaucaucucccaggagggcgacaaggucgucauccgcacccucuccaccuucaagaacaccgagaucuccuuccagcucggcgaggaguucgacgagaccaccgccgacgaccgcaacugcaaguccgucgucucccucgacggcgacaagcucguccacauccagaagugggacggcaaggagaccaacuucguccgcgagaucaaggacggcaagauggucaugacccucaccuucggcgacgucgucgccguccgccacuacgagaaggccuga

SEQ ID NO: 42938 - RNA, 399 nt, Artificial Sequence
  derived and/or modified sequence opt2 from FABP9__Homo_sapiens__NP_001073995
auggucgagcccuuccucggcaccuggaagcucgucuccuccgagaacuucgaggacuacaugaaggagcucggcgucaacuucgccgcccgcaacauggccggccucgucaagcccaccgucaccaucuccgucgacggcaagaugaugaccauccgcaccgaguccuccuuccaggacaccaagaucuccuucaagcucggcgaggaguucgacgagaccaccgccgacaaccgcaaggucaaguccaccaucacccucgagaacggcuccaugauccacguccagaaguggcucggcaaggagaccaccaucaagcgcaagaucgucgacgagaagauggucgucgagugcaagaugaacaacaucgucuccacccgcaucuacgagaaggucuga

SEQ ID NO: 42939 - RNA, 627 nt, Artificial Sequence
  derived and/or modified sequence opt2 from FADD__Homo_sapiens__NP_003815
auggaccccuuccucguccuccuccacuccgucuccuccucccucuccuccuccgagcucaccgagcucaaguuccucugccucggccgcgucggcaagcgcaagcucgagcgcguccaguccggccucgaccucuucuccaugcuccucgagcagaacgaccucgagcccggccacaccgagcuccuccgcgagcuccucgccucccuccgccgccacgaccuccuccgccgcgucgacgacuucgaggccggcgccgccgccggcgccgcccccggcgaggaggaccucugcgccgccuucaacgucaucugcgacaacgucggcaaggacuggcgccgccucgcccgccagcucaaggucuccgacaccaagaucgacuccaucgaggaccgcuacccccgcaaccucaccgagcgcguccgcgagucccuccgcaucuggaagaacaccgagaaggagaacgccaccgucgcccaccucgucggcgcccuccgcuccugccagaugaaccucgucgccgaccucguccaggagguccagcaggcccgcgaccuccagaaccgcuccggcgccaugucccccauguccuggaacuccgacgccuccaccuccgaggccuccuga

SEQ ID NO: 42940 - RNA, 1506 nt, Artificial Sequence
  derived and/or modified sequence opt2 from FADS1__Homo_sapiens__NP_037534
augggcacccgcgccgcccgccccgccggccuccccugcggcgccgagaaccccgcccgccgccgccucgcccucggcgcccgccagcagauccacuccugguccccccgcacccccuccacccgccucaccgcccccgccggccccgcccgcggcgucgcccgccccgccauggcccccgaccccgucgccgccgagaccgccgcccagggccccaccccccgcuacuucaccugggacgaggucgcccagcgcuccggcugcgaggagcgcuggcucgucaucgaccgcaaggucuacaacaucuccgaguucacccgccgccaccccggcggcucccgcgucaucucccacuacgccggccaggacgccaccgaccccuucgucgccuuccacaucaacaagggccucgucaagaaguacaugaacucccuccucaucggcgagcucucccccgagcagcccuccuucgagcccaccaagaacaaggagcucaccgacgaguuccgcgagcuccgcgccaccgucgagcgcaugggccucaugaaggccaaccacgucuucuuccuccucuaccuccuccacauccuccuccucgacggcgccgccuggcucacccucugggucuucggcaccuccuuccuccccuuccuccucugcgccguccuccucuccgccguccaggcccaggccggcuggcuccagcacgacuucggccaccucuccgucuucuccaccuccaaguggaaccaccuccuccaccacuucgucaucggccaccucaagggcgcccccgccuccugguggaaccacaugcacuuccagcaccacgccaagcccaacugcuuccgcaaggaccccgacaucaacaugcaccccuucuucuucgcccucggcaagauccucuccgucgagcucggcaagcagaagaagaaguacaugcccuacaaccaccagcacaaguacuucuuccucaucggcccccccgcccuccucccccucuacuuccagugguacaucuucuacuucgucauccagcgcaagaagugggucgaccucgccuggaugaucaccuucuacguccgcuucuuccucaccuacgucccccuccucggccucaaggccuuccucggccucuucuucaucguccgcuuccucgaguccaacugguucgucugggucacccagaugaaccacauccccaugcacaucgaccacgaccgcaacauggacugggucuccacccagcuccaggccaccugcaacguccacaaguccgccuucaacgacugguucuccggccaccucaacuuccagaucgagcaccaccucuuccccaccaugccccgccacaacuaccacaaggucgccccccucguccagucccucugcgccaagcacggcaucgaguaccaguccaagccccuccucuccgccuucgccgacaucauccacucccucaaggaguccggccagcucuggcucgacgccuaccuccaccaguga

SEQ ID NO: 42941 - RNA, 1269 nt, Artificial Sequence
  derived and/or modified sequence opt2 from FADS2__Homo_sapiens__NP_001268430
augcacggccgcgaggccggccccuucgucugcgucugcguccuccucgccuccauccccaccccccagaccccccuccuccaggccucccucccccccuuccaccccgccuccgccggccaccccaucaccggccagcaggacgccuuccgcgccuuccaccccgaccucgaguucgucggcaaguuccucaagccccuccucaucggcgagcucgcccccgaggagcccucccaggaccacggcaagaacuccaagaucaccgaggacuuccgcgcccuccgcaagaccgccgaggacaugaaccucuucaagaccaaccacgucuucuuccuccuccuccucgcccacaucaucgcccucgaguccaucgccugguucaccgucuucuacuucggcaacggcuggauccccacccucaucaccgccuucguccucgccaccucccaggcccaggccggcuggcuccagcacgacuacggccaccucuccgucuaccgcaagcccaaguggaaccaccucguccacaaguucgucaucggccaccucaagggcgccuccgccaacugguggaaccaccgccacuuccagcaccacgccaagcccaacaucuuccacaaggaccccgacgucaacaugcuccacgucuucguccucggcgaguggcagcccaucgaguacggcaagaagaagcucaaguaccuccccuacaaccaccagcacgaguacuucuuccucaucggccccccccuccucauccccauguacuuccaguaccagaucaucaugaccaugaucguccacaagaacugggucgaccucgccugggccgucuccuacuacauccgcuucuucaucaccuacauccccuucuacggcauccucggcgcccuccucuuccucaacuucauccgcuuccucgagucccacugguucgucugggucacccagaugaaccacaucgucauggagaucgaccaggaggccuaccgcgacugguucuccucccagcucaccgccaccugcaacgucgagcaguccuucuucaacgacugguucuccggccaccucaacuuccagaucgagcaccaccucuuccccaccaugccccgccacaaccuccacaagaucgccccccucgucaagucccucugcgccaagcacggcaucgaguaccaggagaagccccuccuccgcgcccuccucgacaucauccgcucccucaagaaguccggcaagcucuggcucgacgccuaccuccacaaguga

SEQ ID NO: 42942 - RNA, 1338 nt, Artificial Sequence
  derived and/or modified sequence opt2 from FADS3__Homo_sapiens__NP_068373
augggcggcgucggcgagcccggcccccgcgagggccccgcccagcccggcgccccccuccccaccuucugcugggagcagauccgcgcccacgaccagcccggcgacaaguggcucgucaucgagcgccgcgucuacgacaucucccgcugggcccagcgccaccccggcggcucccgccucaucggccaccacggcgccgaggacgccaccgacgccuuccgcgccuuccaccaggaccucaacuucguccgcaaguuccuccagccccuccucaucggcgagcucgcccccgaggagcccucccaggacggcccccucaacgcccagcucgucgaggacuuccgcgcccuccaccaggccgccgaggacaugaagcucuucgacgccucccccaccuucuucgccuuccuccucggccacauccucgccauggagguccucgccuggcuccucaucuaccuccucggccccggcuggguccccuccgcccucgccgccuucauccucgccaucucccaggcccaguccuggugccuccagcacgaccucggccacgccuccaucuucaagaaguccugguggaaccacgucgcccagaaguucgucaugggccagcucaagggcuucuccgcccacugguggaacuuccgccacuuccagcaccacgccaagcccaacaucuuccacaaggaccccgacgucaccgucgcccccgucuuccuccucggcgaguccuccgucgaguacggcaagaagaagcgccgcuaccuccccuacaaccagcagcaccucuacuucuuccucaucggccccccccuccucacccucgucaacuucgaggucgagaaccucgccuacaugcucgucugcaugcagugggccgaccuccucugggccgccuccuucuacgcccgcuucuuccucuccuaccuccccuucuacggcguccccggcguccuccucuucuucgucgccguccgcguccucgagucccacugguucgucuggaucacccagaugaaccacauccccaaggagaucggccacgagaagcaccgcgacugggucuccucccagcucgccgccaccugcaacgucgagcccucccucuucaccaacugguucuccggccaccucaacuuccagaucgagcaccaccucuucccccgcaugccccgccacaacuacucccgcgucgccccccucgucaagucccucugcgccaagcacggccucuccuacgaggucaagcccuuccucaccgcccucgucgacaucguccgcucccucaagaaguccggcgacaucuggcucgacgccuaccuccaccaguga

SEQ ID NO: 42943 - RNA, 1338 nt, Artificial Sequence
  derived and/or modified sequence opt2 from FAF2__Homo_sapiens__NP_055428
auggccgcccccgaggagcgcgaccucacccaggagcagaccgagaagcuccuccaguuccaggaccucaccggcaucgaguccauggaccagugccgccacacccucgagcagcacaacuggaacaucgaggccgccguccaggaccgccucaacgagcaggagggcguccccuccgucuucaaccccccccccucccgcccccuccaggucaacaccgccgaccaccgcaucuacuccuacgucgucucccgcccccagccccgcggccuccucggcuggggcuacuaccucaucaugcuccccuuccgcuucaccuacuacaccauccucgacaucuuccgcuucgcccuccgcuucauccgccccgacccccgcucccgcgucaccgaccccgucggcgacaucgucuccuucaugcacuccuucgaggagaaguacggccgcgcccaccccgucuucuaccagggcaccuacucccaggcccucaacgacgccaagcgcgagcuccgcuuccuccucgucuaccuccacggcgacgaccaccaggacuccgacgaguucugccgcaacacccucugcgcccccgaggucaucucccucaucaacacccgcaugcucuucugggccugcuccaccaacaagcccgagggcuaccgcgucucccaggcccuccgcgagaacaccuaccccuuccucgccaugaucaugcucaaggaccgccgcaugaccgucgucggccgccucgagggccucauccagcccgacgaccucaucaaccagcucaccuucaucauggacgccaaccagaccuaccucgucuccgagcgccucgagcgcgaggagcgcaaccagacccagguccuccgccagcagcaggacgaggccuaccucgccucccuccgcgccgaccaggagaaggagcgcaagaagcgcgaggagcgcgagcgcaagcgccgcaaggaggaggagguccagcagcagaagcucgccgaggagcgccgccgccagaaccuccaggaggagaaggagcgcaagcucgagugccucccccccgagcccucccccgacgaccccgaguccgucaagaucaucuucaagcuccccaacgacucccgcgucgagcgccgcuuccacuucucccagucccucaccgucauccacgacuuccucuucucccucaaggagucccccgagaaguuccagaucgaggccaacuucccccgccgcguccuccccugcauccccuccgaggaguggcccaacccccccacccuccaggaggccggccucucccacaccgagguccucuucguccaggaccucaccgacgaguga

SEQ ID NO: 42944 - RNA, 945 nt, Artificial Sequence
  derived and/or modified sequence opt2 from FAHD2A__Homo_sapiens__NP_057128
augcucgucuccggccgccgccgccuccucaccguccuccuccaggcccagaaguggcccuuccagcccucccgcgacaugcgccucguccaguuccgcgccccccaccucgucggcccccaccucggccucgagaccggcaacggcggcggcgucaucaaccucaacgccuucgaccccacccuccccaagaccaugacccaguuccucgagcagggcgaggccacccucuccgucgcccgccgcgcccucgccgcccagcuccccguccucccccgcuccgaggucaccuuccucgcccccgucacccgccccgacaaggucgucugcgucggcaugaacuacgucgaccacugcaaggagcagaacguccccguccccaaggagcccaucaucuucuccaaguucgccuccuccaucgucggccccuacgacgaggucguccuccccccccagucccaggaggucgacugggaggucgagcucgccgucgucaucggcaagaagggcaagcacaucaaggccaccgacgccauggcccacgucgccggcuucaccgucgcccacgacgucuccgcccgcgacuggcagaugcgccgcaacggcaagcaguggcuccucggcaagaccuucgacaccuucugcccccucggccccgcccucgucaccaaggacuccgucgccgacccccacaaccucaagaucugcugccgcgucaacggcgaggucguccaguccggcaacaccaaccagauggucuucaagaccgaggaccucaucgccugggucucccaguucgucaccuucuaccccggcgacgucauccucaccggcaccccccccggcgucggcgucuuccgcaagccccccgucuuccucaagaagggcgacgagguccagugcgagaucgaggagcucggcgucaucaucaacaaggucgucuga

SEQ ID NO: 42945 - RNA, 1260 nt, Artificial Sequence
  derived and/or modified sequence opt2 from FAH__Homo_sapiens__NP_000128
auguccuucauccccgucgccgaggacuccgacuuccccauccacaaccuccccuacggcgucuucuccacccgcggcgacccccgcccccgcaucggcgucgccaucggcgaccagauccucgaccucuccaucaucaagcaccucuucaccggccccguccucuccaagcaccaggacgucuucaaccagcccacccucaacuccuucaugggccucggccaggccgccuggaaggaggcccgcgucuuccuccagaaccuccucuccgucucccaggcccgccuccgcgacgacaccgagcuccgcaagugcgccuucaucucccaggccuccgccaccaugcaccuccccgccaccaucggcgacuacaccgacuucuacuccucccgccagcacgccaccaacgucggcaucauguuccgcgacaaggagaacgcccucaugcccaacuggcuccaccuccccgucggcuaccacggccgcgccuccuccgucgucgucuccggcacccccauccgccgccccaugggccagaugaagcccgacgacuccaagccccccgucuacggcgccugcaagcuccucgacauggagcucgagauggccuucuucgucggccccggcaaccgccucggcgagcccauccccaucuccaaggcccacgagcacaucuucggcaugguccucaugaacgacugguccgcccgcgacauccagaagugggaguacgucccccucggccccuuccucggcaaguccuucggcaccaccgucucccccugggucguccccauggacgcccucaugcccuucgccguccccaaccccaagcaggacccccgcccccuccccuaccucugccacgacgagcccuacaccuucgacaucaaccucuccgucaaccucaagggcgagggcaugucccaggccgccaccaucugcaaguccaacuucaaguacauguacuggaccaugcuccagcagcucacccaccacuccgucaacggcugcaaccuccgccccggcgaccuccucgccuccggcaccaucuccggccccgagcccgagaacuucggcuccaugcucgagcucuccuggaagggcaccaagcccaucgaccucggcaacggccagacccgcaaguuccuccucgacggcgacgaggucaucaucaccggcuacugccagggcgacggcuaccgcaucggcuucggccagugcgccggcaagguccuccccgcccuccuccccuccuga

SEQ ID NO: 42946 - RNA, 951 nt, Artificial Sequence
  derived and/or modified sequence opt2 from FAIM2__Homo_sapiens__NP_036438
augacccagggcaagcucuccgucgccaacaaggcccccggcaccgagggccagcagcagguccacggcgagaagaaggaggcccccgccguccccuccgccccccccuccuacgaggaggccaccuccggcgagggcaugaaggccggcgccuucccccccgcccccaccgccgucccccuccaccccuccugggccuacgucgaccccuccuccuccuccuccuacgacaacggcuuccccaccggcgaccacgagcucuucaccaccuucuccugggacgaccagaagguccgccgcgucuucguccgcaaggucuacaccauccuccucauccagcuccucgucacccucgccgucgucgcccucuucaccuucugcgaccccgucaaggacuacguccaggccaaccccggcugguacugggccuccuacgccgucuucuucgccaccuaccucacccucgccugcugcuccggcccccgccgccacuuccccuggaaccucauccuccucaccgucuucacccucuccauggccuaccucaccggcaugcucuccuccuacuacaacaccaccuccguccuccucugccucggcaucaccgcccucgucugccucuccgucaccgucuucuccuuccagaccaaguucgacuucaccuccugccagggcguccucuucguccuccucaugacccucuucuucuccggccucauccucgccauccuccuccccuuccaguacguccccuggcuccacgccgucuacgccgcccucggcgccggcgucuucacccucuuccucgcccucgacacccagcuccucaugggcaaccgccgccacucccucucccccgaggaguacaucuucggcgcccucaacaucuaccucgacaucaucuacaucuucaccuucuuccuccagcucuucggcaccaaccgcgaguga

SEQ ID NO: 42947 - RNA, 837 nt, Artificial Sequence
  derived and/or modified sequence opt2 from FAIM3__Homo_sapiens__NP_001135945
auggacuucuggcucuggccccucuacuuccuccccgaguacgagcccuccugggaggagcagcccaugcccgagacccccaagugguuccaccuccccuaccucuuccagaugcccgccuacgccuccuccuccaaguucgucacccgcgucaccacccccgcccagcgcggcaaggucccccccguccaccacuccucccccaccacccagaucacccaccgcccccgcgucucccgcgccuccuccgucgccggcgacaagccccgcaccuuccuccccuccaccaccgccuccaagaucuccgcccucgagggccuccucaagccccagacccccuccuacaaccaccacacccgccuccaccgccagcgcgcccucgacuacggcucccaguccggccgcgagggccagggcuuccacauccucauccccaccauccucggccucuuccuccucgcccuccucggccucgucgucaagcgcgccgucgagcgccgcaaggcccucucccgccgcgcccgccgccucgccguccgcaugcgcgcccucgaguccucccagcgcccccgcggcuccccccgcccccgcucccagaacaacaucuacuccgccugcccccgccgcgcccgcggcgccgacgccgccggcaccggcgaggcccccguccccggccccggcgccccccucccccccgccccccuccaggucuccgagucccccuggcuccacgcccccucccucaagaccuccugcgaguacgucucccucuaccaccagcccgccgccaugauggaggacuccgacuccgacgacuacaucaacguccccgccuga

SEQ ID NO: 42948 - RNA, 1155 nt, Artificial Sequence
  derived and/or modified sequence opt2 from FAM102A__Homo_sapiens__NP_001030331
auggccuuccucaugaagaagaagaaguucaaguuccagaccaccuucacccucgaggagcucaccgccguccccuucgucaacggcguccucuucugcaagguccgccuccucgacggcggcgacuucgucucccucuccucccgcgaggagguccaggagaacugcguccgcuggcgcaagcgcuucaccuucgucugcaagauguccgccaaccccgccaccggccuccucgaccccugcgucuuccgcgucuccguccgcaaggagcucaagggcggcaaggccuacuccaagcucggcuucgccgaccucaaccucgccgaguucgccggcuccggcuccaccguccgcugcugccuccucgagggcuacgacaccaagaacacccgccaggacaacuccauccucaaggucaccaucggcauguuccuccucuccggcgaccccugcuucaagaccccccccuccaccgccaaguccaucuccauccccggccaggacuccucccuccagcucaccugcaagggcggcggcaccuccuccggcggcuccuccaccaacucccucaccggcucccgcccccccaaggcccgccccaccauccucuccuccggccuccccgaggagcccgaccagaaccucuccucccccgaggaggucuuccacuccggccacucccgcaacuccuccuacgccucccagcaguccaagaucuccggcuacuccaccgagcacucccgcuccuccucccucuccgaccucacccaccgccgcaacaccuccaccuccuccuccgccuccggcggccucggcaugaccgucgagggccccgagggcuccgagcgcgagcaccgcccccccgagaagcccccccgccccccccgcccccuccaccucuccgaccgcuccuuccgccgcaagaaggacuccgucgagucccaccccaccugggucgacgacacccgcaucgacgccgacgccaucgucgagaagaucguccagucccaggacuucaccgacggcuccaacaccgaggacuccaaccuccgccucuucgucucccgcgacggcuccgccacccucuccggcauccagcucgccacccgcgucuccuccggcgucuacgagcccgucgucaucgagucccacuga

SEQ ID NO: 42949 - RNA, 357 nt, Artificial Sequence
  derived and/or modified sequence opt2 from FAM103A1__Homo_sapiens__NP_113640
augaccgacaccgccgaggccguccccaaguucgaggagauguucgccucccgcuucaccgagaacgacaaggaguaccaggaguaccucaagcgcccccccgaguccccccccaucgucgaggaguggaacucccgcgccggcggcaaccagcgcaaccgcggcaaccgccuccaggacaaccgccaguuccgcggccgcgacaaccgcuggggcuggcccuccgacaaccgcuccaaccaguggcacggccgcuccuggggcaacaacuacccccagcaccgccaggagcccuacuacccccagcaguacggccacuacggcuacaaccagcgcccccccuacggcuacuacuga

SEQ ID NO: 42950 - RNA, 1071 nt, Artificial Sequence
  derived and/or modified sequence opt2 from FAM105A__Homo_sapiens__NP_061891
auggccgccacccgcucccccacccgcgcccgcgagcgcgagcgcuccggcgcccccgccgccggcuccgaccagguccacuccuggaugcucgccaccucccaggcccucgacaccgucuggcgcauggccaagggcuucgucaugcucgccgucuccuuccucgucgccgccaucugcuacuuccgccgccuccaccucuacuccggccacaagcucaagugguggaucggcuaccuccagcgcaaguucaagcgcaaccucuccgucgaggccgaggucgaccuccucuccuacugcgcccgcgaguggaagggcgagaccccccgcaacaagcucaugcgcaaggccuacgaggagcucuucuggcgccaccacaucaagugcguccgccagguccgccgcgacaacuacgacgcccuccgcuccguccucuuccagaucuucucccagggcaucuccuuccccuccuggaugaaggagaaggacaucgucaagcuccccgagaagcuccucuucucccagggcugcaacuggauccagcaguacuccuucggccccgagaaguacaccggcuccaacgucuucggcaagcuccgcaaguacgucgagcuccucaagacccaguggaccgaguucaacggcauccgcgacuaccacaagcgcggcuccaugugcaacacccucuucuccgacgccauccucgaguacaagcucuacgaggcccucaaguucaucaugcucuaccaggucaccgaggucuacgagcagaugaagaccaagaaggucauccccucccucuuccgccuccucuucucccgcgagaccuccuccgacccccucuccuucaugaugaaccaccucaacuccgucggcgacaccugcggccucgagcagaucgacauguucauccucggcuacucccucgaggucaagaucaaggucuuccgccucuucaaguucaacucccgcgacuucgaggucugcuaccccgaggagccccuccgcgacuggcccgagaucucccuccucaccgagaacgaccgccacuaccacauccccgucuucuga

SEQ ID NO: 42951 - RNA, 519 nt, Artificial Sequence
  derived and/or modified sequence opt2 from FAM107A__Homo_sapiens__NP_001269642
auggcccagcgccucggcgagugggcccgcggccccuccgacgccaccggccucuaccgcgccguccuccuccgcuccgccgccauguacuccgagauccagcgcgagcgcgccgacaucggcggccucauggcccgccccgaguaccgcgaguggaaccccgagcucaucaagcccaagaagcuccucaaccccgucaaggccucccgcucccaccaggagcuccaccgcgagcuccucaugaaccaccgccgcggccucggcgucgacuccaagcccgagcuccagcgcguccucgagcaccgccgccgcaaccagcucaucaagaagaagaaggaggagcucgaggccaagcgccuccagugccccuucgagcaggagcuccuccgccgccagcagcgccucaaccagcucgagaagccccccgagaaggaggaggaccacgcccccgaguucaucaagguccgcgagaaccuccgccgcaucgccacccucaccuccgaggagcgcgagcucuga

SEQ ID NO: 42952 - RNA, 396 nt, Artificial Sequence
  derived and/or modified sequence opt2 from FAM107B__Homo_sapiens__NP_001269625
auggccgagcccgacuacaucgaggacgacaaccccgagcucauccgcccccagaagcucaucaaccccgucaagaccucccgcaaccaccaggaccuccaccgcgagcuccucaugaaccagaagcgcggccucgccccccagaacaagcccgagcuccagaaggucauggagaagcgcaagcgcgaccaggucaucaagcagaaggaggaggaggcccagaagaagaaguccgaccucgagaucgagcuccucaagcgccagcagaagcucgagcagcucgagcucgagaagcagaagcuccaggaggagcaggagaacgcccccgaguucgucaaggucaagggcaaccuccgccgcaccggccaggaggucgcccaggcccaggaguccuga

SEQ ID NO: 42953 - RNA, 789 nt, Artificial Sequence
  derived and/or modified sequence opt2 from FAM109A__Homo_sapiens__NP_001171467
auggcccccggcuccccccccggccccgccaucgccaccaugaagcucaacgagcgcucccucgccuucuacgccaccugcgacgcccccgucgacaacgccggcuuccucuacaagaagggcggccgccacgccgccuaccaccgccgcugguucguccuccgcggcaacaugcucuucuacuucgaggacgccgccucccgcgagcccgucggcgucaucauccucgagggcugcaccgucgagcucgucgaggccgccgaggaguucgccuucgccguccgcuucgccggcacccgcgcccgcaccuacguccucgccgccgagucccaggacgccauggagggcugggucaaggcccucucccgcgccuccuucgacuaccuccgccucgucguccgcgagcucgagcagcagcucgccgccguccgcggcggcggcggcauggcccucccccagccccagccccagucccucccccucccccccucccuccccuccgcccucgcccccguccccucccuccccuccgcccccgcccccguccccgcccucccccucccccgccgccccuccgcccucccccccaaggagaacggcugcgccgucugguccaccgaggccaccuuccgccccggccccgagcccccccccccccccccccgccgccgcgccuccgccccccacggcccccucgacauggcccccuucgcccgccuccacgagugcuacggccaggagauccgcgcccuccgcggccaguggcucuccucccgcguccagcccuga

SEQ ID NO: 42954 - RNA, 888 nt, Artificial Sequence
  derived and/or modified sequence opt2 from FAM110A__Homo_sapiens__NP_001276075
augcccguccacacccucucccccggcgcccccuccgcccccgcccuccccugccgccuccgcacccgcguccccggcuaccuccuccgcggccccgccgacggcggcgcccgcaagcccuccgccgucgagcgccucgaggccgacaaggccaaguacgucaagucccuccacgucgccaacacccgccaggagcccguccagccccuccucuccaagcagccccucuucucccccgagacccgccgcaccguccucacccccucccgccgcgcccuccccggccccugccgccgcccccagcucgaccucgacauccucuccucccucaucgaccucugcgacucccccgucucccccgccgaggccucccgcacccccggccgcgccgagggcgccggccgccccccccccgccacccccccccgccccccccccuccaccuccgccguccgccgcgucgacguccgcccccuccccgccucccccgcccgccccugccccucccccggccccgccgccgccuccucccccgcccgcccccccggccuccagcgcuccaaguccgaccucuccgagcgcuucucccgcgccgccgccgaccucgagcgcuucuucaacuucugcggccucgaccccgaggaggcccgcggccucggcgucgcccaccucgcccgcgccuccuccgacaucgucucccucgccggccccuccgccggccccggcuccuccgagggcggcugcucccgccgcuccuccgucaccgucgaggagcgcgcccgcgagcgcguccccuacggcgucuccgucgucgagcgcaacgcccgcgucaucaaguggcucuacggccuccgccaggcccgcgagucccccgccgccgagggcuga

SEQ ID NO: 42955 - RNA, 1113 nt, Artificial Sequence
  derived and/or modified sequence opt2 from FAM110B__Homo_sapiens__NP_671722
augcccaccgagacccuccagaccggcuccauggucaagcccgucucccccgccggcaccuucaccuccgccgucccccuccgcauccucaacaagggccccgacuacuuccgccgccaggccgagcccaaccccaagcgccucuccgccgucgagcgccucgaggccgacaaggccaaguacgucaagucccaggaggucaucaacgccaagcaggagcccgucaagcccgccguccucgccaagccccccgucugccccgccgccaagcgcgcccucggcucccccacccucaaggucuucggcaaccacgccaagaccgaguccggcguccagcgcgagaaccucaagcucgagauccucaagaacaucaucaacuccuccgagggcuccuccuccggcuccggccacaagcacuccucccgcaacuggcccccccaccgcuccgaggccaccgaccuccaccgccacuccuucgccgagucccucaaggucuaccccacccagggccgccgcuccccccaggagggcggcucccacgucggccgccgccuccucgagcaguccgccgaguccuuccuccacgucucccacuccuccuccgacauccgcaaggucaccuccgucaagccccucaaggccauccccugcuccuccuccgcccccccccucccccccaagcccaagaucgccgccaucgccuccaugaagucccccgaggccgaccccgucgagcccgccugcggcgucucccgccgccccucccuccagcgcuccaaguccgaccucuccgaccgcuacuuccgcgucgacgccgacgucgagcgcuucuucaacuacugcggccucgaccccgaggagcucgagaaccucggcauggagaacuucgcccgcgccaacuccgacaucaucucccucaacuuccgcuccgccuccaugaucuccuccgacugcgagcagucccaggacuccaacuccgaccuccgcaacgacgacuccgccaacgaccgcguccccuacggcaucuccgccaucgagcgcaacgcccgcaucaucaaguggcucuacuccaucaagcaggcccgcgagucccagaaggucucccacgucuga

SEQ ID NO: 42956 - RNA, 966 nt, Artificial Sequence
  derived and/or modified sequence opt2 from FAM110C__Homo_sapiens__NP_001071178
augcgcgcccucgccgcccucuccgccccccccaacgagcgccuccucccccgcgaccccgccgccacccgcgaccccgacgccgcccgccccgcccgccgcuccgccgucgagcgccucgccgccgaccgcgccaaguacguccgcggccgccccggcaccggccgcggcgucgccuccgagggcuccggccccggcgccaucaagugccccggcaacgaccccggcccccccgcccgcgcccccgcccccgucgcccgccgcgccaucgcccgcaagccccuccgccccgacucccucaucaucuaccgccagaagugcgaguucguccgcggcuccggcgccgacggcccccgcgccucccucgucaagaagcucuuccagggccccggcaaggacaaggcccccgucccccgcaccggcgacgagggcaaggccggcaaccccgagaccguccccaccacccccggccccgccgccgaccccgccauccccgagacccccgcccccgccgcccgcuccgccgcccccuccuccguccccgccgccccccccggccccgagccccgcgucguccgccgccgcggccuccagcgcucccaguccgaccucuccucccgcuacuccgccgcccucgccgaguccgacaccuucuuccaguacugcggccucgaccccgaggucgucgaggcccucggccgcgagaacuucaccgccggcuccgacugcgucacccucaagguccgcuccgucuccgucgccaccuccggcuccggcuucucccgccacuccggcggcgacgacgagggccuccaggaggaggagcucaucgagcagguccccuccaccaccuccgucaucgagcgcaacgcccgcaucaucaaguggcucuacaccugcaagaaggccaaggagacccccucccaggagcagucccgcacccgcggcuccaagcccucccgcuga

SEQ ID NO: 42957 - RNA, 2115 nt, Artificial Sequence
  derived and/or modified sequence opt2 from FAM111B__Homo_sapiens__NP_001136176
augaagcagacccacgccgacacccccgucgaccacugccucuccggcauccgcaagugcuccuccaccuucaagcucaaguccgaggucaacaagcacgagaccgcccucgagaugcagaaccccaaccucaacaacaaggagugcugcuucaccuucacccucaacggcaacucccgcaagcucgaccgcuccgucuucaccgccuacggcaagcccuccgaguccaucuacuccgcccucuccgccaacgacuacuucuccgagcgcaucaagaaccaguucaacaagaacaucaucgucuacgaggagaagaccaucgacggccacaucaaccucggcaugccccucaagugccuccccuccgacucccacuucaagaucaccuucggccagcgcaaguccuccaaggaggacggccacauccuccgccagugcgagaaccccaacauggagugcauccucuuccacgucgucgccaucggccgcacccgcaagaagaucgucaagaucaacgagcuccacgagaagggcuccaagcucugcaucuacgcccucaagggcgagaccaucgagggcgcccucugcaaggacggccgcuuccgcuccgacaucggcgaguucgaguggaagcucaaggagggccacaagaagaucuacggcaagcaguccauggucgacgaggucuccggcaagguccucgagauggacaucuccaagaagaaggcccuccagcagaaggacauccacaagaagaucaagcagaacgaguccgccaccgacgagaucaaccaccagucccucauccaguccaagaagaagguccacaagcccaagaaggacggcgagaccaaggacgucgagcacucccgcgagcagauccuccccccccaggaccucucccacuacaucaaggacaagacccgccagaccaucccccgcauccgcaacuacuacuucugcucccucccccgcaaguaccgccagaucaacucccagguccgccgccgcccccaccucggccgccgcuacgccaucaaccucgacguccagaaggaggccaucaaccuccucaagaacuaccagacccucaacgaggccaucaugcaccaguaccccaacuucaaggaggaggcccaguggguccgcaaguacuuccgcgaggagcagaagcgcaugaaccucucccccgccaagcaguucaacaucuacaagaaggacuucggcaagaugaccgccaacuccgucuccgucgccaccugcgagcagcucaccuacuacuccaaguccgucggcuucaugcagugggacaacaacggcaacaccggcaacgccaccugcuucgucuucaacggcggcuacaucuucaccugccgccacgucguccaccucauggucggcaagaacacccaccccucccucuggcccgacaucaucuccaagugcgccaaggucaccuucaccuacaccgaguucugccccacccccgacaacugguucuccaucgagcccuggcucaaggucuccaacgagaaccucgacuacgccauccucaagcucaaggagaacggcaacgccuucccccccggccucuggcgccagaucuccccccagcccuccaccggccucaucuaccucaucggccaccccgagggccagaucaagaagaucgacggcugcaccgucaucccccucaacgagcgccucaagaaguaccccaacgacugccaggacggccucgucgaccucuacgacaccaccuccaacgucuacugcauguucacccagcgcuccuuccucuccgaggucuggaacacccacacccucuccuacgacaccugcuucuccgacggcuccuccggcucccccgucuucaacgccuccggcaagcucgucgcccuccacaccuucggccucuucuaccagcgcggcuucaacguccacgcccucaucgaguucggcuacuccauggacuccauccucugcgacaucaagaagaccaacgagucccucuacaagucccucaacgacgagaagcucgagaccuacgacgaggagaagggcaagcaggaguccucccuccaggaccaccagaucgagcccauggagugcuga

SEQ ID NO: 42958 - RNA, 1692 nt, Artificial Sequence
  derived and/or modified sequence opt2 from FAM114A1__Homo_sapiens__NP_612398
auguccgacgacgccggcgacacccucgccaccggcgacaaggccgaggucaccgagaugcccaacuccgacucccuccccgaggacgccgagguccacugcgacuccgccgccgucucccacgagcccacccccgccgacccccgcggcgagggccacgagaacgccgccguccagggcgccggcgccgccgccaucggcccccccguccagccccaggacgccaacgcccucgagcccccccucaacggcgacgucaccgaggacacccucgccgagugcaucgacuccgucucccucgaggccgagccccgcuccgagaucccccuccaggagcagaacuaccucgccgucgacuccccccccuccggcggcggcugggccggcuggggcuccuggggcaagucccuccucuccuccgccuccgccaccgucggccacggccucaccgccgucaaggagaaggccggcgccacccuccgcauccacggcgucaacuccggcuccuccgagggcgcccagcccaacaccgagaacggcguccccgagaucaccgacgccgccaccgaccagggccccgccgaguccccccccaccucccccuccuccgccucccgcggcaugcucuccgccaucaccaacgucguccagaacaccggcaaguccguccucaccggcggccucgacgcccucgaguucaucggcaagaagaccaugaacguccucgccgaguccgaccccggcuucaagcgcaccaagacccucauggagcgcaccgucucccucucccagaugcuccgcgaggccaaggagaaggagaagcagcgccucgcccagcagcucaccauggagcgcaccgcccacuacggcaugcucuucgacgaguaccagggccucucccaccucgaggcccucgagauccucuccaacgaguccgaguccaagguccaguccuuccucgccucccucgacggcgagaagcucgagcuccucaagaacgaccucaucuccaucaaggacaucuucgccgccaaggagcucgagaacgaggagaaccaggaggagcagggccucgaggagaagggcgaggaguucgcccgcaugcucaccgagcuccucuucgagcuccacgucgccgccacccccgacaagcucaacaaggccaugaagcgcgcccacgacugggucgaggaggaccagaccgucgucuccgucgacgucgccaaggucuccgaggaggagaccaagaaggaggagaaggaggagaagucccaggacccccaggaggacaagaaggaggagaagaagaccaagaccaucgaggaggucuacauguccuccaucgagucccucgccgaggucaccgcccgcugcaucgagcagcuccacaaggucgccgagcucauccuccacggccaggaggaggagaagcccgcccaggaccaggccaagguccucaucaagcucaccaccgccaugugcaacgaggucgccucccucuccaagaaguucaccaacucccucaccaccgucggcuccaacaagaaggccgagguccucaaccccaugaucuccuccguccuccucgagggcugcaacuccaccaccuacauccaggacgccuuccagcuccuccuccccguccuccaggucucccacauccagaccuccugccucaaggcccagcccuga

SEQ ID NO: 42959 - RNA, 2769 nt, Artificial Sequence
  derived and/or modified sequence opt2 from FAM120B__Homo_sapiens__NP_001273308
auggaccgccagaugauccucucccgcuccuccgucaugggcguccgcggccuccagggcuucgucggcuccaccugcccccacaucugcaccgucgucaacuucaaggagcucgccgagcaccaccgcuccaaguaccccggcugcacccccaccaucgucgucgacgccaugugcugccuccgcuacugguacacccccgaguccuggaucugcggcggccaguggcgcgaguacuucuccgcccuccgcgacuucgucaagaccuucaccgccgccggcaucaagcucaucuucuucuucgacggcauggucgagcaggacaagcgcgacgagugggucaagcgccgccucaagaacaaccgcgagaucucccgcaucuuccacuacaucaagucccacaaggagcagcccggccgcaacauguucuucauccccuccggccucgccgucuucacccgcuucgcccucaagacccucggccaggagacccucugcucccuccaggaggccgacuacgaggucgccuccuacggccuccagcacaacugccucggcauccucggcgaggacaccgacuaccucaucuacgacaccugccccuacuucuccaucuccgagcucugccucgagucccucgacaccgucaugcucugccgcgagaagcucugcgagucccucggccucugcgucgccgaccucccccuccucgccugccuccucggcaacgacaucauccccgagggcauguucgaguccuuccgcuacaagugccucuccuccuacaccuccgucaaggagaacuucgacaagaagggcaacaucauccucgccgucuccgaccacaucuccaagguccucuaccucuaccagggcgagaagaagcucgaggagauccucccccucggccccaacaaggcccucuucuacaagggcauggccuccuaccuccuccccggccagaagucccccugguucuuccagaagcccaagggcgucaucacccucgacaagcaggucaucuccaccuccuccgacgccgagucccgcgaggagguccccaugugcuccgacgccgagucccgccaggagguccccaugugcaccggccccgagucccgccgcgagguccccgucuacaccgacuccgagccccgccaggagguccccaugugcuccgaccccgagccccgccaggagguccccaccugcaccggccccgagucccgccgcgagguccccaugugcuccgaccccgagccccgccaggagguccccaugugcaccggccccgaggcccgccaggagguccccauguacaccgacuccgagccccgccaggagguccccauguacaccgacuccgagccccgccaggagguccccauguacaccggcuccgagccccgccaggagguccccauguacaccggccccgagucccgccaggagguccccauguacaccggccccgagucccgccaggagguccucauccgcaccgaccccgagucccgccaggagaucaugugcaccggccacgaguccaagcaggagguccccaucugcaccgaccccaucuccaagcaggaggacuccaugugcacccacgccgagaucaaccagaagcuccccgucgccaccgacuucgaguucaagcucgaggcccucaugugcaccaaccccgagaucaagcaggaggaccccaccaacgucggccccgaggucaagcagcaggucaccauggucuccgacaccgagauccucaaggucgcccgcacccaccacguccaggccgaguccuaccucgucuacaacaucauguccuccggcgagaucgagugcuccaacacccucgaggacgagcucgaccaggcccuccccucccaggccuucaucuaccgccccauccgccagcgcgucuacucccuccuccucgaggacugccaggacgucaccuccaccugccucgccgucaaggagugguucgucuaccccggcaacccccuccgccaccccgaccucguccgcccccuccagaugaccauccccggcggcacccccucccucaagauccucuggcucaaccaggagcccgagauccagguccgccgccucgacacccuccucgccugcuucaaccucuccuccucccgcgaggagcuccaggccgucgagucccccuuccaggcccucugcugccuccucaucuaccucuucguccaggucgacacccucugccucgaggaccuccacgccuucaucgcccaggcccucugccuccagggcaaguccaccucccagcucgucaaccuccagcccgacuacaucaacccccgcgccguccagcucggcucccuccucguccgcggccucaccacccucguccucgucaacuccgccugcggcuuccccuggaagaccuccgacuucaugcccuggaacgucuucgacggcaagcucuuccaccagaaguaccuccaguccgagaagggcuacgccgucgagguccuccucgagcagaaccgcucccgccucaccaaguuccacaaccucaaggccgucgucugcaaggccugcaugaaggagaaccgccgcaucaccggccgcgcccacuggggcucccaccacgccggccgcuggggccgccagggcuccuccuaccaccgcaccggcuccggcuacucccgcuccucccagggccagcccuggcgcgaccagggccccggcucccgccaguacgagcacgaccaguggcgccgcuacuga

SEQ ID NO: 42960 - RNA, 3291 nt, Artificial Sequence
  derived and/or modified sequence opt2 from FAM120C__Homo_sapiens__NP_060318
augggcguccagggcuuccaggaguuccucgagaagcgcugccccggcgccgucguccccgucgaccuccucaagcucgcccgcaccgucucccgccagcagcagcagcagcaccuccaccgccagcucccccccaccgccgcccucgcccccggcgccccccgcgccgcccgcggcuccgucccccuccagcccccccucccccccgccgcccucggcgccuacuccggcggcgccggccccacccgccaccaccaccccgcccaccacuuccaccaccacggccaggcccagcccggccuccaccccccccuccccccccccccccccccccagcuccccggcgcccgcguccucgucgacgccggcuccgcccucccccgccucuacggcggcuaccagaccgacugggucugcggcggccaguggaacgccaugcucggcuaccucuccgcccucugccaggccugcgccuaccccggcggcgacggccucgagcucgucgucauguuccccggcggccucggcaaggaccgccucgccgaguggggccgccgcugccaggccgagcgccagaccgcccagcucaucgucggccacgucggcaacaagggcaccccccccccccgcgccugguuccucccccccgccugccucucccacugcguccgccucgcccucauccgcuuccgcgucaaggucuuccagucccucgaggaccaccaccucgaggucgucgccuucuuccgcgagaacggcuuccacggccuccucgcccacgacuccgaguacgcccucuacaacauccccuccuacuacuccucccacgcccucaagcucuccuggaacggcaagaaccucaccaccaaccaguuccucaugcaggaggucgccaagcagcucggccucaagcgcaugaacuuccccaucuucgccgcccuccucggcaaccacauccuccccgacgaggaccucgccgccuuccacuggucccuccucggccccgagcacccccucgccucccucaagguccgcgcccaccagcucguccucccccccugcgacgucgucaucaaggccgucuccgaguacgucuccuccaucaaggaccccuccaaccucgacgucgucggcaaggacgucuucaagcagucccagucccgcaccgaggacaagaucgagcgcuucaagaaggccgucgaguacuacuccgucaccaccaagcucuccucccuccccgucggccccuccuuccucggcuuccgcaacaaccgccucggcaaccccccccucccccgcaaccaggucggcaccaucuccgccggcaagcccauguucucccaccaggucccccagaaggucaaguaccccccccccuuccccgucggccccaacuccucccuccucuucuccucccacgcccucggcgagucccacgccuucuccgaggaccccaugcuccagaacucccccuucgccaacugggccgucuccuacgacuccuccgccucccaguuccccaacuaccuccccuccaaggccucccccccccucggccccgacuccucccacuccuccuccuccgacggcgacgagcccaacggcgccuccuccgaccacaucaccgaggccuuccaccaccagcccgaguggggcaaccccaaccgcgaccgcggcuccugggcccagcccgucgacaccggcgucuccgaggccucccucggcgacggcgagccccacauccccucccuccucuccauguccacccgcaaccacauggacaucaccauccccccccucccccccgucgcccccgagguccuccgcgucgccgagcaccgccaccgccgcggccucauguaccccuacaucuaccacguccucaccaagggcgagaucaagauccccgucugcaucgaggacgagugcaacauggagcucccccccgccgcccuccucuuccgcuccgcccgccaguacgucuacggcguccucuucucccucgccgagacccagcgcaagauggagcgccucgccaugcgccgccgccuccccgucgagguccccuccgucauccucaaggagugguccgccuacaagggcaaguccccccagacccccgagcucgucuccgcccucaccuuccgcgaguggaccugccccaaccucaagaagcucuggcucggcaaggccgucgaggacaagaaccgccgcaugcgcgccuuccucgccugcaugaaguccgacacccccuccaugcucaaccccgccaacguccccacccaccuccuccucaugugcugcguccuccgcuacaugguccaguggcccggcggccgcauccuccaccgccacgagcucgacaccuuccucgcccaggccgucuccacccagcucuacgagcccgaccgccuccaggagcucaagaucgagaagcucgacgcccgcggcauccagcucgccgcccucuucauguccggcgucgacaccgcccucuucgccaacgacgccugcggccagcccguccccugggagcacugcugccccuggaucuacuucgacggcaagcucuuccaguccaagcucaucaaggccggccgcgagcgcgucucccucgucgagcucugcgacggccaggccgaccucgccaccaaggucgagaagaugcgccaguccauccucgagggcgucaacaugaaccaccccccccccuccgcccuccuccccucccccaccuucgucccccccaugguccccucccucuaccccgucucccucuacucccgcgccaugggcuccaugccccuccccccccagggccgcucccgcggcuucgccggccuccaccccauccccccccagggcggcaagcucgagaucgccggcauggucgucggccagugggccggcucccgcuccucccgcggccgcggcuccuucggcaugcaggucgucuccgucggcggccccggcaagggccacggcaaggagcagaccggccgcggcuccaagggccacaagaagggcaacaagcagggcuccuccgacggcgucuccaagucccucgagcuccaccagggccgcucccgcucccaggucaacggcaacuccggcgcccucaucaaggaggagaaguccgaccaccgccuccccgcccccucccagugcgcccucucccgcgacuccaacgagugcaacaacggcaaccgcuaccuccccaugaacaaccgcgagaagaaccaccuccaggagcagaagcucgagaccgucgcccagcgcaaggaggacuga

SEQ ID NO: 42961 - RNA, 1368 nt, Artificial Sequence
  derived and/or modified sequence opt2 from FAM124B__Homo_sapiens__NP_001116251
auggacgagacccagggcccccucgccaugaccguccaccuccucgccaacuccggccacggcucccuccuccagcgcacccucgaccagcuccucgacugcaucugccccgagguccgccucuuccaggucuccgagcgcgccucccccgucaaguacugcgagaagucccacuccaagcgcucccgcuuccccggcauguccguccuccucuuccuccacgagucccccggcgaggaccgccucuuccgcguccucgacucccuccagcacucccccuggcagugcuaccccacccaggacacccgcggccgccucugccccuacuucuucgccaaccaggaguucuacucccucgacucccagcuccccaucuggggcguccgccagguccacugcggcuccgagauccuccgcgucacccucuacugcuccuucgacaacuacgaggacgccauccgccucuacgagaugauccuccagcgcgaggccacccuccagaaguccaacuucugcuucuucguccucuacgccuccaaguccuucgcccuccagcucucccucaagcagcucccccccggcauguccgucgaccccaaggaguccuccguccuccaguucaagguccaggagaucggccagcucgucccccuccuccccaaccccugcaugcccaucuccuccacccgcuggcagacccaggacuacgacggcaacaagauccuccuccagguccagcucaaccccgagcucggcgucaagaacggcauccucggcgccggcaugcucccccucggcucccgccucaccuccgucuccgccaagcgcaccuccgagccccgcucccagcgcaaccagggcaagcgcucccagggccacucccucgagcuccccgagcccuccggcucccccaccuccgaccgcugcgccggcaccuccuggaagucccccggccgcuccuuccaggucuccucccccgccaugggcgcccaccuccaccucuccucccaccaccucgaguccggcgcccgcaugaagguccucaaccgcgagaacuccuuccagaagcucgaggccgagaccaacgucgacaccggccucaccaucaucaacuccgagccccgccagaccuacuucggcggcuucccccgcgaccuccagaccucccagccccccuucugccuccccgccuccucccucggcgucgccaccuccaagaacaacuccguccucaaggagcgcgucuccccccucccccucgccggccagcgcgaccucggcacccgcaagaccaucuccgagugccuccuccaccuccagguccagggcgaggagaaggaggaggacgaggaggaguucuucaucuga

SEQ ID NO: 42962 - RNA, 1566 nt, Artificial Sequence
  derived and/or modified sequence opt2 from FAM126A__Homo_sapiens__NP_115970
auguucaccuccgagaagggcgucgucgaggaguggcucuccgaguucaagacccuccccgagaccucccuccccaacuacgccaccaaccucaaggacaaguccucccucgucuccucccucuacaaggucauccaggagccccaguccgagcuccucgagcccgucugccaccagcucuucgaguucuaccgcuccggcgaggagcagcuccuccaguucacccuccaguuccuccccgagcucaucuggugcuaccucgccgucuccgccucccgcaacguccacuccuccggcugcaucgaggcccuccuccucggcgucuacaaccucgagaucgucgacaagcagggccacaccaagguccucuccuucaccauccccucccucuccaagcccuccgucuaccacgagcccuccuccaucggcuccauggcccucaccgaguccgcccucucccagcacggccucuccaaggucgucuacuccggcccccacccccagcgcgagaugcucaccgcccagaaccgcuucgagguccucaccuuccuccuccucugcuacaacgccgcccucaccuacaugcccuccgucucccuccagucccucugccagaucugcucccgcaucugcgucugcggcuacccccgccagcacguccgcaaguacaagggcaucuccucccgcauccccgucuccuccggcuucaugguccagaugcucaccggcaucuacuucgccuucuacaacggcgagugggaccucgcccagaaggcccucgacgacaucaucuaccgcgcccagcucgagcucuaccccgagccccuccucgucgccaacgccaucaaggccucccucccccacggccccaugaaguccaacaaggagggcacccgcugcauccaggucgagaucacccccaccuccucccgcaucucccgcaacgccgucaccuccauguccauccgcggccaccgcuggaagcgccacggcaacaccgagcucaccggccaggaggagcucauggagaucuccgaggucgacgagggcuucuacucccgcgccgccuccuccaccucccaguccggccucuccaacuccucccacaacugcuccaacaagcccuccaucggcaagaaccaccgccgcuccggcggcuccaagaccggcggcaaggagaaggagaccaccggcgaguccugcaaggaccacuucgcccgcaagcagacccagcgcgcccaguccgagaaccucgagcuccucucccucaagcgccucacccucaccaccucccagucccuccccaagcccuccucccacggccucgccaagaccgccgccaccgucuucuccaaguccuucgagcaggucuccggcgucaccgucccccacaaccccuccuccgccgucggcugcggcgccggcaccgacgccaaccgcuucuccgccugcucccuccaggaggagaagcucaucuacgucuccgagcgcaccgagcuccccaugaagcaccaguccggccagcagcgcccccccuccaucuccaucacccucuccaccgacuga

SEQ ID NO: 42963 - RNA, 2787 nt, Artificial Sequence
  derived and/or modified sequence opt2 from FAM129A__Homo_sapiens__NP_443198
augggcggcuccgccuccucccagcucgacgagggcaagugcgccuacauccgcggcaagaccgaggccgccaucaagaacuucucccccuacuacucccgccaguacuccgucgccuucugcaaccacguccgcaccgaggucgagcagcagcgcgaccucaccucccaguuccucaagaccaagcccccccucgcccccggcaccauccucuacgaggccgagcucucccaguucuccgaggacaucaagaaguggaaggagcgcuacgucgucgucaagaacgacuacgccgucgaguccuacgagaacaaggaggccuaccagcgcggcgccgcccccaagugccgcauccuccccgccggcggcaagguccucaccuccgaggacgaguacaaccuccucuccgaccgccacuuccccgacccccucgccuccuccgagaaggagaacacccagcccuucgucguccuccccaaggaguuccccgucuaccucuggcagcccuucuuccgccacggcuacuucugcuuccacgaggccgccgaccagaagcgcuucuccgcccuccucuccgacugcguccgccaccucaaccacgacuacaugaagcagaugaccuucgaggcccaggccuuccucgaggccguccaguucuuccgccaggagaagggccacuacggcuccugggagaugaucaccggcgacgagauccagauccucuccaaccucgucauggaggagcuccuccccacccuccagaccgaccuccuccccaagaugaagggcaagaagaacgaccgcaagcgcaccuggcucggccuccucgaggaggccuacacccucguccagcaccaggucuccgagggccucuccgcccucaaggaggagugccgcgcccucaccaagggccucgagggcaccauccgcuccgacauggaccagaucgucaacuccaagaacuaccucaucggcaagaucaaggccauggucgcccagcccgccgagaaguccugccucgaguccguccagcccuuccucgccuccauccucgaggagcucaugggccccgucuccuccggcuucuccgagguccgcguccucuucgagaaggaggucaacgaggucucccagaacuuccagaccaccaaggacuccguccagcucaaggagcaccucgaccgccucaugaaccucccccuccacuccgucaagauggagcccugcuacaccaaggucaaccuccuccacgagcgccuccaggaccucaagucccgcuuccgcuucccccacaucgaccucgucguccagcgcacccagaacuacaugcaggagcucauggagaacgccgucuucaccuucgagcagcuccucuccccccaccuccagggcgaggccuccaagaccgccgucgccaucgagaaggucaagcuccgcguccucaagcaguacgacuacgacuccuccaccauccgcaagaagaucuuccaggaggcccucguccagaucacccuccccaccguccagaaggcccucgccuccaccugcaagcccgagcuccagaaguacgagcaguucaucuucgccgaccacaccaacaugauccacgucgagaacgucuacgaggagauccuccaccagauccuccucgacgagacccucaaggucaucaaggaggccgccauccucaagaagcacaaccucuucgaggacaacauggcccuccccuccgaguccgucuccucccucaccgaccucaagccccccaccggcuccaaccaggccucccccgcccgccgcgccuccgccauccuccccggcguccucggcuccgagacccucuccaacgaggucuuccaggaguccgaggaggagaagcagcccgagguccccuccucccucgccaagggcgagucccucucccuccccggccccucccccccccccgacggcaccgagcaggucaucaucucccgcgucgacgaccccgucgucaaccccgucgccaccgaggacaccgccggccuccccggcaccugcuccuccgagcucgaguucggcggcacccucgaggacgaggagcccgcccaggaggagcccgagcccaucaccgccuccggcucccucaaggcccuccgcaagcuccucaccgccuccgucgagguccccgucgacuccgcccccgucauggaggaggacaccaacggcgagucccacgucccccaggagaacgaggaggaggaggagaaggagcccucccaggccgccgccauccaccccgacaacugcgaggaguccgaggucuccgagcgcgaggcccagccccccugccccgaggcccacggcgaggagcucggcggcuuccccgaggucggcucccccgccuccccccccgccuccggcggccucaccgaggagccccucggccccauggagggcgagcuccccggcgaggccugcacccucaccgcccacgagggccgcggcggcaagugcaccgaggagggcgacgccucccagcaggagggcugcacccucggcuccgaccccaucugccucuccgagucccaggucuccgaggagcaggaggagaugggcggccaguccuccgccgcccaggccaccgccuccgucaacgccgaggagaucaaggucgcccgcauccacgagugccagugggucgucgaggacgcccccaaccccgacguccuccucucccacaaggacgacgucaaggagggcgagggcggccaggaguccuuccccgagcuccccuccgaggaguga

SEQ ID NO: 42964 - RNA, 2202 nt, Artificial Sequence
  derived and/or modified sequence opt2 from FAM129B__Homo_sapiens__NP_001030611
augggcuggaugggcgagaagaccggcaagauccucaccgaguuccuccaguucuacgaggaccaguacggcgucgcccucuucaacuccaugcgccacgagaucgagggcaccggccucccccaggcccagcuccucuggcgcaaggucccccucgacgagcgcaucgucuucuccggcaaccucuuccagcaccaggaggacuccaagaaguggcgcaaccgcuucucccucgucccccacaacuacggccucguccucuacgagaacaaggccgccuacgagcgccagguccccccccgcgccgucaucaacuccgccggcuacaagauccucaccuccgucgaccaguaccucgagcucaucggcaacucccuccccggcaccaccgccaaguccggcuccgcccccauccucaagugccccacccaguucccccucauccucuggcaccccuacgcccgccacuacuacuucugcaugaugaccgaggccgagcaggacaaguggcaggccguccuccaggacugcauccgccacugcaacaacggcauccccgaggacuccaaggucgagggccccgccuucaccgacgccauccgcauguaccgccaguccaaggagcucuacggcaccugggagaugcucugcggcaacgagguccagauccucuccaaccucgucauggaggagcucggccccgagcucaaggccgagcucggcccccgccucaagggcaagccccaggagcgccagcgccaguggauccagaucuccgacgccgucuaccacauggucuacgagcaggccaaggcccgcuucgaggagguccucuccaagguccagcagguccagcccgccaugcaggccgucauccgcaccgacauggaccagaucaucaccuccaaggagcaccucgccuccaagauccgcgccuucauccuccccaaggccgaggucugcguccgcaaccacguccagcccuacauccccuccauccucgaggcccucaugguccccaccucccagggcuucaccgagguccgcgacgucuucuucaaggaggucaccgacaugaaccucaacgucaucaacgagggcggcaucgacaagcucggcgaguacauggagaagcucucccgccucgccuaccacccccucaagaugcaguccugcuacgagaagauggagucccuccgccucgacggccuccagcagcgcuucgacgucuccuccaccuccgucuucaagcagcgcgcccagauccacaugcgcgagcagauggacaacgccgucuacaccuucgagacccuccuccaccaggagcucggcaagggccccaccaaggaggagcucugcaaguccauccagcgcguccucgagcgcguccucaagaaguacgacuacgacuccuccuccguccgcaagcgcuucuuccgcgaggcccuccuccagaucuccauccccuuccuccucaagaagcucgcccccaccugcaaguccgagcucccccgcuuccaggagcucaucuucgaggacuucgcccgcuucauccucgucgagaacaccuacgaggaggucguccuccagaccgucaugaaggacauccuccaggccgucaaggaggccgccguccagcgcaagcacaaccucuaccgcgacuccauggucaugcacaacuccgaccccaaccuccaccuccucgccgagggcgcccccaucgacuggggcgaggaguacuccaacuccggcggcggcggcucccccucccccuccacccccgaguccgccacccucuccgagaagcgccgccgcgccaagcaggucgucuccgucguccaggacgaggaggucggccuccccuucgaggccucccccgagucccccccccccgccucccccgacggcgucaccgagauccgcggccuccucgcccagggccuccgccccgagucccccccccccgccggcccccuccucaacggcgcccccgccggcgaguccccccagcccaaggccgcccccgaggccuccuccccccccgccuccccccuccagcaccuccuccccggcaaggccgucgaccucggcccccccaagcccuccgaccaggagaccggcgagcaggucuccucccccuccucccaccccgcccuccacaccaccaccgaggacuccgccggcguccagaccgaguucuga

SEQ ID NO: 42965 - RNA, 1494 nt, Artificial Sequence
  derived and/or modified sequence opt2 from FAM134B__Homo_sapiens__NP_001030022
auggccucccccgccccccccgagcacgccgaggagggcugccccgcccccgccgccgaggagcaggccccccccucccccccccccccccaggccucccccgccgagcgccagcagcaggaggaggaggcccaggaggccggcgccgccgagggcgccggccuccaggucgaggaggccgccggccgcgccgccgccgccgucaccuggcuccucggcgagcccguccucuggcucggcugccgcgccgacgagcuccucuccuggaagcgcccccuccgcucccuccucggcuucgucgccgccaaccuccucuucugguuccucgcccucacccccuggcgcgucuaccaccucaucuccgucaugauccucggccgcgucaucaugcagaucaucaaggacaugguccucucccgcacccgcggcgcccagcucuggcgcucccucuccgaguccugggaggucaucaacuccaagcccgacgagcgcccccgccucucccacugcaucgccgaguccuggaugaacuucuccaucuuccuccaggagaugucccucuucaagcagcagucccccggcaaguucugccuccucgucugcuccgucugcaccuucuucaccauccucggcuccuacauccccggcgucauccucuccuaccuccuccuccucugcgccuuccucugcccccucuucaagugcaacgacaucggccagaagaucuacuccaagaucaaguccguccuccucaagcucgacuucggcaucggcgaguacaucaaccagaagaagcgcgagcgcuccgaggccgacaaggagaagucccacaaggacgacuccgagcucgacuucuccgcccucugccccaagaucucccucaccgucgccgccaaggagcucuccgucuccgacaccgacgucuccgaggucuccuggaccgacaacggcaccuucaaccucuccgagggcuacaccccccagaccgacaccuccgacgaccucgaccgccccuccgaggaggucuucucccgcgaccucuccgacuuccccucccucgagaacggcaugggcaccaacgacgaggacgagcucucccucggccuccccaccgagcucaagcgcaagaaggagcagcucgacuccggccaccgccccuccaaggagacccaguccgccgccggccucacccucccccucaacuccgaccagaccuuccaccucauguccaaccucgccggcgacgucaucaccgccgccgucaccgccgccaucaaggaccagcucgagggcguccagcaggcccucucccaggccgcccccauccccgaggaggacaccgacaccgaggagggcgacgacuucgagcuccucgaccaguccgagcucgaccagaucgaguccgagcucggccucacccaggaccaggaggccgaggcccagcagaacaagaaguccuccggcuuccucuccaaccuccucggcggccacuga

SEQ ID NO: 42966 - RNA, 3960 nt, Artificial Sequence
  derived and/or modified sequence opt2 from FAM135A__Homo_sapiens__NP_001099001
augaccgagguccaggccauggucgaguucuccgucgagcucaacaaguucuacaacgucgaccucuuccagcgcggcuucuaccagauccgcgccuccaugaagauccccucccgcaucccccaccgcgucgaggccucccuccuccacgccaccggcaugacccucgccuuccccgccuccguccacgacucccucaucugcuccaagaccuuccagauccucuacaagaacgaggaggucguccucaacgacgucaugaucuucaaggucaagaugcuccucgacgagcgcaagaucgaggagacccucgaggagaugaacuuccuccucucccucgaccuccacuucaccgacggcgacuacuccgccgacgaccucaacgcccuccagcucaucuccucccgcacccucaagcuccacuucuccccccaccgcggccuccaccaccacgucaacgucauguucgacuacuuccaccucuccgucgucuccgucaccguccacgccucccucgucgcccuccaccagccccucaucuccuucccccgccccgucaagaccaccuggcucaaccgcaacgcccccgcccagaacaaggacuccgucauccccacccucgaguccgucgucuucggcaucaacuacaccaagcagcucucccccgacggcugcuccuucaucaucgccgacuccuuccuccaccacgccuaccgcuuccacuacacccucugcgccacccuccuccucgccuucaagggccuccacuccuacuucaucaccgucaccgaggagauccccuccugccagaagcucgagcucgaggagauggacgucgaggcccgccucaccgagcucugcgaggaggucaagaagaucgagaaccccgacgagcucgccgagcucaucaacaugaaccucgcccagcucugcucccuccucauggcccucuggggccaguuccucgaggucaucacccuccacgaggagcuccgcauccuccucgcccaggagcaccacacccuccgcguccgccgcuucuccgaggccuucuucugcuucgagcacccccgcgaggccgccaucgccuaccaggagcuccacgcccagucccaccuccagaugugcaccgccaucaagaacaccuccuucugcuccucccuccccccccuccccaucgagugcuccgagcucgacggcgaccucaacucccuccccaucaucuucgaggaccgcuaccucgacuccgucaccgagggcaagcucgacaucucccaggacgacuccgagaucacccagauggagcacaaccucgccucccgccgcuccuccgacgacugccacgaccaccagaccacccccucccucggcguccgcaccaucgagaucaagcccuccaacaaggaccccuucuccggcgagaacaucaccgucaagcucggccccuggaccgagcuccgccaggaggagauccucgucgacaaccuccuccccaacuucgagucccucgaguccaacggcaaguccaaguccaucgagaucaccuucgagaaggaggcccuccaggaggccaagugccucuccaucggcgagucccucaccaagcuccgcuccaaccuccccgcccccuccaccaaggaguaccacgucgucgucuccggcgacaccaucaagcuccccgacaucuccgccaccuacgccuccucccgcuucuccgacuccggcgucgaguccgagcccuccuccuucgccacccaccccaacaccgaccucgucuucgagaccguccagggccagggccccugcaacuccgagcgccucuucccccagcuccucaugaagcccgacuacaacgucaaguucucccucggcaaccacugcaccgaguccaccuccgccaucuccgagauccaguccucccucaccuccaucaacucccuccccuccgacgacgagcucucccccgacgagaacuccaagaaguccgucguccccgagugccaccucaacgacuccaagaccguccucaaccucggcaccaccgaccuccccaagugcgacgacaccaagaaguccuccaucacccuccagcagcaguccgucgucuucuccggcaaccucgacaacgagaccgucgccauccacucccucaacuccuccaucaaggacccccuccaguucgucuucuccgacgaggagaccuccuccgacgucaaguccuccugcuccuccaagcccaaccucgacaccaugugcaagggcuuccagucccccgacaaguccaacaacuccaccggcaccgccaucacccucaacuccaagcucaucugccucggcacccccugcgucaucuccggcuccaucuccuccaacaccgacgucuccgaggaccgcaccaugaagaagaacuccgacguccucaaccucacccagauguacuccgagauccccaccgucgaguccgagacccaccucggcaccuccgaccccuucuccgccuccaccgacaucgucaagcagggccucgucgagaacuacuucggcucccaguccuccaccgacaucuccgacaccugcgccgucuccuacuccaacgcccucuccccccagaaggagaccuccgagaaggagaucuccaaccuccagcaggagcaggacaaggaggacgaggaggaggagcaggaccagcagaugguccagaacggcuacuacgaggagaccgacuacuccgcccucgacggcaccaucaacgcccacuacaccucccgcgacgagcucauggaggagcgccucaccaaguccgagaagaucaacuccgacuaccuccgcgacggcaucaacaugcccaccgucugcaccuccggcugccucuccuuccccuccgccccccgcgagucccccugcaacgucaaguacuccuccaaguccaaguucgacgccaucaccaagcagcccuccuccaccuccuacaacuucaccuccuccaucuccugguacgaguccucccccaagccccagauccaggccuuccuccaggccaaggaggagcucaagcuccucaagcuccccggcuucauguacuccgaggucccccuccucgccuccuccguccccuacuucuccgucgaggaggaggacggcuccgaggacggcguccaccucaucgucugcguccacggccucgacggcaacuccgccgaccuccgccucgucaagaccuacaucgagcucggccuccccggcggccgcaucgacuuccucauguccgagcgcaaccagaacgacaccuucgccgacuucgacuccaugaccgaccgccuccucgacgagaucauccaguacauccagaucuacucccucaccgucuccaagaucuccuucaucggccacucccucggcaaccucaucauccgcuccguccucacccgcccccgcuucaaguacuaccucaacaagcuccacaccuuccucucccucuccggcccccaccucggcacccucuacaacuccuccgcccucgucaacaccggccucugguucaugcagaaguggaagaaguccggcucccuccuccagcucaccugccgcgaccacuccgacccccgccagaccuuccucuacaagcucuccaacaaggccggccuccacuacuucaagaacgucguccucgucggcucccuccaggaccgcuacguccccuaccacuccgcccgcaucgagaugugcaagaccgcccucaaggacaagcaguccggccagaucuacuccgagaugauccacaaccuccuccgccccguccuccaguccaaggacugcaaccucguccgcuacaacgucaucaacgcccuccccaacaccgccgacucccucaucggccgcgccgcccacaucgccguccucgacuccgagaucuuccucgagaaguucuuccucgucgccgcccucaaguacuuccaguga

SEQ ID NO: 42967 - RNA, 4221 nt, Artificial Sequence
  derived and/or modified sequence opt2 from FAM135B__Homo_sapiens__NP_056996
auguccgagauccagggcaccgucgaguucuccgucgagcuccacaaguucuacaacgucgaccucuuccagcgcggcuacuaccagauccgcgucacccucaaggucuccucccgcaucccccaccgccucuccgccuccaucgccggccagaccgaguccuccucccuccacuccgccugcguccacgacuccaccguccacucccgcgucuuccagauccucuaccgcaacgaggagguccccaucaacgacgccgucgucuuccgcguccaccuccuccucggcggcgagcgcauggaggacgcccucuccgaggucgacuuccagcucaaggucgaccuccacuucaccgacuccgagcagcagcuccgcgacgucgccggcgcccccauggucuccucccgcacccucggccuccacuuccacccccgcaacggccuccaccaccagguccccgucauguucgacuacuuccaccucuccgucaucuccgucaccguccacgccgcccucgucgcccuccagcagccccucaucuccuucacccgccccggccgcggcuccuggcucggcaagggcggccccgacaccggccaggagcaguccaucaucucccucgagaaccucgucuucggcgccggcuacugcaagcccaccuccuccgagggcuccuucuacaucaccuccgagaacugcaugcagcacgcccacaaguggcaccgcgaccucugccuccuccuccuccacgccuaccgcggccuccgccuccacuuccucgucaucaugcgcgacauccccgagcucccccacaccgagcucgaggcccucgccgucgaggagacccucucccagcucugcuccgagcuccagaugcucaacaaccccgagaagaucgccgagcagaucuccaaggaccucgccuggcucaccucccacaugaugacccucuggacccaguuccucgacaccgucacccuccacucccaggucaccaccuaccucacccaggagcaccacacccuccgcguccgccgcuucuccgaggccuucuucuacauggagcaccagaagcucgccguccucaccuuccaggagaaccucauccagacccacucccagcucucccucgacauccgcaacuccgaguaccucaccuccaugcccccccuccccgccgagugccucgacaucgacggcgacuggaacacccuccccgucaucuucgaggaccgcuacgucgacugccccgccaccggccacaaccucuccgucuaccccaacuucgacguccccgucaccucccccaccaucaugaaccucaaggacaaggaggacaacugcauggucaacuccaaccucuccuuccgcgaggaccucguccucuccaccaucaagcccucccagauggacuccgacgaggaggucauccgcugccccgagcccggcgagaacgucgccacccagaaccacauggacaugugcuccgagucccaggucuacaucuccaucggcgaguuccagaacaaggccggcguccccgaggacgagugcuggaccggccagaccuccgacgccggcaccuaccccgucgccgacgucgacaccucccgccgcucccccggccccgaggacggccaggcccccguccucaccuacaucgacgucaaguccuccaacaagaaccccucccgcgccgagccccucgucgccuucaacgcccagcacgagucccgcuccucccgcgacaaguacggccucgaccgcaccggccucuccaaggucgucgucggcggcucccaccagaacgccaucuccuccgacaagaccacccuccacgagcucuccacccucggcaagggcaucgaccaggagggcaagaugguccuccucucccucaagcucacccccuccgagcccugcgacccccucuccuccacccuccgcgagccccucgacauccgcuccucccucaaggacucccacaccgaggagcaggaggagcucuccguccucuccggcgucaucaagcgcuccuccuccaucaucuccgacuccggcaucgaguccgagcccuccuccgucgccugguccgaggcccgcucccgcgcccucgagcuccccuccgaccgcgagguccuccaccccuucguccgccgccacgcccuccaccgcaacucccucgagggcggccacaccgaguccaacaccucccuccccuccggcauccaggccucccucaccuccaucuccucccuccccuucgaggaggacgagcgcgaggucgcccucaccaagcucaccaaguccgucuccgccccccacaucuccucccccgaggaggccgccgaggacgccgacaccaagcagcaggacggcggcuucgccgagcccuccgacaugcacuccaagucccagggcucccccggcuccugcucccagcucugcggcgacuccggcaccgacgccggcgccgaccacccccucgucgagaucguccucgacgccgacaaccagcagggccccggcuacaucgacauccccaagggcaagggcaagcaguucgacgcccagggccacugccuccccgacggccgcaccgagaacacccccggcgucgagaccaagggccucaaccucaagaucccccgcgucaucgcccucgagaacccccgcacccgcucccuccaccgcgcccucgaggagacccccaagggcaugcccaaggaccucaacgucggccagcaggcccucuccaacuccggcaucuccgaggucgagggccucucccagcaccagguccccgagcucuccugcaccuccgccgccgacgccaucaaccgcaacuccaccggccagcagucccaguccggcucccccugcaucauggacgacaccgccuucaaccgcggcgucaacgccuuccccgaggccaagcacaaggccggcaccgucugccccaccgucacccacuccguccacucccagguccucaagaaccaggagcucaaggccggcaccuccaucaugggcucccaccucaccuccgccgagaccuucacccucgacucccucaaggccgucgaggucgucaaccucuccgucuccugcaccgccaccugccuccccuucuccuccguccccaaggagacccccgcccgcgccggcuucuccuccaagcagacccucuuccccaucacccaccagccccucggcuccuucggcgucgucuccacccacuccuccacccucgacgaggaggucuccgagcgcauguucuccuucuaccaggccaaggagaaguucaagaaggagcucaagaucgagggcuuccucuacuccgaccucaccguccucgccuccgacauccccuacuucccccccgaggaggaggaggagaaccucgaggacggcauccaccucgucgucugcguccacggccucgacggcaacuccgccgaccuccgccucgucaagaccuucaucgagcucggccuccccggcggcaagcucgacuuccucauguccgagaagaaccagauggacaccuucgccgacuucgacaccaugaccgaccgccuccucgacgagaucauccagcacauccagcucuacaaccucuccaucucccgcaucuccuucaucggccacucccucggcaacaucaucauccgcuccguccucacccgcccccgcuuccgcuacuaccucaacaagcuccacaccuuccucucccucuccggcccccaccucggcacccucuacaacaacuccacccucgucuccaccggccucuggcucaugcagaagcucaagaaguccggcucccuccuccagcucaccuuccgcgacaacgccgaccuccgcaagugcuuccucuaccagcucucccagaagaccggccuccaguacuucaagaacgucguccucgucgccuccccccaggaccgcuacguccccuuccacuccgcccgcaucgagaugugcaagaccgcccucaaggaccgccacaccggccccgucuacgccgagaugaucaacaaccuccucggcccccucgucgaggccaaggacugcacccucauccgccacaacgucuuccacgcccuccccaacaccgccaacacccucaucggccgcgccgcccacaucgccguccucgacuccgagcucuuccucgagaaguucuuccucgucgccggccucaacuacuucaaguga

SEQ ID NO: 42968 - RNA, 417 nt, Artificial Sequence
  derived and/or modified sequence opt2 from FAM136A__Homo_sapiens__NP_116211
auggccgagcuccagcagcuccgcguccaggaggccgucgaguccauggucaagucccucgagcgcgagaacauccgcaagaugcagggccucauguuccgcugcuccgccuccugcugcgaggacucccaggccuccaugaagcagguccaccagugcaucgagcgcugccacgucccccucgcccaggcccaggcccucgucaccuccgagcucgagaaguuccaggaccgccucgcccgcugcaccaugcacugcaacgacaaggccaaggacuccaucgacgccggcuccaaggagcuccaggucaagcagcagcucgacuccugcgucaccaagugcgucgacgaccacaugcaccucauccccaccaugaccaagaagaugaaggaggcccuccucuccaucggcaaguga

SEQ ID NO: 42969 - RNA, 2094 nt, Artificial Sequence
  derived and/or modified sequence opt2 from FAM13A__Homo_sapiens__NP_001015045
auggccugcgagaucaugccccuccaguccucccaggaggacgagcgcccccucucccccuucuaccucuccgcccacgucccccaggucuccaacgucuccgccaccggcgagcuccucgagcgcaccauccgcuccgccgucgagcagcaccucuucgacgucaacaacuccggcggccaguccuccgaggacuccgaguccggcacccucuccgccuccuccgccaccuccgcccgccagcgccgccgccaguccaaggagcaggacgagguccgccacggccgcgacaagggccucaucaacaaggagaacacccccuccggcuucaaccaccucgacgacugcauccucaacacccaggaggucgagaagguccacaagaacaccuucggcugcgccggcgagcgcuccaagcccaagcgccagaaguccuccaccaagcucuccgagcuccacgacaaccaggacggccucgucaacauggagucccucaacuccacccgcucccacgagcgcaccggccccgacgacuucgaguggauguccgacgagcgcaagggcaacgagaaggacggcggccacacccagcacuucgagucccccaccaugaagauccaggagcaccccucccucuccgacaccaagcagcagcgcaaccaggacgccggcgaccaggaggaguccuucgucuccgaggucccccaguccgaccucaccgcccucugcgacgagaagaacugggaggagcccauccccgccuucuccuccuggcagcgcgagaacuccgacuccgacgaggcccaccucuccccccaggccggccgccucauccgccagcuccucgacgaggacuccgaccccaugcucuccccccgcuucuacgccuacggccagucccgccaguaccucgacgacaccgaggucccccccuccccccccaacucccacuccuucaugcgccgccgcuccuccucccucggcuccuacgacgacgagcaggaggaccucacccccgcccagcucacccgccgcauccagucccucaagaagaagauccgcaaguucgaggaccgcuucgaggaggagaagaaguaccgccccucccacuccgacaaggccgccaaccccgagguccucaaguggaccaacgaccucgccaaguuccgccgccagcucaaggaguccaagcucaagaucuccgaggaggaccucaccccccgcaugcgccagcgcuccaacacccuccccaaguccuucggcucccagcucgagaaggaggacgagaagaagcaggagcucgucgacaaggccaucaagcccuccgucgaggccacccucgaguccauccagcgcaagcuccaggagaagcgcgccgaguccucccgccccgaggacaucaaggacaugaccaaggaccagaucgccaacgagaaggucgcccuccagaaggcccuccucuacuacgaguccauccacggccgccccgucaccaagaacgagcgccaggucaugaagccccucuacgaccgcuaccgccucgucaagcagauccucucccgcgccaacaccauccccaucaucggcucccccuccuccaagcgccgcuccccccuccuccagcccaucaucgagggcgagaccgccuccuucuucaaggagaucaaggaggaggaggagggcuccgaggacgacuccaacgucaagcccgacuucauggucacccucaagaccgacuucuccgcccgcugcuuccucgaccaguucgaggacgacgccgacggcuucaucucccccauggacgacaagauccccuccaagugcucccaggacaccggccucuccaaccuccacgccgccuccauccccgagcuccucgagcaccuccaggagaugcgcgaggagaagaagcgcauccgcaagaagcuccgcgacuucgaggacaacuucuuccgccagaacggccgcaacguccagaaggaggaccgcacccccauggccgaggaguacuccgaguacaagcacaucaaggccaagcuccgccuccucgagguccucaucuccaagcgcgacaccgacuccaaguccauguga

SEQ ID NO: 42970 - RNA, 1464 nt, Artificial Sequence
  derived and/or modified sequence opt2 from FAM13C__Homo_sapiens__NP_001001971
auguucuccugcuucugcuucucccuccaggacaacuccuucuccuccaccaccgucaccgagugcgacgaggaccccgucucccuccacgaggaccagaccgacugcuccucccuccgcgacgagaacaacaaggagaacuaccccgacgccggcgcccucgucgaggagcacgccccccccuccugggagccccagcagcagaacgucgaggccaccguccucgucgacuccguccuccgccccuccaugggcaacuucaagucccgcaagcccaaguccaucuucaaggccgaguccggccgcucccacggcgagucccaggagaccgagcacgucgucuccucccaguccgagugccagguccgcgccggcacccccgcccacgaguccccccagaacaacgccuucaagugccaggagaccguccgccuccagccccgcaucgaccagcgcaccgccaucucccccaaggacgccuucgagacccgccaggaccucaacgaggaggaggccgcccagguccacggcgucaaggaccccgcccccgccuccacccaguccguccucgccgacggcaccgacuccgccgaccccucccccguccacaaggacggccagaacgaggccgacuccgcccccgaggaccuccacuccgucggcaccucccgccuccucuaccacaucaccgacggcgacaacccccuccucuccccccgcugcuccaucuucucccagucccagcgcuucaaccucgaccccgaguccgcccccuccccccccuccacccagcaguucaugaugccccgcuccuccucccgcugcuccugcggcgacggcaaggagccccagaccaucacccagcucaccaagcacauccagucccucaagcgcaagauccgcaaguucgaggagaaguucgagcaggagaagaaguaccgcgucaccaagcaggacaagaaccucaucaagccccucuacgaccgcuaccgcaucaucaagcagauccucuccacccccucccucauccccaccauccaggaggaggaggacuccgacgaggaccgcccccagggcucccagcagcccucccucgccgaccccgccucccaccuccccgucggcgaccaccucaccuacuccaacgagaccgagcccguccgcgcccuccuccccgacgagaagaaggaggucaagccccccgcccucuccauguccaaccuccacgaggccaccaugcccguccuccucgaccaccuccgcgagacccgcgccgacaagaagcgccuccgcaaggcccuccgcgaguucgaggagcaguucuucaagcagaccggccgcuccccccagaaggaggaccgcauccccauggccgacgaguacuacgaguacaagcacaucaaggccaagcuccgccuccucgagguccucaucuccaagcaggacgucgccaagaccaucuga

SEQ ID NO: 42971 - RNA, 1449 nt, Artificial Sequence
  derived and/or modified sequence opt2 from FAM149A__Homo_sapiens__NP_056213
augcucuucgagggcaaggucaacccccagacccagucccuccucgccgagugcggcgaguggacccgccgcucccuccaccuccgcguccucggccgccagcucauccuccccaccgacaagggcguccagcacuuccagggcuccacccccgccuccgccguccaccgccccccccucuccgccugcggccacuccuccaacauccgcgagcucugcaucuccggcucccagaucguccccgccgcccucuccgccuccgcccuccccggccccgacgacaccggcgucgccgaccucaccgcccgcuccucccucgaggaggaggucuaccacgucgacggcaagaucgaggaguacuucgccuucgaccgcaaggaggacgacgacgagugccucgagcagaagcccgcccagcccggccgcaaguggcgcaagcucggccucccccccgucuccccccgcgacugcgucaaggacgccgucgccgccgaggucuucgaccacgucuggaccaacauggucgagcuccucgaggagcucauccgcaagcacugggagaccacccucaccgagggcaagaagcagcgcgagacccucaaggucgccggcaaccgcuucccccacguccucgucccccacgcccacgccgacggcgccuccggcccccccuccggccacgccgaggcccacggcaucucccucgccucccgccucaaccccccccagauccaccacuucuccuccuccuucuacuccgacaugaacggcgucaugaccauccaggccaagccccuccagcgccgccccgccuacuucgccgaccgcacccagaacgagaaggaggacaaggccuccggcggcggcgccggcgcccucuccuccgccccccaccgccucggccgcgccuccgacacccacggccucucccccuccgccaagaagacccccguccccuggcgccuccccucccucgccuccgacucccagcgccucaagacccccaacaucuacuccgacgagguccuccgcggcaccaagcuccccaccggcgucgaccacauggccuccccccucguccagaccucccgcucccgcuuccccccccucgucaccgagacccgcggccagaacaccgccguccccggcugccgccucgucuccuaccgcggccgccaccuccagaaccgcguccucuccgccaugcccgacggcaccgagcgcucccgccuccgcgagcgcaccgccacccucgagcgccucucccgccccuccaccacccacaccuuccgccaguccgacaccccccgcaaguccucccucacccagauggaguucgccgcccacaccuggaccggccaguccauccucaccggcucccaguacguccccaaguccuuccagcgcaccacccucaccuucaagcgccgcuuccaggucaccuccuga

SEQ ID NO: 42972 - RNA, 459 nt, Artificial Sequence
  derived and/or modified sequence opt2 from FAM150B__Homo_sapiens__NP_001002919
augcgcggccccggccacccccuccuccucggccuccuccucguccucggcgccgccggccgcggccgcggcggcgccgagccccgcgagcccgccgacggccaggcccuccuccgccucgucgucgagcucguccaggagcuccgcaagcaccacuccgccgagcacaagggccuccagcuccucggccgcgacugcgcccucggccgcgccgaggccgccggccucggccccucccccgagcagcgcgucgagaucgucccccgcgaccuccgcaugaaggacaaguuccucaagcaccucaccggcccccucuacuucucccccaagugcuccaagcacuuccaccgccucuaccacaacacccgcgacugcaccauccccgccuacuacaagcgcugcgcccgccuccucacccgccucgccgucucccccgucugcauggaggacaagcaguga

SEQ ID NO: 42973 - RNA, 1377 nt, Artificial Sequence
  derived and/or modified sequence opt2 from FAM155A__Homo_sapiens__NP_001073865
augacccgcggcgccuggaugugccgccaguacgacgacggccucaagaucuggcucgccgccccccgcgagaacgagaagcccuucaucgacuccgagcgcgcccagaaguggcgccucucccucgccucccuccucuucuucaccguccuccucuccgaccaccucugguucugcgccgaggccaagcucacccgcgcccgcgacaaggagcaccagcagcagcagcgccagcagcagcagcagcagcagcagcagcgccagcgccagcagcagcagcagcagcgccgccagcaggagcccuccuggcccgcccuccucgccuccaugggcgaguccucccccgccgcccaggcccaccgccuccucuccgccuccuccucccccacccucccccccucccccggcgacggcggcggcggcggcggcaagggcaaccgcggcaaggacgaccgcggcaaggcccucuuccucggcaacuccgccaagcccgucuggcgccucgagaccugcuacccccagggcgccuccuccggccagugcuucaccgucgagaacgccgacgccgucugcgcccgcaacuggucccgcggcgccgccggcggcgacggccaggagguccgcuccaagcaccccaccccccucuggaaccucuccgacuucuaccucuccuucugcaacuccuacacccucugggagcucuucuccggccucuccucccccaacacccucaacugcucccucgacgucguccucaaggagggcggcgagaugaccaccugccgccagugcgucgaggccuaccaggacuacgaccaccacgcccaggagaaguacgaggaguucgaguccguccuccacaaguaccuccaguccgaggaguacuccgucaaguccugccccgaggacugcaagaucgucuacaaggccuggcucugcucccaguacuucgaggucacccaguucaacugccgcaagaccauccccugcaagcaguacugccucgagguccagacccgcugccccuucauccuccccgacaacgacgaggucaucuacggcggccucuccuccuucaucugcaccggccucuacgagaccuuccucaccaacgacgagcccgagugcugcgacguccgccgcgaggagaaguccaacaaccccuccaagggcaccgucgagaaguccggcuccugccaccgcaccucccucaccgucuccuccgccacccgccucugcaacucccgccucaagcucugcguccucguccucauccuccuccacaccguccucaccgccuccgccgcccagaacaccgccggccucuccuucggcggcaucaacacccucgaggagaacuccaccaacgaggaguga

SEQ ID NO: 42974 - RNA, 2217 nt, Artificial Sequence
  derived and/or modified sequence opt2 from FAM160B1__Homo_sapiens__NP_001128523
auguucuccaaguucaccuccauccuccagcacgccgucgaggcccucgcccccucccucccccuccaggaggacuucgucuaccacuggaaggccaucacccacuacuacaucgagaccuccgacgacaaggcccccgucaccgacaccaacauccccucccaccucgagcagaugcucgacauccucguccaggaggagaacgagcgcgaguccggcgagaccggccccugcauggaguaccuccuccaccacaagauccucgagacccucuacacccucggcaaggccgacugcccccccggcaugaagcagcagguccucgucuucuacaccaagcuccucggccgcauccgccagccccuccucccccacaucaacguccaccgccccguccagaagcucauccgccucugcggcgagguccucgccacccccaccgagaacgaggagauccaguuccucugcaucgucugcgccaagcucaagcaggaccccuaccucgucaacuucuuccucgagaacaagaugaagucccucgccuccaagggcguccccaacgucaucuccgaggacacccucaagggccaggacucccucuccaccgacaccggccagucccgccagcccgaggagcucuccggcgccaccggcauggagcagaccgagcucgaggacgagcccccccaccagauggaccaccucuccaccucccucgacaaccucuccgucaccucccuccccgaggccuccgucgucugccccaaccaggacuacaaccucgucaacucccuccucaaccucacccgcucccccgacggccgcaucgccgucaaggccugcgagggccucaugcuccucgucucccuccccgagcccgccgccgccaagugccucacccaguccaccugccucugcgagcuccucaccgaccgccucgccucccucuacaaggcccucccccaguccgucgacccccucgacaucgagaccgucgaggccaucaacuggggccucgacuccuacucccacaaggaggacgccuccgccuuccccggcaagcgcgcccucaucuccuuccucuccugguucgacuacugcgaccagcucaucaaggaggcccagaagaccgccgccgucgcccucgccaaggccguccacgagcgcuucuucaucggcgucauggagccccagcucaugcagaccuccgagaugggcauccucaccuccaccgcccuccuccaccgcaucguccgccaggucaccuccgacguccuccuccaggagauggucuucuucauccucggcgagcagcgcgagcccgagacccucgccgagaucucccgccacccccuccgccaccgccucaucgagcacugcgaccacaucuccgacgagaucuccaucaugacccuccgcauguucgagcaccuccuccagaagcccaacgagcacauccucuacaaccucguccuccgcaaccucgaggagcgcaacuacaccgaguacaagccccucugccccgaggacaaggacgucgucgagaacggccucaucgccggcgccgucgaccucgaggaggacccccucuucaccgacaucucccccgagaacacccuccccaaccaggaguggcucuccuccuccccccccgccacccccgaccaccccaagaacgacggcaagaccgagguccacaagaucgucaacuccuuccucugccucguccccgacgacgccaaguccuccuaccacgucgagggcaccggcuacgacaccuaccuccgcgacgcccaccgccaguuccgcgacuacugcgccaucugccuccgcugggaguggcccggcucccccaaggcccucgagaagugcaaccucgaggccgccuucuucgagggccacuuccucaagguccucuucgaccgcaugggccgcauccucgaccagcccuacgacgucaaccuccaggucaccuccguccucucccgccucucccucuucccccacccccacauccacgaguaccuccucgaccccuacgucaaccucgcccccggcugccgcucccucuucuccgucaucguccgcgucgucggcgaccucaugcuccgcauccagcgcauccaggacuucacccccaagcuccuccucguccgcaagcgccuccucggccucgagcccgagggccccaugcagacccuccccuccuggugguga

SEQ ID NO: 42975 - RNA, 2151 nt, Artificial Sequence
  derived and/or modified sequence opt2 from FAM161A__Homo_sapiens__NP_001188472
auggccaccucccaccgcgucgccaagcucgucgccuccucccuccagacccccgucaaccccaucaccggcgcccgcgucgcccaguacgagcgcgaggacccccucaaggcccucgccgccgccgaggccauccucgaggacgaggaggaggagaaggucgcccagcccgccggcgccuccgccgaccucaacaccuccuucuccggcgucgacgagcacgcccccaucuccuacgaggacuucgucaacuuccccgacauccaccacuccaacgaggaguacuucaagaaggucgaggagcucaaggccgcccacaucgagaccauggccaagcucgagaagauguaccaggacaagcuccaccucaaggagguccagcccgucgucauccgcgaggacucccucuccgacuccucccgcuccgucuccgagaagaacuccuaccaccccgucucccucaugaccuccuucuccgagcccgaccucggccaguccuccucccucuacgucuccuccuccgaggaggagcuccccaaccucgagaaggaguacccccgcaagaaccgcaugaugaccuacgccaaggagcucaucaacaacauguggaccgacuucugcgucgaggacuacauccgcugcaaggacaccggcuuccacgccgccgagaagcgccgcaagaagcgcaaggaguggguccccaccaucaccguccccgagcccuuccagaugaugauccgcgagcagaagaagaaggaggaguccaugaaguccaaguccgacaucgagaugguccacaaggcccucaagaagcaggaggaggaccccgaguacaagaagaaguuccgcgccaaccccguccccgccuccgucuuccucccccucuaccacgaccucgucaagcagaaggaggagcgccgccgcucccucaaggagaaguccaaggaggcccuccucgccucccagaagcccuucaaguucaucgcccgcgaggagcagaagcgcgccgcccgcgagaagcagcuccgcgacuuccucaaguacaagaagaagaccaaccgcuucaaggcccgccccaucccccgcuccaccuacggcuccaccaccaacgacaagcucaaggaggaggagcucuaccgcaaccuccgcacccagcuccgcgcccaggagcaccuccagaacuccuccccccuccccugccgcuccgccugcggcugccgcaacccccgcugccccgagcaggccgucaagcucaagugcaagcacaagguccgcugccccacccccgacuucgaggaccuccccgagcgcuaccagaagcaccucuccgagcacaagucccccaagcuccucaccgucugcaagcccuucgaccuccacgccuccccccacgccuccaucaagcgcgagaagauccucgccgacaucgaggccgacgaggagaaccucaaggagacccgcuggcccuaccucuccccccgccgcaagucccccguccgcugcgccggcgucaaccccguccccugcaacugcaacccccccguccccaccgucuccucccgcggccgcgagcaggccguccgccgcucccucgaggagaagaagaugcucgaggaggagcgcaaccgcauccucaccaagcagaagcagcgcaugaaggagcuccagaagcuccucaccacccgcgccaaggccuacgacucccaccagucccucgcccagaucuccaagucccgcgucaagugccuccgcaaguccgagaaggagcgcaugcgcgaguaccagcgcgagcucgaggagcgcgaggagaagcucaagaagcgcccccuccucuucgagcgcgucgcccagaagaacgcccgcauggccgccgagaagcacuacuccaacacccucaaggcccucggcaucuccgacgaguucgucuccaagaagggccaguccggcaagguccucgaguacuucaacaaccaggagaccaaguccgucaccgaggacaaggaguccuucaacgaggaggagaagaucgaggagcgcgagaacggcgaggagaacuacuucaucgacaccaacucccaggacuccuacaaggagaaggacgaggccaacgaggaguccgaggaggagaaguccgucgaggagucccacuga

SEQ ID NO: 42976 - RNA, 504 nt, Artificial Sequence
  derived and/or modified sequence opt2 from FAM163A__Homo_sapiens__NP_775780
augaccgccggcaccgucgucaucaccggcggcauccucgccaccgucauccuccucugcaucaucgccguccucugcuacugccgccuccaguacuacugcugcaagaaguccggcaccgaggucgccgacgaggaggaggagcgcgagcacgaccuccccacccacccccgcggccccaccugcaacgccugcuccucccaggcccucgacggccgcggcucccucgccccccucaccuccgagcccugcucccagcccugcggcgucgccgccucccacugcaccaccugcucccccuacuccucccccuucuacauccgcaccgccgacaugguccccaacggcggcggcggcgagcgccucuccuucgcccccaccuacuacaaggagggcggcccccccucccucaagcucgccgccccccaguccuaccccgucaccuggcccggcuccggccgcgaggccuucaccaacccccgcgccaucuccaccgacgucuga

SEQ ID NO: 42977 - RNA, 501 nt, Artificial Sequence
  derived and/or modified sequence opt2 from FAM163B__Homo_sapiens__NP_001073984
augaccgccggcaccgucgucaucaccggcggcauccucgccaccgucauccuccucugcaucaucgccguccucugcuacugccgccuccaguacuacugcugcaagaaggacgaguccgaggaggacgaggaggagcccgacuucgccguccacucccaccuccccccccuccacuccaaccgcaaccucguccucaccaacggccccgcccucuaccccaccgccuccaccuccuucucccagaaguccccccaggcccgcgcccucugccgcuccugcucccacugcgagccccccaccuucuuccuccaggagccccccgaggaggaggaggacguccucaacggcggcgagcgcguccucuacaaguccgucucccaggaggacgucgagcucccccccggcggcuucggcggccuccaggcccucaaccccaaccgccucuccgccaugcgcgaggccuucgcccgcucccgcuccaucuccaccgacgucuga

SEQ ID NO: 42978 - RNA, 645 nt, Artificial Sequence
  derived and/or modified sequence opt2 from FAM167A__Homo_sapiens__NP_444509
auguccgucccccagauccacgucgaggaggucggcgccgaggagggcgccggcgccgccgccccccccgacgaccaccuccgcucccucaaggcccucaccgagaagcuccgccucgagacccgccgccccuccuaccucgaguggcaggcccgccucgaggagcacaccuggcccuucccccgccccgccgccgagccccaggccucccucgaggagggcgagcgcggcggccaggagccccuccucccccuccgcgaggccggccagcacccccccuccgcccgcuccgccucccagggcgcccgcccccucuccaccggcaagcucgagggcuuccaguccaucgacgaggccaucgccuggcuccgcaaggagcucaccgagaugcgccuccaggaccagcagcucgcccgccagcucaugcgccuccgcggcgacaucaacaagcucaagaucgagcacaccugccgccuccaccgccgcaugcucaacgacgccaccuacgagcucgaggagcgcgacgagcucgccgaccucuucugcgacuccccccucgccuccuccuucucccucuccaccccccucaagcucaucggcgucaccaagaugaacaucaacucccgccgcuucucccucugcuga

SEQ ID NO: 42979 - RNA, 735 nt, Artificial Sequence
  derived and/or modified sequence opt2 from FAM168A__Homo_sapiens__NP_001272979
augaaccccgucuacucccccguccagcccggcgcccccuacggcaaccccaagaacauggccuacaccggcuaccccaccgccuaccccgccgccgcccccgccuacaaccccucccucuaccccaccaacucccccuccuacgcccccgaguuccaguuccuccacuccgccuacgccacccuccucaugaagcaggccuggccccagaacuccuccuccugcggcaccgagggcaccuuccaccuccccgucgacaccggcaccgagaaccgcaccuaccaggccuccuccgccgccuuccgcuacaccgccggcacccccuacaaggucccccccacccaguccaacaccgcccccccccccuacucccccucccccaaccccuaccagaccgccauguaccccauccgcuccgccuacccccagcagaaccucuacgcccagggcgccuacuacacccagcccgucuacgccgcccagccccacgucauccaccacaccaccgucguccagcccaacuccauccccuccgccaucuaccccgcccccgucgccgccccccgcaccaacggcgucgccaugggcauggucgccggcaccaccauggccauguccgccggcacccuccucaccaccccccagcacaccgccaucggcgcccaccccgucuccaugcccaccuaccgcgcccagggcacccccgccuacuccuacguccccccccacugguga

SEQ ID NO: 42980 - RNA, 588 nt, Artificial Sequence
  derived and/or modified sequence opt2 from FAM168B__Homo_sapiens__NP_001009993
augaaccccgucuacucccccggcuccuccggcguccccuacgccaacgccaagggcaucggcuaccccgccggcuuccccaugggcuacgccgccgccgcccccgccuacucccccaacauguaccccggcgccaaccccaccuuccagaccggcuacacccccggcacccccuacaaggucuccugcucccccaccuccggcgccgucccccccuacuccuccucccccaaccccuaccagaccgccgucuaccccguccgcuccgccuacccccagcagucccccuacgcccagcagggcaccuacuacacccagccccucuacgccgcccccccccacgucauccaccacaccaccgucguccagcccaacggcaugcccgccaccgucuaccccgcccccaucccccccccccgcggcaacggcgucaccaugggcauggucgccggcaccaccauggccauguccgccggcacccuccucaccgcccacucccccacccccgucgccccccaccccgucaccguccccaccuaccgcgcccccggcacccccaccuacuccuacguccccccccagugguga

SEQ ID NO: 42981 - RNA, 579 nt, Artificial Sequence
  derived and/or modified sequence opt2 from FAM169B__Homo_sapiens__NP_872368
augaagguccaguccuucggcgagcgcgucguccucuucauccucaacgccaucaucuucggccgccucgagcgcaaccucgacgacgacgacauguucuuccucccccacuccgucaaggagcaggccaagauccucuggcgccgcggcgccgccgucggcuucuacaccaccaagaugaagggccgccucugcggcgacggcaccggcgccugcuaccuccuccccgucuucgacaccgucuucauccgccgcaagcacuggcaccgcggccucggcaccgccaugcuccgcgacuucugcgagaccuuccccgaggacgaggcccucggcgucuccugcuccaugucccccgccauguaccaggcccaccccggcaacuccgaggacgucucccgccacgcccgcaccucccagaacgaccgcccccgccagcccgcccccggcgacggcuccaaggagcgcaugugcggcgaggagcucgaggacaccaaggacgaccccgagugcggcgucgaggaggaggacgccggccucgccggccagccccccggcaagcucacccgcuccucccccuga

SEQ ID NO: 42982 - RNA, 849 nt, Artificial Sequence
  derived and/or modified sequence opt2 from FAM170A__Homo_sapiens__NP_001157463
augaagcgccgccagaagcgcaagcaccucgagaacgaggagucccaggagaccgccgagaagggcggcggcauccagcgcauccaccgcgacuccccccagccccaguccccccucgcccagguccaggagcgcggcgagacccccccccgcucccagcacgucucccucuccuccuacuccuccuacaagaccugcgucuccucccucugcgucaacaaggaggagcgcggcaugaagaucuacuacaugcagguccagaugaacaagggcgucgccgucuccugggagaccgaggagacccucgagucccucgagaagcagccccgcauggaggaggucacccucuccgaggucguccgcgucggcaccccccccuccgacgucuccacccgcaaccuccucuccgacuccgagcccuccggcgaggagaaggagcacgaggagcgcaccgaguccgacucccuccccggcucccccaccgucgaggacaccccccgcgccaagacccccgacuggcucgucaccauggagaacggcuuccgcugcauggccugcugccgcgucuucaccaccauggaggcccuccaggagcacguccaguucggcauccgcgagggcuucuccugccacgucuuccaccucaccauggcccagcucaccggcaacauggaguccgaguccacccaggacgagcaggaggaggagaacggcaacgagaaggaggaggaggagaagcccgaggccaaggaggaggagggccagcccaccgaggaggaccucggccuccgccgcuccuggucccagugccccggcugcgucuuccacucccccaaggaccgcaacuga

SEQ ID NO: 42983 - RNA, 1113 nt, Artificial Sequence
  derived and/or modified sequence opt2 from FAM172A__Homo_sapiens__NP_001156889
augaagaaggacgagcccccccucgacuuccccgacacccucgagggcuucgaguacgccuucaacgagaagggccagcuccgccacaucaagaccggcgagcccuucgucuucaacuaccgcgaggaccuccaccgcuggaaccagaagcgcuacgaggcccucggcgagaucaucaccaaguacgucuacgagcuccucgagaaggacugcaaccucaagaaggucuccauccccgucgacgccaccgaguccgagcccaaguccuucaucuucauguccgaggacgcccucaccaacccccagaagcucaugguccucauccacggcuccggcgucguccgcgccggccagugggcccgccgccucaucaucaacgaggaccucgacuccggcacccagauccccuucaucaagcgcgccgucgccgagggcuacggcgucaucguccucaaccccaacgagaacuacaucgaggucgagaagcccaagauccacguccaguccuccuccgacuccuccgacgagcccgccgagaagcgcgagcgcaaggacaaggucuccaaggagaccaagaagcgccgcgacuucuacgagaaguaccgcaacccccagcgcgagaaggagaugaugcagcucuacauccgcgagaacggcucccccgaggagcacgccaucuacgucugggaccacuucaucgcccaggccgccgccgagaacgucuucuucgucgcccacuccuacggcggccucgccuucgucgagcucaugauccagcgcgaggccgacgucaagaacaaggucaccgccgucgcccucaccgacuccguccacaacgucuggcaccaggaggccggcaagaccauccgcgaguggaugcgcgagaacugcugcaacugggucuccuccuccgagccccucgacaccuccgucgaguccaugcuccccgacugcccccgcgucuccgccggcaccgaccgccacgagcucaccuccuggaaguccuuccccuccaucuucaaguucuucaccgaggccuccgaggccaagaccuccucccucaagcccgccgucacccgccgcucccaccgcaucaagcacgaggagcucuga

SEQ ID NO: 42984 - RNA, 702 nt, Artificial Sequence
  derived and/or modified sequence opt2 from FAM173B__Homo_sapiens__NP_954584
auggagggcggcggcggcaucccccucgagacccucaaggaggagucccagucccgccacguccuccccgccuccuucgaggucaacucccuccagaaguccaacuggggcuuccuccucaccggccucgucggcggcacccucgucgccgucuacgccgucgccacccccuucgucacccccgcccuccgcaaggucugccuccccuucguccccgccaccaccaagcagaucgagaacgucgucaagaugcuccgcugccgccgcggcucccucgucgacaucggcuccggcgacggccgcaucgucaucgccgccgccaagaagggcuucaccgccgucggcuacgagcucaaccccuggcucgucugguacucccgcuaccgcgccuggcgcgagggcguccacggcuccgccaaguucuacaucuccgaccucuggaaggucaccuucucccaguacuccaacgucgucaucuucggcgucccccagaugaugcuccagcucgagaagaagcucgagcgcgagcucgaggacgacgcccgcgucaucgccugccgcuuccccuucccccacuggacccccgaccacgucaccggcgagggcaucgacaccgucugggccuacgacgccuccaccuuccgcggccgcgagaagcgccccugcaccuccaugcacuuccagcuccccauccaggccuga

SEQ ID NO: 42985 - RNA, 573 nt, Artificial Sequence
  derived and/or modified sequence opt2 from FAM174A__Homo_sapiens__NP_940909
augaaggccucccagugcugcugcugccucucccaccuccucgccuccguccuccuccuccuccuccuccccgagcucuccggcccccucgccguccuccuccaggccgccgaggccgcccccggccucggcccccccgacccccgcccccgcacccuccccccccucccccccggccccacccccgcccagcagcccggccgcggccucgccgaggccgccggcccccgcggcuccgagggcggcaacggcuccaaccccgucgccggccucgagaccgacgaccacggcggcaaggccggcgagggcuccgucggcggcggccucgccgucucccccaaccccggcgacaagcccaugacccagcgcgcccucaccguccucauggucgucuccggcgccguccucgucuacuucgucguccgcaccguccgcaugcgccgccgcaaccgcaagacccgccgcuacggcguccucgacaccaacaucgagaacauggagcucaccccccucgagcaggacgacgaggacgacgacaacacccucuucgacgccaaccacccccgccgcuga

SEQ ID NO: 42986 - RNA, 1230 nt, Artificial Sequence
  derived and/or modified sequence opt2 from FAM175A__Homo_sapiens__NP_620775
auggagggcgaguccaccuccgccguccucuccggcuucguccucggcgcccucgccuuccagcaccucaacaccgacuccgacaccgagggcuuccuccucggcgaggucaagggcgaggccaagaacuccaucaccgacucccagauggacgacgucgaggucgucuacaccaucgacauccagaaguacauccccugcuaccagcucuucuccuucuacaacuccuccggcgaggucaacgagcaggcccucaagaagauccucuccaacgucaagaagaacgucgucggcugguacaaguuccgccgccacuccgaccagaucaugaccuuccgcgagcgccuccuccacaagaaccuccaggagcacuucuccaaccaggaccucgucuuccuccuccucacccccuccaucaucaccgaguccugcuccacccaccgccucgagcacucccucuacaagccccagaagggccucuuccaccgcgucccccucgucgucgccaaccucggcauguccgagcagcucggcuacaagaccgucuccggcuccugcauguccaccggcuucucccgcgccguccagacccacuccuccaaguucuucgaggaggacggcucccucaaggagguccacaagaucaacgagauguacgccucccuccaggaggagcucaaguccaucugcaagaaggucgaggacuccgagcaggccgucgacaagcucgucaaggacgucaaccgccucaagcgcgagaucgagaagcgccgcggcgcccagauccaggccgcccgcgagaagaacauccagaaggacccccaggagaacaucuuccucugccaggcccuccgcaccuucuuccccaacuccgaguuccuccacuccugcgucaugucccucaagaaccgccacgucuccaaguccuccugcaacuacaaccaccaccucgacgucgucgacaaccucacccucauggucgagcacaccgacauccccgaggccucccccgccuccaccccccagaucaucaagcacaaggcccucgaccucgacgaccgcuggcaguucaagcgcucccgccuccucgacacccaggacaagcgcuccaaggccgacaccggcuccuccaaccaggacaaggccuccaagauguccucccccgagaccgacgaggagaucgagaagaugaagggcuucggcgaguacucccgcucccccaccuucuga

SEQ ID NO: 42987 - RNA, 1248 nt, Artificial Sequence
  derived and/or modified sequence opt2 from FAM175B__Homo_sapiens__NP_115558
auggccgccuccaucuccggcuacaccuucuccgccgucugcuuccacuccgccaacuccaacgccgaccacgagggcuuccuccucggcgagguccgccaggaggagaccuucuccaucuccgacucccagaucuccaacaccgaguuccuccaggucaucgagauccacaaccaccagcccugcuccaagcucuucuccuucuacgacuacgccuccaaggucaacgaggagucccucgaccgcauccucaaggaccgccgcaagaaggucaucggcugguaccgcuuccgccgcaacacccagcagcagauguccuaccgcgagcagguccuccacaagcagcucacccgcauccucggcguccccgaccucgucuuccuccucuucuccuucaucuccaccgccaacaacuccacccacgcccucgaguacguccucuuccgccccaaccgccgcuacaaccagcgcaucucccucgccauccccaaccucggcaacaccucccagcaggaguacaaggucuccuccguccccaacaccucccaguccuacgccaaggucaucaaggagcacggcaccgacuucuucgacaaggacggcgucaugaaggacauccgcgccaucuaccaggucuacaacgcccuccaggagaagguccaggccgucugcgccgacgucgagaaguccgagcgcgucgucgaguccugccaggccgaggucaacaagcuccgccgccagaucacccagcgcaagaacgagaaggagcaggagcgccgccuccagcaggccguccucucccgccagaugcccuccgagucccucgaccccgccuucuccccccgcaugcccuccuccggcuucgccgccgagggccgcuccacccucggcgacgccgaggccuccgacccccccccccccuacuccgacuuccaccccaacaaccaggaguccacccucucccacucccgcauggagcgcuccgucuucaugccccgcccccaggccgucggcuccuccaacuacgccuccaccuccgccggccucaaguaccccggcuccggcgccgaccucccccccccccagcgcgccgccggcgacuccggcgaggacuccgacgacuccgacuacgagaaccucaucgaccccaccgagcccuccaacuccgaguacucccacuccaaggacucccgccccauggcccaccccgacgaggacccccgcaacacccagaccucccagaucuga

SEQ ID NO: 42988 - RNA, 642 nt, Artificial Sequence
  derived and/or modified sequence opt2 from FAM177A1__Homo_sapiens__NP_001072987
auggaccaggagcccgucggcggcgucgagcgcggcgaggccgucgccgccuccggcgccgccgccgccgccgccuucggcgaguccgccggccagauguccaacgagcgcggcuucgagaacgucgagcucggcgucaucggcaagaagaagaaggucccccgccgcgucauccacuucgucuccggcgagaccauggaggaguacuccaccgacgaggacgaggucgacggccucgagaagaaggacguccuccccaccgucgaccccaccaagcucaccuggggccccuaccucugguucuacaugcuccgcgccgccaccuccacccucuccgucugcgacuuccucggcgagaagaucgccuccguccucggcaucuccacccccaaguaccaguacgccaucgacgaguacuaccgcaugaagaaggaggaggaggaggaggaggaggagaaccgcauguccgaggaggccgagaagcaguaccagcagaacaagcuccagaccgacuccaucguccagaccgaccagcccgagaccgucaucuccuccuccuucgucaacgucaacuucgagauggagggcgacuccgaggucaucauggaguccaagcagaaccccgucuccgucccccccuga

SEQ ID NO: 42989 - RNA, 477 nt, Artificial Sequence
  derived and/or modified sequence opt2 from FAM177B__Homo_sapiens__NP_997351
auggagaucgacggcuuccagcagcucgaccucgagaaguccguccccuccaagaagaccacccccaagcgcaucauccacuucgucgacggcgacaucauggaggaguacuccaccgaggaggaggaggaggaggagaaggaggagcaguccaccaacuccacccucgaccccuccaagcucuccuggggccccuaccuccgcuucugggccggccgcaucgccuccaccuccuucuccaccugcgaguuccucggcggccgcuucgccgucuucuucggccucacccagcccaaguaccaguacguccucaacgaguucuaccgcauccagaacaagaaguccgacaacaaguccgagcgccgcggcuccaaggcccaggccgccgagguccccaacgagaagugccaccucgaggccggcguccaggaguacggcaccauccagcaggacgucaccgaggccaucccccaguga

SEQ ID NO: 42990 - RNA, 3561 nt, Artificial Sequence
  derived and/or modified sequence opt2 from FAM178A__Homo_sapiens__NP_001129595
augacccgccgcugcaugcccgcccgccccggcuuccccuccucccccgcccccggcuccucccccccccgcugccaccuccgccccggcuccaccgcccacgccgccgccggcaagcgcaccgagucccccggcgaccgcaagcaguccaucaucgacuucuucaagcccgccuccaagcaggaccgccacaugcucgacuccccccagaaguccaacaucaaguacggcggcucccgccucuccaucaccggcaccgagcaguucgagcgcaagcucuccucccccaaggaguccaagcccaagcgcgucccccccgagaagucccccaucaucgaggccuucaugaagggcgucaaggagcaccacgaggaccacggcauccacgagucccgccgccccugccucucccucgccuccaaguaccucgccaagggcaccaacaucuacguccccuccuccuaccaccuccccaaggagaugaagucccucaagaagaagcaccgcucccccgagcgccgcaagucccucuucauccacgagaacaacgagaagaacgaccgcgaccgcggcaagaccaacgccgacuccaagaagcagaccaccgucgccgaggccgacaucuucaacaacuccucccgcucccucuccucccgcuccucccucucccgccaccaccccgaggaguccccccucggcgccaaguuccagcucucccucgccuccuacugccgcgagcgcgagcucaagcgccuccgcaaggagcagauggagcagcgcaucaacuccgagaacuccuucuccgaggccuccucccucucccucaaguccuccaucgagcgcaaguacaagccccgccaggagcagcgcaagcagaacgacaucauccccggcaagaacaaccucuccaacgucgagaacggccaccucucccgcaagcgcuccuccuccgacuccugggagcccaccuccgccggcuccaagcagaacaaguuccccgagaagcgcaagcgcaacuccgucgacuccgaccucaaguccacccgcgaguccaugauccccaaggcccgcgaguccuuccucgagaagcgccccgacggcccccaccagaaggagaaguucaucaagcacaucgcccucaagacccccggcgacguccuccgccucgaggacaucuccaaggagcccuccgacgagaccgacggcuccuccgccggccucgcccccuccaacuccggcaacuccggccaccacuccacccgcaacuccgaccagauccaggucgccggcaccaaggagaccaagaugcagaagccccaccucccccucucccaggagaaguccgccaucaagaaggccuccaaccuccagaagaacaagaccgccuccuccaccaccaaggagaaggagaccaagcucccccuccucucccgcguccccuccgccggcuccucccucgucccccucaacgccaagaacugcgcccuccccgucuccaagaaggacaaggagcgcuccuccuccaaggagugcuccggccacuccaccgaguccaccaagcacaaggagcacaaggccaagaccaacaaggccgacuccaacgucuccuccggcaagaucuccggcggcccccuccgcuccgaguacggcacccccaccaaguccccccccgccgcccucgaggucguccccugcauccccucccccgccgcccccuccgacaaggcccccuccgagggcgaguccuccggcaacuccaacgccggcuccuccgcccucaagcgcaagcuccgcggcgacuucgacuccgacgaggagucccucggcuacaaccucgacuccgacgaggaggaggagacccucaagucccucgaggagaucauggcccucaacuucaaccagacccccgccgccaccggcaagccccccgcccucuccaagggccuccgcucccaguccuccgacuacaccggccacguccaccccggcaccuacaccaacacccucgagcgccucgucaaggagauggaggacacccagcgccucgacgagcuccagaagcagcuccaggaggacauccgccagggccgcggcaucaagucccccauccgcaucggcgaggaggacuccaccgacgacgaggacggccuccucgaggagcacaaggaguuccucaagaaguucuccgucaccaucgacgccauccccgaccaccaccccggcgaggagaucuucaacuuccucaacuccggcaagaucuucaaccaguacacccucgaccuccgcgacuccggcuucaucggccaguccgccgucgagaagcucauccucaaguccggcaagaccgaccagaucuuccucaccacccagggcuuccucaccuccgccuaccacuacguccagugccccguccccguccucaaguggcucuuccgcaugauguccguccacaccgacugcaucgucuccguccagauccucuccacccucauggagaucaccauccgcaacgacaccuucuccgacucccccgucuggcccuggauccccucccucuccgacgucgccgccgucuucuucaacaugggcaucgacuuccgcucccucuucccccucgagaaccuccagcccgacuucaacgaggacuaccucgucuccgagacccagaccaccucccgcggcaaggaguccgaggacuccuccuacaagcccaucuucuccacccuccccgagaccaacauccucaacgucgucaaguuccucggccucugcaccuccauccaccccgagggcuaccaggaccgcgagaucaugcuccucauccucaugcucuucaagaugucccucgagaagcagcucaagcagaucccccucgucgacuuccagucccuccucaucaaccucaugaagaacauccgcgacuggaacaccaagguccccgagcucugccucggcaucaacgagcucuccucccacccccacaaccuccucuggcucguccagcucguccccaacuggaccucccgcggccgccagcuccgccagugccucucccucgucaucaucuccaagcuccucgacgagaagcacgaggacguccccaacgccuccaaccuccaggucuccguccuccaccgcuaccucguccagaugaagcccuccgaccuccucaagaagaugguccucaagaagaaggccgagcagcccgacggcaucaucgacgacucccuccaccucgagcucgagaagcaggccuacuaccucaccuacauccuccuccaccucgucggcgaggucuccugcucccacuccuucuccuccggccagcgcaagcacuucguccuccucugcggcgcccucgagaagcacgucaagugcgacauccgcgaggacgcccgccucuucuaccgcaccaaggucaaggaccucgucgcccgcauccacggcaaguggcaggagaucauccagaacugccgccccacccaggucuccuucugcuacaccaucuccugcauccucaacuccuucgccgaguggcacuccuccuacugccucaaguga

SEQ ID NO: 42991 - RNA, 2040 nt, Artificial Sequence
  derived and/or modified sequence opt2 from FAM178B__Homo_sapiens__NP_001116118
auguggccccgccuccccggcgccggccucgccccccagcuccgccgccaggaccagcgccuccacuucaccggccagaugucccacggccuccagauggccggcccccaggagaccguccucgcccucccccuccgcgagggcguccaggccgccgccaccguccccauccuccucuacaaccucgaggacggccucuccgaccacccccucgaccagggcccccgcugccccgcccgccgccccugcucccccgccuccgcccccgcccccaccucccccaagaagcccaagauccaggcccccggcgagaccuuccccaccgacuggucccccccccccgucgaguuccucaacccccgcguccuccaggccucccgcgaggcccccgcccagcgcugggucggcgucgucggcccccagggccuccgccgccucgccggcgagcuccccgaggagcucgagcaggagcaccucgaccucgaccccaagcgcggccucgcccuccccgagaagcucuucuggaacaccuccggccucucccagcaggccgccgcccccgaguucuccuggggcggcuccggcuccuacuucaacaaccucgacuaccuccuccaggagaagcgcgagcaggcccucgagcaggagcgcgagcgccuccuccuccaggagugccucaaccucaacucccucgaccucgacgaggaggaggucccccucacccccgagcaccgcaugcucgucgagaaguacuccgucucccuccagaccaucccccccguccaccccggcgagaccgucuuccucccccgcugccacccccuccccugcauccucgacuccucccuccucaagccccgcucccaccucgagggccucuuccucuccuccccccccgcccagcagcucuccuuccuccgcuccggccuccucaacauccucuaccuccacaugcccgacugccccgucucccuccuccaguggcucuuccagcuccucaccuggccccccgagaccucccucggcgccuucggccuccucugggaccucaucgucgacggcaucuuccuccagcccgacgaggacaagcaccucuggugccccucccuccaggagguccgcgaggccuuccacucccucggcgcccacucccccgcccucuacccccucggccccuucuggcacggcggccgcguccuccccggcgaggccggccucaacgagaacgaggagcaggacgccccccaggagaucgcccucgacaucucccucggccacaucuacaaguuccucgcccucugcgcccaggcccagcccggcgccuacaccgacgagaaccucaugggccucaucgagcuccucugccgcaccucccucgacgucggccuccgccuccuccccaaggucgaccuccagcagcuccuccuccuccuccucgagaacauccgcgaguggcccggcaagcuccaggagcucugcugcacccucuccugggucuccgaccaccaccacaaccuccucgcccucguccaguucuuccccgacaugaccucccgcucccgccgccuccgcucccagcucucccucgucgucaucgcccgcaugcucggccagcaggagaugcucccccucuggcaggagaagacccagcucuccucccucucccgccuccucggccucaugcgccccuccucccuccgccaguaccucgacuccgucccccucccccccugccaggagcagcagcccaaggccuccgccgagcucgaccacaaggccugcuaccucugccacucccuccucaugcucgccggcgucgucgucuccugccaggacaucacccccgaccaguggggcgagcuccagcuccucugcaugcagcucgaccgccacaucuccacccagauccgcgaguccccccaggccaugcaccgcaccaugcucaaggaccucgccacccagaccuacauccgcuggcaggagcuccucacccacugccagccccaggcccaguacuucucccccuggaaggacaucuga

SEQ ID NO: 42992 - RNA, 5163 nt, Artificial Sequence
  derived and/or modified sequence opt2 from FAM179B__Homo_sapiens__NP_055906
auggccgccgcccccuccgcccuccuccuccucccccccuuccccguccucuccaccuaccgccuccagucccgcucccgccccuccgcccccgagaccgacgacucccgcgucggcggcaucaugcgcggcgagaagaacuacuacuuccgcggcgccgccggcgaccacggcuccugccccaccaccaccuccccccucgccuccgcccuccucaugcccuccgaggccgucuccuccuccugguccgaguccggcggcggccucuccggcggcgacgaggaggacacccgccuccuccagcuccuccgcaccgcccgcgaccccuccgaggccuuccaggcccuccaggccgcccucccccgccgcggcggccgccucggcuucccccgccgcaaggaggcccucuaccgcgcccucggccgcguccucgucgagggcggcuccgacgagaagcgccucugccuccagcuccucuccgacguccuccgcggccagggcgaggccggccagcucgaggaggccuucucccucgcccuccucccccagcucgucgucucccuccgcgaggagaaccccgcccuccgcaaggacgcccuccagauccuccacaucugccucaagcgcucccccggcgagguccuccgcacccucauccagcagggccucgaguccaccgacgcccgccuccgcgccuccaccgcccuccuccuccccauccuccucaccaccgaggaccuccuccucggccucgaccucaccgaggucaucaucucccucgcccgcaagcucggcgaccaggagaccgaggaggaguccgagaccgccuucuccgcccuccagcagaucggcgagcgccucggccaggaccgcuuccaguccuacaucucccgccuccccuccgcccuccgccgccacuacaaccgccgccucgagucccaguucggcucccagguccccuacuaccucgagcucgaggccuccggcuuccccgaggacccccuccccugcgccgucacccucuccaacuccaaccucaaguucggcaucaucccccaggagcuccacucccgccuccucgaccaggaggacuacaagaaccgcacccaggccgucgaggagcucaagcagguccucggcaaguucaaccccuccuccaccccccacuccucccucgucggcuucaucucccuccucuacaaccuccucgacgacuccaacuucaaggucguccacggcacccucgagguccuccaccuccucgucauccgccucggcgagcagguccagcaguuccucggccccgucaucgccgccuccgucaagguccucgccgacaacaagcucgucaucaagcaggaguacaugaagaucuuccucaagcucaugaaggaggucggcccccagcagguccucugccuccuccucgagcaccucaagcacaagcacucccgcguccgcgaggaggucgucaacaucugcaucugcucccuccucaccuaccccuccgaggacuucgaccuccccaagcucuccuucgaccucgcccccgcccucgucgacuccaagcgccgcguccgccaggccgcccucgaggccuucgccguccucgccuccuccaugggcuccggcaagaccuccauccucuucaaggccgucgacaccgucgagcuccaggacaacggcgacggcgucaugaacgccguccaggcccgccucgcccgcaagacccucccccgccucaccgagcagggcuucgucgaguacgccguccucaugcccuccuccgccggcggccgcuccaaccaccucgcccacggcgccgacaccgacuggcuccucgccggcaaccgcacccaguccgcccacugccacugcggcgaccacguccgcgacuccaugcacaucuacggcuccuacucccccaccaucugcacccgccgcguccucuccgccggcaagggcaagaacaagcuccccugggagaacgagcagcccggcaucaugggcgagaaccagaccuccaccuccaaggacaucgagcaguucuccaccuacgacuucauccccuccgccaagcucaagcucucccagggcaugcccgucaacgacgaccucugcuucucccgcaagcgcgucucccgcaaccucuuccagaacucccgcgacuucaaccccgacugccucccccucugcgccgccggcaccaccggcacccaccagaccaaccucuccggcaagugcgcccagcucggcuucucccagaucugcggcaagaccggcuccgucggcuccgaccuccaguuccucggcaccaccuccucccaccaggagaaggucuacgccucccucaacuucggcuccaagacccagcagaccuucggcucccagaccgagugcaccuccuccaacggccagaaccccucccccggcgccuacauccuccccuccuaccccgucuccuccccccgcaccucccccaagcacaccuccccccucaucaucucccccaagaagucccaggacaacuccgucaacuucuccaacuccuggccccucaaguccuucgagggccucuccaagcccuccccccagaagaagcucgucucccagaaguccuccgaccccaccggccgcaaccacggcgagaacucccaggagaagccccccguccagcucacccccgcccucguccgcucccccuccucccgccgcggccucaacggcaccaagcccgucccccccaucccccgcggcaucucccuccuccccgacaaggccgaccucuccaccgucggccacaagaagaaggagcccgacgacaucuggaagugcgagaaggacucccuccccaucgaccucuccgagcucaacuucaaggacaaggaccucgaccaggaggagaugcacuccucccuccgcucccuccgcaacuccgccgccaagaagcgcgccaagcucuccggcuccaccuccgaccucgagucccccgacuccgccaugaagcucgaccucaccauggacucccccucccucuccuccucccccaacaucaacuccuacuccgaguccggcgucuacucccaggagucccucaccuccucccucuccaccaccccccagggcaagcgcaucauguccgacaucuuccccaccuucggcuccaagcccugccccacccgccucuccuccgccaagaagaagaucucccacaucgccgagcagucccccuccgccggcuccuccuccaacccccagcagaucuccuccuucgacuucaccaccaccaaggcccucuccgaggacuccgucgucgucgucggcaagggcgucuucggcucccucuccuccgcccccgccaccugcucccaguccgucaucuccuccgucgagaacggcgacaccuucuccaucaagcaguccaucgagccccccuccggcaucuacggccgcuccguccagcagaacaucuccuccuaccucgacgucgagaacgagaaggacgccaaggucuccaucuccaaguccaccuacaacaagaugcgccagaagcgcaaggaggagaaggagcucuuccacaacaaggacugcgagaagaaggagaagaacuccugggagcgcaugcgccacaccggcaccgagaagauggccuccgaguccgagacccccaccggcgccaucucccaguacaaggagcgcaugcccuccgucacccacucccccgagaucauggaccucuccgagcuccgccccuucuccaagcccgagaucgcccucaccgaggcccuccgccuccucgccgacgaggacugggagaagaagaucgagggccucaacuucauccgcugccucgccgccuuccacuccgagauccucaacaccaagcuccacgagaccaacuucgccgucguccaggaggucaagaaccuccgcuccggcgucucccgcgccgccgucgucugccucuccgaccucuucaccuaccucaagaaguccauggaccaggagcucgacaccaccgucaagguccuccuccacaaggccggcgaguccaacaccuucauccgcgaggacgucgacaaggcccuccgcgccauggucaacaacgucacccccgcccgcgccgucgucucccucaucaacggcggccagcgcuacuacggccgcaagaugcucuucuucaugaugugccaccccaacuucgagaagaugcucgagaaguacguccccuccaaggaccuccccuacaucaaggacuccguccgcaaccuccagcagaagggccucggcgagaucccccucgacacccccuccgccaagggccgccgcucccacaccggcuccgucggcaacacccgcuccuccuccgucucccgcgacgccuucaacuccgccgagcgcgccgucaccgagguccgcgaggucacccgcaaguccgucccccgcaacucccucgaguccgccgaguaccucaagcucaucaccggccuccucaacgccaaggacuuccgcgaccgcaucaacggcaucaagcagcuccucuccgacaccgagaacaaccaggaccucgucgucggcaacaucgucaagaucuucgacgccuucaagucccgccuccacgacuccaacuccaaggucaaccucgucgcccucgagaccaugcacaagaugaucccccuccuccgcgaccaccucucccccaucaucaacaugcucauccccgccaucgucgacaacaaccucaacuccaagaaccccggcaucuacgccgccgccaccaacgucguccaggcccucucccagcacgucgacaacuaccuccuccuccagcccuucugcaccaaggcccaguuccucaacggcaaggccaagcaggacaugaccgagaagcucgccgacaucgucaccgagcucuaccagcgcaagccccacgccaccgagcagaagguccucgucguccucuggcaccuccucggcaacaugaccaacuccggcucccuccccggcgccggcggcaacauccgcaccgccaccgccaagcucuccaaggcccucuucgcccagaugggccagaaccuccucaaccaggccgccucccagcccccccacaucaagaagucccucgaggagcuccucgacaugaccauccucaacgagcucuga

SEQ ID NO: 42993 - RNA, 522 nt, Artificial Sequence
  derived and/or modified sequence opt2 from FAM180A__Homo_sapiens__NP_995327
augcacuggaagaugcuccuccuccuccuccucuacuacaacgccgaggccuccaugugccaccgcuggucccgcgccguccucuuccccgccgcccaccgccccaagcgcuccuccucccucccccucaaccccguccuccagaccucccucgaggaggucgagcuccucuacgaguuccuccucgccgagcucgagaucucccccgaccuccagaucuccaucaaggacgaggagcucgccucccuccgcaaggccuccgacuuccgcaccgucugcaacaacgucauccccaaguccauccccgacauccgccgccucuccgccucccucuccucccaccccggcauccucaagaaggaggacuucgagcgcaccguccucacccucgccuacaccgccuaccgcaccgcccucucccacggccaccagaaggacaucugggcccagucccucgucucccucuuccaggcccuccgccacgaccucaugcgcuccucccagcccggcgucccccccuga

SEQ ID NO: 42994 - RNA, 2916 nt, Artificial Sequence
  derived and/or modified sequence opt2 from FAM184A__Homo_sapiens__NP_001093881
augaagcagcaggcccucaccgaguucgaggccuacaagcaccgcgucgaggacaugcagcucugcgccgaggcccagcacguccagcgcaucgucaccaugucccgcgaggucgaggagauccgccgcaaguucgaggagaagcuccgcuccuucggccagcuccagguccaguucgagaaggacaagcgccucgcccucgaggaccuccaggccgcccaccgccgcgagauccaggagcuccucaagucccagcaggaccacuccgccuccgucaacaagggccaggagaaggccgaggagcuccaccgcauggaggucgagucccucaacaagaugcucgaggagcuccgccucgagcgcaagaagcucaucgaggacuacgagggcaagcucaacaaggcccaguccuucuacgagcgcgagcucgacacccucaagcgcucccagcucuucaccgccgagucccuccaggccuccaaggagaaggaggccgaccuccgcaaggaguuccagggccaggaggccauccuccgcaagaccaucggcaagcucaagaccgagcuccagaugguccaggacgaggccggcucccuccucgacaagugccagaagcuccagaccgcccucgccaucgccgagaacaacguccagguccuccagaagcagcucgacgacgccaaggagggcgagauggcccuccucuccaagcacaaggaggucgaguccgagcucgccgccgcccgcgagcgccuccagcagcaggccuccgaccucguccucaaggccucccacaucggcaugcuccaggccacccagaugacccaggaggucaccaucaaggaccucgaguccgagaagucccgcgucaacgagcgccucucccagcucgaggaggagcgcgccuuccuccgcuccaagacccagucccucgacgaggagcagaagcagcagauccucgagcucgagaagaaggucaacgaggccaagcgcacccagcaggaguacuacgagcgcgagcucaagaaccuccagucccgccucgaggaggaggucacccagcucaacgaggcccacuccaagacccucgaggagcucgccuggaagcaccacauggccaucgaggccguccacuccaacgccauccgcgacaagaagaagcuccagauggaccucgaggagcagcacaacaaggacaagcucaaccucgaggaggacaagaaccagcuccagcaggagcucgagaaccucaaggagguccucgaggacaagcucaacaccgccaaccaggagaucggccaccuccaggacaugguccgcaaguccgagcagggccucggcuccgccgagggccucaucgccucccuccaggacucccaggagcgccuccagaacgagcucgaccucaccaaggacucccucaaggagaccaaggacgcccuccucaacgucgagggcgagcucgagcaggagcgccagcagcacgaggagaccaucgccgccaugaaggaggaggagaagcucaaggucgacaagauggcccacgaccucgagaucaaguggaccgagaaccuccgccaggagugcuccaagcuccgcgaggagcuccgccuccagcacgaggaggacaagaaguccgccaugucccagcuccuccagcucaaggaccgcgagaagaacgccgcccgcgacuccuggcagaagaaggucgaggaccuccucaaccagaucucccuccucaagcagaaccucgagauccagcucucccagucccagaccucccuccagcagcuccaggcccaguucacccaggagcgccagcgccucacccaggagcucgaggagcucgaggagcagcaccagcagcgccacaagucccucaaggaggcccacguccucgccuuccagaccauggaggaggagaaggagaaggagcagcgcgcccucgagaaccaccuccagcagaagcacuccgccgagcuccagucccucaaggacgcccaccgcgaguccauggagggcuuccgcaucgagauggagcaggagcuccagacccuccgcuucgagcucgaggacgagggcaaggccaugcucgccucccuccgcuccgagcucaaccaccagcacgccgccgccaucgaccuccuccgccacaaccaccaccaggagcucgccgccgccaagauggagcucgagcgcuccaucgacaucucccgccgccaguccaaggagcacaucugccgcaucaccgaccuccaggaggagcuccgccaccgcgagcaccacaucuccgagcucgacaaggagguccagcaccuccacgagaacaucuccgcccucaccaaggagcucgaguucaagggcaaggagauccuccgcauccgcuccgaguccaaccagcagauccgccucgaggagauggaggagaaguaccucaugcgcgaguccaagcccgaggacauccagaugaucaccgagcucaaggccaugcucaccgagcgcgaccagaucaucaagaagcucaucgaggacaacaaguucuaccagcucgagcucgucaaccgcgagaccaacuucaacaaggucuucaacuccucccccaccgucggcgucaucaacccccucgccaagcagaagaagaagaacgacaagucccccaccaaccgcuucgucuccguccccaaccucuccgcccucgaguccggcggcgucggcaacggccaccccaaccgccucgaccccauccccaacucccccguccacgacaucgaguucaacuccuccaagccccucccccagcccgucccccccaagggccccaagaccuuccucucccccgcccaguccgaggccucccccgucgccucccccgacccccagcgccaggagugguucgcccgcuacuucaccuucuga

SEQ ID NO: 42995 - RNA, 3183 nt, Artificial Sequence
  derived and/or modified sequence opt2 from FAM184B__Homo_sapiens__NP_056503
auggccuccgcccucaacuccaagaucaacccccccggcaccugccagggcuccaaggccgacggcggcgccggcuggcgcauggacugcgacccccagaugcacgucaagaugugcaagaagaucgcccagcucaccaaggucaucuacgcccucaacacccgccaggacgaggccgaggccuccauggaggcccuccgcgaggcccaccaggaggagcuccagaacgccgucgccgagaccaaggcccgccuccuccaggagcagggcugcgccgaggaggaggcccuccuccagcgcauccaggcccucgaguccgcccucgagcuccagaagcgccucaccgaggaggcccucgccgaguccgccuccugccgccucgagaccaaggagcgcgagcuccgcgucgaggccgagcacgccgagcgcguccucacccucucccgcgagaugcucgagcucaaggccgacuacgagcgccgccuccagcaccucaccucccacgaggccaccccccagggccgccucccccaggagucccccgagaccaaguccgagcccggccagggccccgagaugcaggagguccuccucgagguccagcgccuccgcgucgagaaccagcagcucuccaaggacuacgcccgcaaggccgaggagcuccaggccaccuacgagcgcgagaacgaggccauccgccaggccaugcagcaguccgucucccaggcccucuggcaguggcaggagaaggaguccgaccuccgcaagaacuuccagguccaggaguccgcccuccaggcccagguccgcaagcucgagggcgaccucgagcaccgcggccgcaagaucuccgaccucaagaaguacgcccagaagcucaaggagcgcauccaggaccucgacguccagcucaaggaggcccgccaggagaacuccgagcucaagggcaccgccaagaagcucggcgagaagcucgccgucgccaaggaccgcaugaugcuccaggagugccgcggcacccagcagaccgacgccaugaagaccgagcucgucuccgagaacaagguccuccgcgaggagaacgaccucgaggccggcaaccuccacccccagcaggaccaguccugccucaaggagugccccugcaugaagggcggcaccgacaugcagaccaagaaggaggccuccgccgagaccgaguacaugaagcagcaguacgaggaggaccuccgcaagaucaagcaccagaccgaggaggagaagaagcaccucaaggaccagcucgucaagcgccucgaggaccucgucaagaagcacaccgucgagaucaaguccguccgcuccuccgucgaggccgagcgcaagaagcuccagcgcgaggucgaggcccagcucgaggagguccgcaagaaguccgagaaggagaucaagcagcucgaggaggagaaggccgcccucaacgucaagcuccagaacucccuccucgagguccuccgccucgaggaguucauccagcagaacaagacccgccccaccggcgccgaggaguccccccaggagcucggccgccagcacugcuccauccucgagacccaggaccccugccucaagcucgacgagaccuccccccgcggcgaggaguaccaggacaagcucgccgccgaggagggcaccuccuccgacgaggaggagcgcaccaagguccuccucaaggagggcuccgacccccagcccccccucggcucccuccucaaggagaagaccuccaagauccagcgccucgaggaggacuggcagucccagaaggccaagcuccaggcccaggucucccagaugcagcaggcccucgagcagugcaccuccaacuaccgcgaggaccuccaggcccucaagcagcucuccgaccucgagcgcgagaagcuccagcgcgagcuccaggagaccacccagcagaaccacgccaugaaggcccagcucgaggccucccaccagcgcgcccuccgcaugcucgagaaggcccgccaccaggagcucaaggccaccgaggagcgccucaagaaggaguccucccacucccuccagauccagcaccagacccaccgccucgagcuccaggcccucgaggagaaggcccgccaggagcuccaggaggagcgcgagcgcaugcaggcccagcaggcccuccuccucgagucccuccgccaggagcucuccgagcagcaggccgccugcuccggccaccagaaggaccucgaggcccuccaggccgagcuccgcgcccucggccgccagcaggccuccucccagugccccggcgacuccaaggaccacaucaucgccaccgaggagcgcggcggccccggccaggccggcuccccccccggcgccgccggccagggcuccggcgagggcugcggccucugggaggagaacgcccagcuccaggacgccguccgccgccuccgcgccgaggucgagcagcaccagcaggaggcccagaagcuccgcgaccagcgccgcuuccucgaggagacccagcaggcccagcgcgcccgcgaggucgagacccuccgccaggagcaccgcaaggagaugcaggccauggucgccgacuucuccuccgcccaggcccagcuccaggcccgccucgccgcccucgaggccgagcucaaggacuccggcgagaagcccggcaagggcgccucccgccccgaggaccuccagcucaucggccgccuccagacccgccucaaggagcgcgaggacaucaucaagcagcucaccgaggagcgccgcuuccacuacgccgccuuccccuccgccaugucccaccgcaaccgcuccuucuccuucaacccccaccccggcuaccucacccccuccaugaagaagaagaaggucgaggacguccccucccgcgucgucuccguccccaaccucgccuccuacgccaagaacuuccucuccggcgaccucuccucccgcaucaacgccccccccaucaccaccucccccucccucgaccccucccccuccugcggccgcaccuacaagcccaaccaguccaccgacgccaagaccgccacccgcacccccgacggcgagaccgcccaggccaaggagguccagcagaagcagggcuccccccaccaggagugguucaccaaguacuucuccuucuga

SEQ ID NO: 42996 - RNA, 1110 nt, Artificial Sequence
  derived and/or modified sequence opt2 from FAM187B__Homo_sapiens__NP_689694
augccccccaugcucuggcuccuccuccacuucgccgcccccgcccucggcuucuacuucuccaucuccugccccuccggcaagcagugccagcaggcccuccucuccggcaacgacauccuccucuacugcaacuccuccggcgcccacugguacuaccucuucacccagggcaagaagggccgccucaccucccucaccaacaucuccaacauggagaucaugcccgagggcucccuccucaucaaggacccccuccccucccagaccggccucuaccacugcuggaacaagaacggccgccaggucguccaguacgagaucgacuuccaggacgucaccacccuccacaucacccacaaggaccucggccagcgcccccuccagaacgagacccuccaccucggcuccaagcagcucaucuucaccuggugggagcccuggcaggacugcaaccgcugcgaggagcccggcgagugcaagcgccucggcuaccgcuacaucgaggagccccucgaggaggccaugcccugcuggcucuaccucggcgagguccucgucugguccucccgccuccgccccgagcuccaggucgaggccugccacguccagugcaccaacaacacccagcuccgcgucgacuacgucaucuucgacaacuuccgccucgacgagaagaccgaguucgucuggcucgacugcccccucggcuccauguaccgccccgucaacuggcgcgccaacgacaccccccucaccugggagucccagcucuccggccaggacuucaccaccuuccucgaccccuccaccggcggccgccagcuccaggucuuccagcccgccgucuacaagugcuucguccagcaggagcucgucgcccaguucaagcccgccgccucccucgagacccucgaggcccaguggcgcgagaacgacgcccaguggcgcgaggcccgcaaggcccuccgcggccgcgccgacuccguccucaagggccucaagcucguccuccucgucgucaccguccucgcccuccucggcgcccuccucaagugcauccaccccucccccggccgccgcuccacccagguccucgucgucaaguga

SEQ ID NO: 42997 - RNA, 1338 nt, Artificial Sequence
  derived and/or modified sequence opt2 from FAM188A__Homo_sapiens__NP_079224
auguccgagcucaccaaggagcucauggagcucgucuggggcaccaaguccucccccggccucuccgacaccaucuucugccgcuggacccagggcuucgucuucuccgaguccgagggcuccgcccucgagcaguucgagggcggccccugcgccgucaucgcccccguccaggccuuccuccucaagaagcuccucuucuccuccgagaaguccuccuggcgcgacugcuccgaggaggagcagaaggagcuccucugccacacccucugcgacauccucgaguccgccugcugcgaccacuccggcuccuacugccucgucuccuggcuccgcggcaagaccaccgaggagaccgccuccaucuccggcucccccgccgaguccuccugccaggucgagcacuccuccgcccucgccgucgaggagcucggcuucgagcgcuuccacgcccucauccagaagcgcuccuuccgcucccuccccgagcucaaggacgccguccucgaccaguacuccauguggggcaacaaguucggcguccuccucuuccucuacuccguccuccucaccaagggcaucgagaacaucaagaacgagaucgaggacgccuccgagccccucaucgaccccgucuacggccacggcucccagucccucaucaaccuccuccucaccggccacgccgucuccaacgucugggacggcgaccgcgagugcuccggcaugaagcuccucggcauccacgagcaggccgccgucggcuuccucacccucauggaggcccuccgcuacugcaaggucggcuccuaccucaagucccccaaguuccccaucuggaucgucggcuccgagacccaccucaccgucuucuucgccaaggacauggcccucgucgcccccgaggcccccuccgagcaggcccgccgcgucuuccagaccuacgaccccgaggacaacggcuucauccccgacucccuccucgaggacgucaugaaggcccucgaccucgucuccgaccccgaguacaucaaccucaugaagaacaagcucgaccccgagggccucggcaucauccuccucggccccuuccuccaggaguucuuccccgaccagggcuccuccggccccgaguccuucaccgucuaccacuacaacggccucaagcaguccaacuacaacgagaaggucauguacgucgagggcaccgccgucgucaugggcuucgaggaccccaugcuccagaccgacgacacccccaucaagcgcugccuccagaccaaguggcccuacaucgagcuccucuggaccaccgaccgcucccccucccucaacuga

SEQ ID NO: 42998 - RNA, 2274 nt, Artificial Sequence
  derived and/or modified sequence opt2 from FAM188B__Homo_sapiens__NP_115598
auggacucccucuucgucgaggaggucgccgccucccucguccgcgaguuccucucccgcaagggccucaagaagaccugcgucaccauggaccaggagcgcccccgcuccgaccucuccaucaacaaccgcaacgaccuccgcaagguccuccaccucgaguuccucuacaaggagaacaaggccaaggagaacccccucaagaccucccucgagcucaucacccgcuacuuccucgaccacuucggcaacaccgccaacaacuucacccaggacacccccauccccgcccucuccguccccaagaagaacaacaagguccccucccgcugcuccgagaccacccucgucaacaucuacgaccucuccgacgaggacgccggcuggcgcaccucccucuccgagaccuccaaggcccgccacgacaaccucgacggcgacguccucggcaacuucgucuccuccaagcgccccccccacaaguccaagcccaugcagaccguccccggcgagacccccguccucaccuccgccugggagaagaucgacaagcuccacuccgagcccucccucgacgucaagcgcaugggcgagaacucccgccccaaguccggccucaucguccgcggcaugauguccggccccaucgccuccuccccccaggacuccuuccaccgccacuaccuccgccgcuccucccccuccuccuccuccacccagccccaggaggagucccgcaagguccccgagcucuucgucugcacccagcaggacauccucgccuccuccaacuccucccccucccgcaccucccucggccagcucuccgagcucaccgucgagcgccagaagaccaccgccuccucccccccccaccuccccuccaagcgccucccccccugggaccgcgcccgcccccgcgaccccuccgaggacacccccgccgucgacggcuccaccgacaccgaccgcaugccccucaagcucuaccuccccggcggcaacucccgcaugacccaggagcgccucgagcgcgccuucaagcgccagggcucccagcccgcccccguccgcaagaaccagcuccuccccuccgacaaggucgacggcgagcucggcgcccuccgccucgaggacgucgaggacgagcucauccgcgaggaggucauccucucccccguccccuccguccucaagcuccagaccgccuccaagcccaucgaccucuccgucgccaaggagaucaagacccuccucuucggcuccuccuucugcugcuucaacgaggaguggaagcuccaguccuucuccuucuccaacaccgccucccucaaguacggcaucguccagaacaagggcggccccugcggcguccucgccgccguccagggcugcguccuccagaagcuccucuucgagggcgacuccaaggccgacugcgcccagggccuccagcccuccgacgcccaccgcacccgcugccucguccucgcccucgccgacaucgucuggcgcgccggcggccgcgagcgcgccgucgucgcccucgccucccgcacccagcaguucucccccaccggcaaguacaaggccgacggcguccucgagacccucacccuccacucccucaccugcuacgaggaccucgucaccuuccuccagcaguccauccaccaguucgaggucggccccuacggcugcauccuccucacccucuccgccauccucucccgcuccaccgagcucauccgccaggacuucgacguccccaccucccaccucaucggcgcccacggcuacugcacccaggagcucgucaaccuccuccucaccggcaaggccgucuccaacgucuucaacgacgucgucgagcucgacuccggcgacggcaacaucacccuccuccgcggcaucgccgcccgcuccgacaucggcuuccucucccucuucgagcacuacaacaugugccaggucggcugcuuccucaagaccccccgcuuccccaucugggucgucugcuccgagucccacuucuccauccucuucucccuccagcccggccuccuccgcgacuggcgcaccgagcgccucuucgaccucuacuacuacgacggccucgccaaccagcaggagcagauccgccucaccaucgacaccacccagaccaucuccgaggacaccgacaacgaccucguccccccccucgagcucugcauccgcaccaaguggaagggcgccuccgucaacuggaacggcuccgaccccauccucuga

SEQ ID NO: 42999 - RNA, 1953 nt, Artificial Sequence
  derived and/or modified sequence opt2 from FAM189B__Homo_sapiens__NP_001254537
augaugcccucccccuccgacuccucccgcucccucaccucccgccccuccacccgcggccucacccaccuccgccuccaccgccccuggcuccaggcccuccucacccucggccucguccagguccuccucggcauccucgucgucaccuucuccauggucgccuccuccgucaccaccaccgaguccaucaagcgcuccugccccuccugggccggcuucuccaucuccuucuucucccuccucuccguccucugcgucaugcucuccauggccggcuccguccucuccugcaagaacgcccagcucgcccgcgacuuccagcagugcucccucgagggcaaggucugcgucugcugccccuccgucccccuccuccgccccugccccgaguccggccaggagcucaaggucgcccccaacuccaccugcgacgaggcccgcggcgcccucaagaaccuccucuucuccgucugcggccucaccaucugcgccgccaucaucugcacccucuccgccaucgucugcugcauccagaucuucucccucgaccucguccacacccagcucgcccccgagcgcuccgucuccggcccccucggcccccucggcugcaccucccccccccccgccccccuccuccacaccaugcucgaccucgaggaguucgucccccccgucccccccccccccuacuacccccccgaguacaccugcuccuccgagaccgacgcccaguccaucaccuacaacggcuccauggacucccccgucccccucuaccccaccgacugcccccccuccuacgaggccgucaugggccuccgcggcgacucccaggccacccucuucgacccccagcuccacgacggcuccugcaucugcgagcgcgucgccuccaucgucgacgucuccauggacuccggcucccucguccucuccgccaucggcgaccuccccggcggcuccucccccuccgaggacuccugccuccucgagcuccagggcuccguccgcuccgucgacuacguccucuuccgcuccauccagcgcucccgcgccggcuacugccucucccucgacugcggccuccgcggccccuucgaggaguccccccucccccgccgccccccccgcgccgcccgcuccuacuccugcuccgcccccgaggccccccccccccucggcgcccccaccgccgcccgcuccugccaccgccucgagggcuggccccccugggucggccccugcuuccccgagcuccgccgccgcgucccccgcggcggcggccgccccgccgccgccccccccacccgcgcccccacccgccgcuucuccgacuccuccggcucccucaccccccccggccaccgccccccccaccccgccuccccccccccccuccuccucccccgcucccacuccgaccccggcaucaccaccuccuccgacaccgccgacuuccgcgaccucuacaccaagguccucgaggaggaggccgccuccgucuccuccgccgacaccggccucugcuccgaggccugccucuuccgccucgcccgcugccccucccccaagcuccuccgcgcccgcuccgccgagaagcgccgccccguccccaccuuccagaaggucccccuccccuccggccccgcccccgcccacucccucggcgaccucaagggcuccuggcccggccgcggccucgucacccgcuuccuccagaucucccgcaaggcccccgaccccuccggcaccggcgcccacggccacaagcaggucccccgcucccucuggggccgccccggccgcgagucccuccaccuccgcuccugcggcgaccucuccuccuccuccucccuccgccgccuccucuccggccgccgccucgagcgcggcacccgcccccacucccucucccucaacggcggcucccgcgagaccggccucuga

SEQ ID NO: 43000 - RNA, 2469 nt, Artificial Sequence
  derived and/or modified sequence opt2 from FAM193B__Homo_sapiens__NP_001177875
augacccgccgccgcucccgccccuccggcggcgccggccgccgcgagcgcgcccgcgccgccggcccccagaagccccaggcccccgagcccccccccccccccucccucgaggccggcgccggcgccggcccccccgaggcccccgccgagcccgaccacgacggcccccgcgaggacgacgagcccaaccucguccccggcccccaggucccccccgccuccucccagcccguccagaccugcugccuccucugccaccgcgagcgcaagggcugggaggagggccccucccagaacggccucguccuccagggcgagaagcucccccccgacuucaugcccaagcucgucaagaaccuccucggcgagaugccccucugggucugccaguccugccgcaaguccauggaggaggacgagcgccagaccggccgcgagcacgccgucgccaucucccucucccacaccuccugcaagucccaguccugcggcgacgacucccacuccuccuccuccuccuccuccuccuccuccuccuccuccuccuccuccugccccggcaacuccggcgacugggaccccuccuccuuccucuccgcccacaagcucuccggccucuggaacuccccccacuccuccggcgccaugcccggcuccucccucggcuccccccccaccauccccggcgaggccuuccccgucuccgagcaccaccagcacuccgaccucaccgccccccccaacucccccaccggccaccacccccagcccgccucccucauccccucccaccccuccuccuucggcucccccccccacccccaccuccuccccaccacccccgccgcccccuuccccgcccaggccuccgagugccccgucgccgccgccaccgccccccacacccccggccccugccaguccucccaccuccccuccaccuccaugccccuccucaagaugcccccccccuucuccggcugcucccaccccugcuccggccacugcggcggccacugcuccggcccccuccuccccccccccuccucccagccccuccccuccacccaccgcgaccccggcugcaagggccacaaguucgcccacuccggccucgccugccagcucccccagcccugcgaggccgacgagggccucggcgaggaggaggacuccuccuccgagcgcuccuccugcaccuccuccuccacccaccagcgcgacggcaaguucugcgacugcugcuacugcgaguucuucggccacaacgccgagaaggagaaggcccagcucgccgccgaggcccucaagcaggccaaccgcgucuccggcucccgcgagccccgccccgcccgcgagcgccuccucgaguggcccgaccgcgagcucgaccgcgucaacuccuuccucuccucccgccuccaggagaucaagaacaccgucaaggacuccauccgcgccuccuucuccgucugcgagcucuccauggacuccaacggcuucuccaaggagggcgccgccgagcccgagccccagucccucccccccuccaaccucuccggcuccuccgagcagcagcccgacaucaaccucgaccucuccccccucacccucggcuccccccagaaccacacccuccaggcccccggcgagcccgccccccccugggccgagaugcgcggcccccacccccccuggaccgagguccgcggccccccccccggcaucguccccgagaacggccucguccgccgccucaacaccguccccaaccucucccgcgucaucugggucaagacccccaagcccggcuaccccuccuccgaggagcccuccuccaaggagguccccuccugcaagcaggagcuccccgagcccgucuccuccggcggcaagccccagaagggcaagcgccagggcucccaggccaagaaguccgaggccucccccgccccccgcccccccgccucccucgagguccccuccgccaagggccaggucgccggccccaagcagcccggccgcguccucgagcuccccaaggucggcuccugcgccgaggccggcgagggcucccgcggcucccgccccggccccggcugggccggcucccccaagaccgagaaggagaagggcuccuccuggcgcaacuggcccggcgaggccaaggcccgcccccaggagcaggaguccguccagcccuccggccccgcccgcccccagucccucccccagggcaagggccgcucccgccgcucccgcaacaagcaggagaagcccgccuccucccucgacgacgucuuccuccccaaggacauggacggcgucgagauggacgagaccgaccgcgaggucgaguacuucaagcgcuucugccucgacuccgccaagcagacccgccagaaggucgccgucaacuggaccaacuucucccucaagaagaccacccccuccaccgcccaguga

SEQ ID NO: 43001 - RNA, 1440 nt, Artificial Sequence
  derived and/or modified sequence opt2 from FAM196A__Homo_sapiens__NP_001034851
auggucuccaaggacaccggcaagugcauccucaccaccuccgaguccgaggucgagcccgccgccugccucgcccucgagaugaaguacgcccucgaccccaaccgccagaucaagaagcgcaacaaggcccuccagguccgcuucaaggacaucugcgaggcccagaacgagcagcgcgacacccagcucuccuccggccagcucggcgagaagcgcgaggccaagcccgucuccugccgcgccgccuaccgcaaguacaugaccguccccgcccgccgcuccauccccaacgucaccaaguccaccggcguccagaccucccccgaccucaagaagugcuaccagaccuucccccucgaccgcaagaagggcaaccucaagucccuccccgccgccgaccccuucaagucccagaacaacggcuuccucaccgacgccaaggagaagaacgaggccggccccauggaggaggcccgccccugcggcgccggccgcguccacaagaccaccgcccucgucuuccacuccaaccagcacaugaacaccgucgaccagccccucggcgucaacugcaccgagcccugcaagucccccgagccccucuccuacggcgaggccgcccuccagaacuccacccgcccccccuccgaggagcccgacuaccagcuccucggccgcgccaagcaggaccgcggccgccccaacuccgaggagcccgccccccccgcccuccgccgcgucuucaagaccgaggucgccaccgucuacgcccccgcccucuccgcccgcgcccccgagcccggccucuccgacuccgccgccgccucccaguggucccucugccccgccgacgacgagcgccgccgcgccacccaccucaacggccuccaggcccccuccgagaccgcccucgccugcuccccccccaugcagugccucucccccgagugcuccgagcagcccucccagacccacaccccccccggccucggcaaccagcccucccccaccgccgucgccgccggcgaggagugccagcgcaucgucccccacaccgaggucgucgaccucaaggcccagcuccagaugauggagaaccucaucuccuccucccaggagaccaucaagguccuccucggcgucauccaggagcucgagaagggcgaggcccaccgcgagggccucuccuaccgcaccggccaggacaccgccaacugcgacaccugccgcaacuccgccugcaucaucuacuccgucgagcucgacuucaagcagcaggaggacaagcuccagcccguccuccgcaagcuccaccccaucgaggagacccaggucauccccucccccuacucccaggagaccuacuccuccacccccaagcagaaguccaagaccgaguccaagaagcacggccgcuggaagcucugguuccucuga

SEQ ID NO: 43002 - RNA, 1608 nt, Artificial Sequence
  derived and/or modified sequence opt2 from FAM196B__Homo_sapiens__NP_001123363
auggcccagcagaacaugaagguccgccccguccuccucaagcgcaacucccucgaguccgucgaguucgucaagcagccccaccaccgccgcuccaagucccagcagguccgcuucaaggaggacggcaccaccaagaaccccaccggccucgccgaggucgacguccagacccccgaggaccccgccgucaugggcaagacccaggccacccgccaccaccucccccccaccuacucccucuccuucccccgcucccagaaggccggcggcuuccgcaacaucgccauccagaccucccccucccuccgcaagcacuuccccgucuucaagcgcaagcgccucaccgccuccaagucccucgucgagaugcccaccgccucccaguccgccauccaggucaacggcaaccucuccgagcaggacaucgucuccuccgaccucgccuaccuccgccucgcccagcaccucgaggacggcccccgccgcgucaaggucucccacgccuuccucccccgcguccccaagguccaguccaacggccccgucuccaucugccucgaggccggcaccuggcgcucccucgagaaggccaccgccgccauccagguccccgacgacaucuaccacucccccuccugggaggcccgcgaguccgcccucucccccgaccgcuccgccgaggucuccaacuccauccacccccucgacgacacccgccccggcgacggccgccgcgucaccccccucgacuccgagaaguccaccuccugccucaacgccaccuccgucgccucccacacccccggcaccgaggagcucaagcccgagcuccuccuccccaaggacaacuccgacgacaaggaccucggcucccucuccucccaguccaaggagaccugcguccccuccuccccccgcacccacuccucccccucccagggcucccacucccagcccgcccaccccggccgcgccuccgacugccccuccuccuccaacaaccaccagaaccucgucucccucaagaccaacuccgccuccaaguccgcccccggcugccaggagcagaccgccaacaaccccaccgaguccgacacccucgaguuccccaacugccccggcuccaaccaccuccccuccucccucucccgcuccgagaccaagcuccaguccaaccgcgagaucuccgacaucaaccagauccaccucgcccgcggcgagcucugcgaccuccagggccgccuccaguccgucgaggagucccuccacuccaaccaggagaagaucaagguccuccucaacgucauccaggaccucgagaaggcccgcgcccucaccgagggccgcaacuucuaccgcaccggccaggaccucaacaacugcuccaccugccagaacaccgccugcaucaucuacuccgucgaguacgacuuccgccagcaggagggccgcuuccacgagguccuccagucccucgaggaggccgagcccgucgaggaggccucccccccccccaagucccccgccgagccccccgcccccgagaagcaggaccuccgccgcaagaccaagaaggucaagaagaagugcuucugguggaucuga

SEQ ID NO: 43003 - RNA, 1584 nt, Artificial Sequence
  derived and/or modified sequence opt2 from FAM198B__Homo_sapiens__NP_001026870
augaccugccccgacaagcccggccagcucaucaacugguucaucugcucccucugcgucccccgcguccgcaagcucugguccucccgccgcccccgcacccgccgcaaccuccuccucggcaccgccugcgccaucuaccucggcuuccucgucucccaggucggccgcgccucccuccagcacggccaggccgccgagaagggcccccaccgcucccgcgacaccgccgagcccuccuuccccgagaucccccucgacggcacccucgccccccccgagucccagggcaacggcuccacccuccagcccaacgucgucuacaucacccuccgcuccaagcgcuccaagcccgccaacauccgcggcaccgucaagcccaagcgccgcaagaagcacgccgucgccuccgccgcccccggccaggaggcccucgucggccccucccuccagccccaggaggccgcccgcgaggccgacgccgucgcccccggcuacgcccagggcgccaaccucgucaagaucggcgagcgccccuggcgccucguccgcggccccggcguccgcgccggcggccccgacuuccuccagcccuccucccgcgaguccaacauccgcaucuacuccgaguccgcccccuccuggcucuccaaggacgacauccgccgcaugcgccuccucgccgacuccgccgucgccggccuccgccccgucuccucccgcuccggcgcccgccuccucguccucgagggcggcgcccccggcgccguccuccgcugcggccccucccccugcggccuccucaagcagccccucgacauguccgaggucuucgccuuccaccucgaccgcauccucggccucaaccgcacccuccccuccgucucccgcaaggccgaguucauccaggccgccgccgccgccugccucuccaugcgccucgccuucuucaucuuccccgccugggaggacaugcgcguccccggcaagugcugcaucggccacgcccgccucaccuggggcaccuaccagcagcuccucaagcagaagugcuggcagaacggccgcguccccaagcccgaguccggcugcaccgagauccaccaccacgagugguccaagauggcccucuucgacuuccuccuccagaucuacaaccgccucgacaccaacugcugcggcuuccgcccccgcaaggaggacgccugcguccagaacggccuccgccccaagugcgacgaccagggcuccgccgcccucgcccacaucauccagcgcaagcacgacccccgccaccucgucuucaucgacaacaagggcuucuucgaccgcuccgaggacaaccucaacuucaagcuccucgagggcaucaaggaguuccccgccuccgccgucuccguccucaagucccagcaccuccgccagaagcuccuccagucccucuuccucgacaaggucuacugggagucccagggcggccgccagggcaucgagaagcucaucgacgucaucgagcaccgcgccaagauccucaucaccuacaucaacgcccacggcgucaagguccuccccaugaacgaguga

SEQ ID NO: 43004 - RNA, 402 nt, Artificial Sequence
  derived and/or modified sequence opt2 from FAM19A1__Homo_sapiens__NP_998774
auggccauggucuccgccauguccuggguccucuaccucuggaucuccgccugcgccaugcuccucugccacggcucccuccagcacaccuuccagcagcaccaccuccaccgccccgagggcggcaccugcgaggucaucgccgcccaccgcugcugcaacaagaaccgcaucgaggagcgcucccagaccgucaagugcuccugccuccccggcaaggucgccggcaccacccgcaaccgccccuccugcgucgacgccuccaucgucaucggcaagugguggugcgagauggagcccugccucgagggcgaggagugcaagacccuccccgacaacuccggcuggaugugcgccaccggcaacaagaucaagaccacccgcauccacccccgcaccuga

SEQ ID NO: 43005 - RNA, 396 nt, Artificial Sequence
  derived and/or modified sequence opt2 from FAM19A2__Homo_sapiens__NP_848634
auguccaagcgcuaccuccagaaggccaccaagggcaagcuccucaucaucaucuucaucgucacccucuggggcaaggucgucuccuccgccaaccaccacaaggcccaccacgucaagaccggcaccugcgaggucgucgcccuccaccgcugcugcaacaagaacaagaucgaggagcgcucccagaccgucaagugcuccugcuuccccggccaggucgccggcaccacccgcgccgcccccuccugcgucgacgccuccaucgucgagcagaagugguggugccacaugcagcccugccucgagggcgaggagugcaagguccuccccgaccgcaagggcugguccugcuccuccggcaacaaggucaagaccacccgcgucacccacuga

SEQ ID NO: 43006 - RNA, 423 nt, Artificial Sequence
  derived and/or modified sequence opt2 from FAM19A4__Homo_sapiens__NP_001005527
augcgcuccccccgcaugcgcgucugcgccaaguccguccuccucucccacuggcucuuccucgccuacguccucauggucugcugcaagcucauguccgccuccucccagcaccuccgcggccacgccggccaccaccagaucaagcagggcaccugcgaggucgucgccguccaccgcugcugcaacaagaaccgcaucgaggagcgcucccagaccgucaagugcuccugcuuccccggccaggucgccggcaccacccgcgcccagcccuccugcgucgaggccuccaucgucauccagaagugguggugccacaugaaccccugccucgagggcgaggacugcaagguccuccccgacuacuccggcugguccugcuccuccggcaacaaggucaagaccaccaaggucacccgcuga

SEQ ID NO: 43007 - RNA, 399 nt, Artificial Sequence
  derived and/or modified sequence opt2 from FAM19A5__Homo_sapiens__NP_001076436
auggcccccuccccccgcaccggcucccgccaggacgccaccgcccuccccuccauguccuccaccuucugggccuucaugauccucgccucccuccucaucgccuacugcucccagcucgccgccggcaccugcgagaucgucacccucgaccgcgacuccucccagccccgccgcaccaucgcccgccagaccgcccgcugcgccugccgcaagggccagaucgccggcaccacccgcgcccgccccgccugcgucgacgcccgcaucaucaagaccaagcaguggugcgacaugcuccccugccucgagggcgagggcugcgaccuccucaucaaccgcuccggcuggaccugcacccagcccggcggccgcaucaagaccaccaccgucuccuga

SEQ ID NO: 43008 - RNA, 702 nt, Artificial Sequence
  derived and/or modified sequence opt2 from FAM204A__Homo_sapiens__NP_071346
augugguccggccuccucccccccggccucaacgaguccgacgccgaguccaacuccgaggacgaggccacccucgagaacuccggccucaaccuccaggaggacaaggaggacgaguccauccgcaagaccgagaucaucgacuucuccaccgacgagcccaagaccgagaccgaguccaacgucaacgccuacgaggagugccccuccggcauccccaucgacauguggaacaaguuccaggagcuccacaagaagcacuccgagcagaaguccaccaccucccgcuuccgcggcaagcgccgcaagcgcucccgcaaggacaagcucaagaacgagaaggagcuccacuccgagcccuccuccaacgagacccaguggaaggagcucacccaguacuucggcgucaacgaccgcuucgacccccccgucaagcgcaagaaggucgagaaguccggccucgagaagcgcaucgaccaggccgucgaggaguggaacaucgagaaggccgaggagcucuccaaccagcucgccacccgcgagcucggcgucaagaucgccaaggccgucgccugccacaacuucgucaaggccaagaaggaggucgagaacucccaggccgcccgcaagaagaagaagcucgccuggggcuucgaggccaagaagcgcugggagaccaaguccaacaugggcuacauguga

SEQ ID NO: 43009 - RNA, 4008 nt, Artificial Sequence
  derived and/or modified sequence opt2 from FAM205A__Homo_sapiens__NP_001135389
augcucucccccaccuucguccucugggaggucggcuacccccucuacaucuacggcuccaucuucaucgucaucgucaucaucuggcaggucaagcgcucccaccacgagcucuccuccgagcccaagcgcuccugcugccgcugccaccagaagguccgccagcgcgcccgcgacgccgccuccaccgcccgccgccgcucccgcgaggaggccgagaagccccagaagcuccucuccaucaucaagucccagggcuggcucccccucgagcgcuccguccgccgcauccucugcgccgaccccugcugccagaucugcaacuccgucgcccucgagauccagcagcuccucgucggcgagaacaaccagaucucccucacccucuccggcccccuccagggcuccuccugccucgagaugcucuccaccuccuccaugucccucgaccagucccucgaguuccacuccuggcacacccgcgagcucucccucuccuccgucacccccacccucucccagcucaccgaccagaagucccucacccaguccgccgcccaguccaccuacgccgacggcauccaggacuacugggccgaccaccuccagcucggccaggaguuccagguccccgacguccuccgcggccccaacaccaucgccuccucccgcaucgagaagccccgcgccccccucaaccaggaggagaugacccaguccaaccccucccucguccagggcaaccagggccagcaccaccucaacucccaggucucccuccucucccucaaccccgagacccucaaccgcaugcaccccauggcccuccacaugguccuccccgcccaccuccccuuccucucccccgagguccuccgccuccucgagguccacgucaagaaguggaugcacuuccagcgcuggggccucccccgccgcgucgaggagucccuccgccagcucaugcccaaccccccccucuacuaccagcccggcaacgaccagcccgucuccuucaaccucaagaacaccccccaggucucccuccaccgcuucgagaccaucucccuccagaccuggugcuccugcgucgccggccagcccauccagaccuucugggucuccgagugguccaccaugaaccccgagcagcgccaccacugccagcagacccccaaccccauggcccucgcccuccccucccccgcccucaaggcccucuccggcccccacccccaguccggcggccaggacaacgacuccggcuccgaccuccagcagaaguacucccagcucuucugcggccuccccucccuccacuccgagucccucgucgccaccuucaugggcucccagggccuccccaagaucgagaacguccccaagcccccccucaaggaccccuuccucuucaacgagcucuccuucccccagcuccuccccaagaccuccccccaguccgccccccccuccuccccccucucccccaacuggaugucccccuccgaccaccagcgcgcccagaucaacguccccuuccucacccucgccgaguacgaggcccucgaguggcaccuccuccagcgccagcuccagcuccaguggggcuggcccgccgcccuccagcgcucccagcacacccagugccucaugcagcacgagcccugcggcaaggcccagucccccgagaccaccaccgccucccagaccggcaaguccaucuccguccucacccgcgagcuccucuucuuccccgagcacgcccgcaagcuccucgaguuccacauccagaagcagcucauccgccaccgcuggggccucccccagaagauccagcaguccauccagcuccuccucaccuccaccgaccagcagaccgucuccuccuccuccaccgcccucgccaacgucuccaucccccagcccgucgcccucgaggccaacggcgccugcgacguccucucccccaucgccgcccccgucuccaucccccgcccccaccuccucacccaggucaaggccauccuccagucccacaucgacuccaagugcggccagauccaccagggcaagauccccgccugcguccaccgcuccugggacugccgcaucuccggcguccucgccgucgcccccuuccccugcauccccgagucccaguuccucgagcuccagaccgccuccgaccccgaccuccaccacaaggucaugcccuggaugcccaccgcccucgaccagcagcagcaggcccuccccggcaccgucaccgagcaccccaagcuccuccgcguccucuccgucgaggccaucgagaagcucgagaccacccuccgccacaagcaccucgccuuccucuccggccuccccgcccucuacuacgucgcccucccccgcgcccucgcccccgccgucaccucccaguccgucaucaccgagauggagcccucccccgucgagauccccgccgagccccucauccagauggucuccuucgaggagcagugcaucucccucggccccugcccccagggcaacaacgaguccugcaccgacgucgccaaggaguuccagcccgccguccccgucaagggcaccauggagacccucccccucgagucccagacccaccccaccuccccccacucccuccagacccacauccucaccaagcucaacuuccaccuccgcaagaagguccucgagauccaguggggcauccccauccgcgcccgcaagucccgcgagcagaccgucgccgcccccgagaacaucuccacccagaagucccucgagucccucaaccaccagggcgagacccuccuccaggagcuccccaucccccccgacacccuccccgcccccaaccccgagggcguccaccucaaggagcagcucgccaacgaccucaaggccguccagcagaaccagaagcaguccaacuccaaggccgucccccagggcuccgcccacuccgucuccaagaucucccagcccuccggcgacaugaccgaggcccacaugcccugcguccaggucgaggccaacgucaacaagcccucccucgaggagcccugcggccccgagccccagucccccuccaaguccaaggaccccgcccacguccccaugcucgccggcaaccgcgaggaccccgaggagaccaaggccgcccgcgaccaccgcgagggcgacgccggcuucggccgcuccuccacccgcgaggagcgccgccccgccgaggaccagcgccccgccggcaugcuccccaacaagaccccccgcggcuccuggcgcuggucccgcuccuuccaccucgccgaccccugccagcacuccccccagcaccacccccagcucaagcucccccagcuccccccccgcguccccggcgagaaggaguccgagaaggaccuccaggacucccagaccaagcucaccgucauccucgagcccgccaccauccccgagaacgcccagaccguccucccccaggccucccagggccagcccuuccucucccagcccacccaggccaagccccuccagggccagacccuccagggccagguccuccacggccucgucaugcccguccacgcccagaagaagcccucccucaccgaguccuccuuccgcaacaagaucaagugcuuccuccagcacaucaaccccaagaccaagggcaagggccacgaggacuccauguucuccgccgccgccaaggucgccaagacccgcaaggagaacgucgccaagucccucgcccccgccaagucccccgucggccgcuccaagaccgagaagcccaccggcugcuccaaggcccagucccgccccgcccagaagcucgucggccccgccuuccucgacggcccccagucccucgacgacaagcuccgccuccacucccgccagcccggcuccgccuccgcccucggcuacccccgccacugcccccgccacugcccccgcgaggccugcgccaacaagcccggccaccccaccuga

SEQ ID NO: 43010 - RNA, 1212 nt, Artificial Sequence
  derived and/or modified sequence opt2 from FAM20A__Homo_sapiens__NP_001230675
auguaccgcgagcagaugaaccucaccucccucgaccccccccuccagcuccgccucgaggccuccuggguccaguuccaccucggcaucaaccgccacggccucuacucccgcuccucccccgucgucuccaagcuccuccaggacaugcgccacuuccccaccaucuccgccgacuacucccaggacgagaaggcccuccucggcgccugcgacugcacccagaucgucaagcccuccggcguccaccucaagcucguccuccgcuucuccgacuucggcaaggccauguucaagcccaugcgccagcagcgcgacgaggagacccccgucgacuucuucuacuucaucgacuuccagcgccacaacgccgagaucgccgccuuccaccucgaccgcauccucgacuuccgccgcgucccccccaccgucggccgcaucgucaacgucaccaaggagauccucgaggucaccaagaacgagauccuccaguccgucuucuucgucucccccgccuccaacgucugcuucuucgccaagugccccuacaugugcaagaccgaguacgccgucugcggcaacccccaccuccucgagggcucccucuccgccuuccuccccucccucaaccucgccccccgccucuccguccccaaccccuggauccgcuccuacacccucgccggcaaggaggagugggaggucaacccccucuacugcgacaccgucaagcagaucuaccccuacaacaacucccagcgccuccucaacgucaucgacauggccaucuucgacuuccucaucggcaacauggaccgccaccacuacgagauguucaccaaguucggcgacgacggcuuccucauccaccucgacaacgcccgcggcuucggccgccacucccacgacgagaucuccauccucuccccccucucccagugcugcaugaucaagaagaagacccuccuccaccuccagcuccucgcccaggccgacuaccgccucuccgacgucaugcgcgagucccuccucgaggaccagcucucccccguccucaccgagccccaccuccucgcccucgaccgccgccuccagaccauccuccgcaccgucgagggcugcaucgucgcccacggccagcaguccgucaucgucgacggccccgucgagcagcucgcccccgacuccggccaggccaaccucaccuccuga

SEQ ID NO: 43011 - RNA, 1230 nt, Artificial Sequence
  derived and/or modified sequence opt2 from FAM20B__Homo_sapiens__NP_055679
augaagcucaagcagcgcgucguccuccucgccauccuccucgucaucuucaucuucaccaaggucuuccucaucgacaaccucgacaccuccgccgccaaccgcgaggaccagcgcgccuuccaccgcaugaugaccggccuccgcgucgagcucgcccccaagcucgaccacacccuccagucccccugggagaucgccgcccagugggucgucccccgcgaggucuaccccgaggagacccccgagcucggcgccgucaugcacgccauggccaccaagaagaucaucaaggccgacgucggcuacaagggcacccagcucaaggcccuccucauccucgagggcggccagaaggucgucuucaagcccaagcgcuacucccgcgaccacgucgucgagggcgagcccuacgccggcuacgaccgccacaacgccgaggucgccgccuuccaccucgaccgcauccucggcuuccaccgcgccccccucgucgucggccgcuucgucaaccuccgcaccgagaucaagcccgucgccaccgagcagcuccucuccaccuuccucaccgucggcaacaacaccugcuucuacggcaagugcuacuacugccgcgagaccgagcccgccugcgccgacggcgacaucauggagggcuccgucacccucuggcuccccgacgucuggccccuccagaagcaccgccaccccuggggccgcaccuaccgcgagggcaagcucgcccgcugggaguacgacgaguccuacugcgacgccgucaagaagaccucccccuacgacuccggcccccgccuccucgacaucaucgacaccgccgucuucgacuaccucaucggcaacgccgaccgccaccacuacgaguccuuccaggacgacgagggcgccuccaugcucauccuccucgacaacgccaaguccuucggcaaccccucccucgacgagcgcuccauccucgccccccucuaccagugcugcaucauccgcgucuccaccuggaaccgccucaacuaccucaagaacggcguccucaaguccgcccucaaguccgccauggcccacgaccccaucucccccguccucuccgacccccaccucgacgccgucgaccagcgccuccucuccguccucgccaccgucaagcagugcaccgaccaguucggcauggacaccguccucgucgaggaccgcaugccccucucccaccucuga

SEQ ID NO: 43012 - RNA, 1755 nt, Artificial Sequence
  derived and/or modified sequence opt2 from FAM20C__Homo_sapiens__NP_064608
augaagaugaugcucguccgccgcuuccgcguccucauccucauggucuuccucgucgccugcgcccuccacaucgcccucgaccuccucccccgccucgagcgccgcggcgcccgccccuccggcgagcccggcugcuccugcgcccagcccgccgccgaggucgccgcccccggcugggcccagguccgcggccgccccggcgagccccccgccgccuccuccgccgccggcgacgccggcuggcccaacaagcacacccuccgcauccuccaggacuucuccuccgaccccuccuccaaccucuccucccacucccucgagaagcucccccccgccgccgagcccgccgagcgcgcccuccgcggccgcgaccccggcgcccuccgcccccacgaccccgcccaccgcccccuccuccgcgaccccggcccccgccgcuccgaguccccccccggccccggcggcgacgccucccuccucgcccgccucuucgagcacccccucuaccgcgucgccguccccccccucaccgaggaggacguccucuucaacgucaacuccgacacccgccucucccccaaggccgccgagaaccccgacuggccccacgccggcgccgagggcgccgaguuccucucccccggcgaggccgccgucgacuccuaccccaacuggcucaaguuccacaucggcaucaaccgcuacgagcucuacucccgccacaaccccgccaucgaggcccuccuccacgaccucuccucccagcgcaucaccuccgucgccaugaaguccggcggcacccagcucaagcucaucaugaccuuccagaacuacggccaggcccucuucaagcccaugaagcagacccgcgagcaggagaccccccccgacuucuucuacuucuccgacuacgagcgccacaacgccgagaucgccgccuuccaccucgaccgcauccucgacuuccgccgcgucccccccgucgccggccgcauggucaacaugaccaaggagauccgcgacgucacccgcgacaagaagcucuggcgcaccuucuucaucucccccgccaacaacaucugcuucuacggcgagugcuccuacuacugcuccaccgagcacgcccucugcggcaagcccgaccagaucgagggcucccucgccgccuuccuccccgaccucucccucgccaagcgcaagaccuggcgcaaccccuggcgccgcuccuaccacaagcgcaagaaggccgagugggaggucgaccccgacuacugcgaggaggucaagcagaccccccccuacgacuccucccaccgcauccucgacgucauggacaugaccaucuucgacuuccucaugggcaacauggaccgccaccacuacgagaccuucgagaaguucggcaacgagaccuucaucauccaccucgacaacggccgcggcuucggcaaguacucccacgacgagcucuccauccucgucccccuccagcagugcugccgcauccgcaaguccaccuaccuccgccuccagcuccucgccaaggaggaguacaagcucucccuccucauggccgagucccuccgcggcgaccaggucgcccccguccucuaccagccccaccucgaggcccucgaccgccgccuccgcgucguccucaaggccguccgcgacugcgucgagcgcaacggccuccacuccgucgucgacgacgaccucgacaccgagcaccgcgccgccuccgcccgcuga

SEQ ID NO: 43013 - RNA, 579 nt, Artificial Sequence
  derived and/or modified sequence opt2 from FAM210B__Homo_sapiens__NP_543011
auggccggccuccucgcccuccucggccccgccggccgcgucggcgcccgcguccgcccccgcgccaccuggcuccucggcgccaccgcccccugcgccccccccccccucgcccucgcccuccuccccccccgccucgacgcccgccuccuccgcaccgcccgcggcgacugccgcggccaccaggaccccucccaggccaccggcaccaccggcuccuccgucuccugcaccgaggagaagaagcaguccaagucccagcagcucaagaagaucuuccaggaguacggcaccgucggcgucucccuccacaucggcaucucccucaucucccucggcaucuucuacauggucgucuccuccggcgucgacaugcccgccauccuccucaagcucggcuucaaggagucccucguccaguccaagauggccgccggcaccuccaccuucgucgucgccuacgccauccacaagcucuucgcccccguccgcaucuccaucacccucgucuccgucccccucaucguccgcuacuuccgcaaggucggcuucuucaagccccccgccgccaagcccuga

SEQ ID NO: 43014 - RNA, 690 nt, Artificial Sequence
  derived and/or modified sequence opt2 from FAM213A__Homo_sapiens__NP_001230707
auguccuuccuccaggaccccuccuucuucaccaugggcaugugguccaucggcgccggcgcccucggcgccgccgcccucgcccuccuccucgccaacaccgacgucuuccucuccaagccccagaaggccgcccucgaguaccucgaggacaucgaccucaagacccucgagaaggagccccgcaccuucaaggccaaggagcucugggagaagaacggcgccgucaucauggccguccgccgccccggcugcuuccucugccgcgaggaggccgccgaccucuccucccucaaguccaugcucgaccagcucggcgucccccucuacgccgucgucaaggagcacauccgcaccgaggucaaggacuuccagcccuacuucaagggcgagaucuuccucgacgagaagaagaaguucuacggcccccagcgccgcaagaugauguucaugggcuucauccgccucggcgucugguacaacuucuuccgcgccuggaacggcggcuucuccggcaaccucgagggcgagggcuucauccucggcggcgucuucgucgucggcuccggcaagcagggcauccuccucgagcaccgcgagaaggaguucggcgacaaggucaaccuccucuccguccucgaggccgccaagaugaucaagccccagacccucgccuccgagaagaaguga

SEQ ID NO: 43015 - RNA, 3252 nt, Artificial Sequence
  derived and/or modified sequence opt2 from FAM214A__Homo_sapiens__NP_001273424
auggucuucuccggcaacaagggccuccaccgcgaggacacccucgacgaguacuucgaguacgacgccgaggaguuccucgucucccucgcccuccucaucaccgagggccgcacccccgagugcuccgucaagggccgcaccgaguccuuccacugcccccccgcccaguccugcuaccccgucaccaccaagcacgagugcuccgacaagcucgcccagugccgccaggcccgccgcacccgcuccgaggucacccuccucuggaagaacaaccuccccaucauggucgagaugaugcuccuccccgacugcugcuacuccgacgacggccccaccaccgagggcaucgaccucaacgaccccgccaucaagcaggacgcccuccuccucgagcgcuggauccucgagcccgucccccgccagaacggcgaccgcuucaucgaggagaagacccuccuccucgccguccgcuccuucgucuucuucucccagcucuccgccuggcucuccgucucccacggcgccaucccccgcaacauccucuaccgcaucuccgccgccgacgucgaccuccaguggaacuucucccagacccccaucgagcacgucuuccccguccccaacgucucccacaacgucgcccucaaggucuccguccagucccucccccgccaguccaacuaccccguccucaccugcuccauccacaccaacaucggccucuacgagaagcgcauccagcagcacaagcucaagacccaccagcaccacaaccccaacgaggccgagcagugcggcaccaacuccucccagcgccucugcuccaagcagaccuggaccauggcccccgaguccguccuccacgccaaguccggccccucccccgaguacaccgccgccgucaagaacaucaagcucuaccccggcaccggcuccaaguccgaccacggcaccucccaggccaacauccucggcuucuccggcaucggcgacaucaagucccaggagaccuccguccgcacccucaaguccuucuccauggucgacuccuccaucuccaaccgccaguccuucuggcaguccgccggcgagaccaacccccucaucggcucccucauccaggagcgccaggagaucaucgcccgcaucgcccagcaccucauccacugcgaccccuccaccucccacgucuccggccgccccuucaacacccaggaguccuccucccuccacuccaagcucuuccgcgucucccaggagaacgagaacgucggcaagggcaaggaggccuucuccaugaccuucggcucccccgaguucuccucccccgaggacaccaacgagggcaagauccgccucaagcccgagaccccccgcuccgagaccugcaucuccaacgacuucuacucccacaugcccgucggcgagaccaacccccucaucggcucccuccuccaggagcgccaggacgucaucgcccgcaucgcccagcaccucgagcacaucgaccccaccgccucccacaucccccgccaguccuucaacaugcacgacuccuccuccgucgccuccaaggucuuccgcuccuccuacgaggacaagaaccuccucaagaagaacaaggacgaguccuccgucuccaucucccacaccaagugcucccuccucggcgacaucuccgacggcaagaaccucguccccaacaagugcuucaccuccuucaagaacaacuccaaggagaagugcucccucaagcaccagacccgcaaccagugccagaacaaccccuccgagaucauccaguccaccuaccaggagacccagaacaaguccuccucccucuccaccuccuccauccucucccagcacaaggagaacaaccucgaccucaccucccgcuucaaggagcaggagauguccaacggcaucgacaagcaguacuccaacugcaccaccaucgacaagcagaucugcaccaacaaguacaaggagaagaucaucaacgagaacuacaaccccaaguucuucggcaaccuccaguccgacgacuccaagaagaacgacuccaagaucaaggucaccguccucgagauguccgaguaccucaacaaguacgaguccauguccuccaacaaggacuccaagcgccccaagaccugcgagcagaacacccagcucaacuccaucgagaacuaccucaacaaggacaacgagggcuucaagugcaagaaguccgaccagcucaagaacgagcaggacaagcaggaggaccccaccaacgagaagucccagaacuacucccagcgccgcuccaucaaggacugccucuccaccugcgagcagcccaagaacaccgagguccuccgcaccacccucaagcacuccaacgucuggcgcaagcacaacuuccacucccucgacggcaccuccacccgcgccuuccacccccagaccggccucccccuccucuccucccccgucccccagcgcaagacccaguccggcugcuucgaccucgacuccucccuccuccaccucaaguccuucuccucccgcuccccccgccccugccucaacaucgaggacgaccccgacauccacgagaagcccuuccucuccuccuccgccccccccaucaccucccucucccuccucggcaacuucgaggaguccguccucaacuaccgcuucgacccccucggcaucgucgacggcuucaccgccgaggucggcgccuccggcgccuucugccccacccaccucacccuccccgucgaggucuccuucuacuccgucuccgacgacaacgcccccucccccuacaugggcgucaucacccucgagucccucggcaagcgcggcuaccgcgucccccccuccggcaccauccaggucacccucuucaaccccaacaagaccgucgucaagauguucgucgucaucuacgaccuccgcgacaugcccgccaaccaccagaccuuccuccgccagcgcaccuucuccguccccgucaagcaggaggucaagcgcuccgucaacaaggagaacauccgccacaccgaggagcgccuccuccgcuaccucauccaccuccgcuuccaguccuccaaguccggcaagaucuaccuccaccgcgacguccgccuccucuucucccgcaaguccauggaggucgacuccggcgccgccuacgagcucaaguccuacaccgagucccccaccaacccccaguucuccccccgcugcuga

SEQ ID NO: 43016 - RNA, 822 nt, Artificial Sequence
  derived and/or modified sequence opt2 from FAM216A__Homo_sapiens__NP_037432
augcucggccagcuccucccccacaccgcccgcggccucggcgccgccgagaugcccggccagggccccggcuccgacuggaccgagcgcuccuccuccgccgagccccccgccgucgccggcaccgagggcggcggcggcggcuccgccggcuacuccugcuaccagaacuccaagggcuccgaccgcaucaaggacggcuacaaggucaacucccacaucgccaagcuccaggagcucuggaagaccccccagaaccagaccauccaccucuccaaguccaugauggaggccuccuucuucaagcaccccgaccucaccaccggccagaagcgcuaccucugcuccaucgccaagaucuacaacgccaacuaccucaagaugcucaugaagcgccaguacaugcacguccuccagcacuccucccagaagcccggcguccucacccaccaccgcucccgccucuccucccgcuacucccagaagcagcacuaccccugcaccaccuggcgccaccagcucgagcgcgaggacuccggcuccuccgacaucgccgccgccuccgcccccgagaugcucauccagcacucccucuggcgccccguccgcaacaaggagggcaucaagaccggcuacgccuccaagacccgcugcaagucccucaagaucuuccgccgcccccgcaagcucuucaugcagaccgucuccuccgacgacuccgagucccacauguccgaggagaagaaggaggaggaccuccucaacaacuucaugcaguccauguccaucgaggagcagggcgagcaccucaugcucaccuga

SEQ ID NO: 43017 - RNA, 780 nt, Artificial Sequence
  derived and/or modified sequence opt2 from FAM220A__Homo_sapiens__NP_001032240
augcgcgaccgccgcggcccccucggcaccugccucgcccagguccagcaggccggcggcggcgacuccgacaagcucuccugcucccucaagaagcgcaugcccgagggccccuggcccgccgacgcccccuccuggaugaacaagcccgucgucgacggcaacucccaguccgaggcccucucccucgagaugcgcaaggaccccuccggcgccggccucuggcuccacuccggcggccccguccuccccuacguccgcgaguccguccgccgcaaccccgccuccgccgccacccccuccaccgccgucggccucuuccccgcccccaccgagugcuucgcccgcgucuccugcuccggcgucgaggcccucggccgccgcgacuggcucggcggcggcccccgcgccaccgacggccaccgcggccagugccccaagggcgagccccgcgucucccgccucccccgccaccagaagguccccgagaugggcuccuuccaggacgacccccccuccgccuuccccaagggccucggcuccgagcucgagcccgccugccuccacuccauccucuccgccacccuccacgucuaccccgagguccuccucuccgaggagaccaagcgcaucuuccucgaccgccucaagcccauguucuccaagcagaccaucgaguucaagaagaugcucaaguccaccuccgacggccuccagaucacccucggccuccucgcccuccagcccuucgagcucgccaacacccucugccacuccuga

SEQ ID NO: 43018 - RNA, 1527 nt, Artificial Sequence
  derived and/or modified sequence opt2 from FAM227B__Homo_sapiens__NP_689860
auggccggccagcgcaccugccagcgccgcuccucccgcgccggccccggcaagaugcaggagccccccaaguccaucgaggaguuccucaaguuccagaacugggacuacuggccccgcgagauccacuuccgcgacgacgacaagugguccugcacccucaagaagaucaaggaggacuccuccuucgucuccaucuacacccaccucugggagaacgucccccgcaucuucgaggcccuccucaucauggaguccaagcucaaggaguacucccucauccuccagaaccacaccuccgagaucuucaaguggaaguccaugaucuccgagaccuccuccuaccgcaagcucgagcgcuacggcgaguuccucaagaaguaccacaagaagaagaagaucaugcucuccgacgagauggagaccgagaagaacaucgagggcugcuccuucaccggcuucaaggccaacgagcucacccagcucccccgccaccucgacgccgagcagaucuaccucuucauccucaaggcccacaacuucgacgagcgcgucuucaagaucuggaagacccacuuccucuccgaggccuccaucgcccuccuccacgacuccuucugguggugguuccuccacaaguuccgccccgaccgcgagaaccaggacugccucuucgaccgcaucuccgaguccuacgucacccucuucauguccaucccccucucccgcaaggacgccuucuuccagaucuaccccgacugccucgcccaggccaucuacgccaccuuccacgaggccuuccccgaguccuccuaccucuucaacgacgaguucaaggaggaccucggcaacaacaucuuccucuggugcuccggccucaagccccagaagggcuucuggauccacuggaagcucaaggagcucuccaccaccaccauccacggcuccaagaaggcccccgccaaguccgucaaggagcgcaucgccgacucccaggagcacaucuccaccuccaucgacuucaacaucaucaagauccucaacaacccccgcgccuacacccuccccaucuccaaggaggagucccgccucucccgccucgccaccaagucccacuacuccuccaccggccccgaguucaaccgcguccucuucaacuucggcggccaguccccccucauccucuacuaccucaagaugcacgagcucgccggcaucuccaaggcccccaagaagaccaagaucaagcucaccaagaucuuccaggagccccuccccgcccccaccuaccgcgacgucaucaaggaggccaagcgccaguucgcccgcaaccagaaggacuuccgcauccuccaggccaaggccaccaagaagccccacgaggucaagcaggacuucgagaaguuccuccacaagcuccgcuccgaggccgagaucgagcgcgagugcgucgccucccucuccuccuccuccuccuccucccccuccuccaccgacaacuacaacuucgaggaggaggaguacuga

SEQ ID NO: 43019 - RNA, 339 nt, Artificial Sequence
  derived and/or modified sequence opt2 from FAM32A__Homo_sapiens__NP_054796
auggaggccuacgagcagguccagaagggcccccucaagcucaagggcgucgccgagcucggcgucaccaagcgcaagaagaagaagaaggacaaggacaaggccaagcuccucgaggccaugggcaccuccaagaagaacgaggaggagaagcgccgcggccucgacaagcgcacccccgcccaggccgccuucgagaagaugcaggagaagcgccagauggagcgcauccucaagaaggccuccaagacccacaagcagcgcgucgaggacuucaaccgccaccucgacacccucaccgagcacuacgacauccccaaggucuccuggaccaaguga

SEQ ID NO: 43020 - RNA, 579 nt, Artificial Sequence
  derived and/or modified sequence opt2 from FAM3A__Homo_sapiens__NP_001164604
augcgccucgccggccccgaguccuccgucaccgccgccccccgcgcccgcaaguacaagugcggccucccccagcccugccccgaggagcaccucgccuuccgcgucgucuccggcgccgccaacgucaucggccccaagaucugccucgaggacaagaugcucauguccuccgucaaggacaacgucggccgcggccucaacaucgcccucgucaacggcgucuccggcgagcucaucgaggcccgcgccuucgacaugugggccggcgacgucaacgaccuccucaaguucauccgcccccuccacgagggcacccucgucuucgucgccuccuacgacgaccccgccaccaagaugaacgaggagacccgcaagcucuucuccgagcucggcucccgcaacgccaaggagcucgccuuccgcgacuccugggucuucgucggcgccaagggcguccagaacaagucccccuucgagcagcacgucaagaacuccaagcacuccaacaaguacgagggcuggcccgaggcccucgagauggagggcugcaucccccgccgcuccaccgccuccuga

SEQ ID NO: 43021 - RNA, 708 nt, Artificial Sequence
  derived and/or modified sequence opt2 from FAM3B__Homo_sapiens__NP_478066
augcgcccccucgccggcggccuccucaaggucgucuucgucgucuucgccucccucugcgccugguacuccggcuaccuccucgccgagcucauccccgacgccccccucuccuccgccgccuacuccauccgcuccaucggcgagcgccccguccucaaggcccccguccccaagcgccagaagugcgaccacuggacccccugccccuccgacaccuacgccuaccgccuccucuccggcggcggccgcuccaaguacgccaagaucugcuucgaggacaaccuccucaugggcgagcagcucggcaacgucgcccgcggcaucaacaucgccaucgucaacuacgucaccggcaacgucaccgccacccgcugcuucgacauguacgagggcgacaacuccggccccaugaccaaguucauccaguccgccgcccccaagucccuccucuucauggucaccuacgacgacggcuccacccgccucaacaacgacgccaagaacgccaucgaggcccucggcuccaaggagauccgcaacaugaaguuccgcuccuccugggucuucaucgccgccaagggccucgagcuccccuccgagauccagcgcgagaagaucaaccacuccgacgccaagaacaaccgcuacuccggcuggcccgccgagauccagaucgagggcugcauccccaaggagcgcuccuga

SEQ ID NO: 43022 - RNA, 684 nt, Artificial Sequence
  derived and/or modified sequence opt2 from FAM3C__Homo_sapiens__NP_055703
augcgcgucgccggcgccgccaagcucgucgucgccgucgccgucuuccuccucaccuucuacgucaucucccaggucuucgagaucaagauggacgccucccucggcaaccucuucgcccgcuccgcccucgacaccgccgcccgcuccaccaagcccccccgcuacaagugcggcaucuccaaggccugccccgagaagcacuucgccuucaagauggccuccggcgccgccaacgucgucggccccaagaucugccucgaggacaacguccucauguccggcgucaagaacaacgucggccgcggcaucaacgucgcccucgccaacggcaagaccggcgagguccucgacaccaaguacuucgacauguggggcggcgacgucgcccccuucaucgaguuccucaaggccauccaggacggcaccaucguccucaugggcaccuacgacgacggcgccaccaagcucaacgacgaggcccgccgccucaucgccgaccucggcuccaccuccaucaccaaccucggcuuccgcgacaacugggucuucugcggcggcaagggcaucaagaccaagucccccuucgagcagcacaucaagaacaacaaggacaccaacaaguacgagggcuggcccgaggucgucgagauggagggcugcaucccccagaagcaggacuga

SEQ ID NO: 43023 - RNA, 675 nt, Artificial Sequence
  derived and/or modified sequence opt2 from FAM3D__Homo_sapiens__NP_620160
augcgcgucuccggcguccuccgccuccucgcccucaucuucgccaucgucaccaccuggauguucauccgcuccuacauguccuucuccaugaagaccauccgccucccccgcuggcucgccgccucccccaccaaggagauccaggucaagaaguacaagugcggccucaucaagcccugccccgccaacuacuucgccuucaagaucugcuccggcgccgccaacgucgucggccccaccaugugcuucgaggaccgcaugaucaugucccccgucaagaacaacgucggccgcggccucaacaucgcccucgucaacggcaccaccggcgccguccucggccagaaggccuucgacauguacuccggcgacgucaugcaccucgucaaguuccucaaggagauccccggcggcgcccucguccucgucgccuccuacgacgaccccggcaccaagaugaacgacgagucccgcaagcucuucuccgaccucggcuccuccuacgccaagcagcucggcuuccgcgacuccugggucuucaucggcgccaaggaccuccgcggcaagucccccuucgagcaguuccucaagaacucccccgacaccaacaaguacgagggcuggcccgagcuccucgagauggagggcugcaugccccccaagcccuucuga

SEQ ID NO: 43024 - RNA, 1329 nt, Artificial Sequence
  derived and/or modified sequence opt2 from FAM46A__Homo_sapiens__NP_060103
auggccgagggcgagggcuacuucgccauguccgaggacgagcucgccugcucccccuacaucccccucggcggcgacuucggcggcggcgacuucggcggcggcgacuucggcggcggcgacuucggcggcggcggcuccuucggcggccacugccucgacuacugcgagucccccaccgcccacugcaacguccucaacugggagcagguccagcgccucgacggcauccucuccgagaccauccccauccacggccgcggcaacuuccccacccucgagcuccagcccucccucaucgucaaggucguccgccgccgccucgccgagaagcgcaucggcguccgcgacguccgccucaacggcuccgccgccucccacguccuccaccaggacuccggccucggcuacaaggaccucgaccucaucuucugcgccgaccuccgcggcgagggcgaguuccagaccgucaaggacgucguccucgacugccuccucgacuuccuccccgagggcgucaacaaggagaagaucaccccccucacccucaaggaggccuacguccagaagauggucaaggucugcaacgacuccgaccgcuggucccucaucucccucuccaacaacuccggcaagaacgucgagcucaaguucgucgacucccuccgccgccaguucgaguucuccgucgacuccuuccagaucaagcucgacucccuccuccucuucuacgagugcuccgagaaccccaugaccgagaccuuccaccccaccaucaucggcgaguccgucuacggcgacuuccaggaggccuucgaccaccucugcaacaagaucaucgccacccgcaaccccgaggagauccgcggcggcggccuccucaaguacugcaaccuccucguccgcggcuuccgccccgccuccgacgagaucaagacccuccagcgcuacaugugcucccgcuucuucaucgacuucuccgacaucggcgagcagcagcgcaagcucgaguccuaccuccagaaccacuucgucggccucgaggaccgcaaguacgaguaccucaugacccuccacggcgucgucaacgaguccaccgucugccucaugggccacgagcgccgccagacccucaaccucaucaccaugcucgccauccgcguccucgccgaccagaacgucauccccaacgucgccaacgucaccugcuacuaccagcccgcccccuacgucgccgacgccaacuucuccaacuacuacaucgcccagguccagcccgucuucaccugccagcagcagaccuacuccaccuggcuccccugcaacuga

SEQ ID NO: 43025 - RNA, 1170 nt, Artificial Sequence
  derived and/or modified sequence opt2 from FAM46D__Homo_sapiens__NP_689843
auguccgagauccgcuucaccaaccucaccugggaccaggucaucacccucgaccagguccucgacgaggucauccccauccacggcaagggcaacuuccccaccauggaggucaagcccaaggacaucauccacgucgucaaggaccagcucaucggccagggcaucaucgucaaggacgcccgccucaacggcuccgucgccuccuacauccucgccucccacaacggcaucuccuacaaggaccucgacgucaucuucggcgucgagcuccccggcaacgaggaguuccaggucgucaaggacgccguccucgacugccuccucgacuuccuccccaaggacgucaagaaggagaagcucucccccgacaucaugaaggacgccuacguccagaagcucgucaaggucugcaacggccacgacugcuggucccucaucucccucuccaacaacaccggcaagaaccucgagcucaaguucgucuccucccuccgccgccaguucgaguucuccgucgacuccuuccagaucguccucgaccccaugcucgacuucuacuccgacaagaacgccaagcucaccaaggaguccuaccccgucgucgucgccgaguccauguacggcgacuuccaggaggccaugacccaccuccagcacaagcucaucugcacccgcaagcccgaggagauccgcggcggcggccuccucaaguacugcucccuccucguccacggcuucaagcccgccugcauguccgagaucaagaaccucgagcgcuacaugugcucccgcuucuucaucgacuucccccacaucgaggagcagcagaagaagaucgaguccuaccuccacaaccacuucaucggcgagggcaugaccaaguacgacuaccucaugacccuccacggcgucgucaacgaguccaccgucugccucauguccuacgagcgccgccagauccuccaccucaucaccaugauggcccucaagguccucggcgagcucaacauccuccccaacacccagaaggucaccugcuucuaccagcccgcccccuacuucgccgccgaggcccgcuaccccaucuacgucauccccgagcccccccccgucuccuuccagcccuaccacccccuccacuuccgcggcuccaacggcauguccuga

SEQ ID NO: 43026 - RNA, 972 nt, Artificial Sequence
  derived and/or modified sequence opt2 from FAM49A__Homo_sapiens__NP_110424
augggcaaccuccucaagguccucacccgcgagaucgagaacuacccccacuucuuccucgacuucgagaacgcccagcccaccgagggcgagcgcgagaucuggaaccagaucuccgccguccuccaggacuccgaguccauccucgccgaccuccaggccuacaagggcgccggccccgagauccgcgacgccauccagaaccccaacgacauccagcuccaggagaaggccuggaacgccgucugcccccucgucguccgccucaagcgcuucuacgaguucuccauccgccucgagaaggcccuccagucccuccucgagucccucaccugcccccccuacacccccacccagcaccucgagcgcgagcaggcccucgccaaggaguucgccgagauccuccacuucacccuccgcuucgacgagcucaagaugcgcaaccccgccauccagaacgacuucuccuacuaccgccgcaccaucucccgcaaccgcaucaacaacaugcaccucgacaucgagaacgaggucaacaacgagauggccaaccgcaugucccucuucuacgccgaggccacccccaugcucaagacccucuccaacgccaccaugcacuucgucuccgagaacaagacccuccccaucgagaacaccaccgacugccucuccaccaugaccuccgucugcaaggucaugcucgagacccccgaguaccgcucccgcuucaccuccgaggagacccucauguucugcaugcgcgucauggucggcgucaucauccucuacgaccacguccaccccgucggcgccuucugcaagaccuccaagaucgacaugaagggcugcaucaagguccucaaggagcaggcccccgacuccgucgagggccuccucaacgcccuccgcuucaccaccaagcaccucaacgacgaguccaccuccaagcagauccgcgccaugcuccaguga

SEQ ID NO: 43027 - RNA, 975 nt, Artificial Sequence
  derived and/or modified sequence opt2 from FAM49B__Homo_sapiens__NP_001243692
augggcaaccuccucaagguccucaccugcaccgaccucgagcagggccccaacuucuuccucgacuucgagaacgcccagcccaccgaguccgagaaggagaucuacaaccaggucaacgucguccucaaggacgccgagggcauccucgaggaccuccaguccuaccgcggcgccggccacgagauccgcgaggccauccagcaccccgccgacgagaagcuccaggagaaggccuggggcgccgucgucccccucgucggcaagcucaagaaguucuacgaguucucccagcgccucgaggccgcccuccgcggccuccucggcgcccucaccuccacccccuacucccccacccagcaccucgagcgcgagcaggcccucgccaagcaguucgccgagauccuccacuucacccuccgcuucgacgagcucaagaugaccaaccccgccauccagaacgacuucuccuacuaccgccgcacccucucccgcaugcgcaucaacaacguccccgccgagggcgagaacgaggucaacaacgagcucgccaaccgcaugucccucuucuacgccgaggccacccccaugcucaagacccucuccgacgccaccaccaaguucgucuccgagaacaagaaccuccccaucgagaacaccaccgacugccucuccaccauggccuccgucugccgcgucaugcucgagacccccgaguaccgcucccgcuucaccaacgaggagaccgucuccuucugccuccgcgucauggucggcgucaucauccucuacgaccacguccaccccgucggcgccuucgccaagaccuccaagaucgacaugaagggcugcaucaagguccucaaggaccagccccccaacuccgucgagggccuccucaacgcccuccgcuacaccaccaagcaccucaacgacgagaccaccuccaagcagaucaaguccaugcuccaguga

SEQ ID NO: 43028 - RNA, 978 nt, Artificial Sequence
  derived and/or modified sequence opt2 from FAM50B__Homo_sapiens__NP_036267
auggcccaguacaagggcaccaugcgcgaggccggccgcgccaugcaccuccucaagaagcgcgagcgccagcgcgagcagauggagguccucaagcagcgcaucgccgaggagaccauccucaagucccaggucgacaagcgcuucuccgcccacuacgacgccgucgaggccgagcucaaguccuccaccgucggccucgucacccucaacgacaugaaggcccgccaggaggcccucguccgcgagcgcgagcgccagcucgccaagcgccagcaccucgaggagcagcgccuccagcaggagcgccagcgcgagcaggagcagcgccgcgagcgcaagcgcaagaucuccugccucuccuucgcccucgacgaccucgacgaccaggccgacgccgccgaggcccgccgcgccggcaaccucggcaagaaccccgacgucgacaccuccuuccuccccgaccgcgaccgcgaggaggaggagaaccgccuccgcgaggagcuccgccaggagugggaggcccagcgcgagaaggucaaggacgaggagauggaggucaccuucuccuacugggacggcuccggccaccgccgcaccguccgcguccgcaagggcaacaccguccagcaguuccucaagaaggcccuccagggccuccgcaaggacuuccucgagcuccgcuccgccggcgucgagcagcucauguucaucaaggaggaccucauccucccccacuaccacaccuucuacgacuucaucaucgcccgcgcccgcggcaaguccggcccccucuucuccuucgacguccacgacgacguccgccuccucuccgacgccaccauggagaaggacgagucccacgccggcaaggucguccuccgcuccugguacgagaagaacaagcacaucuuccccgccucccgcugggaggccuacgaccccgagaagaagugggacaaguacaccauccgcuga

SEQ ID NO: 43029 - RNA, 1269 nt, Artificial Sequence
  derived and/or modified sequence opt2 from FAM53B__Homo_sapiens__NP_055476
auggucaugguccucuccgagucccucuccacccgcggcgccgacuccaucgccugcggcaccuucucccgcgagcuccacacccccaagaagaugucccagggccccacccucuucuccugcggcaucauggagaacgaccgcuggcgcgaccucgaccgcaagugcccccuccagaucgaccagcccuccaccuccaucugggagugccuccccgagaaggacuccucccucuggcaccgcgaggccgucaccgccugcgccgucaccucccucaucaaggaccucuccaucuccgaccacaacggcaaccccuccgccccccccuccaagcgccagugccgcucccucuccuucuccgacgagauguccuccugccgcaccuccuggcgcccccucggcuccaaggucuggacccccgucgagaagcgccgcugcuacuccggcggcuccguccagcgcuacuccaacggcuucuccaccaugcagcgcuccuccuccuucucccuccccucccgcgccaacguccucuccucccccugcgaccaggccggccuccaccaccgcuucggcggccagcccugccagggcguccccggcuccgcccccugcggccaggccggcgacaccuggucccccgaccuccaccccgucggcggcggccgccucgaccuccagcgcucccucuccugcucccacgagcaguucuccuucgucgaguacugcccccccuccgccaacuccacccccgccuccacccccgagcucgcccgccgcuccuccggccucucccgcucccgcucccagcccugcguccucaacgacaagaaggucggcgucaagcgccgccgccccgaggagguccaggagcagcgccccucccucgaccucgccaagauggcccagaacugccagaccuucuccucccucuccugccucuccgccggcaccgaggacugcggcccccagucccccuucgcccgccacgucuccaacacccgcgccuggaccgcccuccucuccgccuccggccccggcggccgcacccccgccggcacccccguccccgagccccucccccccuccuucgacgaccaccucgccugccaggaggaccucuccugcgaggaguccgacuccugcgcccucgacgaggacugcggccgccgcgccgagcccgccgccgccuggcgcgaccgcggcgcccccggcaacucccucugcucccucgacggcgagcucgacaucgagcagaucgagaagaacuga

SEQ ID NO: 43030 - RNA, 774 nt, Artificial Sequence
  derived and/or modified sequence opt2 from FAM57A__Homo_sapiens__NP_079068
augcuccucacccucgccggcggcgcccucuucuuccccggccucuucgcccucugcaccugggcccuccgccgcucccagcccggcuggucccgcaccgacugcgucaugaucuccacccgccucgucuccuccguccacgccguccucgccaccggcuccggcaucgucaucauccgcuccugcgacgacgucaucaccggccgccacuggcucgcccgcgaguacgucugguuccucauccccuacaugaucuacgacuccuacgccauguaccucugcgaguggugccgcacccgcgaccagaaccgcgcccccucccucacccuccgcaacuuccucucccgcaaccgccucaugaucacccaccacgccgucauccucuucguccucguccccgucgcccagcgccuccgcggcgaccucggcgacuucuucgucggcugcaucuucaccgccgagcucuccacccccuucgucucccucggccgcguccucauccagcucaagcagcagcacacccuccucuacaaggucaacggcauccucacccucgccaccuuccucuccugccgcauccuccucuuccccuucauguacugguccuacggccgccagcagggccucucccuccuccagguccccuucuccauccccuucuacugcaacgucgccaacgccuuccucgucgccccccagaucuacugguucugccuccucugccgcaaggccguccgccucuucgacaccccccaggccaagaaggacggcuga

SEQ ID NO: 43031 - RNA, 687 nt, Artificial Sequence
  derived and/or modified sequence opt2 from FAM58A__Homo_sapiens__NP_001124469
auggaggcccccgagggcggcggcggcggccccgccgcccgcggccccgagggccagcccgcccccgaggcccgcguccacuuccgcgucgcccgcuucaucauggaggccggcgucaagcucggcaugcgcuccauccccaucgccaccgccugcaccaucuaccacaaguucuucugcgagaccaaccucgacgccuacgaccccuaccucaucgccauguccuccaucuaccucgccggcaaggucgaggagcagcaccuccgcacccgcgacaucaucaacgucuccaaccgcuacuucaaccccuccggcgagccccucgagcucgacucccgcuucugggagcuccgcgacuccaucguccagugcgagcuccucaugcuccgcguccuccgcuuccaggucuccuuccagcacccccacaaguaccuccuccacuaccucgucucccuccagaacuggcucaaccgccacuccuggcagcgcacccccgucgccgucaccgccugggcccuccuccgcgacuccuaccacggcgcccucugccuccgcuuccaggcccagcacaucgccgucgccguccucuaccucgcccuccaggucuacggcgucgagguccccgccgaggucgaggccgagaagcccugguggcagaucuacaccauggacaccgagauccccuga

SEQ ID NO: 43032 - RNA, 666 nt, Artificial Sequence
  derived and/or modified sequence opt2 from FAM60A__Homo_sapiens__NP_001129284
auguucggcuuccacaagcccaagauguaccgcuccaucgagggcugcugcaucugccgcgccaaguccuccuccucccgcuucaccgacuccaagcgcuacgagaaggacuuccaguccugcuucggccuccacgagacccgcuccggcgacaucugcaacgccugcguccuccucgucaagcgcuggaagaagcuccccgccggcuccaagaagaacuggaaccacgucgucgacgcccgcgccggccccucccucaagaccacccucaagcccaagaaggucaagacccucuccggcaaccgcaucaaguccaaccagaucuccaagcuccagaaggaguucaagcgccacaacuccgacgcccacuccaccaccuccuccgccucccccgcccagucccccugcuacuccaaccaguccgacgacggcuccgacaccgagauggccuccggcuccaaccgcacccccgucuucuccuuccucgaccucaccuacuggaagcgccagaagaucugcugcggcaucaucuacaagggccgcuucggcgagguccucaucgacacccaccucuucaagcccugcugcuccaacaagaaggccgccgccgagaagcccgaggagcagggccccgagccccuccccaucuccacccaggagugguga

SEQ ID NO: 43033 - RNA, 1866 nt, Artificial Sequence
  derived and/or modified sequence opt2 from FAM63B__Homo_sapiens__NP_001035540
auggaguccucccccgagucccuccagccccucgagcacggcgucgccgccggccccgccuccggcaccggcuccucccaggagggccuccaggagacccgccucgccgccggcgacggccccggcgucugggccgccgagaccuccggcggcaacggccucggcgccgccgccgcccgccgcucccuccccgacuccgccucccccgccggcucccccgagguccccggccccugcuccuccuccgccggccucgaccucaaggacuccggccucgagucccccgccgccgccgaggccccccuccgcggccaguacaaggucaccgccucccccgagaccgccgucgccggcgucggccacgagcucggcaccgccggcgacgccggcgcccgccccgaccucgccggcaccugccaggccgagcucaccgccgccggcuccgaggagcccuccuccgccggcggccucuccuccuccugcuccgaccccuccccccccggcgagucccccucccucgacucccucgaguccuucuccaaccuccacuccuuccccuccuccugcgaguucaacuccgaggagggcgccgagaaccgcguccccgaggaggaggagggcgccgccguccuccccggcgccgucccccucugcaaggaggaggagggcgaggagaccgcccagguccucgccgccuccaaggagcgcuuccccggccaguccgucuaccacaucaaguggauccaguggaaggaggagaacacccccaucaucacccagaacgagaacggccccugcccccuccucgccauccucaacguccuccuccucgccuggaaggucaagcucccccccaugauggagaucaucaccgccgagcagcucauggaguaccucggcgacuacaugcucgacgccaagcccaaggagaucuccgagauccagcgccucaacuacgagcagaacauguccgacgccauggccauccuccacaagcuccagaccggccucgacgucaacguccgcuucaccggcguccgcgucuucgaguacacccccgagugcaucgucuucgaccuccucgacaucccccucuaccacggcuggcucgucgacccccagaucgacgacaucgucaaggccgucggcaacugcuccuacaaccagcucgucgagaagaucaucuccugcaagcaguccgacaacuccgagcucgucuccgagggcuucgucgccgagcaguuccucaacaacaccgccacccagcucaccuaccacggccucugcgagcucaccuccaccguccaggagggcgagcucugcgucuucuuccgcaacaaccacuucuccaccaugaccaaguacaagggccagcucuaccuccucgucaccgaccagggcuuccucaccgaggagaaggucgucugggagucccuccacaacgucgacggcgacggcaacuucugcgacuccgaguuccaccuccgcccccccuccgaccccgagaccgucuacaagggccagcaggaccagaucgaccaggacuaccucauggcccucucccuccagcaggagcagcagucccaggagaucaacugggagcagauccccgagggcaucuccgaccucgagcucgccaagaagcuccaggaggaggaggaccgccgcgccucccaguacuaccaggagcaggagcaggccgccgccgccgccgccgccgccuccacccaggcccagcagggccagcccgcccaggccucccccuccuccggccgccaguccggcaacuccgagcgcaagcgcaaggagccccgcgagaaggacaaggagaaggagaaggagaagaacuccugcgucauccucuga

SEQ ID NO: 43034 - RNA, 747 nt, Artificial Sequence
  derived and/or modified sequence opt2 from FAM64A__Homo_sapiens__NP_001182157
auggccucccgcuggcagaacaugggcaccuccguccgccgccgcucccuccagcaccaggagcagcucgaggacuccaaggagcuccagcccgucgucucccaccaggagaccuccgucggcgcccucggcucccucugccgccaguuccagcgccgccucccccuccgcgccgucaaccucaaccuccgcgccggccccuccuggaagcgccucgagacccccgagcccggccagcagggccuccaggccgccgcccgcuccgccaaguccgcccucggcgccgucucccagcgcauccaggaguccugccaguccggcaccaaguggcucgucgagacccaggucaaggcccgccgccgcaagcgcggcgcccagaagggcuccggcucccccacccacucccucucccagaaguccacccgccucuccggcgccgcccccgcccacuccgccgccgaccccugggagaaggagcaccaccgccucuccguccgcaugggcucccacgcccacccccuccgccgcucccgccgcgaggccgccuuccgcucccccuacuccuccaccgagccccucugcucccccuccgaguccgacuccgaccucgagcccgucggcgccggcauccagcaccuccagaagcucucccaggagcucgacgaggccaucauggccgaggagcgcaagcaggcccucuccgaccgccagggcuucauccucaaggacgucuacgccucccccuga

SEQ ID NO: 43035 - RNA, 3144 nt, Artificial Sequence
  derived and/or modified sequence opt2 from FAM65B__Homo_sapiens__NP_001273374
augcaguucuucgacgccgaggagcuccucgucgacgaggaggacgacgucuucggcgagggccuccccacccgccuccccgagaucaugcucgucggcucccaguccuucucccccggcggccccaacggcaucauccgcucccaguccuucgccggcuucuccggccuccaggagcgccgcucccgcugcaacuccuucaucgagaacuccuccgcccucaagaagccccaggccaagcucaagaagaugcacaaccucggccacaagaacaacaacccccccaaggagccccagcccaagcgcgucgaggaggucuaccgcgcccucaagaacggccucgacgaguaccucgagguccaccagaccgagcucgacaagcucaccgcccagcucaaggacaugaagcgcaacucccgccucggcguccucuacgaccucgacaagcagaucaagaccaucgagcgcuacaugcgccgccucgaguuccacaucuccaaggucgacgagcucuacgaggccuacugcauccagcgccgccuccaggacggcgccuccaagaugaagcaggccuucgccaccucccccgccuccaaggccgcccgcgagucccucaccgagaucaaccgcuccuucaaggaguacaccgagaacaugugcaccaucgaggucgagcucgagaaccuccucggcgaguucuccaucaagaugaagggccucgccggcuucgcccgccucugccccggcgaccaguacgagaucuucaugaaguacggccgccagcgcuggaagcucaagggcaagaucgaggucaacggcaagcaguccugggacggcgaggagaccgucuuccucccccucaucgucggcuucaucuccaucaaggucaccgagcucaagggccucgccacccacauccucgucggcuccgucaccugcgagaccaaggagcucuucgccgcccgcccccaggucgucgccgucgacaucaacgaccucggcaccaucaagcucaaccucgagaucaccugguaccccuucgacgucgaggacaugaccgccuccuccggcgccggcaacaaggccgccgcccuccagcgccgcauguccauguacucccagggcacccccgagacccccaccuucaaggaccacuccuucuucuccaaccuccccgacgacaucuucgagaacggcaaggccgccgaggagaagaugccccucucccucuccuucuccgaccuccccaacggcgacugcgcccucaccucccacuccaccggcucccccuccaacuccaccaaccccgagaucaccaucacccccgccgaguucaaccucuccucccucgccucccagaacgagggcauggacgacaccuccuccgccuccucccgcaacucccucggcgagggccaggagcccaagucccaccucaaggaggaggaccccgaggagccccgcaagcccgccuccgcccccuccgaggccugccgccgccaguccuccggcgccggcgccgagcaccucuuccucgagaacgacgucgccgaggcccuccuccaggaguccgaggaggccuccgagcucaagcccgucgagcucgacaccuccgagggcaacaucaccaagcagcucgucaagcgccucaccuccgccgagguccccauggccaccgaccgccuccucuccgagggcuccgucggcggcgaguccgagggcugccgcuccuuccucgacggcucccucgaggacgccuucaacggccuccuccucgcccucgagccccacaaggagcaguacaaggaguuccaggaccucaaccaggaggucaugaaccucgacgacauccucaagugcaagcccgccgucucccgcucccgcuccuccucccucucccucaccgucgaguccgcccucgaguccuucgacuuccucaacaccuccgacuucgacgaggaggaggacggcgacgaggucugcaacgucggcggcggcgccgacuccgucuucuccgacaccgagaccgagaagcacuccuaccgcuccguccaccccgaggcccgcggccaccucuccgaggcccucaccgaggacaccggcgucggcaccuccgucgccggcuccccccucccccucaccaccggcaacgagucccucgacaucaccaucguccgccaccuccaguacugcacccagcucguccagcagaucgucuucuccuccaagacccccuucgucgcccgcucccuccucgagaagcucucccgccagauccaggucauggagaagcucgccgccgucuccgacgagaacaucggcaacaucuccuccgucgucgaggccauccccgaguuccacaagaagcucucccuccucuccuucuggaccaagugcugcucccccgucggcgucuaccacucccccgccgaccgcgucaugaagcagcucgaggccuccuucgcccgcaccgucaacaaggaguaccccggccucgccgaccccgucuuccgcacccucgucucccagauccucgaccgcgccgagccccuccucuccuccucccucuccuccgaggucgucaccgucuuccaguacuacuccuacuucaccucccacggcgucuccgaccucgaguccuaccucucccagcucgcccgccaggucuccaugguccagacccuccagucccuccgcgacgagaagcuccuccagaccauguccgaccucgcccccuccaaccuccucgcccagcaggagguccuccgcacccucgcccuccuccucacccgcgaggacaacgaggucuccgaggccgucacccucuaccucgccgccgccuccaagaaccagcacuuccgcgagaaggcccuccucuacuacugcgaggcccucaccaagaccaaccuccagcuccagaaggccgccugccucgcccucaagauccucgaggccaccgaguccaucaagaugcucgucacccucugccaguccgacaccgaggagauccgcaacgucgccuccgagacccuccucucccucggcgaggacggccgccucgccuacgagcagcucgacaaguucccccgcgacugcgucaaggucggcggccgccacggcaccgaggucgccaccgccuucuga

SEQ ID NO: 43036 - RNA, 1260 nt, Artificial Sequence
  derived and/or modified sequence opt2 from FAM69C__Homo_sapiens__NP_001037834
auggcccgcgccgccggcgcccgcggccccgccggcuggugccgccgccgcggccgcugcggccgcggcacccuccucgccuucgccgccuggaccgccggcuggguccucgccgccgcccuccuccuccgcgcccaccccggcguccucuccgagcgcugcaccgacgagaagucccgccgcauccucgccgcccucugccaggacuaccagggcggcacccucgccggcgaccucugcgaggaccucugcgucgccggcgagcuccucuuccagcgcugccuccacuacaaccgcggcaagaagguccuccaggccgacuggcgcggccgccccgucguccucaaguccaaggaggaggccuucuccuccuuccccccccucucccuccucgaggaggaggccggcgagggcggccaggacaugcccgaggccgagcuccuccucauggucgccggcgaggucaaguccgcccucggccucgagcucuccaacuccucccucggccccugguggcccggccgccgcggcccccgcuggcgcggccagcucgccucccucugggcccuccuccagcaggaggaguacgucuacuucucccuccuccaggaccucuccccccacguccuccccguccucggcuccugcggccacuucuacgccgucgaguuccucgccgccggcuccccccaccaccgcgcccucuucccccucgaccgcgcccccggcgcccccggcggcggccaggccaaggccaucuccgacaucgcccucuccuuccucgacauggucaaccacuucgacuccgacuucucccaccgccuccaccucugcgacaucaagcccgagaacuucgccauccgcuccgacuucaccgucgucgccaucgacgucgacauggccuucuucgagcccaagaugcgcgagauccucgagcagaacugcaccggcgacgaggacugcaacuucuucgacugcuucucccgcugcgaccuccgcgucaacaagugcggcgcccagcgcgucaacaacaaccuccaggucaucugcgacaagaucuuccgccacugguucuccgccccccucaaguccuccgccgucuccuuccagcuccagcuccagcuccaggaggccguccaggagugcgccgaccccggcguccccuccggcaacacccgccgcgccgccuccuccgucuucuggaagcuccgccagcuccuccaggccacccuccgcgagcuccaggaggccgagaaguga

SEQ ID NO: 43037 - RNA, 1035 nt, Artificial Sequence
  derived and/or modified sequence opt2 from FAM71F1__Homo_sapiens__NP_115988
augcucuccuccuucccccaccgcaagaccuggcgcaaguccaagaagaccgucaaggucacccgcuccuaccccaccuuccccucccucaacgccugggaggaguuccgcggccuccuccccgucgacggcgagcccaaccccggcgccggccucggcgucgaggagggccuccucugccgcgucguccacucccccgaguucaaccucuuccucgacuccgucgucuucgaguccaacuucauccaggucaagcgcggccgcaacuggcgcgacgucuacaaggccuccaacaccauggcccucggcgucaccuccuccguccccugccucccccuccccaacauccuccucauggccuccgucaaguggcaccagggccagaaccagaccuggaaccgccccuccaucgcccccaacaucuuccucaagcgcauccucccccuccgcuucgucgagcuccaggucugcgaccacuaccagcgcauccuccagcuccgcaccgucaccgagaagaucuacuaccucaagcuccaccccgaccaccccgagaccgucuuccacuucuggauccgccucguccagauccuccagaagggccucuccaucaccaccaaggacccccgcauccucgucacccacugccucguccccaagaacugcuccucccccuccggcgacuccaagcucguccagaagaagcuccaggccucccagcccuccgagucccucauccagcucaugaccaagggcgaguccgaggcccucucccagaucuucgccgaccuccaccagcagaaccagcucuccuuccgcuccucccgcaaggucgagaccaacaagaacuccuccggcaaggacuccucccgcgaggacuccauccccugcaccugcgaccuccgcuggcgcgccuccuucaccuacggcgagugggagcgcgagaaccccuccggccuccagccccucucccuccucuccacccucgccgccuccaccggcccccagcucgccccccccaucggcaacuccaucuga

SEQ ID NO: 43038 - RNA, 930 nt, Artificial Sequence
  derived and/or modified sequence opt2 from FAM71F2__Homo_sapiens__NP_001012457
auguccaagauccgcggccucccccccgagguccgcgagcccggccccggcgucgagcucggcgucgagaacggccuccucugccagcucauccacucccccgaguucaaccucuucuccaacuccgucgucuucgaguccaacuucauccagacccacguccccgaggccgacuuccaggucaccaagcccggcaacuggcgcgacgucugcgagggcuccgccaccgucauccucggcgucaccuccuccguccccucccucccccuccccaacguccuccucauggccaacgucaccuggccccagggccccuucaccaccugguccacccccggcgacgcccccgucaucaaccucucccgccuccucccccucaaguacgucgagcuccgcaucuacgaccgccuccagcgcauccuccgcguccgcaccgucaccgagaagaucuacuaccucaagcuccacgagaagcaccccgagaucgucuuccaguucuggguccgccucgucaagauccuccagaagggccucuccaucaccaccaaggacccccgcaucaaguucacccacugccucguccccaagaugcccaccaacuccaccgagaccacccccgagaacucccuccucuccuccccccagcccuccgagccccucguccuccucgccgccgagcagaccuccggcuccuucucccagcucuccggcaagccccagcucaccgccgaccgcaacaacgacaccgccaucgagaucgacaacugcuccuccuacaagauccccucccccgucgccucccccaucaaccucaacauccccaugcgcgccgcccucucccacucccucugggagcaggaggacuggaacgagcaccuccuccagguccacaucgccuccuaccucggcgagcacuuccucggcgccuga

SEQ ID NO: 43039 - RNA, 330 nt, Artificial Sequence
  derived and/or modified sequence opt2 from FAM72B__Homo_sapiens__NP_001307078
auguccaccaacaucugcuccuucaaggacuccgccgucgacuucaccggccgcugcuacuucaccaagaucugcaagugcaagcucaaggacaucgccugccucaagugcggcaacaucgucggcuaccacgucaucguccccugcuccuccugccuccccuccugcaacaacggccacuucuggauguuccacucccaggccgucuacgacaucaaccgccucgacuccaccggcgucaacauccuccucuggggcaaccuccccgagaucgaggaguccaccgacgaggacguccucaacaucuccgccgaggagugcauccgcuga

SEQ ID NO: 43040 - RNA, 786 nt, Artificial Sequence
  derived and/or modified sequence opt2 from FAM78B__Homo_sapiens__NP_001017961
augggcugcauccaguccaucaccugcaaggcccgcauccgccgcgagaacaucgucgucuacgacgucugcgccaccaucgaccagugccccacccgcaucgaggagaccucccccaucguccuccgcuacaagacccccuacuucaaggccuccgcccgcgucgucaugccccccaucccccgccacgagaccugggucgucggcuggauccaggccugcaaccagauggaguucuucaacaccuacuccgaccucggcauguccuccugggagcuccccgaccuccgcgagggccgcgucaaggccaucuccgacuccgacggcgucuccuaccccugguacggcaacaccaccgagaccgucacccucgucggccccaccaacaagaucucccgcuucuccgucuccaugaacgacaacuucuaccccuccgucaccugggccguccccgucuccgacuccaacgucccccuccucacccgcaucaagcgcgaccaguccuucaccaccuggcucgucgccaugaacaccaccaccaaggagaagaucauccuccagaccaucaaguggcgcaugcgcgucgacaucgaggucgacccccuccagcuccucggccagcgcgcccgccucgucggccgcacccagcaggagcagccccgcauccucucccgcauggagcccaucccccccaacgcccucgucaagcccaacgccaacgacgcccagguccucauguggcgccccaagcgcggccccccccucgucgucaucccccccaaguga

SEQ ID NO: 43041 - RNA, 1359 nt, Artificial Sequence
  derived and/or modified sequence opt2 from FAM81B__Homo_sapiens__NP_689761
augcagcuccaguuccucggcacccucgccuccuccgagaagcgcaagaagucccagcgccucuucuucaagaacaucaaguccaccaagaacaaggccggcaaggccuccaucauguccuccgacaccaacgucaacaaguccgccucccccaccgccaccgccgaggagcagcccgucgagcccgacggcccccuccccggcuccgacaacaaccaggagaagaagguccgccucucccccgccaagauguccaccaagaacuccaccgaccucgucgaguacgucgacaagucccacgccuuccuccccaucauccccaacacccagcgcggccagcucgaggaccgccucaacaaccaggcccgcaccaucgccuuccuccucgagcaggccuuccgcaucaaggaggacaucuccgccugccuccagggcacccacggcuuccgcaaggaggagucccucgcccgcaagcuccucgagucccacauccagaccaucaccuccaucgucaagaagcucucccagaacaucgagauccucgaggaccagauccgcgcccgcgaccaggccgccaccggcaccaacuucgccguccacgagaucaacaucaagcaccuccagggcgucggcgaccuccgcggccgcgucgcccgcugcgacuccuccaucgucaagcucuccggcgacauccaccucuuccgccaggagcaccgccagaucgagaaggccauccaggaguucguccccgcccucgagacccucuccaagaaccucgacaugaaggucaugcagcuccucggcaagaucgagaccgccuccuccgagcagaccuccaaccucaagaugguccagggcgacuaccgccacgagaugaaccuccucgaguucaaguuccacucccucuccuccaaccucuacgaggaggucgagaacaacaagaaguggaccgagaaccaguuccucaaguaccgcaaggaccaccucggccacaucaacgagugccucaagguccuccaggagaagcucgagaaguccgagaacaagauggaggagaagcuccuccagcucuccuccaaggucgagaacuucaucaacacccagaagcaggagacccagcucuccaaggucaagcacauggagaacaagcucuccaagaagauggagcagauggagaagcagaucuggggcgagcucgagaccaugcagaacgaguaccaguccggcuucaaguccauccacgacucccucuccucccuccagcagauccagaagaccaagauggaccucgagaaguacaagguccagaaggaccucaagaagcuccagcgcaagaucgucgagcuccaggaggucuga

SEQ ID NO: 43042 - RNA, 885 nt, Artificial Sequence
  derived and/or modified sequence opt2 from FAM83A__Homo_sapiens__NP_001275516
augucccgcucccgccaccucggcaagauccgcaagcgccucgaggacgucaagucccaguggguccgccccgcccgcgccgacuucuccgacaacgaguccgcccgccucgccaccgacgcccuccucgacggcggcuccgaggccuacuggcgcguccucucccaggagggcgaggucgacuuccucuccuccgucgaggcccaguacauccaggcccaggcccgcgagccccccugcccccccgacacccucggcggcgccgaggccggccccaagggccucgacuccuccucccuccaguccggcaccuacuuccccgucgccuccgagggcuccgagcccgcccuccuccacuccugggccuccgccgagaagcccuaccucaaggagaaguccuccgccaccgucuacuuccagaccgucaagcacaacaacauccgcgaccucguccgccgcugcaucacccgcaccucccagaacaucuccauccgcuccgucgagggcgagaucuacugcgccaaguccggccgcaaguucgccggccagauccgcgagaaguucaucaucuccgacuggcgcuucguccucuccggcuccuacuccuucaccuggcucugcggccacguccaccgcaacauccucuccaaguucaccggccaggccgucgagcucuucgacgaggaguuccgccaccucuacgccuccuccaagcccgucaugggccucaaguccccccgccucgucgcccccgucccccccggcgccgcccccgccaacggccgccucuccuccuccuccggcuccgccuccgaccgcaccuccuccaaccccuucuccggccgcuccgccggcucccaccccggcacccgcaccgacggcuga

SEQ ID NO: 43043 - RNA, 3036 nt, Artificial Sequence
  derived and/or modified sequence opt2 from FAM83B__Homo_sapiens__NP_001010872
auggagaccuccuccaugcucuccucccucaacgacgagugcaaguccgacaacuacaucgagccccacuacaaggagugguaccgcgucgccaucgacauccucaucgagcacggccucgaggccuaccaggaguuccucguccaggagcgcgucuccgacuuccucgccgaggaggagaucaacuacauccucaagaacguccagaaggucgcccaguccaccgcccacggcaccgacgacuccugcgacgacacccucuccuccggcaccuacuggcccgucgaguccgacgucgaggcccccaaccucgaccucggcuggcccuacgucaugcccggccuccucggcggcacccacaucgaccuccucuuccaccccccccgcgcccaccuccucaccaucaaggagaccauccgcaagaugaucaaggaggcccgcaaggucaucgcccucgucauggacaucuucaccgacgucgacaucuucaaggagaucgucgaggccuccacccgcggcgucuccgucuacauccuccucgacgaguccaacuucaaccacuuccucaacaugaccgagaagcagggcugcuccguccagcgccuccgcaacauccgcguccgcaccgucaagggccaggacuaccucuccaagaccggcgccaaguuccacggcaagauggagcagaaguuccuccucgucgacugccagaaggucauguacggcuccuacuccuacaugugguccuucgagaaggcccaccucuccaugguccagaucaucaccggccagcucgucgaguccuucgacgaggaguuccgcacccucuacgcccgcuccugcguccccuccuccuucgcccaggaggaguccgcccgcgucaagcacggcaaggcccucugggagaacggcaccuaccagcacuccgucuccucccucgccuccgucuccucccagcgcaaccucuucggccgccaggacaagauccacaagcucgacuccuccuacuucaagaaccgcggcaucuacacccucaacgagcacgacaaguacaacauccgcucccacggcuacaagccccacuucguccccaacuucaacggccccaacgccauccgccaguuccagcccaaccagaucaacgagaacuggaagcgccacuccuacgccggcgagcagcccgagaccguccccuaccuccuccucaaccgcgcccucaaccgcaccaacaacccccccggcaacuggaagaagcccuccgacucccucuccgucgccuccuccucccgcgagggcuacgucucccaccacaacacccccgcccaguccuucgccaaccgccucgcccagcgcaagaccaccaaccucgccgaccgcaacuccaacguccgccgcuccuucaacggcaccgacaaccacauccgcuuccuccagcagcgcaugcccacccucgagcacaccaccaaguccuuccuccgcaacuggcgcaucgaguccuaccucaacgaccacuccgaggccacccccgacuccaacggcuccgcccucggcgaccgcuucgagggcuacgacaaccccgagaaccucaaggccaacgcccucuacacccacucccgccuccgcuccucccucgucuucaagcccacccuccccgagcagaaggaggucaacuccugcaccaccggcuccuccaacuccaccaucaucggcucccagggcuccgagacccccaaggagguccccgacacccccaccaacguccagcaccucaccgacaagccccuccccgaguccauccccaagcucccccuccaguccgaggcccccaagaugcacacccuccagguccccgagaaccacuccgucgcccucaaccagaccaccaacggccacaccgaguccaacaacuacaucuacaagacccucggcgucaacaagcagaccgagaaccucaagaaccagcagaccgagaaccuccucaagcgccgcuccuucccccucuucgacaacuccaaggccaaccucgaccccggcaacuccaagcacuacgucuacuccacccucacccgcaaccgcguccgccagcccgagaagcccaaggaggaccuccucaaguccuccaaguccaugcacaacgucacccacaaccucgaggaggacgaggaggaggucaccaagcgcaacucccccuccggcaccaccaccaaguccgucuccaucgccgcccuccucgacgucaacaaggaggaguccaacaaggagcucgccuccaagaaggaggucaagggcucccccuccuuccucaagaagggcucccagaagcuccgcucccuccucucccucacccccgacaagaaggagaaccucuccaagaacaaggcccccgccuucuaccgccucugcuccuccuccgacacccucgucuccgagggcgaggagaaccagaagcccaagaaguccgacaccaaggucgacuccuccccccgccgcaagcacuccuccuccuccaacucccagggcuccauccacaaguccaaggaggacgucaccgucucccccucccaggagaucaacgccccccccgacgagaacaagcgcacccccucccccggccccgucgaguccaaguuccucgagcgcgccggcgacgccuccgccccccgcuucaacaccgagcagauccaguaccgcgacucccgcgagaucaacgccgucgucacccccgagcgccgccccaccuccuccccccgccccaccuccuccgagcuccuccgcucccacuccaccgaccgccgcgucuacucccgcuucgagcccuucugcaagaucgaguccuccauccagcccaccuccaacaugcccaacaccuccaucaaccgccccgagaucaaguccgccaccaugggcaacuccuacggccgcuccuccccccuccucaacuacaacaccggcgucuaccgcuccuaccagcccaacgagaacaaguuccgcggcuucaugcagaaguucggcaacuucauccacaagaacaaguga

SEQ ID NO: 43044 - RNA, 1758 nt, Artificial Sequence
  derived and/or modified sequence opt2 from FAM83D__Homo_sapiens__NP_112181
auggcccuccucuccgagggccucgacgagguccccgccgccugccucucccccugcggcccccccaaccccaccgagcucuucuccgagucccgccgccucgcccucgaggagcucgucgccggcggccccgaggccuucgccgccuuccuccgccgcgagcgccucgcccgcuuccucaaccccgacgagguccacgccauccuccgcgccgccgagcgccccggcgaggagggcgccgccgccgccgccgccgccgaggacuccuucggcuccucccacgacugcuccuccggcaccuacuuccccgagcaguccgaccucgagcccccccuccucgagcucggcuggcccgccuucuaccagggcgccuaccgcggcgccacccgcgucgagacccacuuccagccccgcggcgccggcgagggcggccccuacggcugcaaggacgcccuccgccagcagcuccgcuccgcccgcgaggucaucgccgucgucauggacgucuucaccgacaucgacaucuuccgcgaccuccaggagaucugccgcaagcagggcgucgccgucuacauccuccucgaccaggcccuccucucccaguuccucgacaugugcauggaccucaagguccaccccgagcaggagaagcucaugaccguccgcaccaucaccggcaacaucuacuacgcccgcuccggcaccaagaucaucggcaagguccacgagaaguucacccucaucgacggcauccgcgucgccaccggcuccuacuccuucaccuggaccgacggcaagcucaacuccuccaaccucgucauccucuccggccaggucgucgagcacuucgaccucgaguuccgcauccucuacgcccaguccaagcccaucucccccaagcuccucucccacuuccaguccuccaacaaguucgaccaccucaccaaccgcaagccccaguccaaggagcucacccucggcaaccuccuccgcaugcgccucgcccgccucuccuccaccccccgcaaggccgaccucgaccccgagaugcccgccgagggcaaggccgagcgcaagccccacgacugcgaguccuccaccgucuccgaggaggacuacuucuccucccaccgcgacgagcuccagucccgcaaggccaucgacgccgccacccagaccgagcccggcgaggagaugcccggccucuccgucuccgaggucggcacccagaccuccaucaccaccgccugcgccggcacccagaccgccgucaucacccgcaucgccuccucccagaccaccaucuggucccgcuccaccaccacccagaccgacauggacgagaacauccucuucccccgcggcacccaguccaccgagggcucccccgucuccaagauguccgucucccgcuccuccucccucaaguccuccuccuccgucuccucccagggcuccgucgccuccuccaccggcucccccgccuccauccgcaccaccgacuuccacaaccccggcuaccccaaguaccucggcaccccccaccucgagcucuaccucuccgacucccuccgcaaccucaacaaggagcgccaguuccacuucgccggcauccgcucccgccucaaccacaugcucgccaugcucucccgccgcacccucuucaccgagaaccaccucggccuccacuccggcaacuucucccgcgucaaccuccucgccguccgcgacgucgcccucuaccccuccuaccaguga

SEQ ID NO: 43045 - RNA, 3558 nt, Artificial Sequence
  derived and/or modified sequence opt2 from FAM83H__Homo_sapiens__XP_006725151
auggcccccggccccaacauggcccgccgcucccaguccuccucccagggcgacaacccccucgcccccggcuaccuccccccccacuacaaggaguacuaccgccucgccgucgacgcccucgccgagggcggcuccgaggccuacucccgcuuccucgccaccgagggcgcccccgacuuccucugccccgaggagcucgagcacgucucccgccaccuccgccccccccaguacgucacccgcgagccccccgagggcucccuccucgacgucgacauggacggcuccuccggcaccuacuggcccgucaacuccgaccaggccguccccgagcucgaccucggcuggccccucaccuucggcuuccagggcaccgaggucaccacccucguccagccccccccccccgacucccccuccaucaaggacgaggcccgccgcaugauccgcuccgcccagcaggucgucgccgucgucauggacauguucaccgacgucgaccuccucuccgagguccucgaggccgccgcccgccgcguccccgucuacauccuccucgacgagaugaacgcccagcacuuccucgacauggccgacaagugccgcgucaaccuccagcacgucgacuuccuccgcguccgcaccgucgccggccccaccuacuacugccgcaccggcaaguccuucaagggccacgucaaggagaaguuccuccucgucgacugcgccgucgucauguccggcuccuacuccuucaugugguccuucgagaagauccaccgcucccucgcccacgucuuccagggcgagcucgucuccuccuucgacgaggaguuccgcauccucuucgcccaguccgagccccucguccccuccgccgccgcccucgcccgcauggacgccuacgcccucgcccccuacgccggcgccggcccccucgucggcguccccggcgucggcgcccccacccccuucuccuuccccaagcgcgcccaccuccucuucccccccccccgcgaggagggccucggcuuccccuccuuccucgaccccgaccgccacuuccucuccgccuuccgccgcgaggagcccccccgcaugcccggcggcgcccucgagccccacgccggccuccgcccccucucccgccgccucgaggccgaggccggccccgccggcgagcucgccggcgcccgcggcuucuuccaggcccgccaccucgagauggacgccuucaagcgccacuccuucgccaccgagggcgccggcgccgucgagaacuucgccgccgcccgccaggucucccgccagaccuuccucucccacggcgacgacuuccgcuuccagaccucccacuuccaccgcgaccagcucuaccagcagcaguaccagugggacccccagcucacccccgcccgcccccagggccucuucgagaagcuccgcggcggccgcgccggcuucgccgaccccgacgacuucacccucggcgccggcccccgcuuccccgagcucggccccgacggccaccagcgccucgacuacguccccuccuccgccucccgcgagguccgccacggcuccgaccccgccuucgcccccggcccccgcggccucgagcccuccggcgccccccgccccaaccucacccagcgcuuccccugccaggccgccgcccgccccggccccgaccccgcccccgaggccgagcccgagcgccgcggcggccccgagggccgcgccggccuccgccgcuggcgccucgccuccuaccucuccggcugccacggcgaggacggcggcgacgacggccuccccgcccccauggaggccgaggccuacgaggacgacguccucgcccccggcggccgcgcccccgccggcgaccuccuccccuccgccuuccgcguccccgccgccuuccccaccaagguccccguccccggccccggcuccggcggcaacggccccgagcgcgagggccccgaggagcccggccucgccaagcaggacuccuuccgcucccgccucaacccccucguccagcgcuccucccgccuccgcuccucccucaucuucuccaccucccaggccgagggcgccgccggcgccgccgccgccaccgagaagguccagcuccuccacaaggagcagaccgucuccgagacccucggccccggcggcgaggccguccgcuccgccgccuccaccaaggucgccgagcuccucgagaaguacaagggccccgcccgcgaccccggcggcggcgccggcgccaucaccgucgccucccacuccaaggccgucgucucccaggccuggcgcgaggaggucgccgcccccggcgccgucggcggcgagcgccgcucccucgaguccugccuccucgaccuccgcgacuccuucgcccagcagcuccaccaggaggccgagcgccagcccggcgccgccucccucaccgccgcccagcuccucgacacccucggccgcuccggcuccgaccgccuccccucccgcuuccucuccgcccagucccacuccaccuccccccagggccucgacuccccccucccccucgagggcuccggcgcccaccagguccuccacaacgaguccaagggcucccccaccuccgccuaccccgagcgcaagggcucccccacccccggcuucuccacccgccgcggcucccccaccaccggcuucaucgagcagaagggcucccccaccuccgccuaccccgagcgccgcggcucccccgucccccccguccccgagcgccgcuccucccccgucccccccguccccgagcgccgcggcucccucacccucaccaucuccggcgagucccccaaggccggccccgccgaggagggccccuccggccccauggagguccuccgcaagggcucccuccgccuccgccagcuccucucccccaagggcgagcgccgcauggaggacgagggcggcuuccccgucccccaggagaacggccagcccgaguccccccgccgccucucccucggccagggcgacuccaccgaggccgccaccgaggagcgcggcccccgcgcccgccucuccuccgccaccgccaacgcccucuacuccuccaaccuccgcgacgacaccaaggccauccucgagcagaucuccgcccacggccagaagcaccgcgccguccccgcccccucccccggccccacccacaacucccccgagcucggccgcccccccgccgccggcguccucgcccccgacauguccgacaaggacaagugcuccgccaucuuccgcuccgacucccucggcacccagggccgccucucccgcacccuccccgccuccgccgaggagcgcgaccgccuccuccgccgcauggaguccaugcgcaaggagaagcgcgucuacucccgcuucgaggucuucugcaagaaggaggaggccuccucccccggcgccggcgagggccccgccgaggagggcacccgcgacuccaaggucggcaaguucguccccaagauccucggcaccuucaaguccaagaaguga

SEQ ID NO: 43046 - RNA, 879 nt, Artificial Sequence
  derived and/or modified sequence opt2 from FAM84A__Homo_sapiens__NP_660158
augggcaaccagcucgaccgcaucacccaccucaacuacuccgagcuccccaccggcgaccccuccggcaucgagaaggacgagcuccgcgucggcgucgccuacuucuucuccgacgacgaggaggaccucgacgagcgcggccagcccgacaaguucggcgucaaggccccccccggcugcacccccugccccgagucccccucccgccaccaccaccaccuccuccaccagcucguccucaacgagacccaguucuccgccuuccgcggccaggagugcaucuucuccaaggucuccggcggcccccagggcgccgaccucuccgucuacgccgucaccgcccuccccgcccucugcgagcccggcgaccuccucgagcuccucuggcuccagcccgcccccgagccccccgcccccgccccccacugggccgucuacgucggcggcggccagaucauccaccuccaccagggcgagauccgccaggacucccucuacgaggccggcgccgccaacgucggccgcgucgucaacuccugguaccgcuaccgcccccucgucgccgagcucgucguccagaacgccugcggccaccucggccucaaguccgaggagaucugcuggaccaacuccgaguccuucgccgccuggugccgcuucggcaagcgcgaguucaaggccggcggcgagguccccgccggcacccagcccccccagcagcaguacuaccucaagguccaccucggcgagaacaagguccacaccgcccgcuuccacucccucgaggaccucauccgcgagaagcgccgcaucgacgccuccggccgccuccgcguccuccaggagcucgccgaccucgucgacgacaaggaguga

SEQ ID NO: 43047 - RNA, 933 nt, Artificial Sequence
  derived and/or modified sequence opt2 from FAM84B__Homo_sapiens__NP_777571
augggcaaccaggucgagaagcucacccaccucuccuacaaggagguccccaccgccgaccccaccggcgucgaccgcgacgacggcccccgcaucggcgucuccuacaucuucuccaacgacgacgaggacgucgagccccagccccccccccagggccccgacggcggcggccuccccgacggcggcgacggccccccccccccccagccccagcccuacgacccccgccuccacgaggucgagugcuccgucuucuaccgcgacgagugcaucuaccagaaguccuucgcccccggcuccgccgcccucuccaccuacacccccgagaaccuccucaacaagugcaagcccggcgaccucgucgaguucgucucccaggcccaguacccccacugggccgucuacgucggcaacuuccaggucguccaccuccaccgccucgaggucaucaacuccuuccucaccgacgccucccagggccgccgcggccgcgucgucaacgaccucuaccgcuacaagccccucuccuccuccgccgucguccgcaacgcccucgcccacgucggcgccaaggagcgcgagcucuccuggcgcaacuccgaguccuucgccgccuggugccgcuacggcaagcgcgaguucaagaucggcggcgagcuccgcaucggcaagcagcccuaccgccuccagauccagcucuccgcccagcgcucccacacccucgaguuccagucccucgaggaccucaucauggagaagcgccgcaacgaccagaucggccgcgccgccguccuccaggagcucgccacccaccuccaccccgccgagcccgaggagggcgacuccaacgucgcccgcaccacccccccccccggccgcccccccgcccccuccuccgaggaggaggacggcgaggccgucgcccacuga

SEQ ID NO: 43048 - RNA, 555 nt, Artificial Sequence
  derived and/or modified sequence opt2 from FAM89A__Homo_sapiens__NP_940954
auguccggcgcccgcgccgcccccggcgccgccggcaacggcgccguccgcggccuccgcgucgacggccuccccccccuccccaagucccucuccggccuccuccacuccgccuccggcggcggcgccuccggcggcuggcgccaccucgagcgccucuacgcccagaagucccgcauccaggacgagcucucccgcggcggccccggcggcggcggcgcccgcgccgccgcccuccccgccaagccccccaaccucgacgccgcccucgcccuccuccgcaaggagauggucggccuccgccagcucgacaugucccuccucugccagcucuacucccucuacgaguccauccaggaguacaagggcgccugccaggccgccuccucccccgacugcaccuacgcccucgagaacggcuucuucgacgaggaggaggaguacuuccaggagcagaacucccuccacgaccgccgcgaccgcggccccccccgcgaccucucccuccccgucuccucccucuccuccuccgacuggauccucgaguccaucuga

SEQ ID NO: 43049 - RNA, 756 nt, Artificial Sequence
  derived and/or modified sequence opt2 from FAM92A1__Homo_sapiens__NP_001269963
augaugcgccgcacccucgagaaccgcaacgcccagaccaagcagcuccagaccgccgucuccaacgucgagaagcacuucggcgagcucugccagaucuucgccgccuacguccgcaagaccgcccgccuccgcgacaaggccgaccuccucgucaacgagaucaacgccuacgccgccaccgagaccccccaccucaagcucggccucaugaacuucgccgacgaguucgccaagcuccaggacuaccgccaggccgaggucgagcgccucgaggccaaggucgucgagccccucaagaccuacggcaccaucgucaagaugaagcgcgacgaccucaaggccacccucaccgcccgcaaccgcgaggccaagcagcucacccagcucgagcgcacccgccagcgcaaccccuccgaccgccacgucaucucccaggccgagaccgagcuccagcgcgccgccauggacgccucccgcaccucccgccaccucgaggagaccaucaacaacuucgagcgccagaagaugaaggacaucaaggucuuccgcaacucccucuacgcccccgacuacuccucccgccucgacaucguccgcgccaacuccaaguccccccuccagcgcucccucuccgccaagugcgucuccggcaccggccaggucuccaccugccgccuccgcaaggaccagcaggccgaggacgacgaggacgacgagcucgacgucaccgaggaggagaacuuccucaaguga

SEQ ID NO: 43050 - RNA, 915 nt, Artificial Sequence
  derived and/or modified sequence opt2 from FAM92B__Homo_sapiens__NP_940893
augaacaucgucuucucccgcgacucccagguccgcgucauggagaacaccgucgccaacaccgagaaguacuucggccaguucugcucccuccucgccgccuacacccgcaagaccgcccgccuccgcgacaaggccgaccagcucgucaagcagcucaucgacuucgccaacuccgagaaccccgagcuccgcgccaccaugcgcggcuucgccgaggaccucgccaagguccaggacuaccgccaggcccaggucgagcgccucgagaccaaggucgucaacccccucaagcucuacggcgcccagaucaagcagacccgcgccgagaucaagaaguucaagcacguccagaaccacgagaucaagcagcucgagaagcucgagaagcuccgccagaagucccccuccgaccagcagaugaucucccaggccgagacccgcguccagcgcgccgccgucgacuccucccgcaccacccuccagcucgaggagaccgucgacggcuuccagcgccagaagcucaaggaccuccagaaguucuucugcgacuucgucaccaucgagauggucuuccacgccaaggccgucgaggucuacuccuccgccuuccagacccucgagaaguacgaccucgagcgcgaccuccucgacuuccgcgccaagaugcagggcgucuacggccacuacgacacccgccuccucgccaacaccucccccccccccuccguccuccagucccucgccucccagggcacccuccagguccagcucucccgcgccaacgaggaccccgagcacccccacgccaaccacggccgcuucucccucugcgagugggucgucaagggccagcccgcccacugcgucugcggccagggcggccaccucaugcuccccggccacucccucuga

SEQ ID NO: 43051 - RNA, 561 nt, Artificial Sequence
  derived and/or modified sequence opt2 from FAM9B__Homo_sapiens__NP_995321
auggccgccuggggcaagaagcacgccggcaaggaccccguccgcgacgagugcgaggagcgcaaccgcuucaccgagacccgcgaggaggacgucaccgacgagcacggcgagcgcgagcccuucgccgagaccgacgagcacaccggcgccaacaccaagaagcccgaggacaccgccgaggaccucaccgccaagcgcaagcgcaugaagauggacaagaccugcuccaagaccaagaacaaguccaagcacgcccuccgcaagaagcagcucaagcgccagaagcgcgacuacauccacucccucaagcuccucaacguccucgaggaguacaucaccgacgagcagaaggaggaggaggaggaggagggcgaggaggaggagcucauccgcaucuuccaggagcagcagaagaaguggcagcaguaccgcuccguccgccgcgagcgccucaaggagaugaagcuccuccgcgaccaguucgucaaggcccucgaggacuucgaggaccucugcgaccgcgucuucuccgacgaggacuccgagcucgacaacuga

SEQ ID NO: 43052 - RNA, 1602 nt, Artificial Sequence
  derived and/or modified sequence opt2 from FAN1__Homo_sapiens__NP_001139568
augauguccgagggcaagccccccgacaagaagcgcccccgccgcucccucuccaucuccaagaacaagaagaaggccuccaacuccaucaucuccugcuucaacaacgccccccccgccaagcucgccugccccgucugcuccaagauggucccccgcuacgaccucaaccgccaccucgacgagaugugcgccaacaacgacuucguccaggucgaccccggccaggucggccucaucaacuccaacgucuccauggucgaccucaccuccgucacccucgaggacgucacccccaagaagucccccccccccaagaccaaccucacccccggccaguccgacuccgccaagcgcgaggucaagcagaagaucucccccuacuucaaguccaacgacgucgucugcaagaaccaggacgagcuccgcaaccgcuccgucaaggucaucugccucggcucccucgccuccaagcucucccgcaaguacgucaaggccaagaaguccaucgacaaggacgaggaguucgccggcuccuccccccaguccuccaaguccaccgucgucaagucccucaucgacaacuccuccgagaucgaggacgaggaccagauccucgagaacuccucccagaaggagaacgucuucaagugcgacucccucaaggaggagugcauccccgagcacaugguccgcggcuccaagaucauggaggccgagucccagaaggccacccgcgagugcgagaaguccgcccucacccccggcuucuccgacaacgccaucaugcucuucucccccgacuucacccuccgcaacacccucaaguccaccuccgaggacucccucgucaagcaggagugcaucaaggaggucgucgagaagcgcgaggccugccacugcgaggaggucaagaugaccgucgccuccgaggccaagauccagcucuccgacuccgaggccaagucccacuccuccgccgacgacgccuccgccugguccaacauccaggaggccccccuccaggacgacuccugccucaacaacgacaucccccacuccaucccccucgagcagggcuccuccugcaacggccccggccagaccaccggccaccccuacuaccuccgcuccuuccucgucguccucaagaccguccucgagaacgaggacgacaugcuccucuucgacgagcaggagaagggcaucgucaccaaguucuaccagcucuccgccaccggccagaagcucuacguccgccucuuccagcgcaagcucuccuggaucaagaugaccaagcucgaguacgaggagaucgcccucgaccucacccccgucaucgaggagcucaccaacgccggcuuccuccagaccgaguccgagcuccaggagcucuccgagguccucgagcuccucuccgcccccgagcucaagucccucgccaagaccuuccaccucgucaaccccaacggccagaagcagcagcucgucgacgccuuccucaagcucgccaagcagcgcuccgucugcaccuggggcaagaacaagcccggcaucggcgccgucauccucaagcgcuucugcuggcuccuccuccaguga

SEQ ID NO: 43053 - RNA, 4368 nt, Artificial Sequence
  derived and/or modified sequence opt2 from FANCA__Homo_sapiens__NP_000126
auguccgacuccuggguccccaacuccgccuccggccaggaccccggcggccgccgccgcgccugggccgagcuccucgccggccgcgucaagcgcgagaaguacaaccccgagcgcgcccagaagcucaaggaguccgccguccgccuccuccgcucccaccaggaccucaacgcccuccuccucgaggucgagggcccccucugcaagaagcucucccucuccaaggucaucgacugcgacuccuccgaggccuacgccaaccacuccuccuccuucaucggcuccgcccuccaggaccaggccucccgccucggcguccccgucggcauccucuccgccggcauggucgccuccuccgucggccagaucugcaccgcccccgccgagaccucccaccccguccuccucaccgucgagcagcgcaagaagcucuccucccuccucgaguucgcccaguaccuccucgcccacuccauguucucccgccucuccuucugccaggagcucuggaagauccaguccucccuccuccucgaggccgucuggcaccuccacguccagggcaucgucucccuccaggagcuccucgagucccaccccgacaugcacgccgucggcuccuggcucuuccgcaaccucugcugccucugcgagcagauggaggccuccugccagcacgccgacgucgcccgcgccaugcucuccgacuucguccagauguucguccuccgcggcuuccagaagaacuccgaccuccgccgcaccgucgagcccgagaagaugccccaggucaccgucgacguccuccagcgcaugcucaucuucgcccucgacgcccucgccgccggcguccaggaggaguccuccacccacaagaucguccgcugcugguucggcgucuucuccggccacacccucggcuccgucaucuccaccgacccccucaagcgcuucuucucccacacccucacccagauccucacccacucccccguccucaaggccuccgacgccguccagaugcagcgcgagugguccuucgcccgcacccacccccuccucaccucccucuaccgccgccucuucgucaugcucuccgccgaggagcucgucggccaccuccaggagguccucgagacccaggagguccacuggcagcgcguccucuccuucgucuccgcccucgucgucugcuuccccgaggcccagcagcuccucgaggacugggucgcccgccucauggcccaggccuucgaguccugccagcucgacuccauggucaccgccuuccucgucguccgccaggccgcccucgagggccccuccgccuuccucuccuacgccgacugguucaaggccuccuucggcuccacccgcggcuaccacggcugcuccaagaaggcccucgucuuccucuucaccuuccucuccgagcucguccccuucgaguccccccgcuaccuccagguccacauccuccaccccccccucguccccggcaaguaccgcucccuccucaccgacuacaucucccucgccaagacccgccucgccgaccucaaggucuccaucgagaacaugggccucuacgaggaccucuccuccgccggcgacaucaccgagccccacucccaggcccuccaggacgucgagaaggccaucauggucuucgagcacaccggcaacauccccgucaccgucauggaggccuccaucuuccgccgccccuacuacgucucccacuuccuccccgcccuccucaccccccgcguccuccccaagguccccgacucccgcgucgccuucaucgagucccucaagcgcgccgacaagaucccccccucccucuacuccaccuacugccaggccugcuccgccgccgaggagaagcccgaggacgccgcccucggcguccgcgccgagcccaacuccgccgaggagccccucggccagcucaccgccgcccucggcgagcuccgcgccuccaugaccgaccccucccagcgcgacgucaucuccgcccaggucgccgucaucuccgagcgccuccgcgccguccucggccacaacgaggacgacuccuccgucgagaucuccaagauccagcucuccaucaacaccccccgccucgagccccgcgagcacauggccgucgaccuccuccucaccuccuucugccagaaccucauggccgccuccuccgucgccccccccgagcgccagggccccugggccgcccucuucguccgcaccaugugcggccgcguccuccccgccguccucacccgccucugccagcuccuccgccaccagggccccucccucuccgccccccacguccucggccucgccgcccucgccguccaccucggcgagucccgcuccgcccuccccgaggucgacgucggcccccccgcccccggcgccggccuccccguccccgcccucuucgacucccuccucaccugccgcacccgcgacucccucuucuucugccucaaguucugcaccgccgccaucuccuacucccucugcaaguucuccucccagucccgcgacacccucugcuccugccucucccccggccucaucaagaaguuccaguuccucauguuccgccucuucuccgaggcccgccagccccucuccgaggaggacgucgccucccucuccuggcgcccccuccaccuccccuccgccgacuggcagcgcgccgcccucucccucuggacccaccgcaccuuccgcgagguccucaaggaggaggacguccaccucaccuaccaggacuggcuccaccucgagcucgagauccagcccgaggccgacgcccucuccgacaccgagcgccaggacuuccaccagugggccauccacgagcacuuccuccccgaguccuccgccuccggcggcugcgacggcgaccuccaggccgccugcaccauccucgucaacgcccucauggacuuccaccaguccucccgcuccuacgaccacuccgagaacuccgaccucgucuucggcggccgcaccggcaacgaggacaucaucucccgccuccaggagauggucgccgaccucgagcuccagcaggaccucaucgucccccucggccacacccccucccaggagcacuuccucuucgagaucuuccgccgccgccuccaggcccucaccuccggcugguccgucgccgccucccuccagcgccagcgcgagcuccucauguacaagcgcauccuccuccgccuccccuccuccguccucugcggcuccuccuuccaggccgagcagcccaucaccgcccgcugcgagcaguucuuccaccucgucaacuccgagaugcgcaacuucugcucccacggcggcgcccucacccaggacaucaccgcccacuucuuccgcggccuccucaacgccugccuccgcucccgcgaccccucccucauggucgacuucauccucgccaagugccagaccaagugcccccucauccucaccuccgcccucgucugguggcccucccucgagcccguccuccucugccgcuggcgccgccacugccaguccccccucccccgcgagcuccagaagcuccaggagggccgccaguucgccuccgacuuccucucccccgaggccgccucccccgcccccaaccccgacuggcucuccgccgccgcccuccacuucgccauccagcagguccgcgaggagaacauccgcaagcagcucaagaagcucgacugcgagcgcgaggagcuccucgucuuccucuucuucuucucccucaugggccuccucuccucccaccucaccuccaacuccaccaccgaccuccccaaggccuuccacgucugcgccgccauccucgagugccucgagaagcgcaagaucuccuggcucgcccucuuccagcucaccgaguccgaccuccgccucggccgccuccuccuccgcgucgcccccgaccagcacacccgccuccuccccuucgccuucuacucccuccucuccuacuuccacgaggacgccgccauccgcgaggaggccuuccuccacgucgccgucgacauguaccucaagcucguccagcucuucgucgccggcgacaccuccaccgucuccccccccgccggccgcucccucgagcucaagggccagggcaaccccgucgagcucaucaccaaggcccgccucuuccuccuccagcucaucccccgcugccccaagaaguccuucucccacgucgccgagcuccucgccgaccgcggcgacugcgaccccgaggucuccgccgcccuccagucccgccagcaggccgcccccgacgccgaccucucccaggagccccaccucuucuga

SEQ ID NO: 43054 - RNA, 2580 nt, Artificial Sequence
  derived and/or modified sequence opt2 from FANCB__Homo_sapiens__NP_001018123
augaccuccaagcaggccauguccuccaacgagcaggagcgccuccucugcuacaacggcgagguccucgucuuccagcucuccaagggcaacuucgccgacaaggagcccaccaagacccccauccuccacguccgccgcauggucuucgaccgcggcaccaaggucuucguccagaaguccaccggcuucuucaccaucaaggaggagaacucccaccucaagaucaugugcugcaacugcgucuccgacuuccgcaccggcaucaaccuccccuacaucgucaucgagaagaacaagaagaacaacgucuucgaguacuuccuccucauccuccacuccaccaacaaguucgagaugcgccucuccuucaagcucggcuacgagaugaaggacggccuccgcguccucaacggcccccucauccucuggcgccacgucaaggccuucuucuucaucuccucccagaccggcaaggucgucuccgucuccggcaacuucuccuccauccagugggccggcgagaucgagaaccucggcaugguccuccucggccucaaggagugcugccucuccgaggaggagugcacccaggagcccuccaaguccgacuacgccaucuggaacaccaaguucugcgucuacucccucgagucccaggagguccucuccgacaucuacaucaucccccccgccuacuccuccgucgucaccuacguccacaucugcgccaccgagaucaucaagaaccagcuccgcaucucccucaucgcccucacccgcaagaaccagcucaucuccuuccagaacggcacccccaagaacgucugccagcuccccuucggcgaccccugcgccguccagcucauggacuccggcggcggcaaccucuucuucgucgucuccuucaucuccaacaacgccugcgccgucuggaaggaguccuuccaggucgccgccaagugggagaagcucucccucguccucaucgacgacuucaucggcuccggcaccgagcagguccuccuccucuucaaggacucccucaacuccgacugccucaccuccuucaagaucaccgaccucggcaagaucaacuacuccuccgagcccuccgacugcaacgaggacgaccucuucgaggacaagcaggagaaccgcuaccucgucguccccccccucgagaccggccucaaggucugcuucuccuccuuccgcgagcuccgccagcaccuccuccucaaggagaagaucaucuccaaguccuacaaggcccucaucaaccucguccagggcaaggacgacaacaccuccuccgccgaggagaaggagugccucgucccccucugcggcgaggaggagaacuccguccacauccucgacgagaagcucuccgacaacuuccaggacuccgagcagcucgucgagaagaucugguaccgcgucaucgacgacucccucgucgucggcgucaagaccaccuccucccucaagcucucccucaacgacgucacccucucccuccucauggaccaggcccacgacucccgcuuccgccuccucaagugccagaaccgcgucaucaagcucuccaccaaccccuuccccgcccccuaccucaugcccugcgagaucggccucgaggccaagcgcgucacccucacccccgacuccaagaaggaggaguccuucgucugcgagcaccccuccaagaaggagugcguccagaucaucaccgccgucaccucccucuccccccuccucaccuucuccaaguucugcugcaccguccuccuccagaucauggagcgcgaguccggcaacugccccaaggaccgcuacgucgucugcggccgcgucuuccucucccucgaggaccucuccaccggcaaguaccuccucaccuuccccaagaagaagcccaucgagcacauggaggaccucuucgcccuccucgccgccuuccacaaguccugcuuccagaucaccucccccggcuacgcccucaacuccaugaaggucuggcuccucgagcacaugaagugcgagaucaucaaggaguuccccgaggucuacuucugcgagcgccccggcuccuucuacggcacccucuucaccuggaagcagcgcacccccuucgagggcauccucaucaucuacucccgcaaccagaccgucauguuccagugccuccacaaccucauccgcauccuccccaucaacugcuuccucaagaaccucaaguccggcuccgagaacuuccucaucgacaacauggccuucacccucgagaaggagcucgucacccucuccucccucuccuccgccaucgccaagcacgaguccaacuucaugcagcgcugcgaggucuccaagggcaaguccuccgucgucgccgccgcccucuccgaccgccgcgagaacauccaccccuaccgcaaggagcuccagcgcgagaagaagaagaugcuccagaccaaccucaaggucuccggcgcccucuaccgcgagaucacccucaaggucgccgagguccagcucaaguccgacuucgccgcccagaagcucuccaaccucuga

SEQ ID NO: 43055 - RNA, 1677 nt, Artificial Sequence
  derived and/or modified sequence opt2 from FANCC__Homo_sapiens__NP_001230672
auggcccaggacuccgucgaccucuccugcgacuaccaguucuggaugcagaagcucuccgucugggaccaggccuccacccucgagacccagcaggacaccugccuccacgucgcccaguuccaggaguuccuccgcaagauguacgaggcccucaaggagauggacuccaacaccgucaucgagcgcuuccccaccaucggccagcuccucgccaaggccugcuggaaccccuucauccucgccuacgacgagucccagaagauccucaucuggugccucugcugccucaucaacaaggagccccagaacuccggccaguccaagcucaacuccuggauccagggcguccucucccacauccucuccgcccuccgcuucgacaaggaggucgcccucuucacccagggccucggcuacgcccccaucgacuacuaccccggccuccucaagaacaugguccucucccucgccuccgagcuccgcgagaaccaccucaacggcuucaacacccagcgccgcauggcccccgagcgcgucgccucccucucccgcgucugcgucccccucaucacccucaccgacgucgacccccucgucgaggcccuccucaucugccacggccgcgagccccaggagauccuccagcccgaguucuucgaggccgucaacgaggccauccuccucaagaagaucucccuccccauguccgccgucgucugccucuggcuccgccaccuccccucccucgagaaggccaugcuccaccucuucgagaagcucaucuccuccgagcgcaacugccuccgccgcaucgagugcuucaucaaggacuccucccucccccaggccgccugccaccccgccaucuuccgcgucgucgacgagauguuccgcugcgcccuccucgagaccgacggcgcccucgagaucaucgccaccauccaggucuucacccagugcuucgucgaggcccucgagaaggccuccaagcagcuccgcuucgcccucaagaccuacuuccccuacaccucccccucccucgccaugguccuccuccaggacccccaggacaucccccgcggccacuggcuccagacccucaagcacaucuccgagcuccuccgcgaggccgucgaggaccagacccacggcuccugcggcggccccuucgaguccugguuccucuucauccacuucggcggcugggccgagauggucgccgagcagcuccucauguccgccgccgagccccccaccgcccuccucuggcuccucgccuucuacuacggcccccgcgacggccgccagcagcgcgcccagaccaugguccaggucaaggccguccucggccaccuccucgccaugucccgcuccuccucccucuccgcccaggaccuccagaccgucgccggccagggcaccgacaccgaccuccgcgcccccgcccagcagcucauccgccaccuccuccucaacuuccuccucugggcccccggcggccacaccaucgccugggacgucaucacccucauggcccacaccgccgagaucacccacgagaucaucggcuuccucgaccagacccucuaccgcuggaaccgccucggcaucgaguccccccgcuccgagaagcucgcccgcgagcuccucaaggagcuccgcacccaggucuga

SEQ ID NO: 43056 - RNA, 4356 nt, Artificial Sequence
  derived and/or modified sequence opt2 from FANCD2__Homo_sapiens__NP_001018125
auggucuccaagcgccgccucuccaaguccgaggacaaggagucccucaccgaggacgccuccaagacccgcaagcagccccucuccaagaagaccaagaagucccacaucgccaacgaggucgaggagaacgacuccaucuucgucaagcuccucaagaucuccggcaucauccucaagaccggcgagucccagaaccagcucgccgucgaccagaucgccuuccagaagaagcucuuccagacccuccgccgccaccccuccuaccccaagaucaucgaggaguucgucuccggccucgaguccuacaucgaggacgaggacuccuuccgcaacugccuccucuccugcgagcgccuccaggacgaggaggccuccaugggcgccuccuacuccaagucccucaucaagcuccuccucggcaucgacauccuccagcccgccaucaucaagacccucuucgagaagcuccccgaguacuucuucgagaacaagaacuccgacgagaucaacaucccccgccucaucgucucccagcucaaguggcucgaccgcgucgucgacggcaaggaccucaccaccaagaucaugcagcucaucuccaucgcccccgagaaccuccagcacgacaucaucaccucccuccccgagauccucggcgacucccagcacgccgacgucggcaaggagcucuccgaccuccucaucgagaacaccucccucaccguccccauccucgacguccucuccucccuccgccucgaccccaacuuccuccucaagguccgccagcucgucauggacaagcucuccuccauccgccucgaggaccuccccgucaucaucaaguucauccuccacuccgucaccgccauggacacccucgaggucaucuccgagcuccgcgagaagcucgaccuccagcacugcguccuccccucccgccuccaggccucccaggucaagcucaaguccaagggccgcgccuccuccuccggcaaccaggaguccuccggccaguccugcaucauccuccucuucgacgucaucaaguccgccauccgcuacgagaagaccaucuccgaggccuggaucaaggccaucgagaacaccgccuccgucuccgagcacaaggucuucgaccucgucaugcucuucaucaucuacuccaccaacacccagaccaagaaguacaucgaccgcguccuccgcaacaagauccgcuccggcugcauccaggagcagcuccuccaguccaccuucuccguccacuaccucguccucaaggacaugugcuccuccauccucucccucgcccagucccuccuccacucccucgaccaguccaucaucuccuucggcucccuccucuacaaguacgccuucaaguucuucgacaccuacugccagcaggaggucgucggcgcccucgucacccacaucugcuccggcaacgaggccgaggucgacaccgcccucgacguccuccucgagcucgucguccucaaccccuccgccaugaugaugaacgccgucuucgucaagggcauccucgacuaccucgacaacaucuccccccagcagauccgcaagcucuucuacguccucuccacccucgccuucuccaagcagaacgaggccuccucccacauccaggacgacaugcaccucgucauccgcaagcagcucuccuccaccgucuucaaguacaagcucaucggcaucaucggcgccgucaccauggccggcaucauggccgccgaccgcuccgagucccccucccucacccaggagcgcgccaaccucuccgacgagcagugcacccaggucaccucccuccuccagcucguccacuccugcuccgagcaguccccccaggccuccgcccucuacuacgacgaguucgccaaccucauccagcacgagaagcucgaccccaaggcccucgagugggucggccacaccaucugcaacgacuuccaggacgccuucgucgucgacuccugcgucguccccgagggcgacuuccccuuccccgucaaggcccucuacggccucgaggaguacgacacccaggacggcaucgccaucaaccuccucccccuccucuucucccaggacuucgccaaggacggcggccccgucaccucccaggaguccggccagaagcucgucuccccccucugccucgcccccuacuuccgccuccuccgccucugcgucgagcgccagcacaacggcaaccucgaggagaucgacggccuccucgacugccccaucuuccucaccgaccucgagcccggcgagaagcucgaguccauguccgccaaggagcgcuccuucaugugcucccucaucuuccucacccucaacugguuccgcgagaucgucaacgccuucugccaggagaccucccccgagaugaagggcaagguccucacccgccucaagcacaucgucgagcuccagaucauccucgagaaguaccucgccgucacccccgacuacguccccccccucggcaacuucgacgucgagacccucgacaucaccccccacaccgucaccgccaucuccgccaagauccgcaagaagggcaagaucgagcgcaagcagaagaccgacggcuccaagaccuccuccuccgacacccucuccgaggagaagaacuccgagugcgaccccacccccucccaccgcggccagcucaacaaggaguucaccggcaaggaggagaagaccucccuccuccuccacaacucccacgccuucuuccgcgagcucgacaucgaggucuucuccauccuccacugcggccucgucaccaaguucauccucgacaccgagaugcacaccgaggccaccgaggucguccagcucggcccccccgagcuccucuuccuccucgaggaccucucccagaagcucgaguccaugcucaccccccccaucgcccgccgcguccccuuccucaagaacaagggcucccgcaacaucggcuucucccaccuccagcagcgcuccgcccaggagaucguccacugcgucuuccagcuccucacccccaugugcaaccaccucgagaacauccacaacuacuuccagugccucgccgccgagaaccacggcgucgucgacggccccggcgucaagguccaggaguaccacaucauguccuccugcuaccagcgccuccuccagaucuuccacggccucuucgccugguccggcuucucccagcccgagaaccagaaccuccucuacuccgcccuccacguccucuccucccgccucaagcagggcgagcacucccagccccucgaggagcuccucucccaguccguccacuaccuccagaacuuccaccaguccauccccuccuuccagugcgcccucuaccucauccgccuccucauggucauccucgagaaguccaccgccuccgcccagaacaaggagaagaucgccucccucgcccgccaguuccucugccgcgucuggcccuccggcgacaaggagaaguccaacaucuccaacgaccagcuccacgcccuccucugcaucuaccucgagcacaccgaguccauccucaaggccaucgaggagaucgccggcgucggcguccccgagcucaucaacucccccaaggacgccuccuccuccaccuuccccacccucacccgccacaccuucgucgucuucuuccgcgucaugauggccgagcucgagaagaccgucaagaagaucgagcccggcaccgccgccgacucccagcagauccacgaggagaagcuccucuacuggaacauggccguccgcgacuucuccauccucaucaaccucaucaaggucuucgacucccaccccguccuccacgucugccucaaguacggccgccucuucgucgaggccuuccucaagcagugcaugccccuccucgacuucuccuuccgcaagcaccgcgaggacguccucucccuccucgagaccuuccagcucgacacccgccuccuccaccaccucugcggccacuccaagauccaccaggacacccgccucacccagcacgucccccuccucaagaagacccucgagcuccucgucugccgcgucaaggccaugcucacccucaacaacugccgcgaggccuucuggcucggcaaccucaagaaccgcgaccuccagggcgaggagaucaagucccagaacucccaggaguccaccgccgacgaguccgaggacgacauguccucccaggccuccaaguccaaggccaccgaggacggcgaggaggacgaggucuccgccggcgagaaggagcaggacuccgacgaguccuacgacgacuccgacuga

SEQ ID NO: 43057 - RNA, 1611 nt, Artificial Sequence
  derived and/or modified sequence opt2 from FANCE__Homo_sapiens__NP_068741
auggccacccccgacgccggccuccccggcgccgagggcgucgagcccgcccccugggcccagcucgaggcccccgcccgccuccuccuccaggcccuccaggccggccccgagggcgcccgccgcggccucggcguccuccgcgcccucggcucccgcggcugggagcccuucgacuggggccgccuccucgaggcccucugccgcgaggagcccgucguccagggccccgacggccgccucgagcucaagccccuccuccuccgccucccccgcaucugccagcgcaaccucaugucccuccucauggccguccgccccucccuccccgaguccggccuccucuccguccuccagaucgcccagcaggaccucgcccccgaccccgacgccuggcuccgcgcccucggcgagcuccuccgccgcgaccucggcgucggcaccuccauggagggcgccuccccccucuccgagcgcugccagcgccagcuccagucccucugccgcggccucggccucggcggccgccgccucaaguccccccaggcccccgaccccgaggaggaggagaaccgcgacucccagcagcccggcaagcgccgcaaggacuccgaggaggaggccgccucccccgagggcaagcgcguccccaagcgccuccgcugcugggaggaggaggaggaccacgagaaggagcgccccgagcacaagucccucgagucccucgccgacggcggcuccgccucccccaucaaggaccagcccgucauggccgucaagaccggcgaggacggcuccaaccucgacgacgccaagggccucgccgagucccucgagcuccccaaggccauccaggaccagcucccccgccuccagcagcuccucaagacccucgaggagggccucgagggccucgaggacgccccccccgucgagcuccagcuccuccacgagugcucccccucccagauggaccuccucugcgcccagcuccagcucccccagcucuccgaccucggccuccuccgccucugcaccuggcuccucgcccucucccccgaccucucccucuccaacgccaccguccucacccgcucccucuuccucggccgcauccucucccucaccuccuccgccucccgccuccucaccaccgcccucaccuccuucugcgccaaguacaccuaccccgucugcuccgcccuccucgaccccguccuccaggcccccggcaccggccccgcccagaccgagcuccucugcugccucgucaagauggagucccucgagcccgacgcccagguccucaugcucggccagauccucgagcuccccuggaaggaggagaccuuccucguccuccagucccuccucgagcgccaggucgagaugacccccgagaaguucuccguccucauggagaagcucugcaagaagggccucgccgccaccaccuccauggccuacgccaagcucaugcucaccgucaugaccaaguaccaggccaacaucaccgagacccagcgccucggccucgccauggcccucgagcccaacaccaccuuccuccgcaagucccucaaggccgcccucaagcaccucggccccuga

SEQ ID NO: 43058 - RNA, 1125 nt, Artificial Sequence
  derived and/or modified sequence opt2 from FANCF__Homo_sapiens__NP_073562
auggagucccuccuccagcaccucgaccgcuucuccgagcuccucgccgucuccuccaccaccuacgucuccaccugggaccccgccaccguccgccgcgcccuccagugggcccgcuaccuccgccacauccaccgccgcuucggccgccacggccccauccgcaccgcccucgagcgccgccuccacaaccaguggcgccaggagggcggcuucggccgcggccccguccccggccucgccaacuuccaggcccucggccacugcgacguccuccucucccuccgccuccucgagaaccgcgcccucggcgacgccgcccgcuaccaccucguccagcagcucuuccccggccccggcguccgcgacgccgacgaggagacccuccaggagucccucgcccgccucgcccgccgccgcuccgccguccacaugcuccgcuucaacggcuaccgcgagaaccccaaccuccaggaggacucccucaugaagacccaggccgagcuccuccucgagcgccuccaggaggucggcaaggccgaggccgagcgccccgcccgcuuccucuccucccucugggagcgccucccccagaacaacuuccucaaggucaucgccgucgcccuccuccagcccccccucucccgccgcccccaggaggagcucgagcccggcauccacaagucccccggcgagggcucccagguccucguccacuggcuccucggcaacuccgaggucuucgccgccuucugccgcgcccuccccgccggccuccucacccucgucaccucccgccaccccgcccucucccccgucuaccucggccuccucaccgacuggggccagcgccuccacuacgaccuccagaagggcaucugggucggcaccgagucccaggacguccccugggaggagcuccacaaccgcuuccagucccucugccaggccccccccccccucaaggacaagguccucaccgcccucgagaccugcaaggcccaggacggcgacuucgagguccccggccucuccaucuggaccgaccuccuccucgcccuccgcuccggcgccuuccgcaagcgccagguccucggccucuccgccggccucuccuccgucuga

SEQ ID NO: 43059 - RNA, 1869 nt, Artificial Sequence
  derived and/or modified sequence opt2 from FANCG__Homo_sapiens__NP_004620
augucccgccagaccaccuccgucggcuccuccugccucgaccucuggcgcgagaagaacgaccgccucguccgccaggccaaggucgcccagaacuccggccucacccuccgccgccagcagcucgcccaggacgcccucgagggccuccgcggccuccuccacucccuccagggccuccccgccgccguccccguccucccccucgagcucaccgucaccugcaacuucaucauccuccgcgccucccucgcccagggcuucaccgaggaccaggcccaggacauccagcgcucccucgagcgcguccucgagacccaggagcagcagggcccccgccucgagcagggccuccgcgagcucugggacuccguccuccgcgccuccugccuccuccccgagcuccucuccgcccuccaccgccucgucggccuccaggccgcccucuggcucuccgccgaccgccucggcgaccucgcccuccuccucgagacccucaacggcucccaguccggcgccuccaaggaccuccuccuccuccucaagaccugguccccccccgccgaggagcucgacgccccccucacccuccaggacgcccagggccucaaggacguccuccucaccgccuucgccuaccgccagggccuccaggagcucaucaccggcaaccccgacaaggcccucuccucccuccacgaggccgccuccggccucugcccccgccccguccucguccaggucuacaccgcccucggcuccugccaccgcaagaugggcaacccccagcgcgcccuccucuaccucgucgccgcccucaaggagggcuccgccuggggccccccccuccucgaggccucccgccucuaccagcagcucggcgacaccaccgccgagcucgagucccucgagcuccucgucgaggcccucaacguccccugcuccuccaaggccccccaguuccucaucgaggucgagcuccuccuccccccccccgaccucgccuccccccuccacugcggcacccagucccagaccaagcacauccucgccucccgcugccuccagaccggccgcgccggcgacgccgccgagcacuaccucgaccuccucgcccuccuccucgacuccuccgagccccgcuucucccccccccccuccccccccggccccugcaugcccgaggucuuccucgaggccgccgucgcccucauccaggccggccgcgcccaggacgcccucacccucugcgaggagcuccucucccgcaccuccucccuccuccccaagaugucccgccucugggaggacgcccgcaagggcaccaaggagcuccccuacugcccccucugggucuccgccacccaccuccuccagggccaggccuggguccagcucggcgcccagaaggucgccaucuccgaguucucccgcugccucgagcuccucuuccgcgccacccccgaggagaaggagcagggcgccgccuucaacugcgagcagggcugcaaguccgacgccgcccuccagcagcuccgcgccgccgcccucaucucccgcggccucgagugggucgccuccggccaggacaccaaggcccuccaggacuuccuccucuccguccagaugugccccggcaaccgcgacaccuacuuccaccuccuccagacccucaagcgccucgaccgccgcgacgaggccaccgcccucugguggcgccucgaggcccagaccaagggcucccacgaggacgcccucuggucccucccccucuaccucgaguccuaccucuccuggauccgccccuccgaccgcgacgccuuccucgaggaguuccgcaccucccuccccaaguccugcgaccucuga

SEQ ID NO: 43060 - RNA, 3987 nt, Artificial Sequence
  derived and/or modified sequence opt2 from FANCI__Homo_sapiens__NP_001106849
auggaccagaagauccucucccucgccgccgagaagaccgccgacaagcuccaggaguuccuccagacccuccgcgagggcgaccucaccaaccuccuccagaaccaggccgucaagggcaaggucgccggcgcccuccuccgcgccaucuucaagggcucccccugcuccgaggaggccggcacccuccgccgccgcaagaucuacaccugcugcauccagcucgucgaguccggcgaccuccagaaggagaucgccuccgagaucaucggccuccucaugcucgaggcccaccacuuccccggcccccuccucgucgagcucgccaacgaguucaucuccgccguccgcgagggcucccucgucaacggcaagucccucgagcuccuccccaucauccucaccgcccucgccaccaagaaggagaaccucgccuacggcaagggcguccucuccggcgaggagugcaagaagcagcucaucaacacccucugcuccggccgcugggaccagcaguacgucauccagcucaccuccauguucaaggacgucccccucaccgccgaggaggucgaguucgucgucgagaaggcccucuccauguucuccaagaugaaccuccaggagauccccccccucgucuaccagcuccucguccucuccuccaagggcucccgcaaguccguccucgagggcaucaucgccuucuucuccgcccucgacaagcagcacaacgaggagcaguccggcgacgagcuccucgacgucgucaccguccccuccggcgagcuccgccacgucgagggcaccaucauccuccacaucgucuucgccaucaagcucgacuacgagcucggccgcgagcucgucaagcaccucaaggucggccagcagggcgacuccaacaacaaccucucccccuucuccaucgcccuccuccucuccgucacccgcauccagcgcuuccaggaccagguccucgaccuccucaagaccuccgucgucaaguccuucaaggaccuccagcuccuccagggcuccaaguuccuccagaaccucgucccccaccgcuccuacgucuccaccaugauccucgaggucgucaagaacuccguccacuccugggaccacgucacccagggccucgucgagcucggcuucauccucauggacuccuacggccccaagaagguccucgacggcaagaccaucgagaccucccccucccucucccgcaugcccaaccagcacgccugcaagcucggcgccaacauccuccucgagaccuucaagauccacgagaugauccgccaggagauccucgagcagguccucaaccgcgucgucacccgcgccuccucccccaucucccacuuccucgaccuccucuccaacaucgucauguacgccccccucguccuccaguccugcuccuccaaggucaccgaggccuucgacuaccucuccuuccucccccuccagaccguccagcgccuccucaaggccguccagccccuccucaaggucuccauguccaugcgcgacugccucauccucguccuccgcaaggccauguucgccaaccagcucgacgcccgcaaguccgccgucgccggcuuccuccuccuccucaagaacuucaagguccucggcucccucuccuccucccagugcucccagucccucuccgucucccagguccacgucgacguccacucccacuacaacuccgucgccaacgagaccuucugccucgagaucauggacucccuccgccgcugccucucccagcaggccgacguccgccucaugcucuacgagggcuucuacgacguccuccgccgcaacucccagcucgccaacuccgucaugcagacccuccucucccagcucaagcaguucuacgagcccaagcccgaccuccuccccccccucaagcucgaggccugcauccucacccagggcgacaagaucucccuccaggagccccucgacuaccuccucugcugcauccagcacugccucgccugguacaagaacaccgucaucccccuccagcagggcgaggaggaggaggaggaggaggaggccuucuacgaggaccucgacgacauccucgaguccaucaccaaccgcaugaucaaguccgagcucgaggacuucgagcucgacaaguccgccgacuucucccaguccaccuccaucggcaucaagaacaacaucugcgccuuccucgucaugggcgucugcgagguccucaucgaguacaacuucuccaucuccuccuucuccaagaaccgcuucgaggacauccucucccucuucaugugcuacaagaagcucuccgacauccucaacgagaaggccggcaaggccaagaccaagauggccaacaagaccuccgacucccuccucuccaugaaguucgucuccucccuccucaccgcccucuuccgcgacuccauccagucccaccaggagucccucuccguccuccgcuccuccaacgaguucaugcgcuacgccgucaacgucgcccuccagaagguccagcagcucaaggagaccggccacgucuccggccccgacggccagaaccccgagaagaucuuccagaaccucugcgacaucacccgcguccuccucuggcgcuacaccuccauccccaccuccgucgaggaguccggcaagaaggagaagggcaaguccaucucccuccucugccucgagggccuccagaagaucuucuccgccguccagcaguucuaccagcccaagauccagcaguuccuccgcgcccucgacgucaccgacaaggagggcgaggagcgcgaggacgccgacgucuccgucacccagcgcaccgccuuccagauccgccaguuccagcgcucccuccucaaccuccucuccucccaggaggaggacuucaacuccaaggaggcccuccuccucgucaccguccucaccucccucuccaagcuccucgagcccuccuccccccaguucguccagaugcucuccuggaccuccaagaucugcaaggagaacucccgcgaggacgcccucuucugcaagucccucaugaaccuccucuucucccuccacgucuccuacaagucccccgucauccuccuccgcgaccucucccaggacauccacggccaccucggcgacaucgaccaggacgucgaggucgagaagaccaaccacuucgccaucgucaaccuccgcaccgccgcccccaccgucugccuccucguccucucccaggccgagaagguccucgaggaggucgacuggcucaucaccaagcucaagggccaggucucccaggagacccucuccgaggaggccuccucccaggccacccuccccaaccagcccgucgagaaggccaucaucaugcagcucggcacccuccucaccuucuuccacgagcucguccagaccgcccuccccuccggcuccugcgucgacacccuccucaaggaccucugcaagauguacaccacccucaccgcccucguccgcuacuaccuccaggucugccaguccuccggcggcauccccaagaacauggagaagcucgucaagcucuccggcucccaccucaccccccucugcuacuccuucaucuccuacguccagaacaaguccaagucccucaacuacaccggcgagaagaaggagaagcccgccgccgucgccaccgccauggcccgcguccuccgcgagaccaagcccauccccaaccucaucuucgccaucgagcaguacgagaaguuccucauccaccucuccaagaaguccaaggucaaccucaugcagcacaugaagcucuccaccucccgcgacuucaagaucaagggcaacauccucgacaugguccuccgcgaggacggcgaggacgagaacgaggagggcaccgccuccgagcacggcggccagaacaaggagcccgccaagaagaagcgcaagaaguga

SEQ ID NO: 43061 - RNA, 1143 nt, Artificial Sequence
  derived and/or modified sequence opt2 from FANCL__Homo_sapiens__NP_001108108
auggccgucaccgaggccucccuccuccgccagugcccccuccuccucccccagaaccgcuccaagaccgucuacgagggcuucaucuccgcccagggccgcgacuuccaccuccgcaucguccuccccgaggaccuccagcucaagaacgcccgccuccucugcuccuggcagcuccgcaccauccucuccggcuaccaccgcaucguccagcagcgcaugcagcacucccccgaccucauguccuucaugauggagcucaagaugcuccucgaggucgcccucaagaaccgccaggagcucuacgcccuccccccccccccccaguucuacuccucccucaucgaggagaucggcacccucggcugggacaagcucgucuacgccgacaccugcuucuccaccaucaagcucaaggccgaggacgccuccggccgcgagcaccucaucacccucaagcucaaggccaaguaccccgccgagucccccgacuacuucgucgacuuccccguccccuucugcgccuccuggaccccccaggucaacuccccccaguccucccucaucuccaucuacucccaguuccucgccgccaucgagucccucaaggccuucugggacgucauggacgagaucgacgagaagaccuggguccucgagcccgagaagcccccccgcuccgccaccgcccgccgcaucgcccucggcaacaacgucuccaucaacaucgaggucgacccccgccaccccaccaugcuccccgagugcuucuuccucggcgccgaccacgucgucaagccccucggcaucaagcucucccgcaacauccaccucugggaccccgagaacuccguccuccagaaccucaaggacguccucgagaucgacuuccccgcccgcgccauccucgagaaguccgacuucaccauggacugcggcaucugcuacgccuaccagcucgacggcaccauccccgaccaggucugcgacaacucccagugcggccagcccuuccaccagaucugccucuacgaguggcuccgcggccuccucaccucccgccaguccuucaacaucaucuucggcgagugccccuacugcuccaagcccaucacccucaagauguccggccgcaagcacuga

SEQ ID NO: 43062 - RNA, 6147 nt, Artificial Sequence
  derived and/or modified sequence opt2 from FANCM__Homo_sapiens__NP_065988
auguccggccgccagcgcacccucuuccagaccuggggcuccuccaucucccgcuccuccggcacccccggcugcuccuccggcaccgagcgcccccagucccccggcuccuccaaggccccccuccccgccgccgccgaggcccagcucgaguccgacgacgacguccuccucgucgccgccuacgaggccgagcgccagcucugccucgagaacggcggcuucugcaccuccgccggcgcccucuggaucuaccccaccaacugccccguccgcgacuaccagcuccacaucucccgcgccgcccucuucugcaacacccucgucugccuccccaccggccucggcaagaccuucaucgccgccgucgucauguacaacuucuaccgcugguuccccuccggcaaggucgucuucauggcccccaccaagccccucgucacccagcagaucgaggccugcuaccaggucaugggcaucccccagucccacauggccgagaugaccggcuccacccaggccuccacccgcaaggagaucuggugcuccaagcgcguccucuuccucaccccccaggucauggucaacgaccucucccgcggcgccugccccgccgccgagaucaagugccucgucaucgacgaggcccacaaggcccucggcaacuacgccuacugccaggucguccgcgagcucgucaaguacaccaaccacuuccgcauccucgcccucuccgccacccccggcuccgacaucaaggccguccagcaggucaucaccaaccuccucaucggccagaucgagcuccgcuccgaggacucccccgacauccucaccuacucccacgagcgcaaggucgagaagcucaucgucccccucggcgaggagcucgccgccauccagaagaccuacauccagauccucgaguccuucgcccgcucccucauccagcgcaacguccucaugcgccgcgacauccccaaccucaccaaguaccagaucauccucgcccgcgaccaguuccgcaagaaccccucccccaacaucgucggcauccagcagggcaucaucgagggcgaguucgccaucugcaucucccucuaccacggcuacgagcuccuccagcagaugggcaugcgcucccucuacuucuuccucugcggcaucauggacggcaccaagggcaugacccgcuccaagaacgagcucggccgcaacgaggacuucaugaagcucuacaaccaccucgagugcauguucgcccgcacccgcuccaccuccgccaacggcaucuccgccauccagcagggcgacaagaacaagaaguucgucuacucccaccccaagcucaagaagcucgaggaggucgucaucgagcacuucaaguccuggaacgccgagaacaccaccgagaagaagcgcgacgagacccgcgucaugaucuucuccuccuuccgcgacuccguccaggagaucgccgagaugcucucccagcaccagcccaucauccgcgucaugaccuucgucggccacgccuccggcaaguccaccaagggcuucacccagaaggagcagcucgaggucgucaagcaguuccgcgacggcggcuacaacacccucgucuccaccugcgucggcgaggagggccucgacaucggcgaggucgaccucaucaucugcuucgacucccagaagucccccauccgccucguccagcgcaugggccgcaccggccgcaagcgccagggccgcaucgucaucauccucuccgagggccgcgaggagcgcaucuacaaccagucccaguccaacaagcgcuccaucuacaaggccaucuccuccaaccgccagguccuccacuucuaccagcgcuccccccgcaugguccccgacggcaucaaccccaagcuccacaagauguucaucacccacggcgucuacgagcccgagaagcccucccgcaaccuccagcgcaaguccuccaucuucuccuaccgcgacggcaugcgccaguccucccucaagaaggacugguuccucuccgaggaggaguucaagcucuggaaccgccucuaccgccuccgcgacuccgacgagaucaaggagaucacccucccccagguccaguucuccucccuccagaacgaggagaacaagcccgcccaggaguccaccaccggcauccaccagcucucccucuccgaguggcgccucuggcaggaccacccccuccccacccaccaggucgaccacuccgaccgcugccgccacuucaucggccucaugcagaugaucgagggcaugcgccacgaggagggcgagugcuccuacgagcucgaggucgaguccuaccuccagauggaggacgucaccuccaccuucaucgccccccgcaacgaguccaacaaccucgccuccgacaccuucaucacccacaagaaguccuccuucaucaagaacaucaaccagggcuccuccuccuccgucaucgaguccgacgaggagugcgccgagaucgucaagcagacccacaucaagcccaccaagaucgucucccucaagaagaaggucuccaaggagaucaagaaggaccagcucaagaaggagaacaaccacggcaucaucgacuccgucgacaacgaccgcaacuccaccgucgagaacaucuuccaggaggaccuccccaacgacaagcgcaccuccgacaccgacgagaucgccgccaccugcaccaucaacgagaacgucaucaaggagcccugcguccuccucaccgagugccaguucaccaacaaguccaccuccucccucgccggcaacguccucgacuccggcuacaacuccuucaacgacgagaaguccgucuccuccaaccucuuccuccccuucgaggaggagcucuacaucguccgcaccgacgaccaguucuacaacugccacucccucaccaaggagguccucgccaacgucgagcgcuuccucuccuacuccccccccccccucuccggccucuccgaccucgaguacgagaucgccaagggcaccgcccucgagaaccuccucuuccuccccugcgccgagcaccuccgcuccgacaagugcaccugccuccucucccacuccgccgucaacucccagcagaaccucgagcucaacucccucaagugcaucaacuaccccuccgagaaguccugccucuacgacauccccaacgacaacaucuccgacgagcccucccucugcgacugcgacguccacaagcacaaccagaacgagaaccucguccccaacaaccgcguccagauccaccgcucccccgcccagaaccucgucggcgagaacaaccacgacgucgacaacuccgaccuccccguccucuccaccgaccaggacgagucccuccuccucuucgaggacgucaacaccgaguucgacgacgucucccucuccccccucaacuccaaguccgagucccuccccgucuccgacaagaccgccaucuccgagaccccccucgucucccaguuccucaucuccgacgagcuccuccucgacaacaacuccgagcuccaggaccagaucacccgcgacgccaacuccuucaagucccgcgaccagcgcggcguccaggaggagaaggucaagaaccacgaggacaucuucgacugcucccgcgaccucuucuccgucaccuucgaccucggcuucugcucccccgacuccgacgacgagauccucgagcacaccuccgacuccaaccgcccccucgacgaccucuacggccgcuaccucgagaucaaggagaucuccgacgccaacuacgucuccaaccaggcccucaucccccgcgaccacuccaagaacuucaccuccggcaccgucaucauccccuccaacgaggacaugcagaaccccaacuacguccaccucccccucuccgccgccaagaacgaggagcuccucucccccggcuacucccaguucucccuccccguccagaagaaggucauguccaccccccucuccaaguccaacacccucaacuccuucuccaagauccgcaaggagauccucaagacccccgacuccuccaaggagaaggucaaccuccagcgcuucaaggaggcccucaacuccaccuucgacuacuccgaguucucccucgagaaguccaaguccuccggccccauguaccuccacaaguccugccacuccgucgaggacggccagcuccucaccuccaacgaguccgaggacgacgagaucuuccgccgcaaggucaagcgcgccaagggcaacguccucaacucccccgaggaccagaagaacuccgaggucgacuccccccuccacgccgucaagaagcgccgcuuccccaucaaccgcuccgagcucuccuccuccgacgaguccgagaacuuccccaagcccugcucccagcucgaggacuucaaggucugcaacggcaacgcccgccgcggcaucaagguccccaagcgccagucccaccucaagcacgucgcccgcaaguuccucgacgacgaggccgagcucuccgaggaggacgccgaguacgucuccuccgacgagaacgacgaguccgagaacgagcaggacuccucccuccucgacuuccucaacgacgagacccagcucucccaggccaucaacgacuccgagaugcgcgccaucuacaugaagucccuccgcucccccaugaugaacaacaaguacaagaugauccacaagacccacaagaacaucaacaucuucucccagauccccgagcaggacgagaccuaccucgaggacuccuucugcgucgacgaggaggaguccugcaagggccaguccuccgaggaggaggucugcgucgacuucaaccucaucaccgacgacugcuucgccaacuccaagaaguacaagacccgccgcgccgucaugcucaaggagaugauggagcagaacugcgcccacuccaagaagaagcucucccgcaucauccuccccgacgacuccuccgaggaggagaacaacgucaacgacaagcgcgaguccaacaucgccgucaaccccuccaccgucaagaagaacaagcagcaggaccacugccucaacuccguccccuccggcuccuccgcccaguccaagguccgcuccaccccccgcgucaacccccucgccaagcaguccaagcagaccucccucaaccucaaggacaccaucuccgaggucuccgacuucaagccccagaaccacaacgagguccaguccaccaccccccccuucaccaccgucgacucccagaaggacugccgcaaguuccccgucccccagaaggacggcuccgcccucgaggacuccuccaccuccggcgccuccugcuccaagucccgcccccaccucgccggcacccacaccucccuccgccucccccaggagggcaagggcaccugcauccucgucggcggccacgagaucaccuccggccucgaggucaucuccucccuccgcgccauccacggccuccaggucgaggucugcccccucaacggcugcgacuacaucgucuccaaccgcauggucgucgagcgccgcucccaguccgagaugcucaacuccgucaacaagaacaaguucaucgagcagauccagcaccuccaguccauguucgagcgcaucugcgucaucgucgagaaggaccgcgagaagaccggcgacaccucccgcauguuccgccgcaccaaguccuacgacucccuccucaccacccucaucggcgccggcauccgcauccucuucuccuccugccaggaggagaccgccgaccuccucaaggagcucucccucgucgagcagcgcaagaacgucggcauccacguccccaccgucgucaacuccaacaaguccgaggcccuccaguucuaccucuccauccccaacaucuccuacaucaccgcccucaacaugugccaccaguucuccuccgucaagcgcauggccaacuccucccuccaggagaucuccauguacgcccaggucacccaccagaaggccgaggagaucuaccgcuacauccacuacgucuucgacauccagaugcuccccaacgaccucaaccaggaccgccucaaguccgacaucuga

SEQ ID NO: 43063 - RNA, 1038 nt, Artificial Sequence
  derived and/or modified sequence opt2 from FANK1__Homo_sapiens__NP_660278
auggagccccagaagaucaugccccccuccaagccccacccccccgucgucggcaaggucacccaccacuccaucgagcucuacugggaccucgagaagaaggccaagcgccagggcccccaggagcagugguuccgcuucuccaucgaggaggaggaccccaagaugcacaccuacggcaucaucuacaccggcuacgccaccaagcacgucgucgagggccucgagccccgcacccucuaccgcuuccgccucaaggucaccucccccuccggcgagugcgaguacuccccccucgucuccgucuccaccacccgcgagcccaucuccuccgagcaccuccaccgcgccgucuccgucaacgacgaggaccuccucguccgcauccuccagggcggccgcgucaaggucgacguccccaacaaguucggcuucaccgcccucauggucgccgcccagaagggcuacacccgccucgucaagauccucgucuccaacggcaccgacgucaaccucaagaacggcuccggcaaggacucccucaugcucgccugcuacgccggccaccucgacgucgucaaguaccuccgccgccacggcgccuccuggcaggcccgcgaccucggcggcugcaccgcccuccacugggccgccgacggcggccacugcuccgucaucgaguggaugaucaaggacggcugcgaggucgacgucgucgacaccggcuccggcuggaccccccucaugcgcgucuccgccgucuccggcaaccagcgcgucgccucccuccucaucgacgccggcgccaacgucaacgucaaggaccgcaacggcaagaccccccucauggucgccguccucaacaaccacgaggagcucguccagcuccuccucgacaagggcgccgacgccuccgucaagaacgaguucggcaagggcguccucgagauggcccgcgucuucgaccgccaguccgucgucucccuccucgaggagcgcaagaagaagcagcgccccaagaaguccugcgucugcuga

SEQ ID NO: 43064 - RNA, 2208 nt, Artificial Sequence
  derived and/or modified sequence opt2 from FAP__Homo_sapiens__NP_001278736
augaagaccugggucaagaucgucuucggcgucgccaccuccgccguccucgcccuccucgucaugugcaucguccuccgccccucccgcguccacaacuccgaggagaacaccaugcgcgcccucacccucaaggacauccucaacggcaccuucuccuacaagaccuucuuccccaacuggaucuccggccaggaguaccuccaccaguccgccgacaacaacaucguccucuacaacaucgagaccggccaguccuacaccauccucuccaaccgcaccaugcucuggcgcuacuccuacaccgccaccuacuacaucuacgaccucuccaacggcgaguucguccgcggcaacgagcucccccgccccauccaguaccucugcuggucccccgucggcuccaagcucgccuacgucuaccagaacaacaucuaccucaagcagcgccccggcgacccccccuuccagaucaccuucaacggccgcgagaacaagaucuucaacggcauccccgacugggucuacgaggaggagaugcucgccaccaaguacgcccucugguggucccccaacggcaaguuccucgccuacgccgaguucaacgacaccgacauccccgucaucgccuacuccuacuacggcgacgagcaguacccccgcaccaucaacauccccuaccccaaggccggcgccaagaaccccgucguccgcaucuucaucaucgacaccaccuaccccgccuacgucggcccccaggagguccccguccccgccaugaucgccuccuccgacuacuacuucuccuggcucaccugggucaccgacgagcgcgucugccuccaguggcucaagcgcguccagaacgucuccguccucuccaucugcgacuuccgcgaggacuggcagaccugggacugccccaagacccaggagcacaucgaggagucccgcaccggcugggccggcggcuucuucgucuccacccccgucuucuccuacgacgccaucuccuacuacaagaucuucuccgacaaggacggcuacaagcacauccacuacaucaaggacaccgucgagaacgccauccagaucaccuccggcaagugggaggccaucaacaucuuccgcgucacccaggacucccucuucuacuccuccaacgaguucgaggaguaccccggccgccgcaacaucuaccgcaucuccaucggcuccuacccccccuccaagaagugcgucaccugccaccuccgcaaggagcgcugccaguacuacaccgccuccuucuccgacuacgccaaguacuacgcccucgucugcuacggccccggcauccccaucuccacccuccacgacggccgcaccgaccaggagaucaagauccucgaggagaacaaggagcucgagaacgcccucaagaacauccagcuccccaaggaggagaucaagaagcucgaggucgacgagaucacccucugguacaagaugauccuccccccccaguucgaccgcuccaagaaguacccccuccucauccaggucuacggcggccccugcucccaguccguccgcuccgucuucgccgucaacuggaucuccuaccucgccuccaaggagggcauggucaucgcccucgucgacggccgcggcaccgccuuccagggcgacaagcuccucuacgccgucuaccgcaagcucggcgucuacgaggucgaggaccagaucaccgccguccgcaaguucaucgagaugggcuucaucgacgagaagcgcaucgccaucuggggcugguccuacggcggcuacgucuccucccucgcccucgccuccggcaccggccucuucaagugcggcaucgccgucgcccccgucuccuccugggaguacuacgccuccgucuacaccgagcgcuucaugggccuccccaccaaggacgacaaccucgagcacuacaagaacuccaccgucauggcccgcgccgaguacuuccgcaacgucgacuaccuccucauccacggcaccgccgacgacaacguccacuuccagaacuccgcccagaucgccaaggcccucgucaacgcccaggucgacuuccaggccaugugguacuccgaccagaaccacggccucuccggccucuccaccaaccaccucuacacccacaugacccacuuccucaagcagugcuucucccucuccgacuga

SEQ ID NO: 43065 - RNA, 1548 nt, Artificial Sequence
  derived and/or modified sequence opt2 from FAR1__Homo_sapiens__NP_115604
auggucuccauccccgaguacuacgagggcaagaacguccuccucaccggcgccaccggcuuccucggcaagguccuccucgagaagcuccuccgcuccugccccaaggucaacuccgucuacguccucguccgccagaaggccggccagaccccccaggagcgcgucgaggagguccucuccggcaagcucuucgaccgccuccgcgacgagaaccccgacuuccgcgagaagaucaucgccaucaacuccgagcucacccagcccaagcucgcccucuccgaggaggacaaggaggucaucaucgacuccaccaacaucaucuuccacugcgccgccaccguccgcuucaacgagaaccuccgcgacgccguccagcucaacgucaucgccacccgccagcucauccuccucgcccagcagaugaagaaccucgaggucuucaugcacgucuccaccgccuacgccuacugcaaccgcaagcacaucgacgaggucgucuaccccccccccgucgaccccaagaagcucaucgacucccucgaguggauggacgacggccucgucaacgacaucacccccaagcucaucggcgaccgccccaacaccuacaucuacaccaaggcccucgccgaguacgucguccagcaggagggcgccaagcucaacgucgccaucguccgccccuccaucgucggcgccuccuggaaggagcccuuccccggcuggaucgacaacuucaacggccccuccggccucuucaucgccgccggcaagggcauccuccgcaccauccgcgccuccaacaacgcccucgccgaccucguccccgucgacgucgucgucaacaugucccucgccgccgccugguacuccggcgucaaccgcccccgcaacaucauggucuacaacugcaccaccggcuccaccaaccccuuccacuggggcgaggucgaguaccacgucaucuccaccuucaagcgcaacccccucgagcaggccuuccgccgccccaacgucaaccucaccuccaaccaccuccucuaccacuacuggaucgccgucucccacaaggcccccgccuuccucuacgacaucuaccuccgcaugaccggccgcuccccccgcaugaugaagaccaucacccgccuccacaaggccauggucuuccucgaguacuucaccuccaacuccugggucuggaacaccgagaacgucaacaugcucaugaaccagcucaaccccgaggacaagaagaccuucaacaucgacguccgccagcuccacugggccgaguacaucgagaacuacugccucggcaccaagaaguacguccucaacgaggagauguccggccuccccgccgcccgcaagcaccucaacaagcuccgcaacauccgcuacggcuucaacaccauccucgucauccucaucuggcgcaucuucaucgcccgcucccagauggcccgcaacaucugguacuucgucgucucccucugcuacaaguuccucuccuacuuccgcgccuccuccaccaugcgcuacuga

SEQ ID NO: 43066 - RNA, 390 nt, Artificial Sequence
  derived and/or modified sequence opt2 from FARP1__Homo_sapiens__NP_001001715
augggcgagaucgagcagcgccccacccccggcucccgccucggcgcccccgagaacuccggcaucuccacccucgagcgcggccagaagcccccccccacccccuccggcaagcucgucuccaucaagauccagaugcucgacgacacccaggaggccuucgagguccccauggucuccuccuccuccuuccucaaggccaccggcuccuccuggaccggcuggguccuccgcugcuccaugaagcccaagcaccacucccaccucaucgagaaguucggcgaggaccgcauccucacccaccucaccggcuccaucuccuacaccaacugggccggcucccgcucccucgccgucaccgucaccgaggagcuccucaaccucuucuga

SEQ ID NO: 43067 - RNA, 1944 nt, Artificial Sequence
  derived and/or modified sequence opt2 from FARP2__Homo_sapiens__NP_001269912
augggcgagaucgagggcaccuaccgcguccuccagaccgccggcaugcgccucggcgcccagacccccgucggcgucuccacccucgagcccggccagacccuccucccccgcaugcaggagaagcaccuccaccuccgcgucaagcuccucgacaacaccauggagaucuucgacaucgagcccaagugcgacggccagguccuccucacccaggucuggaagcgccucaaccucgucgagugcgacuacuucggcauggaguuccagaacacccaguccuacuggaucuggcucgagcccaugaagcccaucauccgccagauccgccgccccaagaacgucguccuccgccucgccgucaaguucuucccccccgaccccggccagcuccaggaggaguacacccgcuaccucuucgcccuccagcucaagcgcgaccuccucgaggagcgccucaccugcgccgacaccaccgccgcccuccucaccucccaccuccuccaguccgagaucggcgacuacgacgagacccucgaccgcgagcaccucaaggucaacgaguaccuccccggccagcagcacugccucgagaagauccucgaguuccaccagaagcacgucggccagacccccgccgaguccgacuuccagguccucgagaucgcccgcaagcucgagauguacggcauccgcuuccacauggccuccgaccgcgagggcaccaagauccagcucgccgucucccacaugggcguccucgucuuccagggcaccaccaagaucaacaccuucaacugguccaagguccgcaagcucuccuucaagcgcaagcgcuuccucaucaagcuccaccccgagguccacggccccuaccaggacacccucgaguuccuccucggcucccgcgacgagugcaagaacuucuggaagaucugcgucgaguaccacaccuucuuccgccuccucgaccagcccaagcccaaggccaaggccgucuucuucucccgcggcuccuccuuccgcuacuccggccgcacccagaagcagcucgucgacuacuucaaggacuccggcaugaagcgcauccccuacgagcgccgccacuccaagacccacaccuccguccgcgcccucaccgccgaccuccccaagcaguccaucuccuuccccgagggccuccgcacccccgccucccccuccuccgccaacgccuucuacucccucucccccuccacccucguccccuccggccuccccgaguucaaggacuccuccuccucccucaccgacccccaggucuccuacgucaagucccccgccgccgagcgccgcuccggcgccgucgccggcggccccgacacccccuccgcccagccccucggcccccccgcccuccagcccggccccggccucuccaccaaguccccccagcccucccccuccucccgcaaguccccccucucccucucccccgccuuccaggucccccucggccccgccgagcagggcuccuccccccuccucucccccguccucuccgacgccggcggcgccggcauggacugcgaggagccccgccacaagcgcguccccgccgacgaggccuacuucaucgucaaggagauccucgccaccgagcgcaccuaccucaaggaccucgaggucaucaccgucugguuccgcuccgccgucgucaaggaggacgccaugcccgccacccucaugacccuccucuucuccaacaucgaccccaucuacgaguuccaccgcggcuuccuccgcgaggucgagcagcgccucgcccucugggagggccccuccaaggcccacaccaagggcucccaccagcgcaucggcgacauccuccuccgcaacaugcgccagcucaaggucuuccagcuccacgagggccacgucgccggcgucaccaagauggaguga

SEQ ID NO: 43068 - RNA, 1356 nt, Artificial Sequence
  derived and/or modified sequence opt2 from FARS2__Homo_sapiens__NP_001305801
auggucggcuccgcccuccgccgcggcgcccacgccuacgucuaccucgucuccaaggccucccacaucucccgcggccaccagcaccaggccuggggcucccgcccccccgccgccgagugcgccacccagcgcgcccccggcuccgucgucgagcuccucggcaaguccuacccccaggacgaccacuccaaccucacccgcaagguccucacccgcgucggccgcaaccuccacaaccagcagcaccacccccucuggcucaucaaggagcgcgucaaggagcacuucuacaagcaguacgucggccgcuucggcaccccccucuucuccgucuacgacaaccucucccccgucgucaccaccuggcagaacuucgacucccuccucauccccgccgaccaccccucccgcaagaagggcgacaacuacuaccucaaccgcacccacaugcuccgcgcccacaccuccgcccaccagugggaccuccuccacgccggccucgacgccuuccucgucgucggcgacgucuaccgccgcgaccagaucgacucccagcacuaccccaucuuccaccagcucgaggccguccgccucuucuccaagcacgagcucuucgccggcaucaaggacggcgagucccuccagcucuucgagcaguccucccgcuccgcccacaagcaggagacccacaccauggaggccgucaagcucgucgaguucgaccucaagcagacccucacccgccucauggcccaccucuucggcgacgagcucgagauccgcugggucgacugcuacuuccccuucacccaccccuccuucgagauggagaucaacuuccacggcgaguggcucgagguccucggcugcggcgucauggagcagcagcucgucaacuccgccggcgcccaggaccgcaucggcugggccuucggccucggccucgagcgccucgccaugauccucuacgacauccccgacauccgccucuucuggugcgaggacgagcgcuuccucaagcaguucugcgucuccaacaucaaccagaaggucaaguuccagccccucuccaaguaccccgccgucaucaacgacaucuccuucuggcuccccuccgagaacuacgccgagaacgacuucuacgaccucguccgcaccaucggcggcgaccucgucgagaaggucgaccucaucgacaaguucguccaccccaagacccacaagaccucccacugcuaccgcaucaccuaccgccacauggagcgcacccucucccagcgcgagguccgccacauccaccaggcccuccaggaggccgccguccagcuccucggcgucgagggccgcuucuga

SEQ ID NO: 43069 - RNA, 1527 nt, Artificial Sequence
  derived and/or modified sequence opt2 from FARSA__Homo_sapiens__NP_004452
auggccgacggccaggucgccgagcuccuccuccgccgccucgaggccuccgacggcggccucgacuccgccgagcucgccgccgagcucggcauggagcaccaggccgucgucggcgccgucaagucccuccaggcccucggcgaggucaucgaggccgagcuccgcuccaccaagcacugggagcucaccgccgagggcgaggagaucgcccgcgagggcucccacgaggcccgcgucuuccgcuccaucccccccgagggccucgcccaguccgagcucaugcgccuccccuccggcaaggucggcuucuccaaggccauguccaacaaguggauccgcgucgacaaguccgccgccgacggcccccgcgucuuccgcgucgucgacuccauggaggacgagguccagcgccgccuccagcucguccgcggcggccaggccgagaagcucggcgagaaggagcgcuccgagcuccgcaagcgcaagcuccucgccgaggucacccucaagaccuacugggucuccaagggcuccgccuucuccaccuccaucuccaagcaggagaccgagcucucccccgagaugaucuccuccggcuccuggcgcgaccgccccuucaagcccuacaacuuccucgcccacggcguccuccccgacuccggccaccuccacccccuccucaagguccgcucccaguuccgccagaucuuccucgagaugggcuucaccgagaugcccaccgacaacuucaucgaguccuccuucuggaacuucgacgcccucuuccagccccagcagcaccccgcccgcgaccagcacgacaccuucuuccuccgcgaccccgccgaggcccuccagcuccccauggacuacguccagcgcgucaagcgcacccacucccagggcggcuacggcucccagggcuacaaguacaacuggaagcucgacgaggcccgcaagaaccuccuccgcacccacaccaccuccgccuccgcccgcgcccucuaccgccucgcccagaagaagcccuucacccccgucaaguacuucuccaucgaccgcgucuuccgcaacgagacccucgacgccacccaccucgccgaguuccaccagaucgagggcgucgucgccgaccacggccucacccucggccaccucaugggcguccuccgcgaguucuucaccaagcucggcaucacccagcuccgcuucaagcccgccuacaaccccuacaccgagcccuccauggaggucuucuccuaccaccagggccucaagaagugggucgaggucggcaacuccggcgucuuccgccccgagaugcuccuccccaugggccuccccgagaacgucuccgucaucgccuggggccucucccucgagcgccccaccaugaucaaguacggcaucaacaacauccgcgagcucgucggccacaaggucaaccuccagauggucuacgacuccccccucugccgccucgacgccgagccccgccccccccccacccaggaggccgccuga

SEQ ID NO: 43070 - RNA, 1008 nt, Artificial Sequence
  derived and/or modified sequence opt2 from FAS__Homo_sapiens__NP_000034
augcucggcaucuggacccuccucccccucguccucaccuccgucgcccgccucuccuccaaguccgucaacgcccaggucaccgacaucaacuccaagggccucgagcuccgcaagaccgucaccaccgucgagacccagaaccucgagggccuccaccacgacggccaguucugccacaagcccugcccccccggcgagcgcaaggcccgcgacugcaccgucaacggcgacgagcccgacugcguccccugccaggagggcaaggaguacaccgacaaggcccacuucuccuccaagugccgccgcugccgccucugcgacgagggccacggccucgaggucgagaucaacugcacccgcacccagaacaccaagugccgcugcaagcccaacuucuucugcaacuccaccgucugcgagcacugcgaccccugcaccaagugcgagcacggcaucaucaaggagugcacccucaccuccaacaccaagugcaaggaggagggcucccgcuccaaccucggcuggcucugccuccuccuccuccccaucccccucaucgucugggucaagcgcaaggagguccagaagaccugccgcaagcaccgcaaggagaaccagggcucccacgagucccccacccucaaccccgagaccgucgccaucaaccucuccgacgucgaccucuccaaguacaucaccaccaucgccggcgucaugacccucucccaggucaagggcuucguccgcaagaacggcgucaacgaggccaagaucgacgagaucaagaacgacaacguccaggacaccgccgagcagaagguccagcuccuccgcaacuggcaccagcuccacggcaagaaggaggccuacgacacccucaucaaggaccucaagaaggccaaccucugcacccucgccgagaagauccagaccaucauccucaaggacaucaccuccgacuccgagaacuccaacuuccgcaacgagauccagucccucgucuga

SEQ ID NO: 43071 - RNA, 846 nt, Artificial Sequence
  derived and/or modified sequence opt2 from FASLG__Homo_sapiens__NP_000630
augcagcagcccuucaacuaccccuacccccagaucuacugggucgacuccuccgccuccucccccugggccccccccggcaccguccuccccugccccaccuccgucccccgccgccccggccagcgccgcccccccccccccccccccccccccccccuccccccccccccccccccccccccccuccccccccucccccuccccccccucaagaagcgcggcaaccacuccaccggccucugccuccucgucauguucuucaugguccucgucgcccucgucggccucggccucggcauguuccagcucuuccaccuccagaaggagcucgccgagcuccgcgaguccaccucccagaugcacaccgccuccucccucgagaagcagaucggccaccccucccccccccccgagaagaaggagcuccgcaaggucgcccaccucaccggcaaguccaacucccgcuccaugccccucgagugggaggacaccuacggcaucguccuccucuccggcgucaaguacaagaagggcggccucgucaucaacgagaccggccucuacuucgucuacuccaaggucuacuuccgcggccaguccugcaacaaccucccccucucccacaaggucuacaugcgcaacuccaaguacccccaggaccucgucaugauggagggcaagaugauguccuacugcaccaccggccagaugugggcccgcuccuccuaccucggcgccgucuucaaccucaccuccgccgaccaccucuacgucaacgucuccgagcucucccucgucaacuucgaggagucccagaccuucuucggccucuacaagcucuga

SEQ ID NO: 43072 - RNA, 7536 nt, Artificial Sequence
  derived and/or modified sequence opt2 from FASN__Homo_sapiens__NP_004095
auggaggaggucgucaucgccggcauguccggcaagcuccccgaguccgagaaccuccaggaguucugggacaaccucaucggcggcgucgacauggucaccgacgacgaccgccgcuggaaggccggccucuacggccucccccgccgcuccggcaagcucaaggaccucucccgcuucgacgccuccuucuucggcguccaccccaagcaggcccacaccauggacccccagcuccgccuccuccucgaggucaccuacgaggccaucgucgacggcggcaucaaccccgacucccuccgcggcacccacaccggcgucugggucggcgucuccggcuccgagaccuccgaggcccucucccgcgaccccgagacccucgucggcuacuccauggucggcugccagcgcgccaugauggccaaccgccucuccuucuucuucgacuuccgcggccccuccaucgcccucgacaccgccugcuccuccucccucauggcccuccagaacgccuaccaggccauccacuccggccagugccccgccgccaucgucggcggcaucaacguccuccucaagcccaacaccuccguccaguuccuccgccucggcaugcucucccccgagggcaccugcaaggccuucgacaccgccggcaacggcuacugccgcuccgagggcgucgucgccguccuccucaccaagaagucccucgcccgccgcgucuacgccaccauccucaacgccggcaccaacaccgacggcuucaaggagcagggcgucaccuuccccuccggcgacauccaggagcagcucauccgcucccucuaccaguccgccggcgucgcccccgaguccuucgaguacaucgaggcccacggcaccggcaccaaggucggcgacccccaggagcucaacggcaucacccgcgcccucugcgccacccgccaggagccccuccucaucggcuccaccaaguccaacaugggccaccccgagcccgccuccggccucgccgcccucgccaagguccuccucucccucgagcacggccucugggcccccaaccuccacuuccacucccccaaccccgagauccccgcccuccucgacggccgccuccaggucgucgaccagccccuccccguccgcggcggcaacgucggcaucaacuccuucggcuucggcggcuccaacguccacaucauccuccgccccaacacccagcccccccccgcccccgccccccacgccacccucccccgccuccuccgcgccuccggccgcacccccgaggccguccagaagcuccucgagcagggccuccgccacucccaggaccucgccuuccucuccaugcucaacgacaucgccgccguccccgccaccgccaugcccuuccgcggcuacgccguccucggcggcgagcgcggcggccccgagguccagcagguccccgccggcgagcgcccccucugguucaucugcuccggcaugggcacccaguggcgcggcaugggccucucccucaugcgccucgaccgcuuccgcgacuccauccuccgcuccgacgaggccgucaagcccuucggccucaaggucucccagcuccuccucuccaccgacgaguccaccuucgacgacaucguccacuccuucgucucccucaccgccauccagaucggccucaucgaccuccucuccugcaugggccuccgccccgacggcaucgucggccacucccucggcgaggucgccugcggcuacgccgacggcugccucucccaggaggaggccguccucgccgccuacuggcgcggccagugcaucaaggaggcccaccucccccccggcgccauggccgccgucggccucuccugggaggagugcaagcagcgcugcccccccggcgucguccccgccugccacaacuccaaggacaccgucaccaucuccggcccccaggcccccgucuucgaguucgucgagcagcuccgcaaggagggcgucuucgccaaggagguccgcaccggcggcauggccuuccacuccuacuucauggaggccaucgcccccccccuccuccaggagcucaagaaggucauccgcgagcccaagccccgcuccgcccgcuggcucuccaccuccauccccgaggcccaguggcacuccucccucgcccgcaccuccuccgccgaguacaacgucaacaaccucgucucccccguccucuuccaggaggcccucuggcacguccccgagcacgccgucguccucgagaucgccccccacgcccuccuccaggccguccucaagcgcggccucaagcccuccugcaccaucaucccccucaugaagaaggaccaccgcgacaaccucgaguucuuccucgccggcaucggccgccuccaccucuccggcaucgacgccaaccccaacgcccucuucccccccgucgaguuccccgccccccgcggcaccccccucaucuccccccucaucaagugggaccacucccucgccugggacguccccgccgccgaggacuuccccaacggcuccggcucccccuccgccgccaucuacaacaucgacaccuccuccgagucccccgaccacuaccucgucgaccacacccucgacggccgcguccucuuccccgccaccggcuaccucuccaucgucuggaagacccucgcccgcgcccucggccucggcgucgagcagcuccccgucgucuucgaggacgucguccuccaccaggccaccauccuccccaagaccggcaccgucucccucgagguccgccuccucgaggccucccgcgccuucgaggucuccgagaacggcaaccucgucgucuccggcaaggucuaccagugggacgaccccgacccccgccucuucgaccaccccgagucccccacccccaaccccaccgagccccucuuccucgcccaggccgaggucuacaaggagcuccgccuccgcggcuacgacuacggcccccacuuccagggcauccucgaggccucccucgagggcgacuccggccgccuccucuggaaggacaacugggucuccuucauggacaccaugcuccagauguccauccucggcuccgccaagcacggccucuaccuccccacccgcgucaccgccauccacaucgaccccgccacccaccgccagaagcucuacacccuccaggacaaggcccaggucgccgacgucgucgucucccgcuggcuccgcgucaccgucgccggcggcguccacaucuccggccuccacaccgaguccgccccccgccgccagcaggagcagcagguccccauccucgagaaguucugcuucaccccccacaccgaggagggcugccucuccgagcgcgccgcccuccaggaggagcuccagcucugcaagggccucguccaggcccuccagaccaaggucacccagcagggccucaagauggucguccccggccucgacggcgcccagaucccccgcgaccccucccagcaggagcucccccgccuccucuccgccgccugccgccuccagcucaacggcaaccuccagcucgagcucgcccagguccucgcccaggagcgccccaagcuccccgaggacccccuccucuccggccuccucgacucccccgcccucaaggccugccucgacaccgccgucgagaacaugcccucccucaagaugaaggucgucgagguccucgccggccacggccaccucuacucccgcauccccggccuccucuccccccacccccuccuccagcucuccuacaccgccaccgaccgccacccccaggcccucgaggccgcccaggccgagcuccagcagcacgacgucgcccagggccagugggaccccgccgaccccgcccccuccgcccucggcuccgccgaccuccucgucugcaacugcgccgucgccgcccucggcgaccccgccuccgcccucuccaacauggucgccgcccuccgcgagggcggcuuccuccuccuccacacccuccuccgcggccacccccucggcgacaucgucgccuuccucaccuccaccgagccccaguacggccagggcauccucucccaggacgccugggagucccucuucucccgcgucucccuccgccucgucggccucaagaaguccuucuacggcuccacccucuuccucugccgccgccccaccccccaggacucccccaucuuccuccccgucgacgacaccuccuuccgcugggucgagucccucaagggcauccucgccgacgaggacuccucccgccccgucuggcucaaggccaucaacugcgccaccuccggcgucgucggccucgucaacugccuccgccgcgagcccggcggcaaccgccuccgcugcguccuccucuccaaccucuccuccaccucccacguccccgaggucgaccccggcuccgccgagcuccagaagguccuccagggcgaccucgucaugaacgucuaccgcgacggcgccuggggcgccuuccgccacuuccuccucgaggaggacaagcccgaggagcccaccgcccacgccuucgucuccacccucacccgcggcgaccucuccuccauccgcugggucugcuccucccuccgccacgcccagcccaccugccccggcgcccagcucugcaccgucuacuacgccucccucaacuuccgcgacaucaugcucgccaccggcaagcucucccccgacgccauccccggcaaguggaccucccaggacucccuccucggcauggaguucuccggccgcgacgccuccggcaagcgcgucaugggccucguccccgccaagggccucgccaccuccguccuccucucccccgacuuccucugggacguccccuccaacuggacccucgaggaggccgccuccguccccgucgucuacuccaccgccuacuacgcccucgucguccgcggccgcguccgccccggcgagacccuccucauccacuccggcuccggcggcgucggccaggccgccaucgccaucgcccucucccucggcugccgcgucuucaccaccgucggcuccgccgagaagcgcgccuaccuccaggcccgcuucccccagcucgacuccaccuccuucgccaacucccgcgacaccuccuucgagcagcacguccucuggcacaccggcggcaagggcgucgaccucguccucaacucccucgccgaggagaagcuccaggccuccguccgcugccucgccacccacggccgcuuccucgagaucggcaaguucgaccucucccagaaccacccccucggcauggccaucuuccucaagaacgucaccuuccacggcguccuccucgacgccuucuucaacgaguccuccgccgacuggcgcgaggucugggcccucguccaggccggcauccgcgacggcgucguccgcccccucaagugcaccgucuuccacggcgcccaggucgaggacgccuuccgcuacauggcccagggcaagcacaucggcaaggucgucguccagguccucgccgaggagcccgaggccguccucaagggcgccaagcccaagcucauguccgccaucuccaagaccuucugccccgcccacaaguccuacaucaucgccggcggccucggcggcuucggccucgagcucgcccaguggcucauccagcgcggcguccagaagcucguccucaccucccgcuccggcauccgcaccggcuaccaggccaagcagguccgccgcuggcgccgccagggcguccagguccaggucuccaccuccaacaucuccucccucgagggcgcccgcggccucaucgccgaggccgcccagcucggccccgucggcggcgucuucaaccucgccgucguccuccgcgacggccuccucgagaaccagacccccgaguucuuccaggacgucugcaagcccaaguacuccggcacccucaaccucgaccgcgucacccgcgaggccugccccgagcucgacuacuucgucgucuucuccuccgucuccugcggccgcggcaacgccggccaguccaacuacggcuucgccaacuccgccauggagcgcaucugcgagaagcgccgccacgagggccuccccggccucgccguccaguggggcgccaucggcgacgucggcauccucgucgagaccauguccaccaacgacaccaucgucuccggcacccucccccagcgcauggccuccugccucgagguccucgaccucuuccucaaccagccccacaugguccucuccuccuucguccucgccgagaaggccgccgccuaccgcgaccgcgacucccagcgcgaccucgucgaggccgucgcccacauccucggcauccgcgaccucgccgccgucaaccucgacuccucccucgccgaccucggccucgacucccucauguccgucgagguccgccagacccucgagcgcgagcucaaccucguccucuccguccgcgagguccgccagcucacccuccgcaagcuccaggagcucuccuccaaggccgacgaggccuccgagcucgccugccccacccccaaggaggacggccucgcccagcagcagacccagcucaaccuccgcucccuccucgucaaccccgagggccccacccucaugcgccucaacuccguccaguccuccgagcgcccccucuuccucguccaccccaucgagggcuccaccaccgucuuccacucccucgccucccgccucuccauccccaccuacggccuccagugcacccgcgccgccccccucgacuccauccacucccucgccgccuacuacaucgacugcauccgccagguccagcccgagggccccuaccgcgucgccggcuacuccuacggcgccugcgucgccuucgagaugugcucccagcuccaggcccagcagucccccgcccccacccacaacucccucuuccucuucgacggcucccccaccuacguccucgccuacacccaguccuaccgcgccaagcucacccccggcugcgaggccgaggccgagaccgaggccaucugcuucuucguccagcaguucaccgacauggagcacaaccgcguccucgaggcccuccucccccucaagggccucgaggagcgcgucgccgccgccgucgaccucaucaucaagucccaccagggccucgaccgccaggagcucuccuucgccgcccgcuccuucuacuacaagcuccgcgccgccgagcaguacacccccaaggccaaguaccacggcaacgucaugcuccuccgcgccaagaccggcggcgccuacggcgaggaccucggcgccgacuacaaccucucccaggucugcgacggcaaggucuccguccacgucaucgagggcgaccaccgcacccuccucgagggcuccggccucgaguccaucaucuccaucauccacuccucccucgccgagccccgcgucuccguccgcgagggcuga

SEQ ID NO: 43073 - RNA, 2133 nt, Artificial Sequence
  derived and/or modified sequence opt2 from FASTKD2__Homo_sapiens__NP_055744
augcucaccacccucaagcccuucggcuccgucuccgucgaguccaagaugaacaacaaggccggcuccuucuucuggaaccuccgccaguucuccacccucgucuccaccucccgcaccaugcgccucugcugccucggccucugcaagcccaagaucguccacuccaacuggaacauccucaacaacuuccacaaccgcaugcaguccaccgacaucauccgcuaccucuuccaggacgccuucaucuucaaguccgacgucggcuuccagaccaagggcaucuccacccucaccgcccuccgcaucgagcgccuccucuacgccaagcgccucuucuucgacuccaagcagucccucguccccgucgacaaguccgacgacgagcucaagaaggucaaccucaaccacgaggucuccaacgaggacguccucaccaaggagaccaagcccaaccgcaucuccucccgcaagcucuccgaggagugcaacucccucuccgacguccucgacgccuucuccaaggcccccaccuuccccuccuccaacuacuucaccgccauguggaccaucgccaagcgccucuccgacgaccagaagcgcuucgagaagcgccucauguucucccaccccgccuucaaccagcucugcgagcacaugaugcgcgaggccaagaucaugcaguacaaguaccuccucuucucccuccacgccaucgucaagcucggcaucccccagaacaccauccucguccagacccuccuccgcgucacccaggagcgcaucaacgagugcgacgagaucugccucuccguccucuccaccguccucgaggccauggagcccugcaagaacguccacguccuccgcaccggcuuccgcauccucgucgaccagcaggucuggaagaucgaggacgucuucacccuccaggucgucaugaagugcaucggcaaggacgcccccaucgcccucaagcgcaagcucgagaugaaggcccuccgcgagcucgaccgcuucuccguccucaacucccagcacauguucgagguccucgccgccaugaaccaccgcucccucauccuccucgacgagugcuccaaggucguccucgacaacauccacggcugcccccuccgcaucaugaucaacauccuccaguccugcaaggaccuccaguaccacaaccucgaccucuucaagggccucgccgacuacgucgccgccaccuucgacaucuggaaguuccgcaagguccucuucauccucauccucuucgagaaccucggcuuccgccccgucggccucauggaccucuucaugaagcgcaucgucgaggaccccgagucccucaacaugaagaacauccucuccauccuccacaccuacuccucccucaaccacgucuacaagugccagaacaaggagcaguucgucgaggucauggccuccgcccucaccggcuaccuccacaccaucuccuccgagaaccuccucgacgccgucuacuccuucugccucaugaacuacuucccccucgcccccuucaaccagcuccuccagaaggacaucaucuccgagcuccucaccuccgacgacaugaagaacgccuacaagcuccacacccucgacaccugccucaagcucgacgacaccgucuaccuccgcgacaucgcccucucccucccccagcucccccgcgagcuccccuccucccacaccaacgccaaggucgccgagguccucuccucccuccucggcggcgagggccacuucuccaaggacguccaccucccccacaacuaccacaucgacuucgagauccgcauggacaccaaccgcaaccagguccucccccucuccgacgucgacaccaccuccgccaccgacauccagcgcgucgccguccucugcgucucccgcuccgccuacugccucggcuccucccacccccgcggcuuccucgccaugaagaugcgccaccucaacgccaugggcuuccacgucauccucgucaacaacugggagauggacaagcucgagauggaggacgccgucaccuuccucaagaccaagaucuacuccgucgaggcccuccccgucgccgccgucaacguccaguccacccaguga

SEQ ID NO: 43074 - RNA, 1569 nt, Artificial Sequence
  derived and/or modified sequence opt2 from FASTK__Homo_sapiens__NP_001245390
augcgccgcccccgcggcgagcccggcccccgcgccccccgccccaccgagggcgccaccugcgccggccccggcgaguccuggucccccucccccaacuccaugcuccgcguccuccucuccgcccagaccucccccgcccgccucuccggccuccuccucaucccccccguccagcccugcugccucggccccuccaaguggggcgaccgccccgucggcggcggccccuccgccggccccguccagggccuccagcgccuccucgagcaggccaagucccccggcgagcuccuccgcuggcucggccagaaccccuccaagguccgcgcccaccacuacuccgucgcccuccgccgccucggccagcuccucggcucccgcccccgccccccccccgucgagcaggucacccuccaggaccucucccagcucaucauccgcaacugccccuccuucgacauccacaccauccacgucugccuccaccucgccguccuccucggcuuccccuccgacggcccccucgucugcgcccucgagcaggagcgccgccuccgccucccccccaagcccccccccccccuccagccccuccuccgcgaggcccgccccgaggagcucaccccccacgucaugguccuccucgcccagcaccucgcccgccaccgccuccgcgagccccagcuccucgaggccaucgcccacuuccucgucguccaggagacccagcucuccuccaaggucguccagaagcucguccuccccuucggccgccucaacuaccucccccucgagcagcaguucaugcccugccucgagcgcauccucgcccgcgaggccggcgucgccccccucgccaccgucaacauccucaugucccucugccagcuccgcugccuccccuuccgcgcccuccacuucgucuucucccccggcuucaucaacuacaucuccggcaccccccacgcccucaucguccgccgcuaccucucccuccucgacaccgccgucgagcucgagcuccccggcuaccgcggcccccgccucccccgccgccagcagguccccaucuucccccagccccucaucaccgaccgcgcccgcugcaaguacucccacaaggacaucgucgccgagggccuccgccagcuccucggcgaggagaaguaccgccaggaccucaccgucccccccggcuacugcaccgacuuccuccucugcgccuccuccuccggcgccguccuccccguccgcacccaggaccccuuccuccccuaccccccccgcuccugcccccagggccaggccgccuccuccgccaccacccgcgaccccgcccagcgcgucguccucguccuccgcgagcgcuggcacuucugccgcgacggccgcguccuccucggcucccgcgcccuccgcgagcgccaccucggccucaugggcuaccagcuccucccccuccccuucgaggagcucgagucccagcgcggccucccccagcucaaguccuaccuccgccagaagcuccaggcccucggccuccgcuggggccccgagggcggcuga

SEQ ID NO: 43075 - RNA, 13767 nt, Artificial Sequence
  derived and/or modified sequence opt2 from FAT1__Homo_sapiens__XP_006714202
augggccgccaccucgcccuccuccuccuccuccuccuccucuuccagcacuucggcgacuccgacggcucccagcgccucgagcagaccccccuccaguucacccaccucgaguacaacgucaccguccaggagaacuccgccgccaagaccuacgucggccaccccgucaagaugggcgucuacaucacccaccccgccugggagguccgcuacaagaucgucuccggcgacuccgagaaccucuucaaggccgaggaguacauccucggcgacuucugcuuccuccgcauccgcaccaagggcggcaacaccgccauccucaaccgcgaggucaaggaccacuacacccucaucgucaaggcccucgagaagaacaccaacgucgaggcccgcaccaagguccgcguccagguccucgacaccaacgaccuccgcccccucuucucccccaccuccuacuccgucucccuccccgagaacaccgccauccgcaccuccaucgcccgcgucuccgccaccgacgccgacaucggcaccaacggcgaguucuacuacuccuucaaggaccgcaccgacauguucgccauccaccccaccuccggcgucaucguccucaccggccgccucgacuaccucgagaccaagcucuacgagauggagauccucgccgccgaccgcggcaugaagcucuacggcuccuccggcaucuccuccauggccaagcucaccguccacaucgagcaggccaacgagugcgcccccgucaucaccgccgucacccucucccccuccgagcucgaccgcgaccccgccuacgccaucgucaccgucgacgacugcgaccagggcgccaacggcgacaucgccucccucuccaucgucgccggcgaccuccuccagcaguuccgcaccguccgcuccuuccccggcuccaaggaguacaaggucaaggccaucggcggcaucgacugggacucccaccccuucggcuacaaccucacccuccaggccaaggacaagggcacccccccccaguucuccuccgucaaggucauccacgucaccuccccccaguucaaggccggccccgucaaguucgagaaggacgucuaccgcgccgagaucuccgaguucgccccccccaacacccccgucgucauggucaaggccauccccgccuacucccaccuccgcuacgucuucaaguccacccccggcaaggccaaguucucccucaacuacaacaccggccucaucuccauccucgagcccgucaagcgccagcaggccgcccacuucgagcucgaggucaccaccuccgaccgcaaggccuccaccaagguccucgucaagguccucggcgccaacuccaacccccccgaguucacccagaccgccuacaaggccgccuucgacgagaacguccccaucggcaccaccgucaugucccucuccgccgucgaccccgacgagggcgagaacggcuacgucaccuacuccaucgccaaccucaaccacguccccuucgccaucgaccacuucaccggcgccgucuccaccuccgagaaccucgacuacgagcucaugccccgcgucuacacccuccgcauccgcgccuccgacuggggccuccccuaccgccgcgaggucgagguccucgccaccaucacccucaacaaccucaacgacaacaccccccucuucgagaagaucaacugcgagggcaccaucccccgcgaccucggcgucggcgagcagaucaccaccgucuccgccaucgacgccgacgagcuccagcucguccaguaccagaucgaggccggcaacgagcucgacuucuucucccucaaccccaacuccggcguccucucccucaagcgcucccucauggacggccucggcgccaaggucuccuuccacucccuccgcaucaccgccaccgacggcgagaacuucgccaccccccucuacaucaacaucaccgucgccgccucccacaagcucgucaaccuccagugcgaggagaccggcgucgccaagaugcucgccgagaagcuccuccaggccaacaagcuccacaaccagggcgaggucgaggacaucuucuucgacucccacuccgucaacgcccacaucccccaguuccgcuccacccuccccaccggcauccaggucaaggagaaccagcccgucggcuccuccgucaucuucaugaacuccaccgaccucgacaccggcuucaacggcaagcucgucuacgccgucuccggcggcaacgaggacuccugcuucaugaucgacauggagaccggcaugcucaagauccucuccccccucgaccgcgagaccaccgacaaguacacccucaacaucaccgucuacgaccucggcaucccccagaaggccgccuggcgccuccuccacgucgucgucgucgacgccaacgacaacccccccgaguuccuccaggaguccuacuucgucgaggucuccgaggacaaggagguccacuccgagaucauccaggucgaggccaccgacaaggaccucggccccaacggccacgucaccuacuccaucgucaccgacaccgacaccuucuccaucgacuccgucaccggcgucgucaacaucgcccgcccccucgaccgcgagcuccagcacgagcacucccucaagaucgaggcccgcgaccaggcccgcgaggagccccagcucuucuccaccgucgucgucaaggucucccucgaggacgucaacgacaacccccccaccuucaucccccccaacuaccgcgucaagguccgcgaggaccuccccgagggcaccgucaucauguggcucgaggcccacgaccccgaccucggccaguccggccagguccgcuacucccuccucgaccacggcgagggcaacuucgacgucgacaagcucuccggcgccguccgcaucguccagcagcucgacuucgagaagaagcaggucuacaaccucaccguccgcgccaaggacaagggcaagcccgucucccucuccuccaccugcuacgucgaggucgaggucgucgacgucaacgagaaccuccacccccccgucuucuccuccuucgucgagaagggcaccgucaaggaggacgcccccgucggcucccucgucaugaccgucuccgcccacgacgaggacgcccgccgcgacggcgagauccgcuacuccauccgcgacggcuccggcgucggcgucuucaagaucggcgaggagaccggcgucaucgagaccuccgaccgccucgaccgcgaguccaccucccacuacuggcucaccgucuucgccaccgaccagggcgucgucccccucuccuccuucaucgagaucuacaucgaggucgaggacgucaacgacaacgccccccagaccuccgagcccgucuacuaccccgagaucauggagaacucccccaaggacgucuccgucguccagaucgaggccuucgaccccgacuccuccuccaacgacaagcucauguacaagaucaccuccggcaacccccagggcuucuucuccauccaccccaagaccggccucaucaccaccaccucccgcaagcucgaccgcgagcagcaggacgagcacauccucgaggucaccgucaccgacaacggcuccccccccaaguccaccaucgcccgcgucaucgucaagauccucgacgagaacgacaacaagccccaguuccuccagaaguucuacaagauccgccuccccgagcgcgagaagcccgaccgcgagcgcaacgcccgccgcgagccccucuaccacgucaucgccaccgacaaggacgagggccccaacgccgagaucuccuacuccaucgaggacggcaacgagcacggcaaguucuucaucgagcccaagaccggcgucgucuccuccaagcgcuucuccgccgccggcgaguacgacauccucuccaucaaggccgucgacaacggccgcccccagaaguccuccaccacccgccuccacaucgaguggaucuccaagcccaagcccucccucgagcccaucuccuucgaggaguccuucuucaccuucaccgucauggaguccgaccccgucgcccacaugaucggcgucaucuccgucgagccccccggcaucccccucugguucgacaucaccggcggcaacuacgacucccacuucgacgucgacaagggcaccggcaccaucaucgucgccaagccccucgacgccgagcagaaguccaacuacaaccucaccgucgaggccaccgacggcaccaccaccauccucacccaggucuucaucaaggucaucgacaccaacgaccaccgcccccaguucuccaccuccaaguacgaggucgucauccccgaggacaccgcccccgagaccgagauccuccagaucuccgccgucgaccaggacgagaagaacaagcucaucuacacccuccaguccucccgcgacccccucucccucaagaaguuccgccucgaccccgccaccggcucccucuacaccuccgagaagcucgaccacgaggccguccaccagcacacccucaccgucaugguccgcgaccaggacguccccgucaagcgcaacuucgcccgcaucgucgucaacgucuccgacaccaacgaccacgcccccugguucaccgccuccuccuacaagggccgcgucuacgaguccgccgccgucggcuccgucguccuccaggucaccgcccucgacaaggacaagggcaagaacgccgagguccucuacuccaucgaguccggcaacaucggcaacuccuucaugaucgaccccguccucggcuccaucaagaccgccaaggagcucgaccgcuccaaccaggccgaguacgaccucauggucaaggccaccgacaagggcuccccccccauguccgagaucaccuccguccgcaucuucgucaccaucgccgacaacgccucccccaaguucaccuccaaggaguacuccgucgagcucuccgagaccgucuccaucggcuccuucgucggcauggucaccgcccacucccaguccuccgucgucuacgagaucaaggacggcaacaccggcgacgccuucgacaucaacccccacuccggcaccaucaucacccagaaggcccucgacuucgagacccuccccaucuacacccucaucauccagggcaccaacauggccggccucuccaccaacaccaccguccucguccaccuccaggacgagaacgacaacgcccccgucuucaugcaggccgaguacaccggccucaucuccgaguccgccuccaucaacuccgucguccucaccgaccgcaacgucccccucgucauccgcgccgccgacgccgacaaggacuccaacgcccuccucgucuaccacaucgucgagcccuccguccacaccuacuucgccaucgacuccuccaccggcgccauccacaccguccucucccucgacuacgaggagaccuccaucuuccacuucaccguccagguccacgacaugggcaccccccgccucuucgccgaguacgccgccaacgucaccguccacgucaucgacaucaacgacugcccccccgucuucgccaagccccucuacgaggccucccuccuccuccccaccuacaagggcgucaaggucaucaccgucaacgccaccgacgccgacuccuccgccuucucccagcucaucuacuccaucaccgagggcaacaucggcgagaaguucuccauggacuacaagaccggcgcccucaccguccagaacaccacccagcuccgcucccgcuacgagcucaccguccgcgccuccgacggccgcuucgccggccucaccuccgucaagaucaacgucaaggaguccaaggagucccaccucaaguucacccaggacgucuacuccgccgucgucaaggagaacuccaccgaggccgagacccucgccgucaucaccgccaucggcaaccccaucaacgagccccucuucuaccacauccucaaccccgaccgccgcuucaagaucucccgcaccuccggcguccucuccaccaccggcacccccuucgaccgcgagcagcaggaggccuucgacgucgucgucgaggucaccgaggagcacaagcccuccgccgucgcccacgucgucgucaaggucaucgucgaggaccagaacgacaacgcccccgucuucgucaaccuccccuacuacgccgucgucaaggucgacaccgaggucggccacgucauccgcuacgucaccgccgucgaccgcgacuccggccgcaacggcgagguccacuacuaccucaaggagcaccacgagcacuuccagaucggcccccucggcgagaucucccucaagaagcaguucgagcucgacacccucaacaaggaguaccucgucaccgucgucgccaaggacggcggcaaccccgccuucuccgccgaggucaucguccccaucaccgucaugaacaaggccaugcccgucuucgagaagcccuucuacuccgccgagaucgccgaguccauccagguccacucccccgucguccacguccaggccaacucccccgagggccucaaggucuucuacuccaucaccgacggcgaccccuucucccaguucaccaucaacuucaacaccggcgucaucaacgucaucgccccccucgacuucgaggcccaccccgccuacaagcucuccauccgcgccaccgacucccucaccggcgcccacgccgaggucuucgucgacaucaucgucgacgacaucaacgacaacccccccgucuucgcccagcaguccuacgccgucacccucuccgaggccuccgucaucggcaccuccgucguccagguccgcgccaccgacuccgacuccgagcccaaccgcggcaucuccuaccagauguucggcaaccacuccaagucccacgaccacuuccacgucgacuccuccaccggccucaucucccuccuccgcacccucgacuacgagcagucccgccagcacaccaucuucguccgcgccgucgacggcggcaugcccacccucuccuccgacgucaucgucaccgucgacgucaccgaccucaacgacaaccccccccucuucgagcagcagaucuacgaggcccgcaucuccgagcacgccccccacggccacuucgucaccugcgucaaggccuacgacgccgacuccuccgacaucgacaagcuccaguacuccauccucuccggcaacgaccacaagcacuucgucaucgacuccgccaccggcaucaucacccucuccaaccuccaccgccacgcccucaagcccuucuacucccucaaccucuccgucuccgacggcgucuuccgcuccuccacccagguccacgucaccgucaucggcggcaaccuccacucccccgccuuccuccagaacgaguacgaggucgagcucgccgagaacgccccccuccacacccucgucauggaggucaagaccaccgacggcgacuccggcaucuacggccacgucaccuaccacaucgucaacgacuucgccaaggaccgcuucuacaucaacgagcgcggccagaucuucacccucgagaagcucgaccgcgagacccccgccgagaaggucaucuccguccgccucauggccaaggacgccggcggcaaggucgccuucugcaccgucaacgucauccucaccgacgacaacgacaacgccccccaguuccgcgccaccaaguacgaggucaacaucggcuccuccgccgccaagggcaccuccgucgucaagguccucgccuccgacgccgacgagggcuccaacgccgacaucaccuacgccaucgaggccgacuccgaguccgucaaggagaaccucgagaucaacaagcucuccggcgucaucaccaccaaggagucccucaucggccucgagaacgaguucuucaccuucuucguccgcgccgucgacaacggcucccccuccaaggaguccgucguccucgucuacgucaagauccucccccccgagaugcagcuccccaaguucuccgagcccuucuacaccuucaccgucuccgaggacguccccaucggcaccgagaucgaccucauccgcgccgagcacuccggcaccguccucuacucccucgucaagggcaacacccccgaguccaaccgcgacgaguccuucgucaucgaccgccaguccggccgccucaagcucgagaagucccucgaccacgagaccaccaagugguaccaguucuccauccucgcccgcugcacccaggacgaccacgagauggucgccuccgucgacgucuccauccaggucaaggacgccaacgacaacucccccgucuucgaguccucccccuacgaggccuucaucgucgagaaccuccccggcggcucccgcgucauccagauccgcgccuccgacgccgacuccggcaccaacggccaggucauguacucccucgaccagucccaguccgucgaggucaucgaguccuucgccaucaacauggagaccggcuggaucaccacccucaaggagcucgaccacgagaagcgcgacaacuaccagaucaaggucgucgccuccgaccacggcgagaagauccagcucuccuccaccgccaucgucgacgucaccgucaccgacgucaacgacucccccccccgcuucaccgccgagaucuacaagggcaccgucuccgaggacgacccccagggcggcgucaucgccauccucuccaccaccgacgccgacuccgaggagaucaaccgccaggucaccuacuucaucaccggcggcgacccccucggccaguucgccgucgagaccauccagaacgaguggaaggucuacgucaagaagccccucgaccgcgagaagcgcgacaacuaccuccucaccaucaccgccaccgacggcaccuucuccuccaaggccaucgucgaggucaagguccucgacgccaacgacaacucccccgucugcgagaagacccucuacuccgacaccauccccgaggacguccuccccggcaagcucaucaugcagaucuccgccaccgacgccgacauccgcuccaacgccgagaucaccuacacccuccucggcuccggcgccgagaaguucaagcucaaccccgacaccggcgagcucaagaccuccaccccccucgaccgcgaggagcaggccgucuaccaccuccucguccgcgccaccgacggcggcggccgcuucugccaggccuccaucguccucacccucgaggacgucaacgacaacgcccccgaguucuccgccgaccccuacgccaucaccgucuucgagaacaccgagcccggcacccuccucacccgcguccaggccaccgacgccgacgccggccucaaccgcaagauccucuacucccucaucgacuccgccgacggccaguucuccaucaacgagcucuccggcaucauccagcucgagaagccccucgaccgcgagcuccaggccgucuacacccucucccucaaggccgucgaccagggccucccccgccgccucaccgccaccggcaccgucaucgucuccguccucgacaucaacgacaacccccccgucuucgaguaccgcgaguacggcgccaccgucuccgaggacauccucgucggcaccgagguccuccaggucuacgccgccucccgcgacaucgaggccaacgccgagaucaccuacuccaucaucuccggcaacgagcacggcaaguucuccaucgacuccaagaccggcgccgucuucaucaucgagaaccucgacuacgaguccucccacgaguacuaccucaccgucgaggccaccgacggcggcacccccucccucuccgacgucgccaccgucaacgucaacgucaccgacaucaacgacaacacccccgucuucucccaggacaccuacaccaccgucaucuccgaggacgccguccucgagcaguccgucaucaccgucauggccgacgacgccgacggccccuccaacucccacauccacuacuccaucaucgacggcaaccagggcuccuccuucaccaucgaccccguccgcggcgaggucaaggucaccaagcuccucgaccgcgagaccaucuccggcuacacccucaccguccaggccuccgacaacggcucccccccccgcgucaacaccaccaccgucaacaucgacgucuccgacgucaacgacaacgcccccgucuucucccgcggcaacuacuccgucaucauccaggagaacaagcccgucggcuucuccguccuccagcucgucgucaccgacgaggacuccucccacaacggcccccccuucuucuucaccaucgucaccggcaacgacgagaaggccuucgaggucaacccccagggcguccuccucaccuccuccgccaucaagcgcaaggagaaggaccacuaccuccuccaggucaaggucgccgacaacggcaagccccagcucuccucccucaccuacaucgacauccgcgucaucgaggaguccaucuacccccccgccauccucccccucgagaucuucaucaccuccuccggcgaggaguacuccggcggcgucaucggcaagauccacgccaccgaccaggacgucuacgacacccucaccuacucccucgacccccagauggacaaccucuucuccgucuccuccaccggcggcaagcucaucgcccacaagaagcucgacaucggccaguaccuccucaacgucuccgucaccgacggcaaguucaccaccgucgccgacaucaccguccacauccgccaggucacccaggagaugcucaaccacaccaucgccauccgcuucgccaaccucacccccgaggaguucgucggcgacuacuggcgcaacuuccagcgcgcccuccgcaacauccucggcguccgccgcaacgacauccagaucgucucccuccaguccuccgagccccacccccaccucgacguccuccucuucgucgagaagcccggcuccgcccagaucuccaccaagcagcuccuccacaagaucaacuccuccgucaccgacaucgaggagaucaucggcguccgcauccucaacgucuuccagaagcucugcgccggccucgacugccccuggaaguucugcgacgagaaggucuccgucgacgaguccgucauguccacccacuccaccgcccgccucuccuucgucaccccccgccaccaccgcgccgccgucugccucugcaaggagggccgcugcccccccguccaccacggcugcgaggacgaccccugccccgagggcuccgagugcgucuccgaccccugggaggagaagcacaccugcgucugccccuccggccgcuucggccagugccccggcuccuccuccaugacccucaccggcaacuccuacgucaaguaccgccucaccgagaacgagaacaagcucgagaugaagcucaccaugcgccuccgcaccuacuccacccacgccgucgucauguacgcccgcggcaccgacuacuccauccucgagauccaccacggccgccuccaguacaaguucgacugcggcuccggccccggcaucgucuccguccaguccauccaggucaacgacggccaguggcacgccgucgcccucgaggucaacggcaacuacgcccgccucguccucgaccagguccacaccgccuccggcaccgcccccggcacccucaagacccucaaccucgacaacuacgucuucuucggcggccacauccgccagcagggcacccgccacggccgcuccccccaggucggcaacggcuuccgcggcugcauggacuccaucuaccucaacggccaggagcucccccucaacuccaagccccgcuccuacgcccacaucgaggaguccgucgacgucucccccggcugcuuccucaccgccaccgaggacugcgccuccaaccccugccagaacggcggcgucugcaaccccucccccgccggcggcuacuacugcaagugcuccgcccucuacaucggcacccacugcgagaucuccgucaaccccugcuccuccaagcccugccucuacggcggcaccugcgucgucgacaacggcggcuucgucugccagugccgcggccucuacaccggccagcgcugccagcucucccccuacugcaaggacgagcccugcaagaacggcggcaccugcuucgacucccucgacggcgccgucugccagugcgacuccggcuuccgcggcgagcgcugccaguccgacaucgacgagugcuccggcaaccccugccuccacggcgcccucugcgagaacacccacggcuccuaccacugcaacugcucccacgaguaccgcggccgccacugcgaggacgccgcccccaaccaguacgucuccacccccuggaacaucggccucgccgagggcaucggcaucgucgucuucgucgccggcaucuuccuccucgucgucgucuucguccucugccgcaagaugaucucccgcaagaagaagcaccaggccgagcccaaggacaagcaccucggccccgccaccgccuuccuccagcgccccuacuucgacuccaagcucaacaagaacaucuacuccgacauccccccccagguccccguccgccccaucuccuacacccccuccauccccuccgacucccgcaacaaccucgaccgcaacuccuucgagggcuccgccauccccgagcaccccgaguucuccaccuucaaccccgaguccguccacggccaccgcaaggccgucgccgucugcuccgucgcccccaaccuccccccccccccccccuccaacucccccuccgacuccgacuccauccagaagcccuccugggacuucgacuacgacaccaaggucgucgaccucgaccccugccucuccaagaagccccucgaggagaagcccucccagcccuacuccgcccgcgagucccucuccgagguccagucccucuccuccuuccaguccgaguccugcgacgacaacggcuaccacugggacaccuccgacuggaugcccuccgucccccuccccgacauccaggaguuccccaacuacgaggucaucgacgagcagaccccccucuacuccgccgaccccaacgccaucgacaccgacuacuaccccggcggcuacgacaucgaguccgacuucccccccccccccgaggacuuccccgccgccgacgagcuccccccccucccccccgaguucuccaaccaguucgaguccauccaccccccccgcgacaugcccgccgccggcucccucggcuccuccucccgcaaccgccagcgcuucaaccucaaccaguaccuccccaacuucuacccccucgacauguccgagccccagaccaagggcaccggcgagaacuccaccugccgcgagccccacgcccccuacccccccggcuaccagcgccacuucgaggcccccgccgucgaguccaugcccauguccgucuacgccuccaccgccuccugcuccgacgucuccgccugcugcgaggucgaguccgaggucaugauguccgacuacgaguccggcgacgacggccacuucgaggaggucaccauccccccccucgacucccagcagcacaccgaggucuga

SEQ ID NO: 43076 - RNA, 13050 nt, Artificial Sequence
  derived and/or modified sequence opt2 from FAT2__Homo_sapiens__XP_011535905
augaccaucgcccuccucggcuucgccaucuuccuccuccacugcgccaccugcgagaagccccucgagggcauccucuccuccuccgccuggcacuucacccacucccacuacaacgccaccaucuacgagaacuccucccccaagaccuacgucgaguccuucgagaagaugggcaucuaccucgccgagccccagugggccguccgcuaccgcaucaucuccggcgacgucgccaacgucuucaagaccgaggaguacgucgucggcaacuucugcuuccuccgcauccgcaccaaguccuccaacaccgcccuccucaaccgcgagguccgcgacuccuacacccucaucauccaggccaccgagaagacccucgagcucgaggcccucacccgcgucgucguccacauccucgaccagaacgaccucaagccccucuucuccccccccuccuaccgcgucaccaucuccgaggacaugccccucaagucccccaucugcaaggucaccgccaccgacgccgaccucggccagaacgccgaguucuacuacgccuucaacacccgcuccgagauguucgccauccaccccaccuccggcgucgucaccgucgccggcaagcucaacgucaccuggcgcggcaagcacgagcuccagguccucgccgucgaccgcaugcgcaagaucuccgagggcaacggcuucggcucccucgccgcccucgucguccacgucgagcccgcccuccgcaagccccccgccaucgccuccgucgucgucaccccccccgacuccaacgacggcaccaccuacgccaccguccucgucgacgccaacuccuccggcgccgaggucgaguccgucgaggucgucggcggcgaccccggcaagcacuucaaggccaucaaguccuacgcccgcuccaacgaguucucccucgucuccgucaaggacaucaacuggauggaguaccuccacggcuucaaccucucccuccaggcccgcuccggcuccggccccuacuucuacucccagauccgcggcuuccaccucccccccuccaagcucuccucccucaaguucgagaaggccgucuaccgcguccagcucuccgaguucuccccccccggcucccgcgucgucaugguccgcgucacccccgccuuccccaaccuccaguacguccucaagcccuccuccgagaacgucggcuucaagcucaacgcccgcaccggccucaucaccaccaccaagcucauggacuuccacgaccgcgcccacuaccagcuccacauccgcaccucccccggccaggccuccaccgucgucgucaucgacaucgucgacugcaacaaccacgccccccucuucaaccgcuccuccuacgacggcacccucgacgagaacaucccccccggcaccuccguccucgccgucaccgccaccgaccgcgaccacggcgagaacggcuacgucaccuacuccaucgccggccccaaggcccuccccuucuccaucgaccccuaccucggcaucaucuccaccuccaagcccauggacuacgagcucaugaagcgcaucuacaccuuccgcguccgcgccuccgacuggggcucccccuuccgccgcgagaaggaggucuccaucuuccuccagcuccgcaaccucaacgacaaccagcccauguucgaggaggucaacugcaccggcuccauccgccaggacuggcccgucggcaaguccaucaugaccauguccgccaucgacgucgacgagcuccagaaccucaaguacgagaucgucuccggcaacgagcucgaguacuucgaccucaaccacuucuccggcgucaucucccucaagcgccccuucaucaaccucaccgccggccagcccaccuccuacucccucaagaucaccgccuccgacggcaagaacuacgccucccccaccacccucaacaucaccgucgucaaggacccccacuucgagguccccgucaccugcgacaagaccggcguccucacccaguucaccaagaccauccuccacuucaucggccuccagaaccaggaguccuccgacgaggaguucaccucccucuccaccuaccagaucaaccacuacaccccccaguucgaggaccacuucccccaguccaucgacguccucgaguccguccccaucaacaccccccucgcccgccucgccgccaccgaccccgacgccggcuucaacggcaagcucgucuacgucaucgccgacggcaacgaggagggcugcuucgacaucgagcucgagaccggccuccucaccgucgccgccccccucgacuacgaggccaccaacuucuacauccucaacgucaccgucuacgaccucggcaccccccagaaguccuccuggaagcuccucaccgucaacgucaaggacuggaacgacaacgccccccgcuucccccccggcggcuaccagcucaccaucuccgaggacaccgaggucggcaccaccaucgccgagcucaccaccaaggacgccgacuccgaggacaacggccgcguccgcuacacccuccucucccccaccgagaaguucucccuccacccccucaccggcgagcucgucgucaccggccaccucgaccgcgaguccgagccccgcuacauccucaaggucgaggcccgcgaccagcccuccaagggccaccagcucuucuccgucaccgaccucaucaucacccucgaggacgucaacgacaacuccccccagugcaucaccgagcacaaccgccucaagguccccgaggaccucccccccggcaccguccucaccuuccucgacgccuccgaccccgaccucggccccgccggcgagguccgcuacguccucauggacggcgcccacggcaccuuccgcgucgaccucaugaccggcgcccucauccucgagcgcgagcucgacuucgagcgccgcgccggcuacaaccucucccucugggccuccgacggcggccgcccccucgcccgccgcacccucugccacgucgaggucaucguccucgacgucaacgagaaccuccaccccccccacuucgccuccuucguccaccagggccagguccaggagaacucccccuccggcacccaggucaucgucgucgccgcccaggacgacgacuccggccucgacggcgagcuccaguacuuccuccgcgccggcaccggccucgccgccuucuccaucaaccaggacaccggcaugauccagacccucgccccccucgaccgcgaguucgccuccuacuacuggcucaccguccucgccgucgaccgcggcuccgucccccucuccuccgucaccgaggucuacaucgaggucaccgacgccaacgacaaccccccccagaugucccaggccgucuucuaccccuccauccaggaggacgcccccgucggcaccuccguccuccagcucgacgccugggaccccgacuccuccuccaagggcaagcucaccuucaacaucaccuccggcaacuacaugggcuucuucaugauccaccccgucaccggccuccucuccaccgcccagcagcucgaccgcgagaacaaggacgagcacauccucgaggucaccguccucgacaacggcgagcccucccucaaguccaccucccgcgucgucgucggcauccucgacgucaacgacaacccccccaucuucucccacaagcucuucaacguccgccuccccgagcgccucucccccgucucccccggccccgucuaccgccucgucgccuccgaccucgacgagggccucaacggccgcgucaccuacuccaucgaggacuccgacgaggaggccuucuccaucgaccucgucaccggcgucgucuccuccuccuccaccuucaccgccggcgaguacaacauccucaccaucaaggccaccgacuccggccagcccccccucuccgccuccguccgccuccacaucgaguggauccccuggccccgccccuccuccaucccccucgccuucgacgagaccuacuacuccuucaccgucauggagaccgaccccgucaaccacauggucggcgucaucuccgucgagggccgccccggccucuucugguucaacaucuccggcggcgacaaggacauggacuucgacaucgagaagaccaccggcuccaucgucaucgcccgcccccucgacacccgccgccgcuccaacuacaaccucaccgucgaggucaccgacggcucccgcaccaucgccacccagguccacaucuucaugaucgccaacaucaaccaccaccgcccccaguuccucgagacccgcuacgagguccgcgucccccaggacaccguccccggcgucgagcuccuccgcguccaggccaucgaccaggacaagggcaagucccucaucuacaccauccacggcucccaggaccccggcuccgccucccucuuccagcucgaccccuccuccggcguccucgucaccgucggcaagcucgaccucggcuccggccccucccagcacacccucaccgucaugguccgcgaccaggagauccccaucaagcgcaacuucgucugggucaccauccacgucgaggacggcaaccuccaccccccccgcuucacccagcuccacuacgaggccuccguccccgacaccaucgcccccggcaccgagcuccuccagguccgcgccauggacgccgaccgcggcgucaacgccgagguccacuacucccuccucaagggcaacuccgagggcuucuucaacaucaacgcccuccucggcaucaucacccucgcccagaagcucgaccaggccaaccacgccccccacacccucaccgucaaggccgaggaccagggcuccccccaguggcacgaccucgccaccgucaucauccacgucuaccccuccgaccgcuccgcccccaucuucuccaaguccgaguacuucgucgagauccccgaguccauccccgucggcucccccauccuccucgucuccgccaugucccccuccgaggucaccuacgagcuccgcgagggcaacaaggacggcgucuucuccaugaacuccuacuccggccucaucuccacccagaagaagcucgaccacgagaagaucuccuccuaccagcucaagauccgcggcuccaacauggccggcgccuucaccgacgucauggucgucgucgacaucaucgacgagaacgacaacgcccccauguuccucaaguccaccuucgucggccagaucuccgaggccgccccccucuacuccaugaucauggacaagaacaacaaccccuucgucauccacgccuccgacuccgacaaggaggccaacucccuccucgucuacaagauccucgagcccgaggcccucaaguucuucaagaucgaccccuccaugggcacccucaccaucgucuccgagauggacuacgaguccaugcccuccuuccaguucugcgucuacguccacgaccagggcucccccguccucuucgccccccgccccgcccaggucaucauccacguccgcgacgucaacgacucccccccccgcuucuccgagcagaucuacgaggucgccaucgucggccccauccaccccggcauggagcuccucaugguccgcgccuccgacgaggacuccgaggucaacuacuccaucaagaccggcaacgccgacgaggccgucaccauccaccccgucaccggcuccaucuccguccucaaccccgccuuccucggccucucccgcaagcucaccauccgcgccuccgacggccucuaccaggacaccgcccucgucaagaucucccucacccagguccucgacaagucccuccaguucgaccaggacgucuacugggccgccgucaaggagaaccuccaggaccgcaaggcccucgucauccucggcgcccagggcaaccaccucaacgacacccucuccuacuuccuccucaacggcaccgacauguuccacaugguccaguccgccggcguccuccagacccgcggcgucgccuucgaccgcgagcagcaggacacccacgagcucgccgucgagguccgcgacaaccgcaccccccagcgcgucgcccagggccucguccgcgucuccaucgaggacgucaacgacaacccccccaaguucaagcaccuccccuacuacaccaucauccaggacggcaccgagcccggcgacguccucuuccaggucuccgccaccgacgaggaccucggcaccaacggcgccgucaccuacgaguucgccgaggacuacaccuacuuccgcaucgaccccuaccucggcgacaucucccucaagaagcccuucgacuaccaggcccucaacaaguaccaccucaaggucaucgcccgcgacggcggcacccccucccuccaguccgaggaggagguccucgucaccguccgcaacaaguccaacccccucuuccagucccccuacuacaagguccgcguccccgagaacaucacccucuacacccccauccuccacacccaggcccgcucccccgagggccuccgccucaucuacaacaucgucgaggaggagccccucaugcucuucaccaccgacuucaagaccggcguccucaccgucaccggcccccucgacuacgaguccaagaccaagcacgucuucaccguccgcgccaccgacaccgcccucggcuccuucuccgaggccaccgucgagguccucgucgaggacgucaacgacaacccccccaccuucucccagcucgucuacaccaccuccaucuccgagggccuccccgcccagacccccgucauccagcuccucgccuccgaccaggacuccggccgcaaccgcgacgucuccuaccagaucgucgaggacggcuccgacgucuccaaguucuuccagaucaacggcuccaccggcgagauguccaccguccaggagcucgacuacgaggcccagcagcacuuccacgucaagguccgcgccauggacaagggcgaccccccccucaccggcgagacccucgucgucgucaacgucuccgacaucaacgacaacccccccgaguuccgccagccccaguacgaggccaacgucuccgagcucgccaccugcggccaccucguccucaagguccaggccaucgaccccgacucccgcgacaccucccgccucgaguaccucauccucuccggcaaccaggaccgccacuucuucaucaacuccuccuccggcaucaucuccauguucaaccucugcaagaagcaccucgacuccuccuacaaccuccgcgucggcgccuccgacggcgucuuccgcgccaccguccccgucuacaucaacaccaccaacgccaacaaguacucccccgaguuccagcagcaccucuacgaggccgagcucgccgagaacgccauggucggcaccaaggucaucgaccuccucgccaucgacaaggacuccggccccuacggcaccaucgacuacaccaucaucaacaagcucgccuccgagaaguucuccaucaaccccaacggccagaucgccacccuccagaagcucgaccgcgagaacuccaccgagcgcgucaucgccaucaaggucauggcccgcgacggcggcggccgcgucgccuucugcaccgucaagaucauccucaccgacgagaacgacaaccccccccaguucaaggccuccgaguacaccgucuccauccaguccaacgucuccaaggacucccccgucauccagguccucgccuacgacgccgacgagggccagaacgccgacgucaccuacuccgucaaccccgaggaccucgucaaggacgucaucgagaucaaccccgucaccggcgucgucaaggucaaggacucccucgucggccucgagaaccagacccucgacuucuucaucaaggcccaggacggcggccccccccacuggaacucccucguccccguccgccuccaggucguccccaagaaggucucccuccccaaguucuccgagccccucuacaccuucuccgcccccgaggaccuccccgagggcuccgagaucggcaucgucaaggccgucgccgcccaggaccccgucaucuacucccucguccgcggcaccacccccgaguccaacaaggacggcgucuucucccucgaccccgacaccggcgucaucaagguccgcaagcccauggaccacgaguccaccaagcucuaccagaucgacgucauggcccacugccuccagaacaccgacgucgucucccucgucuccgucaacauccaggucggcgacgucaacgacaaccgccccgucuucgaggccgaccccuacaaggccguccucaccgagaacaugcccgucggcaccuccgucauccaggucaccgccaucgacaaggacaccggccgcgacggccaggucuccuaccgccucuccgccgaccccggcuccaacguccacgagcucuucgccaucgacuccgaguccggcuggaucaccacccuccaggagcucgacugcgagaccugccagaccuaccacuuccacgucgucgccuacgaccacggccagaccauccagcucuccucccaggcccucguccaggucuccaucaccgacgagaacgacaacgccccccgcuucgccuccgaggaguaccgcggcuccgucgucgagaacuccgagcccggcgagcucgucgccacccucaagacccucgacgccgacaucuccgagcagaaccgccaggucaccugcuacaucaccgagggcgacccccucggccaguucggcaucucccaggucggcgacgaguggcgcaucuccucccgcaagacccucgaccgcgagcacaccgccaaguaccuccuccgcgucaccgccuccgacggcaaguuccaggccuccgucaccgucgagaucuucguccucgacgucaacgacaacuccccccagugcucccagcuccucuacaccggcaagguccacgaggacgucuuccccggccacuucauccucaaggucuccgccaccgaccucgacaccgacaccaacgcccagaucaccuacucccuccacggccccggcgcccacgaguucaagcucgacccccacaccggcgagcucaccacccucaccgcccucgaccgcgagcgcaaggacgucuucaaccucgucgccaaggccaccgacggcggcggccgcuccugccaggccgacaucacccuccacgucgaggacgucaacgacaacgccccccgcuucuuccccucccacugcgccgucgccgucuucgacaacaccaccgucaagacccccgucgccgucgucuucgcccgcgaccccgaccagggcgccaacgcccaggucgucuacucccuccccgacuccgccgagggccacuucuccaucgacgccaccaccggcgucauccgccucgagaagccccuccagguccgcccccaggccccccucgagcucaccguccgcgccuccgaccucggcacccccaucccccucuccacccucggcaccgucaccgucuccgucgucggccucgaggacuaccuccccgucuuccucaacaccgagcacuccguccagguccccgaggacgccccccccggcaccgagguccuccagcucgccacccucacccgccccggcgccgagaagaccggcuaccgcgucgucuccggcaacgagcagggccgcuuccgccucgacgcccgcaccggcauccucuacgucaacgccucccucgacuucgagaccucccccaaguacuuccucuccaucgagugcucccgcaaguccuccuccucccucuccgacgucaccaccgucauggucaacaucaccgacgucaacgagcaccgcccccaguucccccaggaccccuacuccacccgcguccucgagaacgcccucgucggcgacgucauccucaccgucuccgccaccgacgaggacggcccccucaacuccgacaucaccuacucccucaucggcggcaaccagcucggccacuucaccauccaccccaagaagggcgagcuccaggucgccaaggcccucgaccgcgagcaggccuccuccuacucccucaagcuccgcgccaccgacuccggccagcccccccuccacgaggacaccgacaucgccauccaggucgccgacgucaacgacaaccccccccgcuucuuccagcucaacuacuccaccaccguccaggagaacucccccaucggcuccaagguccuccagcucauccucuccgaccccgacucccccgagaacggcccccccuacuccuuccgcaucaccaagggcaacaacggcuccgccuuccgcgucacccccgacggcuggcucgucaccgccgagggccucucccgccgcgcccaggagugguaccagcuccagauccaggccuccgacuccggcauccccccccucuccucccucaccuccguccgcguccacgucaccgagcagucccacuacgcccccuccgcccucccccucgagaucuucaucaccgucggcgaggacgaguuccagggcggcauggucggcaagauccacgccaccgaccgcgacccccaggacacccucaccuacucccucgccgaggaggagacccucggccgccacuucuccgucggcgcccccgacggcaagaucaucgccgcccagggccucccccgcggccacuacuccuucaacgucaccgucuccgacggcaccuucaccaccaccgccggcguccacgucuacgucuggcacgucggccaggaggcccuccagcaggccauguggaugggcuucuaccagcucacccccgaggagcucgucuccgaccacuggcgcaaccuccagcgcuuccucucccacaagcucgacaucaagcgcgccaacauccaccucgccucccuccagcccgccgaggccgucgccggcgucgacguccuccucgucuucgagggccacuccggcaccuucuacgaguuccaggagcucgccuccaucaucacccacuccgccaaggagauggagcacuccgucggcguccagaugcgcuccgccaugcccaugguccccugccagggccccaccugccagggccagaucugccacaacaccguccaccucgaccccaaggucggccccaccuacuccaccgcccgccucuccauccucaccccccgccaccaccuccagcgcuccugcuccugcaacggcaccgccacccgcuucuccggccaguccuacguccgcuaccgcgcccccgccgcccgcaacuggcacauccacuucuaccucaagacccuccagccccaggccauccuccucuucaccaacgagaccgccuccgucucccucaagcucgccuccggcgucccccagcucgaguaccacugccucggcggcuucuacggcaaccucuccucccagcgccacgucaacgaccacgaguggcacuccauccucgucgaggagauggacgccuccauccgccucauggucgacuccaugggcaacaccucccucgucguccccgagaacugccgcggccuccgccccgagcgccaccuccuccucggcggccucauccuccuccacuccuccuccaacgucucccagggcuucgagggcugccucgacgccgucgucgucaacgaggaggcccucgaccuccucgcccccggcaagaccgucgccggccuccucgagacccaggcccucacccagugcugccuccacuccgacuacugcucccagaacaccugccucaacggcggcaagugcuccuggacccacggcgccggcuacgucugcaagugccccccccaguucuccggcaagcacugcgagcagggccgcgagaacugcaccuucgcccccugccucgagggcggcaccugcauccucucccccaagggcgccuccugcaacugcccccaccccuacaccggcgaccgcugcgagauggaggcccgcggcugcuccgagggccacugccucgucacccccgagauccagcgcggcgacuggggccagcaggagcuccucaucaucaccgucgccgucgccuucaucaucaucuccaccgucggccuccucuucuacugccgccgcugcaagucccacaagcccgucgccauggaggaccccgaccuccucgcccgcuccgucggcgucgacacccaggccaugcccgccaucgagcucaacccccucuccgccuccuccugcaacaaccucaaccagcccgagcccuccaaggccuccguccccaacgagcucgucaccuucggccccaacuccaagcagcgccccgucgucugcuccguccccccccgccucccccccgccgccguccccucccacuccgacaacgagcccgucaucaagcgcaccugguccuccgaggagauggucuaccccggcggcgccauggucuggccccccaccuacucccgcaacgagcgcugggaguacccccacuccgaggucacccagggcccccucccccccuccgcccaccgccacuccacccccgucgucaugcccgagcccaacggccucuacggcggcuuccccuucccccucgagauggagaacaagcgcgccccccuccccccccgcuacuccaaccagaaccucgaggaccucaugcccucccgcccccccuccccccgcgagcgccucgucgcccccugccucaacgaguacaccgccaucuccuacuaccacucccaguuccgccagggcggcggcggccccugccucgccgacggcggcuacaagggcgucggcaugcgccucucccgcgccggccccuccuacgccgucugcgaggucgagggcgccccccucgccggccagggccagccccgcgucccccccaacuacgagggcuccgacauggucgaguccgacuacggcuccugcgaggaggucauguucuga

SEQ ID NO: 43077 - RNA, 13674 nt, Artificial Sequence
  derived and/or modified sequence opt2 from FAT3__Homo_sapiens__NP_001008781
auggacaucaucaugggccacugcgucggcacccgcccccccgccugcugccucauccuccuccucuucaagcuccucgccaccgucucccagggccuccccggcaccggcccccucggcuuccacuucacccacuccaucuacaacgccaccgucuacgagaacuccgccgcccgcaccuacgucaacucccagucccgcaugggcaucacccucaucgaccucuccugggacaucaaguaccgcaucgucuccggcgacgaggagggcuucuucaaggccgaggaggucaucaucgccgacuucugcuuccuccgcauccgcaccaagggcggcaacuccgccauccucaaccgcgagauccaggacaacuaccuccucaucgucaagggcuccguccgcggcgaggaccucgaggccuggaccaaggucaacauccagguccucgacaugaacgaccuccgcccccucuucucccccaccaccuacuccgucaccaucgccgaguccaccccccuccgcaccuccgucgcccaggucaccgccaccgacgccgacaucggcuccaacggcgaguucuacuacuacuucaagaacaaggucgaccucuucuccguccaccccaccuccggcgucaucucccucuccggccgccucaacuacgacgagaagaaccgcuacgaccucgagauccucgccgucgaccgcggcaugaagcucuacggcaacaacggcgucuccuccaccgccaagcucuacguccacaucgagcgcaucaacgagcacgcccccaccauccacgucgucacccacguccccuucucccucgagaaggagcccaccuacgccgucgucaccgucgacgaccucgacgacggcgccaacggcgagaucgaguccgucuccaucgucgccggcgacccccucgaccaguucuuccucgccaaggagggcaaguggcucaacgaguacaagaucaaggagcgcaagcagaucgacugggaguccuuccccuacggcuacaaccucacccuccaggccaaggacaagggcuccccccagaagugcuccgcccucaaggccgucuacaucggcaaccccacccgcgacaccguccccauccgcuucgagaaggaggucuacgacgucuccaucuccgaguucuccccccccggcgucgucgucgccaucgucaagcucucccccgagcccaucgacgucgaguacaagcucucccccggcgaggacgccgucuacuucaagaucaacccccgcuccggccucaucgucaccgcccgcccccucaacaccgucaagaaggaggucuacaagcucgaggucaccaacaaggagggcgaccucaaggcccaggucaccaucuccaucgaggacgccaacgaccacacccccgaguuccagcagccccucuacgacgccuacgucaacgaguccguccccgucggcaccuccguccucaccgucuccgccuccgacaaggacaagggcgagaacggcuacaucaccuacuccaucgccucccucaaccuccuccccuucgucaucaaccaguucaccggcgucaucuccaccaccgaggagcucgacuucgaguccucccccgagaucuaccgcuucaucguccgcgccuccgacuggggcucccccuaccgccacgaguccgaggucaacgucaccauccgcaucggcaacgucaacgacaacuccccccucuucgagaaggucgccugccagggcgucaucuccuacgacuuccccgucggcggccacaucaccgccgucuccgccaucgacaucgacgagcucgagcucgucaaguacaagaucaucuccggcaacgagcucggcuucuucuaccucaaccccgacuccggcguccuccagcucaagaagucccucaccaacuccggcaucaagaacggcaacuucgcccuccgcaucaccgccaccgacggcgagaaccucgccgaccccauguccaucaacaucuccguccuccacggcaaggucuccuccaaguccuucuccugccgcgagacccgcgucgcccagaagcucgccgagaagcuccucaucaaggccaaggccaacggcaagcucaaccucgaggacggcuuccucgacuucuacuccaucaaccgccagggccccuacuucgacaaguccuuccccuccgacgucgccgucaaggaggaccuccccgucggcgccaacauccucaagaucaaggccuacgacgccgacuccggcuucaacggcaagguccucuucaccaucuccgacggcaacaccgacuccugcuucaacaucgacauggagaccggccagcucaagguccucaugcccauggaccgcgagcacaccgaccucuaccuccucaacaucaccaucuacgaccucggcaacccccagaaguccuccuggcgccuccucaccaucaacgucgaggacgccaacgacaacucccccgucuucauccaggacuccuacuccgucaacauccucgaguccuccggcaucggcaccgagaucauccaggucgaggcccgcgacaaggaccucggcuccaacggcgaggucaccuacuccguccucaccgacacccagcaguucgccaucaacuccuccaccggcaucgucuacgucgccgaccagcucgaccgcgaguccaaggccaacuacucccucaagaucgaggcccgcgacaaggccgaguccggccagcagcucuucuccgucgucacccucaaggucuuccucgacgacgucaacgacugcucccccgccuucauccccuccuccuacuccgucaagguccucgaggaccuccccgucggcaccgucaucgccuggcucgagacccacgaccccgaccucggccucggcggccagguccgcuacucccucgucaacgacuacaacggccgcuucgagaucgacaaggccuccggcgccauccgccucuccaaggagcucgacuacgagaagcagcaguucuacaaccucaccguccgcgccaaggacaagggccgccccgucucccucuccuccgucuccuucgucgaggucgaggucgucgacgucaacgagaaccuccacacccccuacuuccccgacuucgccgucgucggcuccgucaaggagaacucccgcaucggcaccuccguccuccaggucaccgcccgcgacgaggacuccggccgcgacggcgagauccaguacuccauccgcgacggcuccggccucggccgcuucuccaucgacgacgaguccggcgucaucaccgccgccgacauccucgaccgcgagaccaugggcuccuacuggcucaccgucuacgccaccgaccgcggcgucgucccccucuacuccaccaucgaggucuacaucgaggucgaggacgucaacgacaacgccccccucaccuccgagcccaucuacuaccccgucgucauggagaacucccccaaggacgucuccgucauccagauccaggccgaggaccccgacuccuccuccaacgagaagcucaccuaccgcaucaccuccggcaacccccagaacuucuucgccaucaacaucaagaccggccucaucaccaccaccucccgcaagcucgaccgcgagcagcaggccgagcacuuccucgaggucaccgucaccgacggcggccccucccccaagcaguccaccaucugggucgucguccagguccucgacgagaacgacaacaagccccaguuccccgagaaggucuaccagaucaagcuccccgagcgcgaccgcaagaagcgcggcgagcccaucuaccgcgccuucgccuucgaccgcgacgagggccccaacgccgagaucuccuacuccaucgucgacggcaacgacgacggcaaguucuucaucgaccccaagaccggcauggucuccucccgcaagcaguucaccgccggcuccuacgacauccucaccaucaaggccgucgacaacggccgcccccagaaguccuccaccgcccgccuccacaucgaguggaucaagaagcccccccccucccccaucccccucaccuucgacgagcccuucuacaacuucaccgucauggaguccgaccgcgucaccgagaucgucggcgucgucuccguccagcccgccaacaccccccucugguucgacaucgucggcggcaacuucgacuccgccuucgacgccgagaagggcgucggcaccaucgucaucgccaagccccucgacgccgagcagcgcuccaucuacaacauguccgucgaggucaccgacggcaccaacgucgccgucacccaggucuucaucaagguccucgacaacaacgacaacggccccgaguucucccagcccaacuacgacgucaccaucuccgaggacguccuccccgacaccgagauccuccagaucgaggccaccgaccgcgacgagaagcacaagcucuccuacaccguccacuccuccaucgacuccaucuccaugcgcaaguuccgcaucgaccccuccaccggcguccucuacaccgccgagcgccucgaccacgaggcccaggacaagcacauccucaacaucaugguccgcgaccaggaguuccccuaccgccgcaaccucgcccgcgucaucgucaacgucgaggacgccaacgaccacucccccuacuucaccaacccccucuacgaggccuccgucuucgaguccgccgcccucggcuccgccguccuccaggucaccgcccucgacaaggacaagggcgagaacgccgagcucaucuacaccaucgaggccggcaacaccggcaacauguucaagaucgagcccguccucggcaucaucaccaucugcaaggagcccgacaugaccaccaugggccaguucguccucuccaucaaggucaccgaccagggcuccccccccauguccgccaccgccaucguccgcaucuccgucaccauguccgacaacucccaccccaaguucauccacaaggacuaccaggccgaggucaacgagaacgucgacaucggcaccuccgucauccucaucuccgccaucucccaguccacccucaucuacgaggucaaggacggcgacaucaacggcaucuucaccaucaaccccuacuccggcgucaucaccacccagaaggcccucgacuacgagcgcaccuccuccuaccagcucaucauccaggccaccaacauggccggcauggccuccaacgccaccgucaacauccagaucgucgacgagaacgacaacgcccccgucuuccucuucucccaguacuccggcucccucuccgaggccgcccccaucaacuccaucguccgcucccucgacaacuccccccucgucauccgcgccaccgacgccgacuccaaccgcaacgcccuccucgucuaccagaucgucgaguccaccgccaagaaguucuucaccgucgacuccuccaccggcgccauccgcaccaucgccaaccucgaccacgagaccaucgcccacuuccacuuccacguccacguccgcgacuccggcuccccccagcucaccgccgagucccccgucgaggucaacaucgaggucaccgacgucaacgacaacccccccgucuucacccaggccgucuucgagaccauccuccuccuccccaccuacgucggcgucgagguccucaaggucuccgccaccgaccccgacuccgaggucccccccgagcucaccuacucccucauggagggcucccucgaccacuuccucaucgacuccaacuccggcguccucaccaucaagaacaacaaccucuccaaggaccacuacaugcucaucgucaaggucuccgacggcaaguucuacuccaccuccauggucaccaucauggucaaggaggccauggacuccggccuccacuucacccaguccuucuacuccaccuccaucuccgagaacaacaccaacaucaccaaggucgccaucgucaacgccgucggcaaccgccucaacgagccccucaaguacuccauccucaaccccggcaacaaguucaagaucaaguccaccuccggcgucauccagaccaccggcguccccuucgaccgcgaggagcaggagcucuacgagcucgucgucgaggccucccgcgagcucgaccaccuccgcgucgcccgcgucgucguccgcgucaacaucgaggacaucaacgacaacucccccgucuucgucggccuccccuacuacgccgccguccaggucgacgccgagcccggcacccucaucuaccaggucaccgccaucgacaaggacaagggccccaacggcgaggucaccuacguccuccaggacgacuacggccacuucgagaucaaccccaacuccggcaacgucauccucaaggaggccuucaacuccgaccucuccaacaucgaguacggcgucaccauccucgccaaggacggcggcaagcccucccucuccaccuccgucgagcuccccaucaccaucgucaacaaggccaugcccgucuucgacaagcccuucuacaccgccuccgucaacgaggacauccgcaugaacacccccauccucuccaucaacgccaccucccccgagggccagggcaucaucuacaucaucaucgacggcgaccccuucaagcaguucaacaucgacuucgacaccggcguccucaaggucgucuccccccucgacuacgaggucaccuccgccuacaagcucaccauccgcgccuccgacgcccucaccggcgcccgcgccgaggucaccgucgaccuccucgucaacgacgucaacgacaacccccccaucuucgaccagcccaccuacaacaccacccucuccgaggccucccucaucggcacccccguccuccaggucgucuccaucgacgccgacuccgagaacaacaagaugguccacuaccagaucguccaggacaccuacaacuccaccgacuacuuccacaucgacuccuccuccggccucauccucaccgcccgcaugcucgaccacgagcucguccagcacugcacccucaagguccgcuccaucgacuccggcuuccccucccucuccuccgagguccucguccacaucuacaucuccgacgucaacgacaacccccccgucuucaaccagcucaucuacgaguccuacgucuccgagcucgccccccgcggccacuucgucaccugcguccaggccuccgacgccgacuccuccgacuucgaccgccucgaguacuccauccucuccggcaacgaccgcaccuccuuccucauggacuccaaguccggcgucaucacccucuccaaccaccgcaagcagcgcauggagccccucuacucccucaacgucuccgucuccgacggccucuucaccuccaccgcccagguccacauccgcguccucggcgccaaccucuacucccccgccuucucccaguccaccuacgucgccgagguccgcgagaacgucgccgccggcaccaaggucauccacguccgcgccaccgacggcgaccccggcaccuacggccagaucuccuacgccaucaucaacgacuucgccaaggaccgcuuccucaucgacuccaacggccaggucaucaccaccgagcgccucgaccgcgagaacccccucgagggcgacgucuccaucuucguccgcgcccucgacggcggcggccgcaccaccuucugcaccguccgcgucaucgucgucgacgagaacgacaacgccccccaguucaugaccgucgaguaccgcgccuccguccgcgccgacgucggccgcggccaccucgucacccagguccaggccaucgaccccgacgacggcgccaacucccgcaucaccuacucccucuacuccgaggccuccgucuccgucgccgaccuccucgagaucgaccccgacaacggcuggauggucaccaagggcaacuucaaccagcucaagaacaccguccucuccuucuucgucaaggccgucgacggcggcauccccgucaagcacucccucauccccgucuacauccacguccucccccccgagaccuuccuccccuccuucacccagucccaguacuccuucaccaucgccgaggacaccgccaucggcuccaccgucgacacccuccgcauccuccccucccagaacgucugguucuccaccgucaacggcgagcgccccgagaacaacaagggcggcaucuucgucaucgagcaggagaccggcaccaucaagcucgacaagcgccucgaccgcgagaccucccccgccuuccacuucaaggucgccgccaccaucccccucgacaaggucgacaucgucuucaccgucgacgucgacaucaagguccucgaccucaacgacaacaagcccgucuucgagaccuccuccuacgacaccaucaucauggagggcaugcccgucggcaccaagcucacccagguccgcgccaucgacauggacuggggcgccaacggccaggucaccuacucccuccacuccgacucccagcccgagaaggucauggaggccuucaacaucgacuccaacaccggcuggaucuccacccucaaggaccucgaccacgagaccgaccccaccuucaccuucuccgucgucgccuccgaccucggcgaggccuucucccucuccuccaccgcccucgucuccguccgcgucaccgacaucaacgacaacgcccccgucuucgcccaggaggucuaccgcggcaacgucaaggaguccgacccccccggcgaggucgucgccguccucuccaccugggaccgcgacaccuccgacgucaaccgccaggucuccuaccacaucaccggcggcaacccccgcggccgcuucgcccucggccucguccaguccgaguggaaggucuacgucaagcgcccccucgaccgcgaggagcaggacaucuacuuccucaacaucaccgccaccgacggccucuucgucacccaggccauggucgaggucuccgucuccgacgucaacgacaacucccccgucugcgaccaggucgccuacaccgcccuccuccccgaggacauccccuccaacaagaucauccucaaggucuccgccaaggacgccgacaucggcuccaacggcuacauccgcuacucccucuacggcuccggcaacuccgaguucuuccucgaccccgaguccggcgagcucaagacccucgcccuccucgaccgcgagcgcauccccgucuacucccucauggccaaggccaccgacggcggcggccgcuucugccaguccaacauccaccucauccucgaggacgucaacgacaacccccccgucuucuccuccgaccacuacaacaccugcgucuacgagaacaccgccaccaaggcccuccucacccgcguccaggccgucgaccccgacaucggcaucaaccgcaaggucgucuacucccucgccgacuccgccggcggcgucuucuccaucgacuccuccuccggcaucaucauccucgagcagccccucgaccgcgagcagcaguccuccuacaacaucuccguccgcgccaccgaccagucccccggccagucccucuccucccucaccaccgucaccaucaccguccucgacaucaacgacaacccccccgucuucgagcgccgcgacuaccucgucaccguccccgaggacaccucccccggcacccagguccucgccgucuucgccaccuccaaggacaucggcaccaacgccgagaucaccuaccucauccgcuccggcaacgagcagggcaaguucaagaucaaccccaagaccggcggcaucuccgucuccgagguccucgacuacgagcucugcaagcgcuucuaccucgucgucgaggccaaggacggcggcacccccgcccucuccgccgucgccaccgucaacaucaaccucaccgacgucaacgacaacccccccaaguucucccaggacgucuacuccgccgucaucuccgaggacgcccucgucggcgacuccgucauccuccucaucgccgaggacgucgacucccagcccaacggccagauccacuucuccaucgucaacggcgaccgcgacaacgaguucaccgucgaccccguccucggccucgucaaggucaagaagaagcucgaccgcgagcgcgucuccggcuacucccuccucguccaggccgucgacuccggcauccccgccauguccuccaccgccaccgucaacaucgacaucuccgacgucaacgacaacucccccgucuucacccccgccaacuacaccgccgucauccaggagaacaagcccgucggcaccuccauccuccagcucgucgucaccgaccgcgacuccuuccacaacggcccccccuucuccuucuccauccucuccggcaacgaggaggaggaguucguccucgacccccacggcauccuccgcuccgccgucgucuuccagcacaccgagucccucgaguacguccucugcguccaggccaaggacuccggcaagccccagcaggucucccacaccuacauccgcguccgcgucaucgaggaguccacccacaagcccaccgccaucccccucgagaucuucaucgucaccauggaggacgacuuccccggcggcgucaucggcaagauccacgccaccgaccaggacauguacgacguccucaccuucgcccucaaguccgagcagaagucccucuucaaggucaacucccacgacggcaagaucaucgcccucggcggccucgacuccggcaaguacguccucaacgucuccgucuccgacggccgcuuccagguccccaucgacgucgucguccacgucgagcagcucguccacgagaugcuccagaacaccgucaccauccgcuucgagaacgucucccccgaggacuucgucggccuccacaugcacggcuuccgccgcacccuccgcaacgccguccucacccagaagcaggacucccuccgcaucaucuccauccagcccgucgccggcaccaaccagcucgacaugcucuucgccgucgagaugcacuccuccgaguucuacaagcccgccuaccucauccagaagcucuccaacgcccgccgccaccucgagaacaucaugcgcaucuccgccauccucgagaagaacugcuccggccucgacugccaggagcagcacugcgagcagggccucucccucgacucccacgcccucaugaccuacuccaccgcccgcaucuccuucgucugcccccgcuucuaccgcaacguccgcugcaccugcaacggcggccucugccccggcuccaacgaccccugcgucgagaagcccugccccggcgacaugcagugcgucuccuacgaggccucccgccgccccuuccucugccagugcccccccggcaagcucggcgagugcuccggccacaccucccucuccuucgccggcaacuccuacaucaaguaccgccucuccgagaacuccaaggaggaggacuucaagcucgcccuccgccuccgcacccuccaguccaacggcaucaucauguacacccgcgccaaccccugcaucauccucaagaucgucgacggcaagcucugguuccagcucgacugcggcuccggccccggcauccucggcaucuccggccgcgccgucaacgacggcuccuggcacuccgucuuccucgagcucaaccgcaacuucaccucccucucccucgacgacuccuacgucgagcgccgccgcgccccccucuacuuccagacccucuccaccgaguccuccaucuacuucggcgcccucguccaggccgacaacauccgcucccucaccgacacccgcgucacccagguccucuccggcuuccagggcugccucgacuccgucauccucaacaacaacgagcucccccuccagaacaagcgcuccuccuucgccgaggucgucggccucaccgagcucaagcucggcugcguccucuaccccgacgccugcaagcgcucccccugccagcacggcggcuccugcaccggccuccccuccggcggcuaccagugcaccugccucucccaguucaccggccgcaacugcgaguccgagaucaccgccugcuuccccaaccccugccgcaacggcggcuccugcgaccccaucggcaacaccuucaucugcaacugcaaggccggccucaccggcgucaccugcgaggaggacaucaacgagugcgagcgcgaggagugcgagaacggcggcuccugcgucaacgucuucggcuccuuccucugcaacugcacccccggcuacgucggccaguacugcggccuccgccccgucgucguccccaacauccaggccggccacuccuacgucggcaaggaggagcucaucggcaucgccgucguccucuucgucaucuucauccucgucguccucuucaucgucuuccgcaagaaggucuuccgcaagaacuacucccgcaacaacaucacccucguccaggaccccgccaccgccgcccuccucaacaaguccaacggcauccccuuccgcaaccuccgcggcuccggcgacggccgcaacgucuaccaggaggucggccccccccagguccccguccgccccauggccuacacccccugcuuccaguccgacucccgcuccaaccucgacaagaucgucgacggccucggcggcgagcaccaggagaugaccaccuuccaccccgaguccccccgcauccucaccgcccgccgcggcgucgucgucugcuccgucgcccccaaccuccccgccgucucccccugccgcuccgacugcgacuccauccgcaagaacggcugggacgccggcaccgagaacaagggcgucgacgaccccggcgaggucaccugcuucgccggcuccaacaagggcuccaacuccgagguccagucccucuccuccuuccaguccgacuccggcgacgacaacgccuaccacugggacaccuccgacuggaugcccggcgcccgccucuccgacaucgaggagguccccaacuacgagaaccaggacggcggcuccgcccaccagggcuccacccgcgagcucgaguccgacuacuaccucggcggcuacgacaucgacuccgaguacccccccccccacgaggaggaguuccucucccaggaccagcucccccccccccuccccgaggacuuccccgaccaguacgaggcccucccccccucccagcccgucucccucgccuccacccucucccccgacugccgccgccgcccccaguuccaccccucccaguaccuccccccccaccccuuccccaacgagaccgaccucgucggcccccccgccuccugcgaguucuccaccuucgccgucuccaugaaccagggcaccgagcccaccggccccgccgacuccgucucccucucccuccacaacucccgcggcaccuccuccuccgacgucuccgccaacugcggcuucgacgacuccgaggucgccauguccgacuacgaguccgucggcgagcucucccucgccucccuccacauccccuucgucgagacccagcaccagacccaggucuga

SEQ ID NO: 43078 - RNA, 14946 nt, Artificial Sequence
  derived and/or modified sequence opt2 from FAT4__Homo_sapiens__NP_078858
auggaccucgcccccgaccgcgccaccggccgccccuggcucccccuccacacccucuccgucucccagcuccuccgcgucuucuggcuccucucccuccuccccggccaggccuggguccacggcgccgagccccgccaggucuuccagguccucgaggagcagccccccggcacccucgucggcaccauccagacccgccccggcuucaccuaccgccucuccgagucccacgcccucuucgccaucaacuccuccaccggcgcccucuacaccaccuccaccaucgaccgcgagucccuccccuccgacgucaucaaccucgucguccucuccuccgcccccaccuaccccaccgagguccgcguccucguccgcgaccucaacgacaacgcccccgucuuccccgaccccuccaucgucgucaccuucaaggaggacuccuccuccggccgccaggucauccucgacaccgccaccgacuccgacaucggcuccaacggcgucgaccaccgcuccuaccgcaucauccgcggcaacgaggccggccgcuuccgccucgacaucacccucaaccccuccggcgagggcgccuuccuccaccucgucuccaagggcggccucgaccgcgaggucaccccccaguaccagcuccucgucgaggucgaggacaagggcgagcccaagcgccgcggcuaccuccaggucaacgucaccguccaggacaucaacgacaacccccccgucuucggcuccucccacuaccaggccggcguccccgaggacgccgucgucggcuccuccguccuccaggucgccgccgccgacgccgacgagggcaccaacgccgacauccgcuaccgccuccaggacgagggcacccccuuccagauggaccccgagaccggccucaucaccguccgcgagccccucgacuucgaggcccgccgccaguacucccucaccguccaggccauggaccgcggcguccccucccucaccggccgcgccgaggcccucauccagcuccucgacgucaacgacaacgaccccgucgucaaguuccgcuacuuccccgccaccucccgcuacgccuccgucgacgagaacgcccaggucggcaccgucgucgcccuccucaccgucaccgacgccgacucccccgccgccaacggcaacaucuccguccagauccucggcggcaacgagcagcgccacuucgagguccaguccuccaagguccccaaccucucccucaucaaggucgccuccgcccucgaccgcgagcgcauccccuccuacaaccucaccgucuccgucuccgacaacuacggcgccccccccggcgccgccguccaggcccgcuccuccgucgccucccucgucaucuucgucaacgacaucaacgaccacccccccgucuucucccagcaggucuaccgcgucaaccucuccgaggaggccccccccggcuccuacgucuccggcaucuccgccaccgacggcgacuccggccucaacgccaaccuccgcuacuccaucgucuccggcaacggccucggcugguuccacaucuccgagcacuccggccucgucaccaccggcuccuccggcggccucgaccgcgagcucgccucccagaucguccucaacaucuccgcccgcgaccagggcguccaccccaaggucuccuacgcccagcucgucgucacccuccucgacgucaacgacgagaagcccgucuucucccagcccgagggcuacgacgucuccgucgucgagaacgcccccaccggcaccgagcuccucaugcuccgcgccaccgacggcgaccucggcgacaacggcaccguccgcuucucccuccaggaggccgagaccgaccgccgcuccuuccgccucgaccccgucuccggccgccucuccaccaucuccucccucgaccgcgaggagcaggccuucuacucccuccucguccucgccaccgaccucggcucccccccccaguccuccauggcccgcaucaacgucucccuccucgacaucaacgacaacucccccgucuucuaccccguccaguacuucgcccacaucaaggagaacgagcccggcggcuccuacaucaccaccgucuccgccaccgaccccgaccucggcaccaacggcaccgucaaguacuccaucuccgccggcgaccgcucccgcuuccaggucaacgcccaguccggcgucaucuccacccgcauggcccucgaccgcgaggagaagaccgccuaccagcuccagaucgucgccaccgacggcggcaaccuccagucccccaaccaggccaucgucaccaucaccguccucgacacccaggacaacccccccgucuucucccaggucgccuacuccuucgucgucuucgagaacgucgcccucggcuaccacgucggcuccgucuccgccuccaccauggaccucaacuccaacaucuccuaccucaucaccaccggcgaccagaagggcauguucgccaucaaccaggucaccggccagcucaccaccgccaacgucaucgaccgcgaggagcaguccuucuaccagcucaaggucgucgccuccggcggcaccgucaccggcgacaccauggucaacaucaccgucaaggaccucaacgacaacuccccccacuuccuccaggccaucgaguccgucaacgucgucgagaacuggcaggccggccacuccaucuuccaggccaaggccgucgaccccgacgagggcgucaacggcaugguccucuacucccucaagcagaaccccaagaaccucuucgccaucaacgagaagaacggcaccaucucccuccucggcccccucgacguccacgccggcuccuaccagaucgagauccucgccuccgacaugggcgucccccagcucuccuccuccgucauccucaccgucuacguccacgacgucaacgacaacucccccgucuucgaccagcucuccuacgaggucacccucuccgaguccgagcccgucaacucccgcuucuucaagguccaggccuccgacaaggacuccggcgccaacggcgagaucgccuacaccaucgccgagggcaacaccggcgacgccuucggcaucuuccccgacggccagcucuacaucaaguccgagcucgaccgcgagcuccaggaccgcuacguccucauggucgucgccuccgaccgcgccgucgagccccucuccgccaccgucaacgucaccgucauccucgaggacgucaacgacaaccgcccccucuucaacuccaccaacuacaccuucuacuucgaggaggagcagcgcgccggcuccuucgucggcaaggucuccgccgucgacaaggacuucggccccaacggcgagguccgcuacuccuucgagaugguccagcccgacuucgagcuccacgccaucuccggcgagaucaccaacacccaccaguucgaccgcgagucccucaugcgccgccgcggcaccgccgucuucuccuucaccgucaucgccaccgaccagggcaucccccagccccucaaggaccaggccaccguccacgucuacaugaaggacaucaacgacaacgcccccaaguuccucaaggacuucuaccaggccaccaucuccgaguccgccgccaaccucacccagguccuccgcgucuccgccuccgacgucgacgagggcaacaacggccucauccacuacuccaucaucaagggcaacgaggagcgccaguucgccaucgacuccaccuccggccaggucacccucaucggcaagcucgacuacgaggccacccccgccuacucccucgucauccaggccgucgacuccggcaccaucccccucaacuccaccugcacccucaacaucgacauccucgacgagaacgacaacacccccuccuuccccaaguccacccucuucgucgacguccucgagaacaugcgcaucggcgagcucgucuccuccgucaccgccaccgacuccgacuccggcgacaacgccgaccucuacuacuccaucaccggcaccaacaaccacggcaccuucuccaucucccccaacaccggcuccaucuuccucgccaagaagcucgacuucgagacccagucccucuacaagcucaacaucaccgccaaggaccagggccgccccccccgcuccuccaccauguccgucgucauccacguccgcgacuucaacgacaacccccccuccuucccccccggcgacaucuucaaguccaucgucgagaacauccccaucggcaccuccgucaucuccgucaccgcccacgaccccgacgccgacaucaacggccagcucuccuacaccaucauccagcagaugccccgcggcaaccacuucaccaucgacgaggucaagggcaccaucuacaccaacgccgagaucgaccgcgaguucgccaaccucuucgagcucaccgucaaggccaacgaccaggccguccccaucgagacccgccgcuacgcccucaagaacgucaccauccucgucaccgaccucaacgacaacguccccauguucaucucccagaacgcccucgccgccgaccccuccgccgucaucggcuccguccucaccaccaucauggccgccgaccccgacgagggcgccaacggcgagaucgaguacgagaucaucaacggcgacaccgacaccuucaucgucgaccgcuacuccggcgaccuccgcgucgccuccgcccucguccccucccagcucaucuacaaccucaucgucuccgccaccgaccucggccccgagcgccgcaaguccaccaccgagcucaccaucauccuccagggccucgacggccccgucuucacccagcccaaguacaucaccauccucaaggagggcgagcccaucggcaccaacgucaucuccaucgaggccgccuccccccgcggcuccgaggcccccgucgaguacuacaucgucuccguccgcugcgaggagaagaccgucggccgccucuucaccaucggccgccacaccggcaucauccagaccgccgccauccucgaccgcgagcagggcgccugccucuaccucgucgacgucuacgccaucgagaaguccaccgccuucccccgcacccagcgcgccgaggucgagaucacccuccaggacaucaacgacaacccccccgucuuccccaccgacaugcucgaccucaccgucgaggagaacaucggcgacggcuccaagaucaugcagcucaccgccauggacgccgacgagggcgccaacgcccucgucaccuacaccaucaucuccggcgccgacgacuccuuccgcaucgaccccgaguccggcgaccucaucgccacccgccgccucgaccgcgagcgccgcuccaaguacucccuccucguccgcgccgacgacggccuccaguccuccgacaugcgcaucaacaucaccgucuccgacgucaacgaccacacccccaaguucucccgccccgucuacuccuucgacauccccgaggacaccauccccggcucccucgucgccgccauccucgccaccgacgacgacuccggcgucaacggcgagaucaccuacaucgucaacgaggacgacgaggacggcaucuucuuccucaaccccaucaccggcgucuucaaccucacccgccuccucgacuacgagguccagcaguacuacauccucaccguccgcgccgaggacggcggcggccaguucaccaccauccgcgucuacuucaacauccucgacgucaacgacaacccccccaucuucucccucaacuccuacuccaccucccucauggagaaccuccccgucggcuccaccguccucgucuucaacgucaccgacgccgacgacggcaucaacucccagcucaccuacuccaucgccuccggcgacucccucggccaguucaccgucgacaagaacggcguccucaagguccucaaggcccucgaccgcgagucccaguccuucuacaaccucgucguccagguccacgaccucccccagauccccgccucccgcuucaccuccaccgcccaggucuccaucauccuccucgacgucaacgacaacccccccaccuuccucucccccaagcucaccuacauccccgagaacacccccaucgacaccgucgucuucaaggcccaggccaccgaccccgacuccggccccaacuccuacaucgaguacacccuccucaacccccucggcaacaaguucuccaucggcaccaucgacggcgagguccgccucaccggcgagcucgaccgcgaggaggucuccaacuacacccucaccgucgucgccaccgacaagggccagcccucccucuccuccuccaccgaggucgucgucaugguccucgacaucaacgacaacaaccccaucuucgcccaggcccucuacaaggucgagaucaacgagaacacccucaccggcaccgacaucauccaggucuucgccgccgacggcgacgagggcaccaacggccagguccgcuacggcaucgucaacggcaacaccaaccaggaguuccgcaucgacuccgucaccggcgccaucaccgucgccaagccccucgaccgcgagaagacccccaccuaccaccucaccguccaggccaccgaccgcggcuccaccccccgcaccgacaccuccaccgucuccaucguccuccucgacaucaacgacuucguccccgucuucgagcucucccccuacuccgucaacguccccgagaaccucggcacccucccccgcaccauccuccaggucgucgcccgcgacgacgaccgcggcuccaacuccaagcucuccuacguccucuucggcggcaacgaggacaacgccuucacccucuccgccuccggcgagcucggcgucacccagucccucgaccgcgagaccaaggagcgcuucguccucaugaucaccgccaccgacuccggcucccccgcccucaccggcaccggcaccaucaacgucaucgucgacgacgucaacgacaacguccccaccuucgccuccaaggccuacuucaccaccauccccgaggacgcccccaccggcaccgacguccuccucgucaacgccuccgacgccgacgccuccaagaacgccgucauccgcaucaucggcggcaacucccaguucaccaucaaccccuccaccggccagaucaucaccuccgcccuccucgaccgcgagaccaaggacaacuacacccucgucgucgucugcuccgacgccggcucccccgagccccucuccuccuccaccuccguccucgucaccgucaccgacgucaacgacaaccccccccgcuuccagcaccaccccuacgucacccacauccccucccccacccuccccggcuccuucgucuucgccgucaccgucaccgacgccgacaucggccccaacuccgagcuccacuacucccucuccggccgcaacuccgagaaguuccacaucgacccccuccgcggcgccaucauggccgccggcccccucaacggcgccuccgaggucaccuucuccguccacgucaaggacggcggcuccuuccccaagaccgacuccaccaccgucaccguccgcuucgucaacaaggccgacuuccccaagguccgcgccaaggagcagaccuucauguuccccgagaaccagcccgucuccucccucgucaccaccaucaccggcuccucccuccgcggcgagcccauguccuacuacaucgccuccggcaaccucggcaacaccuuccagaucgaccagcucaccggccaggucuccaucucccagccccucgacuucgagaagauccagaaguacgucgucuggaucgaggcccgcgacggcggcuucccccccuucuccuccuacgagaagcucgacaucaccguccucgacgucaacgacaacgcccccaucuucaaggaggaccccuucaucuccgagauccucgagaaccucuccccccgcaagauccucaccgucuccgccauggacaaggacuccggccccaacggccagcucgacuacgagaucgucaacggcaacauggagaacuccuucuccaucaaccacgccaccggcgagauccgcuccguccgcccccucgaccgcgagaaggucucccacuacguccucaccaucaaguccuccgacaagggcucccccucccaguccaccuccgucaaggucaugaucaacauccucgacgagaacgacaacgccccccgcuucucccagaucuucuccgcccacguccccgagaacuccccccucggcuacaccgucacccgcgucaccaccuccgacgaggacaucggcaucaacgccaucucccgcuacuccaucauggacgccucccuccccuucaccaucaaccccuccaccggcgacaucgucaucucccgcccccucaaccgcgaggacaccgaccgcuaccgcauccgcgucuccgcccacgacuccggcuggaccgucuccaccgacgucaccaucuucgucaccgacaucaacgacaacgccccccgcuucucccgcaccuccuacuaccucgacugccccgagcucaccgagaucggcuccaaggucacccaggucuucgccaccgaccccgacgagggcuccaacggccaggucuucuacuucaucaagucccaguccgaguacuuccgcaucaacgccaccaccggcgagaucuucaacaagcagauccucaaguaccagaacgucaccggcuucuccaacgucaacaucaaccgccacuccuucaucgucaccuccuccgaccgcggcaagcccucccucaucuccgagaccaccgucaccaucaacaucgucgacuccaacgacaacgccccccaguuccucaaguccaaguacuucacccccgucaccaagaacgucaaggucggcaccaagcucauccgcgucaccgccaucgacgacaaggacuucggccucaacuccgaggucgaguacuucaucuccaacgacaaccaccucggcaaguucaagcucgacaacgacaccggcuggaucuccgucgccuccucccucaucuccgaccucaaccagaacuucuucaucaccgucaccgccaaggacaagggcaaccccccccucuccucccaggccaccguccacaucaccgucaccgaggagaacuaccacacccccgaguucucccagucccacauguccgccaccauccccgagucccacuccaucggcuccaucguccgcaccgucuccgcccgcgaccgcgacgccgccaugaacggccucaucaaguacuccaucuccuccggcaacgaggagggcaucuucgccaucaacuccuccaccggcauccucacccucgccaaggcccucgacuacgagcucugccagaagcacgagaugaccaucuccgccaucgacggcggcugggucgcccgcaccggcuacugcuccgucaccgucaacgucaucgacgucaacgacaacucccccgucuuccucuccgacgacuacuuccccaccguccucgagaacgcccccuccggcaccaccgucauccaccucaacgccaccgacgccgacuccggcaccaacgccgucaucgccuacaccguccaguccuccgacuccgaccucuucgucaucgaccccaacaccggcgucaucaccacccagggcuuccucgacuucgagaccaagcaguccuaccaccucaccgucaaggccuucaacguccccgacgaggagcgcugcuccuucgccaccgucaacauccagcucaagggcaccaacgaguacgucccccgcuucgucuccaagcucuacuacuucgagaucuccgaggccgcccccaagggcaccaucgucggcgaggucuucgccuccgaccgcgaccucggcaccgacggcgagguccacuaccucaucuucggcaacucccgcaagaagggcuuccagaucaacaagaagaccggccagaucuacgucuccggcauccucgaccgcgagaaggaggagcgcgucucccucaagguccucgccaagaacuucggcuccauccgcggcgccgacaucgacgaggucaccgucaacgucaccguccucgacgccaacgacccccccaucuucacccucaacaucuacuccguccagaucuccgagggcguccccaucggcacccacgucaccuucgucuccgccuucgacuccgacuccauccccuccuggucccgcuucuccuacuucaucggcuccggcaacgagaacggcgccuucuccaucaacccccagaccggccagaucaccgucaccgccgagcucgaccgcgagacccuccccaucuacaaccucuccguccucgccgucgacuccggcacccccuccgccaccggcuccgccucccuccucgucacccucgaggacaucaacgacaacggccccaugcucaccgucuccgagggcgaggucauggagaacaagcgccccggcacccucgucaugacccuccaguccaccgaccccgaccucccccccaaccagggccccuucaccuacuaccuccucuccaccggccccgccaccuccuacuucucccucuccaccgccggcguccucuccaccacccgcgagaucgaccgcgagcagaucgccgacuucuaccucuccgucgucaccaaggacuccggcgucccccagauguccuccaccggcaccguccacaucaccgucaucgaccagaacgacaaccccucccagucccgcaccgucgagaucuucgucaacuacuacggcaaccucuuccccggcggcauccucggcuccgucaagccccaggaccccgacguccucgacuccuuccacugcucccucaccuccggcgucaccucccucuucuccauccccggcggcaccugcgaccucaacucccagccccgcuccaccgacggcaccuucgaccucaccguccucuccaacgacggcguccacuccaccgucaccuccaacauccgcgucuucuucgccggcuucuccaacgccaccgucgacaacuccauccuccuccgccucggcguccccaccgucaaggacuuccucaccaaccacuaccuccacuuccuccgcaucgccuccucccagcucaccggccucggcaccgccguccagcucuacuccgccuacgaggagaacaaccgcaccuuccuccucgccgccgucaagcgcaaccacaaccaguacgucaaccccuccggcgucgccaccuucuucgaguccaucaaggagauccuccuccgccaguccggcgucaaggucgaguccgucgaccacgacuccugcguccacggccccugccagaacggcggcuccugccuccgccgccucgccgucuccuccguccucaagucccgcgagucccuccccgucaucaucgucgccaacgagccccuccagcccuuccucugcaagugccuccccggcuacgccggcuccuggugcgagaucgacaucgacgagugccuccccucccccugccacuccggcggcaccugccacaaccucgucggcggcuucuccugcuccugccccgacggcuucaccggccgcgccugcgagcgcgacaucaacgagugccuccagucccccugcaagaacggcgccaucugccagaacuuccccggcuccuucaacugcgucugcaagaccggcuacaccggcaagaugugcgaguccuccgucaacuacugcgagugcaaccccugcuucaacggcggcuccugccaguccggcgucgacuccuacuacugccacugccccuucggcgucuucggcaagcacugcgagcucaacuccuacggcuucgaggagcucuccuacauggaguuccccucccucgaccccaacaacaacuacaucuacgucaaguucgccaccaucaagucccacgcccuccuccucuacaacuacgacaaccagaccggcgaccgcgccgaguuccucgcccucgagaucgccgaggagcgccuccgcuucuccuacaaccucggcuccggcaccuacaagcucaccaccaugaagaaggucuccgacggccacuuccacaccgucaucgcccgccgcgccggcauggccgccucccucaccgucgacuccugcuccgagaaccaggagcccggcuacugcaccgucuccaacgucgccgucuccgacgacuggacccucgacguccagcccaaccgcgucaccgucggcggcauccgcucccucgagcccauccuccagcgccgcggccacgucgagucccacgacuucgucggcugcaucauggaguucgccgucaacggccgcccccucgagcccucccaggcccucgccgcccagggcauccucgaccagugcccccgccucgagggcgccugcacccgcucccccugccagcacggcggcaccugcauggacuacugguccuggcagcagugccacugcaaggagggccucaccggcaaguacugcgagaaguccgucacccccgacaccgcccucucccucgagggcaagggccgccucgacuaccacaugucccagaacgagaagcgcgaguaccuccuccgccagucccuccgcggcgccaugcucgagcccuucggcgucaacucccucgaggucaaguuccgcacccgcuccgagaacggcguccucauccacauccaggaguccuccaacuacaccaccgucaagaucaagaacggcaaggucuacuucaccuccgacgccggcaucgccggcaaggucgagcgcaacauccccgaggucuacgucgccgacggccacuggcacaccuuccucaucggcaagaacggcaccgccaccguccucuccgucgaccgcaucuacaaccgcgacaucauccaccccacccaggacuucggcggccucgacguccucaccaucucccucggcggcaucccccccaaccaggcccaccgcgacgcccagaccgccggcuucgacggcugcaucgccuccaugugguacggcggcgagucccuccccuucuccggcaagcacucccucgccuccaucuccaagaccgaccccuccgucaagaucggcugccgcggccccaacaucugcgccuccaaccccugcuggggcgaccuccucugcaucaaccagugguacgccuaccgcugcgucccccccggcgacugcgccucccaccccugccagaacggcggcuccugcgagcccggccuccacuccggcuucaccugcuccugccccgacucccacaccggccgcaccugcgagauggucgucgccugccucggcguccucugcccccagggcaaggucugcaaggccggcucccccgccggccacgucugcguccucucccagggccccgaggagaucucccucccccucugggccguccccgccaucgucggcuccugcgccaccguccucgcccuccucguccucucccucauccucugcaaccagugccgcggcaagaaggccaagaaccccaaggaggagaagaagcccaaggagaagaagaagaagggcuccgagaacgucgccuucgacgaccccgacaacaucccccccuacggcgacgacaugaccguccgcaagcagcccgagggcaaccccaagcccgacaucaucgagcgcgagaaccccuaccucaucuacgacgagaccgacaucccccacaacuccgagaccauccccuccgccccccucgccucccccgagcaggagaucgagcacuacgacaucgacaacgccuccuccaucgcccccuccgacgccgacaucauccagcacuacaagcaguuccgcucccacacccccaaguucuccauccagcgccacuccccccucggcuucgcccgccagucccccaugccccucggcgccuccucccucaccuaccagcccuccuacggccagggccuccgcaccuccucccucucccacuccgccugccccacccccaacccccucucccgccacucccccgcccccuucuccaaguccuccaccuucuaccgcaacucccccgcccgcgagcuccaccuccccauccgcgacggcaacacccucgagaugcacggcgacaccugccagcccggcaucuucaacuacgccacccgccucggccgccgcuccaaguccccccaggccauggccucccacggcucccgccccggcucccgccucaagcagcccaucggccagaucccccucgaguccuccccccccgucggccucuccaucgaggaggucgagcgccucaacaccccccgcccccgcaaccccuccaucugcuccgccgaccacggccgcuccuccuccgaggaggacugccgccgcccccucucccgcacccgcaaccccgccgacggcauccccgcccccgaguccuccuccgacuccgacucccacgaguccuucaccugcuccgagauggaguacgaccgcgagaagcccauggucuacaccucccgcaugcccaagcucucccaggucaacgaguccgacgccgacgacgaggacaacuacggcgcccgccucaagccccgccgcuaccacggccgccgcgccgagggcggccccgucggcacccaggccgccgcccccggcaccgccgacaacacccuccccaugaagcucggccagcaggccggcaccuucaacugggacaaccuccucaacuggggccccggcuucggccacuacgucgacgucuucaaggaccucgccucccuccccgagaaggccgccgccaacgaggagggcaaggccggcaccaccaagcccguccccaaggacggcgaggccgagcaguacgucuga

SEQ ID NO: 43079 - RNA, 552 nt, Artificial Sequence
  derived and/or modified sequence opt2 from FATE1__Homo_sapiens__NP_149076
auggccggcggcccccccaacaccaaggccgagauggagaugucccucgccgaggagcucaaccacggccgccagggcgagaaccaggagcaccucgucaucgccgagaugauggagcucggcucccgcucccgcggcgccucccagaagaagcagaagcucgagcagaaggccgccggcuccgccuccgccaagcgcgucuggaacaugaccgccacccgccccaagaagaugggcucccagcuccccaagccccgcaugcuccgcgaguccggccacggcgacgcccaccuccaggaguacgccggcaacuuccagggcauccgcuuccacuacgaccgcaaccccggcaccgacgccgucgcccagaccucccucgaggaguucaacguccucgagauggaggucaugcgccgccagcucuacgccgucaaccgccgccuccgcgcccucgaggagcagggcgccaccuggcgccaccgcgagacccucaucaucgccguccucgucuccgccuccaucgccaaccucuggcucuggaugaaccaguga

SEQ ID NO: 43080 - RNA, 402 nt, Artificial Sequence
  derived and/or modified sequence opt2 from FAU__Homo_sapiens__NP_001988
augcagcucuucguccgcgcccaggagcuccacaccuucgaggucaccggccaggagaccgucgcccagaucaaggcccacgucgccucccucgagggcaucgcccccgaggaccaggucguccuccucgccggcgccccccucgaggacgaggccacccucggccagugcggcgucgaggcccucaccacccucgaggucgccggccgcaugcucggcggcaagguccacggcucccucgcccgcgccggcaagguccgcggccagacccccaaggucgccaagcaggagaagaagaagaagaagaccggccgcgccaagcgccgcaugcaguacaaccgccgcuucgucaacgucguccccaccuucggcaagaagaagggccccaacgccaacuccuga

SEQ ID NO: 43081 - RNA, 3402 nt, Artificial Sequence
  derived and/or modified sequence opt2 from FBF1__Homo_sapiens__NP_001074011
auggcccccaagaccaagaagggcugcaaggucacccuccccgagaagcccgucaagcucgccucccacacccgcgacaccaccggcgucucccagauguuccccuccuccaaggcccgcaccaagucccuccucggcgacgacgucuucuccaccauggccggccucgaggaggccgacgccgaggucuccggcaucuccgaggccgacccccaggcccuccuccaggccaugaaggaccucgacggcauggacgccgacauccucggccucaagaaguccaacuccgcccccuccaagaaggccgccaaggaccccggcaagggcgagcuccccaaccaccccaagcccgccggcggcgccauccccaccaagaagucccuccccucccccuccuccuccggccaccagaaccgccgcuucuccuccgaggaccucgaggacccccuccgcggccuccucuccuacgacgagggcggcaucaccaagcagccccccgucacccaguccaagaccgccuccgacaagucccccuccaccguccgcgaccagggccccuccaucccccucacccccggcgacacccccauccgcaagaaggaggagcuccucuucgacgacggcgacgacaucauggccacccucggcuucggcgacucccccaaggccgagaagcgccagaucggcgaccaggagggcccccgccccgcccgcuccacccucgacgagcuccucggccgcggcauggccaccaagcuccucgcccgccccggcaccggcgagcaccgcgaguucaagcucgacaagaaguaccagcgcccccaggacuccgaggacauguggggcgacgaggacuucaccuucggcgccuaccagcccaccgucgucuccuccgagggccgccagucccgccgccaguccguccgcuucuucgccgacuccggcgccgaccccaagggcgagcccggcuccaagcaguccccccccauggccuccucccccauccagccccgcaagggcggcgccgacuggcucggccucaaggacgaggaccucgaccucuuccccgccucccccacccgcgaggcccaccgcgaguccuccguccccgucacccccuccguccccccccccgccucccagcacuccacccccgccggccucccccccucccgcgccaagccccccaccgagggcgccggcucccccgccaaggccucccaggccuccaagcuccgcgccuccaaggaggagaaggaggacuggcucucccacgcccucucccgcaagaagucccagggccucgcccgcgagcagcacgccggcaccuccgagggccuccaccucgccggcaccgccggccacccccccuccggcucccagccccucaccuccacccagggccucgagcacgccgccgccggcggcuccuccggcaccaccgcccgcgagcgccccugcguccgccccggcgucuccggcucccccgucacccagaaccacgccgccuccgcccuccccaccggcucccccaagcgcggcaccgcccccggcgaccucuccgccaccgagcccgccaccugcuuccccuccacccagaagcccaccgagcccuccguccccguccagccccuccuccccgagucccucgcccgcucccuccuccccuccaccgaguaccagaagcagcuccucgccgcccagguccagcuccagugcucccccgccgagcuccaggccgagcuccuccacucccaggcccgccucgccgagcucgaggcccagguccgcaagcucgagcucgagcgcgcccagcacgagcuccuccucggcucccuccagcagcagcaccaggccgaccucgagcucaucgaguccgcccaccgcucccgcaucaagguccucgagaccuccuaccagcagcgcgaggagcgccuccgccgcgagaacgaggagcucuccgcccgcuaccucucccagugccaggaggccgagcaggcccgcgccgagcucaccgcccagcaccagcgccgccucgccgccaucgcccaggagaaggaccaggagauggagcgccuccgcgagcuccagcgcgccuccauccucgacaugcgccgcgaccacgaggagcagcuccagcgccucaagcuccucaaggaccgcgaggucgacgccgccaccuccgccaccucccacacccgcucccucaacuccaucauccaccagauggagaaguucuccuccucccuccacgagcucuccucccgcgucgaggccucccaccucaccaccucccaggagcgcgagcucggcauccgccagcgcgacgagcagcuccgcgcccuccaggagcgccucggccagcagcagcgcgacauggaggaggagcgcucccgccagcaggaggucaucggcaagauggaggcccgccucaacgagcagucccgccuccucgagcaggagcgcuggcgcgucaccgccgagcaguccaaggccgaguccaugcagcgcgcccucgaggagcagcgcaaggucaccgcccagcagauggccauggagcgcgccgagcucgagcgcgccaaguccgcccuccucgaggagcagaaguccgucaugcucaagugcggcgaggagcgccgccgccucgccgccgagugggccgaguucuccgcccagcagaagcucuccaaggagcgcgccgagcgcgaggccgagcgcgcccuccaggucgacacccagcgcgagggcacccucaucucccucgccaaggagcaggccgagcucaagauccgcgccuccgagcuccgcgccgaggagaagcagcucgccgccgagcgcgccgcccucgagcaggagcgccaggagcuccgccucgagaaggagcgcaucaacgccaccgcccuccgcgucaagcuccgcgccgaggaggucgaguccauguccaaggucgccuccgagaaguacgaggagggcgagcgcgcccuccgcgaggcccagcagguccaggccgagcagcaggcccgccuccaggccguccagcagcagcaggagcgccuccgcaagcaggagcagcacaugcaccaggagcaccucucccucgcccagcagcgccuccagcucgaccgcgcccgccaggaccuccccuccucccucgucggccucuucccccgcgcccagggccccgccgccuccucccaguccgcccucaugccccccgcccccaccacccgcuggugcucccagccccccaccggccucgaccccuccccccuccaccuccacgcccgccucgcccuccuccgccacauggccgagcaggaccgcgacuuccucgagaacgagcaguucuuccucgagacccucaagaagggcuccuacaaccucaccucccacuccgccuga

SEQ ID NO: 43082 - RNA, 966 nt, Artificial Sequence
  derived and/or modified sequence opt2 from FBL__Homo_sapiens__NP_001427
augaagcccggcuucuccccccgcggcggcggcuucggcggccgcggcggcuucggcgaccgcggcggccgcggcggccgcggcggcuucggcggcggccgcggccgcggcggcggcuuccgcggccgcggccgcggcggcggcggcggcggcggcggcggcggcggcggcggccgcggcggcggcggcuuccacuccggcggcaaccgcggccgcggccgcggcggcaagcgcggcaaccaguccggcaagaacgucauggucgagccccaccgccacgagggcgucuucaucugccgcggcaaggaggacgcccucgucaccaagaaccucguccccggcgaguccgucuacggcgagaagcgcgucuccaucuccgagggcgacgacaagaucgaguaccgcgccuggaaccccuuccgcuccaagcucgccgccgccauccucggcggcgucgaccagauccacaucaagcccggcgccaagguccucuaccucggcgccgccuccggcaccaccgucucccacgucuccgacaucgucggccccgacggccucgucuacgccgucgaguucucccaccgcuccggccgcgaccucaucaaccucgccaagaagcgcaccaacaucauccccgucaucgaggacgcccgccacccccacaaguaccgcaugcucaucgccauggucgacgucaucuucgccgacgucgcccagcccgaccagacccgcaucgucgcccucaacgcccacaccuuccuccgcaacggcggccacuucgucaucuccaucaaggccaacugcaucgacuccaccgccuccgccgaggccgucuucgccuccgaggucaagaagaugcagcaggagaacaugaagccccaggagcagcucacccucgagcccuacgagcgcgaccacgccgucgucgucggcgucuaccgccccccccccaaggucaagaacuga

SEQ ID NO: 43083 - RNA, 945 nt, Artificial Sequence
  derived and/or modified sequence opt2 from FBLIM1__Homo_sapiens__XP_011539920
auggccuccaagcccgagaagcgcgucgccuccuccgucuucaucacccucgcccccccccgccgcgacgucgccgucgccgaggagguccgccaggccgucugcgaggcccgccgcggccgccccugggaggcccccgcccccaugaagacccccgaggccggccucgccggccgccccucccccuggaccacccccggccgcgccgccgccaccguccccgccgcccccaugcagcucuucaacggcggcugccccccccccccccccguccucgacggcgaggacguccuccccgaccucgaccuccucccccccccccccccccccccccccguccuccuccccuccgaggaggaggcccccgcccccaugggcgccucccucaucgccgaccucgagcagcuccaccucucccccccccccccccccccccaggcccccgccgagggccccuccguccagcccggcccccuccgccccauggaggaggagcucccccccccccccgccgagcccgucgagaagggcgccuccaccgacaucugcgccuucugccacaagaccgucuccccccgcgagcucgccgucgaggccaugaagcgccaguaccacgcccagugcuucaccugccgcaccugccgccgccagcucgccggccaguccuucuaccagaaggacggccgcccccucugcgagcccugcuaccaggacacccucgagcgcugcggcaagugcggcgaggucguccgcgaccacaucauccgcgcccucggccaggccuuccaccccuccugcuucaccugcgucaccugcgcccgcugcaucggcgacgaguccuucgcccucggcucccagaacgaggucuacugccucgacgacuucuaccgcaccgccggcuccuccugccucuccuccccccgcaccaaggccgccacccccuga

SEQ ID NO: 43084 - RNA, 2052 nt, Artificial Sequence
  derived and/or modified sequence opt2 from FBLN1__Homo_sapiens__NP_001987
auggagcgcgccgcccccucccgccgcgucccccucccccuccuccuccucggcggccucgcccuccucgccgccggcgucgacgccgacguccuccucgaggccugcugcgccgacggccaccgcauggccacccaccagaaggacugcucccuccccuacgccaccgaguccaaggagugccgcaugguccaggagcagugcugccacucccagcucgaggagcuccacugcgccaccggcaucucccucgccaacgagcaggaccgcugcgccaccccccacggcgacaacgccucccucgaggccaccuucgucaagcgcugcugccacugcugccuccucggccgcgccgcccaggcccagggccaguccugcgaguacucccucauggucggcuaccagugcggccaggucuuccgcgccugcugcgucaagucccaggagaccggcgaccucgacgucggcggccuccaggagaccgacaagaucaucgaggucgaggaggagcaggaggaccccuaccucaacgaccgcugccgcggcggcggccccugcaagcagcagugccgcgacaccggcgacgaggucgucugcuccugcuucgucggcuaccagcuccucuccgacggcgucuccugcgaggacgucaacgagugcaucaccggcucccacuccugccgccucggcgaguccugcaucaacaccgucggcuccuuccgcugccagcgcgacuccuccugcggcaccggcuacgagcucaccgaggacaacuccugcaaggacaucgacgagugcgaguccggcauccacaacugccuccccgacuucaucugccagaacacccucggcuccuuccgcugccgccccaagcuccagugcaaguccggcuucauccaggacgcccucggcaacugcaucgacaucaacgagugccucuccaucuccgcccccugccccaucggccacaccugcaucaacaccgagggcuccuacaccugccagaagaacguccccaacugcggccgcggcuaccaccucaacgaggagggcacccgcugcgucgacgucgacgagugcgccccccccgccgagcccugcggcaagggccaccgcugcgucaacucccccggcuccuuccgcugcgagugcaagaccggcuacuacuucgacggcaucucccgcaugugcgucgacgucaacgagugccagcgcuaccccggccgccucugcggccacaagugcgagaacacccucggcuccuaccucugcuccugcuccgucggcuuccgccucuccgucgacggccgcuccugcgaggacaucaacgagugcuccuccucccccugcucccaggagugcgccaacgucuacggcuccuaccagugcuacugccgccgcggcuaccagcucuccgacgucgacggcgucaccugcgaggacaucgacgagugcgcccuccccaccggcggccacaucugcuccuaccgcugcaucaacauccccggcuccuuccagugcuccugccccuccuccggcuaccgccucgcccccaacggccgcaacugccaggacaucgacgagugcgucaccggcauccacaacugcuccaucaacgagaccugcuucaacauccagggcggcuuccgcugccucgccuucgagugccccgagaacuaccgccgcuccgccgccacccgcugcgagcgccuccccugccacgagaaccgcgagugcuccaagcucccccuccgcaucaccuacuaccaccucuccuuccccaccaacauccaggcccccgccgucgucuuccgcaugggccccuccuccgccguccccggcgacuccaugcagcucgccaucaccggcggcaacgaggagggcuucuucaccacccgcaaggucuccccccacuccggcgucgucgcccucaccaagcccguccccgagccccgcgaccuccuccucaccgucaagauggaccucucccgccacggcaccgucuccuccuucgucgccaagcucuucaucuucgucuccgccgagcucuga

SEQ ID NO: 43085 - RNA, 3696 nt, Artificial Sequence
  derived and/or modified sequence opt2 from FBLN2__Homo_sapiens__NP_001158507
augguccuccucugggagcccgccggcgccuggcucgcccucggccucgcccucgcccucggccccuccgucgccgccgccgccccccgccaggacugcaccggcgucgagugccccccccucgagaacugcaucgaggaggcccucgagcccggcgccugcugcgccaccugcguccagcagggcugcgccugcgagggcuaccaguacuacgacugccuccagggcggcuucguccgcggccgcguccccgccggccaguccuacuucgucgacuucggcuccaccgagugcuccugcccccccggcggcggcaagaucuccugccaguucaugcucugccccgagcucccccccaacugcaucgaggccgucgucgucgccgacuccugcccccagugcggccaggucggcugcguccacgccggccacaaguacgccgccggccacaccguccaccucccccccugccgcgccugccacugccccgacgccggcggcgagcucaucugcuaccagcuccccggcugccacggcaacuucuccgacgccgaggagggcgaccccgagcgccacuacgaggaccccuacuccuacgaccaggaggucgccgaggucgaggccgccaccgcccucggcggcgagguccaggccggcgccguccaggccggcgccggcggcccccccgccgcccucggcggcggcucccagccccucuccaccauccaggccccccccuggcccgccguccucccccgccccaccgccgccgccgcccucggcccccccgcccccguccaggccaaggcccgccgcgucaccgaggacuccgaggaggaggaggaggaggaggaggagcgcgaggagauggccgucaccgagcagcucgccgccggcggccaccgcggccucgacggccuccccaccaccgcccccgccggccccucccuccccauccaggaggagcgcgccgaggccggcgcccgcgccgaggccggcgcccgccccgaggagaaccucauccucgacgcccaggccaccucccgcuccaccggccccgagggcgucacccacgcccccucccucggcaaggccgcccucguccccacccaggccguccccggcuccccccgcgaccccgucaagcccuccccccacaacauccucuccaccucccuccccgacgccgccuggaucccccccacccgcgaggucccccgcaagccccagguccucccccacucccacgucgaggaggacaccgaccccaacuccguccacuccaucccccgcuccucccccgagggcuccaccaaggaccucaucgagaccugcugcgccgccggccagcagugggccaucgacaacgacgagugccucgagauccccgaguccggcaccgaggacaacgucugccgcaccgcccagcgccacugcugcgucuccuaccuccaggagaaguccugcauggccggcguccucggcgccaaggagggcgagaccugcggcgccgaggacaacgacuccugcggcaucucccucuacaagcagugcugcgacugcugcggccucggccuccgcguccgcgccgagggccaguccugcgaguccaaccccaaccucggcuaccccugcaaccacgucaugcucuccugcugcgagggcgaggagccccucaucguccccgagguccgccgcccccccgagcccgccgccgccccccgccgcgucuccgaggccgagauggccggccgcgaggcccucucccucggcaccgaggccgagcuccccaacucccuccccggcgacgaccaggacgagugccuccuccuccccggcgagcucugccagcaccucugcaucaacaccgucggcuccuaccacugcgccugcuuccccggcuucucccuccaggacgacggccgcaccugccgccccgagggccaccccccccagcccgaggccccccaggagcccgcccucaaguccgaguucucccaggucgccuccaacaccaucccccucccccucccccagcccaacaccugcaaggacaacggccccugcaagcaggucugcuccaccgucggcggcuccgccaucugcuccugcuuccccggcuacgccaucauggccgacggcgucuccugcgaggaccaggacgagugccucaugggcgcccacgacugcucccgccgccaguucugcgucaacacccucggcuccuucuacugcgucaaccacaccguccucugcgccgacggcuacauccucaacgcccaccgcaagugcgucgacaucaacgagugcgucaccgaccuccacaccugcucccgcggcgagcacugcgucaacacccucggcuccuuccacugcuacaaggcccucaccugcgagcccggcuacgcccucaaggacggcgagugcgaggacgucgacgagugcgccaugggcacccacaccugccagcccggcuuccucugccagaacaccaagggcuccuucuacugccaggcccgccagcgcugcauggacggcuuccuccaggaccccgagggcaacugcgucgacaucaacgagugcaccucccucuccgagcccugccgccccggcuucuccugcaucaacaccgucggcuccuacaccugccagcgcaacccccucaucugcgcccgcggcuaccacgccuccgacgacggcaccaagugcgucgacgucaacgagugcgagaccggcguccaccgcugcggcgagggccaggucugccacaaccuccccggcuccuaccgcugcgacugcaaggccggcuuccagcgcgacgccuucggccgcggcugcaucgacgucaacgagugcugggccucccccggccgccucugccagcacaccugcgagaacacccucggcuccuaccgcugcuccugcgccuccggcuuccuccucgccgccgacggcaagcgcugcgaggacgucaacgagugcgaggcccagcgcugcucccaggagugcgccaacaucuacggcuccuaccagugcuacugccgccagggcuaccagcucgccgaggacggccacaccugcaccgacaucgacgagugcgcccagggcgccggcauccucugcaccuuccgcugccucaacguccccggcuccuaccagugcgccugccccgagcagggcuacaccaugaccgccaacggccgcuccugcaaggacgucgacgagugcgcccucggcacccacaacugcuccgaggccgagaccugccacaacauccagggcuccuuccgcugccuccgcuucgagugcccccccaacuacguccaggucuccaagaccaagugcgagcgcaccaccugccacgacuuccucgagugccagaacucccccgcccgcaucacccacuaccagcucaacuuccagaccggccuccucguccccgcccacaucuuccgcaucggccccgcccccgccuucaccggcgacaccaucgcccucaacaucaucaagggcaacgaggagggcuacuucggcacccgccgccucaacgccuacaccggcgucgucuaccuccagcgcgccguccucgagccccgcgacuucgcccucgacgucgagaugaagcucuggcgccagggcuccgucaccaccuuccucgccaagaugcacaucuucuucaccaccuucgcccucuga

SEQ ID NO: 43086 - RNA, 1347 nt, Artificial Sequence
  derived and/or modified sequence opt2 from FBLN5__Homo_sapiens__NP_006320
augcccggcaucaagcgcauccucaccgucaccauccucgcccucugccuccccucccccggcaacgcccaggcccagugcaccaacggcuucgaccucgaccgccaguccggccagugccucgacaucgacgagugccgcaccauccccgaggccugccgcggcgacaugaugugcgucaaccagaacggcggcuaccucugcaucccccgcaccaaccccgucuaccgcggccccuacuccaaccccuacuccacccccuacuccggccccuaccccgccgccgcccccccccucuccgcccccaacuaccccaccaucucccgcccccucaucugccgcuucggcuaccagauggacgaguccaaccagugcgucgacgucgacgagugcgccaccgacucccaccagugcaaccccacccagaucugcaucaacaccgagggcggcuacaccugcuccugcaccgacggcuacuggcuccucgagggccagugccucgacaucgacgagugccgcuacggcuacugccagcagcucugcgccaacguccccggcuccuacuccugcaccugcaaccccggcuucacccucaacgaggacggccgcuccugccaggacgucaacgagugcgccaccgagaaccccugcguccagaccugcgucaacaccuacggcuccuucaucugccgcugcgaccccggcuacgagcucgaggaggacggcguccacugcuccgacauggacgagugcuccuucuccgaguuccucugccagcacgagugcgucaaccagcccggcaccuacuucugcuccugcccccccggcuacauccuccucgacgacaaccgcuccugccaggacaucaacgagugcgagcaccgcaaccacaccugcaaccuccagcagaccugcuacaaccuccagggcggcuucaagugcaucgaccccauccgcugcgaggagcccuaccuccgcaucuccgacaaccgcugcaugugccccgccgagaaccccggcugccgcgaccagcccuucaccauccucuaccgcgacauggacgucgucuccggccgcuccguccccgccgacaucuuccagaugcaggccaccacccgcuaccccggcgccuacuacaucuuccagaucaaguccggcaacgagggccgcgaguucuacaugcgccagaccggccccaucuccgccacccucgucaugacccgccccaucaagggcccccgcgagauccagcucgaccucgagaugaucaccgucaacaccgucaucaacuuccgcggcuccuccgucauccgccuccgcaucuacgucucccaguaccccuucuga

SEQ ID NO: 43087 - RNA, 8616 nt, Artificial Sequence
  derived and/or modified sequence opt2 from FBN1__Homo_sapiens__NP_000129
augcgccgcggccgccuccucgagaucgcccucggcuucaccguccuccucgccuccuacaccucccacggcgccgacgccaaccucgaggccggcaacgucaaggagacccgcgccucccgcgccaagcgccgcggcggcggcggccacgacgcccucaagggccccaacgucugcggcucccgcuacaacgccuacugcugccccggcuggaagacccuccccggcggcaaccagugcaucguccccaucugccgccacuccugcggcgacggcuucugcucccgccccaacaugugcaccugccccuccggccagaucgcccccuccugcggcucccgcuccauccagcacugcaacauccgcugcaugaacggcggcuccugcuccgacgaccacugccucugccagaagggcuacaucggcacccacugcggccagcccgucugcgaguccggcugccucaacggcggccgcugcgucgcccccaaccgcugcgccugcaccuacggcuucaccggcccccagugcgagcgcgacuaccgcaccggccccugcuucaccgucaucuccaaccagaugugccagggccagcucuccggcaucgucugcaccaagacccucugcugcgccaccgucggccgcgccuggggccaccccugcgagaugugccccgcccagccccaccccugccgccgcggcuucauccccaacauccgcaccggcgccugccaggacgucgacgagugccaggccauccccggccucugccagggcggcaacugcaucaacaccgucggcuccuucgagugcaagugccccgccggccacaagcucaacgaggucucccagaagugcgaggacaucgacgagugcuccaccauccccggcaucugcgagggcggcgagugcaccaacaccgucuccuccuacuucugcaagugcccccccggcuucuacaccucccccgacggcacccgcugcaucgacguccgccccggcuacugcuacaccgcccucaccaacggccgcugcuccaaccagcucccccaguccaucaccaagaugcagugcugcugcgacgccggccgcugcuggucccccggcgucaccgucgcccccgagaugugccccauccgcgccaccgaggacuucaacaagcucugcuccguccccauggucauccccggccgccccgaguaccccccccccccccucggccccaucccccccguccuccccgucccccccggcuucccccccggcccccagauccccgucccccgcccccccgucgaguaccucuaccccucccgcgagcccccccgcguccuccccgucaacgucaccgacuacugccagcucguccgcuaccucugccagaacggccgcugcauccccacccccggcuccuaccgcugcgagugcaacaagggcuuccagcucgaccuccgcggcgagugcaucgacgucgacgagugcgagaagaaccccugcgccggcggcgagugcaucaacaaccagggcuccuacaccugccagugccgcgccggcuaccaguccacccucacccgcaccgagugccgcgacaucgacgagugccuccagaacggccgcaucugcaacaacggccgcugcaucaacaccgacggcuccuuccacugcgucugcaacgccggcuuccacgucacccgcgacggcaagaacugcgaggacauggacgagugcuccauccgcaacaugugccucaacggcaugugcaucaacgaggacggcuccuucaagugcaucugcaagcccggcuuccagcucgccuccgacggccgcuacugcaaggacaucaacgagugcgagacccccggcaucugcaugaacggccgcugcgucaacaccgacggcuccuaccgcugcgagugcuuccccggccucgccgucggccucgacggccgcgucugcgucgacacccacaugcgcuccaccugcuacggcggcuacaagcgcggccagugcaucaagccccucuucggcgccgucaccaaguccgagugcugcugcgccuccaccgaguacgccuucggcgagcccugccagcccugccccgcccagaacuccgccgaguaccaggcccucugcuccuccggccccggcaugaccuccgccggcuccgacaucaacgagugcgcccucgaccccgacaucugccccaacggcaucugcgagaaccuccgcggcaccuacaagugcaucugcaacuccggcuacgaggucgacuccaccggcaagaacugcgucgacaucaacgagugcguccucaacucccuccucugcgacaacggccagugccgcaacacccccggcuccuucgucugcaccugccccaagggcuucaucuacaagcccgaccucaagaccugcgaggacaucgacgagugcgaguccucccccugcaucaacggcgucugcaagaacucccccggcuccuucaucugcgagugcuccuccgaguccacccucgaccccaccaagaccaucugcaucgagaccaucaagggcaccugcuggcagaccgucaucgacggccgcugcgagaucaacaucaacggcgccacccucaagucccagugcugcuccucccucggcgccgccuggggcucccccugcacccucugccaggucgaccccaucugcggcaagggcuacucccgcaucaagggcacccagugcgaggacaucgacgagugcgaggucuuccccggcgucugcaagaacggccucugcgucaacacccgcggcuccuucaagugccagugccccuccggcaugacccucgacgccaccggccgcaucugccucgacauccgccucgagaccugcuuccuccgcuacgaggacgaggagugcacccuccccaucgccggccgccaccgcauggacgccugcugcugcuccgucggcgccgccuggggcaccgaggagugcgaggagugccccaugcgcaacacccccgaguacgaggagcucugcccccgcggccccggcuucgccaccaaggagaucaccaacggcaagcccuucuucaaggacaucaacgagugcaagaugauccccucccucugcacccacggcaagugccgcaacaccaucggcuccuucaagugccgcugcgacuccggcuucgcccucgacuccgaggagcgcaacugcaccgacaucgacgagugccgcaucucccccgaccucugcggccgcggccagugcgucaacacccccggcgacuucgagugcaagugcgacgagggcuacgaguccggcuucaugaugaugaagaacugcauggacaucgacgagugccagcgcgacccccuccucugccgcggcggcgucugccacaacaccgagggcuccuaccgcugcgagugcccccccggccaccagcucucccccaacaucuccgccugcaucgacaucaacgagugcgagcucuccgcccaccucugccccaacggccgcugcgucaaccucaucggcaaguaccagugcgccugcaaccccggcuaccacuccacccccgaccgccucuucugcgucgacaucgacgagugcuccaucaugaacggcggcugcgagaccuucugcaccaacuccgagggcuccuacgagugcuccugccagcccggcuucgcccucaugcccgaccagcgcuccugcaccgacaucgacgagugcgaggacaaccccaacaucugcgacggcggccagugcaccaacauccccggcgaguaccgcugccucugcuacgacggcuucauggccuccgaggacaugaagaccugcgucgacgucaacgagugcgaccucaaccccaacaucugccucuccggcaccugcgagaacaccaagggcuccuucaucugccacugcgacaugggcuacuccggcaagaagggcaagaccggcugcaccgacaucaacgagugcgagaucggcgcccacaacugcggcaagcacgccgucugcaccaacaccgccggcuccuucaagugcuccugcucccccggcuggaucggcgacggcaucaagugcaccgaccucgacgagugcuccaacggcacccacaugugcucccagcacgccgacugcaagaacaccaugggcuccuaccgcugccucugcaaggagggcuacaccggcgacggcuucaccugcaccgaccucgacgagugcuccgagaaccucaaccucugcggcaacggccagugccucaacgcccccggcggcuaccgcugcgagugcgacaugggcuucguccccuccgccgacggcaaggccugcgaggacaucgacgagugcucccuccccaacaucugcgucuucggcaccugccacaaccuccccggccucuuccgcugcgagugcgagaucggcuacgagcucgaccgcuccggcggcaacugcaccgacgucaacgagugccucgaccccaccaccugcaucuccggcaacugcgucaacacccccggcuccuacaucugcgacugcccccccgacuucgagcucaaccccacccgcgucggcugcgucgacacccgcuccggcaacugcuaccucgacauccgcccccgcggcgacaacggcgacaccgccugcuccaacgagaucggcgucggcgucuccaaggccuccugcugcugcucccucggcaaggccuggggcacccccugcgagaugugccccgccgucaacaccuccgaguacaagauccucugccccggcggcgagggcuuccgccccaaccccaucaccgucauccucgaggacaucgacgagugccaggagcuccccggccucugccagggcggcaagugcaucaacaccuucggcuccuuccagugccgcugccccaccggcuacuaccucaacgaggacacccgcgucugcgacgacgucaacgagugcgagacccccggcaucugcggccccggcaccugcuacaacaccgucggcaacuacaccugcaucugcccccccgacuacaugcaggucaacggcggcaacaacugcauggacaugcgccgcucccucugcuaccgcaacuacuacgccgacaaccagaccugcgacggcgagcuccucuucaacaugaccaagaagaugugcugcugcuccuacaacaucggccgcgccuggaacaagcccugcgagcagugccccauccccuccaccgacgaguucgccacccucugcggcucccagcgccccggcuucgucaucgacaucuacaccggccuccccgucgacaucgacgagugccgcgagauccccggcgucugcgagaacggcgucugcaucaacauggucggcuccuuccgcugcgagugccccgucggcuucuucuacaacgacaagcuccucgucugcgaggacaucgacgagugccagaacggccccgucugccagcgcaacgccgagugcaucaacaccgccggcuccuaccgcugcgacugcaagcccggcuaccgcuucaccuccaccggccagugcaacgaccgcaacgagugccaggagauccccaacaucugcucccacggccagugcaucgacaccgucggcuccuucuacugccucugccacaccggcuucaagaccaacgacgaccagaccaugugccucgacaucaacgagugcgagcgcgacgccugcggcaacggcaccugccgcaacaccaucggcuccuucaacugccgcugcaaccacggcuucauccucucccacaacaacgacugcaucgacgucgacgagugcgccuccggcaacggcaaccucugccgcaacggccagugcaucaacaccgucggcuccuuccagugccagugcaacgagggcuacgaggucgcccccgacggccgcaccugcgucgacaucaacgagugccuccucgagccccgcaagugcgcccccggcaccugccagaaccucgacggcuccuaccgcugcaucugcccccccggcuacucccuccagaacgagaagugcgaggacaucgacgagugcgucgaggagcccgagaucugcgcccucggcaccugcuccaacaccgagggcuccuucaagugccucugccccgagggcuucucccucuccuccuccggccgccgcugccaggaccuccgcauguccuacugcuacgccaaguucgagggcggcaagugcuccucccccaagucccgcaaccacuccaagcaggagugcugcugcgcccucaagggcgagggcuggggcgaccccugcgagcucugccccaccgagcccgacgaggccuuccgccagaucugccccuacggcuccggcaucaucgucggccccgacgacuccgccgucgacauggacgagugcaaggagcccgacgucugcaagcacggccagugcaucaacaccgacggcuccuaccgcugcgagugccccuucggcuacauccucgccggcaacgagugcgucgacaccgacgagugcuccgucggcaaccccugcggcaacggcaccugcaagaacgucaucggcggcuucgagugcaccugcgaggagggcuucgagcccggccccaugaugaccugcgaggacaucaacgagugcgcccagaacccccuccucugcgccuuccgcugcgucaacaccuacggcuccuacgagugcaagugccccgucggcuacguccuccgcgaggaccgccgcaugugcaaggacgaggacgagugcgaggagggcaagcacgacugcaccgagaagcagauggagugcaagaaccucaucggcaccuacaugugcaucugcggccccggcuaccagcgccgccccgacggcgagggcugcgucgacgagaacgagugccagaccaagcccggcaucugcgagaacggccgcugccucaacacccgcggcuccuacaccugcgagugcaacgacggcuucaccgccucccccaaccaggacgagugccucgacaaccgcgagggcuacugcuucaccgagguccuccagaacaugugccagaucggcuccuccaaccgcaaccccgucaccaaguccgagugcugcugcgacggcggccgcggcuggggcccccacugcgagaucugccccuuccagggcaccgucgccuucaagaagcucugcccccacggccgcggcuucaugaccaacggcgccgacaucgacgagugcaaggucauccacgacgucugccgcaacggcgagugcgucaacgaccgcggcuccuaccacugcaucugcaagaccggcuacacccccgacaucaccggcaccuccugcgucgaccucaacgagugcaaccaggcccccaagcccugcaacuucaucugcaagaacaccgagggcuccuaccagugcuccugccccaagggcuacauccuccaggaggacggccgcuccugcaaggaccucgacgagugcgccaccaagcagcacaacugccaguuccucugcgucaacaccaucggcggcuucaccugcaagugcccccccggcuucacccagcaccacaccuccugcaucgacaacaacgagugcaccuccgacaucaaccucugcggcuccaagggcaucugccagaacacccccggcuccuucaccugcgagugccagcgcggcuucucccucgaccagaccggcuccuccugcgaggacgucgacgagugcgagggcaaccaccgcugccagcacggcugccagaacaucaucggcggcuaccgcugcuccugcccccagggcuaccuccagcacuaccaguggaaccagugcgucgacgagaacgagugccucuccgcccacaucugcggcggcgccuccugccacaacacccucggcuccuacaagugcaugugccccgccggcuuccaguacgagcaguucuccggcggcugccaggacaucaacgagugcggcuccgcccaggcccccugcuccuacggcugcuccaacaccgagggcggcuaccucugcggcugcccccccggcuacuuccgcaucggccagggccacugcgucuccggcaugggcaugggccgcggcaaccccgagccccccgucuccggcgagauggacgacaacucccucucccccgaggccugcuacgagugcaagaucaacggcuaccccaagcgcggccgcaagcgccgcuccaccaacgagaccgacgccuccaacaucgaggaccaguccgagaccgaggccaacgucucccucgccuccugggacgucgagaagaccgccaucuucgccuucaacaucucccacgucuccaacaagguccgcauccucgagcuccuccccgcccucaccacccucaccaaccacaaccgcuaccucaucgaguccggcaacgaggacggcuucuucaagaucaaccagaaggagggcaucuccuaccuccacuucaccaagaagaagcccgucgccggcaccuacucccuccagaucuccuccaccccccucuacaagaagaaggagcucaaccagcucgaggacaaguacgacaaggacuaccucuccggcgagcucggcgacaaccucaagaugaagauccagguccuccuccacuga

SEQ ID NO: 43088 - RNA, 8739 nt, Artificial Sequence
  derived and/or modified sequence opt2 from FBN2__Homo_sapiens__NP_001990
augggccgccgccgccgccucugccuccagcucuacuuccucuggcucggcugcgucguccucugggcccagggcaccgccggccagccccagccccccccccccaagcccccccgcccccagccccccccccagcagguccgcuccgccaccgccggcuccgagggcggcuuccucgcccccgaguaccgcgaggagggcgccgccgucgccucccgcguccgccgccgcggccagcaggacguccuccgcggccccaacgucugcggcucccgcuuccacuccuacugcugccccggcuggaagacccuccccggcggcaaccagugcaucguccccaucugccgcaacuccugcggcgacggcuucugcucccgccccaacaugugcaccugcuccuccggccagaucuccuccaccugcggcuccaaguccauccagcagugcuccguccgcugcaugaacggcggcaccugcgccgacgaccacugccagugccagaagggcuacaucggcaccuacugcggccagcccgucugcgagaacggcugccagaacggcggccgcugcaucggccccaaccgcugcgccugcgucuacggcuucaccggcccccagugcgagcgcgacuaccgcaccggccccugcuucacccaggucaacaaccagaugugccagggccagcucaccggcaucgucugcaccaagacccucugcugcgccaccaucggccgcgccuggggccaccccugcgagaugugccccgcccagccccagcccugccgccgcggcuucauccccaacauccgcaccggcgccugccaggacgucgacgagugccaggccauccccggcaucugccagggcggcaacugcaucaacaccgucggcuccuucgagugccgcugccccgccggccacaagcaguccgagaccacccagaagugcgaggacaucgacgagugcuccaucauccccggcaucugcgagaccggcgagugcuccaacaccgucggcuccuacuucugcgucugcccccgcggcuacgucaccuccaccgacggcucccgcugcaucgaccagcgcaccggcaugugcuucuccggccucgucaacggccgcugcgcccaggagcuccccggccgcaugaccaagaugcagugcugcugcgagcccggccgcugcuggggcaucggcaccauccccgaggccugccccguccgcggcuccgaggaguaccgccgccucugcauggacggccuccccaugggcggcauccccggcuccgccggcucccgccccggcggcaccggcggcaacggcuucgcccccuccggcaacggcaacggcuacggccccggcggcaccggcuucauccccauccccggcggcaacggcuucucccccggcgucggcggcgccggcgucggcgccggcggccagggccccaucaucaccggccucaccauccucaaccagaccaucgacaucugcaagcaccacgccaaccucugccucaacggccgcugcauccccaccgucuccuccuaccgcugcgagugcaacaugggcuacaagcaggacgccaacggcgacugcaucgacgucgacgagugcaccuccaaccccugcaccaacggcgacugcgucaacacccccggcuccuacuacugcaagugccacgccggcuuccagcgcacccccaccaagcaggccugcaucgacaucgacgagugcauccagaacggcguccucugcaagaacggccgcugcgucaacaccgacggcuccuuccagugcaucugcaacgccggcuucgagcucaccaccgacggcaagaacugcgucgaccacgacgagugcaccaccaccaacaugugccucaacggcaugugcaucaacgaggacggcuccuucaagugcaucugcaagcccggcuucguccucgcccccaacggccgcuacugcaccgacgucgacgagugccagacccccggcaucugcaugaacggccacugcaucaacuccgagggcuccuuccgcugcgacugcccccccggccucgccgucggcauggacggccgcgucugcgucgacacccacaugcgcuccaccugcuacggcggcaucaagaagggcgucugcguccgccccuuccccggcgccgucaccaaguccgagugcugcugcgccaaccccgacuacggcuucggcgagcccugccagcccugccccgccaagaacuccgccgaguuccacggccucugcuccuccggcgucggcaucaccgucgacggccgcgacaucaacgagugcgcccucgaccccgacaucugcgccaacggcaucugcgagaaccuccgcggcuccuaccgcugcaacugcaacuccggcuacgagcccgacgccuccggccgcaacugcaucgacaucgacgagugccucgucaaccgccuccucugcgacaacggccucugccgcaacacccccggcuccuacuccugcaccugcccccccggcuacgucuuccgcaccgagaccgagaccugcgaggacaucaacgagugcgaguccaaccccugcgucaacggcgccugccgcaacaaccucggcuccuucaacugcgagugcucccccggcuccaagcucuccuccaccggccucaucugcaucgacucccucaagggcaccugcuggcucaacauccaggacucccgcugcgaggucaacaucaacggcgccacccucaaguccgagugcugcgccacccucggcgccgccuggggcucccccugcgagcgcugcgagcucgacaccgccugcccccgcggccucgcccgcaucaagggcgucaccugcgaggacgucaacgagugcgaggucuuccccggcgucugccccaacggccgcugcgucaacuccaagggcuccuuccacugcgagugccccgagggccucacccucgacggcaccggccgcgucugccucgacauccgcauggagcagugcuaccucaagugggacgaggacgagugcauccaccccguccccggcaaguuccgcauggacgccugcugcugcgccgucggcgccgccuggggcaccgagugcgaggagugccccaagcccggcaccaaggaguacgagacccucugcccccgcggcgccggcuucgccaaccgcggcgacguccucaccggccgccccuucuacaaggacaucaacgagugcaaggccuuccccggcaugugcaccuacggcaagugccgcaacaccaucggcuccuucaagugccgcugcaacuccggcuucgcccucgacauggaggagcgcaacugcaccgacaucgacgagugccgcaucucccccgaccucugcggcuccggcaucugcgucaacacccccggcuccuucgagugcgagugcuucgagggcuacgaguccggcuucaugaugaugaagaacugcauggacaucgacgagugcgagcgcaacccccuccucugccgcggcggcaccugcgucaacaccgagggcuccuuccagugcgacugcccccucggccacgagcucucccccucccgcgaggacugcgucgacaucaacgagugcucccucuccgacaaccucugccgcaacggcaagugcgucaacaugaucggcaccuaccagugcuccugcaaccccggcuaccaggccacccccgaccgccagggcugcaccgacaucgacgagugcaugaucaugaacggcggcugcgacacccagugcaccaacuccgagggcuccuacgagugcuccugcuccgagggcuacgcccucaugcccgacggccgcuccugcgccgacaucgacgagugcgagaacaaccccgacaucugcgacggcggccagugcaccaacauccccggcgaguaccgcugccucugcuacgacggcuucauggccuccauggacaugaagaccugcaucgacgucaacgagugcgaccucaacuccaacaucugcauguucggcgagugcgagaacaccaagggcuccuucaucugccacugccagcucggcuacuccgucaagaagggcaccaccggcugcaccgacgucgacgagugcgagaucggcgcccacaacugcgacaugcacgccuccugccucaacauccccggcuccuucaagugcuccugccgcgagggcuggaucggcaacggcaucaagugcaucgaccucgacgagugcuccaacggcacccaccagugcuccaucaacgcccagugcgucaacacccccggcuccuaccgcugcgccugcuccgagggcuucaccggcgacggcuucaccugcuccgacgucgacgagugcgccgagaacaucaaccucugcgagaacggccagugccucaacguccccggcgccuaccgcugcgagugcgagaugggcuucacccccgccuccgacucccgcuccugccaggacaucgacgagugcuccuuccagaacaucugcgucuucggcaccugcaacaaccuccccggcauguuccacugcaucugcgacgacggcuacgagcucgaccgcaccggcggcaacugcaccgacaucgacgagugcgccgaccccaucaacugcgucaacggccucugcgucaacacccccggccgcuacgagugcaacugcccccccgacuuccagcucaaccccaccggcgucggcugcgucgacaaccgcgucggcaacugcuaccucaaguucggcccccgcggcgacggcucccucuccugcaacaccgagaucggcgucggcgucucccgcuccuccugcugcugcucccucggcaaggccuggggcaaccccugcgagaccugcccccccgucaacuccaccgaguacuacacccucugccccggcggcgagggcuuccgccccaaccccaucaccaucauccucgaggacaucgacgagugccaggagcuccccggccucugccagggcggcaacugcaucaacaccuucggcuccuuccagugcgagugcccccagggcuacuaccucuccgaggacacccgcaucugcgaggacaucgacgagugcuucgcccaccccggcgucugcggccccggcaccugcuacaacacccucggcaacuacaccugcaucugcccccccgaguacaugcaggucaacggcggccacaacugcauggacaugcgcaaguccuucugcuaccgcuccuacaacggcaccaccugcgagaacgagcuccccuucaacgucaccaagcgcaugugcugcugcaccuacaacgucggcaaggccuggaacaagcccugcgagcccugccccacccccggcaccgccgacuucaagaccaucugcggcaacauccccggcuucaccuucgacauccacaccggcaaggccgucgacaucgacgagugcaaggagauccccggcaucugcgccaacggcgucugcaucaaccagaucggcuccuuccgcugcgagugccccaccggcuucuccuacaacgaccuccuccucgucugcgaggacaucgacgagugcuccaacggcgacaaccucugccagcgcaacgccgacugcaucaacucccccggcuccuaccgcugcgagugcgccgccggcuucaagcucucccccaacggcgccugcgucgaccgcaacgagugccucgagauccccaacgucugcucccacggccucugcgucgaccuccagggcuccuaccagugcaucugccacaacggcuucaaggccucccaggaccagaccaugugcauggacgucgacgagugcgagcgccaccccugcggcaacggcaccugcaagaacaccgucggcuccuacaacugccucugcuaccccggcuucgagcucacccacaacaacgacugccucgacaucgacgagugcuccuccuucuucggccaggucugccgcaacggccgcugcuucaacgagaucggcuccuucaagugccucugcaacgagggcuacgagcucacccccgacggcaagaacugcaucgacaccaacgagugcgucgcccuccccggcuccugcucccccggcaccugccagaaccucgagggcuccuuccgcugcaucugcccccccggcuacgaggucaaguccgagaacugcaucgacaucaacgagugcgacgaggaccccaacaucugccucuucggcuccugcaccaacacccccggcggcuuccagugccucugcccccccggcuucguccucuccgacaacggccgccgcugcuucgacacccgccaguccuucugcuucaccaacuucgagaacggcaagugcuccguccccaaggccuucaacaccaccaaggccaagugcugcugcuccaagaugcccggcgagggcuggggcgaccccugcgagcucugccccaaggacgacgaggucgccuuccaggaccucugccccuacggccacggcaccguccccucccuccacgacacccgcgaggacgucaacgagugccucgagucccccggcaucugcuccaacggccagugcaucaacaccgacggcuccuuccgcugcgagugccccaugggcuacaaccucgacuacaccggcguccgcugcgucgacaccgacgagugcuccaucggcaaccccugcggcaacggcaccugcaccaacgucaucggcuccuucgagugcaacugcaacgagggcuucgagcccggccccaugaugaacugcgaggacaucaacgagugcgcccagaacccccuccucugcgccuuccgcugcaugaacaccuucggcuccuacgagugcaccugccccaucggcuacgcccuccgcgaggaccagaagaugugcaaggaccucgacgagugcgccgagggccuccacgacugcgagucccgcggcaugaugugcaagaaccucaucggcaccuucaugugcaucugcccccccggcauggcccgccgccccgacggcgagggcugcgucgacgagaacgagugccgcaccaagcccggcaucugcgagaacggccgcugcgucaacaucaucggcuccuaccgcugcgagugcaacgagggcuuccaguccuccuccuccggcaccgagugccucgacaaccgccagggccucugcuucgccgagguccuccagaccaucugccagauggccuccuccucccgcaaccucgucaccaaguccgagugcugcugcgacggcggccgcggcuggggccaccagugcgagcucugcccccuccccggcaccgcccaguacaagaagaucugcccccacggccccggcuacaccaccgacggccgcgacaucgacgagugcaaggucaugcccaaccucugcaccaacggccagugcaucaacaccaugggcuccuuccgcugcuucugcaaggucggcuacaccaccgacaucuccggcaccuccugcaucgaccucgacgagugcucccagucccccaagcccugcaacuacaucugcaagaacaccgagggcuccuaccagugcuccugcccccgcggcuacguccuccaggaggacggcaagaccugcaaggaccucgacgagugccagaccaagcagcacaacugccaguuccucugcgucaacacccucggcggcuucaccugcaagugcccccccggcuucacccagcaccacaccgccugcaucgacaacaacgagugcggcucccagcccucccucugcggcgccaagggcaucugccagaacacccccggcuccuucuccugcgagugccagcgcggcuucucccucgacgccaccggccucaacugcgaggacgucgacgagugcgacggcaaccaccgcugccagcacggcugccagaacauccucggcggcuaccgcugcggcugcccccagggcuacauccagcacuaccaguggaaccagugcgucgacgagaacgagugcuccaaccccaacgccugcggcuccgccuccugcuacaacacccucggcuccuacaagugcgccugccccuccggcuucuccuucgaccaguucuccuccgccugccacgacgucaacgagugcuccuccuccaagaaccccugcaacuacggcugcuccaacaccgagggcggcuaccucugcggcugcccccccggcuacuaccgcgucggccagggccacugcgucuccggcaugggcuucaacaagggccaguaccucucccucgacaccgaggucgacgaggagaacgcccucucccccgaggccugcuacgagugcaagaucaacggcuacuccaagaaggacucccgccagaagcgcuccauccacgagcccgaccccaccgccgucgagcagaucucccucgaguccgucgacauggacucccccgucaacaugaaguucaaccucucccaccucggcuccaaggagcacauccucgagcuccgccccgccauccagccccucaacaaccacauccgcuacgucaucucccagggcaacgacgacuccgucuuccgcauccaccagcgcaacggccucuccuaccuccacaccgccaagaagaagcucaugcccggcaccuacacccucgagaucaccuccaucccccucuacaagaagaaggagcucaagaagcucgaggaguccaacgaggacgacuaccuccucggcgagcucggcgaggcccuccgcaugcgccuccagauccagcucuacuga

SEQ ID NO: 43089 - RNA, 8430 nt, Artificial Sequence
  derived and/or modified sequence opt2 from FBN3__Homo_sapiens__NP_115823
augacccucgagggccucuaccucgcccgcggcccccucgcccgccuccuccucgccugguccgcccuccucugcauggccggcggccagggccgcugggacggcgcccucgaggccgccggccccggccgcguccgccgccgcggcucccccggcauccuccagggccccaacgucugcggcucccgcuuccacgccuacugcugccccggcuggcgcaccuuccccggccgcucccagugcgucguccccaucugccgccgcgccugcggcgagggcuucugcucccagcccaaccucugcaccugcgccgacggcacccucgcccccuccugcggcgucucccgcggcuccggcugcuccgucuccugcaugaacggcggcaccugccgcggcgccuccugccucugccagaagggcuacaccggcaccgucugcggccagcccaucugcgaccgcggcugccacaacggcggccgcugcaucggccccaaccgcugcgccugcgucuacggcuucaugggcccccagugcgagcgcgacuaccgcaccggccccugcuucggccaggucggccccgagggcugccagcaccagcucaccggccucgucugcaccaaggcccucugcugcgccaccgucggccgcgccuggggccuccccugcgagcucugccccgcccagccccaccccugccgccgcggcuucauccccaacauccacaccggcgccugccaggacgucgacgagugccaggccguccccggccucugccagggcggcuccugcgucaacauggucggcuccuuccacugccgcugccccgucggccaccgccucuccgacuccuccgccgccugcgaggacuaccgcgccggcgccugcuucuccguccucuucggcggccgcugcgccggcgaccucgccggccacuacacccgccgccagugcugcugcgaccgcggccgcugcugggccgccggccccguccccgagcucugccccccccgcggcuccaacgaguuccagcagcucugcgcccagcgccucccccuccuccccggccaccccggccucuuccccggccuccucggcuucggcuccaacggcaugggccccccccucggccccgcccgccucaacccccacggcuccgacgcccgcggcauccccucccucggccccggcaacuccaacaucggcaccgccacccucaaccagaccaucgacaucugccgccacuucaccaaccucugccucaacggccgcugccuccccacccccuccuccuaccgcugcgagugcaacgucggcuacacccaggacguccgcggcgagugcaucgacgucgacgagugcaccuccucccccugccaccacggcgacugcgucaacauccccggcaccuaccacugccgcugcuaccccggcuuccaggccacccccacccgccaggccugcgucgacgucgacgagugcaucgucuccggcggccucugccaccucggccgcugcgucaacaccgagggcuccuuccagugcgucugcaacgccggcuucgagcucucccccgacggcaagaacugcgucgaccacaacgagugcgccaccuccaccaugugcgucaacggcgucugccucaacgaggacggcuccuucuccugccucugcaagcccggcuuccuccucgcccccggcggccacuacugcauggacaucgacgagugccagacccccggcaucugcgucaacggccacugcaccaacaccgagggcuccuuccgcugccagugccucggcggccucgccgucggcaccgacggccgcgucugcgucgacacccacguccgcuccaccugcuacggcgccaucgagaagggcuccugcgcccgccccuuccccggcaccgucaccaaguccgagugcugcugcgccaaccccgaccacggcuucggcgagcccugccagcucugccccgccaaggacuccgccgaguuccaggcccucugcuccuccggccucggcaucaccaccgacggccgcgacaucaacgagugcgcccucgaccccgaggucugcgccaacggcgucugcgagaaccuccgcggcuccuaccgcugcgucugcaaccucggcuacgaggccggcgccuccggcaaggacugcaccgacgucgacgagugcgcccucaacucccuccucugcgacaacggcuggugccagaacucccccggcuccuacuccugcuccugcccccccggcuuccacuucuggcaggacaccgagaucugcaaggacgucgacgagugccucuccucccccugcgucuccggcgucugccgcaaccucgccggcuccuacaccugcaagugcggccccggcucccgccucgaccccuccggcaccuucugccucgacuccaccaagggcaccugcuggcucaagauccaggagucccgcugcgaggucaaccuccagggcgccucccuccgcuccgagugcugcgccacccucggcgccgccuggggcucccccugcgagcgcugcgagaucgaccccgccugcgcccgcggcuucgcccgcaugaccggcgucaccugcgacgacgucaacgagugcgaguccuuccccggcgucugccccaacggccgcugcgucaacaccgccggcuccuuccgcugcgagugccccgagggccucaugcucgacgccuccggccgccucugcgucgacguccgccucgagcccugcuuccuccgcugggacgaggacgagugcggcgucacccuccccggcaaguaccgcauggacgucugcugcugcuccaucggcgccgucuggggcgucgagugcgaggccugccccgaccccgagucccucgaguucgccucccucugcccccgcggccucggcuucgccucccgcgacuuccucuccggccgccccuucuacaaggacgucaacgagugcaaggucuuccccggccucugcacccacggcaccugccgcaacaccgucggcuccuuccacugcgccugcgccggcggcuucgcccucgacgcccaggagcgcaacugcaccgacaucgacgagugccgcaucucccccgaccucugcggccagggcaccugcgucaacacccccggcuccuucgagugcgagugcuuccccggcuacgaguccggcuucaugcucaugaagaacugcauggacgucgacgagugcgcccgcgacccccuccucugccgcggcggcaccugcaccaacaccgacggcuccuacaagugccagugcccccccggccacgagcucaccgccaagggcaccgccugcgaggacaucgacgagugcucccucuccgacggccucugcccccacggccagugcgucaacgucaucggcgccuuccagugcuccugccacgccggcuuccaguccacccccgaccgccagggcugcgucgacaucaacgagugccgcguccagaacggcggcugcgacguccacugcaucaacaccgagggcuccuaccgcugcuccugcggccagggcuacucccucaugcccgacggccgcgccugcgccgacgucgacgagugcgaggagaacccccgcgucugcgaccagggccacugcaccaacaugcccggcggccaccgcugccucugcuacgacggcuucauggccacccccgacaugcgcaccugcgucgacgucgacgagugcgaccucaacccccacaucugccuccacggcgacugcgagaacaccaagggcuccuucgucugccacugccagcucggcuacaugguccgcaagggcgccaccggcugcuccgacgucgacgagugcgaggucggcggccacaacugcgacucccacgccuccugccucaacauccccggcuccuucuccugccgcugccuccccggcugggucggcgacggcuucgagugccacgaccucgacgagugcgucucccaggagcaccgcugcuccccccgcggcgacugccucaacguccccggcuccuaccgcugcaccugccgccagggcuucgccggcgacggcuucuucugcgaggaccgcgacgagugcgccgagaacgucgaccucugcgacaacggccagugccucaacgcccccggcggcuaccgcugcgagugcgagaugggcuucgaccccaccgaggaccaccgcgccugccaggacgucgacgagugcgcccagggcaaccucugcgccuucggcuccugcgagaaccuccccggcauguuccgcugcaucugcaacggcggcuacgagcucgaccgcggcggcggcaacugcaccgacaucaacgagugcgccgaccccgucaacugcaucaacggcgucugcaucaacacccccggcuccuaccucugcuccugcccccaggacuucgagcucaaccccuccggcgucggcugcgucgacacccgcgccggcaacugcuuccucgagacccacgaccgcggcgacuccggcaucuccugcuccgccgagaucggcgucggcgucacccgcgccuccugcugcugcucccucggccgcgccuggggcaaccccugcgagcucugccccauggccaacaccaccgaguaccgcacccucugccccggcggcgagggcuuccagcccaaccgcaucaccgucauccucgaggacaucgacgagugccaggagcuccccggccucugccagggcggcgacugcgucaacaccuucggcuccuuccagugcgagugcccccccggcuaccaccucuccgagcacacccgcaucugcgaggacaucgacgagugcuccacccacuccggcaucugcggccccggcaccugcuacaacacccucggcaacuacaccugcgucugccccgccgaguaccuccaggucaacggcggcaacaacugcauggacaugcgcaaguccgucugcuuccgccacuacaacggcaccugccagaacgagcucgccuucaacgucacccgcaagaugugcugcugcuccuacaacaucggccaggccuggaaccgccccugcgaggccugccccacccccaucucccccgacuaccagauccucugcggcaaccaggcccccggcuuccucaccgacauccacaccggcaagccccucgacaucgacgagugcggcgagauccccgccaucugcgccaacggcaucugcaucaaccagaucggcuccuuccgcugcgagugccccgccggcuucaacuacaacuccauccuccucgccugcgaggacgucgacgagugcggcucccgcgagucccccugccagcagaacgccgacugcaucaacauccccggcuccuaccgcugcaagugcacccgcggcuacaagcucucccccggcggcgccugcgucggccgcaacgagugccgcgagauccccaacgucugcucccacggcgacugcauggacaccgagggcuccuacaugugccucugccaccgcggcuuccaggccuccgccgaccagacccucugcauggacaucgacgagugcgaccgccagcccugcggcaacggcaccugcaagaacaucaucggcuccuacaacugccucugcuuccccggcuucgucgucacccacaacggcgacugcgucgacuucgacgagugcaccacccucgucggccaggucugccgcuucggccacugccucaacaccgccggcuccuuccacugccucugccaggacggcuucgagcucaccgccgacggcaagaacugcgucgacaccaacgagugccucucccucgccggcaccugccuccccggcaccugccagaaccucgagggcuccuuccgcugcaucugcccccccggcuuccagguccaguccgaccacugcaucgacaucgacgagugcuccgaggagcccaaccucugccucuucggcaccugcaccaacucccccggcuccuuccagugccucugcccccccggcuucguccucuccgacaacggccaccgcugcuucgacacccgccaguccuucugcuucacccgcuucgaggccggcaagugcuccguccccaaggccuucaacaccaccaagacccgcugcugcugcuccaagcgccccggcgagggcuggggcgaccccugcgagcucugcccccaggagggcuccgccgccuuccaggagcucugccccuucggccacggcgccguccccggccccgacgacucccgcgaggacgucaacgagugcgccgagaaccccggcgucugcaccaacggcgucugcgucaacaccgacggcuccuuccgcugcgagugccccuucggcuacucccucgacuucaccggcaucaacugcgucgacaccgacgagugcuccgucggccaccccugcggccagggcaccugcaccaacgucaucggcggcuucgagugcgccugcgccgacggcuucgagcccggccucaugaugaccugcgaggacaucgacgagugcucccucaacccccuccucugcgccuuccgcugccacaacaccgagggcuccuaccucugcaccugccccgccggcuacacccuccgcgaggacggcgccaugugccgcgacgucgacgagugcgccgacggccagcaggacugccacgcccgcggcauggagugcaagaaccucaucggcaccuucgccugcgucugcccccccggcaugcgcccccuccccggcuccggcgagggcugcaccgacgacaacgagugccacgcccagcccgaccucugcgucaacggccgcugcgucaacaccgccggcuccuuccgcugcgacugcgacgagggcuuccagcccucccccacccucaccgagugccacgacauccgccagggccccugcuucgccgagguccuccagaccaugugccgcucccucuccuccuccuccgaggccgucacccgcgccgagugcugcugcggcggcggccgcggcuggggcccccgcugcgagcucugcccccuccccggcaccuccgccuaccgcaagcucugcccccacggcuccggcuacaccgccgagggccgcgacgucgacgagugccgcaugcucgcccaccucugcgcccacggcgagugcaucaacucccucggcuccuuccgcugccacugccaggccggcuacacccccgacgccaccgccaccaccugccucgacauggacgagugcucccagguccccaagcccugcaccuuccucugcaagaacaccaagggcuccuuccucugcuccugcccccgcggcuaccuccucgaggaggacggccgcaccugcaaggaccucgacgagugcaccucccgccagcacaacugccaguuccucugcgucaacaccgucggcgccuucaccugccgcugcccccccggcuucacccagcaccaccaggccugcuucgacaacgacgagugcuccgcccagcccggccccugcggcgcccacggccacugccacaacacccccggcuccuuccgcugcgagugccaccagggcuucacccucgucuccuccggccacggcugcgaggacgucaacgagugcgacggcccccaccgcugccagcacggcugccagaaccagcucggcggcuaccgcugcuccugcccccagggcuucacccagcacucccagugggcccagugcgucgacgagaacgagugcgcccucuccccccccaccugcggcuccgccuccugccgcaacacccucggcggcuuccgcugcgucugccccuccggcuucgacuucgaccaggcccucggcggcugccaggaggucgacgagugcgccggccgccgcggccccugcuccuacuccugcgccaacacccccggcggcuuccucugcggcugcccccagggcuacuuccgcgccggccagggccacugcgucuccggccucggcuucucccccggcccccaggacacccccgacaaggaggagcuccucuccuccgaggccugcuacgagugcaagaucaacggccucuccccccgcgaccgcccccgccgcuccgcccaccgcgaccaccaggucaaccucgccacccucgacuccgaggcccuccucacccucggccucaaccucucccaccucggccgcgccgagcgcauccucgagcuccgccccgcccucgagggccucgagggccgcauccgcuacgucaucguccgcggcaacgagcagggcuucuuccgcaugcaccaccuccgcggcgucuccucccuccagcucggccgccgccgccccggccccggcaccuaccgccucgaggucgucucccacauggccggccccuggggcguccagcccgagggccagcccggccccuggggccaggcccuccgccucaagguccagcuccagcuccucuga

SEQ ID NO: 43090 - RNA, 1017 nt, Artificial Sequence
  derived and/or modified sequence opt2 from FBP1__Homo_sapiens__NP_000498
auggccgaccaggcccccuucgacaccgacgucaacacccucacccgcuucgucauggaggagggccgcaaggcccgcggcaccggcgagcucacccagcuccucaacucccucugcaccgccgucaaggccaucuccuccgccguccgcaaggccggcaucgcccaccucuacggcaucgccggcuccaccaacgucaccggcgaccaggucaagaagcucgacguccucuccaacgaccucgucaugaacaugcucaaguccuccuucgccaccugcguccucgucuccgaggaggacaagcacgccaucaucgucgagcccgagaagcgcggcaaguacgucgucugcuucgacccccucgacggcuccuccaacaucgacugccucgucuccgucggcaccaucuucggcaucuaccgcaagaaguccaccgacgagcccuccgagaaggacgcccuccagcccggccgcaaccucgucgccgccggcuacgcccucuacggcuccgccaccaugcucguccucgccauggacugcggcgucaacugcuucaugcucgaccccgccaucggcgaguucauccucgucgacaaggacgucaagaucaagaagaagggcaagaucuacucccucaacgagggcuacgcccgcgacuucgaccccgccgucaccgaguacauccagcgcaagaaguucccccccgacaacuccgcccccuacggcgcccgcuacgucggcuccauggucgccgacguccaccgcacccucgucuacggcggcaucuuccucuaccccgccaacaagaagucccccaacggcaagcuccgccuccucuacgagugcaaccccauggccuacgucauggagaaggccggcggcauggccaccaccggcaaggaggccguccucgacgucauccccaccgacauccaccagcgcgcccccgucauccucggcucccccgacgacguccucgaguuccucaaggucuacgagaagcacuccgcccaguga

SEQ ID NO: 43091 - RNA, 1020 nt, Artificial Sequence
  derived and/or modified sequence opt2 from FBP2__Homo_sapiens__NP_003828
augaccgaccgcucccccuucgagaccgacaugcucacccucacccgcuacgucauggagaagggccgccaggccaagggcaccggcgagcucacccagcuccucaacuccaugcucaccgccaucaaggccaucuccuccgccguccgcaaggccggccucgcccaccucuacggcaucgccggcuccgucaacgucaccggcgacgaggucaagaagcucgacguccucuccaacucccucgucaucaacaugguccaguccuccuacuccaccugcguccucgucuccgaggagaacaaggacgccaucaucaccgccaaggagaagcgcggcaaguacgucgucugcuucgacccccucgacggcuccuccaacaucgacugccucgccuccaucggcaccaucuucgccaucuaccgcaagaccuccgaggacgagcccuccgagaaggacgcccuccagugcggccgcaacaucgucgccgccggcuacgcccucuacggcuccgccacccucgucgcccucuccaccggccagggcgucgaccucuucaugcucgaccccgcccucggcgaguucguccucgucgagaaggacgucaagaucaagaagaagggcaagaucuacucccucaacgagggcuacgccaaguacuucgacgccgccaccaccgaguacguccagaagaagaaguuccccgaggacggcuccgcccccuacggcgcccgcuacgucggcuccauggucgccgacguccaccgcacccucgucuacggcggcaucuuccucuaccccgccaaccagaagucccccaagggcaagcuccgccuccucuacgagugcaaccccgucgccuacaucaucgagcaggccggcggccucgccaccaccggcacccagcccguccucgacgucaagcccgaggccauccaccagcgcgucccccucauccucggcucccccgaggacguccaggaguaccucaccugcguccagaagaaccaggccggcuccuga

SEQ ID NO: 43092 - RNA, 2943 nt, Artificial Sequence
  derived and/or modified sequence opt2 from FBRS__Homo_sapiens__NP_001098549
auggagaccgccgccgccgccgcccccggccccggcugggccgccgagggcgagcgccgccgccgccgcugcucccgccgcgaccgcgaccgcgagcagcgccgccgccgcggccccggcggcgacgccccccgcgcccuccucgccgccccccgcggcuccuccuccuccuccuccccccccccccccgcccgccccugguccuccgccuccuccggcgagcgccccggcggcccccgccgccgccgcccccgcccccgcccccgccccccccgcccccgcgcccgcaagcgccccgccggcuccggcucccgcggcgaggaggaggaggaggaggaggaggagggcggcgccgacgacggcgaggccgaggaggagcccgaggaggaggaggaggaggaggaggaccucaucgacggcuucgccaucgccuccuucgccacccucgaggcccuccagaaggacgccucccuccagccccccgagcgccucgagcaccgccucaagcacuccggcaagcgcaagcgcggcggcuccuccggcgccaccggcgagcccggcgacuccuccgaccgcgagcccggccgcccccccggcgaccgcgcccgcaaguggcccaacaagcgccgccgcaaggaggccuccucccgccacucccucgaggccggcuacaucugcgacgccgaguccgaccucgacgagcgcgucuccgacgacgaccucgaccccuccuucaccgucuccaccuccaaggccuccggcccccacggcgccuucaacggcaacugcgaggccaagcucuccgucguccccaaggucuccggccucgagcgcucccaggagcagccccccggccccgacccccuccucguccccuucccccccaaggagcccccccccccccccgucccccgcccccccgucuccccccccgccccccuccccgccacccccucccuccccccccccccccagccccagcuccagcuccgcgucucccccuucggccuccgcaccucccccuacggcuccucccucgaccucuccaccggcuccuccucccgccccccccccaaggcccccgccccccccgucgcccagcccccccccuccuccuccuccuccuccuccuccuccuccuccgccuccuccuccuccgcccagcucacccaccgcccccccacccccucccucccccucccccucuccacccacuccuuccccccccccggccuccgcccccccccccccccccaccaccccucccucuucucccccggccccacccucccccccccccccccccuccuccagguccccggccaccccggcgccuccgccgccaacgcccucuccgagcaggaccucaucggccaggaccucaacucccgcuaccucaacgcccagggcggccccgaggucgucggcgccggcggcuccgcccgcccccucgccuuccaguuccaccagcacaaccaccagcaccagcacacccaccagcacacccaccagcacuucacccccuacccccccggccuccuccccccccacggcccccacauguucgagaaguaccccggcaagauggagggccucuuccgccacaaccccuacaccgccuucccccccgccguccccggccucccccccggccucccccccgccgucuccuucggcucccuccagggcgccuuccagcccaaguccaccaaccccgagcuccccccccgccucggccccguccccuccggccucucccagaagggcacccagauccccgaccacuuccgccccccccuccgcaagcccggcaaguggugcgccaugcacguccgcgucgccuacaugauccuccgccaccaggagaagaugaagggcgacucccacaagcucgacuuccgcaacgaccuccuccccugccuccccggccccuacggcgcccucccccccggccaggagcucucccaccccgccucccucuucaccgccaccggcgccguccacgccgccgccaaccccuucaccgccgcccccggcgcccacggccccuuccucucccccuccacccacaucgaccccuucggccgccccaccuccuucgccucccucgccgcccucuccaacggcgccuucggcggccucggcucccccaccuucaacuccggcgccgucuucgcccagaaggagucccccggcgccccccccgccuucgccuccccccccgaccccuggggccgccuccaccgcuccccccucaccuuccccgccuggguccgcccccccgaggccgcccgcacccccggcuccgacaaggagcgccccgucgagcgccgcgagcccuccaucaccaaggaggagaaggaccgcgaccuccccuucucccgcccccagcuccgcgucucccccgccacccccaaggcccgcgccggcgaggagggcccccgccccaccaaggaguccguccgcgucaaggaggagcgcaaggaggaggccgccgccgccgccgccgccgccgccgccgccgccgccgccgccgccgccgccgccaccggcccccagggccuccaccuccucuucgagcgcccccgccccccccccuuccucggccccuccccccccgaccgcugcgccggcuuccucgagcccaccuggcucgccgcccccccccgccucgcccgccccccccgcuucuacgaggccggcgaggagcucaccggccccggcgccgucgccgccgcccgccucuacggccucgagcccgcccacccccuccucuacucccgccucgcccccccccccccccccgccgccgcccccggcaccccccaccuccucuccaagaccccccccggcgcccuccucggcgccccccccccccucguccccgccccccgccccuccucccccccccgcggccccggccccgcccgcgccgaccgcuga

SEQ ID NO: 43093 - RNA, 903 nt, Artificial Sequence
  derived and/or modified sequence opt2 from FBXL15__Homo_sapiens__NP_077302
auggagccccccauggagcccuccggcggcgagcaggagcccggcgccguccgcuuccucgaccuccccugggaggacguccuccucccccacguccucaaccgcgucccccuccgccagcuccuccgccuccagcgcgucucccgcgccuuccgcucccucguccagcuccaccucgccggccuccgccgcuucgacgccgcccaggucggcccccagaucccccgcgccgcccucgcccgccuccuccgcgacgccgagggccuccaggagcucgcccucgcccccugccacgaguggcucuccgacgaggaccucguccccguccucgcccgcaacccccagcuccgcuccgucgcccucggcggcugcggccagcucucccgccgcgcccucggcgcccucgccgagggcugcccccgccuccagcgccucucccucgcccacugcgacugggucgacggccucgcccuccgcggccucgccgaccgcugccccgcccucgaggagcucgaccucaccgccugccgccagcucaaggacgaggccaucgucuaccucgcccagcgccgcggcgccggccuccgcucccucucccucgccgucaacgccaacgucggcgacgccgccguccaggagcucgcccgcaacugccccgagcuccaccaccucgaccucaccggcugccuccgcgucggcuccgacggcguccgcacccucgccgaguacugccccguccuccgcucccuccgcguccgccacugccaccacgucgccgaguccucccucucccgccuccgcaagcgcggcgucgacaucgacgucgagcccccccuccaccaggcccucguccuccuccaggacauggccggcuucgcccccuucgucaaccuccaggucuga

SEQ ID NO: 43094 - RNA, 2106 nt, Artificial Sequence
  derived and/or modified sequence opt2 from FBXL17__Homo_sapiens__NP_001156787
augggccaccuccucuccaaggagccccgcaaccgccccucccagaagcgcccccgcugcugcuccuggugccgccgccgccgcccccuccuccgccucccccgccgcacccccgccaagguccccccccagcccgccgccccccgcucccgcgacugcuucuuccgcggccccugcaugcucugcuucaucguccacucccccggcgcccccgcccccgccggccccgaggaggagcccccccucuccccccccccccgcgacggcgccuacgccgccgccuccuccucccagcaccucgcccgccgcuacgccgcccucgccgccgaggacugcgccgccgccgcccgccgcuuccuccucuccuccgccgccgccgccgccgccgccgccgccuccgccuccucccccgccuccugcugcaaggagcucggccucgccgccgccgccgccugggagcagcagggccgcucccucuuccucgccucccucggccccguccgcuuccucggcccccccgccgccguccagcucuuccgcggccccacccccucccccgccgagcuccccaccccccccgagauggucugcaagcgcaagggcgccggcguccccgccugcacccccugcaagcagccccgcugcggcggcggcggcugcggcggcggcggcggcggcggcggcggcggcggccccgccggcggcggcgccucccccccccgcccccccgacgccggcugcugccaggcccccgagcagcccccccagccccucugccccccccccuccucccccaccuccgagggcgcccccaccgaggccggcggcgacgccguccgcgccggcggcaccgccccccucuccgcccagcagcagcacgagugcggcgacgccgacugccgcgagucccccgagaaccccugcgacugccaccgcgagcccccccccgagacccccgacaucaaccagcucccccccuccauccuccucaagaucuucuccaaccucucccucgacgagcgcugccucuccgccucccucgucugcaaguacuggcgcgaccucugccucgacuuccaguucuggaagcagcucgaccucuccucccgccagcaggucaccgacgagcuccucgagaagaucgccucccgcucccagaacaucaucgagaucaacaucuccgacugccgcuccauguccgacaacggcgucugcguccucgccuucaagugccccggccuccuccgcuacaccgccuaccgcugcaagcagcucuccgacaccuccaucaucgccgucgccucccacugcccccuccuccagaagguccacgucggcaaccaggacaagcucaccgacgagggccucaagcagcucggcuccaagugccgcgagcucaaggacauccacuucggccagugcuacaagaucuccgacgagggcaugaucgucaucgccaagggcugccucaagcuccagcgcaucuacaugcaggagaacaagcucgucaccgaccaguccgucaaggccuucgccgagcacugccccgagcuccaguacgucggcuucaugggcugcuccgucaccuccaagggcgucauccaccucaccaagcuccgcaaccucuccucccucgaccuccgccacaucaccgagcucgacaacgagaccgucauggagaucgucaagcgcugcaagaaccucuccucccucaaccucugccucaacuggaucaucaacgaccgcugcgucgaggucaucgccaaggagggccagaaccucaaggagcucuaccucgucuccugcaagaucaccgacuacgcccucaucgccaucggccgcuacuccaugaccaucgagaccgucgacgucggcuggugcaaggagaucaccgaccagggcgccacccucaucgcccaguccuccaagucccuccgcuaccucggccucaugcgcugcgacaaggucaacgaggucaccgucgagcagcucguccagcaguacccccacaucaccuucuccaccguccuccaggacugcaagcgcacccucgagcgcgccuaccagaugggcuggacccccaacauguccgccgccuccuccuga

SEQ ID NO: 43095 - RNA, 2085 nt, Artificial Sequence
  derived and/or modified sequence opt2 from FBXL19__Homo_sapiens__NP_001093254
augggcaugaagguccccggcaagggcgaguccggccccuccgcccuccucaccccccccauguccuccuccucccgcggccccggcgccggcgcccgccgccgccgcacccgcugccgccgcugccgcgccugcguccgcaccgagugcggcgacugccacuucugccgcgacaugaagaaguucggcggccccggccgcaugaagcaguccugccuccuccgccagugcaccgcccccguccucccccacaccgccgucugccuccucugcggcgaggccggcaaggaggacaccgucgagggcgaggaggagaaguucggccucucccucauggagugcaccaucugcaacgagaucguccaccccggcugccucaagaugggcaaggccgagggcgucaucaacgccgagauccccaacugcugggagugcccccgcugcacccaggagggccgcaccuccaaggacuccggcgagggccccggccgccgccgcgccgacaacggcgaggagggcgccucccucggcuccggcuggaagcucaccgaggagcccccccucccccccccccccccccgccgcaagggcccccuccccgccggccccccccccgaggacguccccggcccccccaagcgcaaggagcgcgaggccggcaacgagccccccaccccccgcaagaaggucaagggcggccgcgagcgccaccucaagaaggucggcggcgacgccugccuccuccgcggcuccgaccccggcggccccggccuccuccccccccgcguccucaaccccucccaggccuucuccuccugccaccccggccucccccccgagaacugggagaagcccaagcccccccucgccuccgccgagggccccgccguccccucccccuccccccagcgcgagaagcucgagcgcuucaagcgcaugugccagcuccucgagcgcguccccgacaccuccuccuccuccuccgacuccgacuccgacuccgacuccuccggcaccucccucuccgaggacgaggcccccggcgaggcccgcaacggccgccgccccgcccgcggcuccuccggcgagaaggagaaccgcggcggccgccgcgccguccgccccggcuccggcggcccccuccucuccuggccccucggccccgccccccccccccgccccccccagcucgagcgccacgucguccgcccccccccccgcucccccgagcccgacacccucccccucgccgccggcuccgaccacccccucccccgcgccgccuggcuccgcgucuuccagcaccucggcccccgcgagcucugcaucugcaugcgcgucugccgcaccuggucccgcuggugcuacgacaagcgccucuggccccgcauggaccucucccgccgcaagucccucaccccccccaugcucuccggcgucguccgccgccagccccgcgcccucgaccucuccuggaccggcgucuccaagaagcagcucauguggcuccucaaccgccuccagggccuccaggagcucguccucuccggcugcuccuggcucuccgucuccgcccucggcuccgccccccuccccgcccuccgccuccucgaccuccgcuggaucgaggacgucaaggacucccagcuccgcgagcuccuccuccccccccccgacaccaagcccggccagaccgagucccgcggccgccuccagggcgucgccgagcuccgccucgccggccucgagcucaccgacgccucccuccgccuccuccuccgccacgccccccagcucuccgcccucgaccucucccacugcgcccacgucggcgaccccuccguccaccuccucaccgcccccaccuccccccuccgcgagacccucguccaccucaaccucgccggcugccaccgccucaccgaccacugccucccccucuuccgccgcugcccccgccuccgccgccucgaccuccgcuccugccgccagcucucccccgaggccugcgcccgccucgccgccgccggcccccccggccccuuccgcugccccgaggagaagcuccuccucaaggacuccuga

SEQ ID NO: 43096 - RNA, 1215 nt, Artificial Sequence
  derived and/or modified sequence opt2 from FBXL20__Homo_sapiens__NP_001171835
augcgccgcgacgucaacggcgucaccaagucccgcuucgagauguucuccaacuccgacgaggccgucaucaacaagaagcuccccaaggagcuccuccuccgcaucuucuccuuccucgacgucgucacccucugccgcugcgcccaggucucccgcgccuggaacguccucgcccucgacggcuccaacuggcagcgcaucgaccucuucgacuuccagcgcgacaucgagggccgcgucgucgagaacaucuccaagcgcugcggcggcuuccuccgcaagcucucccuccgcggcugccucggcgucggcgacaacgcccuccgcaccuucgcccagaacugccgcaacaucgagguccucaaccucaacggcugcaccaagaccaccgacgccgagggcugcccccuccucgagcagcucaacaucuccuggugcgaccaggucaccaaggacggcauccaggcccucguccgcggcugcggcggccucaaggcccucuuccucaagggcugcacccagcucgaggacgaggcccucaaguacaucggcgcccacugccccgagcucgucacccucaaccuccagaccugccuccagaucaccgacgagggccucaucaccaucugccgcggcugccacaagcuccagucccucugcgccuccggcugcuccaacaucaccgacgccauccucaacgcccucggccagaacugcccccgccuccgcauccucgaggucgcccgcugcucccagcucaccgacgucggcuucaccacccucgcccgcaacugccacgagcucgagaagauggaccucgaggagugcguccagaucaccgacuccacccucauccagcucuccauccacugcccccgccuccagguccucucccucucccacugcgagcucaucaccgacgacggcauccgccaccucggcaacggcgccugcgcccacgaccagcucgaggucaucgagcucgacaacugcccccucaucaccgacgccucccucgagcaccucaaguccugccacucccucgagcgcaucgagcucuacgacugccagcagaucacccgcgccggcaucaagcgccuccgcacccaccuccccaacaucaagguccacgccuacuucgcccccgucacccccccccccuccgucggcggcucccgccagcgcuucugccgcugcugcaucauccucuga

SEQ ID NO: 43097 - RNA, 1068 nt, Artificial Sequence
  derived and/or modified sequence opt2 from FBXL2__Homo_sapiens__NP_001165184
auggucuucuccaacaacgacgagggccucaucaacaagaagcuccccaaggagcuccuccuccgcaucuucuccuuccucgacaucgucacccucugccgcugcgcccagaucuccaaggccuggaacauccucgcccucgacggcuccaacuggcagcgcaucgaccucuucaacuuccagaccgacgucgagggccgcgucgucgagaacaucuccaagcgcugcggcggcuuccuccgcaagcucucccuccgcggcugcaucggcgucggcgacuccucccucaagaccuucgcccagaacugccgcaacaucgagcaccucaaccucaacggcugcaccaagaucaccgacuccaccugcuacucccucucccgcuucugcuccaagcucaagcacauccagaacuacugccacgagcucgucucccucaaccuccaguccugcucccgcaucaccgacgagggcgucguccagaucugccgcggcugccaccgccuccaggcccucugccucuccggcugcuccaaccucaccgacgccucccucaccgcccucggccucaacugcccccgccuccagauccucgaggccgcccgcugcucccaccucaccgacgccggcuucacccuccucgcccgcaacugccacgagcucgagaagauggaccucgaggagugcauccucaucaccgacuccacccucauccagcucuccauccacugccccaagcuccaggcccucucccucucccacugcgagcucaucaccgacgacggcauccuccaccucuccaacuccaccugcggccacgagcgccuccgcguccucgagcucgacaacugccuccucaucaccgacgucgcccucgagcaccucgagaacugccgcggccucgagcgccucgagcucuacgacugccagcaggucacccgcgccggcaucaagcgcaugcgcgcccagcucccccacgucaagguccacgccuacuucgcccccgucaccccccccaccgccgucgccggcuccggccagcgccucugccgcugcugcgucauccucuga

SEQ ID NO: 43098 - RNA, 1287 nt, Artificial Sequence
  derived and/or modified sequence opt2 from FBXL3__Homo_sapiens__NP_036290
augaagcgcggcggccgcgacuccgaccgcaacuccuccgaggagggcaccgccgagaaguccaagaagcuccgcaccaccaacgagcacucccagaccugcgacuggggcaaccuccuccaggacaucauccuccaggucuucaaguaccucccccuccucgaccgcgcccacgccucccaggucugccgcaacuggaaccaggucuuccacaugcccgaccucuggcgcugcuucgaguucgagcucaaccagcccgccaccuccuaccucaaggccacccaccccgagcucaucaagcagaucaucaagcgccacuccaaccaccuccaguacgucuccuucaaggucgacuccuccaaggaguccgccgaggccgccugcgacauccucucccagcucgucaacugcucccucaagacccucggccucaucuccaccgcccgccccuccuucauggaccuccccaagucccacuucaucuccgcccucaccgucgucuucgucaacuccaagucccucuccucccucaagaucgacgacacccccgucgacgaccccucccucaagguccucgucgccaacaacuccgacacccucaagcuccucaagauguccuccugcccccacgucucccccgccggcauccucugcgucgccgaccagugccacggccuccgcgagcucgcccucaacuaccaccuccucuccgacgagcuccuccucgcccucuccuccgagaagcacguccgccucgagcaccuccgcaucgacgucgucuccgagaaccccggccagacccacuuccacaccauccagaaguccuccugggacgccuucauccgccacucccccaaggucaaccucgucauguacuucuuccucuacgaggaggaguucgaccccuucuuccgcuacgagauccccgccacccaccucuacuucggccgcuccgucuccaaggacguccucggccgcgucggcaugaccugcccccgccucgucgagcucgucgucugcgccaacggccuccgcccccucgacgaggagcucauccgcaucgccgagcgcugcaagaaccucuccgccaucggccucggcgagugcgaggucuccugcuccgccuucgucgaguucgucaagaugugcggcggccgccucucccagcucuccaucauggaggagguccucauccccgaccagaaguacucccucgagcagauccacugggaggucuccaagcaccucggccgcgucugguuccccgacaugaugcccaccugguga

SEQ ID NO: 43099 - RNA, 1866 nt, Artificial Sequence
  derived and/or modified sequence opt2 from FBXL4__Homo_sapiens__NP_001265645
augucccccgucuuccccaugcucaccguccucaccauguucuacuacaucugccuccgccgccgcgcccgcaccgccacccgcggcgagaugaugaacacccaccgcgccaucgaguccaacucccagaccuccccccucaacgccgaggucguccaguacgccaaggaggucgucgacuucuccucccacuacggcuccgagaacuccauguccuacaccauguggaaccucgccggcguccccaacgucuuccccuccuccggcgacuucacccagaccgccgucuuccgcaccuacggcaccuggugggaccagugccccuccgccucccuccccuucaagcgcaccccccccaacuuccagucccaggacuacgucgagcucaccuucgagcagcaggucuaccccaccgccguccacguccucgagaccuaccaccccggcgccgucauccgcauccucgccugcuccgccaaccccuacucccccaacccccccgccgagguccgcugggagauccucugguccgagcgccccaccaaggucaacgccucccaggcccgccaguucaagcccugcaucaagcagaucaacuuccccaccaaccucauccgccucgaggucaacuccucccuccucgaguacuacaccgagcucgacgccgucguccuccacggcgucaaggacaagcccguccucucccucaagaccucccucaucgacaugaacgacaucgaggacgacgccuacgccgagaaggacggcugcggcauggacucccucaacaagaaguucuccuccgccguccucggcgagggccccaacaacggcuacuucgacaagcuccccuacgagcucauccagcucauccucaaccaccucacccuccccgaccucugccgccucgcccagaccugcaagcuccucucccagcacugcugcgacccccuccaguacauccaccucaaccuccagcccuacugggccaagcucgacgacaccucccucgaguuccuccagucccgcugcacccucguccaguggcucaaccucuccuggaccggcaaccgcggcuucaucuccgucgccggcuucucccgcuuccucaaggucugcggcuccgagcucguccgccucgagcucuccugcucccacuuccucaacgagaccugccucgaggucaucuccgagaugugccccaaccuccaggcccucaaccucuccuccugcgacaagcuccccccccaggccuucaaccacaucgccaagcucugcucccucaagcgccucguccucuaccgcaccaaggucgagcagaccgcccuccucuccauccucaacuucugcuccgagcuccagcaccucucccucggcuccugcgucaugaucgaggacuacgacgucaucgccuccaugaucggcgccaagugcaagaagcuccgcacccucgaccucuggcgcugcaagaacaucaccgagaacggcaucgccgagcucgccuccggcugcccccuccucgaggagcucgaccucggcuggugccccacccuccaguccuccaccggcugcuucacccgccucgcccaccagcuccccaaccuccagaagcucuuccucaccgccaaccgcuccgucugcgacaccgacaucgacgagcucgccugcaacugcacccgccuccagcagcucgacauccucggcacccgcauggucucccccgccucccuccgcaagcuccucgaguccugcaaggaccucucccuccucgacgucuccuucugcucccagaucgacaaccgcgccguccucgagcucaacgccuccuuccccaaggucuucaucaagaaguccuucacccaguga

SEQ ID NO: 43100 - RNA, 2025 nt, Artificial Sequence
  derived and/or modified sequence opt2 from FBXL5__Homo_sapiens__NP_001180464
auggcccccuuccccgaggaggucgacgucuucaccgccccccacuggcgcaugaagcagcucgucggccucuacugcgacaagucccucuacgccaccuucaaggaguucaagaugcacgagcagaucgagaacgaguacaucaucggccuccuccagcagcgcucccagaccaucuacaacguccacuccgacaacaagcucuccgagaugcucucccucuucgagaagggccucaagaacgucaagaacgaguacgagcagcucaacuacgccaagcagcucaaggagcgccucgaggccuucacccgcgacuuccucccccacaugaaggaggaggaggaggucuuccagcccaugcucauggaguacuucaccuacgaggagcucaaggacaucaagaagaaggucaucgcccagcacugcucccagaaggacaccgccgagcuccuccgcggccucucccucuggaaccacgccgaggagcgccagaaguucuucaaguacuccgucgacgagaaguccgacaaggaggccgaggucuccgagcacuccaccggcaucacccaccucccccccgaggucaugcucuccaucuucuccuaccucaacccccaggagcucugccgcugcucccaggucuccaugaaguggucccagcucaccaagaccggcucccucuggaagcaccucuaccccguccacugggcccgcggcgacugguacuccggccccgccaccgagcucgacaccgagcccgacgacgagugggucaagaaccgcaaggacgagucccgcgccuuccacgagugggacgaggacgccgacaucgacgaguccgaggaguccgccgaggaguccaucgccaucuccaucgcccagauggagaagcgccuccuccacggccucauccacaacguccuccccuacgucggcaccuccgucaagacccucguccucgccuacuccuccgccgucuccuccaagaugguccgccagauccucgagcucugccccaaccucgagcaccucgaccucacccagaccgacaucuccgacuccgccuucgacuccugguccuggcucggcugcugccagucccuccgccaccucgaccucuccggcugcgagaagaucaccgacgucgcccucgagaagaucucccgcgcccucggcauccucaccucccaccaguccggcuuccucaagaccuccaccuccaagaucaccuccaccgccuggaagaacaaggacaucaccaugcaguccaccaagcaguacgccugccuccacgaccucaccaacaagggcaucggcgaggagaucgacaacgagcaccccuggaccaagcccgucuccuccgagaacuucaccucccccuacgucuggaugcucgacgccgaggaccucgccgacaucgaggacaccgucgaguggcgccaccgcaacgucgagucccucugcgucauggagaccgccuccaacuucuccugcuccaccuccggcugcuucuccaaggacaucgucggccuccgcaccuccgucugcuggcagcagcacugcgccucccccgccuucgccuacugcggccacuccuucugcugcaccggcaccgcccuccgcaccauguccucccuccccgaguccuccgccaugugccgcaaggccgcccgcacccgccucccccgcggcaaggaccucaucuacuucggcuccgagaaguccgaccaggagaccggccgcguccuccucuuccucucccucuccggcugcuaccagaucaccgaccacggccuccgcguccucacccucggcggcggccuccccuaccucgagcaccucaaccucuccggcugccucaccaucaccggcgccggccuccaggaccucgucuccgccugccccucccucaacgacgaguacuucuacuacugcgacaacaucaacggcccccacgccgacaccgccuccggcugccagaaccuccagugcggcuuccgcgccugcugccgcuccggcgaguga

SEQ ID NO: 43101 - RNA, 1476 nt, Artificial Sequence
  derived and/or modified sequence opt2 from FBXL7__Homo_sapiens__NP_036436
augggcgccaacaacggcaagcaguacggcuccgagggcaagggcuccuccuccaucuccuccgacgucuccuccuccaccgaccacacccccaccaaggcccagaagaacgucgccaccuccgaggacuccgaccucuccaugcgcacccucuccacccccucccccgcccucaucugcccccccaaccuccccggcuuccagaacggccgcggcuccuccaccuccuccuccuccaucaccggcgagaccgucgccaugguccacucccccccccccacccgccucacccacccccucauccgccucgccucccgcccccagaaggagcaggccuccaucgaccgccuccccgaccacuccaugguccagaucuucuccuuccuccccaccaaccagcucugccgcugcgcccgcgucugccgccgcugguacaaccucgccugggacccccgccucuggcgcaccauccgccucaccggcgagaccaucaacgucgaccgcgcccucaagguccucacccgccgccucugccaggacacccccaacgucugccucaugcucgagaccgucaccgucuccggcugccgccgccucaccgaccgcggccucuacaccaucgcccagugcugccccgagcuccgccgccucgaggucuccggcugcuacaacaucuccaacgaggccgucuucgacgucgucucccucugccccaaccucgagcaccucgacgucuccggcugcuccaaggucaccugcaucucccucacccgcgaggccuccaucaagcucuccccccuccacggcaagcagaucuccauccgcuaccucgacaugaccgacugcuucguccucgaggacgagggccuccacaccaucgccgcccacugcacccagcucacccaccucuaccuccgccgcugcguccgccucaccgacgagggccuccgcuaccucgucaucuacugcgccuccaucaaggagcucuccgucuccgacugccgcuucgucuccgacuucggccuccgcgagaucgccaagcucgagucccgccuccgcuaccucuccaucgcccacugcggccgcgucaccgacgucggcauccgcuacgucgccaaguacugcuccaagcuccgcuaccucaacgcccgcggcugcgagggcaucaccgaccacggcgucgaguaccucgccaagaacugcaccaagcucaagucccucgacaucggcaagugcccccucgucuccgacaccggccucgagugccucgcccucaacugcuucaaccucaagcgccucucccucaaguccugcgaguccaucaccggccagggccuccagaucgucgccgccaacugcuucgaccuccagacccucaacguccaggacugcgaggucuccgucgaggcccuccgcuucgucaagcgccacugcaagcgcugcgucaucgagcacaccaaccccgccuucuucuga

SEQ ID NO: 43102 - RNA, 1962 nt, Artificial Sequence
  derived and/or modified sequence opt2 from FBXO10__Homo_sapiens__XP_005251496
auggaggccggcggccucccccucgagcucuggcgcaugauccucgccuaccuccaccuccccgaccucggccgcugcucccucgucugccgcgccugguacgagcucauccucucccucgacuccacccgcuggcgccagcucugccucggcugcaccgagugccgccaccccaacuggcccaaccagcccgacgucgagcccgaguccuggcgcgaggccuucaagcagcacuaccucgccuccaagaccuggaccaagaacgcccucgaccucgaguccuccaucugcuucucccucuuccgccgccgccgcgagcgccgcacccucuccgucggccccggccgcgaguucgacucccucggcuccgcccucgccauggccucccucuacgaccgcaucguccucuuccccggcgucuacgaggagcagggcgagaucauccucaagguccccgucgagaucgucggccagggcaagcucggcgaggucgcccuccucgccuccaucgaccagcacugcuccaccacccgccucugcaaccucgucuucacccccgccugguucucccccaucauguacaagaccaccuccggccacguccaguucgacaacugcaacuucgagaacggccacauccagguccacggccccggcaccugccaggucaaguucugcaccuucaagaacacccacaucuuccuccacaacgucccccucugcguccucgagaacugcgaguucgucggcuccgagaacaacuccgucaccgucgagggccaccccuccgccgacaagaacugggccuacaaguaccuccucggccucaucaaguccucccccaccuuccuccccaccgaggacuccgacuuccucaugucccucgaccucgagucccgcgaccaggccuggucccccaagaccugcgacaucgucaucgagggcucccagucccccaccucccccgccuccuccucccccaagcccggcuccaaggccggcucccaggaggccgaggucggcuccgacggcgagcgcgucgcccagacccccgacuccuccgacggcggccucucccccuccggcgaggacgaggacgaggaccagcucauguaccgccucuccuaccagguccagggcccccgccccguccucggcggcuccuuccucggccccccccuccccggcgccuccauccagcuccccuccugccucguccucaacucccuccagcaggagcuccagaaggacaaggaggccauggcccucgccaacuccguccagggcugccucauccgcaagugccucuuccgcgacggcaagggcggcgucuucgucugcucccacggccgcgccaagauggagggcaacaucuuccgcaaccucaccuacgccguccgcugcauccacaacuccaagaucaucaugcuccgcaacgacaucuaccgcugccgcgccuccggcaucuuccuccgccucgagggcggcggccucaucgccggcaacaacaucuaccacaacgccgaggccggcgucgacauccgcaagaaguccaacccccucauccucugcaaccagauccaccacggccuccgcuccggcaucgucguccucggcaacggcaagggcaucauccgcaacaaccagaucuucuccaacaaggaggccggcaucuacauccucuaccacggcaaccccgucgucuccggcaaccacaucuucaagggccgcgccgccggcaucgccgucaacgagaacggcaagggccucaucaccgagaacgucauccgcgagaaccaguggggcggcgucgacauccgccgcggcggcauccccguccuccgcuccaaccucaucugcuucggcuacuccgacggcgucgucgucggcgacgagggcaagggccucaucgagggcaacaccaucuacgagaacggcaaguacaacggcaagacccgcuga

SEQ ID NO: 43103 - RNA, 2784 nt, Artificial Sequence
  derived and/or modified sequence opt2 from FBXO11__Homo_sapiens__NP_001177203
augaacuccguccgcgccgccaaccgccgcccccgccgcgucucccgcccccgccccguccagcagcagcagcagcagcccccccagcagccccccccccagcccccccagcagcagcccccccagcagcagccccccccccccccccagcagcagcagcagcagcagcccccccccccccccccccccccccccccccucccccaggagcgcaacaacgucggcgagcgcgacgacgacguccccgccgacauggucgccgaggaguccggccccggcgcccagaacucccccuaccagcuccgccgcaagacccuccuccccaagcgcaccgccugccccaccaagaacuccauggagggcgccuccaccuccaccaccgagaacuucggccaccgcgccaagcgcgcccgcgucuccggcaagucccaggaccucuccgccgcccccgccgagcaguaccuccaggagaagcuccccgacgaggucguccucaagaucuucuccuaccuccucgagcaggaccucugccgcgccgccugcgucugcaagcgcuucuccgagcucgccaacgaccccauccucuggaagcgccucuacauggaggucuucgaguacacccgccccaugaugcaccccgagcccggcaaguucuaccagaucaaccccgaggaguacgagcaccccaaccccuggaaggaguccuuccagcagcucuacaagggcgcccacgucaagcccggcuucgccgagcacuucuacuccaaccccgcccgcuacaagggccgcgagaacaugcucuacuacgacaccaucgaggacgcccucggcggcguccaggaggcccacuucgacggccucaucuucguccacuccggcaucuacaccgacgaguggaucuacaucgagucccccaucaccaugaucggcgccgcccccggcaaggucgccgacaaggucaucaucgagaacacccgcgacuccaccuucgucuucauggagggcuccgaggacgccuacgucggcuacaugaccauccgcuucaaccccgacgacaaguccgcccagcaccacaacgcccaccacugccucgagaucaccgucaacugcucccccaucaucgaccacugcaucauccgcuccaccugcaccgucggcuccgccgucugcgucuccggccagggcgccugccccaccaucaagcacugcaacaucuccgacugcgagaacgucggccucuacaucaccgaccacgcccagggcaucuacgaggacaacgagaucuccaacaacgcccucgccggcaucugggucaagaaccacggcaaccccaucauccgccgcaaccacauccaccacggccgcgacgucggcgucuucaccuucgaccacggcaugggcuacuucgaguccugcaacauccaccgcaaccgcaucgccggcuucgaggucaaggccuacgccaaccccaccgucguccgcugcgagauccaccacggccagaccggcggcaucuacguccacgagaagggccgcggccaguucaucgagaacaagaucuacgccaacaacuucgccggcgucuggaucaccuccaacuccgaccccaccauccgcggcaacuccaucuucaacggcaaccagggcggcgucuacaucuucggcgacggccgcggccucaucgagggcaacgacaucuacggcaacgcccucgccggcauccagauccgcaccaacuccugccccaucguccgccacaacaagauccacgacggccagcacggcggcaucuacguccacgagaagggccagggcgucaucgaggagaacgaggucuacuccaacacccucgccggcgucugggucaccaccggcuccacccccguccuccgccgcaaccgcauccacuccggcaagcaggucggcgucuacuucuacgacaacggccacggcguccucgaggacaacgacaucuacaaccacauguacuccggcguccagauccgcaccggcuccaaccccaagauccgccgcaacaagaucuggggcggccagaacggcggcauccucgucuacaacuccggccucggcugcaucgaggacaacgagaucuucgacaacgccauggccggcgucuggaucaagaccgacuccaaccccacccuccgccgcaacaagauccacgacggccgcgacggcggcaucugcaucuucaacggcggccgcggccuccucgaggagaacgacaucuuccgcaacgcccaggccggcguccucaucuccaccaacucccaccccauccuccgcaagaaccgcaucuucgacggcuucgccgccggcaucgagaucaccaaccacgccaccgccacccucgagggcaaccagaucuucaacaaccgcuucggcggccucuuccucgccuccggcgucaacgucaccaugaaggacaacaagaucaugaacaaccaggacgccaucgagaaggccgucucccgcggccagugccucuacaagaucuccuccuacaccuccuaccccaugcacgacuucuaccgcugccacaccugcaacaccaccgaccgcaacgccaucugcgucaacugcaucaagaagugccaccagggccacgacgucgaguucauccgccacgaccgcuucuucugcgacugcggcgccggcacccucuccaaccccugcacccucgccggcgagcccacccacgacaccgacacccucuacgacuccgccccccccaucgaguccaacacccuccagcacaacuga

SEQ ID NO: 43104 - RNA, 1533 nt, Artificial Sequence
  derived and/or modified sequence opt2 from FBXO15__Homo_sapiens__NP_001136430
auggccaccggccgcggccgcauccuccagcagcacuggcucggccuccagacccuccgcggccccucccgcggcggcggcgccgcccgcggccgcgcccgcgccuucggcugccgcaagggccccggcgucaagcucuccgccggcuccgccgcccuccgcugccacgccggcggcggccagcacugggaguccuccuucuccugcugcuccggcuuccucgacggcaugcccuccgagauccuccucaagaucuucuccuaccucgacgccgucucccuccucugcaccggcugcgucucccgccgcuucuaccaccucgccaacgacaacuucaucuggaucggcaucuacuccaccgccuucucccccgcccgcuccaacuggaaguucaacuccgucgagaagaucgccauguccauguccuuccucuccguccaggacaaggaggccggcuacuggaagaaggaguacaucaccaagcagaucgccuccgucaaggccgcccucgccgacauccucaagcccgucaaccccuacaccggccuccccgucaagaccaaggaggcccuccgcaucuucggccucggcugggccaucauccucaaggagaagggcggcaaggaguacaucauggagcacgucgaccucuccaucaacgacaccuccgucaccgucaucugguacggcaagaaguggcccugccucgccucccucuccacccucgaccucugcggcaugacccccgucuucaccgacugguacaagacccccaccaagcaccgccuccgcuggcacucccucaucgccaaguacaaccucucccaccucaccaucuccaccaugaucggcugcgaccgccucauccgcaucuucugccuccaccccggccuccucgucggcgucuggaagaaggaggaggagcucgccuucgucauggccaaccuccacuuccaccaccucgucgagcgcuccacccucggcuccgccaccauccccuacgagcuccccccccacucccccuuccucgacgacucccccgaguacggccuccacggcuaccagcuccacgucgaccuccacuccggcggcgucuucuaccucugcggcaccuuccgcaaccucuucaccaagcgcggcaacaucgagaacggccacgucaagcucaucgucauccaccucaagaacaaccgcgagcaccucccccucaucggcaaggucggccucuccuggaagaccgacaucuucgacggcugcaucaaguccugcuccaugauggacgucacccuccucgacgagcacggcaagcccuucuggugcuucuccucccccgucugccuccgcucccccgccacccccuccgacuccuccuccuuccucggccagaccuacaacgucgacuacgucgacgccgagggccgcguccacgucgagcucgucuggauccgcgagaccgaggaguaccucaucgucaaccucguccucuaccucuccaucgccaagaucaaccacugguucggcaccgaguacuga

SEQ ID NO: 43105 - RNA, 837 nt, Artificial Sequence
  derived and/or modified sequence opt2 from FBXO17__Homo_sapiens__NP_079183
augggcgcccgccucucccgccgccgccuccccgccgaccccucccucgcccucgacgcccucccccccgagcuccucguccagguccucucccacguccccccccgcucccucgucacccgcugccgccccgucugccgcgccuggcgcgacaucgucgacggccccaccgucuggcuccuccagcucgcccgcgaccgcuccgccgagggccgcgcccucuacgccgucgcccagcgcugccuccccuccaacgaggacaaggaggaguucccccucugcgcccucgcccgcuacugccuccgcgcccccuucggccgcaaccucaucuucaacuccugcggcgagcagggcuuccgcggcugggaggucgagcacggcggcaacggcugggccaucgagaagaaccucacccccguccccggcgcccccucccagaccugcuucgucaccuccuucgaguggugcuccaagcgccagcucgucgaccucgucauggagggcgucuggcaggagcuccucgacuccgcccagaucgagaucugcgucgccgacugguggggcgcccgcgagaacugcggcugcgucuaccagcuccgcguccgccuccucgacgucuacgagaaggaggucgucaaguucuccgccucccccgaccccguccuccaguggaccgagcgcggcugccgccaggucucccacgucuucaccaacuucggcaagggcauccgcuacgucuccuucgagcaguacggccgcgacgucuccuccugggucggccacuacggcgcccucgucacccacuccuccguccgcguccgcauccgccucuccuga

SEQ ID NO: 43106 - RNA, 2961 nt, Artificial Sequence
  derived and/or modified sequence opt2 from FBXO18__Homo_sapiens__NP_001245381
auggccaaguccaacuccgucggccaggacuccugccaggacuccgagggcgacaugaucuuccccgccgaguccuccugcgcccucccccaggagggcuccgccggccccggcucccccggcuccgccccccccucccgcaagcgcuccugguccuccgaggaggaguccaaccaggccaccggcaccucccgcugggacggcgucuccaagaaggccccccgccaccaccucuccguccccugcacccgcccccgcgaggcccgccaggaggccgaggacuccaccucccgccucuccgccgaguccggcgagaccgaccaggacgccggcgacgucggccccgaccccauccccgacuccuacuacggccuccucggcacccuccccugccaggaggcccucucccacaucugcucccuccccuccgagguccuccgccacgucuucgccuuccuccccgucgaggaccucuacuggaaccucucccucgucugccaccucuggcgcgagaucaucuccgacccccucuucauccccuggaagaagcucuaccaccgcuaccucaugaacgaggagcaggccgucuccaaggucgacggcauccucuccaacugcggcaucgagaaggaguccgaccucugcguccucaaccucauccgcuacaccgccaccaccaagugcucccccuccgucgaccccgagcgcguccucuggucccuccgcgaccacccccuccuccccgaggccgaggccugcguccgccagcaccuccccgaccucuacgccgccgccggcggcgucaacaucugggcccucgucgccgccgucguccuccucuccuccuccgucaacgacauccagcgccuccucuucugccuccgccgccccuccuccaccgucaccaugcccgacgucaccgagacccucuacugcaucgccguccuccucuacgccaugcgcgagaagggcaucaacaucuccaaccgcauccacuacaacaucuucuacugccucuaccuccaggagaacuccugcacccaggccaccaaggucaaggaggagcccuccgucuggcccggcaagaagaccauccagcucacccacgagcagcagcucauccucaaccacaagauggagccccuccaggucgucaagaucauggccuucgccggcaccggcaagaccuccacccucgucaaguacgccgagaaguggucccagucccgcuuccucuacgucaccuucaacaaguccaucgccaagcaggccgagcgcgucuuccccuccaacgucaucugcaagaccuuccacuccauggccuacggccacaucggccgcaaguaccaguccaagaagaagcucaaccucuucaagcucacccccuucauggucaacuccguccucgccgagggcaagggcggcuucauccgcgccaagcucgucugcaagacccucgagaacuucuucgccuccgccgacgaggagcucaccaucgaccacguccccaucuggugcaagaacucccagggccagcgcgucauggucgagcaguccgagaagcucaacggcguccucgaggccucccgccucugggacaacaugcgcaagcucggcgagugcaccgaggaggcccaccagaugacccacgacggcuaccucaagcucuggcagcucuccaagcccucccucgccuccuucgacgccaucuucgucgacgaggcccaggacugcacccccgccaucaugaacaucguccucucccagcccugcggcaagaucuucgucggcgacccccaccagcagaucuacaccuuccgcggcgccgucaacgcccucuucaccgucccccacacccacgucuucuaccucacccaguccuuccgcuucggcgucgagaucgccuacgucggcgccaccauccucgacgucugcaagcgcguccgcaagaagacccucgucggcggcaaccaccaguccggcauccgcggcgacgccaagggccaggucgcccuccucucccgcaccaacgccaacgucuucgacgaggccguccgcgucaccgagggcgaguuccccucccgcauccaccucaucggcggcaucaaguccuucggccucgaccgcaucaucgacaucuggauccuccuccagcccgaggaggagcgccgcaagcagaaccucgucaucaaggacaaguucauccgccgcuggguccacaaggagggcuucuccggcuucaagcgcuacgucaccgccgccgaggacaaggagcucgaggccaagaucgccgucgucgagaaguacaacauccgcauccccgagcucguccagcgcaucgagaagugccacaucgaggaccucgacuucgccgagauggagucccaccacgucggccaggccggccucgagcuccccaccuccgaguacauccucggcaccguccacaaggccaagggccucgaguucgacaccguccacguccucgacgacuucgucaagguccccugcgcccgccacaaccucccccagcucccccacuuccgcgucgaguccuucuccgaggacgaguggaaccuccucuacgucgccgucacccgcgccaagaagcgccucaucaugaccaagucccucgagaacauccucacccucgccggcgaguacuuccuccaggccgagcucaccuccaacguccucaagaccggcgucguccgcugcugcgucggccagugcaacaacgccauccccgucgacaccguccucaccaugaagaagcuccccaucaccuacuccaaccgcaaggagaacaagggcggcuaccucugccacuccugcgccgagcagcgcaucggcccccucgccuuccucaccgccucccccgagcagguccgcgccauggagcgcaccgucgagaacaucguccucccccgccacgaggcccuccucuuccucgucuucuga

SEQ ID NO: 43107 - RNA, 540 nt, Artificial Sequence
  derived and/or modified sequence opt2 from FBXO28__Homo_sapiens__NP_001129587
auggccgccgccgccgaggagcgcauggccgaggagggcggcggcggccagggcgacggcggcuccucccucgccuccggcuccacccagcgccagccccccccccccgccccccagcacccccagcccggcucccaggcccuccccgcccccgcccucgcccccgaccagcucccccagaacaacacccucgucgcccuccccaucgucgccaucgagaacauccucuccuucauguccuacgacgagaucucccagcuccgccucgucugcaagcgcauggaccucgucugccagcgcaugcucaaccagggcuuccucaaggucgagcgcuaccacaaccucugccagaagcaggucaaggcccagcucccccgccgcgaguccgagcgccgcaaccacucccucgcccgccacgccgacauccucgccgccgucgagacccgccucucccuccucaacaugaccuucaugaaguacgucgacuccaaccucugcugcuucauccccggcaaguuccaggaccgccuccagcccuga

SEQ ID NO: 43108 - RNA, 2238 nt, Artificial Sequence
  derived and/or modified sequence opt2 from FBXO30__Homo_sapiens__XP_005267216
auggaggaggagcuccagcacucccacugcgucaacugcgucucccgccgcugcaugacccgccccgagcccggcaucuccugcgaccucaucggcugcccccucgucugcggcgccgucuuccacuccugcaaggccgacgagcaccgccuccucugccccuucgagcgcguccccugccucaacuccgacuucggcugccccuucaccauggcccgcaacaaggucgccgagcaccucgagaugugccccgccuccgucgucugcugcaccauggaguggaaccgcuggcccgucuccuacgccgaccgcaaguccuacgagaaccucucccgcgacgucgacgaggucgcccagcucgacauggcccucgcccuccaggaccagcgcaugcuccucgagucccucaaggucgccaccaugauguccaaggccaccgacaaggucuccaagccccgcgagcagaucuccgucaaguccuccguccccgagaucccccacgccaacggccucgucuccgucgacgaggaguccuacggcgcccucuaccaggccaccgucgagaccacccgcucccucgccgccgcccucgacauccucaacaccgccacccgcgacaucggcaugcucaacaccuccguccccaacgacauggacgagcagcagaacgcccgcgagucccucgaggaccagaaccucaaggaccaggaccaccucuacgaggaggagaucggcgccgucggcggcaucgacuacaacgacaccaaccagaacgcccaguccgagcagaacggcuccuccgaccuccucugcgaccucaacaccuccuccuacgacaccuccgcccucugcaacggcuucccccucgagaacaucugcacccaggucaucgaccagaaccagaaccuccacggcgacuccaagcaguccaaccucaccaacggcgacugcgucgccuccuccgacggcaccuccaagcccuccuccucccucgccgucgccgcccagcuccgcgagaucauccccuccuccgcccuccccaacggcaccguccagcacauccucaugcccgacgacgagggcgagggcgagcucugcuggaagaaggucgaccucggcgacgucaagaacgucgacguccucuccuucucccacgcccccuccuucaacuuccucuccaacuccugcugguccaagcccaaggaggacaaggccgucgacaccuccgaccucgaggucgccgaggaccccaugggccuccagggcaucgaccucaucaccgccgcccuccucuucugccucggcgacucccccggcggccgcggcaucuccgacucccgcauggccgacaucuaccacaucgacgucggcacccagaccuucucccuccccuccgccauccucgccaccuccaccauggucggcgagaucgccuccgccuccgccugcgaccacgccaacccccagcucuccaaccccucccccuuccagacccucggccucgaccucguccucgagugcgucgcccgcuaccagcccaagcagcgcuccauguucaccuucgucugcggccagcucuuccgccgcaaggaguucuccucccacuucaagaacguccacggcgacauccacgccggccucaacggcuggauggagcagcgcugcccccucgccuacuacggcugcaccuacucccagcgccgcuucugccccuccauccagggcgccaagaucauccacgaccgccaccuccgcuccuucggcguccagcccugcgucuccaccguccucgucgagcccgcccgcaacugcguccucggccuccacaacgaccaccucuccucccuccccuucgagguccuccagcacaucgccggcuuccucgacggcuucucccucugccagcucuccugcgucuccaagcucaugcgcgacgucugcggcucccuccuccagucccgcggcauggucauccuccaguggggcaagcgcaaguaccccgagggcaacuccuccuggcagaucaaggagaaggucuggcgcuucuccaccgccuucugcuccgucaacgaguggaaguucgccgacauccucuccauggccgaccaccucaagaagugcuccuacaacgucgucgagaagcgcgaggaggccaucccccuccccugcaugugcgucacccgcgagcucaccaaggagggccgcucccuccgcuccguccucaagcccguccucuga

SEQ ID NO: 43109 - RNA, 1104 nt, Artificial Sequence
  derived and/or modified sequence opt2 from FBXO31__Homo_sapiens__NP_001269612
auguaccuccccccccacgacccccacgucgacgaccccaugcgcuucaagccccucuuccgcauccaccucauggagcgcaaggccgccaccgucgagugcauguacggccacaagggcccccaccacggccacauccagaucgucaagaaggacgaguucuccaccaagugcaaccagaccgaccaccaccgcauguccggcggccgccaggaggaguuccgcaccuggcuccgcgaggaguggggccgcacccucgaggacaucuuccacgagcacaugcaggagcucauccucaugaaguucaucuacaccucccaguacgacaacugccucaccuaccgccgcaucuaccucccccccucccgccccgacgaccucaucaagcccggccucuucaagggcaccuacggcucccacggccucgagaucgucaugcucuccuuccacggccgccgcgcccgcggcaccaagaucaccggcgaccccaacauccccgccggccagcagaccgucgagaucgaccuccgccaccgcauccagcuccccgaccucgagaaccagcgcaacuucaacgagcucucccgcaucguccucgagguccgcgagcgcguccgccaggagcagcaggagggcggccacgaggccggcgagggccgcggccgccagggcccccgcgagucccagcccucccccgcccagccccgcgccgaggcccccuccaagggccccgacggcacccccggcgaggacggcggcgagcccggcgacgccgucgccgccgccgagcagcccgcccagugcggccagggccagcccuucguccuccccgucggcgucuccucccgcaacgaggacuacccccgcaccugccgcaugugcuucuacggcaccggccucaucgccggccacggcuucaccucccccgagcgcacccccggcgucuucauccucuucgacgaggaccgcuucggcuucgucuggcucgagcucaaguccuucucccucuacucccgcguccaggccaccuuccgcaacgccgacgcccccuccccccaggccuucgacgagaugcucaagaacauccagucccucaccuccuga

SEQ ID NO: 43110 - RNA, 789 nt, Artificial Sequence
  derived and/or modified sequence opt2 from FBXO32__Homo_sapiens__NP_001229392
augcccuuccucggccaggacuggcgcucccccggccagaacugggucaagaccgccgacggcuggaagcgcuuccucgacgagaaguccggcuccuucgucuccgaccucuccuccuacugcaacaaggaggucuacaacaaggagaaccucuucaacucccucaacuacgacgucgccgccaagaagcgcaagaaggacaugcucaacuccaagaccaagacccaguacuuccaccaggagaaguggaucuacguccacaagggcuccaccaaggagcgccacggcuacugcacccucggcgaggccuucaaccgccucgacuucuccaccgccauccucgacucccgccgcuucaacuacgucguccgccccgccuucaagggccucaccuucaccgaccucccccucugccuccagcucaacaucaugcagcgccucuccgacggccgcgaccucgucucccucggccaggccgcccccgaccuccacguccucuccgaggaccgccuccucuggaagaagcucugccaguaccacuucuccgagcgccagauccgcaagcgccucauccucuccgacaagggccagcucgacuggaagaagauguacuucaagcucguccgcugcuacccccgcaaggagcaguacggcgacacccuccagcucugcaagcacugccacauccucuccuggaagggcaccgaccaccccugcaccgccaacaaccccgaguccugcuccgucucccucuccccccaggacuucaucaaccucuucaaguucuga

SEQ ID NO: 43111 - RNA, 1668 nt, Artificial Sequence
  derived and/or modified sequence opt2 from FBXO33__Homo_sapiens__NP_976046
augcuccucuuccucuccgucccccagccccgcccccccggcgcccgcacccgcgccggcgccgcccgcgucgcccgcuggcgccgccuccgccuccagcagcuccgccgccuccgcggccuccuccgcguccuccgcggccgccccggcgccggcucccgccgccgcggccgcauggcccucugcggccaggccgccggcgccgccucccuccccuccgagcucaucguccacaucuucuccuuccuccccgcccccgaccgccuccgcgccuccgccuccugcucccacuggcgcgagugccucuucuaccccgcccucuggccccagcuccgcaucugccuccgcgucucccccgccgagcagccccgccucgaguuccucaugcgcaagugcggcugguucguccgcgagcuccgcgucgaguucgccgccgagaacuaccucuccggcggcggccccggcgacggcggcggcgccgacaccggcaccggcggcgaggaggucgaggcccuccagcucuccgcccgcuggcucgagguccuccgcaccuaccucgagcucguccucugcguccucgucuccauccgcaacaaccgcaaccuccagaaguucucccucuucggcgacaucuccguccuccagcagcagggcucccucuccaacaccuaccucuccaaggucgaccccgacggcaagaagaucaagcagauccagcagcucuucgaggagauccucuccaacucccgccagcucaaguggcucuccugcggcuucaugcucgagaucgucacccccaccucccucuccucccucuccaacgccgucgccaacaccauggagcaccucucccuccucgacaacaacauccccggcaacuccacccucaucaccgccgucgagcucgagcgcuucgucaaccuccacucccucgcccucgacuucugcgacuucaccgccgagauggcccgcguccucaccgacuccaaccacgucccccuccagcgccucucccuccucguccacaacgucuccgucaugcacaagucccucgacaacaugcccaacgacgagcacuggaaggcccucucccgcaaguccaccuccuuccgcgucuacaucauggccuucgacaucaaguccgaggacaugcucaagauccucaagcccuccaucccccucgagcgcauccacuucgacuccuacaucaccugcgucuccggcgccaucgucgaccucaucucccgccaguacgacaaguuccucacccacuucauccucaugaacgacgucaucgacaccuccggcuuccccgaccucuccgacaaccgcaacgaggacccccucguccuccucgccuggcgcugcaccaagcucucccuccucgccauccacggcuacaccgucugggcccacaaccucaucgccaucgcccgccuccgcggcuccgaccucaagguccucgaggucaccgaggaguccaucgacuucgaccagggcgagcucgccgaccaggacgucgaccccguccacaaccucaucgagcaggucucccucggccucggccagcccuggcacgccgucauggacaucgagucccucuccgucuucaccgagcccaaccgccacuucuaccgcgagaugcaguccuucuccgaggacaucuga

SEQ ID NO: 43112 - RNA, 2832 nt, Artificial Sequence
  derived and/or modified sequence opt2 from FBXO38__Homo_sapiens__NP_001258652
augggcccccgcaagaaguccgucaagaccugcaucaugaacaacgagauccccgaggagaugaccgccgacgagaccaaggacuacaugaaccagcucucccacgagguccucugccacaucuuccgcuaccucccccuccaggacaucaugugcauggagugccucucccgcaagcucaaggaggccgucacccucuaccuccgcgucguccgcgucgucgaccucugcgccggccgcuggugggaguacaugcccuccggcuucaccgacgccuccuuccucacccuccucaagaagaugcccgacgucgagcagcucuacggccuccacccccgcuaccucgagcgccgccgcguccgcggccacgaggccuucuccauccccggcguccucgaggcccuccaggccugccccaaccucgucggcgucgagaccucccaccucgagcucgucgaguccaucuggaccuacaugccccacguccacauccucggcaaguuccgcaaccgcaacggcgccuuccccaucccccccgagaacaagcucaagauccccaucggcgccaagauccagacccuccaccucgucggcgucaacguccccgagauccccugcauccccaugcuccgccaccucuacaugaaguggguccgccucaccaagccccagcccuucaaggacuuccucugcaucucccuccgcaccuucgucaugcgcaacugcgccggccccaccaacucccucaaguacgucccccucgucaccggccucgccuccgcccgcaaccucgagcaccucgagaugguccgcguccccuuccucggcggccucauccagcacgucgucgaggacuccuggcgcuccggcggcuuccgcaaccuccacaccaucguccucggcgccugcaagaacgcccucgaggucgaccucggcuaccucaucaucaccgccgcccgccgccuccacgagguccgcauccagcccucccucaccaaggacggcgucuucuccgcccucaagauggccgagcucgaguucccccaguucgagacccuccaccucggcuacgucgacgaguuccuccuccagucccgcauggccaacgccgaccucgucaaguacggccucgccgacgucgucgagaaccccggcaucaucaccgacaucggcaugaaggccgucaacgaggucuucuccugcaucaaguaccucgccaucuacaacugcccccaccuccacaaccccuacaacuggaucuccgaccacucccgcuggacccgccucgucgacaucaaccucguccgcugccacgcccucaagcucgacuccuucggccaguucaucgagcuccuccccucccucgaguucaucucccucgaccagauguuccgcgagccccccaagggcugcgcccgcgucggccucuccgccggcaccggcaucggcgucuccuccgcccucgucuccaaccagaacuccaacaacgacgacaacaacgcccagaacaacaacgccaacauccacgacaacaaccaccaccaccccgacgacuccgacgaggagaacgacuuccgccaggaccuccagcccggcgagcagcaguucgccgccgacgcccucaacgagauggaggacaucguccaggaggacggcgaggucgucgccgaguccggcaacaacacccccgcccacucccaggccaucauccccgucgacgucgacgaggagcaggccggccccuccggccuccagcgcgucgucaagcccaccuccaucaccguccacgacuccgaguccgacgacgaggaggacucccucgagcuccaggaggucuggauccccaagaacggcacccgccgcuacuccgagcgcgaggagaagaccggcgaguccguccagucccgcgagcucuccgaggucgccaagaccaagccccgccacgccaugaagcgcaagcgcaccgccgacaaguccaccuccaccuccgaccccgucaucgaggacgaccacguccagguccucguccucaaguccaagaaccucgucggcgucaccaugaccaacugcggcaucaccgaccucguccucaaggacugccccaagaugauguucauccacgccacccgcugccgcguccucaagcaccucaaggucgagaacgcccccaucgucaaccgcuucgacuacgcccagugcaagaagcucaacauggaccagguccucgaccagauccuccgcaugccccccgagcgcaaccgcaucaucuaccuccgccccaugcagcaggucgacacccucacccucgagcagaagcucuucuccggccccuaccccuaccacaucugcaucauccacgaguucuccaacccccccaacguccgcaacaagguccgcauccgcuccuggauggacaccaucgccaacaucaaccaggagcucaucaaguacgaguucuuccccgaggccacccgcuccgaggaggaccucaagaaguaccccaaguaccccuggggccgcgagaucuacacccucgagggcgucgucgacggcgcccccuacuccaugaucuccgacuuccccuggcuccgcucccuccgcgccgccgagcccaacuccuucgcccgcuacgacuucgaggacgacgaggaguccaccaucuacgccccccgccgcaagggccagcucuccgccgacaucugcauggagaccaucggcgaggagaucuccgagaugcgccagaugaagaagggcgucuuccagcgcgucgucgccaucuucauccacuacugcgacgucaacggcgagcccgucgaggacgacuacaucuga

SEQ ID NO: 43113 - RNA, 1416 nt, Artificial Sequence
  derived and/or modified sequence opt2 from FBXO3__Homo_sapiens__NP_036307
auggccgccauggagaccgagaccgccccccucacccucgagucccuccccaccgacccccuccuccucauccucuccuuccucgacuaccgcgaccucaucaacugcugcuacgucucccgccgccucucccagcucuccucccacgacccccucuggcgccgccacugcaagaaguacuggcucaucuccgaggaggagaagacccagaagaaccagugcuggaagucccucuucaucgacaccuacuccgacgucggccgcuacaucgaccacuacgccgccaucaagaaggccugggacgaccucaagaaguaccucgagccccgcugcccccgcaugguccucucccucaaggagggcgcccgcgaggaggaccucgacgccgucgaggcccagaucggcugcaagcuccccgacgacuaccgcugcuccuaccgcauccacaacggccagaagcucgucguccccggccuccucggcuccauggcccucuccaaccacuaccgcuccgaggaccuccucgacgucgacaccgccgccggcggcuuccagcagcgccagggccucaaguacugccucccccucaccuucugcauccacaccggccucucccaguacaucgccgucgaggccgccgagggccgcaacaagaacgaggucuucuaccagugccccgaccagauggcccgcaaccccgccgccaucgacauguucaucaucggcgccaccuucaccgacugguucaccuccuacgucaagaacgucgucuccggcggcuuccccaucauccgcgaccagaucuuccgcuacguccacgaccccgagugcgucgccaccaccggcgacaucaccgucuccgucuccaccuccuuccuccccgagcucuccuccguccaccccccccacuacuucuucaccuaccgcauccgcaucgagauguccaaggacgcccuccccgagaaggccugccagcucgacucccgcuacuggcgcaucaccaacgccaagggcgacgucgaggagguccagggccccggcgucgucggcgaguuccccaucaucucccccggccgcgucuacgaguacaccuccugcaccaccuucuccaccaccuccggcuacauggagggcuacuacaccuuccacuuccucuacuucaaggacaagaucuucaacgucgccaucccccgcuuccacauggccugccccaccuuccgcgucuccaucgcccgccucgagaugggccccgacgaguacgaggagauggaggaggaggaggaggaggaggaggaggaggacgaggacgacgacuccgccgacauggacgaguccgacgaggacgacgaggaggagcgccgccgccgcgucuucgacguccccauccgccgccgccgcugcucccgccucuucuga

SEQ ID NO: 43114 - RNA, 2130 nt, Artificial Sequence
  derived and/or modified sequence opt2 from FBXO40__Homo_sapiens__NP_057382
augggcaaggcccgccgcuccccccccggccaccaccgccacugcgagggcugcuucaaccgccacugccacauccccgucgagcccaacaccuccugccucgucaucuccugccaccuccucugcggcgccaccuuccacaugugcaaggaggccgagcaccagcuccucugcccccucgagcagguccccugccucaacuccgaguacggcugcccccucuccaugucccgccacaagcucgccaagcaccuccaggucugccccgccuccgucgucugcugcuccauggaguggaaccgcuggcccaacgucgacuccgagaccacccuccacgagaacaucaugaaggagacccccuccgaggagugccucgacaccgcccucgcccuccaggaccagaagguccucuuccgcucccucaagauggucgagcucuuccccgagacccgcgaggccaccgaggaggagcccaccaugaacggcgagaccuccgucgaggagaugggcggcgccgucggcggcgucgacaucggccucgucccccacggccucuccgccaccaacggcgagauggccgagcucucccaggaggagcgcgagguccucgccaagaccaaggagggcauggaccucgucaaguucggccagugggagaacaucuucuccaaggagcacgccgccuccgcccucaccaacuccuccgccuccugcgaguccaagaacaagaacgacuccgagaaggagcagaucuccuccggccacaacauggucgagggcgagggcgcccccaagaagaaggagccccaggagaaccagaagcagcaggacguccgcaccgccauggagaccaccggccucgcccccuggcaggacggcguccucgagcgccucaagaccgccgucgacgccaaggacuacaacauguaccucguccacaacggccgcaugcucauccacuucggccagaugcccgccugcacccccaaggagcgcgacuucgucuacggcaagcucgaggcccaggaggucaagaccgucuacaccuucaagguccccgucuccuacugcggcaagcgcgcccgccucggcgacgccaugcucuccugcaagcccuccgagcacaaggccgucgacaccuccgaccucggcaucaccgucgaggaccuccccaaguccgaccucaucaagaccacccuccagugcgcccucgagcgcgagcucaagggccacgucaucuccgagucccgcuccaucgacggccucuucauggacuucgccacccagaccuacaacuucgagcccgagcaguucuccuccggcaccguccucgccgaccucaccgccgccacccccggcggccuccacgucgagcuccacuccgagugcgucacccgccgccacaacaaguccuccuccgccuucaccuucaccugcaacaaguucuuccgccgcgacgaguucccccuccacuucaagaacguccacaccgacauccaguccugccucaacggcugguuccagcaccgcugcccccucgccuaccucggcugcaccuucguccagaaccacuuccgcccccccggccagaaggccaaggucaucuacucccaggagcucaagaccuucgccaucaagcccgaggucgcccccgagcucuccgagggccgcaagaacaaccaccuccucggccacggcggcaagucccagaacucccucaccucccucccccucgagauccucaaguacaucgccggcuuccucgacuccgucucccucgcccagcucucccaggucuccguccucaugcgcaacaucugcgccacccuccuccaggagcgcggcaugguccuccuccaguggaagaagaagcgcuacucccacggcggcaccuccuggcgcguccaccgcgagaucuggcaguucuccucccucuucuccaagaucaaguccugggaguucaacgaggucaccuccauguccgagcaccucaaguccugccccuucaacaucgucgagcacaagaccgaccccauccuccucaccuccaugugccagccccgcgagcaggcccgcgagucccucgucuccaccuuccgcauccgcccccgcggccgcuacgucuccuga

SEQ ID NO: 43115 - RNA, 1359 nt, Artificial Sequence
  derived and/or modified sequence opt2 from FBXO47__Homo_sapiens__XP_011523166
auggccucccgcaucaacaccaacuucacccucauccccaaccagaagcuccgccgcuccaaccgccagaccuccugcuacuccaagacccucggcuccggcuuccagcccaucuccaccuucggcaacuucaaggcccucccccucgagaucuuccagaucauccucaaguaccucuccgucaaggacaucuccaugcucuccauggucuccaagaccgucucccagcacaucaucaacuacaucuccaccuccuccggcuccaagcgccuccuccuccaggacuuccacaaccucgagcuccccgaccgccgccaggacuccgccauccucgagcacuaccgcucccucggccuccucuucaagcgcugcacccuccuccuccccaccaaggagcgccucaaguacauccacaagauccucaccgaggucuccugcuucaaguucaacggcugcgccgcccccaugcagugccucggccucaccugcuacggcauguuccuccagacccucaccgccggcugggacgagcucgagugccaccgcgucuacaacuuccucugcgagcucaccaaccucugccgcaagauccagauggccgucugcuccaagcccggcuccgcccagaagcucgagcuccgcauccgccucuucugccgcaacguccuccucgaccacuggacccaccgcuccgacuccgccuucuggcucacccgcauccucaagcccuggcccauggucaaccaggcccgccuccucuacaucaucuucggccccaucuccccccaggacggccaggucgucuggcaggagaugaucgaggagcccaccgacgaguucucccucaagggccucgccgacgccaucaagcuccucuacgacgccuccaccaaggaguggaccgccgacgacgucaucucccucgucgacgagcucuccgucgucccccgcgaguggcuccucgagaacaacgcccgccuccucaugcucuccggcaacaacaucugcuucuccuucauggccuccaaggccgucaacggccgcaccaucgagcucgcccgccucgucgucuuccucgcccucgucugcgagaaggagcucuacugcauggacuggaccgucaagaugaugcagaaggucugcaaggucuucuccacccccgucgagcgcaagaacuuccuccagaacgucgccaacgccuucgccugcgucaucauggagaugcuccaguccaucauguccggcgaccgcgacgaggacgaccgcuccuuccucaaccucuuccaccucguccacgcccaggccaacuuccacaaggagguccucuaccucaccaugaacaccccccucuccaccuga

SEQ ID NO: 43116 - RNA, 1164 nt, Artificial Sequence
  derived and/or modified sequence opt2 from FBXO4__Homo_sapiens__NP_036308
auggccggcuccgagccccgcuccggcaccaacuccccccccccccccuucuccgacuggggccgccucgaggccgccauccucuccggcuggaagaccuucuggcaguccgucuccaaggagcgcgucgcccgcaccaccucccgcgaggaggucgacgaggccgccuccacccucacccgccuccccaucgacguccagcucuacauccucuccuuccucuccccccacgaccucugccagcucggcuccaccaaccacuacuggaacgagaccguccgcgaccccauccucuggcgcuacuuccuccuccgcgaccuccccuccugguccuccgucgacuggaagucccuccccgaccucgagauccucaagaagcccaucuccgaggucaccgacggcgccuucuucgacuacauggccgucuaccgcaugugcugccccuacacccgccgcgccuccaaguccucccgccccauguacggcgccgucaccuccuuccuccacucccucaucauccagaacgagccccgcuucgccauguucggccccggccucgaggagcucaacaccucccucguccucucccucauguccuccgaggagcucugccccaccgccggccucccccagcgccagaucgacggcaucggcuccggcgucaacuuccagcucaacaaccagcacaaguucaacauccucauccucuacuccaccacccgcaaggagcgcgaccgcgcccgcgaggagcacaccuccgccgucaacaagauguucucccgccacaacgagggcgacgaccagcagggcucccgcuacuccgucaucccccagauccagaaggucugcgaggucgucgacggcuucaucuacgucgccaacgccgaggcccacaagcgccacgaguggcaggacgaguucucccacaucauggccaugaccgaccccgccuucggcuccuccggccgcccccuccucguccucuccugcaucucccagggcgacgucaagcgcaugcccugcuucuaccucgcccacgagcuccaccucaaccuccucaaccaccccuggcucguccaggacaccgaggccgagacccucaccggcuuccucaacggcaucgaguggauccucgaggaggucgaguccaagcgcgcccgcuga

SEQ ID NO: 43117 - RNA, 1206 nt, Artificial Sequence
  derived and/or modified sequence opt2 from FBXO5__Homo_sapiens__NP_001135994
augaagugcgacuucaacugcaaccacguccacuccggccucaagcucgucaagcccgacgacaucggccgccucgucuccuacacccccgccuaccucgagggcuccugcaaggacugcaucaaggacuacgagcgccucuccugcaucggcucccccaucgucuccccccgcaucguccagcucgagaccgaguccaagcgccuccacaacaaggagaaccagcacguccagcagacccucaacuccaccaacgagaucgaggcccucgagaccucccgccucuacgaggacuccggcuacuccuccuucucccuccaguccggccucuccgagcacgaggagggcucccuccucgaggagaacuucggcgacucccuccaguccugccuccuccagauccagucccccgaccaguaccccaacaagaaccuccuccccguccuccacuucgagaaggucgucugcuccacccucaagaagaacgccaagcgcaaccccaaggucgaccgcgagaugcucaaggagaucaucgcccgcggcaacuuccgccuccagaacaucaucggccgcaagaugggccucgagugcgucgacauccucuccgagcucuuccgccgcggccuccgccacguccucgccaccauccucgcccagcucuccgacauggaccucaucaacgucuccaaggucuccaccaccuggaagaagauccucgaggacgacaagggcgccuuccagcucuacuccaaggccauccagcgcgucaccgagaacaacaacaaguucuccccccacgccuccacccgcgaguacgucauguuccgcaccccccucgccuccguccagaaguccgccgcccagaccucccucaagaaggacgcccagaccaagcucuccaaccagggcgaccagaagggcuccaccuacucccgccacaacgaguucuccgaggucgccaagacccucaagaagaacgagucccucaaggccugcauccgcugcaacucccccgccaaguacgacugcuaccuccagcgcgccaccugcaagcgcgagggcugcggcuucgacuacugcaccaagugccucugcaacuaccacaccaccaaggacugcuccgacggcaagcuccucaaggccuccugcaagaucggcccccuccccggcaccaagaaguccaagaagaaccuccgccgccucuga

SEQ ID NO: 43118 - RNA, 1332 nt, Artificial Sequence
  derived and/or modified sequence opt2 from FBXO7__Homo_sapiens__NP_001028196
auggcccgcccccccggcggcuccggcccccuccucgacuccgagcacuccucccuccagaacaacgagcagcccucccucgccaccuccuccaaccagaccuccaugcaggacgagcagcccuccgacuccuuccagggccaggccgcccaguccggcgucuggaacgacgacuccaugcucggccccucccagaacuucgaggccgaguccauccaggacaacgcccacauggccgagggcaccggcuucuaccccuccgagcccaugcucugcuccgaguccgucgagggccaggucccccacucccucgagacccucuaccaguccgccgacugcuccgacgccaacgacgcccucaucguccucauccaccuccucaugcucgaguccggcuacaucccccagggcaccgaggccaaggcccucuccaugcccgagaaguggaagcucuccggcgucuacaagcuccaguacaugcacccccucugcgagggcuccuccgccacccucaccugcgucccccucggcaaccucaucgucgucaacgccacccucaagaucaacaacgagauccgcuccgucaagcgccuccagcuccuccccgaguccuucaucugcaaggagaagcucggcgagaacgucgccaacaucuacaaggaccuccagaagcucucccgccucuucaaggaccagcucgucuacccccuccucgccuucacccgccaggcccucaaccuccccgacgucuucggccucgucguccucccccucgagcucaagcuccgcaucuuccgccuccucgacguccgcuccguccucucccucuccgccgucugccgcgaccucuucaccgccuccaacgacccccuccucuggcgcuuccucuaccuccgcgacuuccgcgacaacaccguccgcguccaggacaccgacuggaaggagcucuaccgcaagcgccacauccagcgcaaggagucccccaagggccgcuucgucaugcuccuccccuccuccacccacaccauccccuucuaccccaacccccuccacccccgccccuuccccuccucccgccucccccccggcaucaucggcggcgaguacgaccagcgccccacccuccccuacgucggcgaccccaucuccucccucauccccggccccggcgagacccccucccaguuccccccccuccgcccccgcuucgaccccgucggcccccuccccggccccaaccccauccuccccggccgcggcggccccaacgaccgcuuccccuuccgccccucccgcggccgccccaccgacggccgccucuccuucauguga

SEQ ID NO: 43119 - RNA, 960 nt, Artificial Sequence
  derived and/or modified sequence opt2 from FBXO8__Homo_sapiens__NP_036312
augggccagggccucuggcgcgucguccgcaaccagcagcuccagcaggagggcuacuccgagcagggcuaccucacccgcgagcagucccgccgcauggccgccuccaacaucuccaacaccaaccaccgcaagcagguccagggcggcaucgacaucuaccaccuccucaaggcccgcaaguccaaggagcaggagggcuucaucaaccucgagaugcucccccccgagcucuccuucaccauccucuccuaccucaacgccaccgaccucugccucgccuccugcgucuggcaggaccucgccaacgacgagcuccucuggcagggccucugcaaguccaccuggggccacugcuccaucuacaacaagaaccccccccucggcuucuccuuccgcaagcucuacaugcagcucgacgagggcucccucaccuucaacgccaaccccgacgagggcgucaacuacuucauguccaagggcauccucgacgacucccccaaggagaucgccaaguucaucuucugcacccgcacccucaacuggaagaagcuccgcaucuaccucgacgagcgccgcgacguccucgacgaccucgucacccuccacaacuuccgcaaccaguuccuccccaacgcccuccgcgaguucuuccgccacauccacgcccccgaggagcgcggcgaguaccucgagacccucaucaccaaguucucccaccgcuucugcgccugcaaccccgaccucaugcgcgagcucggccucucccccgacgccgucuacguccucugcuacucccucauccuccucuccaucgaccucaccuccccccacgucaagaacaagauguccaagcgcgaguucauccgcaacacccgccgcgccgcccagaacaucuccgaggacuucgucggccaccucuacgacaacaucuaccucaucggccacgucgccgccuga

SEQ ID NO: 43120 - RNA, 1344 nt, Artificial Sequence
  derived and/or modified sequence opt2 from FBXO9__Homo_sapiens__NP_036479
augcccgacaucaucugggucuuccccccccaggccgaggccgaggaggacugccacuccgacaccguccgcgccgacgacgacgaggagaacgagucccccgccgagaccgaccuccaggcccagcuccagauguuccgcgcccaguggauguucgagcucgcccccggcgucuccuccuccaaccucgagaaccgccccugccgcgccgcccgcggcucccuccagaagaccuccgccgacaccaagggcaagcaggagcaggccaaggaggagaaggcccgcgagcucuuccucaaggccgucgaggaggagcagaacggcgcccucuacgaggccaucaaguucuaccgccgcgccaugcagcucguccccgacaucgaguucaagaucaccuacacccgcucccccgacggcgacggcgucggcaacuccuacaucgaggacaacgacgacgacuccaagauggccgaccuccucuccuacuuccagcagcagcucaccuuccaggaguccguccucaagcucugccagcccgagcucgaguccucccagauccacaucuccguccuccccauggagguccucauguacaucuuccgcugggucgucuccuccgaccucgaccuccgcucccucgagcagcucucccucgucugccgcggcuucuacaucugcgcccgcgaccccgagaucuggcgccucgccugccucaaggucuggggccgcuccugcaucaagcucguccccuacaccuccuggcgcgagauguuccucgagcgcccccgcguccgcuucgacggcgucuacaucuccaagaccaccuacauccgccagggcgagcagucccucgacggcuucuaccgcgccuggcaccaggucgaguacuaccgcuacauccgcuucuuccccgacggccacgucaugaugcucaccacccccgaggagccccaguccaucgucccccgccuccgcacccgcaacacccgcaccgacgccauccuccucggccacuaccgccucucccaggacaccgacaaccagaccaaggucuucgccgucaucaccaagaagaaggaggagaagccccucgacuacaaguaccgcuacuuccgccgcguccccguccaggaggccgaccaguccuuccacgucggccuccagcucugcuccuccggccaccagcgcuucaacaagcucaucuggauccaccacuccugccacaucaccuacaaguccaccggcgagaccgccgucuccgccuucgagaucgacaagauguacaccccccucuucuucgcccgcguccgcuccuacaccgccuucuccgagcgcccccucuga

SEQ ID NO: 43121 - RNA, 1629 nt, Artificial Sequence
  derived and/or modified sequence opt2 from FBXW11__Homo_sapiens__NP_036432
auggagcccgacuccgucaucgaggacaagaccaucgagcucaugugcuccgucccccgcucccucuggcucggcugcgccaaccucgucgaguccaugugcgcccucuccugccuccaguccaugcccuccguccgcugccuccagaucuccaacggcaccuccuccgucaucgucucccgcaagcgccccuccgagggcaacuaccagaaggagaaggaccucugcaucaaguacuucgaccagugguccgaguccgaccaggucgaguucgucgagcaccucaucucccgcaugugccacuaccagcacggccacaucaacuccuaccucaagcccaugcuccagcgcgacuucaucaccgcccuccccgagcagggccucgaccacaucgccgagaacauccucuccuaccucgacgcccgcucccucugcgccgccgagcucgucugcaaggaguggcagcgcgucaucuccgagggcaugcucuggaagaagcucaucgagcgcaugguccgcaccgacccccucuggaagggccucuccgagcgccgcggcugggaccaguaccucuucaagaaccgccccaccgacggcccccccaacuccuucuaccgcucccucuaccccaagaucauccaggacaucgagaccaucgaguccaacuggcgcugcggccgccacaaccuccagcgcauccagugccgcuccgagaacuccaagggcgucuacugccuccaguacgacgacgagaagaucaucuccggccuccgcgacaacuccaucaagaucugggacaagaccucccucgagugccucaagguccucaccggccacaccggcuccguccucugccuccaguacgacgagcgcgucaucgucaccggcuccuccgacuccaccguccgcgucugggacgucaacaccggcgagguccucaacacccucauccaccacaacgaggccguccuccaccuccgcuucuccaacggccucauggucaccugcuccaaggaccgcuccaucgccgucugggacauggccuccgccaccgacaucacccuccgccgcguccucgucggccaccgcgccgccgucaacgucgucgacuucgacgacaaguacaucgucuccgccuccggcgaccgcaccaucaaggucugguccaccuccaccugcgaguucguccgcacccucaacggccacaagcgcggcaucgccugccuccaguaccgcgaccgccucgucgucuccggcuccuccgacaacaccauccgccucugggacaucgagugcggcgccugccuccgcguccucgagggccacgaggagcucguccgcugcauccgcuucgacaacaagcgcaucgucuccggcgccuacgacggcaagaucaaggucugggaccuccaggccgcccucgacccccgcgcccccgccuccacccucugccuccgcacccucgucgagcacuccggccgcgucuuccgccuccaguucgacgaguuccagaucaucuccuccucccacgacgacaccauccucaucugggacuuccucaacgucccccccuccgcccagaacgagacccgcucccccucccgcaccuacaccuacaucucccgcuga

SEQ ID NO: 43122 - RNA, 1239 nt, Artificial Sequence
  derived and/or modified sequence opt2 from FBXW4__Homo_sapiens__NP_071322
auggccgccgccgccggcgaggaggaggaggaggaggaggccgcccgcgaguccgccgcccgccccgccgccggccccgcccucuggcgccuccccgaggagcuccuccuccucaucugcuccuaccucgacaugcgcgcccucggccgccucgcccaggucugccgcuggcuccgccgcuucaccuccugcgaccuccucuggcgccgcaucgcccgcgccucccucaacuccggcuucacccgccucggcaccgaccucaugaccuccguccccgucaaggagcgcgucaaggucucccagaacuggcgccucggccgcugccgcgagggcauccuccucaaguggcgcugcucccagaugcccuggaugcagcucgaggacgacucccucuacaucucccaggccaacuucauccucgccuaccaguuccgccccgacggcgccucccucaaccgccgcccccucggcgucuucgccggccacgacgaggacgucugccacuucguccucgccaacucccacaucgucuccgccggcggcgacggcaagaucggcauccacaagauccacuccaccuucaccgucaaguacuccgcccacgagcaggaggucaacugcgucgacugcaagggcggcaucaucgucuccggcucccgcgaccgcaccgccaaggucuggccccucgccuccggccgccucggccagugccuccacaccauccagaccgaggaccgcgucugguccaucgccaucuccccccuccucuccuccuucgucaccggcaccgccugcugcggccacuucuccccccuccgcaucugggaccucaacuccggccagcucaugacccaccucggcuccgacuucccccccggcgccggcguccucgacgucauguacgagucccccuucacccuccucuccugcggcuacgacaccuacguccgcuacugggaccuccgcaccuccguccgcaagugcgucauggagugggaggagccccacgacuccacccucuacugccuccagaccgacggcaaccaccuccucgccaccggcuccuccuacuacggcgucguccgccucugggaccgccgccagcgcgccugccuccacgccuucccccucaccuccaccccccucuccucccccgucuacugccuccgccucaccaccaagcaccucuacgccgcccucuccuacaaccuccacguccucgacuuccagaaccccuga

SEQ ID NO: 43123 - RNA, 1884 nt, Artificial Sequence
  derived and/or modified sequence opt2 from FBXW7__Homo_sapiens__NP_060785
augugcgucccccgcuccggccucauccucuccugcaucugccucuacugcggcguccuccuccccguccuccuccccaaccuccccuuccucaccugccucuccauguccacccucgaguccgucaccuaccuccccgagaagggccucuacugccagcgccuccccuccucccgcacccacggcggcaccgagucccucaagggcaagaacaccgagaacaugggcuucuacggcacccucaagaugaucuucuacaagaugaagcgcaagcucgaccacggcuccgagguccgcuccuucucccucggcaagaagcccugcaaggucuccgaguacaccuccaccaccggccucguccccugcuccgccacccccaccaccuucggcgaccuccgcgccgccaacggccagggccagcagcgccgccgcaucaccuccguccagccccccaccggccuccaggaguggcucaagauguuccaguccugguccggccccgagaagcuccucgcccucgacgagcucaucgacuccugcgagcccacccaggucaagcacaugaugcaggucaucgagccccaguuccagcgcgacuucaucucccuccuccccaaggagcucgcccucuacguccucuccuuccucgagcccaaggaccuccuccaggccgcccagaccugccgcuacuggcgcauccucgccgaggacaaccuccucuggcgcgagaagugcaaggaggagggcaucgacgagccccuccacaucaagcgccgcaaggucaucaagcccggcuucauccacucccccuggaaguccgccuacauccgccagcaccgcaucgacaccaacuggcgccgcggcgagcucaagucccccaagguccucaagggccacgacgaccacgucaucaccugccuccaguucugcggcaaccgcaucgucuccggcuccgacgacaacacccucaaggucugguccgccgucaccggcaagugccuccgcacccucgucggccacaccggcggcgucugguccucccagaugcgcgacaacaucaucaucuccggcuccaccgaccgcacccucaaggucuggaacgccgagaccggcgagugcauccacacccucuacggccacaccuccaccguccgcugcaugcaccuccacgagaagcgcgucgucuccggcucccgcgacgccacccuccgcgucugggacaucgagaccggccagugccuccacguccucaugggccacgucgccgccguccgcugcguccaguacgacggccgccgcgucgucuccggcgccuacgacuucauggucaaggucugggaccccgagaccgagaccugccuccacacccuccagggccacaccaaccgcgucuacucccuccaguucgacggcauccacgucgucuccggcucccucgacaccuccauccgcgucugggacgucgagaccggcaacugcauccacacccucaccggccaccagucccucaccuccggcauggagcucaaggacaacauccucgucuccggcaacgccgacuccaccgucaagaucugggacaucaagaccggccagugccuccagacccuccagggccccaacaagcaccaguccgccgucaccugccuccaguucaacaagaacuucgucaucaccuccuccgacgacggcaccgucaagcucugggaccucaagaccggcgaguucauccgcaaccucgucacccucgaguccggcggcuccggcggcgucgucuggcgcauccgcgccuccaacaccaagcucgucugcgccgucggcucccgcaacggcaccgaggagaccaagcuccucguccucgacuucgacgucgacaugaaguga

SEQ ID NO: 43124 - RNA, 1599 nt, Artificial Sequence
  derived and/or modified sequence opt2 from FBXW8__Homo_sapiens__NP_036306
auggacgacuacucccucgacgaguuccgccgccgcuggcaggaggagcucgcccaggcccaggcccccaagaagcgccgccgccccgaggccgccgagcgccgcgcccgccgccccgagaacgagaugaacgacguccccuucuucgacauccagcuccccuacgagcucgccaucaacaucuuccaguaccucgaccgcaaggagcucggccgcugcgcccaggucuccaagaccuggaaggucaucgccgaggacgagguccucugguaccgccucugccagcaggagggccaccuccccgacuccuccaucuccgacuacuccugcuggaagcucaucuuccaggagugccgcgccaaggagcacaugcuccgcaccaacuggaagaaccgcaagggcgccgucuccgagcucgagcacguccccgacaccguccucugcgacguccacucccacgacggcgucgucaucgccggcuacaccuccggcgacguccgcgucugggacacccgcaccugggacuacgucgcccccuuccucgaguccgaggacgaggaggacgagcccggcaugcagcccaacgucuccuucguccgcaucaacuccucccucgccgucgccgccuacgaggacggcuuccucaacaucugggaccuccgcaccggcaaguaccccguccaccgcuucgagcacgacgcccgcauccaggcccucgcccucucccaggacgacgccaccgucgccaccgccuccgccuucgacgucgucaugcucucccccaacgaggagggcuacuggcagaucgccgccgaguucgagguccccaagcucguccaguaccucgagaucguccccgagacccgccgcuaccccgucgccgucgccgccgccggcgaccucauguaccuccucaaggccgaggacuccgcccgcacccuccucuacgcccacggcccccccgucaccugccucgacgucuccgccaaccaggucgccuucggcguccagggccucggcugggucuacgagggcuccaagauccucgucuacucccucgaggccggccgccgccuccucaagcucggcaacguccuccgcgacuucaccugcgucaaccucuccgacuccccccccaaccucauggucuccggcaacauggacggccgcguccgcauccacgaccuccgcuccggcaacaucgcccucucccucuccgcccaccagcuccgcgucuccgccguccagauggacgacuggaagaucgucuccggcggcgaggagggccucgucuccgucugggacuaccgcaugaaccagaagcucugggaggucuacuccggccaccccguccagcacaucuccuucuccucccacucccucaucaccgccaacguccccuaccagaccgucaugcgcaacgccgaccucgacuccuucaccacccaccgccgccaccgcggccucauccgcgccuacgaguucgccgucgaccagcucgccuuccaguccccccuccccgucugccgcuccuccugcgacgccauggccacccacuacuacgaccucgcccucgccuuccccuacaaccacgucuga

SEQ ID NO: 43125 - RNA, 864 nt, Artificial Sequence
  derived and/or modified sequence opt2 from FCAR__Homo_sapiens__NP_001991
auggaccccaagcagaccacccuccucugccucguccucugccucggccagcgcauccaggcccaggagggcgacuuccccaugcccuucaucuccgccaaguccucccccgucaucccccucgacggcuccgucaagauccagugccaggccauccgcgaggccuaccucacccagcucaugaucaucaagaacuccaccuaccgcgagaucggccgccgccucaaguucuggaacgagaccgaccccgaguucgucaucgaccacauggacgccaacaaggccggccgcuaccagugccaguaccgcaucggccacuaccgcuuccgcuacuccgacacccucgagcucgucgucaccggccucuacggcaagcccuuccucuccgccgaccgcggccucguccucaugcccggcgagaacaucucccucaccugcuccuccgcccacauccccuucgaccgcuucucccucgccaaggagggcgagcucucccucccccagcaccaguccggcgagcaccccgccaacuucucccucggccccgucgaccucaacgucuccggcaucuaccgcugcuacggcugguacaaccgcucccccuaccucugguccuuccccuccaacgcccucgagcucgucgucaccgacuccauccaccaggacuacaccacccagaaccucauccgcauggccgucgccggccucguccucgucgcccuccucgccauccucgucgagaacuggcacucccacaccgcccucaacaaggaggccuccgccgacgucgccgagcccuccuggucccagcagaugugccagcccggccucaccuucgcccgcacccccuccgucugcaaguga

SEQ ID NO: 43126 - RNA, 774 nt, Artificial Sequence
  derived and/or modified sequence opt2 from FCER1A__Homo_sapiens__NP_001992
auggcccccgccauggagucccccacccuccucugcgucgcccuccucuucuucgcccccgacggcguccucgccgucccccagaagcccaaggucucccucaacccccccuggaaccgcaucuucaagggcgagaacgucacccucaccugcaacggcaacaacuucuucgaggucuccuccaccaagugguuccacaacggcucccucuccgaggagaccaacuccucccucaacaucgucaacgccaaguucgaggacuccggcgaguacaagugccagcaccagcaggucaacgaguccgagcccgucuaccucgaggucuucuccgacuggcuccuccuccaggccuccgccgaggucgucauggagggccagccccucuuccuccgcugccacggcuggcgcaacugggacgucuacaaggucaucuacuacaaggacggcgaggcccucaaguacugguacgagaaccacaacaucuccaucaccaacgccaccgucgaggacuccggcaccuacuacugcaccggcaaggucuggcagcucgacuacgaguccgagccccucaacaucaccgucaucaaggccccccgcgagaaguacuggcuccaguucuucaucccccuccucgucgucauccucuucgccgucgacaccggccucuucaucuccacccagcagcaggucaccuuccuccucaagaucaagcgcacccgcaagggcuuccgccuccucaacccccaccccaagcccaaccccaagaacaacuga

SEQ ID NO: 43127 - RNA, 261 nt, Artificial Sequence
  derived and/or modified sequence opt2 from FCER1G__Homo_sapiens__NP_004097
augauccccgccgucguccuccuccuccuccuccucgucgagcaggccgccgcccucggcgagccccagcucugcuacauccucgacgccauccucuuccucuacggcaucguccucacccuccucuacugccgccucaagauccagguccgcaaggccgccaucaccuccuacgagaaguccgacggcgucuacaccggccucuccacccgcaaccaggagaccuacgagacccucaagcacgagaagcccccccaguga

SEQ ID NO: 43128 - RNA, 963 nt, Artificial Sequence
  derived and/or modified sequence opt2 from FCER2__Homo_sapiens__NP_001193948
augaacccccccucccaggagaucgaggagcucccccgccgccgcugcugccgccgcggcacccagaucguccuccucggccucgucaccgccgcccucugggccggccuccucacccuccuccuccucuggcacugggacaccacccagucccucaagcagcucgaggagcgcgccgcccgcaacgucucccaggucuccaagaaccucgagucccaccacggcgaccagauggcccagaagucccaguccacccagaucucccaggagcucgaggagcuccgcgccgagcagcagcgccucaagucccaggaccucgagcucuccuggaaccucaacggccuccaggccgaccucuccuccuucaagucccaggagcucaacgagcgcaacgaggccuccgaccuccucgagcgccuccgcgaggaggucaccaagcuccgcauggagcuccaggucuccuccggcuucgucugcaacaccugccccgagaaguggaucaacuuccagcgcaagugcuacuacuucggcaagggcaccaagcaguggguccacgcccgcuacgccugcgacgacauggagggccagcucgucuccauccacucccccgaggagcaggacuuccucaccaagcacgccucccacaccggcuccuggaucggccuccgcaaccucgaccucaagggcgaguucaucugggucgacggcucccacgucgacuacuccaacugggcccccggcgagcccaccucccgcucccagggcgaggacugcgucaugaugcgcggcuccggccgcuggaacgacgccuucugcgaccgcaagcucggcgccugggucugcgaccgccucgccaccugcaccccccccgccuccgagggcuccgccgaguccaugggccccgacucccgccccgaccccgacggccgccuccccacccccuccgccccccuccacuccuga

SEQ ID NO: 43129 - RNA, 16218 nt, Artificial Sequence
  derived and/or modified sequence opt2 from FCGBP__Homo_sapiens__NP_003881
augggcgcccucugguccugguggauccucugggccggcgccacccuccucuggggccucacccaggaggccuccgucgaccucaagaacaccggccgcgaggaguuccucaccgccuuccuccagaacuaccagcucgccuacuccaaggccuacccccgccuccucaucuccucccucuccgagucccccgccuccgucuccauccucucccaggccgacaacaccuccaagaaggucaccguccgccccggcgaguccgucauggucaacaucuccgccaaggccgagaugaucggcuccaagaucuuccagcacgccgucgucauccacuccgacuacgccaucuccguccaggcccucaacgccaagcccgacaccgccgagcucacccuccuccgccccauccaggcccucggcaccgaguacuucguccucaccccccccggcaccuccgcccgcaacgucaaggaguucgccgucgucgccggcgccgccggcgccuccgucuccgucacccucaagggcuccgucaccuucaacggcaaguucuaccccgccggcgacguccuccgcgucacccuccagcccuacaacgucgcccagcuccaguccuccgucgaccucuccggcuccaaggucaccgccuccucccccgucgccguccucuccggccacuccugcgcccagaagcacaccaccugcaaccacgucgucgagcagcuccuccccaccuccgccuggggcacccacuacgucguccccacccucgccucccagucccgcuacgaccucgccuucgucgucgccucccaggccaccaagcucaccuacaaccacggcggcaucaccggcucccgcggccuccaggccggcgacgucgucgaguucgagguccgccccuccuggccccucuaccucuccgccaacgucggcauccagguccuccucuucggcaccggcgccauccgcaacgaggucaccuacgaccccuaccucguccucauccccgacgucgccgccuacugccccgccuacgucgucaaguccguccccggcugcgagggcgucgcccucgucgucgcccagaccaaggccaucuccggccucaccaucgacggccacgccgucggcgccaagcucaccugggaggccguccccggcuccgaguucuccuacgccgaggucgagcucggcaccgccgacaugauccacaccgccgaggccaccaccaaccucggccuccucaccuucggccucgccaaggccaucggcuacgccaccgccgccgacugcggccgcaccguccucucccccgucgagcccuccugcgagggcaugcagugcgccgccggccagcgcugccaggucgucggcggcaaggccggcugcgucgccgaguccaccgccgucugccgcgcccagggcgacccccacuacaccaccuucgacggccgccgcuacgacaugaugggcaccugcuccuacaccauggucgagcucugcuccgaggacgacacccuccccgccuucuccgucgaggccaagaacgagcaccgcggcucccgccgcgucuccuacgucggccucgucaccguccgcgccuacucccacuccgucucccucacccgcggcgaggucggcuucguccucgucgacaaccagcgcucccgccuccccgucucccucuccgagggccgccuccgcgucuaccaguccggcccccgcgccgucgucgagcucgucuucggccucgucgucaccuacgacugggacugccagcucgcccucucccuccccgcccgcuuccaggaccaggucugcggccucugcggcaacuacaacggcgaccccgccgacgacuuccucacccccgacggcgcccucgcccccgacgccgucgaguucgccuccuccuggaagcucgacgacggcgacuaccucugcgaggacggcugccagaacaacugccccgccugcacccccggccaggcccagcacuacgagggcgaccgccucugcggcaugcucaccaagcucgacggccccuucgccgucugccacgacacccucgacccccgccccuuccucgagcagugcgucuacgaccucugcgucgucggcggcgagcgccucucccucugccgcggccucuccgccuacgcccaggccugccucgagcucggcaucuccgucggcgacuggcgcucccccgccaacugcccccucuccugccccgccaacucccgcuacgagcucugcggccccgccugccccaccuccugcaacggcgccgccgcccccuccaacugcuccggccgccccugcgucgagggcugcgucugccuccccggcuucgucgccuccggcggcgccugcguccccgccuccuccugcggcugcaccuuccagggccuccagcucgcccccggccaggaggucugggccgacgagcucugccagcgccgcugcaccugcaacggcgccacccaccaggucaccugccgcgacaagcaguccugccccgccggcgagcgcugcuccguccagaacggccuccucggcugcuaccccgaccgcuucggcaccugccagggcuccggcgacccccacuacgucuccuucgacggccgccgcuucgacuucaugggcaccugcaccuaccuccucgucggcuccugcggccagaacgccgcccuccccgccuuccgcguccucgucgagaacgagcaccgcggcucccagaccgucuccuacacccgcgccguccgcgucgaggcccgcggcgucaaggucgccguccgccgcgaguaccccggccagguccucgucgacgacguccuccaguaccuccccuuccaggccgccgacggccagguccaggucuuccgccagggccgcgacgccgucguccgcaccgacuucggccucaccgucaccuacgacuggaacgcccgcgucaccgccaagguccccuccuccuacgccgaggcccucugcggccucugcggcaacuucaacggcgaccccgccgacgaccucgcccuccgcggcggcggccaggccgccaacgcccucgccuucggcaacuccuggcaggaggagacccgccccggcugcggcgccaccgagcccggcgacugccccaagcucgacucccucgucgcccagcagcuccaguccaagaacgagugcggcauccucgccgaccccaagggccccuuccgcgagugccacuccaagcucgacccccagggcgccguccgcgacugcgucuacgaccgcugccuccuccccggccaguccggcccccucugcgacgcccucgccaccuacgccgccgccugccaggccgccggcgccaccguccaccccuggcgcuccgaggagcucugcccccucuccugccccccccacucccacuacgaggccugcuccuacggcugcccccucuccugcggcgaccuccccguccccggcggcugcggcuccgagugccacgagggcugcgucugcgacgagggcuucgcccucuccggcgaguccugccucccccucgccuccugcggcugcguccaccagggcaccuaccacccccccggccagaccuucuaccccggccccggcugcgacucccucugccacugccaggagggcggccucgucuccugcgaguccuccuccugcggcccccacgaggccugccagcccuccggcggcucccucggcugcgucgccgucggcuccuccaccugccaggccuccggcgacccccacuacaccaccuucgacggccgccgcuucgacuucaugggcaccugcgucuacguccucgcccagaccugcggcacccgccccggccuccaccgcuucgccguccuccaggagaacgucgccuggggcaacggccgcgucuccgucacccgcgucaucaccguccaggucgccaacuucacccuccgccucgagcagcgccaguggaaggucaccgucaacggcgucgacaugaagcuccccgucguccucgccaacggccagauccgcgccucccagcacggcuccgacgucgucaucgagaccgacuucggccuccgcgucgccuacgaccucgucuacuacguccgcgucaccguccccggcaacuacuaccagcagaugugcggccucugcggcaacuacaacggcgaccccaaggacgacuuccagaagcccaacggcucccaggccggcaacgccaacgaguucggcaacuccugggaggaggucguccccgacucccccugccucccccccacccccugcccccccggcuccgaggacugcauccccucccacaagugcccccccgagcucgagaagaaguaccagaaggaggaguucugcggccuccucuccucccccaccggcccccucuccuccugccacaagcucgucgacccccagggcccccucaaggacugcaucuucgaccucugccucggcggcggcaaccucuccauccucugcuccaacauccacgccuacgucuccgccugccaggccgccggcggccacgucgagcccuggcgcaccgagaccuucugccccauggagugcccccccaacucccacuacgagcucugcgccgacaccugcucccucggcugcuccgcccucuccgcccccccccagugccaggacggcugcgccgagggcugccagugcgacuccggcuuccucuacaacggccaggccugcguccccauccagcagugcggcugcuaccacaacggcgucuacuacgagcccgagcagaccguccucaucgacaacugccgccagcagugcaccugccacgccggcaagggcauggucugccaggagcacuccugcaagcccggccaggucugccagcccuccggcggcauccucuccugcgucaccaaggaccccugccacggcgucaccugccgcccccaggagaccugcaaggagcagggcggccagggcgucugccuccccaacuacgaggccaccugcuggcucuggggcgacccccacuaccacuccuucgacggccgcaaguucgacuuccagggcaccugcaacuacguccucgccaccaccggcugccccggcgucuccacccagggccucacccccuucaccgucaccaccaagaaccagaaccgcggcaaccccgccgucuccuacguccgcgucgucaccgucgccgcccucggcaccaacaucuccauccacaaggacgagaucggcaagguccgcgucaacggcguccucaccgcccuccccgucuccgucgccgacggccgcaucuccgucacccagggcgccuccaaggcccuccucgucgccgacuucggccuccaggucuccuacgacuggaacuggcgcgucgacgucacccuccccuccuccuaccacggcgccgucugcggccucugcggcaacauggaccgcaaccccaacaacgaccaggucuuccccaacggcacccucgcccccuccauccccaucuggggcggcuccuggcgcgcccccggcugggacccccucugcugggacgagugccgcggcuccugccccaccugccccgaggaccgccucgagcaguacgagggccccggcuucugcggcccccucgcccccggcaccggcggccccuucaccaccugccacgcccacgucccccccgaguccuucuucaagggcugcguccucgacgucugcaugggcggcggcgaccgcgacauccucugcaaggcccucgccuccuacgucgccgccugccaggccgccggcgucgucaucgaggacuggcgcgcccaggucggcugcgagaucaccugccccgagaacucccacuacgaggucugcggcucccccugccccgccuccugccccucccccgccccccucaccacccccgccgucugcgagggccccugcgucgagggcugccagugcgacgccggcuucguccucuccgccgaccgcugcgucccccucaacaacggcugcggcugcugggccaacggcaccuaccacgaggccggcuccgaguucugggccgacggcaccugcucccaguggugccgcugcggccccggcggcggcucccucgucugcacccccgccuccugcggccucggcgaggucugcggccuccuccccuccggccagcacggcugccagcccgucuccaccgccgagugccaggccuggggcgacccccacuacgucacccucgacggccaccgcuucaacuuccagggcaccugcgaguaccuccucuccgcccccugccacggccccccccucggcgccgagaacuucaccgucaccgucgccaacgagcaccgcggcucccaggccgucuccuacacccgcuccgucacccuccagaucuacaaccacucccucacccucuccgcccgcuggccccgcaagcuccaggucgacggcgucuucgucacccuccccuuccagcucgacucccuccuccacgcccaccucuccggcgccgacgucgucgucaccaccaccuccggccucucccucgccuucgacggcgacuccuucguccgccuccgcguccccgccgccuacgccggcucccucugcggccucugcggcaacuacaaccaggaccccgccgacgaccucaaggccgucggcggcaagcccgccggcuggcaggucggcggcgcccagggcugcggcgagugcgucuccaagcccugccccucccccugcacccccgagcagcaggaguccuucggcggccccgacgccugcggcgucaucuccgccaccgacggcccccucgcccccugccacggccucgucccccccgcccaguacuuccagggcugccuccucgacgccugccagguccagggccaccccggcggccucugccccgccgucgccaccuacgucgccgccugccaggccgccggcgcccagcuccgcgaguggcgccgccccgacuucugccccuuccagugccccgcccacucccacuacgagcucugcggcgacuccugccccggcuccugccccucccucuccgcccccgagggcugcgaguccgccugccgcgagggcugcgucugcgacgccggcuucguccucuccggcgacaccugcguccccgucggccagugcggcugccuccacgacgaccgcuacuacccccucggccagaccuucuaccccggccccggcugcgacucccucugccgcugccgcgagggcggcgaggucuccugcgagcccuccuccugcggcccccacgagaccugccgccccuccggcggcucccucggcugcgucgccgucggcuccaccaccugccaggccuccggcgacccccacuacaccaccuucgacggccgccgcuucgacuucaugggcaccugcgucuacguccucgcccagaccugcggcacccgccccggccuccaccgcuucgccguccuccaggagaacgucgccuggggcaacggccgcgucuccgucacccgcgucaucaccguccaggucgccaacuucacccuccgccucgagcagcgccaguggaaggucaccgucaacggcgucgacaugaagcuccccgucguccucgccaacggccagauccgcgccucccagcacggcuccgacgucgucaucgagaccgacuucggccuccgcgucgccuacgaccucgucuacuacguccgcgucaccguccccggcaacuacuaccagcucaugugcggccucugcggcaacuacaacggcgaccccaaggacgacuuccagaagcccaacggcucccaggccggcaacgccaacgaguucggcaacuccugggaggaggucguccccgacucccccugccuccccccccccaccugcccccccggcuccgagggcugcauccccuccgaggagugcccccccgagcucgagaagaaguaccagaaggaggaguucugcggccuccucuccucccccaccggcccccucuccuccugccacaagcucgucgacccccagggcccccucaaggacugcaucuucgaccucugccucggcggcggcaaccucuccauccucugcuccaacauccacgccuacgucuccgccugccaggccgccggcggccaggucgagcccuggcgcaacgagaccuucugccccauggagugcccccagaacucccacuacgagcucugcgccgacaccugcucccucggcugcuccgcccucuccgccccccuccagugccccgacggcugcgccgagggcugccagugcgacuccggcuuccucuacaacggccaggccugcguccccauccagcagugcggcugcuaccacaacggcgccuacuacgagcccgagcagaccguccucaucgacaacugccgccagcagugcaccugccacgucggcaaggucgucgucugccaggagcacuccugcaagcccggccaggucugccagcccuccggcggcauccucuccugcgucaacaaggaccccugccacggcgucaccugccgcccccaggagaccugcaaggagcagggcggccagggcgucugccuccccaacuacgaggccaccugcuggcucuggggcgacccccacuaccacuccuucgacggccgcaaguucgacuuccagggcaccugcaacuacguccucgccaccaccggcugccccggcgucuccacccagggccucacccccuucaccgucaccaccaagaaccagaaccgcggcaaccccgccgucuccuacguccgcgucgucaccgucgccgcccucggcaccaacaucuccauccacaaggacgagaucggcaagguccgcgucaacggcguccucaccgcccuccccgucuccgucgccgacggccgcaucuccgucacccagggcgccuccaaggcccuccucgucgccgacuucggccuccaggucuccuacgacuggaacuggcgcgucgacgucacccuccccuccuccuaccacggcgccgucugcggccucugcggcaacauggaccgcaaccccaacaacgaccaggucuuccccaacggcacccucgcccccuccauccccaucuggggcggcuccuggcgcgcccccggcugggacccccucugcugggacgagugccgcggcuccugccccaccugccccgaggaccgccucgagcaguacgagggccccggcuucugcggcccccucgcccccggcaccggcggccccuucaccaccugccacgcccacgucccccccgaguccuucuucaagggcugcguccucgacgucugcaugggcggcggcgaccgcgacauccucugcaaggcccucgccuccuacgucgccgccugccaggccgccggcgucgucaucgaggacuggcgcgcccaggucggcugcgagaucaccugccccgagaacucccacuacgaggucugcggcccccccugccccgccuccugccccucccccgccccccucaccacccccgccgucugcgagggccccugcgucgagggcugccagugcgacgccggcuucguccucuccgccgaccgcugcgucccccucaacaacggcugcggcugcugggccaacggcaccuaccacgaggccggcuccgaguucugggccgacggcaccugcucccaguggugccgcugcggccccggcggcggcucccucgucugcacccccgccuccugcggccucggcgaggucugcggccuccuccccuccggccagcacggcugccagcccgucuccaccgccgagugccaggccuggggcgacccccacuacgucacccucgacggccaccgcuucgacuuccagggcaccugcgaguaccuccucuccgcccccugccacggccccccccucggcgccgagaacuucaccgucaccgucgccaacgagcaccgcggcucccaggccgucuccuacacccgcuccgucacccuccagaucuacaaccacucccucacccucuccgcccgcuggccccgcaagcuccaggucgacggcgucuucgucacccuccccuuccagcucgacucccuccuccacgcccaccucuccggcgccgacgucgucgucaccaccaccuccggccucucccucgccuucgacggcgacuccuucguccgccuccgcguccccgccgccuacgccggcucccucugcggccucugcggcaacuacaaccaggaccccgccgacgaccucaaggccgucggcggcaagcccgccggcuggcaggucggcggcgcccagggcugcggcgagugcgucuccaagcccugccccucccccugcacccccgagcagcaggaguccuucggcggccccgacgccugcggcgucaucuccgccaccgacggcccccucgcccccugccacggccucgucccccccgcccaguacuuccagggcugccuccucgacgccugccagguccagggccaccccggcggccucugccccgccgucgccaccuacgucgccgccugccaggccgccggcgcccagcuccgcgaguggcgccgccccgacuucugccccuuccagugccccgcccacucccacuacgagcucugcggcgacuccugccccggcuccugccccucccucuccgcccccgagggcugcgaguccgccugccgcgagggcugcgucugcgacgccggcuucguccucuccggcgacaccugcguccccgucggccagugcggcugccuccacgacgaccgcuacuacccccucggccagaccuucuaccccggccccggcugcgacucccucugccgcugccgcgagggcggcgaggucuccugcgagcccuccuccugcggcccccacgagaccugccgccccuccggcggcucccucggcugcgucgccgucggcuccaccaccugccaggccuccggcgacccccacuacaccaccuucgacggccaccgcuucgacuucaugggcaccugcgucuacguccucgcccagaccugcggcacccgccccggccuccaccgcuucgccguccuccaggagaacgucgccuggggcaacggccgcgucuccgucacccgcgucaucaccguccaggucgccaacuucacccuccgccucgagcagcgccaguggaaggucaccgucaacggcgucgacaugaagcuccccgucguccucgccaacggccagauccgcgccucccagcacggcuccgacgucgucaucgagaccgacuucggccuccgcgucgccuacgaccucgucuacuacguccgcgucaccguccccggcaacuacuaccagcucaugugcggccucugcggcaacuacaacggcgaccccaaggacgacuuccagaagcccaacggcucccaggccggcaacgccaacgaguucggcaacuccugggaggaggucguccccgacucccccugccuccccccccccaccugcccccccggcuccgccggcugcauccccuccgacaagugcccccccgagcucgagaagaaguaccagaaggaggaguucugcggccuccucuccucccccaccggcccccucuccuccugccacaagcucgucgacccccagggcccccucaaggacugcaucuucgaccucugccucggcggcggcaaccucuccauccucugcuccaacauccacgccuacgucuccgccugccaggccgccggcggccacgucgagcccuggcgcaacgagaccuucugccccauggagugcccccagaacucccacuacgagcucugcgccgacaccugcucccucggcugcuccgcccucuccgccccccuccagugccccgacggcugcgccgagggcugccagugcgacuccggcuuccucuacaacggccaggccugcguccccauccagcagugcggcugcuaccacaacggcgucuacuacgagcccgagcagaccguccucaucgacaacugccgccagcagugcaccugccacgucggcaaggucgucgucugccaggagcacuccugcaagcccggccaggucugccagcccuccggcggcauccucuccugcgucaccaaggaccccugccacggcgucaccugccgcccccaggagaccugcaaggagcagggcggccagggcgucugccuccccaacuacgaggccaccugcuggcucuggggcgacccccacuaccacuccuucgacggccgcaaguucgacuuccagggcaccugcaacuacguccucgccaccaccggcugccccggcgucuccacccagggccucacccccuucaccgucaccaccaagaaccagaaccgcggcaaccccgccgucuccuacguccgcgucgucaccgucgccgcccucggcaccaacaucuccauccacaaggacgagaucggcaagguccgcgucaacggcguccucaccgcccuccccgucuccgucgccgacggccgcaucuccgucgcccagggcgccuccaaggcccuccucgucgccgacuucggccuccaggucuccuacgacuggaacuggcgcgucgacgucacccuccccuccuccuaccacggcgccgucugcggccucugcggcaacauggaccgcaaccccaacaacgaccaggucuuccccaacggcacccucgcccccuccauccccaucuggggcggcuccuggcgcgcccccggcugggacccccucugcugggacgagugccgcggcuccugccccaccugccccgaggaccgccucgagcaguacgagggccccggcuucugcggcccccucuccuccggcaccggcggccccuucaccaccugccacgcccacgucccccccgaguccuucuucaagggcugcguccucgacgucugcaugggcggcggcgaccgcgacauccucugcaaggcccucgccuccuacgucgccgccugccaggccgccggcgucgucaucgaggacuggcgcgcccaggucggcugcgagaucaccugccccgagaacucccacuacgaggucugcggcccccccugccccgccuccugccccucccccgccccccucaccacccccgccgucugcgagggccccugcgucgagggcugccagugcgacgccggcuucguccucuccgccgaccgcugcgucccccucaacaacggcugcggcugcugggccaacggcaccuaccacgaggccggcuccgaguucugggccgacggcaccugcucccaguggugccgcugcggccccggcggcggcucccucgucugcacccccgccuccugcggccucggcgaggucugcggccuccuccccuccggccagcacggcugccagcccgucuccaccgccgagugccaggccuggggcgacccccacuacgucacccucgacggccaccgcuucgacuuccagggcaccugcgaguaccuccucuccgcccccugccacggccccccccucggcgccgagaacuucaccgucaccgucgccaacgagcaccgcggcucccaggccgucuccuacacccgcuccgucacccuccagaucuacaaccacucccucacccucuccgcccgcuggccccgcaagcuccaggucgacggcgucuucgucgcccuccccuuccagcucgacucccuccuccacgcccaccucuccggcgccgacgucgucgucaccaccaccuccggccucucccucgccuucgacggcgacuccuucguccgccuccgcguccccgccgccuacgccgccucccucugcggccucugcggcaacuacaaccaggaccccgccgacgaccucaaggccgucggcggcaagcccgccggcuggcaggucggcggcgcccagggcugcggcgagugcgucuccaagcccugccccucccccugcacccccgagcagcaggaguccuucggcggccccgacgccugcggcgucaucuccgccaccgacggcccccucgcccccugccacggccucgucccccccgcccaguacuuccagggcugccuccucgacgccugccagguccagggccaccccggcggccucugccccgccgucgccaccuacgucgccgccugccaggccgccggcgcccagcucggcgaguggcgccgccccgacuucugcccccuccagugccccgcccacucccacuacgagcucugcggcgacuccugccccgucuccugccccucccucuccgcccccgagggcugcgaguccgccugccgcgagggcugcgucugcgacgccggcuucguccucuccggcgacaccugcguccccgucggccagugcggcugccuccacgacggccgcuacuacccccucggcgaggucuucuaccccggccccgagugcgagcgccgcugcgagugcggccccggcggccacgucaccugccaggagggcgccgccugcggcccccacgaggagugccgccucgaggacggcguccaggccugccacgccaccggcugcggccgcugccucgccaacggcggcauccacuacaucacccucgacggccgcgucuacgaccuccacggcuccugcuccuacguccucgcccaggucugccaccccaagcccggcgacgaggacuucuccaucguccucgagaagaacgccgccggcgaccuccagcgccuccucgucaccgucgccggccaggucgucucccucgcccagggccagcaggucaccgucgacggcgaggccgucgcccuccccgucgccgucggccgcguccgcgucaccgccgagggccgcaacaugguccuccagaccaccaagggccuccgccuccucuucgacggcgacgcccaccuccucauguccauccccucccccuuccgcggccgccucugcggccucugcggcaacuucaacggcaacugguccgacgacuucguccuccccaacggcuccgccgccuccuccgucgagaccuucggcgccgccuggcgcgcccccggcuccuccaagggcugcggcgagggcugcggcccccagggcugccccgucugccucgccgaggagaccgcccccuacgaguccaacgaggccugcggccagcuccgcaacccccagggccccuucgccaccugccaggccguccucucccccuccgaguacuuccgccagugcgucuacgaccucugcgcccagaagggcgacaaggccuuccucugccgcucccucgccgccuacaccgccgccugccaggccgccggcgucgccgucaagcccuggcgcaccgacuccuucugcccccuccacugccccgcccacucccacuacuccaucugcacccgcaccugccagggcuccugcgccgcccucuccggccucaccggcugcaccacccgcugcuucgagggcugcgagugcgacgaccgcuuccuccucucccagggcgucugcauccccguccaggacugcggcugcacccacaacggccgcuaccuccccgucaacuccucccuccucaccuccgacugcuccgagcgcugcuccugcuccuccuccuccggccucaccugccaggccgccggcugcccccccggccgcgucugcgaggucaaggccgaggcccgcaacugcugggccacccgcggccucugcguccucuccgucggcgccaaccucaccaccuucgacggcgcccgcggcgccaccaccucccccggcgucuacgagcucuccucccgcugccccggccuccagaacaccauccccugguaccgcgucgucgccgagguccagaucugccacggcaagaccgaggccgucggccagguccacaucuucuuccaggacggcauggucacccucacccccaacaagggcgucugggucaacggccuccgcgucgaccuccccgccgagaagcucgccuccgucuccgucucccgcacccccgacggcucccuccucguccgccagaaggccggcguccaggucuggcucggcgccaacggcaaggucgccgucaucgucuccaacgaccacgccggcaagcucugcggcgccugcggcaacuucgacggcgaccagaccaacgacuggcacgacucccaggagaagcccgccauggagaaguggcgcgcccaggacuucucccccugcuacggcuga

SEQ ID NO: 43130 - RNA, 954 nt, Artificial Sequence
  derived and/or modified sequence opt2 from FCGR2A__Homo_sapiens__NP_001129691
augaccauggagacccagaugucccagaacgucugcccccgcaaccucuggcuccuccagccccucaccguccuccuccuccucgccuccgccgacucccaggccgccgccccccccaaggccguccucaagcucgagccccccuggaucaacguccuccaggaggacuccgucacccucaccugccagggcgcccgcucccccgaguccgacuccauccagugguuccacaacggcaaccucauccccacccacacccagcccuccuaccgcuucaaggccaacaacaacgacuccggcgaguacaccugccagaccggccagaccucccucuccgaccccguccaccucaccguccucuccgaguggcucguccuccagaccccccaccucgaguuccaggagggcgagaccaucaugcuccgcugccacuccuggaaggacaagccccucgucaaggucaccuucuuccagaacggcaagucccagaaguucucccaccucgaccccaccuucuccaucccccaggccaaccacucccacuccggcgacuaccacugcaccggcaacaucggcuacacccucuucuccuccaagcccgucaccaucaccguccagguccccuccaugggcuccuccucccccaugggcaucaucgucgccgucgucaucgccaccgccgucgccgccaucgucgccgccgucgucgcccucaucuacugccgcaagaagcgcaucuccgccaacuccaccgaccccgucaaggccgcccaguucgagccccccggccgccagaugaucgccauccgcaagcgccagcucgaggagaccaacaacgacuacgagaccgccgacggcggcuacaugacccucaacccccgcgcccccaccgacgacgacaagaacaucuaccucacccucccccccaacgaccacgucaacuccaacaacuga

SEQ ID NO: 43131 - RNA, 873 nt, Artificial Sequence
  derived and/or modified sequence opt2 from FCGR2B__Homo_sapiens__NP_001002273
augggcauccucuccuuccuccccguccucgccaccgaguccgacugggccgacugcaaguccccccagcccuggggccacaugcuccucuggaccgccguccucuuccucgcccccgucgccggcacccccgccccccccaaggccguccucaagcucgagccccaguggaucaacguccuccaggaggacuccgucacccucaccugccgcggcacccacucccccgaguccgacuccauccagugguuccacaacggcaaccucauccccacccacacccagcccuccuaccgcuucaaggccaacaacaacgacuccggcgaguacaccugccagaccggccagaccucccucuccgaccccguccaccucaccguccucuccgaguggcucguccuccagaccccccaccucgaguuccaggagggcgagaccaucguccuccgcugccacuccuggaaggacaagccccucgucaaggucaccuucuuccagaacggcaaguccaagaaguucucccgcuccgaccccaacuucuccaucccccaggccaaccacucccacuccggcgacuaccacugcaccggcaacaucggcuacacccucuacuccuccaagcccgucaccaucaccguccaggcccccuccuccucccccaugggcaucaucgucgccgucgucaccggcaucgccgucgccgccaucgucgccgccgucgucgcccucaucuacugccgcaagaagcgcaucuccgccaaccccaccaaccccgacgaggccgacaaggucggcgccgagaacaccaucaccuacucccuccucaugcaccccgacgcccucgaggagcccgacgaccagaaccgcaucuga

SEQ ID NO: 43132 - RNA, 873 nt, Artificial Sequence
  derived and/or modified sequence opt2 from FCGR3A__Homo_sapiens__NP_000560
augggcggcggcgccggcgagcgccucuucaccuccuccugccucgucggccucgucccccucggccuccgcaucucccucgucaccugcccccuccagugcggcaucauguggcagcuccuccuccccaccgcccuccuccuccucgucuccgccggcaugcgcaccgaggaccuccccaaggccgucgucuuccucgagccccagugguaccgcguccucgagaaggacuccgucacccucaagugccagggcgccuacucccccgaggacaacuccacccagugguuccacaacgagucccucaucuccucccaggccuccuccuacuucaucgacgccgccaccgucgacgacuccggcgaguaccgcugccagaccaaccucuccacccucuccgaccccguccagcucgagguccacaucggcuggcuccuccuccaggccccccgcugggucuucaaggaggaggaccccauccaccuccgcugccacuccuggaagaacaccgcccuccacaaggucaccuaccuccagaacggcaagggccgcaaguacuuccaccacaacuccgacuucuacauccccaaggccacccucaaggacuccggcuccuacuucugccgcggccucuucggcuccaagaacgucuccuccgagaccgucaacaucaccaucacccagggccucgccgucuccaccaucuccuccuucuucccccccggcuaccaggucuccuucugccucgucaugguccuccucuucgccgucgacaccggccucuacuucuccgucaagaccaacauccgcuccuccacccgcgacuggaaggaccacaaguucaaguggcgcaaggacccccaggacaaguga

SEQ ID NO: 43133 - RNA, 702 nt, Artificial Sequence
  derived and/or modified sequence opt2 from FCGR3B__Homo_sapiens__NP_000561
auguggcagcuccuccuccccaccgcccuccuccuccucgucuccgccggcaugcgcaccgaggaccuccccaaggccgucgucuuccucgagccccagugguacuccguccucgagaaggacuccgucacccucaagugccagggcgccuacucccccgaggacaacuccacccagugguuccacaacgagaaccucaucuccucccaggccuccuccuacuucaucgacgccgccaccgucaacgacuccggcgaguaccgcugccagaccaaccucuccacccucuccgaccccguccagcucgagguccacaucggcuggcuccuccuccaggccccccgcugggucuucaaggaggaggaccccauccaccuccgcugccacuccuggaagaacaccgcccuccacaaggucaccuaccuccagaacggcaaggaccgcaaguacuuccaccacaacuccgacuuccacauccccaaggccacccucaaggacuccggcuccuacuucugccgcggccucgucggcuccaagaacgucuccuccgagaccgucaacaucaccaucacccagggccucgccgucuccaccaucuccuccuucuccccccccggcuaccaggucuccuucugccucgucaugguccuccucuucgccgucgacaccggccucuacuucuccgucaagaccaacaucuga

SEQ ID NO: 43134 - RNA, 1098 nt, Artificial Sequence
  derived and/or modified sequence opt2 from FCGRT__Homo_sapiens__NP_001129491
augggcgucccccgcccccagcccugggcccucggccuccuccucuuccuccuccccggcucccucggcgccgagucccaccucucccuccucuaccaccucaccgccgucuccucccccgcccccggcacccccgccuucugggucuccggcuggcucggcccccagcaguaccucuccuacaacucccuccgcggcgaggccgagcccugcggcgccugggucugggagaaccaggucuccugguacugggagaaggagaccaccgaccuccgcaucaaggagaagcucuuccucgaggccuucaaggcccucggcggcaagggccccuacacccuccagggccuccucggcugcgagcucggccccgacaacaccuccguccccaccgccaaguucgcccucaacggcgaggaguucaugaacuucgaccucaagcagggcaccuggggcggcgacuggcccgaggcccucgccaucucccagcgcuggcagcagcaggacaaggccgccaacaaggagcucaccuuccuccucuucuccugcccccaccgccuccgcgagcaccucgagcgcggccgcggcaaccucgaguggaaggagccccccuccaugcgccucaaggcccgccccuccucccccggcuucuccguccucaccugcuccgccuucuccuucuacccccccgagcuccagcuccgcuuccuccgcaacggccucgccgccggcaccggccagggcgacuucggccccaacuccgacggcuccuuccacgccuccuccucccucaccgucaaguccggcgacgagcaccacuacugcugcaucguccagcacgccggccucgcccagccccuccgcgucgagcucgagucccccgccaaguccuccguccucgucgucggcaucgucaucggcguccuccuccucaccgccgccgccgucggcggcgcccuccucuggcgccgcaugcgcuccggccuccccgcccccuggaucucccuccgcggcgacgacaccggcguccuccuccccacccccggcgaggcccaggacgccgaccucaaggacgucaacgucauccccgccaccgccuga

SEQ ID NO: 43135 - RNA, 2676 nt, Artificial Sequence
  derived and/or modified sequence opt2 from FCHO1__Homo_sapiens__NP_001154829
auguccuacuucggcgagcacuucuggggcgagaagaaccacggcuucgagguccucuaccacuccgucaagcagggccccaucuccaccaaggagcucgccgacuucauccgcgagcgcgccaccaucgaggagaccuacuccaaggccauggccaagcucuccaagcucgccuccaacggcacccccaugggcaccuucgccccccucugggaggucuuccgcgucuccuccgacaagcucgcccucugccaccucgagcucacccgcaagcuccaggaccucaucaaggacguccuccgcuacggcgaggagcagcucaagacccacaagaagugcaaggaggaggucgucuccacccucgacgccguccagguccucuccggcgucucccagcuccuccccaagucccgcgagaacuaccucaaccgcugcauggaccaggagcgccuccgccgcgaguccaccucccagaaggagauggacaaggccgagaccaagaccaagaaggccgccgagucccuccgccgcuccgucgagaaguacaacuccgcccgcgccgacuucgagcagaagaugcucgacuccgcccuccgcuuccaggccauggaggagacccaccuccgccacaugaaggcccuccucggcuccuacgcccacuccgucgaggacacccacguccagaucggccagguccacgaggaguucaagcagaacaucgagaacgucuccgucgagaugcuccuccgcaaguucgccgaguccaagggcaccggccgcgagaagcccggcccccucgacuucgaggccuacuccgccgccgcccuccaggaggccaugaagcgccuccgcggcgccaaggccuuccgccuccccggccucucccgccgcgagcgcgagcccgagccccccgccgccgucgacuuccucgagcccgacuccggcaccugccccgaggucgacgaggagggcuucaccguccgccccgacgucacccagaacuccaccgccgagcccucccgcuucuccuccuccgacuccgacuucgacgacgaggagccccgcaaguucuacguccacaucaagcccgcccccgcccgcgcccccgccugcucccccgaggccgccgccgcccagcuccgcgccaccgccggcucccucauccucccccccggccccggcggcaccaugaagcgccacuccucccgcgacgccgccggcaagccccagcgcccccgcuccgccccccgcaccuccuccugcgccgagcgccuccaguccgaggagcaggucuccaagaaccucuucggccccccccucgaguccgccuucgaccacgaggacuucaccggcuccuccucccucggcuucaccuccucccccucccccuucuccuccuccucccccgagaacgucgaggacuccggccucgacucccccucccacgccgcccccggccccucccccgacuccugggucccccgccccggcaccccccaguccccccccuccugccgcgcccccccccccgaggcccgcggcauccgcgcccccccccuccccgacuccccccagccccucgccuccucccccggccccuggggccucgaggcccucgccggcggcgaccucaugcccgcccccgccgaccccaccgcccgcgagggccucgccgcccccccccgccgccuccgcucccgcaaggucuccugcccccucacccgcuccaacggcgaccucucccgcucccucucccccuccccccucggcuccuccgccgccuccaccgcccucgagcgccccuccuuccucucccagaccggccacggcgucucccgcggccccucccccgucguccucggcucccaggacgcccuccccaucgccaccgccuucaccgaguacguccacgccuacuuccgcggccacucccccuccugccucgcccgcgucaccggcgagcucaccaugaccuuccccgccggcaucguccgcgucuucuccggcaccccccccccccccguccucuccuuccgccucguccacaccaccgccaucgagcacuuccagcccaacgccgaccuccucuucuccgaccccucccaguccgaccccgagaccaaggacuucuggcucaacauggccgcccucaccgaggcccuccagcgccaggccgagcagaaccccaccgccuccuacuacaacgucguccuccuccgcuaccaguucucccgccccggcccccaguccgucccccuccagcucuccgcccacuggcagugcggcgccacccucacccaggucuccgucgaguacggcuaccgccccggcgccaccgccguccccaccccccucaccaacguccagauccuccuccccgucggcgagcccgucaccaacguccgccuccagcccgccgccaccuggaaccucgaggagaagcgccucaccuggcgccuccccgacgucuccgaggccggcggcuccggccgccucuccgccuccugggagccccucuccggccccuccacccccucccccgucgccgcccaguucaccuccgagggcaccacccucuccggcgucgaccucgagcucgucggcuccggcuaccgcaugucccucgucaagcgccgcuucgccaccgccgcccccccccagggcugcaccugguga

SEQ ID NO: 43136 - RNA, 2334 nt, Artificial Sequence
  derived and/or modified sequence opt2 from FCHO2__Homo_sapiens__NP_001139504
auggucauggccuacuucgucgagaacuucuggggcgagaagaacuccggcuucgacguccucuaccacaacaugaagcacggccagaucuccaccaaggagcucgccgacuucguccgcgagcgcgccaccaucgaggaggccuacucccgcuccaugaccaagcucgccaaguccgccuccaacuacucccagcucggcaccuucgcccccgucugggacgucuucaagaccuccaccgagaagcucgccaacugccaccucgaccucguccgcaagcuccaggagcucaucaaggagguccagaaguacggcgaggagcaggucaagucccacaagaagaccaaggaggaggucgccggcacccucgaggccguccagaccauccaguccaucacccaggcccuccagaaguccaaggagaacuacaacgccaagugcgucgagcaggagcgccucaagaaggagggcgccacccagcgcgagaucgagaaggccgccgucaaguccaagaaggccaccgacaccuacaagcucuacgucgagaaguacgcccucgccaaggccgacuucgagcagaagaugaccgagaccgcccagguccacgaggaguucaucaacaacauggccaacaccaccgucgagucccucauccagaaguucgccgaguccaagggcaccggcaaggagcgccccggccucaucgaguucgaggagugcgacaccgccuccgccgucgagggcaucaagccccgcaagcgcaagaccuucgcccuccccggcaucaucaagaaggagaaggacgccgaguccgucgagugccccgacgccgacucccucaacauccccgacgucgacgaggagggcuacuccaucaagcccgagaccaaccagaacgacaccaaggagaaccacuucuacuccuccuccgacuccgacuccgaggacgaggagcccaagaaguaccgcaucgagaucaagcccaugcaccccaacaacucccaccacaccauggccucccucgacgagcucaaggucuccaucggcaacaucacccucucccccgccaucucccgccacucccccguccagaugaaccgcaaccucuccaacgaggagcucaccaaguccaagcccuccgccccccccaacgagaagggcaccuccgaccuccucgccugggacccccucuucggccccucccucgacuccuccuccuccuccucccucaccuccuccuccuccgcccgccccaccaccccccucuccgucggcaccaucgucccccccccccgccccgccucccgccccaagcucaccuccggcaagcucuccggcaucaacgagaucccccgccccuucuccccccccgucaccuccaacaccucccccccccccgccgccccccucgcccgcgccgaguccuccuccuccaucuccuccuccgccucccucuccgccgccaacacccccaccgucggcgucucccgcggccccucccccgucucccucggcaaccaggacacccuccccgucgccgucgcccucaccgaguccgucaacgccuacuucaagggcgccgaccccaccaagugcaucgucaagaucaccggcgacaugaccauguccuuccccuccggcaucaucaaggucuucaccuccaaccccacccccgccguccucugcuuccgcgucaagaacaucucccgccucgagcagauccuccccaacgcccagcucgucuucuccgaccccucccagugcgacuccaacaccaaggacuucuggaugaacaugcaggccgucaccgucuaccucaagaagcucuccgagcagaaccccgccgccuccuacuacaacgucgacguccucaaguaccaggucuccuccaacggcauccaguccaccccccucaaccucgccaccuacuggaagugcuccgccuccaccaccgaccuccgcgucgacuacaaguacaaccccgaggccauggucgcccccuccguccucuccaacauccaggucgucguccccgucgacggcggcgucaccaacaugcagucccucccccccgccaucuggaacgccgagcagaugaaggccuucuggaagcucuccuccaucuccgagaaguccgagaacggcggcuccggcucccuccgcgccaaguucgaccucuccgagggccccuccaagcccaccacccucgccguccaguuccucuccgagggcuccacccucuccggcgucgacuucgagcucgucggcaccggcuaccgccucucccucaucaagaagcgcuucgccaccggccgcuaccucgccgacugcuga

SEQ ID NO: 43137 - RNA, 2223 nt, Artificial Sequence
  derived and/or modified sequence opt2 from FCHSD2__Homo_sapiens__NP_055639
augcagccccccccccgcaaggucaaggucacccaggagcucaagaacauccaggucgagcagaugaccaagcuccaggccaagcaccaggccgagugcgaccuccucgaggacaugcgcaccuucucccagaagaaggccgccaucgagcgcgaguacgcccagggcaugcagaagcucgccucccaguaccucaagcgcgacuggcccggcgucaaggccgacgaccgcaacgacuaccgcuccauguaccccgucuggaaguccuuccucgagggcaccaugcaggucgcccagucccgcaugaacaucugcgagaacuacaagaacuucaucuccgagcccgcccgcaccguccgcucccucaaggagcagcagcucaagcgcugcgucgaccagcucaccaagauccagaccgagcuccaggagaccgucaaggaccucgccaagggcaagaagaaguacuucgagaccgagcagauggcccacgccguccgcgagaaggccgacaucgaggccaaguccaagcucucccucuuccagucccgcaucucccuccagaaggccuccgucaagcucaaggcccgccgcuccgagugcaacuccaaggccacccacgcccgcaacgacuaccuccucacccucgccgccgccaacgcccaccaggaccgcuacuaccagaccgaccucgucaacaucaugaaggcccucgacggcaacgucuacgaccaccucaaggacuaccucaucgccuucucccgcaccgagcucgagaccugccaggccguccagaacaccuuccaguuccuccucgagaacuccuccaaggucguccgcgacuacaaccuccagcucuuccuccaggagaacgccgucuuccacaagccccagcccuuccaguuccagcccugcgacuccgacaccucccgccagcucgaguccgagaccggcaccaccgaggagcacucccucaacaaggaggcccgcaagugggccacccgcgucgcccgcgagcacaagaacaucguccaccagcagcgcguccucaacgaccucgagugccacggcgccgccgucuccgagcagucccgcgccgagcucgagcagaagaucgacgaggcccgcgagaacauccgcaaggccgagaucaucaagcucaaggccgaggcccgccucgaccuccucaagcagaucggcgucuccgucgacaccuggcucaaguccgccaugaaccaggucauggaggagcucgagaacgagcgcugggcccgcccccccgccgucaccuccaacggcacccuccacucccucaacgccgacaccgagcgcgaggagggcgaggaguucgaggacaacauggacgucuucgacgacuccuccuccucccccuccggcacccuccgcaacuacccccucaccugcaaggucgucuacuccuacaaggccucccagcccgacgagcucaccaucgaggagcacgagguccucgaggucaucgaggacggcgacauggaggacugggucaaggcccgcaacaaggucggccaggucggcuacguccccgagaaguaccuccaguuccccaccuccaacucccuccucuccaugcuccagucccucgccgcccucgacucccgcucccacaccuccuccaacuccaccgaggccgagcucgucuccggcucccucaacggcgacgccuccgucugcuucgucaaggcccucuacgacuacgagggccagaccgacgacgagcucuccuuccccgagggcgccaucauccgcauccucaacaaggagaaccaggacgacgacggcuucugggagggcgaguucaacggccgcaucggcgucuuccccuccguccucgucgaggagcucuccgccuccgagaacggcgacacccccuggaugcgcgagauccagaucucccccucccccaagccccacgccucccuccccccccucccccucuacgaccagccccccuccucccccuaccccucccccgacaagcgcuccucccucuacuucccccgcucccccuccgccaacgagaagucccuccacgccgagucccccggcuucucccaggccucccgccacacccccgagaccuccuacggcaagcuccgccccguccgcgccgccccccccccccccacccagaaccaccgccgccccgccgagaagaucgaggacgucgagaucacccucgucuga

SEQ ID NO: 43138 - RNA, 981 nt, Artificial Sequence
  derived and/or modified sequence opt2 from FCN1__Homo_sapiens__NP_001994
auggagcucuccggcgccaccauggcccgcggccucgccguccuccucguccucuuccuccacaucaagaaccuccccgcccaggccgccgacaccugccccgaggucaaggucgucggccucgagggcuccgacaagcucaccauccuccgcggcugccccggccuccccggcgcccccggccccaagggcgaggccggcgucaucggcgagcgcggcgagcgcggccuccccggcgcccccggcaaggccggccccgucggccccaagggcgaccgcggcgagaagggcaugcgcggcgagaagggcgacgccggccagucccaguccugcgccaccggcccccgcaacugcaaggaccuccucgaccgcggcuacuuccucuccggcuggcacaccaucuaccuccccgacugccgcccccucaccguccucugcgacauggacaccgacggcggcggcuggaccgucuuccagcgccgcauggacggcuccgucgacuucuaccgcgacugggccgccuacaagcagggcuucggcucccagcucggcgaguucuggcucggcaacgacaacauccacgcccucaccgcccagggcuccuccgagcuccgcgucgaccucgucgacuucgagggcaaccaccaguucgccaaguacaaguccuucaaggucgccgacgaggccgagaaguacaagcucguccucggcgccuucgucggcggcuccgccggcaacucccucaccggccacaacaacaacuucuucuccaccaaggaccaggacaacgacgucuccuccuccaacugcgccgagaaguuccagggcgccuggugguacgccgacugccacgccuccaaccucaacggccucuaccucaugggcccccacgaguccuacgccaacggcaucaacugguccgccgccaagggcuacaaguacuccuacaaggucuccgagaugaagguccgccccgccuga

SEQ ID NO: 43139 - RNA, 942 nt, Artificial Sequence
  derived and/or modified sequence opt2 from FCN2__Homo_sapiens__NP_004099
auggagcucgaccgcgccgucggcguccucggcgccgccacccuccuccucuccuuccucggcauggccugggcccuccaggccgccgacaccugccccgaggucaagauggucggccucgagggcuccgacaagcucaccauccuccgcggcugccccggccuccccggcgcccccggccccaagggcgaggccggcaccaacggcaagcgcggcgagcgcggcccccccggcccccccggcaaggccggcccccccggccccaacggcgcccccggcgagccccagcccugccucaccggcccccgcaccugcaaggaccuccucgaccgcggccacuuccucuccggcuggcacaccaucuaccuccccgacugccgcccccucaccguccucugcgacauggacaccgacggcggcggcuggaccgucuuccagcgccgcgucgacggcuccgucgacuucuaccgcgacugggccaccuacaagcagggcuucggcucccgccucggcgaguucuggcucggcaacgacaacauccacgcccucaccgcccagggcaccuccgagcuccgcgucgaccucgucgacuucgaggacaacuaccaguucgccaaguaccgcuccuucaaggucgccgacgaggccgagaaguacaaccucguccucggcgccuucgucgagggcuccgccggcgacucccucaccuuccacaacaaccaguccuucuccaccaaggaccaggacaacgaccucaacaccggcaacugcgccgucauguuccagggcgccuggugguacaagaacugccacgucuccaaccucaacggccgcuaccuccgcggcacccacggcuccuucgccaacggcaucaacuggaaguccggcaagggcuacaacuacuccuacaaggucuccgagaugaagguccgccccgccuga

SEQ ID NO: 43140 - RNA, 1101 nt, Artificial Sequence
  derived and/or modified sequence opt2 from FCRL1__Homo_sapiens__NP_001152869
augcucccccgccuccuccuccucaucugcgccccccucugcgagcccgccgagcucuuccucaucgccucccccucccaccccaccgagggcucccccgucacccucaccugcaagaugcccuuccuccaguccuccgacgcccaguuccaguucugcuucuuccgcgacacccgcgcccucggccccggcugguccuccucccccaagcuccagaucgccgccauguggaaggaggacaccggcuccuacuggugcgaggcccagaccauggccuccaagguccuccgcucccgccgcucccagaucaacguccaccgcguccccgucgccgacgucucccucgagacccagccccccggcggccaggucauggagggcgaccgccucguccucaucugcuccgucgccaugggcaccggcgacaucaccuuccucugguacaagggcgccgucggccucaaccuccaguccaagacccagcgcucccucaccgccgaguacgagauccccuccguccgcgaguccgacgccgagcaguacuacugcgucgccgagaacggcuacggccccucccccuccggccucgucuccaucaccguccgcauccccgucucccgccccauccucaugcuccgcgccccccgcgcccaggccgccgucgaggacguccucgagcuccacugcgaggcccuccgcggcuccccccccauccucuacugguucuaccacgaggacaucacccucggcucccgcuccgcccccuccggcggcggcgccuccuucaaccucucccucaccgaggagcacuccggcaacuacuccugcgaggccaacaacggccucggcgcccagcgcuccgaggccgucacccucaacuucaccggccgccgcuccgcccgcgacccccuccgcucccuccccuccccccucccccaggaguucaccuaccucaacucccccacccccggccagcuccagcccaucuacgagaacgagccccgcgagcaguccgucgccguccacggccgccagcagcacuccuccgagcagaaggcccagaagcccuggggccacaucuggcgcacccgcuuccccuga

SEQ ID NO: 43141 - RNA, 1335 nt, Artificial Sequence
  derived and/or modified sequence opt2 from FCRL2__Homo_sapiens__NP_001152960
augcuccucuggucccuccucgucaucuucgacgccgucaccgagcaggccgacucccucacccucgucgcccccuccuccgucuucgagggcgacuccaucguccucaagugccagggcgagcagaacuggaagauccagaagauggccuaccacaaggacaacaaggagcucuccgucuucaagaaguucuccgacuuccucauccaguccgccguccucuccgacuccggcaacuacuucugcuccaccaagggccagcucuuccucugggacaagaccuccaacaucgucaagaucaagguccaggagcucuuccagcgccccguccucaccgccuccuccuuccagcccaucgagggcggccccgucucccucaagugcgagacccgccucuccccccagcgccucgacguccagcuccaguucugcuucuuccgcgagaaccagguccucggcuccggcugguccuccucccccgagcuccagaucuccgccgucugguccgaggacaccggcuccuacuggugcaaggccgagaccgucacccaccgcauccgcaagcagucccuccagucccagauccacguccagcgcauccccaucuccaacgucucccucgagauccgcgcccccggcggccaggucaccgagggccagaagcucauccuccucugcuccgucgccggcggcaccggcaacgucaccuucuccugguaccgcgaggccaccggcaccuccaugggcaagaagacccagcgcucccucuccgccgagcucgagauccccgccgucaaggaguccgacgccggcaaguacuacugccgcgccgacaacggccacguccccauccaguccaaggucgucaacauccccguccgcauccccgucucccgccccguccucacccuccgcucccccggcgcccaggccgccgucggcgaccuccucgagcuccacugcgaggcccuccgcggcuccccccccauccucuaccaguucuaccacgaggacgucacccucggcaacuccuccgcccccuccggcggcggcgccuccuucaaccucucccucaccgccgagcacuccggcaacuacuccugcgaggccaacaacggccucggcgcccagugcuccgaggccguccccgucuccaucuccggccccgacggcuaccgccgcgaccucaugaccgccggcguccucuggggccucuucggcguccucggcuucaccggcgucgcccuccuccucuacgcccucuuccacaagaucuccggcgaguccuccgccaccaacgagccccgcacccccaaguccuccacccuccucuga

SEQ ID NO: 43142 - RNA, 2205 nt, Artificial Sequence
  derived and/or modified sequence opt2 from FCRL3__Homo_sapiens__XP_006711208
augcuccucuggcuccuccuccucauccucacccccggccgcgagcaguccggcgucgcccccaaggccguccuccuccucaacccccccugguccaccgccuucaagggcgagaaggucgcccucaucugcuccuccaucucccacucccucgcccagggcgacaccuacugguaccacgacgagaagcuccucaagaucaagcacgacaagauccagaucaccgagcccggcaacuaccagugcaagacccgcggcuccucccucuccgacgccguccacgucgaguucucccccgacuggcucauccuccaggcccuccaccccgucuucgagggcgacaacgucauccuccgcugccagggcaaggacaacaagaacacccaccagaaggucuacuacaaggacggcaagcagcuccccaacuccuacaaccucgagaagaucaccgucaacuccgucucccgcgacaacuccaaguaccacugcaccgccuaccgcaaguucuacauccucgacaucgaggucaccuccaagccccucaacauccagguccaggagcucuuccuccaccccguccuccgcgccuccuccuccacccccaucgagggcucccccaugacccucaccugcgagacccagcucuccccccagcgccccgacguccagcuccaguucucccucuuccgcgacucccagacccucggccucggcuggucccgcuccccccgccuccagauccccgccauguggaccgaggacuccggcuccuacuggugcgaggucgagaccgucacccacuccaucaagaagcgcucccuccgcucccagauccgcguccagcgcguccccgucuccaacgucaaccucgagauccgccccaccggcggccagcucaucgagggcgagaacaugguccucaucugcuccgucgcccagggcuccggcaccgucaccuucuccuggcacaaggagggccgcguccgcucccucggccgcaagacccagcgcucccuccucgccgagcuccacguccucaccgucaaggaguccgacgccggccgcuacuacugcgccgccgacaacguccacucccccauccucuccaccuggauccgcgucaccguccgcauccccgucucccaccccguccucaccuuccgcgccccccgcgcccacaccgucgucggcgaccuccucgagcuccacugcgagucccuccgcggcuccccccccauccucuaccgcuucuaccacgaggacgucacccucggcaacuccuccgcccccuccggcggcggcgccuccuucaaccucucccucaccgccgagcacuccggcaacuacuccugcgacgccgacaacggccucggcgcccagcacucccacggcgucucccuccgcgucaccguccccgucucccgccccguccucacccuccgcgcccccggcgcccaggccgucgucggcgaccuccucgagcuccacugcgagucccuccgcggcuccuuccccauccucuacugguucuaccacgaggacgacacccucggcaacaucuccgcccacuccggcggcggcgccuccuucaaccucucccucaccaccgagcacuccggcaacuacuccugcgaggccgacaacggccucggcgcccagcacuccaaggucgucacccucaacgucaccggcaccucccgcaaccgcaccggccucaccgccgccggcaucaccggccucguccucuccauccucguccucgccgccgccgccgcccuccuccacuacgcccgcgcccgccgcaagcccggcggccucuccgccaccggcaccuccucccacucccccuccgagugccaggagcccuccuccucccgccccucccgcaucgacccccaggagcccacccacuccaagccccucgcccccauggagcucgagcccauguacuccaacgucaaccccggcgacuccaaccccaucuacucccagaucugguccauccagcacaccaaggagaacuccgccaacugccccaugaugcaccaggagcacgaggagcucaccguccucuacuccgagcucaagaagacccaccccgacgacuccgccggcgaggccuccucccgcggccgcgcccacgaggaggacgacgaggagaacuacgagaacgucccccgcguccuccucgccuccgaccacuga

SEQ ID NO: 43143 - RNA, 1548 nt, Artificial Sequence
  derived and/or modified sequence opt2 from FCRL4__Homo_sapiens__NP_112572
augcuccucugggccucccuccucgccuucgcccccgucugcggccaguccgccgccgcccacaagcccgucaucuccguccacccccccuggaccaccuucuucaagggcgagcgcgucacccucaccugcaacggcuuccaguucuacgccaccgagaagaccaccugguaccaccgccacuacuggggcgagaagcucacccucacccccggcaacacccucgagguccgcgaguccggccucuaccgcugccaggcccgcggcuccccccgcuccaaccccguccgccuccucuucuccuccgacucccucauccuccaggcccccuacuccgucuucgagggcgacacccucguccuccgcugccaccgccgccgcaaggagaagcucaccgccgucaaguacaccuggaacggcaacauccucuccaucuccaacaaguccugggaccuccucaucccccaggccuccuccaacaacaacggcaacuaccgcugcaucggcuacggcgacgagaacgacgucuuccgcuccaacuucaagaucaucaagauccaggagcucuucccccaccccgagcucaaggccaccgacucccagcccaccgagggcaacuccgucaaccucuccugcgagacccagcucccccccgagcgcuccgacaccccccuccacuucaacuucuuccgcgacggcgaggucauccucuccgacugguccaccuaccccgagcuccagcuccccaccgucuggcgcgagaacuccggcuccuacuggugcggcgccgagaccguccgcggcaacauccacaagcacucccccucccuccagauccacguccagcgcauccccgucuccggcguccuccucgagacccagcccuccggcggccaggccgucgagggcgagaugcucguccucgucugcuccgucgccgagggcaccggcgacaccaccuucuccuggcaccgcgaggacaugcaggagucccucggccgcaagacccagcgcucccuccgcgccgagcucgagcuccccgccauccgccagucccacgccggcggcuacuacugcaccgccgacaacuccuacggccccguccaguccaugguccucaacgucaccguccgcgagacccccggcaaccgcgacggccucgucgccgccggcgccaccggcggccuccucuccgcccuccuccucgccgucgcccuccucuuccacugcuggcgccgccgcaaguccggcgucggcuuccucggcgacgagacccgccucccccccgcccccggccccggcgaguccucccacuccaucugccccgcccaggucgagcuccagucccucuacgucgacguccaccccaagaagggcgaccucgucuacuccgagauccagaccacccagcucggcgaggaggaggaggccaacaccucccgcacccuccucgaggacaaggacgucuccgucgucuacuccgaggucaagacccagcaccccgacaacuccgccggcaagaucuccuccaaggacgaggaguccuga

SEQ ID NO: 43144 - RNA, 2934 nt, Artificial Sequence
  derived and/or modified sequence opt2 from FCRL5__Homo_sapiens__NP_112571
augcuccucugggucauccuccucguccucgcccccgucuccggccaguucgcccgcaccccccgccccaucaucuuccuccagccccccuggaccaccgucuuccagggcgagcgcgucacccucaccugcaagggcuuccgcuucuacuccccccagaagaccaagugguaccaccgcuaccucggcaaggagauccuccgcgagacccccgacaacauccucgagguccaggaguccggcgaguaccgcugccaggcccagggcuccccccucuccucccccguccaccucgacuucuccuccgccucccucauccuccaggccccccucuccgucuucgagggcgacuccgucguccuccgcugccgcgccaaggccgaggucacccucaacaacaccaucuacaagaacgacaacguccucgccuuccucaacaagcgcaccgacuuccacaucccccacgccugccucaaggacaacggcgccuaccgcugcaccggcuacaaggaguccugcugccccgucuccuccaacaccgucaagauccagguccaggagcccuucacccgccccguccuccgcgccuccuccuuccagcccaucuccggcaaccccgucacccucaccugcgagacccagcucucccucgagcgcuccgacgucccccuccgcuuccgcuucuuccgcgacgaccagacccucggccucggcuggucccucucccccaacuuccagaucaccgccaugugguccaaggacuccggcuucuacuggugcaaggccgccaccaugcccuacuccgucaucuccgacuccccccgcuccuggauccagguccagauccccgccucccaccccguccucacccucucccccgagaaggcccucaacuucgagggcaccaaggucacccuccacugcgagacccaggaggacucccuccgcacccucuaccgcuucuaccacgagggcgucccccuccgccacaaguccguccgcugcgagcgcggcgccuccaucuccuucucccucaccaccgagaacuccggcaacuacuacugcaccgccgacaacggccucggcgccaagcccuccaaggccgucucccucuccgucaccguccccgucucccaccccguccucaaccucuccucccccgaggaccucaucuucgagggcgccaaggucacccuccacugcgaggcccagcgcggcucccuccccauccucuaccaguuccaccacgagggcgccgcccucgagcgccgcuccgccaacuccgccggcggcgucgccaucuccuucucccucaccgccgagcacuccggcaacuacuacugcaccgccgacaacggcuucggcccccagcgcuccaaggccgucucccucuccgucaccguccccgucucccaccccguccucacccucuccuccgccgaggcccucaccuucgagggcgccaccgucacccuccacugcgagguccagcgcggcuccccccagauccucuaccaguucuaccacgaggacaugccccucugguccuccuccacccccuccgucggccgcgucuccuucuccuucucccucaccgagggccacuccggcaacuacuacugcaccgccgacaacggcuucggcccccagcgcuccgaggucgucucccucuucgucaccguccccgucucccgccccauccucacccuccgcgucccccgcgcccaggccgucgucggcgaccuccucgagcuccacugcgaggccccccgcggcuccccccccauccucuacugguucuaccacgaggacgucacccucggcuccuccuccgcccccuccggcggcgaggccuccuucaaccucucccucaccgccgagcacuccggcaacuacuccugcgaggccaacaacggccucgucgcccagcacuccgacaccaucucccucuccgucaucguccccgucucccgccccauccucaccuuccgcgccccccgcgcccaggccgucgucggcgaccuccucgagcuccacugcgaggcccuccgcggcuccucccccauccucuacugguucuaccacgaggacgucacccucggcaagaucuccgcccccuccggcggcggcgccuccuucaaccucucccucaccaccgagcacuccggcaucuacuccugcgaggccgacaacggccucgaggcccagcgcuccgagauggucacccucaaggucgccguccccgucucccgccccguccucacccuccgcgcccccggcacccacgccgccgucggcgaccuccucgagcuccacugcgaggcccuccgcggcuccccccucauccucuaccgcuucuuccacgaggacgucacccucggcaaccgcuccucccccuccggcggcgccucccucaaccucucccucaccgccgagcacuccggcaacuacuccugcgaggccgacaacggccucggcgcccagcgcuccgagaccgucacccucuacaucaccggccucaccgccaaccgcuccggccccuucgccaccggcgucgccggcggccuccucuccaucgccggccucgccgccggcgcccuccuccucuacugcuggcucucccgcaaggccggccgcaagcccgccuccgaccccgcccgcucccccuccgacuccgacucccaggagcccaccuaccacaacguccccgccugggaggagcuccagcccgucuacaccaacgccaacccccgcggcgagaacgucgucuacuccgagguccgcaucauccaggagaagaagaagcacgccgucgccuccgacccccgccaccuccgcaacaagggcucccccaucaucuacuccgaggucaaggucgccuccacccccgucuccggcucccucuuccucgccuccuccgccccccaccgcuga

SEQ ID NO: 43145 - RNA, 1242 nt, Artificial Sequence
  derived and/or modified sequence opt2 from FCRL6__Homo_sapiens__NP_001271146
augcuccccucccucggccccaugcuccucuggaccgccguccuccucuucguccccugcgucggcaagaccgucuggcucuaccuccaggccuggcccaaccccgucuucgagggcgacgcccucacccuccgcugccagggcuggaagaacaccccccucucccaggucaaguucuaccgcgacggcaaguuccuccacuucuccaaggagaaccagacccucuccaugggcgccgccaccguccagucccgcggccaguacuccugcuccggccaggucauguacaucccccagaccuucacccagaccuccgagaccgccaugguccagguccaggagcucuuccccccccccguccucuccgccauccccucccccgagccccgcgagggcucccucgucacccuccgcugccagaccaagcuccacccccuccgcuccgcccuccgccuccucuucuccuuccacaaggacggccacacccuccaggaccgcggcccccaccccgagcucugcauccccggcgccaaggagggcgacuccggccucuacuggugcgaggucgcccccgagggcggccagguccagaagcaguccccccagcucgagguccgcguccaggcccccgucucccgccccguccucacccuccaccacggccccgccgaccccgccgucggcgacaugguccagcuccucugcgaggcccagcgcggcuccccccccauccucuacuccuucuaccucgacgagaagaucgucggcaaccacuccgcccccugcggcggcaccaccucccuccucuuccccgucaaguccgagcaggacgccggcaacuacuccugcgaggccgagaacuccgucucccgcgagcgcuccgagcccaagaagcucucccucaagggcucccagguccucuucacccccgccuccaacuggcucguccccuggcuccccgccucccuccucggccucauggucaucgccgccgcccuccucgucuacguccgcuccuggcgcaaggccggcccccuccccucccagaucccccccaccgcccccggcggcgagcagugcccccucuacgccaacguccaccaccagaagggcaaggacgagggcgucgucuacuccgucguccaccgcaccuccaagcgcuccgaggcccgcuccgccgaguucaccgucggccgcaaguucuaccaccucugcggcggcgagaugcccgccgcccaguga

SEQ ID NO: 43146 - RNA, 1149 nt, Artificial Sequence
  derived and/or modified sequence opt2 from FCRLA__Homo_sapiens__NP_001171795
augcucaagaagaucuccgucggcgucgccggcgaccucaacaccgucaccaugaagcucggcugcguccucauggccugggcccucuaccucucccucggcguccucugggucgcccagaugcuccucgccgccggcugccacgccgccgccuccuucgagacccuccagugcgagggccccgucugcaccgaggaguccuccugccacaccgaggacgaccucaccgacgcccgcgaggccggcuuccaggucaaggccuacaccuucuccgagcccuuccaccucaucgucuccuacgacuggcucauccuccagggccccgccaagcccgucuucgagggcgaccuccucguccuccgcugccaggccuggcaggacuggccccucacccaggucaccuucuaccgcgacggcuccgcccucggcccccccggccccaaccgcgaguucuccaucaccgucguccagaaggccgacuccggccacuaccacugcuccggcaucuuccagucccccggccccggcauccccgagaccgccuccgucgucgccaucaccguccaggagcucuuccccgcccccauccuccgcgccguccccuccgccgagccccaggccggcucccccaugacccucuccugccagaccaagcucccccuccagcgcuccgccgcccgccuccucuucuccuucuacaaggacggccgcaucguccagucccgcggccucuccuccgaguuccagauccccaccgccuccgaggaccacuccggcuccuacuggugcgaggccgccaccgaggacaaccaggucuggaagcaguccccccagcucgagauccgcguccagggcgccuccuccuccgccgccccccccacccucaaccccgccccccagaaguccgccgcccccggcaccgcccccgaggaggcccccggcccccucccccccccccccacccccuccuccgaggaccccggcuucuccuccccccucggcaugcccgacccccaccucuaccaccagaugggccuccuccucaagcacaugcaggacguccgcguccuccucggccaccuccucauggagcuccgcgagcucuccggccaccgcaagcccggcaccaccaaggccaccgccgaguga

SEQ ID NO: 43147 - RNA, 957 nt, Artificial Sequence
  derived and/or modified sequence opt2 from FCRLB__Homo_sapiens__NP_001275758
auguggccccucaccgcccuccuccuccucguccccuccuccggccaggccgccacccucgagaagcccauccucucccuccacccccccuggaccaccaucuucaagggcgagcgcgucacccucaagugcgacggcuaccacccccuccuccucgagcuccagcccaucuccacccucugguaccucggccaccuccuccuccccucccacaagaaguccaucgagguccagacccccggcgucuaccgcugccagacccgcggcgcccccgucuccgaccccauccaccucuccgucuccaacgacuggcucauccuccagguccccuacgcccccgucuucgagggcgagccccucguccuccgcugccgcggcugguacgacaaggucgucuacaagcuccacuacuaccacgacggccaggccguccgcuacuuccacuccuccgccaacuacaccguccuccaggcccgcgccuccgacuccggccgcuaccagugcuccggcaccaugcgcauccccgucgaguccgcccccauguucuccgccaaggucgccgucaccguccaggccgcccgcugcgccgccuccaccggcgcccccuccacccagucccgcuccccccgcucccgcuccuccaaccgcaccggcgcccgccgccuccccccccccgccgucuccggcaacgccguccgcggcugcuccucccgcggccgcguccuccccuggacccgcccccccccccccccccagcuccacggcccccagcccuggcuccucgucaucggccgcuuccccuccgaguccccccgcugccccgaccgcucccgcugguccccccccuccggcaccccccccccccccggcugcuccucccgccgcgccgccccccgccuccgcggccacccccccgcccuccgccgccgccccuggaacaaccgccucgagcccuga

SEQ ID NO: 43148 - RNA, 1254 nt, Artificial Sequence
  derived and/or modified sequence opt2 from FDFT1__Homo_sapiens__NP_001274672
auggaguucgucaagugccucggccaccccgaggaguucuacaaccucguccgcuuccgcaucggcggcaagcgcaaggucaugcccaagauggaccaggacucccucuccuccucccucaagaccugcuacaaguaccucaaccagaccucccgcuccuucgccgccgucauccaggcccucgacggcgagaugcgcaacgccgucugcaucuucuaccucguccuccgcgcccucgacacccucgaggacgacaugaccaucuccgucgagaagaaggucccccuccuccacaacuuccacuccuuccucuaccagcccgacuggcgcuucauggaguccaaggagaaggaccgccagguccucgaggacuuccccaccaucucccucgaguuccgcaaccucgccgagaaguaccagaccgucaucgccgacaucugccgccgcaugggcaucggcauggccgaguuccucgacaagcacgucaccuccgagcaggagugggacaaguacugccacuacgucgccggccucgucggcaucggccucucccgccucuucuccgccuccgaguucgaggacccccucgucggcgaggacaccgagcgcgccaacuccaugggccucuuccuccagaagaccaacaucauccgcgacuaccucgaggaccagcagggcggccgcgaguucuggccccaggaggucuggucccgcuacgucaagaagcucggcgacuucgccaagcccgagaacaucgaccucgccguccagugccucaacgagcucaucaccaacgcccuccaccacauccccgacgucaucaccuaccucucccgccuccgcaaccaguccgucuucaacuucugcgccaucccccaggucauggccaucgccacccucgccgccugcuacaacaaccagcaggucuucaagggcgccgucaagauccgcaagggccaggccgucacccucaugauggacgccaccaacaugcccgccgucaaggccaucaucuaccaguacauggaggagaucuaccaccgcauccccgacuccgaccccuccuccuccaagacccgccagaucaucuccaccauccgcacccagaaccuccccaacugccagcucaucucccgcucccacuacucccccaucuaccucuccuucgucaugcuccucgccgcccucuccuggcaguaccucaccacccucucccaggucaccgaggacuacguccagaccggcgagcacuga

SEQ ID NO: 43149 - RNA, 1260 nt, Artificial Sequence
  derived and/or modified sequence opt2 from FDPS__Homo_sapiens__NP_001129293
augccccucucccgcuggcuccgcuccgucggcgucuuccuccuccccgcccccuacugggccccccgcgagcgcuggcucggcucccuccgccgccccucccucguccacggcuaccccguccucgccuggcacuccgcccgcugcuggugccaggccuggaccgaggagccccgcgcccucugcuccucccuccgcaugaacggcgaccagaacuccgacgucuacgcccaggagaagcaggacuucguccagcacuucucccagaucguccgcguccucaccgaggacgagaugggccaccccgagaucggcgacgccaucgcccgccucaaggagguccucgaguacaacgccaucggcggcaaguacaaccgcggccucaccgucgucgucgccuuccgcgagcucgucgagccccgcaagcaggacgccgacucccuccagcgcgccuggaccgucggcuggugcgucgagcuccuccaggccuucuuccucgucgccgacgacaucauggacuccucccucacccgccgcggccagaucugcugguaccagaagcccggcgucggccucgacgccaucaacgacgccaaccuccucgaggccugcaucuaccgccuccucaagcucuacugccgcgagcagcccuacuaccucaaccucaucgagcucuuccuccaguccuccuaccagaccgagaucggccagacccucgaccuccucaccgccccccagggcaacgucgaccucguccgcuucaccgagaagcgcuacaaguccaucgucaaguacaagaccgccuucuacuccuucuaccuccccaucgccgccgccauguacauggccggcaucgacggcgagaaggagcacgccaacgccaagaagauccuccucgagaugggcgaguucuuccagauccaggacgacuaccucgaccucuucggcgaccccuccgucaccggcaagaucggcaccgacauccaggacaacaagugcuccuggcucgucguccagugccuccagcgcgccacccccgagcaguaccagauccucaaggagaacuacggccagaaggaggccgagaaggucgcccgcgucaaggcccucuacgaggagcucgaccuccccgccgucuuccuccaguacgaggaggacuccuacucccacaucauggcccucaucgagcaguacgccgccccccucccccccgccgucuuccucggccucgcccgcaagaucuacaagcgccgcaaguga

SEQ ID NO: 43150 - RNA, 555 nt, Artificial Sequence
  derived and/or modified sequence opt2 from FDX1__Homo_sapiens__NP_004100
auggccgccgccggcggcgcccgccuccuccgcgccgccuccgccguccucggcggccccgccggccgcuggcuccaccacgccggcucccgcgccggcuccuccggccuccuccgcaaccgcggccccggcggcuccgccgaggccucccgcucccucuccgucuccgcccgcgcccgcuccuccuccgaggacaagaucaccguccacuucaucaaccgcgacggcgagacccucaccaccaagggcaaggucggcgacucccuccucgacgucgucgucgagaacaaccucgacaucgacggcuucggcgccugcgagggcacccucgccugcuccaccugccaccucaucuucgaggaccacaucuacgagaagcucgacgccaucaccgacgaggagaacgacaugcucgaccucgccuacggccucaccgaccgcucccgccucggcugccagaucugccucaccaaguccauggacaacaugaccguccgcguccccgagaccgucgccgacgcccgccaguccaucgacgucggcaagaccuccuga

SEQ ID NO: 43151 - RNA, 561 nt, Artificial Sequence
  derived and/or modified sequence opt2 from FDX1L__Homo_sapiens__NP_001026904
augcacgucauggccgccuccauggcccgcggcggcgucuccgcccgcguccuccuccaggccgcccgcggcaccugguggaaccgccccggcggcaccuccggcuccggcgagggcgucgcccucggcaccacccgcaaguuccaggccaccggcucccgccccgccggcgaggaggacgccggcggccccgagcgccccggcgacgucgucaacgucgucuucgucgaccgcuccggccagcgcauccccgucuccggccgcgucggcgacaacguccuccaccucgcccagcgccacggcgucgaccucgagggcgccugcgaggccucccucgccugcuccaccugccacgucuacgucuccgaggaccaccucgaccuccuccccccccccgaggagcgcgaggacgacaugcucgacauggccccccuccuccaggagaacucccgccucggcugccagaucguccucacccccgagcucgagggcgccgaguucacccuccccaagaucacccgcaacuucuacgucgacggccacguccccaagccccacuga

SEQ ID NO: 43152 - RNA, 1605 nt, Artificial Sequence
  derived and/or modified sequence opt2 from FDXR__Homo_sapiens__NP_001244941
auggccucccgcugcuggcgcugguggggcugguccgccuggccccgcacccgccucccccccgccggcuccacccccuccuucugccaccacuucuccacccaggagaagaccccccagaucugcgucgucggcuccggccccgccggcuucuacaccgcccagcaccuccucaagcgcgucgaggcccucugcucccagccccgcguccucaacucccccgcccucuccggcgagggcgaggaccucggcgccucccagccccucucccucggccccaccuccugccaccccgucccccagcagcacccccaggcccacgucgacaucuacgagaagcagcccguccccuucggccucguccgcuucggcgucgcccccgaccaccccgaggucaagaacgucaucaacaccuucacccagaccgcccacuccggccgcugcgccuucuggggcaacgucgaggucggccgcgacgucaccguccccgagcuccaggaggccuaccacgccgucguccucuccuacggcgccgaggaccaccgcgcccucgagauccccggcgaggagcuccccggcgucugcuccgcccgcgccuucgucggcugguacaacggccuccccgagaaccaggagcucgagcccgaccucuccugcgacaccgccgucauccucggccagggcaacgucgcccucgacgucgcccgcauccuccucaccccccccgagcaccucgagcgcaccgacaucaccaaggccgcccucggcguccuccgccagucccgcgucaagaccgucuggcucgucggccgccgcggcccccuccaggucgccuucaccaucaaggagcuccgcgagaugauccagcuccccggcgcccgccccauccucgaccccgucgacuuccucggccuccaggacaagaucaaggaggucccccgcccccgcaagcgccucaccgagcuccuccuccgcaccgccaccgagaagcccggccccgccgaggccgcccgccaggccuccgccucccgcgccuggggccuccgcuucuuccgcuccccccagcagguccuccccucccccgacggccgccgcgccgccggcguccgccucgccgucacccgccucgagggcgucgacgaggccacccgcgccguccccaccggcgacauggaggaccuccccugcggccucguccucuccuccaucggcuacaagucccgccccgucgaccccuccguccccuucgacuccaagcucggcgucauccccaacgucgagggccgcgucauggacguccccggccucuacugcuccggcugggucaagcgcggccccaccggcgucaucgccaccaccaugaccgacuccuuccucaccggccagaugcuccuccaggaccucaaggccggccuccuccccuccggcccccgccccggcuacgccgccauccaggcccuccucuccucccgcggcguccgccccgucuccuucuccgacugggagaagcucgacgccgaggaggucgcccgcggccagggcaccggcaagccccgcgagaagcucgucgacccccaggagaugcuccgccuccucggccacuga

SEQ ID NO: 43153 - RNA, 1272 nt, Artificial Sequence
  derived and/or modified sequence opt2 from FECH__Homo_sapiens__NP_000131
augcgcucccucggcgccaacauggccgccgcccuccgcgccgccggcguccuccuccgcgacccccucgccuccuccuccuggcgcgucugccagcccuggcgcuggaaguccggcgccgccgccgccgccgucaccaccgagaccgcccagcacgcccagggcgccaagccccagguccagccccagaagcgcaagcccaagaccggcauccucaugcucaacaugggcggccccgagacccucggcgacguccacgacuuccuccuccgccucuuccucgaccgcgaccucaugacccuccccauccagaacaagcucgcccccuucaucgccaagcgccgcacccccaagauccaggagcaguaccgccgcaucggcggcggcucccccaucaagaucuggaccuccaagcagggcgagggcauggucaagcuccucgacgagcucucccccaacaccgccccccacaaguacuacaucggcuuccgcuacguccacccccucaccgaggaggccaucgaggagauggagcgcgacggccucgagcgcgccaucgccuucacccaguacccccaguacuccugcuccaccaccggcuccucccucaacgccaucuaccgcuacuacaaccaggucggccgcaagcccaccaugaagugguccaccaucgaccgcuggcccacccaccaccuccucauccagugcuucgccgaccacauccucaaggagcucgaccacuucccccucgagaagcgcuccgaggucgucauccucuucuccgcccacucccuccccauguccgucgucaaccgcggcgaccccuacccccaggaggucuccgccaccguccagaaggucauggagcgccucgaguacugcaaccccuaccgccucgucuggcaguccaaggucggccccaugcccuggcucggcccccagaccgacgaguccaucaagggccucugcgagcgcggccgcaagaacauccuccucguccccaucgccuucaccuccgaccacaucgagacccucuacgagcucgacaucgaguacucccagguccucgccaaggagugcggcgucgagaacauccgccgcgccgagucccucaacggcaacccccucuucuccaaggcccucgccgaccucguccacucccacauccaguccaacgagcucugcuccaagcagcucacccucuccugcccccucugcgucaaccccgucugccgcgagaccaaguccuucuucaccucccagcagcucuga

SEQ ID NO: 43154 - RNA, 2010 nt, Artificial Sequence
  derived and/or modified sequence opt2 from FEM1A__Homo_sapiens__NP_061178
auggaccuccgcaccgccgucuacaacgccgcccgcgacggcaagcuccagcuccuccagaagcuccucuccggccgcucccgcgaggagcucgacgagcucaccggcgaggucgccggcggcggcaccccccuccucaucgccgcccgcuacggccaccucgacgucgucgaguaccucgucgaccgcugcggcgccuccgucgaggccggcggcuccguccacuucgacggcgagaccaucgagggcgcccccccccucugggccgccuccgccgccggccaccucgacgucguccgcucccuccuccgccgcggcgccuccgucaaccgcaccacccgcaccaacuccaccccccuccgcgccgccugcuucgacggccaccucgaggucguccgcuaccucgucggcgagcaccaggccgaccucgaggucgccaaccgccacggccacaccugccucaugaucuccugcuacaagggccaccgcgagaucgcccgcuaccuccucgagcagggcgcccaggucaaccgccgcuccgccaagggcaacaccgcccuccacgacugcgccgaguccggcucccucgagauccuccagcuccuccucggcugcaaggcccgcauggagcgcgacggcuacggcaugaccccccuccucgccgccuccgucaccggccacaccaacaucgucgaguaccucauccaggagcagcccggccaggagcaggucgccggcggcgaggcccagcccggccucccccaggaggaccccuccaccucccagggcugcgcccagccccagggcgcccccugcugcuccuccucccccgaggagccccucaacggcgaguccuacgaguccugcugccccaccucccgcgaggccgccgucgaggcccucgagcuccucggcgccaccuacgucgacaagaagcgcgaccuccucggcgcccucaagcacuggcgccgcgccauggagcuccgccaccagggcggcgaguaccuccccaagcccgagcccccccagcucguccucgccuacgacuacucccgcgaggucaacaccaccgaggagcucgaggcccucaucaccgaccccgacgagaugcgcaugcaggcccuccucauccgcgagcgcauccucggccccucccaccccgacaccuccuacuacauccgcuaccgcggcgccgucuacgccgacuccggcaacuucgagcgcugcauccgccucuggaaguacgcccucgacaugcagcaguccaaccucgagccccucucccccaugaccgccuccuccuuccucuccuucgccgagcucuucuccuacguccuccaggaccgcgccgccaagggcucccucggcacccagaucggcuucgccgaccucaugggcguccucaccaagggcguccgcgaggucgagcgcgcccuccagcucccccgcgagcccggcgacuccgcccaguucaccaaggcccucgccaucauccuccaccuccucuaccuccucgagaaggucgagugcacccccucccaggagcaccucaagcaccagaccgucuaccgccuccucaagugcgccccccgcggcaagaacggcuucaccccccuccacauggccgucgacaaggacaccaccaacgucggccgcuaccccgucggccgcuuccccucccuccacgucgucaagguccuccucgacugcggcgccgaccccgacucccgcgacuucgacaacaacaccccccuccacaucgccgcccagaacaacugccccgccaucaugaacgcccucaucgaggccggcgcccacauggacgccaccaacgccuucaagaagaccgccuacgagcuccucgacgagaagcuccucgcccgcggcaccaugcagcccuucaacuacgucacccuccagugccucgccgcccgcgcccucgacaagaacaagauccccuacaagggcuucauccccgaggaccucgaggccuucaucgagcuccacuga

SEQ ID NO: 43155 - RNA, 1884 nt, Artificial Sequence
  derived and/or modified sequence opt2 from FEM1B__Homo_sapiens__NP_056137
auggagggccucgccggcuacgucuacaaggccgccuccgagggcaagguccucacccucgccgcccuccuccucaaccgcuccgaguccgacauccgcuaccuccucggcuacgucucccagcagggcggccagcgcuccaccccccucaucaucgccgcccgcaacggccacgccaaggucguccgccuccuccucgagcacuaccgcguccagacccagcagaccggcaccguccgcuucgacggcuacgucaucgacggcgccaccgcccucuggugcgccgccggcgccggccacuucgaggucgucaagcuccucgucucccacggcgccaacgucaaccacaccaccgucaccaacuccaccccccuccgcgccgccugcuucgacggccgccucgacaucgucaaguaccucgucgagaacaacgccaacaucuccaucgccaacaaguacgacaacaccugccucaugaucgccgccuacaagggccacaccgacgucguccgcuaccuccucgagcagcgcgccgaccccaacgccaaggcccacugcggcgccaccgcccuccacuucgccgccgaggccggccacaucgacaucgucaaggagcucaucaaguggcgcgccgccaucgucgucaacggccacggcaugaccccccucaaggucgccgccgaguccugcaaggccgacgucgucgagcuccuccucucccacgccgacugcgaccgccgcucccgcaucgaggcccucgagcuccucggcgccuccuucgccaacgaccgcgagaacuacgacaucaucaagaccuaccacuaccucuaccucgccaugcucgagcgcuuccaggacggcgacaacauccucgagaaggagguccucccccccauccacgccuacggcaaccgcaccgagugccgcaacccccaggagcucgaguccauccgccaggaccgcgacgcccuccacauggagggccucaucguccgcgagcgcauccucggcgccgacaacaucgacgucucccaccccaucaucuaccgcggcgccgucuacgccgacaacauggaguucgagcagugcaucaagcucuggcuccacgcccuccaccuccgccagaagggcaaccgcaacacccacaaggaccuccuccgcuucgcccaggucuucucccagaugauccaccucaacgagaccgucaaggcccccgacaucgagugcguccuccgcugcuccguccucgagaucgagcaguccaugaaccgcgucaagaacaucuccgacgccgacguccacaacgccauggacaacuacgagugcaaccucuacaccuuccucuaccucgucugcaucuccaccaagacccagugcuccgaggaggaccagugcaagaucaacaagcagaucuacaaccucauccaccucgacccccgcacccgcgagggcuucacccuccuccaccucgccgucaacuccaacacccccgucgacgacuuccacaccaacgacgucugcuccuuccccaacgcccucgucaccaagcuccuccucgacugcggcgccgaggucaacgccgucgacaacgagggcaacuccgcccuccacaucaucguccaguacaaccgccccaucuccgacuuccucacccuccacuccaucaucaucucccucgucgaggccggcgcccacaccgacaugaccaacaagcagaacaagaccccccucgacaaguccaccaccggcgucuccgagauccuccucaagacccagaugaagaugucccucaagugccucgccgcccgcgccguccgcgccaacgacaucaacuaccaggaccagaucccccgcacccucgaggaguucgucggcuuccacuga

SEQ ID NO: 43156 - RNA, 1854 nt, Artificial Sequence
  derived and/or modified sequence opt2 from FEM1C__Homo_sapiens__NP_064562
auggaccucaagaccgccgucuucaacgccgcccgcgacggcaagcuccgccuccucaccaagcuccucgccuccaaguccaaggaggaggucuccucccucaucuccgagaagaccaacggcgccaccccccuccucauggccgcccgcuacggccaccucgacauggucgaguuccuccucgagcagugcuccgccuccaucgaggucggcggcuccgucaacuucgacggcgagaccaucgagggcgcccccccccucugggccgccuccgccgccggccaccucaaggucguccagucccuccucaaccacggcgccuccgucaacaacaccacccucaccaacuccaccccccuccgcgccgccugcuucgacggccaccucgagaucgucaaguaccucgucgagcacaaggccgaccucgaggucuccaaccgccacggccacaccugccucaugaucuccugcuacaagggccacaaggagaucgcccaguaccuccucgagaagggcgccgacgucaaccgcaaguccgucaagggcaacaccgcccuccacgacugcgccgaguccggcucccucgacaucaugaagaugcuccucauguacugcgccaagauggagaaggacggcuacggcaugaccccccuccucuccgccuccgucaccggccacaccaacaucgucgacuuccucacccaccacgcccagaccuccaagaccgagcgcaucaacgcccucgagcuccucggcgccaccuucgucgacaagaagcgcgaccuccucggcgcccucaaguacuggaagaaggccaugaacaugcgcuacuccgaccgcaccaacaucaucuccaagcccgucccccagacccucaucauggccuacgacuacgccaaggaggucaacuccgccgaggagcucgagggccucaucgccgaccccgacgagaugcgcaugcaggcccuccucauccgcgagcgcauccucggccccucccaccccgacaccuccuacuacauccgcuaccgcggcgccgucuacgccgacuccggcaacuucaagcgcugcaucaaccucuggaaguacgcccucgacaugcagcaguccaaccucgacccccucucccccaugaccgccuccucccuccucuccuucgccgagcucuucuccuucaugcuccaggaccgcgccaagggccuccucggcaccaccgucaccuucgacgaccucaugggcauccucugcaaguccguccucgagaucgagcgcgccaucaagcagacccagugccccgccgacccccuccagcucaacaaggcccucuccaucauccuccaccucaucugccuccucgagaagguccccugcacccucgagcaggaccacuucaagaagcagaccaucuaccgcuuccucaagcuccacccccgcggcaagaacaacuucuccccccuccaccucgccgucgacaagaacaccaccugcgucggccgcuaccccgucugcaaguuccccucccuccaggucaccgccauccucaucgagugcggcgccgacgucaacguccgcgacuccgacgacaacuccccccuccacaucgccgcccucaacaaccaccccgacaucaugaaccuccucaucaaguccggcgcccacuucgacgccaccaaccuccacaagcagaccgccuccgaccuccucgacgagaaggagaucgccaagaaccucauccagcccaucaaccacaccacccuccagugccucgccgcccgcgucaucgucaaccaccgcaucuacuacaagggccacauccccgagaagcucgagaccuucgucucccuccaccgcuga

SEQ ID NO: 43157 - RNA, 1143 nt, Artificial Sequence
  derived and/or modified sequence opt2 from FEN1__Homo_sapiens__NP_004102
augggcauccagggccucgccaagcucaucgccgacgucgcccccuccgccauccgcgagaacgacaucaaguccuacuucggccgcaaggucgccaucgacgccuccauguccaucuaccaguuccucaucgccguccgccagggcggcgacguccuccagaacgaggagggcgagaccaccucccaccucaugggcauguucuaccgcaccauccgcaugauggagaacggcaucaagcccgucuacgucuucgacggcaagcccccccagcucaaguccggcgagcucgccaagcgcuccgagcgccgcgccgaggccgagaagcagcuccagcaggcccaggccgccggcgccgagcaggaggucgagaaguucaccaagcgccucgucaaggucaccaagcagcacaacgacgagugcaagcaccuccucucccucaugggcauccccuaccucgacgcccccuccgaggccgaggccuccugcgccgcccucgucaaggccggcaaggucuacgccgccgccaccgaggacauggacugccucaccuucggcucccccguccucaugcgccaccucaccgccuccgaggccaagaagcuccccauccaggaguuccaccucucccgcauccuccaggagcucggccucaaccaggagcaguucgucgaccucugcauccuccucggcuccgacuacugcgaguccauccgcggcaucggccccaagcgcgccgucgaccucauccagaagcacaaguccaucgaggagaucguccgccgccucgaccccaacaaguaccccguccccgagaacuggcuccacaaggaggcccaccagcucuuccucgagcccgagguccucgaccccgaguccgucgagcucaagugguccgagcccaacgaggaggagcucaucaaguucaugugcggcgagaagcaguucuccgaggagcgcauccgcuccggcgucaagcgccucuccaagucccgccagggcuccacccagggccgccucgacgacuucuucaaggucaccggcucccucuccuccgccaagcgcaaggagcccgagcccaagggcuccaccaagaagaaggccaagaccggcgccgccggcaaguucaagcgcggcaaguga

SEQ ID NO: 43158 - RNA, 501 nt, Artificial Sequence
  derived and/or modified sequence opt2 from FERD3L__Homo_sapiens__NP_690862
auggccgccuaccccgaguccugcgucgacaccaccguccucgacuucgucgccgaccucucccucgccuccccccgccgcccccuccucugcgacuucgcccccggcgucucccucggcgaccccgcccucgcccuccgcgagggccgcccccgccgcauggcccgcuucgaggagggcgaccccgaggaggaggagugcgaggucgaccagggcgacggcgaggaggaggaggaggaggagcgcggccgcggcgucucccuccucggccgccccaagcgcaagcgcgucaucaccuacgcccagcgccaggccgccaacauccgcgagcgcaagcgcauguucaaccucaacgaggccuucgaccagcuccgccgcaagguccccaccuucgccuacgagaagcgccucucccgcaucgagacccuccgccucgccaucgucuacaucuccuucaugaccgagcuccucgaguccugcgagaagaaggaguccggcuga

SEQ ID NO: 43159 - RNA, 2469 nt, Artificial Sequence
  derived and/or modified sequence opt2 from FER__Homo_sapiens__NP_005237
augggcuucggcuccgaccucaagaacucccacgaggccguccucaagcuccaggacugggagcuccgccuccucgagaccgucaagaaguucauggcccuccgcaucaaguccgacaaggaguacgccuccacccuccagaaccucugcaaccaggucgacaaggaguccaccguccagaugaacuacgucuccaacgucuccaaguccuggcuccucaugauccagcagaccgagcagcucucccgcaucaugaagacccacgccgaggaccucaacuccggcccccuccaccgccucaccaugaugaucaaggacaagcagcaggucaagaaguccuacaucggcguccaccagcagaucgaggccgagaugaucaaggucaccaagaccgagcucgagaagcucaagugcuccuaccgccagcucaucaaggagaugaacuccgccaaggagaaguacaaggaggcccucgccaagggcaaggagaccgagaaggccaaggagcgcuacgacaaggccaccaugaagcuccacaugcuccacaaccaguacguccucgcccucaagggcgcccagcuccaccagaaccaguacuacgacaucacccucccccuccuccucgacucccuccagaagaugcaggaggagaugaucaaggcccucaagggcaucuucgacgaguacucccagaucaccucccucgucaccgaggagaucgucaacguccacaaggagauccagauguccgucgagcagaucgaccccuccaccgaguacaacaacuucaucgacguccaccgcaccaccgccgccaaggagcaggagaucgaguucgacaccucccuccucgaggagaacgagaaccuccaggccaacgagaucauguggaacaaccucaccgccgagucccuccaggucaugcucaagacccucgccgaggagcucaugcagacccagcagaugcuccucaacaaggaggaggccguccucgagcucgagaagcgcaucgaggaguccuccgagaccugcgagaagaaguccgacaucguccuccuccucucccagaagcaggcccucgaggagcucaagcaguccguccagcagcuccgcugcaccgaggccaaguucuccgcccagaaggagcuccucgagcagaagguccaggagaacgacggcaaggagcccccccccgucgucaacuacgaggaggacgcccgcuccgucaccuccauggagcgcaaggagcgccucuccaaguucgaguccauccgccacuccaucgccggcaucauccgcucccccaaguccgcccucggcuccuccgcccucuccgacaugaucuccaucuccgagaagccccucgccgagcaggacugguaccacggcgccaucccccgcaucgaggcccaggagcuccucaagaagcagggcgacuuccucguccgcgagucccacggcaagcccggcgaguacguccucuccgucuacuccgacggccagcgccgccacuucaucauccaguacgucgacaacauguaccgcuucgagggcaccggcuucuccaacaucccccagcucaucgaccaccacuacaccaccaagcaggucaucaccaagaaguccggcgucguccuccucaaccccauccccaaggacaagaaguggauccucucccacgaggacgucauccucggcgagcuccucggcaagggcaacuucggcgaggucuacaagggcacccucaaggacaagaccuccgucgccgucaagaccugcaaggaggaccucccccaggagcucaagaucaaguuccuccaggaggccaagauccucaagcaguacgaccaccccaacaucgucaagcucaucggcgucugcacccagcgccagcccgucuacaucaucauggagcucgucuccggcggcgacuuccucaccuuccuccgccgcaagaaggacgagcucaagcucaagcagcucgucaaguucucccucgacgccgccgccggcaugcucuaccucgaguccaagaacugcauccaccgcgaccucgccgcccgcaacugccucgucggcgagaacaacguccucaagaucuccgacuucggcaugucccgccaggaggacggcggcgucuacuccuccuccggccucaagcagauccccaucaaguggaccgcccccgaggcccucaacuacggccgcuacuccuccgaguccgacgucugguccuucggcauccuccucugggagaccuucucccucggcgucugccccuaccccggcaugaccaaccagcaggcccgcgagcaggucgagcgcggcuaccgcauguccgccccccagcacugccccgaggacaucuccaagaucaugaugaagugcugggacuacaagcccgagaaccgccccaaguucuccgagcuccagaaggagcucaccaucaucaagcgcaagcucaccuga

SEQ ID NO: 43160 - RNA, 2034 nt, Artificial Sequence
  derived and/or modified sequence opt2 from FERMT1__Homo_sapiens__NP_060141
augcucuccuccaccgacuucaccuucgccuccugggagcucgucguccgcgucgaccaccccaacgaggagcagcagaaggacgucacccuccgcgucuccggcgaccuccacgucggcggcgucaugcucaagcucgucgagcagaucaacaucucccaggacugguccgacuucgcccucuggugggagcagaagcacugcuggcuccucaagacccacuggacccucgacaaguacggcguccaggccgacgccaagcuccucuucaccccccagcacaagaugcuccgccuccgccuccccaaccucaagaugguccgccuccgcgucuccuucuccgccgucgucuucaaggccgucuccgacaucugcaagauccucaacauccgccgcuccgaggagcucucccuccucaagcccuccggcgacuacuucaagaagaagaagaagaaggacaagaacaacaaggagcccaucaucgaggacauccucaaccucgaguccucccccaccgccuccggcuccuccgucucccccggccucuacuccaagaccaugacccccaucuacgaccccaucaacggcacccccgccuccuccaccaugaccugguucuccgacuccccccucaccgagcagaacugcuccauccucgccuucucccagcccccccagucccccgaggcccucgccgacauguaccagccccgcucccucgucgacaaggccaagcucaacgccggcuggcucgacuccucccgcucccucauggagcagggcauccaggaggacgagcagcuccuccuccgcuucaaguacuacuccuucuucgaccucaaccccaaguacgacgccguccgcaucaaccagcucuacgagcaggcccgcugggccauccuccucgaggagaucgacugcaccgaggaggagaugcucaucuucgccgcccuccaguaccacaucuccaagcucucccucuccgccgagacccaggacuucgccggcgaguccgaggucgacgagaucgaggccgcccucuccaaccucgaggucacccucgagggcggcaaggccgacucccuccucgaggacaucaccgacauccccaagcucgccgacaaccucaagcucuuccgccccaagaagcuccuccccaaggccuucaagcaguacugguucaucuucaaggacaccuccaucgccuacuucaagaacaaggagcucgagcagggcgagccccucgagaagcucaaccuccgcggcugcgaggucguccccgacgucaacgucgccggccgcaaguucggcaucaagcuccucauccccgucgccgacggcaugaacgagauguaccuccgcugcgaccacgagaaccaguacgcccaguggauggccgccugcaugcucgccuccaagggcaagaccauggccgacuccuccuaccagcccgagguccucaacauccucuccuuccuccgcaugaagaaccgcaacuccgccucccaggucgccuccucccucgagaacauggacaugaaccccgagugcuucgucuccccccgcugcgccaagcgccacaaguccaagcagcucgccgcccgcauccucgaggcccaccagaacgucgcccagaugccccucgucgaggccaagcuccgcuucauccaggccuggcagucccuccccgaguucggccucaccuacuaccucguccgcuucaagggcuccaagaaggacgacauccucggcgucuccuacaaccgccucaucaagaucgacgccgccaccggcauccccgucaccaccuggcgcuucaccaacaucaagcaguggaacgucaacugggagacccgccaggucgucaucgaguucgaccagaacgucuucaccgccuucaccugccucuccgccgacugcaagaucguccacgaguacaucggcggcuacaucuuccucuccacccgcuccaaggaccagaacgagacccucgacgaggaccucuuccacaagcucaccggcggccaggacuga

SEQ ID NO: 43161 - RNA, 2064 nt, Artificial Sequence
  derived and/or modified sequence opt2 from FERMT2__Homo_sapiens__NP_001128471
auggcccucgacggcauccgcaugcccgacggcugcuacgccgacggcaccugggagcucuccguccacgucaccgaccucaaccgcgacgucacccuccgcgucaccggcgagguccacaucggcggcgucaugcucaagcucgucgagaagcucgacgucaagaaggacugguccgaccacgcccucuggugggagaagaagcgcaccuggcuccucaagacccacuggacccucgacaaguacggcauccaggccgacgccaagcuccaguucaccccccagcacaagcuccuccgccuccagcuccccaacaugaaguacgucaaggucaaggucaacuucuccgaccgcgucuucaaggccgucuccgacaucugcaagaccuucaacauccgccaccccgaggagcucucccuccucaagaagccccgcgaccccaccaagaagaagaagaagaagcucgacgaccaguccgaggacgaggcccucgagcucgagggcccccucaucacccccggcuccggcuccaucuacuccucccccggccucuacuccaagaccaugacccccaccuacgacgcccacgacggcuccccccucucccccaccuccgccugguucggcgacuccgcccucuccgagggcaaccccggcauccucgccgucucccagcccaucaccucccccgagauccucgccaagauguucaagccccaggcccuccucgacaaggccaagaucaaccagggcuggcucgacuccucccgcucccucauggagcaggacgucaaggagaacgaggcccuccuccuccgcuucaaguacuacuccuucuucgaccucaaccccaaguacgacgccauccgcaucaaccagcucuacgagcaggccaagugggccauccuccucgaggagaucgagugcaccgaggaggagaugaugauguucgccgcccuccaguaccacaucaacaagcucuccaucaugaccuccgagaaccaccucaacaacuccgacaaggaggucgacgaggucgacgccgcccucuccgaccucgagaucacccucgagggcggcaagaccuccaccauccucggcgacaucaccuccauccccgagcucgccgacuacaucaaggucuucaagcccaagaagcucacccucaagggcuacaagcaguacuggugcaccuucaaggacaccuccaucuccugcuacaaguccaaggaggaguccuccggcacccccgcccaccagaugaaccuccgcggcugcgaggucacccccgacgucaacaucuccggccagaaguucaacaucaagcuccucauccccgucgccgagggcaugaacgagaucuggcuccgcugcgacaacgagaagcaguacgcccacuggauggccgccugccgccucgccuccaagggcaagaccauggccgacuccuccuacaaccucgagguccagaacauccucuccuuccucaagaugcagcaccucaaccccgacccccagcucauccccgagcagaucaccaccgacaucacccccgagugccucgucuccccccgcuaccucaagaaguacaagaacaagcagcccggcuacauccgcgaccucaucaccgcccgcauccucgaggcccaccagaacgucgcccagaugucccucaucgaggccaagaugcgcuucauccaggccuggcagucccuccccgaguucggcaucacccacuucaucgcccgcuuccagggcggcaagaaggaggagcucaucggcaucgccuacaaccgccucauccgcauggacgccuccaccggcgacgccaucaagaccuggcgcuucuccaacaugaagcaguggaacgucaacugggagaucaagauggucaccgucgaguucgccgacgagguccgccucuccuucaucugcaccgaggucgacugcaaggucguccacgaguucaucggcggcuacaucuuccucuccacccgcgccaaggaccagaacgagucccucgacgaggagauguucuacaagcucaccuccggcugggucuga

SEQ ID NO: 43162 - RNA, 1992 nt, Artificial Sequence
  derived and/or modified sequence opt2 from FERMT3__Homo_sapiens__NP_113659
auggccggcaugaagaccgccuccggcgacuacaucgacuccuccugggagcuccgcgucuucgucggcgaggaggaccccgaggccgaguccgucacccuccgcgucaccggcgagucccacaucggcggcguccuccucaagaucgucgagcagaucaaccgcaagcaggacugguccgaccacgccaucuggugggagcagaagcgccaguggcuccuccagacccacuggacccucgacaaguacggcauccucgccgacgcccgccucuucuucggcccccagcaccgccccgucauccuccgccuccccaaccgccgcgcccuccgccuccgcgccuccuucucccagccccucuuccaggccgucgccgccaucugccgccuccucuccauccgccaccccgaggagcucucccuccuccgcgcccccgagaagaaggagaagaagaagaaggagaaggagcccgaggaggagcucuacgaccucuccaaggucguccucgccggcggcgucgcccccgcccucuuccgcggcaugcccgcccacuucuccgacuccgcccagaccgaggccugcuaccacaugcucucccgcccccagcccccccccgacccccuccuccuccagcgccucccccgccccuccucccucuccgacaagacccagcuccacucccgcuggcucgacuccucccgcugccucaugcagcagggcaucaaggccggcgacgcccucuggcuccgcuucaaguacuacuccuucuucgaccucgaccccaagaccgaccccguccgccucacccagcucuacgagcaggcccgcugggaccuccuccucgaggagaucgacugcaccgaggaggagaugauggucuucgccgcccuccaguaccacaucaacaagcucucccaguccggcgaggucggcgagcccgccggcaccgaccccggccucgacgaccucgacgucgcccucuccaaccucgaggucaagcucgagggcuccgcccccaccgacguccucgacucccucaccaccauccccgagcucaaggaccaccuccgcaucuuccgcccccgcaagcucacccucaagggcuaccgccagcacugggucgucuucaaggagaccacccucuccuacuacaagucccaggacgaggcccccggcgaccccauccagcagcucaaccucaagggcugcgaggucguccccgacgucaacgucuccggccagaaguucugcaucaagcuccucguccccucccccgagggcauguccgagaucuaccuccgcugccaggacgagcagcaguacgcccgcuggauggccggcugccgccucgccuccaagggccgcaccauggccgacuccuccuacaccuccgagguccaggccauccucgccuuccucucccuccagcgcaccggcuccggcggccccggcaaccacccccacggccccgacgccuccgccgagggccucaaccccuacggccucgucgccccccgcuuccagcgcaaguucaaggccaagcagcucaccccccgcauccucgaggcccaccagaacgucgcccagcucucccucgccgaggcccagcuccgcuucauccaggccuggcagucccuccccgacuucggcaucuccuacgucaugguccgcuucaagggcucccgcaaggacgagauccucggcaucgccaacaaccgccucauccgcaucgaccucgccgucggcgacgucgucaagaccuggcgcuucuccaacaugcgccaguggaacgucaacugggacauccgccaggucgccaucgaguucgacgagcacaucaacgucgccuucuccugcgucuccgccuccugccgcaucguccacgaguacaucggcggcuacaucuuccucuccacccgcgagcgcgcccgcggcgaggagcucgacgaggaccucuuccuccagcucaccggcggccacgaggccuucuga

SEQ ID NO: 43163 - RNA, 2085 nt, Artificial Sequence
  derived and/or modified sequence opt2 from FES__Homo_sapiens__NP_001137257
augggcuucuccuccgagcucugcuccccccagggccacggcguccuccagcagaugcaggaggccgagcuccgccuccucgagggcaugcgcaaguggauggcccagcgcgucaaguccgaccgcgaguacgccggccuccuccaccacaugucccuccaggacuccggcggccagucccgcgccaucucccccgacucccccaucucccagacccacucccaggacaucgagaagcucaagucccaguaccgcgcccucgcccgcgacuccgcccaggccaagcgcaaguaccaggaggccuccaaggacaaggaccgcgacaaggccaaggacaaguacguccgcucccucuggaagcucuucgcccaccacaaccgcuacguccucggcguccgcgccgcccagcuccaccaccagcaccaccaccagcuccuccuccccggccuccuccgcucccuccaggaccuccacgaggagauggccugcauccucaaggagauccuccaggaguaccucgagaucuccucccucguccaggacgaggucgucgccauccaccgcgagauggccgccgccgccgcccgcauccagcccgaggccgaguaccagggcuuccuccgccaguacggcuccgcccccgacgucccccccugcgucaccuucgacgagucccuccucgaggagggcgagccccucgagcccggcgagcuccagcucaacgagcucaccgucgaguccguccagcacacccucaccuccgucaccgacgagcucgccgucgccaccgagauggucuuccgccgccaggagauggucacccagcuccagcaggagcuccgcaacgaggaggagaacacccacccccgcgagcgcguccagcuccucggcaagcgccagguccuccaggaggcccuccagggccuccaggucgcccucugcucccaggccaagcuccaggcccagcaggagcuccuccagaccaagcucgagcaccucggccccggcgagcccccccccguccuccuccuccaggacgaccgccacuccaccuccuccuccgagcaggagcgcgagggcggccgcacccccacccucgagauccucaagucccacaucuccggcaucuuccgccccaaguucuccaaccucuaccgccucgagggcgagggcuuccccuccaucccccuccucaucgaccaccuccucuccacccagcagccccucaccaagaaguccggcgucguccuccaccgcgccguccccaaggacaaguggguccucaaccacgaggaccucguccucggcgagcagaucggccgcggcaacuucggcgaggucuucuccggccgccuccgcgccgacaacacccucgucgccgucaaguccugccgcgagacccucccccccgaccucaaggccaaguuccuccaggaggcccgcauccucaagcaguacucccaccccaacaucguccgccucaucggcgucugcacccagaagcagcccaucuacaucgucauggagcucguccagggcggcgacuuccucaccuuccuccgcaccgagggcgcccgccuccgcgucaagacccuccuccagauggucggcgacgccgccgccggcauggaguaccucgaguccaagugcugcauccaccgcgaccucgccgcccgcaacugccucgucaccgagaagaacguccucaagaucuccgacuucggcaugucccgcgaggaggccgacggcgucuacgccgccuccggcggccuccgccagguccccgucaaguggaccgcccccgaggcccucaacuacggccgcuacuccuccgaguccgacgucugguccuucggcauccuccucugggagaccuucucccucggcgccucccccuaccccaaccucuccaaccagcagacccgcgaguucgucgagaagggcggccgccuccccugccccgagcucugccccgacgccgucuuccgccucauggagcagugcugggccuacgagcccggccagcgccccuccuucuccaccaucuaccaggagcuccaguccauccgcaagcgccaccgcuga

SEQ ID NO: 43164 - RNA, 717 nt, Artificial Sequence
  derived and/or modified sequence opt2 from FEV__Homo_sapiens__NP_059991
augcgccaguccggcgccucccagccccuccucaucaacauguaccuccccgaccccgucggcgacggccucuucaaggacggcaagaaccccuccuggggcccccucucccccgccguccagaagggcuccggccagauccagcucuggcaguuccuccucgagcuccucgccgaccgcgccaacgccggcugcaucgccugggagggcggccacggcgaguucaagcucaccgaccccgacgaggucgcccgccgcuggggcgagcgcaaguccaagcccaacaugaacuacgacaagcucucccgcgcccuccgcuacuacuacgacaagaacaucauguccaagguccacggcaagcgcuacgccuaccgcuucgacuuccagggccucgcccaggccugccagcccccccccgcccacgcccacgccgccgccgccgccgccgccgccgccgccgccgcccaggacggcgcccucuacaagcuccccgccggccucgccccccuccccuuccccggccucuccaagcucaaccucauggccgccuccgccggcgucgcccccgccggcuucuccuacuggcccggccccggccccgccgccaccgccgccgccgccaccgccgcccucuaccccucccccucccuccagcccccccccggccccuucggcgccgucgccgccgccucccaccucggcggccacuaccacuga

SEQ ID NO: 43165 - RNA, 1179 nt, Artificial Sequence
  derived and/or modified sequence opt2 from FEZ1__Homo_sapiens__NP_005094
auggaggccccccucgucucccucgacgaggaguucgaggaccuccgccccuccugcuccgaggaccccgaggagaagccccagugcuucuacggcuccuccccccaccaccucgaggaccccucccucuccgagcucgagaacuucuccuccgagaucaucuccuucaaguccauggaggaccucgucaacgaguucgacgagaagcucaacgucugcuuccgcaacuacaacgccaagaccgagaaccucgcccccgucaagaaccagcuccagauccaggaggaggaggagacccuccaggacgaggaggucugggacgcccucaccgacaacuacauccccucccucuccgaggacuggcgcgaccccaacaucgaggcccucaacggcaacugcuccgacaccgagauccacgagaaggaggaggaggaguucaacgagaaguccgagaacgacuccggcaucaacgaggagccccuccucaccgccgaccaggucaucgaggagaucgaggagaugaugcagaacucccccgaccccgaggaggaggaggagguccucgaggaggaggacggcggcgagaccuccucccaggccgacuccguccuccuccaggagaugcaggcccucacccagaccuucaacaacaacugguccuacgagggccuccgccacauguccggcuccgagcucaccgagcuccucgaccaggucgagggcgccauccgcgacuucuccgaggagcucguccagcagcucgcccgccgcgacgagcucgaguucgagaaggaggucaagaacuccuucaucaccguccucaucgagguccagaacaagcagaaggagcagcgcgagcucaugaagaagcgccgcaaggagaagggccucucccuccaguccucccgcaucgagaagggcaaccagaugccccucaagcgcuucuccauggagggcaucuccaacauccuccaguccggcauccgccagaccuucggcuccuccggcaccgacaagcaguaccucaacaccgucauccccuacgagaagaaggccuccccccccuccgucgaggaccuccagaugcucaccaacauccucuucgccaugaaggaggacaacgagaagguccccacccuccucaccgacuacauccucaagguccucugccccaccuga

SEQ ID NO: 43166 - RNA, 1143 nt, Artificial Sequence
  derived and/or modified sequence opt2 from FEZ2__Homo_sapiens__NP_001036013
auggccgccgacggcgacuggcaggacuucuacgaguuccaggagcccgcccgcucccuccucgaccaggagaacugcaacgccucccccgagcccggcgccgaggccggcgccgaggccggcggcggcgccgacggcuuccccgcccccgccugcucccucgaggagaagcucucccucugcuuccgccccuccgaccccggcgccgagcccccccgcaccgccguccgccccaucaccgagcgcucccuccuccagggcgacgagaucuggaacgcccucaccgacaacuacggcaacgucaugcccgucgacuggaaguccucccacacccgcacccuccaccuccucacccucaaccucuccgagaagggcgucuccgacucccuccucuucgacaccuccgacgacgaggagcuccgcgagcagcucgacaugcacuccaucaucgucuccugcgucaacgacgagccccucuucaccgccgaccaggucaucgaggagaucgaggagaugaugcaggagucccccgaccccgaggacgacgagacccccacccaguccgaccgccucuccaugcucucccaggagauccagacccucaagcgcuccuccaccggcuccuacgaggagcgcgucaagcgccucuccgucuccgagcucaacgagauccucgaggagaucgagaccgccaucaaggaguacuccgaggagcucguccagcagcucgcccuccgcgacgagcucgaguucgagaaggaggucaagaacuccuucaucuccguccucaucgagguccagaacaagcagaaggagcacaaggagaccgccaagaagaagaagaagcucaagaacggcuccucccagaacggcaagaacgagcgcucccacaugcccggcacccgcuucuccauggagggcaucuccaacgucauccagaacggccuccgccacaccuucggcaacuccggcggcgagaagcaguaccucaccaccgucauccccuacgagaagaagaacggcccccccuccgucgaggaccuccagauccucaccaagauccuccgcgccaugaaggaggacuccgagaagguccccucccuccucaccgacuacauccucaagguccucugccccaccuga

SEQ ID NO: 43167 - RNA, 1428 nt, Artificial Sequence
  derived and/or modified sequence opt2 from FEZF1__Homo_sapiens__NP_001019784
auggacuccuccugccacaacgccaccaccaagaugcucgccaccgcccccgcccgcggcaacaugauguccaccuccaagccccucgccuucuccaucgagcgcaucauggcccgcacccccgagcccaaggcccuccccgucccccacuuccuccagggcgcccuccccaagggcgagcccaagcacucccuccaccucaacuccuccauccccugcaugauccccuucguccccgucgccuacgacaccucccccaaggccggcgucaccggcuccgagccccgcaaggccucccucgaggcccccgccgcccccgccgccguccccuccgcccccgccuucuccugcuccgaccuccucaacugcgcccucucccucaagggcgaccucgcccgcgacgcccucccccuccagcaguacaagcucguccgcccccgcgucgucaaccacuccuccuuccacgccaugggcgcccucugcuaccucaaccgcggcgacggccccugccaccccgccgccggcgucaacauccaccccgucgccuccuacuuccucuccuccccccuccacccccagcccaagaccuaccucgccgagcgcaacaagcucgucguccccgccgucgagaaguaccccuccggcgucgccuucaaggaccucucccaggcccagcuccagcacuacaugaaggaguccgcccagcuccucuccgagaagaucgccuucaagaccuccgacuucucccgcggcucccccaacgccaagcccaaggucuucaccugcgaggucugcggcaaggucuucaacgcccacuacaaccucacccgccacaugcccguccacaccggcgcccgccccuucgucugcaaggucugcggcaagggcuuccgccaggccuccacccucugccgccacaagaucauccacacccaggagaagccccacaagugcaaccagugcggcaaggccuucaaccgcuccuccacccucaacacccacacccgcauccacgccggcuacaagcccuucgucugcgaguucugcggcaagggcuuccaccagaagggcaacuacaagaaccacaagcucacccacuccggcgagaagcaguucaagugcaacaucugcaacaaggccuuccaccaggucuacaaccucaccuuccacaugcacacccacaacgacaagaagcccuucaccugccccaccugcggcaagggcuucugccgcaacuucgaccucaagaagcacguccgcaagcuccacgacuccucccucggccucgcccgcacccccgccggcgagcccggcaccgagcccccccccccccucccccagcagccccccaugacccuccccccccuccagcccccccuccccacccccggcccccuccagcccggccuccaccagggccaccaguga

SEQ ID NO: 43168 - RNA, 1380 nt, Artificial Sequence
  derived and/or modified sequence opt2 from FEZF2__Homo_sapiens__NP_060478
auggccuccuccgccucccucgagaccauggucccccccgccugcccccgcgccggcgccucccccgccaccuccaagacccucgccuucuccaucgagcgcaucauggccaagaccuccgagccccgcgcccccuucgagccccgccccggcgcccucgaggccgacggcucccagggcaagaagcuccucaaccucugcuccccccuccccugcaugaucccccuccagccccucggcuacgagguccccuccaagacccuccucuccuacuccgagcucuggaaguccucccuccgcgccggcggcggcggcggcggcggcggcggcggcggcggcggcggcggcggcgcccccgucugcggcgccuccggccucugcaagaccaacugcggcgucugcugcaaggccgagcucggccucgcccccuccgcccuccccgccggccgcgucaucaagccccaggucaucaaccaggccgucggccuccccgccuccggcucccucuacuacuucaacuaccucgacuccaccgccuacccccccuccgagcuccucuccggccaccucuuccccuccggccuccucaacgcccaggcccccgccgcccucgccgcccaccccaagcucuuccuccucgagaacgccaagcucgccggccucgccgccgacaaguucccccaccccgcccccuacccccacaaggagcgccuccccgccccccucgagcagguccucaaggagaacuccgcccucaccgccgagcgcggcggcgucaagggccacuccaagcuccccggcggcuccgccgacggcaagcccaagaacuucaccugcgaggucugcggcaaggucuucaacgcccacuacaaccucacccgccacaugcccguccacaccggcgcccgccccuucgucugcaaggucugcggcaagggcuuccgccaggccuccacccucugccgccacaagaucauccacacccaggagaagccccacaagugcaaccagugcggcaaggccuucaaccgcuccuccacccucaacacccacauccgcauccacgccggcuacaagcccuucgucugcgaguucugcggcaagggcuuccaccagaagggcaacuacaagaaccacaagcucacccacuccggcgagaagcaguacaagugcaccaucugcaacaaggccuuccaccaggucuacaaccucaccuuccacaugcacacccacaacgacaagaagcccuucaccugcgccaccugcggcaagggcuucugccgcaacuucgaccucaagaagcacguccgcaagcuccacgacuccgucggccccgccgcccccuccgccaaggaccucacccgcaccguccaguccuga

SEQ ID NO: 43169 - RNA, 903 nt, Artificial Sequence
  derived and/or modified sequence opt2 from FFAR1__Homo_sapiens__NP_005294
auggaccuccccccccagcucuccuucggccucuacgucgccgccuucgcccucggcuucccccucaacguccucgccauccgcggcgccaccgcccacgcccgccuccgccucacccccucccucgucuacgcccucaaccucggcugcuccgaccuccuccucaccgucucccucccccucaaggccgucgaggcccucgccuccggcgccuggccccuccccgccucccucugccccgucuucgccgucgcccacuucuucccccucuacgccggcggcggcuuccucgccgcccucuccgccggccgcuaccucggcgccgccuucccccucggcuaccaggccuuccgccgccccugcuacuccuggggcgucugcgccgccaucugggcccucguccucugccaccucggccucgucuucggccucgaggcccccggcggcuggcucgaccacuccaacaccucccucggcaucaacacccccgucaacggcucccccgucugccucgaggccugggaccccgccuccgccggccccgcccgcuucucccucucccuccuccucuucuuccucccccucgccaucaccgccuucugcuacgucggcugccuccgcgcccucgcccgcuccggccucacccaccgccgcaagcuccgcgccgccugggucgccggcggcgcccuccucacccuccuccucugcgucggccccuacaacgccuccaacgucgccuccuuccucuaccccaaccucggcggcuccuggcgcaagcucggccucaucaccggcgccugguccgucguccucaacccccucgucaccggcuaccucggccgcggccccggccucaagaccgucugcgccgcccgcacccagggcggcaagucccagaaguga

SEQ ID NO: 43170 - RNA, 993 nt, Artificial Sequence
  derived and/or modified sequence opt2 from FFAR2__Homo_sapiens__NP_005297
augcuccccgacuggaaguccucccucauccucauggccuacaucaucaucuuccucaccggccuccccgccaaccuccucgcccuccgcgccuucgucggccgcauccgccagccccagcccgcccccguccacauccuccuccucucccucacccucgccgaccuccuccuccuccuccuccuccccuucaagaucaucgaggccgccuccaacuuccgcugguaccuccccaaggucgucugcgcccucaccuccuucggcuucuacuccuccaucuacugcuccaccuggcuccucgccggcaucuccaucgagcgcuaccucggcgucgccuuccccguccaguacaagcucucccgccgcccccucuacggcgucaucgccgcccucgucgccugggucauguccuucggccacugcaccaucgucaucaucguccaguaccucaacaccaccgagcagguccgcuccggcaacgagaucaccugcuacgagaacuucaccgacaaccagcucgacgucguccuccccguccgccucgagcucugccucguccucuucuucauccccauggccgucaccaucuucugcuacuggcgcuucgucuggaucaugcucucccagccccucgucggcgcccagcgccgccgccgcgccgucggccucgccgucgucacccuccucaacuuccucgucugcuucggccccuacaacgucucccaccucgucggcuaccaccagcgcaagucccccugguggcgcuccaucgccgucgucuucuccucccucaacgccucccucgacccccuccucuucuacuucuccuccuccgucguccgccgcgccuucggccgcggccuccagguccuccgcaaccagggcuccucccuccucggccgccgcggcaaggacaccgccgagggcaccaacgaggaccgcggcgucggccagggcgagggcaugcccuccuccgacuucaccaccgaguga

SEQ ID NO: 43171 - RNA, 1041 nt, Artificial Sequence
  derived and/or modified sequence opt2 from FFAR3__Homo_sapiens__NP_005295
auggacaccggccccgaccaguccuacuucuccggcaaccacugguucgucuucuccgucuaccuccucaccuuccucgucggccucccccucaaccuccucgcccucgucgucuucgucggcaagcuccagcgccgccccgucgccgucgacguccuccuccucaaccucaccgccuccgaccuccuccuccuccucuuccuccccuuccgcauggucgaggccgccaacggcaugcacuggccccuccccuucauccucugcccccucuccggcuucaucuucuucaccaccaucuaccucaccgcccucuuccucgccgccgucuccaucgagcgcuuccucuccgucgcccacccccucugguacaagacccgcccccgccucggccaggccggccucgucuccgucgccugcuggcuccucgccuccgcccacugcuccgucgucuacgucaucgaguucuccggcgacaucucccacucccagggcaccaacggcaccugcuaccucgaguuccgcaaggaccagcucgccauccuccuccccguccgccucgagauggccgucguccucuucgucgucccccucaucaucaccuccuacugcuacucccgccucgucuggauccucggccgcggcggcucccaccgccgccagcgccgcgucgccggccuccucgccgccacccuccucaacuuccucgucugcuucggccccuacaacgucucccacgucgucggcuacaucugcggcgagucccccgccuggcgcaucuacgucacccuccucuccacccucaacuccugcgucgaccccuucgucuacuacuucuccuccuccggcuuccaggccgacuuccacgagcuccuccgccgccucugcggccucuggggccaguggcagcaggaguccuccauggagcucaaggagcagaagggcggcgaggagcagcgcgccgaccgccccgccgagcgcaagaccuccgagcacucccagggcugcggcaccggcggccaggucgccugcgccgaguccuga

SEQ ID NO: 43172 - RNA, 1086 nt, Artificial Sequence
  derived and/or modified sequence opt2 from FFAR4__Homo_sapiens__NP_001182684
augucccccgagugcgcccgcgccgccggcgacgccccccuccgcucccucgagcaggccaaccgcacccgcuuccccuucuucuccgacgucaagggcgaccaccgccucguccucgccgccgucgagaccaccguccucguccucaucuucgccgucucccuccucggcaacgucugcgcccucguccucgucgcccgccgccgccgccgcggcgccaccgccugccucguccucaaccucuucugcgccgaccuccucuucaucuccgccaucccccucguccucgccguccgcuggaccgaggccuggcuccucggccccgucgccugccaccuccucuucuacgucaugacccucuccggcuccgucaccauccucacccucgccgccgucucccucgagcgcauggucugcaucguccaccuccagcgcggcguccgcggccccggccgccgcgcccgcgccguccuccucgcccucaucuggggcuacuccgccgucgccgcccucccccucugcgucuucuuccgcgucgucccccagcgccuccccggcgccgaccaggagaucuccaucugcacccucaucuggcccaccauccccggcgagaucuccugggacgucuccuucgucacccucaacuuccucguccccggccucgucaucgucaucuccuacuccaagauccuccagaucaccaaggccucccgcaagcgccucaccgucucccucgccuacuccgagucccaccagauccgcgucucccagcaggacuuccgccucuuccgcacccucuuccuccucauggucuccuucuucaucauguggucccccaucaucaucaccauccuccucauccucauccagaacuucaagcaggaccucgucaucuggcccucccucuucuucugggucgucgccuucaccuucgccaacuccgcccucaaccccauccucuacaacaugacccucugccgcaacgaguggaagaagaucuucugcugcuucugguuccccgagaagggcgccauccucaccgacaccuccgucaagcgcaacgaccucuccaucaucuccggcuga

SEQ ID NO: 43173 - RNA, 2601 nt, Artificial Sequence
  derived and/or modified sequence opt2 from FGA__Homo_sapiens__NP_000499
auguucuccaugcgcaucgucugccucguccucuccgucgucggcaccgccuggaccgccgacuccggcgagggcgacuuccucgccgagggcggcggcguccgcggcccccgcgucgucgagcgccaccaguccgccugcaaggacuccgacuggcccuucugcuccgacgaggacuggaacuacaagugccccuccggcugccgcaugaagggccucaucgacgaggucaaccaggacuucaccaaccgcaucaacaagcucaagaacucccucuucgaguaccagaagaacaacaaggacucccacucccucaccaccaacaucauggagauccuccgcggcgacuucuccuccgccaacaaccgcgacaacaccuacaaccgcgucuccgaggaccuccgcucccgcaucgagguccucaagcgcaaggucaucgagaagguccagcacauccagcuccuccagaagaacguccgcgcccagcucgucgacaugaagcgccucgaggucgacaucgacaucaagauccgcuccugccgcggcuccugcucccgcgcccucgcccgcgaggucgaccucaaggacuacgaggaccagcagaagcagcucgagcaggucaucgccaaggaccuccuccccucccgcgaccgccagcaccucccccucaucaagaugaagcccguccccgaccucguccccggcaacuucaagucccagcuccagaaggucccccccgaguggaaggcccucaccgacaugccccagaugcgcauggagcucgagcgccccggcggcaacgagaucacccgcggcggcuccaccuccuacggcaccggcuccgagaccgaguccccccgcaaccccuccuccgccggcuccuggaacuccggcuccuccggccccggcuccaccggcaaccgcaaccccggcuccuccggcaccggcggcaccgccaccuggaagcccggcuccuccggccccggcuccaccggcuccuggaacuccggcuccuccggcaccggcuccaccggcaaccagaaccccggcuccccccgccccggcuccaccggcaccuggaaccccggcuccuccgagcgcggcuccgccggccacuggaccuccgaguccuccgucuccggcuccaccggccaguggcacuccgaguccggcuccuuccgccccgacucccccggcuccggcaacgcccgccccaacaaccccgacuggggcaccuucgaggaggucuccggcaacgucucccccggcacccgccgcgaguaccacaccgagaagcucgucaccuccaagggcgacaaggagcuccgcaccggcaaggagaaggucaccuccggcuccaccaccaccacccgccgcuccugcuccaagaccgucaccaagaccgucaucggccccgacggccacaaggaggucaccaaggaggucgucaccuccgaggacggcuccgacugccccgaggccauggaccucggcacccucuccggcaucggcacccucgacggcuuccgccaccgccaccccgacgaggccgccuucuucgacaccgccuccaccggcaagaccuuccccggcuucuucucccccaugcucggcgaguucgucuccgagaccgagucccgcggcuccgaguccggcaucuucaccaacaccaaggaguccuccucccaccaccccggcaucgccgaguuccccucccgcggcaaguccuccuccuacuccaagcaguucaccuccuccaccuccuacaaccgcggcgacuccaccuucgaguccaaguccuacaagauggccgacgaggccggcuccgaggccgaccacgagggcacccacuccaccaagcgcggccacgccaagucccgccccguccgcgacugcgacgacguccuccagacccaccccuccggcacccaguccggcaucuucaacaucaagcuccccggcuccuccaagaucuucuccgucuacugcgaccaggagaccucccucggcggcuggcuccucauccagcagcgcauggacggcucccucaacuucaaccgcaccuggcaggacuacaagcgcggcuucggcucccucaacgacgagggcgagggcgaguucuggcucggcaacgacuaccuccaccuccucacccagcgcggcuccguccuccgcgucgagcucgaggacugggccggcaacgaggccuacgccgaguaccacuuccgcgucggcuccgaggccgagggcuacgcccuccaggucuccuccuacgagggcaccgccggcgacgcccucaucgagggcuccgucgaggagggcgccgaguacaccucccacaacaacaugcaguucuccaccuucgaccgcgacgccgaccagugggaggagaacugcgccgaggucuacggcggcggcuggugguacaacaacugccaggccgccaaccucaacggcaucuacuaccccggcggcuccuacgacccccgcaacaacucccccuacgagaucgagaacggcgucgucugggucuccuuccgcggcgccgacuacucccuccgcgccguccgcaugaagauccgcccccucgucacccaguga

SEQ ID NO: 43174 - RNA, 1476 nt, Artificial Sequence
  derived and/or modified sequence opt2 from FGB__Homo_sapiens__NP_005132
augaagcgcauggucuccugguccuuccacaagcucaagaccaugaagcaccuccuccuccuccuccucugcgucuuccucgucaagucccagggcgucaacgacaacgaggagggcuucuucuccgcccgcggccaccgcccccucgacaagaagcgcgaggaggcccccucccuccgccccgcccccccccccaucuccggcggcggcuaccgcgcccgccccgccaaggccgccgccacccagaagaaggucgagcgcaaggcccccgacgccggcggcugccuccacgccgaccccgaccucggcguccucugccccaccggcugccagcuccaggaggcccuccuccagcaggagcgccccauccgcaacuccgucgacgagcucaacaacaacgucgaggccgucucccagaccuccuccuccuccuuccaguacauguaccuccucaaggaccucuggcagaagcgccagaagcaggucaaggacaacgagaacgucgucaacgaguacuccuccgagcucgagaagcaccagcucuacaucgacgagaccgucaacuccaacauccccaccaaccuccgcguccuccgcuccauccucgagaaccuccgcuccaagauccagaagcucgaguccgacgucuccgcccagauggaguacugccgcacccccugcaccgucuccugcaacauccccgucgucuccggcaaggagugcgaggagaucauccgcaagggcggcgagaccuccgagauguaccucauccagcccgacuccuccgucaagcccuaccgcgucuacugcgacaugaacaccgagaacggcggcuggaccgucauccagaaccgccaggacggcuccgucgacuucggccgcaagugggaccccuacaagcagggcuucggcaacgucgccaccaacaccgacggcaagaacuacugcggccuccccggcgaguacuggcucggcaacgacaagaucucccagcucacccgcaugggccccaccgagcuccucaucgagauggaggacuggaagggcgacaaggucaaggcccacuacggcggcuucaccguccagaacgaggccaacaaguaccagaucuccgucaacaaguaccgcggcaccgccggcaacgcccucauggacggcgccucccagcucaugggcgagaaccgcaccaugaccauccacaacggcauguucuucuccaccuacgaccgcgacaacgacggcuggcucaccuccgacccccgcaagcagugcuccaaggaggacggcggcggcuggugguacaaccgcugccacgccgccaaccccaacggccgcuacuacuggggcggccaguacaccugggacauggccaagcacggcaccgacgacggcgucgucuggaugaacuggaagggcuccugguacuccaugcgcaagauguccaugaagauccgccccuucuucccccagcaguga

SEQ ID NO: 43175 - RNA, 2886 nt, Artificial Sequence
  derived and/or modified sequence opt2 from FGD1__Homo_sapiens__NP_004454
augcacggccaccgcgcccccggcggcgccggccccuccgagcccgagcaccccgccaccaacccccccggcgccgccccccccgccugcgccgacuccgaccccggcgccuccgagcccggccuccucgcccgccgcggcuccggcuccgcccucggcggcccccucgacccccaguucgucggccccuccgacaccucccucggcgccgcccccggccaccgcguccuccccugcggccccuccccccagcaccaccgcgcccuccgcuucuccuaccaccucgagggcucccagccccgccccggccuccaccagggcaaccgcauccucgucaagucccucucccucgaccccggccagucccucgagccccaccccgagggcccccagcgccuccgcuccgaccccggcccccccaccgagacccccucccagcgccccuccccccucaagcgcgcccccggccccaagccccaggucccccccaagcccuccuaccuccagaugccccgcaugccccccccccucgagcccaucccccccccccccucccgcccccuccccgccgacccccgcgucgccaagggccucgccccccgcgccgaggccucccccuccuccgccgccgucuccucccucaucgagaaguucgagcgcgagcccgucaucgucgccuccgaccgccccguccccggccccucccccggcccccccgagcccgucaugcucccccagcccaccucccagccccccgucccccagcuccccgagggcgaggccucccgcugccucuuccuccucgcccccggcccccgcgacggcgagaagguccccaaccgcgacuccggcaucgacuccaucuccucccccuccaacuccgaggagaccugcuucgucuccgacgacggcccccccucccacucccucugccccggcccccccgcccucgccuccguccccgucgcccucgccgacccccaccgccccggcucccaggaggucgacuccgaccucgaggaggaggacgacgaggaggaggaggaggagaaggaccgcgagauccccgucccccucauggagcgccaggaguccgucgagcucaccguccagcagaaggucuuccacaucgccaacgagcuccuccagaccgagaaggccuacgucucccgccuccaccuccucgaccaggucuucugcgcccgccuccucgaggaggcccgcaaccgcuccuccuuccccgccgacgucguccacggcaucuucuccaacaucugcuccaucuacugcuuccaccagcaguuccuccuccccgagcucgagaagcgcauggaggagugggaccgcuacccccgcaucggcgacauccuccagaagcucgcccccuuccucaagauguacggcgaguacgucaagaacuucgaccgcgccgucgagcucgucaacaccuggaccgagcgcuccacccaguucaaggucaucauccacgagguccagaaggaggaggccugcggcaaccucacccuccagcaccacaugcucgagcccguccagcgcaucccccgcuacgagcuccuccucaaggacuaccuccucaagcucccccacggcucccccgacuccaaggacgcccagaagucccucgagcucaucgccaccgccgccgagcacuccaacgccgccauccgcaagauggagcgcaugcacaagcuccucaaggucuacgagcuccucggcggcgaggaggacaucgucucccccaccaaggagcucaucaaggagggccacauccucaagcucuccgccaagaacggcaccacccaggaccgcuaccucauccucuucaacgaccgccuccucuacugcgucccccgccuccgccuccucggccagaaguucuccguccgcgcccgcaucgacgucgacggcauggagcucaaggaguccuccaaccucaaccucccccgcaccuuccucgucuccggcaagcagcgcucccucgagcuccaggcccgcaccgaggaggagaagaaggacuggguccaggccaucaacuccacccuccucaagcacgagcagacccucgagaccuucaagcuccucaacuccaccaaccgcgaggacgaggacaccccccccaacucccccaacgucgaccucggcaagcgcgcccccacccccauccgcgagaaggaggucaccaugugcaugcgcugccaggagcccuucaacuccaucaccaagcgccgccaccacugcaaggccugcggccacgucgucugcggcaagugcuccgaguuccgcgcccgccucgucuacgacaacaaccgcuccaaccgcgucugcaccgacugcuacgucgcccuccacggcguccccggcuccucccccgccugcucccagcacaccccccagcgccgccgcuccauccucgagaagcaggccuccgucgccgccgagaacuccgucaucugcuccuuccuccacuacauggagaagggcggcaagggcuggcacaaggccugguucgucguccccgagaacgagccccucguccucuacaucuacggcgccccccaggacgucaaggcccagcgcucccucccccucaucggcuucgaggucggcccccccgaggccggcgagcgccccgaccgccgccacgucuucaagaucacccagucccaccucuccugguacuucucccccgagaccgaggagcuccagcgccgcuggauggccguccucggccgcgccggccgcggcgacaccuucugccccggccccacccucuccgaggaccgcgagauggaggaggcccccgucgccgcccucggcgccaccgccgagccccccgaguccccccagacccgcgacaagaccuga

SEQ ID NO: 43176 - RNA, 1968 nt, Artificial Sequence
  derived and/or modified sequence opt2 from FGD2__Homo_sapiens__NP_775829
augaagggcgccuccgaggagaagcucgccuccgucuccaaccucgucaccgucuucgagaacucccgcacccccgaggccgccccccgcggccagcgccucgaggacguccaccaccgccccgagugccgcccccccgagucccccggcccccgcgagaagaccaacgucggcgaggccgucggcuccgagccccgcaccgucucccgccgcuaccucaacucccucaagaacaagcucuccuccgaggccuggcgcaaguccugccagcccgucacccucuccggcuccggcacccaggagcccgagaagaagaucguccaggagcuccucgagaccgagcaggccuacgucgcccgccuccaccuccucgaccaggucuucuuccaggagcuccucaagaccgcccgcuccuccaaggccuuccccgaggacgucguccgcgucaucuucuccaacaucuccuccaucuaccaguuccacucccaguucuuccuccccgagcuccagcgccgccucgacgacuggaccgccaacccccgcaucggcgacgucauccagaagcucgcccccuuccucaagauguacuccgaguacgucaagaacuucgagcgcgccgccgagcuccucgccaccuggaccgacaaguccccccucuuccaggagguccucacccgcauccaguccuccgaggccuccggcucccucacccuccagcaccacaugcucgagcccguccagcgcaucccccgcuacgagcuccuccucaaggaguacauccagaagcuccccgcccaggcccccgaccaggccgacgcccagaaggcccucgacaugaucuucuccgccgcccagcacuccaacgccgccaucaccgagauggagcgccuccaggaccucugggaggucuaccagcgccucggccucgaggacgacaucgucgaccccuccaacacccuccuccgcgagggccccguccucaagaucuccuuccgccgcaacgaccccauggagcgcuaccucuuccucuucaacaacaugcuccucuacugcgucccccgcgucauccaggucggcgcccaguuccagguccgcacccgcaucgacgucgccggcaugaagguccgcgagcucauggacgccgaguucccccacuccuuccucgucuccggcaagcagcgcacccucgagcuccaggcccgcucccaggaggagaugaucuccuggaugcaggccuuccaggccgccaucgaccagaucgagaagcgcaacgagaccuucaaggccgccgcccagggccccgagggcgacauccaggagcaggagcuccaguccgaggagcucggccuccgcgccccccaguggguccgcgacaagauggucaccaugugcaugcgcugccaggagcccuucaacgcccucacccgccgccgccaccacugccgcgccugcggcuacgucgucugcgcccgcugcuccgacuaccgcgccgagcucaaguacgacgacaaccgccccaaccgcgucugccuccacugcuacgccuuccucaccggcaacguccuccccgaggccaaggaggacaagcgccgcggcauccucgagaagggcuccuccgccacccccgaccagucccucaugugcuccuuccuccagcucaucggcgacaaguggggcaaguccggcccccgcggcuggugcgucaucccccgcgacgacccccucguccucuacgucuacgccgccccccaggacaugcgcgcccacaccuccaucccccuccucggcuaccaggucaccgucggcccccagggcgacccccgcgucuuccagcuccagcaguccggccagcucuacaccuucaaggccgagaccgaggagcucaagggccgcugggucaaggccauggagcgcgccgccuccggcuggucccccuccuggcccaacgacggcgaccucuccgacuga

SEQ ID NO: 43177 - RNA, 2178 nt, Artificial Sequence
  derived and/or modified sequence opt2 from FGD3__Homo_sapiens__NP_001077005
auggaguccggccgcggcuccuccaccccccccggccccaucgccgcccucggcaugcccgacaccggccccggcuccuccucccucggcaagcuccaggcccuccccgucggcccccgcgcccacugcggcgaccccgucucccucgccgccgccggcgacggcucccccgacaucggccccaccggcgagcucuccggcucccucaagauccccaaccgcgacuccggcaucgacucccccuccuccuccgucgccggcgagaacuuccccugcgaggagggccucgaggccggccccucccccaccguccucggcgcccacgccgagauggcccucgacucccagguccccaaggucaccccccaggaggaggccgacuccgacgucggcgaggagcccgacuccgagaacaccccccagaaggccgacaaggacgccggccucgcccagcacuccggcccccagaagcuccuccacaucgcccaggagcuccuccacaccgaggagaccuacgucaagcgccuccaccuccucgaccaggucuucugcacccgccucaccgacgccggcaucccccccgaggucaucaugggcaucuucuccaacaucuccuccauccaccgcuuccacggccaguuccuccuccccgagcucaagacccgcaucaccgaggagugggacaccaacccccgccucggcgacauccuccagaagcucgcccccuuccucaagauguacggcgaguacgucaagaacuucgaccgcgccgucggccucgucuccaccuggacccagcgcuccccccucuucaaggacgucguccacuccauccagaagcaggaggucugcggcaaccucacccuccagcaccacaugcucgagcccguccagcgcgucccccgcuacgagcuccuccucaaggacuaccucaagcgccucccccaggacgcccccgaccgcaaggacgccgagcgcucccucgagcucaucuccaccgccgccaaccacuccaacgccgccauccgcaaggucgagaagaugcacaagcuccucgaggucuacgagcagcucggcggcgaggaggacaucgucaaccccgccaacgagcucaucaaggagggccagauccagaagcucuccgccaagaacggcaccccccaggaccgccaccucuuccucuucaacuccaugauccucuacugcguccccaagcuccgccucaugggccagaaguucuccguccgcgagaagauggacaucuccggccuccagguccaggacaucgucaagcccaacaccgcccacaccuucaucaucaccggccgcaagcgcucccucgagcuccagacccgcaccgaggaggagaagaaggaguggauccagaucauccaggccaccaucgagaagcacaagcagaacuccgagaccuucaaggccuucggcggcgccuucucccaggacgaggaccccucccucucccccgacaugcccaucaccuccaccucccccgucgagcccgucgucaccaccgagggcuccuccggcgccgccggccucgagccccgcaagcucuccuccaagacccgccgcgacaaggagaagcaguccugcaaguccugcggcgagaccuucaacuccaucaccaagcgccgccaccacugcaagcucugcggcgccgucaucugcggcaagugcuccgaguucaaggccgagaacucccgccagucccgcgucugccgcgacugcuuccucacccagcccgucgcccccgaguccaccgagaagacccccaccgccgacccccagcccucccuccucugcggcccccuccgccucuccgaguccggcgagaccugguccgaggucugggccgccauccccauguccgacccccagguccuccaccuccagggcggcucccaggacggccgccucccccgcaccaucccccuccccuccugcaagcucuccguccccgaccccgaggagcgccucgacuccggccacgucuggaagcuccagugggccaagcaguccugguaccucuccgccuccuccgccgagcuccagcagcaguggcucgagacccucuccaccgccgcccacggcgacaccgcccaggacucccccggcgcccuccagcuccagguccccaugggcgccgccgcccccuga

SEQ ID NO: 43178 - RNA, 2637 nt, Artificial Sequence
  derived and/or modified sequence opt2 from FGD4__Homo_sapiens__NP_001291409
augaacuucaagcgcgucaagcccaacaucuuccuccucaaccagucccgccucaucaucuccaucugcgagaucauguccaccgaccagggcuccuccaccugccccaagaucgcccucgucccccccugcuccaccuccuccaccaccacccucgucggcgagaacgucuccgaggaggaggcccagggcaucaacggcaaccgccccgccaagcacuccgccgccucccccaagccccaggucccccccaagccccuccaccuccagaacucccccuccuccaacauccaccagaccccccgccacaaggcccuccccuccgccaagccccgcauggaggagaucaagcccgccuccgccuccugcgucuccaaggagaagcccuccaaggucuccgaccucaucucccgcuucgagggcggcuccucccucuccaacuacuccgaccucaagaaggaguccgccgucaaccucaacgccccccgcacccccggccgccacggccucaccaccaccccccagcagaagcuccucucccagcaccucccccagcgccagggcaacgacaccgacaagacccagggcgcccagaccugcgucgccaacggcgucauggccgcccagaaccagauggagugcgaggaggagaaggccgccacccucuccuccgacaccuccauccaggccuccgagccccuccucgacacccacaucgucaacggcgagcgcgacgagaccgccaccgcccccgccucccccaccaccgacuccugcgacggcaacgccuccgacuccuccuaccgcacccccggcaucggccccguccucccccucgaggagcgcggcgccgagaccgagaccaagguccaggagcgcgagaacggcgaguccccccucgagcucgagcagcucgaccagcaccacgagaugaaggagaccaacgagcagaagcuccacaagaucgccaacgagcuccuccucaccgagcgcgccuacgucaaccgccucgaccuccucgaccaggucuucuacugcaagcuccucgaggaggccaaccgcggcuccuuccccgccgagauggucaacaagaucuucuccaacaucuccuccaucaacgccuuccacuccaaguuccuccuccccgagcucgagaagcgcaugcaggagugggagaccaccccccgcaucggcgacauccuccagaagcucgcccccuuccucaagauguacggcgaguacgucaagggcuucgacaacgccauggagcucgucaagaacaugaccgagcgcaucccccaguucaaguccgucgucgaggagauccagaagcagaagaucugcggcucccucacccuccagcaccacaugcucgagcccguccagcgcaucccccgcuacgagaugcuccucaaggacuaccuccgcaagcucccccccgacucccucgacuggaacgacgccaagaagucccucgagaucaucuccaccgccgccucccacuccaacuccgccauccgcaagauggagaaccucaagaagcuccucgagaucuacgagaugcucggcgaggaggaggacaucgucaaccccuccaacgagcucaucaaggagggccagauccucaagcucgccgcccgcaacaccuccgcccaggagcgcuaccucuuccucuucaacaacaugcuccucuacugcguccccaaguucucccucgucggcuccaaguucaccguccgcacccgcgucggcaucgacggcaugaagaucgucgagacccagaacgaggaguacccccacaccuuccaggucuccggcaaggagcgcacccucgagcuccaggccuccuccgcccaggacaaggaggaguggaucaaggcccuccaggagaccaucgacgccuuccaccagcgccacgagaccuuccgcaacgccaucgccaaggacaacgacauccacuccgaggucuccaccgccgagcucggcaagcgcgccccccgcuggauccgcgacaacgaggucaccaugugcaugaagugcaaggagcccuucaacgcccucacccgccgccgccaccacugccgcgccugcggcuacgucgucugcuggaagugcuccgacuacaaggcccagcucgaguacgacggcggcaagcucuccaaggucugcaaggacugcuaccagaucaucuccggcuucaccgacuccgaggagaagaagcgcaagggcauccucgagaucgaguccgccgaggucuccggcaacuccgucgucugcuccuuccuccaguacauggagaaguccaagcccuggcagaaggccuggugcgucauccccaagcaggacccccucguccucuacauguacggcgccccccaggacguccgcgcccaggccaccaucccccuccucggcuacgucgucgacgagaugccccgcuccgccgaccucccccacuccuucaagcucacccaguccaaguccguccacuccuucgccgccgacuccgaggagcucaagcagaaguggcucaaggucauccuccucgccgucaccggcgagacccccggcggccccaacgagcaccccgccacccucgacgaccaccccgagcccaagaagaaguccgagugcuga

SEQ ID NO: 43179 - RNA, 4389 nt, Artificial Sequence
  derived and/or modified sequence opt2 from FGD5__Homo_sapiens__NP_689749
auguuccgcggccccaagccccccaucgcccccaagccccgccucaccgcccccaacgaguggcgcgccuccgucuaccucaacgacucccucaacaagugcuccaacggccgccuccccugcgucgaccgcggccucgacgagggcccccgcuccauccccaagugcuccgaguccgagaccgacgaggacuacaucgucgucccccgcgucccccuccgcgaggacgagcccaaggacgagggcuccgucggcaacaaggcccucgucucccccgaguccuccgccgaggaggaggaggagcgcgaggagggcggcgaggccugcggccucgagggcaccggcgccggcgaggacuccgucgcccccgccgcccccggcgccggcgcccucucccgcgagggcgaggagggcaccgaccucgcccucgaggacgagggcgagggcugcgccgacgagcccggcacccucgagcaggucucccgcuccgaggaggaggagaagcucguccagccccaccgcgagugcucccucgaggacuccggccccugggccggcgagggcgucuuccaguccgaccuccuccucccccacauccacggcgaggaccaggagccccccgacacccccggcgaggccgaggaggacgacgaggagggcugcgccuccaccgaccccgccggcgccgacgagggcuccggccccgaccgccccaccgaggacaugggccaggacgccgaggacaccuccgaggagccccccgagaaggaggagcucgccggcguccaggaggccgagaccgccaccgacugccccgagguccucgaggagggcugcgaggaggccaccggcgucaccggcggcgagcaggucgaccucuccgagccccccgaccacgagaagaagaccaaccaggaggucgccgccgccacccucgaggaccacgcccaggacgaguccgccgaggaguccugccagaucguccccuucgagaacgacugcauggaggacuucgucaccucccucaccggcucccccuacgaguucuuccccaccgaguccaccuccuucugcuccgaguccugcuccccccucuccgaguccgccaagggccucgaguccgagcaggcccccaagcucggccuccgcgccgaggagaaccccauggucggcgcccucugcggccagugcggcucccuccagggcggcgccgccgagggccccgccgcccccgacgucgucgucguccucgaggaggaggcccucgacgacgcccucgccaaccccuacgucaugggcgucggccuccccggccaggccgcccccggcgagggcggccaggccgccuccgacgcccucggcggcuacggcuccaaggaggagcucaacugcgaggccgagggcggccucguccccgccgaccgcaagaacaccuccacccgcguccgcccccacuccggcaaggucgccggcuacguccccgagaccguccccgaggagaccggccccgaggccggcuccuccgcccccggcaucggcggcgccgccgaggaggucggcaagacccuccucucccucgagggcaagccccucgaggccucccgcgcccuccccgccaagccccgcgccuucacccucuacccccgcuccuucuccgucgagggccgcgagauccccgucuccgucuaccaggagcccgagggcuccggccucgacgaccaccgcaucaagcgcaaggaggacaaccucucccucuccugcgucaucggcuccuccggcuccuucucccagcgcaaccaccuccccuccuccggcaccuccacccccuccuccauggucgacauccccccccccuucgaccucgccugcaucaccaagaagcccaucaccaaguccucccccucccuccucaucgaguccgacucccccgacaaguacaagaagaagaaguccuccuucaagcgcuuccucgcccucaccuucaagaagaagaccgagaacaagcuccacgucgacgucaacgucuccuccucccgcuccuccuccgaguccuccuaccacggccccucccgcauccucgaggucgaccgccgcucccucuccaacuccccccagcucaagucccgcaccggcaagcuccgcgccuccgagucccccuccucccucaucuucuaccgcgacggcaagcgcaagggcguccccuucucccgcaccgucucccgcgucgaguccuucgaggaccgcucccgcccccccuuccucccccucccccucaccaagccccgcuccaucuccuuccccuccgccgacaccuccgacuacgagaacauccccgccaugaacuccgacuacgagaacauccagauccccccccgccgccccgcccgcgccggcgccuucaccaagcucuucgaggaccagucccgcgcccucuccaccgccaacgagaacgacggcuacgucgacauguccuccuucaacgccuucgaguccaagcagcaguccgccgaccaggacgccgaguccgccuacaccgagcccuacaaggucugccccaucuccuccgccgcccccaaggaggaccucaccuccgacgaggagcagcgcuccuccgaggaggaggacuccgccucccgcgaccccuccgucacccacaaggucgagggccagucccgcgcccucgucaucgcccaggagcuccucuccuccgagaaggccuacgucgagaugcuccagcaccucaaccucgacuuccacggcgccgucaugcgcgcccucgacgacauggaccacgagggccgcgacacccucgcccgcgaggagcuccgccagggccucuccgagcuccccgccauccacgaccuccaccagggcauccucgaggagcucgaggagcgccucuccaacugggagucccagcagaaggucgccgacgucuuccucgcccgcgagcagggcuucgaccaccacgccacccacauccuccaguucgaccgcuaccucggccuccucuccgagaacugccuccacuccccccgccucgccgccgccguccgcgaguucgagcaguccguccagggcggcucccagaccgccaagcaccgccuccuccgcgucguccagcgccucuuccaguaccagguccuccucaccgacuaccucaacaaccucugccccgacuccgccgaguacgacaacacccagggcgcccucucccucaucuccaaggucaccgaccgcgccaacgacuccauggagcagggcgagaaccuccagaagcucguccacaucgagcacuccguccgcggccagggcgaccuccuccagcccggccgcgaguuccucaaggagggcacccucaugaaggucaccggcaagaaccgccgcccccgccaccucuuccucaugaacgacguccuccucuacaccuacccccagaaggacggcaaguaccgccucaagaacacccucgccgucgccaacaugaaggucucccgccccgucauggagaagguccccuacgcccucaagaucgagaccuccgaguccugccucaugcucuccgccuccuccugcgccgagcgcgacgagugguacggcugccucucccgcgcccuccccgaggacuacaaggcccaggcccucgccgccuuccaccacuccgucgagauccgcgagcgccucggcgucucccucggcgagcgcccccccacccucguccccgucacccacgucaugaugugcaugaacugcggcugcgacuucucccucacccuccgccgccaccacugccacgccugcggcaagaucgucugccgcaacugcucccgcaacaaguacccccucaaguaccucaaggaccgcauggccaaggucugcgacggcugcuucggcgagcucaagaagcgcggccgcgccguccccggccucaugcgcgagcgccccgucuccauguccuucccccucuccuccccccgcuucuccggcuccgccuucuccuccgucuuccaguccaucaaccccuccaccuucaagaagcagaagaagguccccuccgcccucaccgaggucgccgccuccggcgagggcuccgccaucuccggcuaccucucccgcugcaagcgcggcaagcgccacuggaagaagcucugguucgucaucaagggcaagguccucuacaccuacauggccuccgaggacaaggucgcccucgaguccaugccccuccucggcuucaccaucgcccccgagaaggaggagggcuccuccgaggucggccccaucuuccaccucuaccacaagaagacccucuucuacuccuucaaggccgaggacaccaacuccgcccagcgcuggaucgaggccauggaggacgccuccguccucuga

SEQ ID NO: 43180 - RNA, 4293 nt, Artificial Sequence
  derived and/or modified sequence opt2 from FGD6__Homo_sapiens__NP_060821
augaccuccgccgccgagaucaagaagccccccgucgcccccaagcccaaguucgucgucgccaacaacaagcccgcccccccccccaucgcccccaagcccgacaucgucaucuccuccgucccccaguccaccaagaagaugaagcccgccaucgcccccaagcccaagguccucaagaccucccccguccgcgagaucggccagucccccucccgcaagaucaugcucaaccucgagggccacaagcaggagcucgccgaguccaccgacaacuucaacugcaaguacgagggcaaccaguccaacgacuacaucucccccaugugcuccugcuccuccgagugcauccacaagcucggccaccgcgagaaccucugcgucaagcagcucguccucgagccccucgagaugaacgagaaccucgagaacuccaagaucgacgagacccucaccaucaagacccgcuccaagugcgaccucuacggcgagaaggccaagaaccagggcggcgucguccucaaggccuccguccucgaggaggagcucaaggacgcccucauccaccagaugccccccuucaucuccgcccagaagcaccgccccaccgacucccccgagaugaacggcggcugcaacuccaacggccaguuccgcaucgaguucgccgaccucucccccucccccuccuccuucgagaagguccccgaccaccacuccugccaccuccagcuccccuccgacgagugcgagcacuucgagaccugccaggacgacuccgagaaguccaacaacugcuuccaguccuccgagcucgaggcccucgagaacggcaagcgcuccacccucaucuccuccgacggcgucuccaagaaguccgaggucaaggaccucggcccccucgagauccaccucguccccuacacccccaaguuccccacccccaagccccgcaagacccgcaccgcccgccuccuccgccagaagugcgucgacacccccuccgaguccaccgaggagcccggcaacuccgacuccuccuccuccugccucaccgagaacucccucaagaucaacaagaucuccguccuccaccagaacguccucugcaagcaggagcaggucgacaagaugaagcucggcaacaaguccgagcucaacauggaguccaacuccgacgcccaggaccucgucaacucccagaaggccaugugcaacgagaccaccuccuucgagaagauggcccccuccuucgacaaggacuccaaccucuccuccgacuccaccaccgucgacggcuccuccaugucccucgccgucgacgagggcaccggcuucauccgcugcaccgucuccaugucccuccccaagcagcucaagcucaccugcaacgagcaccuccaguccggccgcaaccucggcgucuccgccccccagaugcagaaggaguccgucaucaaggaggagaacucccuccgcaucguccccaagaagccccagcgccacucccuccccgccaccggcguccucaagaaggccgccuccgaggagcuccucgagaaguccuccuaccccuccuccgaggagaaguccuccgagaagucccucgagcgcaaccaccuccagcaccucugcgcccagaaccgcggcgucuccuccuccuucgacaugcccaagcgcgccuccgagaagcccgucuggaagcucccccaccccauccuccccuucuccggcaaccccgaguuccucaaguccgucaccgucuccuccaacuccgagcccuccaccgcccucaccaagccccgcgccaagucccucuccgccauggacgucgagaagugcaccaagcccugcaaggacuccaccaagaagaacuccuucaagaagcuccucuccaugaagcucuccaucugcuucaugaaguccgacuuccagaaguucugguccaaguccucccagcucggcgacaccaccaccggccaccucuccuccggcgagcagaagggcaucgaguccgacuggcagggccuccucgucggcgaggagaagcgcuccaagcccaucaaggccuacuccaccgagaacuacucccucgagucccagaagaagcgcaagaagucccgcggccagaccuccgccgccaacggccuccgcgccgagucccucgacgaccagaugcucucccgcgaguccuccucccaggcccccuacaaguccgucaccucccucugcgcccccgaguacgagaacauccgccacuacgaggagauccccgaguacgagaaccuccccuucaucauggccauccgcaagacccaggagcucgaguggcagaacuccuccuccauggaggacgccgacgccaacgucuacgaggucgaggagcccuacgaggcccccgacggccagcuccagcucggcccccgccaccagcacuccuccuccggcgccucccaggaggagcagaacgaccucggccucggcgaccuccccuccgacgaggaggagaucaucaacuccuccgacgaggacgacgucuccuccgaguccuccaagggcgagcccgacccccucgaggacaagcaggacgaggacaacggcaugaaguccaagguccaccacaucgccaaggagaucauguccuccgagaaggucuucgucgacguccucaagcuccuccacaucgacuuccgcgacgccgucgcccacgccucccgccagcucggcaagcccgucaucgaggaccgcauccucaaccagauccucuacuaccucccccagcucuacgagcucaaccgcgaccuccucaaggagcucgaggagcgcaugcuccacuggaccgagcagcagcgcaucgccgacaucuucgucaagaagggccccuaccucaagauguacuccaccuacaucaaggaguucgacaagaacaucgcccuccucgacgagcagugcaagaagaaccccggcuucgccgccgucguccgcgaguucgagauguccccccgcugcgccaaccucgcccucaagcacuaccuccucaagcccguccagcgcaucccccaguaccgccuccuccucaccgacuaccucaagaaccucaucgaggacgccggcgacuaccgcgacacccaggacgcccucgccgucgucaucgaggucgccaaccacgccaacgacaccaugaagcagggcgacaacuuccagaagcucaugcagauccaguacucccucaacggccaccacgagaucguccagcccggccgcgucuuccucaaggagggcauccucaugaagcucucccgcaaggucaugcagccccgcauguucuuccucuucaacgacgcccuccucuacaccacccccguccaguccggcauguacaagcucaacaacaugcucucccucgccggcaugaagguccgcaagcccacccaggaggccuaccagaacgagcucaagaucgaguccgucgagcgcuccuucauccucuccgccuccuccgccaccgagcgcgacgaguggcucgaggccaucucccgcgccaucgaggaguacgccaagaagcgcaucaccuucugccccucccgcucccucgacgaggccgacuccgagaacaaggaggaggucuccccccucggcuccaaggcccccaucuggauccccgacacccgcgccaccaugugcaugaucugcaccuccgaguucacccucaccuggcgccgccaccacugccgcgccugcggcaagaucgucugccaggccugcuccuccaacaaguacggccucgacuaccucaagaaccagcccgcccgcgucugcgagcacugcuuccaggagcuccagaagcucgaccaccagcacuccccccgcaucggcucccccggcaaccacaagucccccuccuccgcccucuccuccguccuccacuccauccccuccggccgcaagcagaagaagauccccgccgcccucaaggaggucuccgccaacaccgaggacuccuccauguccggcuaccucuaccgcuccaagggcaacaagaagcccuggaagcacuucugguucgucaucaagaacaagguccucuacaccuacgccgccuccgaggacgucgccgcccucgagucccagccccuccucggcuucaccgucauccaggucaaggacgagaacuccgaguccaaggucuuccagcuccuccacaagaacaugcucuucuacgucuucaaggccgaggacgcccacuccgcccagaaguggaucgaggccuuccaggagggcaccauccucuga

SEQ ID NO: 43181 - RNA, 627 nt, Artificial Sequence
  derived and/or modified sequence opt2 from FGF10__Homo_sapiens__XP_005248321
auguggaaguggauccucacccacugcgccuccgccuucccccaccuccccggcugcugcugcugcugcuuccuccuccucuuccucgucuccuccguccccgucaccugccaggcccucggccaggacauggucucccccgaggccaccaacuccuccuccuccuccuucuccucccccuccuccgccggccgccacguccgcuccuacaaccaccuccagggcgacguccgcuggcgcaagcucuucuccuucaccaaguacuuccucaagaucgagaagaacggcaaggucuccggcaccaagaaggagaacugccccuacuccauccucgagaucaccuccgucgagaucggcgucgucgccgucaaggccaucaacuccaacuacuaccucgccaugaacaagaagggcaagcucuacggcuccaaggaguucaacaacgacugcaagcucaaggagcgcaucgaggagaacggcuacaacaccuacgccuccuucaacuggcagcacaacggccgccagauguacgucgcccucaacggcaagggcgccccccgccgcggccagaagacccgccgcaagaacaccuccgcccacuuccuccccauggucguccacuccuga

SEQ ID NO: 43182 - RNA, 678 nt, Artificial Sequence
  derived and/or modified sequence opt2 from FGF11__Homo_sapiens__NP_004103
auggccgcccucgccuccucccucauccgccagaagcgcgagguccgcgagcccggcggcucccgccccgucuccgcccagcgccgcgucugcccccgcggcaccaagucccucugccagaagcagcuccucauccuccucuccaagguccgccucugcggcggccgccccgcccgccccgaccgcggccccgagccccagcucaagggcaucgucaccaagcucuucugccgccagggcuucuaccuccaggccaaccccgacggcuccauccagggcacccccgaggacaccuccuccuucacccacuucaaccucauccccgucggccuccgcgucgucaccauccaguccgccaagcucggccacuacauggccaugaacgccgagggccuccucuacuccuccccccacuucaccgccgagugccgcuucaaggagugcgucuucgagaacuacuacguccucuacgccuccgcccucuaccgccagcgccgcuccggccgcgccugguaccucggccucgacaaggagggccaggucaugaagggcaaccgcgucaagaagaccaaggccgccgcccacuuccuccccaagcuccucgaggucgccauguaccaggagcccucccuccacuccguccccgaggccucccccuccuccccccccgcccccuga

SEQ ID NO: 43183 - RNA, 546 nt, Artificial Sequence
  derived and/or modified sequence opt2 from FGF12__Homo_sapiens__NP_004104
auggaguccaaggagccccagcucaagggcaucgucacccgccucuucucccagcagggcuacuuccuccagaugcaccccgacggcaccaucgacggcaccaaggacgagaacuccgacuacacccucuucaaccucauccccgucggccuccgcgucgucgccauccagggcgucaaggccucccucuacgucgccaugaacggcgagggcuaccucuacuccuccgacgucuucacccccgagugcaaguucaaggaguccgucuucgagaacuacuacgucaucuacuccuccacccucuaccgccagcaggaguccggccgcgccugguuccucggccucaacaaggagggccagaucaugaagggcaaccgcgucaagaagaccaagcccuccucccacuucguccccaagcccaucgaggucugcauguaccgcgagcccucccuccacgagaucggcgagaagcagggccgcucccgcaaguccuccggcacccccaccaugaacggcggcaaggucgucaaccaggacuccaccuga

SEQ ID NO: 43184 - RNA, 600 nt, Artificial Sequence
  derived and/or modified sequence opt2 from FGF13__Homo_sapiens__NP_001132970
auguccggcaaggucaccaagcccaaggaggagaaggacgccuccaaggagccccagcucaagggcaucgucaccaagcucuacucccgccagggcuaccaccuccagcuccaggccgacggcaccaucgacggcaccaaggacgaggacuccaccuacacccucuucaaccucauccccgucggccuccgcgucgucgccauccagggcguccagaccaagcucuaccucgccaugaacuccgagggcuaccucuacaccuccgagcucuucacccccgagugcaaguucaaggaguccgucuucgagaacuacuacgucaccuacuccuccaugaucuaccgccagcagcaguccggccgcggcugguaccucggccucaacaaggagggcgagaucaugaagggcaaccacgucaagaagaacaagcccgccgcccacuuccuccccaagccccucaaggucgccauguacaaggagcccucccuccacgaccucaccgaguucucccgcuccggcuccggcacccccaccaagucccgcuccgucuccggcguccucaacggcggcaaguccaugucccacaacgaguccaccuga

SEQ ID NO: 43185 - RNA, 744 nt, Artificial Sequence
  derived and/or modified sequence opt2 from FGF14__Homo_sapiens__NP_004106
auggccgccgccaucgccuccggccucauccgccagaagcgccaggcccgcgagcagcacugggaccgccccuccgccucccgccgccgcuccucccccuccaagaaccgcggccucugcaacggcaaccucgucgacaucuucuccaagguccgcaucuucggccucaagaagcgccgccuccgccgccaggacccccagcucaagggcaucgucacccgccucuacugccgccagggcuacuaccuccagaugcaccccgacggcgcccucgacggcaccaaggacgacuccaccaacuccacccucuucaaccucauccccgucggccuccgcgucgucgccauccagggcgucaagaccggccucuacaucgccaugaacggcgagggcuaccucuaccccuccgagcucuucacccccgagugcaaguucaaggaguccgucuucgagaacuacuacgucaucuacuccuccaugcucuaccgccagcaggaguccggccgcgccugguuccucggccucaacaaggagggccaggccaugaagggcaaccgcgucaagaagaccaagcccgccgcccacuuccuccccaagccccucgaggucgccauguaccgcgagcccucccuccacgacgucggcgagaccguccccaagcccggcgucacccccuccaaguccaccuccgccuccgccaucaugaacggcggcaagcccgucaacaaguccaagaccaccuga

SEQ ID NO: 43186 - RNA, 624 nt, Artificial Sequence
  derived and/or modified sequence opt2 from FGF16__Homo_sapiens__NP_003859
auggccgaggucggcggcgucuucgccucccucgacugggaccuccacggcuucuccuccucccucggcaacgucccccucgccgacucccccggcuuccucaacgagcgccucggccagaucgagggcaagcuccagcgcggcucccccaccgacuucgcccaccucaagggcauccuccgccgccgccagcucuacugccgcaccggcuuccaccucgagaucuuccccaacggcaccguccacggcacccgccacgaccacucccgcuucggcauccucgaguucaucucccucgccgucggccucaucuccauccgcggcgucgacuccggccucuaccucggcaugaacgagcgcggcgagcucuacggcuccaagaagcucacccgcgagugcgucuuccgcgagcaguucgaggagaacugguacaacaccuacgccuccacccucuacaagcacuccgacuccgagcgccaguacuacgucgcccucaacaaggacggcuccccccgcgagggcuaccgcaccaagcgccaccagaaguucacccacuuccucccccgccccgucgaccccuccaagcuccccuccaugucccgcgaccucuuccacuaccgcuga

SEQ ID NO: 43187 - RNA, 618 nt, Artificial Sequence
  derived and/or modified sequence opt2 from FGF17__Homo_sapiens__NP_001291407
augggcgccgcccgccuccuccccaaccucacccucugccuccagcuccucauccucugcugccagacccaguacguccgcgaccagggcgccaugaccgaccagcucucccgccgccagauccgcgaguaccagcucuacucccgcaccuccggcaagcacguccaggucaccggccgccgcaucuccgccaccgccgaggacggcaacaaguucgccaagcucaucgucgagaccgacaccuucggcucccgcguccgcaucaagggcgccgaguccgagaaguacaucugcaugaacaagcgcggcaagcucaucggcaagcccuccggcaaguccaaggacugcgucuucaccgagaucguccucgagaacaacuacaccgccuuccagaacgcccgccacgagggcugguucauggccuucacccgccagggccgcccccgccaggccucccgcucccgccagaaccagcgcgaggcccacuucaucaagcgccucuaccagggccagcuccccuuccccaaccacgccgagaagcagaagcaguucgaguucgucggcuccgcccccacccgccgcaccaagcgcacccgccgcccccagccccucaccuga

SEQ ID NO: 43188 - RNA, 624 nt, Artificial Sequence
  derived and/or modified sequence opt2 from FGF18__Homo_sapiens__NP_003853
auguacuccgcccccuccgccugcaccugccucugccuccacuuccuccuccucugcuuccagguccagguccucgucgccgaggagaacgucgacuuccgcauccacgucgagaaccagacccgcgcccgcgacgacgucucccgcaagcagcuccgccucuaccagcucuacucccgcaccuccggcaagcacauccagguccucggccgccgcaucuccgcccgcggcgaggacggcgacaaguacgcccagcuccucgucgagaccgacaccuucggcucccagguccgcaucaagggcaaggagaccgaguucuaccucugcaugaaccgcaagggcaagcucgucggcaagcccgacggcaccuccaaggagugcgucuucaucgagaagguccucgagaacaacuacaccgcccucauguccgccaaguacuccggcugguacgucggcuucaccaagaagggccgcccccgcaagggccccaagacccgcgagaaccagcaggacguccacuucaugaagcgcuaccccaagggccagcccgagcuccagaagcccuucaaguacaccaccgucaccaagcgcucccgccgcauccgccccacccaccccgccuga

SEQ ID NO: 43189 - RNA, 651 nt, Artificial Sequence
  derived and/or modified sequence opt2 from FGF19__Homo_sapiens__NP_005108
augcgcuccggcugcgucgucguccacgucuggauccucgccggccucuggcucgccgucgccggccgcccccucgccuucuccgacgccggcccccacguccacuacggcuggggcgaccccauccgccuccgccaccucuacaccuccggcccccacggccucuccuccugcuuccuccgcauccgcgccgacggcgucgucgacugcgcccgcggccaguccgcccacucccuccucgagaucaaggccgucgcccuccgcaccgucgccaucaagggcguccacuccguccgcuaccucugcaugggcgccgacggcaagaugcagggccuccuccaguacuccgaggaggacugcgccuucgaggaggagauccgccccgacggcuacaacgucuaccgcuccgagaagcaccgccuccccgucucccucuccuccgccaagcagcgccagcucuacaagaaccgcggcuuccucccccucucccacuuccuccccaugcuccccaugguccccgaggagcccgaggaccuccgcggccaccucgaguccgacauguucuccuccccccucgagaccgacuccauggaccccuucggccucgucaccggccucgaggccguccgcucccccuccuucgagaaguga

SEQ ID NO: 43190 - RNA, 468 nt, Artificial Sequence
  derived and/or modified sequence opt2 from FGF1__Homo_sapiens__NP_001244139
auggccgagggcgagaucaccaccuucaccgcccucaccgagaaguucaaccucccccccggcaacuacaagaagcccaagcuccucuacugcuccaacggcggccacuuccuccgcauccuccccgacggcaccgucgacggcacccgcgaccgcuccgaccagcacauccagcuccagcucuccgccgaguccgucggcgaggucuacaucaaguccaccgagaccggccaguaccucgccauggacaccgacggccuccucuacggcucccagacccccaacgaggagugccucuuccucgagcgccucgaggagaaccacuacaacaccuacaucuccaagaagcacgccgagaagaacugguucgucggccucaagaagaacggcuccugcaagcgcggcccccgcacccacuacggccagaaggccauccucuuccucccccuccccgucuccuccgacuga

SEQ ID NO: 43191 - RNA, 636 nt, Artificial Sequence
  derived and/or modified sequence opt2 from FGF20__Homo_sapiens__NP_062825
auggccccccucgccgaggucggcggcuuccucggcggccucgagggccucggccagcaggucggcucccacuuccuccucccccccgccggcgagcgccccccccuccucggcgagcgccgcuccgccgccgagcgcuccgcccgcggcggccccggcgccgcccagcucgcccaccuccacggcauccuccgccgccgccagcucuacugccgcaccggcuuccaccuccagauccuccccgacggcuccguccagggcacccgccaggaccacucccucuucggcauccucgaguucaucuccgucgccgucggccucgucuccauccgcggcgucgacuccggccucuaccucggcaugaacgacaagggcgagcucuacggcuccgagaagcucaccuccgagugcaucuuccgcgagcaguucgaggagaacugguacaacaccuacuccuccaacaucuacaagcacggcgacaccggccgccgcuacuucgucgcccucaacaaggacggcaccccccgcgacggcgcccgcuccaagcgccaccagaaguucacccacuuccucccccgccccgucgaccccgagcgcguccccgagcucuacaaggaccuccucauguacaccuga

SEQ ID NO: 43192 - RNA, 630 nt, Artificial Sequence
  derived and/or modified sequence opt2 from FGF21__Homo_sapiens__XP_005258788
auggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccuga

SEQ ID NO: 43193 - RNA, 756 nt, Artificial Sequence
  derived and/or modified sequence opt2 from FGF23__Homo_sapiens__NP_065689
augcucggcgcccgccuccgccucugggucugcgcccucugcuccgucugcuccauguccguccuccgcgccuaccccaacgccuccccccuccucggcuccuccuggggcggccucauccaccucuacaccgccaccgcccgcaacuccuaccaccuccagauccacaagaacggccacgucgacggcgccccccaccagaccaucuacuccgcccucaugauccgcuccgaggacgccggcuucgucgucaucaccggcgucaugucccgccgcuaccucugcauggacuuccgcggcaacaucuucggcucccacuacuucgaccccgagaacugccgcuuccagcaccagacccucgagaacggcuacgacgucuaccacuccccccaguaccacuuccucgucucccucggccgcgccaagcgcgccuuccuccccggcaugaaccccccccccuacucccaguuccucucccgccgcaacgagaucccccucauccacuucaacacccccaucccccgccgccacacccgcuccgccgaggacgacuccgagcgcgacccccucaacguccucaagccccgcgcccgcaugacccccgcccccgccuccugcucccaggagcuccccuccgccgaggacaacucccccauggccuccgacccccucggcgucguccgcggcggccgcgucaacacccacgccggcggcaccggccccgagggcugccgccccuucgccaaguucaucuga

SEQ ID NO: 43194 - RNA, 867 nt, Artificial Sequence
  derived and/or modified sequence opt2 from FGF2__Homo_sapiens__NP_001997
auggucggcgucggcggcggcgacgucgaggacgucaccccccgccccggcggcugccagaucuccggccgcggcgcccgcggcugcaacggcauccccggcgccgccgccugggaggccgcccucccccgccgccgcccccgccgccaccccuccgucaacccccgcucccgcgccgccggcuccccccgcacccgcggccgccgcaccgaggagcgccccuccggcucccgccucggcgaccgcggccgcggccgcgcccuccccggcggccgccucggcggccgcggccgcggccgcgcccccgagcgcgucggcggccgcggccgcggccgcggcaccgccgccccccgcgccgcccccgccgcccgcggcucccgccccggccccgccggcaccauggccgccggcuccaucaccacccuccccgcccuccccgaggacggcggcuccggcgccuucccccccggccacuucaaggaccccaagcgccucuacugcaagaacggcggcuucuuccuccgcauccaccccgacggccgcgucgacggcguccgcgagaaguccgacccccacaucaagcuccagcuccaggccgaggagcgcggcgucgucuccaucaagggcgucugcgccaaccgcuaccucgccaugaaggaggacggccgccuccucgccuccaagugcgucaccgacgagugcuucuucuucgagcgccucgaguccaacaacuacaacaccuaccgcucccgcaaguacaccuccugguacgucgcccucaagcgcaccggccaguacaagcucggcuccaagaccggccccggccagaaggccauccucuuccuccccauguccgccaaguccuga

SEQ ID NO: 43195 - RNA, 720 nt, Artificial Sequence
  derived and/or modified sequence opt2 from FGF3__Homo_sapiens__NP_005238
augggccucaucuggcuccuccuccucucccuccucgagcccggcuggcccgccgccggccccggcgcccgccuccgccgcgacgccggcggccgcggcggcgucuacgagcaccucggcggcgccccccgccgccgcaagcucuacugcgccaccaaguaccaccuccagcuccaccccuccggccgcgucaacggcucccucgagaacuccgccuacuccauccucgagaucaccgccgucgaggucggcaucgucgccauccgcggccucuucuccggccgcuaccucgccaugaacaagcgcggccgccucuacgccuccgagcacuacuccgccgagugcgaguucgucgagcgcauccacgagcucggcuacaacaccuacgccucccgccucuaccgcaccgucuccuccacccccggcgcccgccgccagcccuccgccgagcgccucugguacgucuccgucaacggcaagggccgcccccgccgcggcuucaagacccgccgcacccagaaguccucccucuuccucccccgcguccucgaccaccgcgaccacgagaugguccgccagcuccaguccggccucccccgcccccccggcaagggcguccagccccgccgccgccgccagaagcagucccccgacaaccucgagcccucccacguccaggccucccgccucggcucccagcucgaggccuccgcccacuga

SEQ ID NO: 43196 - RNA, 621 nt, Artificial Sequence
  derived and/or modified sequence opt2 from FGF4__Homo_sapiens__XP_006718538
auguccggccccggcaccgccgccgucgcccuccuccccgccguccuccucgcccuccucgcccccugggccggccgcggcggcgccgccgcccccaccgcccccaacggcacccucgaggccgagcucgagcgccgcugggagucccucgucgcccucucccucgcccgccuccccgucgccgcccagcccaaggaggccgccguccaguccggcgccggcgacuaccuccucggcaucaagcgccuccgccgccucuacugcaacgucggcaucggcuuccaccuccaggcccuccccgacggccgcaucggcggcgcccacgccgacacccgcgacucccuccucgagcucucccccgucgagcgcggcgucgucuccaucuucggcgucgccucccgcuucuucgucgccauguccuccaagggcaagcucuacggcucccccuucuucaccgacgagugcaccuucaaggagauccuccuccccaacaacuacaacgccuacgaguccuacaaguaccccggcauguucaucgcccucuccaagaacggcaagaccaagaagggcaaccgcgucucccccaccaugaaggucacccacuuccucccccgccucuga

SEQ ID NO: 43197 - RNA, 807 nt, Artificial Sequence
  derived and/or modified sequence opt2 from FGF5__Homo_sapiens__NP_004455
augucccucuccuuccuccuccuccucuucuucucccaccucauccucuccgccugggcccacggcgagaagcgccucgcccccaagggccagcccggccccgccgccaccgaccgcaacccccgcggcuccuccucccgccaguccuccuccuccgccauguccuccuccuccgccuccuccucccccgccgccucccucggcucccagggcuccggccucgagcaguccuccuuccaguggucccccuccggccgccgcaccggcucccucuacugccgcgucggcaucggcuuccaccuccagaucuaccccgacggcaaggucaacggcucccacgaggccaacaugcucuccguccucgagaucuucgccgucucccagggcaucgucggcauccgcggcgucuucuccaacaaguuccucgccauguccaagaagggcaagcuccacgccuccgccaaguucaccgacgacugcaaguuccgcgagcgcuuccaggagaacuccuacaacaccuacgccuccgccauccaccgcaccgagaagaccggccgcgagugguacgucgcccucaacaagcgcggcaaggccaagcgcggcugcuccccccgcgucaagccccagcacaucuccacccacuuccucccccgcuucaagcaguccgagcagcccgagcucuccuucaccgucaccguccccgagaagaagaagccccccucccccaucaagcccaagaucccccucuccgccccccgcaagaacaccaacuccgucaaguaccgccucaaguuccgcuucggcuga

SEQ ID NO: 43198 - RNA, 627 nt, Artificial Sequence
  derived and/or modified sequence opt2 from FGF6__Homo_sapiens__NP_066276
auggcccucggccagaagcucuucaucaccaugucccgcggcgccggccgccuccagggcacccucugggcccucgucuuccucggcauccucgucggcauggucguccccucccccgccggcacccgcgccaacaacacccuccucgacucccgcggcuggggcacccuccucucccgcucccgcgccggccucgccggcgagaucgccggcgucaacugggaguccggcuaccucgucggcaucaagcgccagcgccgccucuacugcaacgucggcaucggcuuccaccuccagguccuccccgacggccgcaucuccggcacccacgaggagaaccccuacucccuccucgagaucuccaccgucgagcgcggcgucgucucccucuucggcguccgcuccgcccucuucgucgccaugaacuccaagggccgccucuacgccacccccuccuuccaggaggagugcaaguuccgcgagacccuccuccccaacaacuacaacgccuacgaguccgaccucuaccagggcaccuacaucgcccucuccaaguacggccgcgucaagcgcggcuccaaggucucccccaucaugaccgucacccacuuccucccccgcaucuga

SEQ ID NO: 43199 - RNA, 585 nt, Artificial Sequence
  derived and/or modified sequence opt2 from FGF7__Homo_sapiens__NP_002000
augcacaaguggauccucaccuggauccuccccacccuccucuaccgcuccugcuuccacaucaucugccucgucggcaccaucucccucgccugcaacgacaugacccccgagcagauggccaccaacgucaacugcuccucccccgagcgccacacccgcuccuacgacuacauggagggcggcgacauccgcguccgccgccucuucugccgcacccagugguaccuccgcaucgacaagcgcggcaaggucaagggcacccaggagaugaagaacaacuacaacaucauggagauccgcaccgucgccgucggcaucgucgccaucaagggcgucgaguccgaguucuaccucgccaugaacaaggagggcaagcucuacgccaagaaggagugcaacgaggacugcaacuucaaggagcucauccucgagaaccacuacaacaccuacgccuccgccaaguggacccacaacggcggcgagauguucgucgcccucaaccagaagggcauccccguccgcggcaagaagaccaagaaggagcagaagaccgcccacuuccuccccauggccaucaccuga

SEQ ID NO: 43200 - RNA, 648 nt, Artificial Sequence
  derived and/or modified sequence opt2 from FGF8__Homo_sapiens__NP_006110
augggcuccccccgcuccgcccucuccugccuccuccuccaccuccucguccucugccuccaggcccaggucaccguccaguccucccccaacuucacccagcacguccgcgagcagucccucgucaccgaccagcucucccgccgccucauccgcaccuaccagcucuacucccgcaccuccggcaagcacguccagguccucgccaacaagcgcaucaacgccauggccgaggacggcgaccccuucgccaagcucaucgucgagaccgacaccuucggcucccgcguccgcguccgcggcgccgagaccggccucuacaucugcaugaacaagaagggcaagcucaucgccaaguccaacggcaagggcaaggacugcgucuucaccgagaucguccucgagaacaacuacaccgcccuccagaacgccaaguacgagggcugguacauggccuucacccgcaagggccgcccccgcaagggcuccaagacccgccagcaccagcgcgagguccacuucaugaagcgccucccccgcggccaccacaccaccgagcagucccuccgcuucgaguuccucaacuacccccccuucacccgcucccuccgcggcucccagcgcaccugggcccccgagccccgcuga

SEQ ID NO: 43201 - RNA, 627 nt, Artificial Sequence
  derived and/or modified sequence opt2 from FGF9__Homo_sapiens__NP_002001
auggccccccucggcgaggucggcaacuacuucggcguccaggacgccguccccuucggcaacguccccguccuccccgucgacucccccguccuccucuccgaccaccucggccaguccgaggccggcggccucccccgcggccccgccgucaccgaccucgaccaccucaagggcauccuccgccgccgccagcucuacugccgcaccggcuuccaccucgagaucuuccccaacggcaccauccagggcacccgcaaggaccacucccgcuucggcauccucgaguucaucuccaucgccgucggccucgucuccauccgcggcgucgacuccggccucuaccucggcaugaacgagaagggcgagcucuacggcuccgagaagcucacccaggagugcgucuuccgcgagcaguucgaggagaacugguacaacaccuacuccuccaaccucuacaagcacgucgacaccggccgccgcuacuacgucgcccucaacaaggacggcaccccccgcgagggcacccgcaccaagcgccaccagaaguucacccacuuccucccccgccccgucgaccccgacaagguccccgagcucuacaaggacauccucucccaguccuga

SEQ ID NO: 43202 - RNA, 705 nt, Artificial Sequence
  derived and/or modified sequence opt2 from FGFBP1__Homo_sapiens__NP_005121
augaagaucugcucccucacccuccucuccuuccuccuccucgccgcccagguccuccucgucgagggcaagaagaaggucaagaacggccuccacuccaaggucgucuccgagcagaaggacacccucggcaacacccagaucaagcagaagucccgccccggcaacaagggcaaguucgucaccaaggaccaggccaacugccgcugggccgccaccgagcaggaggagggcaucucccucaaggucgagugcacccagcucgaccacgaguucuccugcgucuucgccggcaaccccaccuccugccucaagcucaaggacgagcgcgucuacuggaagcaggucgcccgcaaccuccgcucccagaaggacaucugccgcuacuccaagaccgccgucaagacccgcgucugccgcaaggacuuccccgaguccucccucaagcucgucuccuccacccucuucggcaacaccaagccccgcaaggagaagaccgagauguccccccgcgagcacaucaagggcaaggagaccacccccuccucccucgccgucacccagaccauggccaccaaggcccccgagugcgucgaggaccccgacauggccaaccagcgcaagaccgcccucgaguucugcggcgagaccugguccucccucugcaccuucuuccucuccaucguccaggacaccuccugcuga

SEQ ID NO: 43203 - RNA, 672 nt, Artificial Sequence
  derived and/or modified sequence opt2 from FGFBP2__Homo_sapiens__NP_114156
augaaguucguccccugccuccuccucgucacccucuccugccucggcacccucggccaggccccccgccagaagcagggcuccaccggcgaggaguuccacuuccagaccggcggccgcgacuccugcaccaugcgccccuccucccucggccagggcgccggcgaggucuggcuccgcgucgacugccgcaacaccgaccagaccuacuggugcgaguaccgcggccagcccuccaugugccaggccuucgccgccgaccccaagcccuacuggaaccaggcccuccaggagcuccgccgccuccaccacgccugccagggcgcccccguccuccgccccuccgucugccgcgaggccggcccccaggcccacaugcagcaggucaccuccucccucaagggcucccccgagcccaaccagcagcccgaggccggcacccccucccuccgccccaaggccaccgucaagcucaccgaggccacccagcucggcaaggacuccauggaggagcucggcaaggccaagcccaccacccgccccaccgccaagcccacccagcccggcccccgccccggcggcaacgaggaggccaagaagaaggccugggagcacugcuggaagcccuuccaggcccucugcgccuuccucaucuccuucuuccgcggcuga

SEQ ID NO: 43204 - RNA, 777 nt, Artificial Sequence
  derived and/or modified sequence opt2 from FGFBP3__Homo_sapiens__NP_689642
augaccccccccaagcuccgcgccucccucucccccucccuccuccuccuccucuccggcugccuccucgccgccgcccgccgcgagaagggcgccgccuccaacgucgccgagcccguccccggccccaccggcggcuccuccggccgcuuccucucccccgagcagcacgccugcuccuggcagcuccuccuccccgcccccgaggccgccgccggcuccgagcucgcccuccgcugccagucccccgacggcgcccgccaccagugcgccuaccgcggccaccccgagcgcugcgccgccuacgccgcccgccgcgcccacuucuggaagcagguccucggcggccuccgcaagaagcgccgccccugccacgaccccgccccccuccaggcccgccucugcgccggcaagaagggccacggcgccgagcuccgccucgucccccgcgccuccccccccgcccgccccaccgucgccggcuucgccggcgaguccaagccccgcgcccgcaaccgcggccgcacccgcgagcgcgccuccggccccgccgccggcaccccccccccccaguccgccccccccaaggagaaccccuccgagcgcaagaccaacgagggcaagcgcaaggccgcccucguccccaacgaggagcgccccaugggcaccggccccgaccccgacggccucgacggcaacgccgagcucaccgagaccuacugcgccgagaaguggcacucccucugcaacuucuucgucaacuucuggaacggcuga

SEQ ID NO: 43205 - RNA, 2439 nt, Artificial Sequence
  derived and/or modified sequence opt2 from FGFR1__Homo_sapiens__NP_001167535
auggccgccgucacccgcgacuucggcgagaugcuccuccacuccggccgcguccuccccgccgaggcccagcccuggggcgcccccgucgaggucgaguccuuccucguccaccccggcgaccuccuccagcuccgcugccgccuccgcgacgacguccaguccaucaacuggcuccgcgacggcguccagcucgccgaguccaaccgcacccgcaucaccggcgaggaggucgagguccaggacuccguccccgccgacuccggccucuacgccugcgucaccuccucccccuccggcuccgacaccaccuacuucuccgucaacgucuccgacgcccuccccuccuccgaggacgacgacgacgacgacgacuccuccuccgaggagaaggagaccgacaacaccaagcccaaccgcaugcccgucgcccccuacuggaccucccccgagaagauggagaagaagcuccacgccguccccgccgccaagaccgucaaguucaagugccccuccuccggcacccccaaccccacccuccgcuggcucaagaacggcaaggaguucaagcccgaccaccgcaucggcggcuacaagguccgcuacgccaccugguccaucaucauggacuccgucguccccuccgacaagggcaacuacaccugcaucgucgagaacgaguacggcuccaucaaccacaccuaccagcucgacgucgucgagcgcuccccccaccgccccauccuccaggccggccuccccgccaacaagaccgucgcccucggcuccaacgucgaguucaugugcaaggucuacuccgacccccagccccacauccaguggcucaagcacaucgaggucaacggcuccaagaucggccccgacaaccuccccuacguccagauccucaagaccgccggcgucaacaccaccgacaaggagauggagguccuccaccuccgcaacgucuccuucgaggacgccggcgaguacaccugccucgccggcaacuccaucggccucucccaccacuccgccuggcucaccguccucgaggcccucgaggagcgccccgccgucaugaccuccccccucuaccucgagaucaucaucuacugcaccggcgccuuccucaucuccugcauggucggcuccgucaucgucuacaagaugaaguccggcaccaagaaguccgacuuccacucccagauggccguccacaagcucgccaaguccaucccccuccgccgccaggucuccgccgacuccuccgccuccaugaacuccggcguccuccucguccgccccucccgccucuccuccuccggcacccccaugcucgccggcgucuccgaguacgagcuccccgaggacccccgcugggagcucccccgcgaccgccucguccucggcaagccccucggcgagggcugcuucggccaggucguccucgccgaggccaucggccucgacaaggacaagcccaaccgcgucaccaaggucgccgucaagaugcucaaguccgacgccaccgagaaggaccucuccgaccucaucuccgagauggagaugaugaagaugaucggcaagcacaagaacaucaucaaccuccucggcgccugcacccaggacggcccccucuacgucaucgucgaguacgccuccaagggcaaccuccgcgaguaccuccaggcccgccgcccccccggccucgaguacugcuacaaccccucccacaaccccgaggagcagcucuccuccaaggaccucgucuccugcgccuaccaggucgcccgcggcauggaguaccucgccuccaagaagugcauccaccgcgaccucgccgcccgcaacguccucgucaccgaggacaacgucaugaagaucgccgacuucggccucgcccgcgacauccaccacaucgacuacuacaagaagaccaccaacggccgccuccccgucaaguggauggcccccgaggcccucuucgaccgcaucuacacccaccaguccgacgucugguccuucggcguccuccucugggagaucuucacccucggcggcucccccuaccccggcguccccgucgaggagcucuucaagcuccucaaggagggccaccgcauggacaagcccuccaacugcaccaacgagcucuacaugaugaugcgcgacugcuggcacgccguccccucccagcgccccaccuucaagcagcucgucgaggaccucgaccgcaucgucgcccucaccuccaaccaggaguaccucgaccucuccaugccccucgaccaguacucccccuccuuccccgacacccgcuccuccaccugcuccuccggcgaggacuccgucuucucccacgagccccuccccgaggagcccugccucccccgccaccccgcccagcucgccaacggcggccucaagcgccgcuga

SEQ ID NO: 43206 - RNA, 648 nt, Artificial Sequence
  derived and/or modified sequence opt2 from FGFR1OP2__Homo_sapiens__NP_001165358
auguccugcaccaucgagaaggcccucgccgacgccaaggcccucgucgagcgccuccgcgaccacgacgacgccgccgagucccucaucgagcagaccaccgcccucaacaagcgcgucgaggccaugaagcaguaccaggaggagauccaggagcucaacgaggucgcccgccaccgcccccgcuccacccucgucaugggcauccagcaggagaaccgccagauccgcgagcuccagcaggagaacaaggagcuccgcaccucccucgaggagcaccaguccgcccucgagcucaucauguccaaguaccgcgagcagauguuccgccuccucauggccuccaagaaggacgaccccggcaucaucaugaagcucaaggagcagcacuccaaggagcuccaggcccacgucgaccagaucaccgagauggccgccgucaugcgcaaggccaucgagaucgacgagcagcagggcugcaaggagcaggagcgcaucuuccagcucgagcaggagaacaagggccuccgcgagauccuccagaucacccgcgaguccuuccucaaccuccgcaaggacgacgccuccgaguccaccucccucuccgcccucgucaccaacuccgaccucucccuccgcaaguccuga

SEQ ID NO: 43207 - RNA, 1056 nt, Artificial Sequence
  derived and/or modified sequence opt2 from FGFR1OP__Homo_sapiens__NP_001265619
auggccgccaccgccgccgccgucgucgccgaggaggacaccgagcuccgcgaccuccucguccagacccucgagaacuccggcguccucaaccgcaucaaggccgagcuccgcgccgccgucuuccucgcccucgaggagcaggagaaggucgagaacaagaccccccucgucaacgagucccucaagaaguuccucaacaccaaggacggccgccucgucgccucccucgucgccgaguuccuccaguucuucaaccucgacuucacccucgccgucuuccagcccgagaccuccacccuccagggccucgagggccgcgagaaccucgcccgcgaccucggcaucaucgaggccgagggcaccgucggcggcccccuccuccucgaggucauccgccgcugccagcagaaggagaagggccccaccaccggcgagaaggccaacgacgaggccaaccaguccgacaccuccgucucccucuccgagcccaaguccaaguccucccuccaccuccucucccacgagaccaagaucggcuccuuccucuccaaccgcacccucgacggcaaggacaaggccggccucugccccgacgaggacgacauggagggcgacuccuucuucgacgaccccauccccaagcccgagaagaccuacggccuccgcaaggagccccgcaagcaggccggcucccucgccucccucuccgacgcccccccccucaaguccggccucuccucccucgccggcgcccccucccucaaggacuccgaguccaagcgcggcaacaccguccucaaggaccucaagcucaucuccgacaagaucggcucccucggccucggcaccggcgaggacgacgacuacgucgacgacuucaacuccaccucccaccgcuccgagaaguccgagaucuccaucggcgaggagaucgaggaggaccucuccgucgagaucgacgacaucaacaccuccgacaagaccaucacccagcucgagugccuccucuccaucggcgcccuccacuucaagaacaccgccgacaucuucuga

SEQ ID NO: 43208 - RNA, 2466 nt, Artificial Sequence
  derived and/or modified sequence opt2 from FGFR2__Homo_sapiens__NP_000132
auggucuccuggggccgcuucaucugccucgucgucgucaccauggccacccucucccucgcccgccccuccuucucccucgucgaggacaccacccucgagcccgaggagccccccaccaaguaccagaucucccagcccgaggucuacgucgccgcccccggcgagucccucgagguccgcugccuccucaaggacgccgccgucaucuccuggaccaaggacggcguccaccucggccccaacaaccgcaccguccucaucggcgaguaccuccagaucaagggcgccaccccccgcgacuccggccucuacgccugcaccgccucccgcaccgucgacuccgagaccugguacuucauggucaacgucaccgacgccaucuccuccggcgacgacgaggacgacaccgacggcgccgaggacuucgucuccgagaacuccaacaacaagcgcgcccccuacuggaccaacaccgagaagauggagaagcgccuccacgccguccccgccgccaacaccgucaaguuccgcugccccgccggcggcaaccccaugcccaccaugcgcuggcucaagaacggcaaggaguucaagcaggagcaccgcaucggcggcuacaagguccgcaaccagcacuggucccucaucauggaguccgucguccccuccgacaagggcaacuacaccugcgucgucgagaacgaguacggcuccaucaaccacaccuaccaccucgacgucgucgagcgcuccccccaccgccccauccuccaggccggccuccccgccaacgccuccaccgucgucggcggcgacgucgaguucgucugcaaggucuacuccgacgcccagccccacauccaguggaucaagcacgucgagaagaacggcuccaaguacggccccgacggccuccccuaccucaagguccucaaggccgccggcgucaacaccaccgacaaggagaucgagguccucuacauccgcaacgucaccuucgaggacgccggcgaguacaccugccucgccggcaacuccaucggcaucuccuuccacuccgccuggcucaccguccuccccgcccccggccgcgagaaggagaucaccgccucccccgacuaccucgagaucgccaucuacugcaucggcgucuuccucaucgccugcauggucgucaccgucauccucugccgcaugaagaacaccaccaagaagcccgacuucuccucccagcccgccguccacaagcucaccaagcgcaucccccuccgccgccaggucaccgucuccgccgaguccuccuccuccaugaacuccaacaccccccucguccgcaucaccacccgccucuccuccaccgccgacacccccaugcucgccggcgucuccgaguacgagcuccccgaggaccccaagugggaguucccccgcgacaagcucacccucggcaagccccucggcgagggcugcuucggccaggucgucauggccgaggccgucggcaucgacaaggacaagcccaaggaggccgucaccgucgccgucaagaugcucaaggacgacgccaccgagaaggaccucuccgaccucgucuccgagauggagaugaugaagaugaucggcaagcacaagaacaucaucaaccuccucggcgccugcacccaggacggcccccucuacgucaucgucgaguacgccuccaagggcaaccuccgcgaguaccuccgcgcccgccgcccccccggcauggaguacuccuacgacaucaaccgcguccccgaggagcagaugaccuucaaggaccucgucuccugcaccuaccagcucgcccgcggcauggaguaccucgccucccagaagugcauccaccgcgaccucgccgcccgcaacguccucgucaccgagaacaacgucaugaagaucgccgacuucggccucgcccgcgacaucaacaacaucgacuacuacaagaagaccaccaacggccgccuccccgucaaguggauggcccccgaggcccucuucgaccgcgucuacacccaccaguccgacgucugguccuucggcguccucaugugggagaucuucacccucggcggcucccccuaccccggcauccccgucgaggagcucuucaagcuccucaaggagggccaccgcauggacaagcccgccaacugcaccaacgagcucuacaugaugaugcgcgacugcuggcacgccguccccucccagcgccccaccuucaagcagcucgucgaggaccucgaccgcauccucacccucaccaccaacgaggaguaccucgaccucucccagccccucgagcaguacucccccuccuaccccgacacccgcuccuccugcuccuccggcgacgacuccgucuucucccccgaccccaugcccuacgagcccugccucccccaguacccccacaucaacggcuccgucaagaccuga

SEQ ID NO: 43209 - RNA, 2421 nt, Artificial Sequence
  derived and/or modified sequence opt2 from FGFR3__Homo_sapiens__NP_000133
augggcgcccccgccugcgcccucgcccucugcgucgccgucgccaucgucgccggcgccuccuccgagucccucggcaccgagcagcgcgucgucggccgcgccgccgagguccccggccccgagcccggccagcaggagcagcucgucuucggcuccggcgacgccgucgagcucuccugccccccccccggcggcggccccaugggccccaccgucugggucaaggacggcaccggccucguccccuccgagcgcguccucgucggcccccagcgccuccagguccucaacgccucccacgaggacuccggcgccuacuccugccgccagcgccucacccagcgcguccucugccacuucuccguccgcgucaccgacgcccccuccuccggcgacgacgaggacggcgaggacgaggccgaggacaccggcgucgacaccggcgcccccuacuggacccgccccgagcgcauggacaagaagcuccucgccguccccgccgccaacaccguccgcuuccgcugccccgccgccggcaaccccacccccuccaucuccuggcucaagaacggccgcgaguuccgcggcgagcaccgcaucggcggcaucaagcuccgccaccagcaguggucccucgucauggaguccgucguccccuccgaccgcggcaacuacaccugcgucgucgagaacaaguucggcuccauccgccagaccuacacccucgacguccucgagcgcuccccccaccgccccauccuccaggccggccuccccgccaaccagaccgccguccucggcuccgacgucgaguuccacugcaaggucuacuccgacgcccagccccacauccaguggcucaagcacgucgaggucaacggcuccaaggucggccccgacggcacccccuacgucaccguccucaagaccgccggcgccaacaccaccgacaaggagcucgagguccucucccuccacaacgucaccuucgaggacgccggcgaguacaccugccucgccggcaacuccaucggcuucucccaccacuccgccuggcucgucguccuccccgccgaggaggagcucgucgaggccgacgaggccggcuccgucuacgccggcauccucuccuacggcgucggcuucuuccucuucauccucgucgucgccgccgucacccucugccgccuccgcuccccccccaagaagggccucggcucccccaccguccacaagaucucccgcuucccccucaagcgccaggucucccucgaguccaacgccuccauguccuccaacaccccccucguccgcaucgcccgccucuccuccggcgagggccccacccucgccaacgucuccgagcucgagcuccccgccgaccccaagugggagcucucccgcgcccgccucacccucggcaagccccucggcgagggcugcuucggccaggucgucauggccgaggccaucggcaucgacaaggaccgcgccgccaagcccgucaccgucgccgucaagaugcucaaggacgacgccaccgacaaggaccucuccgaccucgucuccgagauggagaugaugaagaugaucggcaagcacaagaacaucaucaaccuccucggcgccugcacccagggcggcccccucuacguccucgucgaguacgccgccaagggcaaccuccgcgaguuccuccgcgcccgccgcccccccggccucgacuacuccuucgacaccugcaagccccccgaggagcagcucaccuucaaggaccucgucuccugcgccuaccaggucgcccgcggcauggaguaccucgccucccagaagugcauccaccgcgaccucgccgcccgcaacguccucgucaccgaggacaacgucaugaagaucgccgacuucggccucgcccgcgacguccacaaccucgacuacuacaagaagaccaccaacggccgccuccccgucaaguggauggcccccgaggcccucuucgaccgcgucuacacccaccaguccgacgucugguccuucggcguccuccucugggagaucuucacccucggcggcucccccuaccccggcauccccgucgaggagcucuucaagcuccucaaggagggccaccgcauggacaagcccgccaacugcacccacgaccucuacaugaucaugcgcgagugcuggcacgccgcccccucccagcgccccaccuucaagcagcucgucgaggaccucgaccgcguccucaccgucaccuccaccgacgaguaccucgaccucuccgcccccuucgagcaguacucccccggcggccaggacacccccuccuccuccuccuccggcgacgacuccgucuucgcccacgaccuccucccccccgccccccccuccuccggcggcucccgcaccuga

SEQ ID NO: 43210 - RNA, 2205 nt, Artificial Sequence
  derived and/or modified sequence opt2 from FGFR4__Homo_sapiens__NP_001278909
augcgccuccuccucgcccuccucggcguccuccucuccguccccggcccccccguccucucccucgaggccuccgaggaggucgagcucgagcccugccucgcccccucccucgagcagcaggagcaggagcucaccgucgcccucggccagcccguccgccucugcugcggccgcgccgagcgcggcggccacugguacaaggagggcucccgccucgcccccgccggccgcguccgcggcuggcgcggccgccucgagaucgccuccuuccuccccgaggacgccggccgcuaccucugccucgcccgcggcuccaugaucguccuccagaaccucacccucaucaccggcgacucccucaccuccuccaacgacgacgaggaccccaagucccaccgcgaccccuccaaccgccacuccuacccccagcaggcccccuacuggacccacccccagcgcauggagaagaagcuccacgccguccccgccggcaacaccgucaaguuccgcugccccgccgccggcaaccccacccccaccauccgcuggcucaaggacggccaggccuuccacggcgagaaccgcaucggcggcauccgccuccgccaccagcacuggucccucgucauggaguccgucguccccuccgaccgcggcaccuacaccugccucgucgagaacgccgucggcuccauccgcuacaacuaccuccucgacguccucgagcgcuccccccaccgccccauccuccaggccggccuccccgccaacaccaccgccgucgucggcuccgacgucgagcuccucugcaaggucuacuccgacgcccagccccacauccaguggcucaagcacaucgucaucaacggcuccuccuucggcgccgacggcuuccccuacguccagguccucaagaccgccgacaucaacuccuccgaggucgagguccucuaccuccgcaacgucuccgccgaggacgccggcgaguacaccugccucgccggcaacuccaucggccucuccuaccaguccgccuggcucaccguccuccccgaggaggaccccaccuggaccgccgccgcccccgaggccuccucccccuggucccaggcccuccccgccucccaggcccaccccugguacgaggccugcgucuccccccccgccgccccccccugcucccccgccucccucguccucggcaagccccucggcgagggcugcuucggccaggucguccgcgccgaggccuucggcauggaccccgcccgccccgaccaggccuccaccgucgccgucaagaugcucaaggacaacgccuccgacaaggaccucgccgaccucgucuccgagauggaggucaugaagcucaucggccgccacaagaacaucaucaaccuccucggcgucugcacccaggagggcccccucuacgucaucgucgagugcgccgccaagggcaaccuccgcgaguuccuccgcgcccgccgcccccccggccccgaccucucccccgacggcccccgcuccuccgagggcccccucuccuuccccguccucgucuccugcgccuaccaggucgcccgcggcaugcaguaccucgagucccgcaagugcauccaccgcgaccucgccgcccgcaacguccucgucaccgaggacaacgucaugaagaucgccgacuucggccucgcccgcggcguccaccacaucgacuacuacaagaagaccuccaacggccgccuccccgucaaguggauggcccccgaggcccucuucgaccgcgucuacacccaccaguccgacgucugguccuucggcauccuccucugggagaucuucacccucggcggcucccccuaccccggcauccccgucgaggagcucuucucccuccuccgcgagggccaccgcauggaccgccccccccacugcccccccgagcucuacggccucaugcgcgagugcuggcacgccgcccccucccagcgccccaccuucaagcagcucgucgaggcccucgacaagguccuccucgccgucuccgaggaguaccucgaccuccgccucaccuucggccccuacucccccuccggcggcgacgccuccuccaccugcuccuccuccgacuccgucuucucccacgacccccucccccucggcuccuccuccuuccccuucggcuccggcguccagaccuga

SEQ ID NO: 43211 - RNA, 1515 nt, Artificial Sequence
  derived and/or modified sequence opt2 from FGFRL1__Homo_sapiens__NP_001004358
augacccccuccccccuccuccuccuccuccuccccccccuccuccucggcgccuucccccccgccgccgccgcccgcggcccccccaagauggccgacaaggucgucccccgccaggucgcccgccucggccgcaccguccgccuccagugccccgucgagggcgacccccccccccucaccauguggaccaaggacggccgcaccauccacuccggcuggucccgcuuccgcguccucccccagggccucaaggucaagcaggucgagcgcgaggacgccggcgucuacgucugcaaggccaccaacggcuucggcucccucuccgucaacuacacccucgucguccucgacgacaucucccccggcaaggagucccucggccccgacuccuccuccggcggccaggaggaccccgccucccagcagugggcccgcccccgcuucacccagcccuccaagaugcgccgccgcgucaucgcccgccccgucggcuccuccguccgccucaagugcgucgccuccggccacccccgccccgacaucaccuggaugaaggacgaccaggcccucacccgccccgaggccgccgagccccgcaagaagaaguggacccucucccucaagaaccuccgccccgaggacuccggcaaguacaccugccgcgucuccaaccgcgccggcgccaucaacgccaccuacaaggucgacgucauccagcgcacccgcuccaagcccguccucaccggcacccaccccgucaacaccaccgucgacuucggcggcaccaccuccuuccagugcaagguccgcuccgacgucaagcccgucauccaguggcucaagcgcgucgaguacggcgccgagggccgccacaacuccaccaucgacgucggcggccagaaguucgucguccuccccaccggcgacgucuggucccgccccgacggcuccuaccucaacaagcuccucaucacccgcgcccgccaggacgacgccggcauguacaucugccucggcgccaacaccaugggcuacuccuuccgcuccgccuuccucaccguccuccccgaccccaagccccccggcccccccgucgccuccuccuccuccgccaccucccuccccuggcccgucgucaucggcauccccgccggcgccgucuucauccucggcacccuccuccucuggcucugccaggcccagaagaagcccugcacccccgcccccgcccccccccuccccggccaccgcccccccggcaccgcccgcgaccgcuccggcgacaaggaccuccccucccucgccgcccucuccgccggccccggcgucggccucugcgaggagcacggcucccccgccgccccccagcaccuccucggccccggccccgucgccggccccaagcucuaccccaagcucuacaccgacauccacacccacacccacacccacucccacacccacucccacgucgagggcaagguccaccagcacauccacuaccagugcuga

SEQ ID NO: 43212 - RNA, 1314 nt, Artificial Sequence
  derived and/or modified sequence opt2 from FGG__Homo_sapiens__NP_000500
auguccuggucccuccacccccgcaaccucauccucuacuucuacgcccuccucuuccucuccuccaccugcgucgccuacgucgccacccgcgacaacugcugcauccucgacgagcgcuucggcuccuacugccccaccaccugcggcaucgccgacuuccucuccaccuaccagaccaaggucgacaaggaccuccagucccucgaggacauccuccaccaggucgagaacaagaccuccgaggucaagcagcucaucaaggccauccagcucaccuacaaccccgacgaguccuccaagcccaacaugaucgacgccgccacccucaagucccgcaagaugcucgaggagaucaugaaguacgaggccuccauccucacccacgacuccuccauccgcuaccuccaggagaucuacaacuccaacaaccagaagaucgucaaccucaaggagaaggucgcccagcucgaggcccagugccaggagcccugcaaggacaccguccagauccacgacaucaccggcaaggacugccaggacaucgccaacaagggcgccaagcaguccggccucuacuucaucaagccccucaaggccaaccagcaguuccucgucuacugcgagaucgacggcuccggcaacggcuggaccgucuuccagaagcgccucgacggcuccgucgacuucaagaagaacuggauccaguacaaggagggcuucggccaccucucccccaccggcaccaccgaguucuggcucggcaacgagaagauccaccucaucuccacccaguccgccauccccuacgcccuccgcgucgagcucgaggacuggaacggccgcaccuccaccgccgacuacgccauguucaaggucggccccgaggccgacaaguaccgccucaccuacgccuacuucgccggcggcgacgccggcgacgccuucgacggcuucgacuucggcgacgaccccuccgacaaguucuucaccucccacaacggcaugcaguucuccaccugggacaacgacaacgacaaguucgagggcaacugcgccgagcaggacggcuccggcugguggaugaacaagugccacgccggccaccucaacggcgucuacuaccagggcggcaccuacuccaaggccuccacccccaacggcuacgacaacggcaucaucugggccaccuggaagacccgcugguacuccaugaagaagaccaccaugaagaucauccccuucaaccgccucaccaucggcgagggccagcagcaccaccucggcggcgccaagcaggccggcgacgucuga

SEQ ID NO: 43213 - RNA, 1086 nt, Artificial Sequence
  derived and/or modified sequence opt2 from FGGY__Homo_sapiens__XP_011540039
auguccggcggcgagcagaagcccgagcgcuacuacgucggcgucgacgucggcaccggcuccguccgcgccgcccucgucgaccaguccggcguccuccucgccuucgccgaccagcccaucaagaacugggagccccaguucaaccaccacgagcaguccuccgaggacaucugggccgccugcugcgucgucaccaagaaggucguccagggcaucgaccucaaccagauccgcggccucggcuucgacgccaccugcucccucgucguccucgacaagcaguuccacccccuccccgucaaccaggagggcgacucccaccgcaacgucaucauguggcucgaccaccgcgccgucucccaggucaaccgcaucaacgagaccaagcacuccguccuccaguacgucggcggcgucauguccgucgagaugcaggcccccaagcuccucuggcucaaggagaaccuccgcgagaucugcugggacaaggccggccacuucuucgaccuccccgacuuccucuccuggaaggccaccggcgucaccgcccgcucccucugcucccucgucugcaaguggaccuacuccgccgagaagggcugggacgacuccuucuggaagaugaucggccucgaggacuucgucgccgacaacuacuccaagaucggcaaccagguccucccccccggcgccucccucggcaacggccucacccccgaggccgcccgcgaccucggccuccuccccggcaucgccgucgccgccucccucaucgacgcccacgccggcggccucggcgucaucggcgccgacguccgcggccacggccucaucugcgagggccagcccgucaccucccgccucgccgucaucugcggcaccuccuccugccacaugggcaucuccaaggaccccaucuucguccccggcgucuggggccccuacuucuccgccaugguccccggcuucuggcucaacgagggcggccaguccgucaccggcaagcucaucgaccacaugguccagggccacgccgccuuccccgagcuccaggucaaggccaccgcccgcucccccgacuga

SEQ ID NO: 43214 - RNA, 939 nt, Artificial Sequence
  derived and/or modified sequence opt2 from FGL1__Homo_sapiens__NP_004458
auggccaaggucuucuccuucauccucgucaccaccgcccucaccaugggccgcgagaucuccgcccucgaggacugcgcccaggagcagaugcgccuccgcgcccagguccgccuccucgagacccgcgucaagcagcagcaggucaagaucaagcagcuccuccaggagaacgagguccaguuccucgacaagggcgacgagaacaccgucaucgaccucggcuccaagcgccaguacgccgacugcuccgagaucuucaacgacggcuacaagcucuccggcuucuacaagaucaagccccuccagucccccgccgaguucuccgucuacugcgacauguccgacggcggcggcuggaccgucauccagcgccgcuccgacggcuccgagaacuucaaccgcggcuggaaggacuacgagaacggcuucggcaacuucguccagaagcacggcgaguacuggcucggcaacaagaaccuccacuuccucaccacccaggaggacuacacccucaagaucgaccucgccgacuucgagaagaacucccgcuacgcccaguacaagaacuucaaggucggcgacgagaagaacuucuacgagcucaacaucggcgaguacuccggcaccgccggcgacucccucgccggcaacuuccaccccgagguccaguggugggccucccaccagcgcaugaaguucuccaccugggaccgcgaccacgacaacuacgagggcaacugcgccgaggaggaccaguccggcuggugguucaaccgcugccacuccgccaaccucaacggcgucuacuacuccggccccuacaccgccaagaccgacaacggcaucgucugguacaccuggcacggcuggugguacucccucaaguccgucgucaugaagauccgccccaacgacuucauccccaacgucaucuga

SEQ ID NO: 43215 - RNA, 1320 nt, Artificial Sequence
  derived and/or modified sequence opt2 from FGL2__Homo_sapiens__NP_006673
augaagcucgccaacugguacuggcucuccuccgccguccucgccaccuacggcuuccucgucgucgccaacaacgagaccgaggagaucaaggacgagcgcgccaaggacgucugccccguccgccucgagucccgcggcaagugcgaggaggccggcgagugccccuaccaggucucccuccccccccucaccauccagcuccccaagcaguucucccgcaucgaggaggucuucaaggagguccagaaccucaaggagaucgucaacucccucaagaaguccugccaggacugcaagcuccaggccgacgacaacggcgaccccggccgcaacggccuccuccuccccuccaccggcgcccccggcgaggucggcgacaaccgcguccgcgagcucgaguccgaggucaacaagcucuccuccgagcucaagaacgccaaggaggagaucaacguccuccacggccgccucgagaagcucaaccucgucaacaugaacaacaucgagaacuacgucgacuccaaggucgccaaccucaccuucgucgucaacucccucgacggcaagugcuccaagugccccucccaggagcagauccagucccgccccguccagcaccucaucuacaaggacugcuccgacuacuacgccaucggcaagcgcuccuccgagaccuaccgcgucacccccgaccccaagaacuccuccuucgaggucuacugcgacauggagaccaugggcggcggcuggaccguccuccaggcccgccucgacggcuccaccaacuucacccgcaccuggcaggacuacaaggccggcuucggcaaccuccgccgcgaguucuggcucggcaacgacaagauccaccuccucaccaaguccaaggagaugauccuccgcaucgaccucgaggacuucaacggcgucgagcucuacgcccucuacgaccaguucuacgucgccaacgaguuccucaaguaccgccuccacgucggcaacuacaacggcaccgccggcgacgcccuccgcuucaacaagcacuacaaccacgaccucaaguucuucaccacccccgacaaggacaacgaccgcuaccccuccggcaacugcggccucuacuacuccuccggcuggugguucgacgccugccucuccgccaaccucaacggcaaguacuaccaccagaaguaccgcggcguccgcaacggcaucuucuggggcaccuggcccggcgucuccgaggcccaccccggcggcuacaaguccuccuucaaggaggccaagaugaugauccgccccaagcacuucaagcccuga

SEQ ID NO: 43216 - RNA, 1383 nt, Artificial Sequence
  derived and/or modified sequence opt2 from FGR__Homo_sapiens__XP_011539313
augggcugcgucuucugcaagaagcucgagcccgucgccaccgccaaggaggacgccggccucgagggcgacuuccgcuccuacggcgccgccgaccacuacggccccgaccccaccaaggcccgccccgccuccuccuucgcccacauccccaacuacuccaacuucuccucccaggccaucaaccccggcuuccucgacuccggcaccauccgcggcgucuccgucaaggucaccggcggccgccucggccucuccgcccccgagaagcucgccgccuuccccgccaccaccuggccccuccucacccaguccaagcucaaguccgccuacucccucuccauccgcgacugggaccagacccgcggcgaccacgucaagcacuacaagauccgcaagcucgacaugggcggcuacuacaucaccacccgcguccaguucaacuccguccaggagcucguccagcacuacauggaggucaacgacggccucugcaaccuccucaucgcccccugcaccaucaugaagccccagacccucggccucgccaaggacgccugggagaucucccgcuccuccaucacccucgagcgccgccucggcaccggcugcuucggcgacgucuggcucggcaccuggaacggcuccaccaaggucgccgucaagacccucaagcccggcaccaugucccccaaggccuuccucgaggaggcccaggucaugaagcuccuccgccacgacaagcucguccagcucuacgccgucgucuccgaggagcccaucuacaucgucaccgaguucaugugccacggcucccuccucgacuuccucaagaaccccgagggccaggaccuccgccucccccagcucgucgacauggccgcccaggucgccgagggcauggccuacauggagcgcaugaacuacauccaccgcgaccuccgcgccgccaacauccucgucggcgagcgccucgccugcaagaucgccgacuucggccucgcccgccucaucaaggacgacgaguacaaccccugccagggcuccaaguuccccaucaaguggaccgcccccgaggccgcccucuucggccgcuucaccaucaaguccgacgucugguccuucggcauccuccucaccgagcucaucaccaagggccgcauccccuaccccggcaugaacaagcgcgagguccucgagcaggucgagcagggcuaccacaugcccugcccccccggcugccccgccucccucuacgaggccauggagcagaccuggcgccucgaccccgaggagcgccccaccuucgaguaccuccaguccuuccucgaggacuacuucaccuccgccgagccccaguaccagcccggcgaccagaccuga

SEQ ID NO: 43217 - RNA, 3432 nt, Artificial Sequence
  derived and/or modified sequence opt2 from FHDC1__Homo_sapiens__NP_203751
augcacgucaugaacugcgucucccucgucuccgacaaggagaacggcaacaucgccaccgcccccggcuucaugaucggccagacccccccccccgccccccccccccccccccccccccccccccccuccccccccugcuccugcucccgcgaggagugccccuccucccccccccccccccccccccccccccuccccggcgagccccccauccccccccccccccccggccucccccccaccacccacaugaacggcuacucccaccucggcaagaagaagcgcaugcgcuccuucuucuggaagaccauccccgaggagcagguccgcggcaagaccaacaucuggacccucgccgcccgccaggagcaccacuaccagaucgacaccaagaccaucgaggagcucuucggccagcaggaggacaccaccaaguccucccucccccgccgcggccgcacccucaacuccuccuuccgcgaggcccgcgaggagaucaccauccucgacgccaagcgcuccaugaacaucggcaucuuccucaagcaguucaagaaguccccccgcuccaucgucgaggacauccaccagggcaaguccgagcacuacggcuccgagacccuccgcgaguuccucaaguuccuccccgaguccgaggaggucaagaagcucaaggccuucuccggcgacgucuccaagcucucccucgccgacuccuuccucuacggccucauccagguccccaacuacucccuccgcaucgaggccaugguccucaagaaggaguuccuccccuccugcuccucccucuacaccgacaucaccguccuccgcaccgccaucaaggagcucauguccugcgaggagcuccacuccauccuccaccucguccuccaggccggcaacaucaugaacgccggcggcuacgccggcaacgccgucggcuucaagcucuccucccuccucaagcucgccgacaccaaggccaacaagcccggcaugaaccuccuccacuucgucgcccaggaggcccagaagaaggacaccauccuccucaacuucuccgagaagcuccaccacguccagaagaccgcccgccucucccucgagaacaccgaggccgagcuccaccuccucuucguccgcaccaagucccucaaggagaacauccagcgcgacggcgagcucugccagcagauggaggacuuccuccaguucgccaucgagaagcuccgcgagcucgagugcuggaagcaggagcuccaggacgaggccuacacccucaucgacuucuucugcgaggacaagaagaccaugaagcucgacgagugcuuccagaucuuccgcgacuucugcaccaaguucaacaaggccgucaaggacaaccacgaccgcgaggcccaggagcuccgccagcuccagcgccucaaggagcaggagcagaagcagcgcuccugggccaccggcgagcucggcgccuucggccgcuccuccuccgagaacgacgucgagcuccucaccaagaagggcgccgagggccuccuccccuuccuccacccccgccccaucucccccuccucccccuccuaccgcccccccaacacccgccgcucccgccucucccucggccccuccgccgaccgcgagcuccucaccuuccucgaguccuccaccggcucccccgaggagcccaacaaguuccacucccucccccgcuccuccccccgccaggcccgccccaccaucgccugccucgagcccgccgagguccgccaccaggacuccuccuucgcccacaagccccaggccuccggcggccaggaggaggcccccaacccccccuccgcccaggcccaccagcucgccgccgcccagcccgagaaccacgccuccgccuucccccgcgcccgccgccagggcgucuccguccuccgcaagcgcuacuccgagcccgucucccucggcuccgcccagucccccccccucuccccccucgcccucggcaucaaggagcacgagcucgucaccggccucgcccaguucaaccuccagggcucccagggcauggaggagaccucccagcucacccucuccgacuucucccccauggagcucgaguccgucggccaccgcggcccccagucccucuccgccuccuccuccucccucacccccaugggccgcgacgcccucggcucccucucccccgcccucgaggacggcaaggccgcccccgacgagcccggcuccgccgcccucggcuccgucggcuccuccgaccccgagaacaaggacccccgcccccucuucugcaucuccgacaccaccgacugcucccucacccucgacugcuccgagggcaccgacucccgcccccgcggcggcgaccccgaggagggcggcgagggcgacggcuccauguccuccggcgucggcgagaugggcgacucccaggucuccuccaaccccaccuccuccccccccggcgaggcccccgcccccgucuccgucgacuccgagcccuccugcaagggcggccucccccgcgacaagcccaccaagcgcaaggacgucgucgcccccaagcgcggcucccucaaggaggccucccccggcgccuccaagcccggcuccgcccgccgcucccagggcgccgucgccaaguccguccgcacccucaccgccuccgagaacgaguccaugcgcaaggucaugcccaucaccaaguccucccgcggcgccggcuggcgccgccccgagcucuccucccgcggccccucccagaacccccccuccuccaccgacaccgucuggucccgccagaacuccguccgccgcgccuccaccggcgccgaggagcagcgccucccccgcggcuccuccggcuccuccuccacccgccccggccgcgacgucccccuccagccccgcggcuccuucaagaagcccuccgccaagccccuccgcaaccucccccgccagaagcccgaggagaacaagaccugccgcgcccacuccgagggccccgagucccccaaggaggagcccaagacccccuccguccccuccgucccccacgagcucccccgcguccccuccuucgcccgcaacaccgucgccuccuccucccgcuccaugcgcaccgaccucccccccgucgccaaggcccccggcaucacccgcaccgucucccagcgccagcuccgcgucaagggcgaccccgaggacgccgcccccaaggacuccuccacccuccgccgcgccuccuccgcccgcgcccccaagaagcgccccgaguccgccgagggccccuccgccaacaccgaggccccccucaaggcccgcggcgccggcgagcgcgccucccuccgccgcaaggacuccucccgcaccacccucggccgcauccucaacccccuccgcaaguga

SEQ ID NO: 43218 - RNA, 1533 nt, Artificial Sequence
  derived and/or modified sequence opt2 from FH__Homo_sapiens__NP_000134
auguaccgcgcccuccgccuccucgcccgcucccgcccccucguccgcgcccccgccgccgcccucgccuccgcccccggccucggcggcgccgccguccccuccuucuggccccccaacgccgcccgcauggccucccagaacuccuuccgcaucgaguacgacaccuucggcgagcucaagguccccaacgacaaguacuacggcgcccagaccguccgcuccaccaugaacuucaagaucggcggcgucaccgagcgcaugcccacccccgucaucaaggccuucggcauccucaagcgcgccgccgccgaggucaaccaggacuacggccucgaccccaagaucgccaacgccaucaugaaggccgccgacgaggucgccgagggcaagcucaacgaccacuucccccucgucgucuggcagaccggcuccggcacccagaccaacaugaacgucaacgaggucaucuccaaccgcgccaucgagaugcucggcggcgagcucggcuccaagauccccguccaccccaacgaccacgucaacaagucccaguccuccaacgacaccuuccccaccgccaugcacaucgccgccgccaucgagguccacgagguccuccuccccggccuccagaagcuccacgacgcccucgacgccaaguccaaggaguucgcccagaucaucaagaucggccgcacccacacccaggacgccgucccccucacccucggccaggaguucuccggcuacguccagcaggucaaguacgccaugacccgcaucaaggccgccaugccccgcaucuacgagcucgccgccggcggcaccgccgucggcaccggccucaacacccgcaucggcuucgccgagaaggucgccgccaaggucgccgcccucaccggccuccccuucgucaccgcccccaacaaguucgaggcccucgccgcccacgacgcccucgucgagcucuccggcgccaugaacaccaccgccugcucccucaugaagaucgccaacgacauccgcuuccucggcuccggcccccgcuccggccucggcgagcucauccuccccgagaacgagcccggcuccuccaucaugcccggcaaggucaaccccacccagugcgaggccaugaccauggucgccgcccaggucaugggcaaccacgucgccgucaccgucggcggcuccaacggccacuucgagcucaacgucuucaagcccaugaugaucaagaacguccuccacuccgcccgccuccucggcgacgccuccgucuccuucaccgagaacugcgucgucggcauccaggccaacaccgagcgcaucaacaagcucaugaacgagucccucaugcucgucaccgcccucaacccccacaucggcuacgacaaggccgccaagaucgccaagaccgcccacaagaacggcuccacccucaaggagaccgccaucgagcucggcuaccucaccgccgagcaguucgacgagugggucaagcccaaggacaugcucggccccaaguga

SEQ ID NO: 43219 - RNA, 444 nt, Artificial Sequence
  derived and/or modified sequence opt2 from FHIT__Homo_sapiens__NP_002003
auguccuuccgcuucggccagcaccucaucaagcccuccgucgucuuccucaagaccgagcucuccuucgcccucgucaaccgcaagcccgucguccccggccacguccucgucugcccccuccgccccgucgagcgcuuccacgaccuccgccccgacgaggucgccgaccucuuccagaccacccagcgcgucggcaccgucgucgagaagcacuuccacggcaccucccucaccuucuccaugcaggacggccccgaggccggccagaccgucaagcacguccacguccacguccucccccgcaaggccggcgacuuccaccgcaacgacuccaucuacgaggagcuccagaagcacgacaaggaggacuuccccgccuccuggcgcuccgaggaggagauggccgccgaggccgccgcccuccgcgucuacuuccaguga

SEQ ID NO: 43220 - RNA, 891 nt, Artificial Sequence
  derived and/or modified sequence opt2 from FHL1__Homo_sapiens__NP_001153171
auggccucccaccgccacuccggccccuccuccuacaaggucggcaccauggccgagaaguucgacugccacuacugccgcgacccccuccagggcaagaaguacguccagaaggacggccaccacugcugccucaagugcuucgacaaguucugcgccaacaccugcgucgagugccgcaagcccaucggcgccgacuccaaggagguccacuacaagaaccgcuucuggcacgacaccugcuuccgcugcgccaagugccuccacccccucgccaacgagaccuucgucgccaaggacaacaagauccucugcaacaagugcaccacccgcgaggacucccccaagugcaagggcugcuucaaggccaucgucgccggcgaccagaacgucgaguacaagggcaccgucuggcacaaggacugcuucaccugcuccaacugcaagcaggucaucggcaccggcuccuucuuccccaagggcgaggacuucuacugcgucaccugccacgagaccaaguucgccaagcacugcgucaagugcaacaaggccaucaccuccggcggcaucaccuaccaggaccagcccuggcacgccgacugcuucgucugcgucaccugcuccaagaagcucgccggccagcgcuucaccgccgucgaggaccaguacuacugcgucgacugcuacaagaacuucgucgccaagaagugcgccggcugcaagaaccccaucaccggcuucggcaagggcuccuccgucgucgccuacgagggccaguccuggcacgacuacugcuuccacugcaagaagugcuccgucaaccucgccaacaagcgcuucgucuuccaccaggagcaggucuacugccccgacugcgccaagaagcucuga

SEQ ID NO: 43221 - RNA, 1170 nt, Artificial Sequence
  derived and/or modified sequence opt2 from FHL2__Homo_sapiens__XP_005263959
augacccgccgcggcuucucccgcgccggcgccgcccagcgcuccacccgccccgccgccgagccccagccccccgccgcccgcgcccuccagccccgccccggcguccccggcccccuccgcugccgcgaguaccuccagccccccgccccccgccgcgaggccgagggccucucccaccagggcuccgaggucggcgccgaguccggcgcccgccccaaggagcgcggcgccgagcccgagcucggccgccucuggcuccgcaccgucuccuccuggcgccucggcuggcacuucgacuucggcgucgccgagaagcccggcgucaagaugaccgagcgcuucgacugccaccacugcaacgagucccucuucggcaagaaguacauccuccgcgaggagucccccuacugcgucgucugcuucgagacccucuucgccaacaccugcgaggagugcggcaagcccaucggcugcgacugcaaggaccucuccuacaaggaccgccacuggcacgaggccugcuuccacugcucccagugccgcaacucccucgucgacaagcccuucgccgccaaggaggaccagcuccucugcaccgacugcuacuccaacgaguacuccuccaagugccaggagugcaagaagaccaucaugcccggcacccgcaagauggaguacaagggcuccuccuggcacgagaccugcuucaucugccaccgcugccagcagcccaucggcaccaaguccuucauccccaaggacaaccagaacuucugcguccccugcuacgagaagcagcacgccaugcagugcguccagugcaagaagcccaucaccaccggcggcgucaccuaccgcgagcagcccuggcacaaggagugcuucgucugcaccgccugccgcaagcagcucuccggccagcgcuucaccgcccgcgacgacuucgccuacugccucaacugcuucugcgaccucuacgccaagaagugcgccggcugcaccaaccccaucuccggccucggcggcaccaaguacaucuccuucgaggagcgccaguggcacaacgacugcuucaacugcaagaagugcucccucucccucgucggccgcggcuuccucaccgagcgcgacgacauccucugccccgacugcggcaaggacaucuga

SEQ ID NO: 43222 - RNA, 855 nt, Artificial Sequence
  derived and/or modified sequence opt2 from FHL5__Homo_sapiens__XP_006715676
augaccaccgcccacuucuacugccaguacugcaccgccucccuccucggcaagaaguacguccucaaggacgacucccccuacugcgucaccugcuacgaccgcgucuucuccaacuacugcgaggagugcaagaagcccaucgaguccgacuccaaggaccucugcuacaaggaccgccacuggcacgagggcugcuucaagugcaccaagugcaaccacucccucgucgagaagcccuucgccgccaaggacgagcgccuccucugcaccgagugcuacuccaacgagugcuccuccaagugcuuccacugcaagcgcaccaucaugcccggcucccgcaagauggaguucaagggcaacuacuggcacgagaccugcuucgucugcgagaacugccgccagcccaucggcaccaagccccucaucuccaaggaguccggcaacuacugcguccccugcuucgagaaggaguucgcccacuacugcaacuucugcaagaaggucaucaccuccggcggcaucaccuucugcgaccagcucuggcacaaggagugcuuccucugcuccggcugccgcaaggaccucugcgaggagcaguucaugucccgcgacgacuaccccuucugcgucgacugcuacaaccaccucuacgccaacaagugcgucgccugcuccaagcccaucuccggccucaccggcgccaaguucaucugcuuccaggacucccaguggcacuccgagugcuucaacugcggcaagugcuccgucucccucgucggcaagggcuuccucacccagaacaaggagaucuucugccagaagugcggcuccggcauggacaccgacaucuga

SEQ ID NO: 43223 - RNA, 3495 nt, Artificial Sequence
  derived and/or modified sequence opt2 from FHOD1__Homo_sapiens__NP_037373
auggccggcggcgaggaccgcggcgacggcgagcccgucuccgucgucaccguccgcguccaguaccucgaggacaccgaccccuucgccugcgccaacuuccccgagccccgccgcgcccccaccugcucccucgacggcgcccucccccucggcgcccagauccccgccguccaccgccuccucggcgccccccucaagcucgaggacugcgcccuccaggucucccccuccggcuacuaccucgacaccgagcucucccucgaggagcagcgcgagaugcucgagggcuucuacgaggagaucuccaagggccgcaagcccacccucauccuccgcacccagcucuccguccgcgucaacgccauccucgagaagcucuacuccuccuccggccccgagcuccgccgcucccucuucucccucaagcagaucuuccaggaggacaaggaccucguccccgaguucguccacuccgagggccucuccugccucauccgcgucggcgccgccgccgaccacaacuaccaguccuacauccuccgcgcccucggccagcucaugcucuucgucgacggcaugcucggcgucgucgcccacuccgacaccauccaguggcucuacacccucugcgccucccucucccgccucgucgucaagaccgcccucaagcuccuccucgucuucgucgaguacuccgagaacaacgccccccucuucauccgcgccgucaacuccgucgccuccaccaccggcgccccccccugggccaaccucgucuccauccucgaggagaagaacggcgccgaccccgagcuccucgucuacaccgucacccucaucaacaagacccucgccgcccuccccgaccaggacuccuucuacgacgucaccgacgcccucgagcagcagggcauggaggcccucguccagcgccaccucggcaccgccggcaccgacgucgaccuccgcacccagcucguccucuacgagaacgcccucaagcucgaggacggcgacaucgaggaggcccccggcgccggcggccgccgcgagcgccgcaagcccuccuccgaggagggcaagcgcucccgccgcucccucgagggcggcggcugccccgcccgcgcccccgagcccggccccaccggccccgccucccccgucggccccaccuccuccaccggccccgcccuccucaccggccccgccuccucccccgucggcccccccuccggccuccaggccuccgucaaccucuuccccaccaucuccgucgcccccuccgccgacaccuccuccgagcgcuccaucuacaaggcccgcuuccucgagaacgucgccgccgccgagaccgagaagcaggucgcccucgcccagggccgcgccgagacccucgccggcgccaugcccaacgaggccggcggccaccccgacgcccgccagcucugggacucccccgagaccgcccccgccgcccgcaccccccagucccccgcccccugcguccuccuccgcgcccagcgcucccucgcccccgagcccaaggagccccucauccccgccucccccaaggccgagcccaucugggagcuccccacccgcgccccccgccucuccaucggcgaccucgacuucuccgaccucggcgaggacgaggaccaggacaugcucaacgucgaguccgucgaggccggcaaggacauccccgcccccucccccccccucccccuccucuccggcgucccccccccccccccccuccccccccccccccccaucaagggccccuucccccccccccccccccucccccucgccgccccccucccccacuccguccccgacuccuccgcccuccccaccaagcgcaagaccgucaagcucuucuggcgcgagcucaagcucgccggcggccacggcgucuccgccucccgcuucggccccugcgccacccucugggccucccucgaccccgucuccgucgacaccgcccgccucgagcaccucuucgagucccgcgccaaggagguccuccccuccaagaaggccggcgagggccgccgcaccaugaccaccguccucgaccccaagcgcuccaacgccaucaacaucggccucaccacccucccccccguccacgucaucaaggccgcccuccucaacuucgacgaguucgccgucuccaaggacggcaucgagaagcuccucaccaugaugcccaccgaggaggagcgccagaagaucgaggaggcccagcucgccaaccccgacaucccccucggccccgccgagaacuuccucaugacccucgccuccaucggcggccucgccgcccgccuccagcucugggccuucaagcucgacuacgacuccauggagcgcgagaucgccgagccccucuucgaccucaaggucggcauggagcagcucguccagaacgccaccuuccgcugcauccucgccacccuccucgccgucggcaacuuccucaacggcucccaguccuccggcuucgagcucuccuaccucgagaaggucuccgaggucaaggacaccguccgccgccagucccuccuccaccaccucugcucccucguccuccagacccgccccgaguccuccgaccucuacuccgagauccccgcccucacccgcugcgccaaggucgacuucgagcagcucaccgagaaccucggccagcucgagcgccgcucccgcgccgccgaggagucccuccgcucccucgccaagcacgagcucgcccccgcccuccgcgcccgccucacccacuuccucgaccagugcgcccgccgcgucgccaugcuccgcaucguccaccgccgcgucugcaaccgcuuccacgccuuccuccucuaccucggcuacaccccccaggccgcccgcgagguccgcaucaugcaguucugccacacccuccgcgaguucgcccucgaguaccgcaccugccgcgagcgcguccuccagcagcagcagaagcaggccaccuaccgcgagcgcaacaagacccgcggccgcaugaucaccgagaccgagaaguucuccggcgucgccggcgaggcccccuccaaccccuccguccccgucgccgucuccuccggccccggccgcggcgacgccgacucccacgccuccaugaagucccuccucaccucccgccccgaggacaccacccacaaccgccgcucccgcggcaugguccaguccuccucccccaucaugcccaccgucggccccuccaccgccucccccgaggagccccccggcuccucccuccccuccgacaccuccgacgagaucauggaccuccucguccaguccgucaccaaguccuccccccgcgcccucgccgcccgcgagcgcaagcgcucccgcggcaaccgcaagucccuccgccgcacccucaaguccggccucggcgacgaccucguccaggcccucggccucuccaagggccccggccucgaggucuga

SEQ ID NO: 43224 - RNA, 4269 nt, Artificial Sequence
  derived and/or modified sequence opt2 from FHOD3__Homo_sapiens__NP_001268668
auggccacccucgccugccgcguccaguuccucgacgacaccgaccccuucaacuccaccaacuuccccgagcccucccgccccccccucuucaccuuccgcgaggaccucgcccucggcacccagcucgccggcguccaccgccuccuccaggccccccacaagcucgacgacugcacccuccagcucucccacaacggcgccuaccucgaccucgaggccacccucgccgagcagcgcgacgagcucgagggcuuccaggacgacgccggccgcggcaagaagcacuccaucauccuccgcacccagcucuccguccgcguccacgccugcaucgagaagcucuacaacuccuccggccgcgaccuccgccgcgcccucuucucccucaagcagaucuuccaggacgacaaggaccucguccacgaguucgucgucgccgagggccucaccugccucaucaaggucggcgccgaggccgaccagaacuaccagaacuacauccuccgcgcccucggccagaucaugcucuacgucgacggcaugaacggcgucaucaaccgcaacgagaccauccaguggcucuacacccucaucggcuccaaguuccgccucgucgucaagaccgcccucaagcuccuccucgucuucgucgaguacuccgaguccaacgccccccuccucauccaggccgucaccgccgucgacaccaagcgcggcgucaagcccugguccaacaucauggagauccucgaggagaaggacggcgucgacaccgagcuccucgucuacgccaugacccucgucaacaagacccucuccggccuccccgaccaggacaccuucuacgacgucgucgacugccucgaggagcucggcaucgccgccgucucccagcgccaccucaacaagaagggcaccgaccucgaccucgucgagcagcucaacaucuacgaggucgcccuccgccacgaggacggcgacgagaccaccgagcccccccccuccggcugccgcgaccgccgccgcgccuccgucugcuccuccggcggcggcgagcaccgcggccucgaccgccgccgcucccgccgccacuccguccaguccaucaaguccacccucuccgcccccaccucccccugcucccaguccgcccccuccuucaagcccaaccagguccgcgaccuccgcgagaaguacuccaacuucggcaacaacuccuaccacuccucccgccccuccuccggcuccuccguccccaccacccccaccuccuccgucucccccccccaggaggcccgccucgagcgcuccucccccuccggccuccucaccuccuccuuccgccagcaccaggagucccucgccgccgagcgcgagcgccgccgccaggagcgcgaggagcgccuccagcgcaucgagcgcgaggagcgcaacaaguuccgcuacaaguaccucgagcagcucgccgccgaggagcacgagaaggagcuccgcucccgcuccgucucccgcggccgcgccgaccucucccucgaccucaccucccccgccgcccccgccugccucgccccccucucccacucccccuccuccuccgacucccaggaggcccucaccgucuccgccuccucccccggcaccccccaccacccccaggccuccgccggcgaccccgagcccgaguccgaggccgagcccgaggccgaggccggcgccggccaggucgccgacgaggccggccaggacaucgccuccgcccacgagggcgccgagaccgaggucgagcaggcccucgagcaggagcccgaggagcgcgccucccucuccgagaaggagcgccagaacgagggcgucaacgagcgcgacaacugcuccgccuccuccgucuccuccuccuccuccacccucgagcgcgaggagaaggaggacaagcucucccgcgaccgcaccaccggccucuggcccgccggcguccaggacgccggcgucaacggccagugcggcgacauccucaccaacaagcgcuucaugcucgacaugcucuacgcccacaaccgcaagucccccgacgacgaggagaagggcgacggcgaggccggccgcacccagcaggaggccgaggccgucgccucccucgccacccgcaucuccacccuccaggccaacucccagacccaggacgaguccguccgccgcgucgacgucggcugccucgacaaccgcggcuccgucaaggccuucgccgagaaguucaacuccggcgaccucggccgcggcuccaucucccccgacgccgagcccaacgacaagguccccgagaccgcccccguccagcccaagaccgaguccgacuacaucugggaccagcucauggccaacccccgcgagcuccgcauccaggacauggacuucaccgaccucggcgaggaggacgacaucgacguccucgacgucgaccucggccaccgcgaggcccccggccccccccccccccccccccccaccuuccucggccucccccccccccccccccccccccuccucgacuccaucccccccccccccguccccggcaaccuccucgucccccccccccccgucuucaacgccccccagggccucggcuggucccaggucccccgcggccagcccaccuucaccaagaagaagaagaccauccgccucuucuggaacgagguccgccccuucgacuggcccugcaagaacaaccgccgcugccgcgaguuccucugguccaagcucgagcccaucaaggucgacaccucccgccucgagcaccucuucgaguccaaguccaaggagcucuccgucuccaagaagaccgccgccgacggcaagcgccaggagaucaucguccucgacuccaagcgcuccaacgccaucaacaucggccucaccguccucccccccccccgcaccaucaagaucgccauccucaacuucgacgaguacgcccucaacaaggagggcaucgagaagauccucaccaugauccccaccgacgaggagaagcagaagauccaggaggcccagcucgccaaccccgagaucccccucggcuccgccgagcaguuccuccucacccucuccuccaucuccgagcucuccgcccgccuccaccucugggccuucaagauggacuacgagaccaccgagaaggaggucgccgagccccuccucgaccucaaggagggcaucgaccagcucgagaacaacaagacccucggcuucauccucuccacccuccucgccaucggcaacuuccucaacggcaccaacgccaaggccuucgagcucuccuaccucgagaagguccccgaggucaaggacaccguccacaagcagucccuccuccaccacgucugcaccauggucgucgagaacuuccccgacuccuccgaccucuacuccgagaucggcgccaucacccgcuccgccaaggucgacuucgaccagcuccaggacaaccucugccagauggagcgccgcugcaaggccuccugggaccaccucaaggccaucgccaagcacgagaugaagcccguccucaagcagcgcauguccgaguuccucaaggacugcgccgagcgcaucaucauccucaagaucguccaccgccgcaucaucaaccgcuuccacuccuuccuccucuucaugggccacccccccuacgccauccgcgaggucaacaucaacaaguucugccgcaucaucuccgaguucgcccucgaguaccgcaccacccgcgagcgcguccuccagcagaagcagaagcgcgccaaccaccgcgagcgcaacaagacccgcggcaagaugaucaccgacuccggcaaguucuccggcuccucccccgccccccccucccagccccagggccucuccuacgccgaggacgccgccgagcacgagaacaugaaggccguccucaagaccuccucccccuccgucgaggacgccacccccgcccucggcguccgcacccgcucccgcgccucccgcggcuccaccuccuccuggaccaugggcaccgacgacucccccaacgucaccgacgacgccgccgacgagaucauggaccgcaucgucaaguccgccacccagguccccucccagcgcgucgucccccgcgagcgcaagcgcucccgcgccaaccgcaagucccuccgccgcacccucaaguccggccucacccccgaggaggcccgcgcccucggccucgucggcaccuccgagcuccagcucuga

SEQ ID NO: 43225 - RNA, 1074 nt, Artificial Sequence
  derived and/or modified sequence opt2 from FIBP__Homo_sapiens__NP_004205
augaccuccgagcucgacaucuucgucggcaacaccacccucaucgacgaggacgucuaccgccucuggcucgacggcuacuccgucaccgacgccgucgcccuccgcguccgcuccggcauccucgagcagaccggcgccaccgccgccguccuccaguccgacaccauggaccacuaccgcaccuuccacaugcucgagcgccuccuccacgccccccccaagcuccuccaccagcucaucuuccagaucccccccucccgccaggcccuccucaucgagcgcuacuacgccuucgacgaggccuucguccgcgagguccucggcaagaagcucuccaagggcaccaagaaggaccucgacgacaucuccaccaagaccggcaucacccucaaguccugccgccgccaguucgacaacuucaagcgcgucuucaaggucgucgaggagaugcgcggcucccucgucgacaacauccagcagcacuuccuccucuccgaccgccucgcccgcgacuacgccgccaucgucuucuucgccaacaaccgcuucgagaccggcaagaagaagcuccaguaccucuccuucggcgacuucgccuucugcgccgagcucaugauccagaacuggacccucggcgccgucgacucccagauggacgacauggacauggaccucgacaaggaguuccuccaggaccucaaggagcucaagguccucgucgccgacaaggaccuccucgaccuccacaagucccucgucugcaccgcccuccgcggcaagcucggcgucuucuccgagauggaggccaacuucaagaaccucucccgcggccucgucaacgucgccgccaagcucacccacaacaaggacguccgcgaccucuucgucgaccucgucgagaaguucgucgagcccugccgcuccgaccacuggccccucuccgacguccgcuucuuccucaaccaguacuccgccuccguccacucccucgacggcuuccgccaccaggcccucugggaccgcuacaugggcacccuccgcggcugccuccuccgccucuaccacgacuga

SEQ ID NO: 43226 - RNA, 2724 nt, Artificial Sequence
  derived and/or modified sequence opt2 from FIG4__Homo_sapiens__NP_055660
augcccaccgccgccgcccccaucaucuccuccguccagaagcucguccucuacgagacccgcgcccgcuacuuccucgucggcuccaacaacgccgagaccaaguaccgcguccucaagaucgaccgcaccgagcccaaggaccucgucaucaucgacgaccgccacgucuacacccagcaggagguccgcgagcuccucggccgccucgaccucggcaaccgcaccaagaugggccagaagggcuccuccggccucuuccgcgccgucuccgccuucggcgucgucggcuucguccgcuuccucgagggcuacuacaucguccucaucaccaagcgccgcaagauggccgacaucggcggccacgccaucuacaaggucgaggacaccaacaugaucuacauccccaacgacuccguccgcgucacccaccccgacgaggcccgcuaccuccgcaucuuccagaacgucgaccucuccuccaacuucuacuucuccuacuccuacgaccucucccacucccuccaguacaaccucaccguccuccgcaugccccucgagaugcucaaguccgagaugacccagaaccgccaggaguccuucgacaucuucgaggacgagggccucaucacccagggcggcuccggcgucuucggcaucugcuccgagcccuacaugaaguacgucuggaacggcgagcuccucgacaucaucaaguccaccguccaccgcgacuggcuccucuacaucauccacggcuucugcggccaguccaagcuccucaucuacggccgccccgucuacgucacccucaucgcccgccgcuccuccaaguucgccggcacccgcuuccucaagcgcggcgccaacugcgagggcgacgucgccaacgaggucgagaccgagcagauccucugcgacgccuccgucauguccuucaccgccggcuccuacuccuccuacguccagguccgcggcuccgucccccucuacuggucccaggacaucuccaccaugaugcccaagccccccaucacccucgaccaggccgaccccuucgcccacgucgccgcccuccacuucgaccagauguuccagcgcuucggcucccccaucaucauccucaaccucgucaaggagcgcgagaagcgcaagcacgagcgcauccucuccgaggagcucgucgccgccgucaccuaccucaaccaguuccucccccccgagcacaccaucgucuacauccccugggacauggccaaguacaccaaguccaagcucugcaacguccucgaccgccucaacgucaucgccgaguccgucgucaagaagaccggcuucuucgucaaccgccccgacuccuacugcuccauccuccgccccgacgagaaguggaacgagcucggcggcugcgucauccccaccggccgccuccagaccggcauccuccgcaccaacugcgucgacugccucgaccgcaccaacaccgcccaguucauggucggcaagugcgcccucgccuaccagcucuacucccucggccucaucgacaagcccaaccuccaguucgacaccgacgccguccgccucuucgaggagcucuacgaggaccacggcgacacccucucccuccaguacggcggcucccagcucguccaccgcgucaagaccuaccgcaagaucgcccccuggacccagcacuccaaggacaucaugcagacccucucccgcuacuacuccaacgccuucuccgacgccgaccgccaggacuccaucaaccucuuccucggcgucuuccaccccaccgagggcaagccccaccucugggagcuccccaccgacuucuaccuccaccacaagaacaccaugcgccuccuccccacccgccgcuccuacaccuacugguggacccccgaggucaucaagcaccucccccuccccuacgacgaggucaucugcgccgucaaccucaagaagcucaucgucaagaaguuccacaaguacgaggaggagaucgacauccacaacgaguucuuccgccccuacgagcucuccuccuucgacgacaccuucugccucgccaugaccuccuccgcccgcgacuucaugcccaagaccgucggcaucgaccccucccccuucaccguccgcaagcccgacgagaccggcaaguccguccucggcaacaaguccaaccgcgaggaggccguccuccagcgcaagaccgccgccuccgccccccccccccccuccgaggaggccgucuccuccuccuccgaggacgacuccggcaccgaccgcgaggaggagggcuccgucucccagcgcuccacccccgucaagaugaccgacgccggcgacuccgccaaggucaccgagaacgucguccagcccaugaaggagcucuacggcaucaaccucuccgacggccucuccgaggaggacuucuccaucuacucccgcuucguccagcucggccagucccagcacaagcaggacaagaacucccagcagcccugcucccgcugcuccgacggcgucaucaagcucacccccaucuccgccuucucccaggacaacaucuacgagguccagcccccccgcgucgaccgcaaguccaccgagaucuuccaggcccacauccaggccucccagggcaucaugcagccccucggcaaggaggacuccuccauguaccgcgaguacauccgcaaccgcuaccucuga

SEQ ID NO: 43227 - RNA, 1065 nt, Artificial Sequence
  derived and/or modified sequence opt2 from FIGF__Homo_sapiens__NP_004460
auguaccgcgagugggucgucgucaacgucuucaugaugcucuacguccagcucguccagggcuccuccaacgagcacggccccgucaagcgcuccucccaguccacccucgagcgcuccgagcagcagauccgcgccgccuccucccucgaggagcuccuccgcaucacccacuccgaggacuggaagcucuggcgcugccgccuccgccucaaguccuucaccuccauggacucccgcuccgccucccaccgcuccacccgcuucgccgccaccuucuacgacaucgagacccucaaggucaucgacgaggaguggcagcgcacccagugcuccccccgcgagaccugcgucgaggucgccuccgagcucggcaaguccaccaacaccuucuucaagccccccugcgucaacgucuuccgcugcggcggcugcugcaacgaggagucccucaucugcaugaacaccuccaccuccuacaucuccaagcagcucuucgagaucuccgucccccucaccuccguccccgagcucguccccgucaaggucgccaaccacaccggcugcaagugccuccccaccgccccccgccaccccuacuccaucauccgccgcuccauccagauccccgaggaggaccgcugcucccacuccaagaagcucugccccaucgacaugcucugggacuccaacaagugcaagugcguccuccaggaggagaacccccucgccggcaccgaggaccacucccaccuccaggagcccgcccucugcggcccccacaugauguucgacgaggaccgcugcgagugcgucugcaagacccccugccccaaggaccucauccagcaccccaagaacugcuccugcuucgagugcaaggagucccucgagaccugcugccagaagcacaagcucuuccaccccgacaccugcuccugcgaggaccgcugccccuuccacacccgccccugcgccuccggcaagaccgccugcgccaagcacugccgcuuccccaaggagaagcgcgccgcccagggcccccacucccgcaagaaccccuga

SEQ ID NO: 43228 - RNA, 660 nt, Artificial Sequence
  derived and/or modified sequence opt2 from FIGLA__Homo_sapiens__NP_001004311
auggaccccgcccccggcguccucgacccccgcgccgccccccccgcccuccucggcaccccccaggccgagguccucgaggacguccuccgcgagcaguucggcccccucccccagcucgccgccgucugccgccucaagcgccuccccuccggcggcuacuccuccaccgagaaccuccagcucguccucgagcgccgccgcgucgccaacgccaaggagcgcgagcgcaucaagaaccucaaccgcggcuucgcccgccucaaggcccucguccccuuccucccccagucccgcaagcccuccaaggucgacauccucaagggcgccaccgaguacauccagguccucuccgaccuccucgagggcgccaaggacuccaagaagcaggaccccgacgagcaguccuacuccaacaacuccuccgagucccacaccuccuccgcccgccagcucucccgcaacaucacccagcacaucuccugcgccuucggccucaagaacgaggaggagggccccugggccgacggcggcuccggcgagcccgcccacgccugccgccacuccgucauguccaccaccgagaucaucucccccacccgcucccucgaccgcuuccccgaggucgagcuccucucccaccgccucccccaggucuga

SEQ ID NO: 43229 - RNA, 2280 nt, Artificial Sequence
  derived and/or modified sequence opt2 from FIGN__Homo_sapiens__NP_060556
augaucuccuccaccuccgucuacggccucaagaugcaguggacccccgagcacgcccaguggcccgagcagcacuucgacaucaccuccaccacccgcucccccgcccacaaggucgaggccuaccgcggccaccuccagcgcaccuaccaguacgccugggccaacgacgacaucuccgcccucaccgccuccaaccuccucaagaaguacgccgagaaguacuccggcauccucgagggccccgucgaccgccccguccucuccaacuacuccgacacccccuccggccucgucaacggccgcaagaacgaguccgagcccuggcagcccucccucaacuccgaggccgucuaccccaugaacugcguccccgacgucaucaccgccuccaaggccggcgucuccuccgcccucccccccgccgacgucuccgccuccaucggcuccucccccggcgucgccuccaaccucaccgagcccuccuacuccuccuccaccugcggcucccacaccguccccucccuccacgccggccuccccucccaggaguacgcccccggcuacaacggcuccuaccuccacuccaccuacuccucccagcccgcccccgcccuccccuccccccaccccuccccccuccacuccuccggccuccuccagcccccccccccccccccccccccccccgcccucguccccggcuacaacggcaccuccaaccucuccuccuacuccuaccccuccgccuccuaccccccccagaccgccgucggcuccggcuacucccccggcggcgccccccccccccccuccgccuaccuccccuccggcauccccgcccccaccccccucccccccaccaccguccccggcuacaccuaccagggccacggccucacccccaucgcccccuccgcccucaccaacuccuccgccuccucccucaagcgcaaggccuucuacauggccggccagggcgacauggacuccuccuacggcaacuacuccuacggccagcagcgcuccacccagucccccauguaccgcaugcccgacaacuccaucuccaacaccaaccgcggcaacggcuucgaccgcuccgccgagaccuccucccucgccuucaagcccaccaagcagcucauguccuccgagcagcagcgcaaguucuccucccaguccucccgcgcccucaccccccccuccuacuccaccgccaagaacucccucggcucccgcuccuccgaguccuucggcaaguacaccucccccgucauguccgagcacggcgacgagcaccgccagcuccucucccaccccaugcagggccccggccuccgcgccgccaccuccuccaaccacuccgucgacgagcagcucaagaacaccgacacccaccucaucgaccucgucaccaacgagaucaucacccagggcccccccgucgacuggaacgacaucgccggccucgaccucgucaaggccgucaucaaggaggagguccucuggcccguccuccgcuccgacgccuucuccggccucaccgcccucccccgcuccauccuccucuucggcccccgcggcaccggcaagacccuccucggccgcugcaucgccucccagcucggcgccaccuucuucaagaucgccggcuccggccucgucgccaaguggcucggcgaggccgagaagaucauccacgccuccuuccucgucgcccgcugccgccagcccuccgucaucuucgucuccgacaucgacaugcuccucuccucccaggucaacgaggagcacucccccgucucccgcaugcgcaccgaguuccucaugcagcucgacaccguccucaccuccgccgaggaccagaucgucgucaucugcgccaccuccaagcccgaggagaucgacgagucccuccgccgcuacuucaugaagcgccuccucaucccccuccccgacuccaccgcccgccaccagaucaucguccagcuccucucccagcacaacuacugccucaacgacaaggaguucgcccuccucguccagcgcaccgagggcuucuccggccucgacgucgcccaccucugccaggaggccgucgucggcccccuccacgccaugcccgccaccgaccucuccgccaucaugcccucccagcuccgccccgucaccuaccaggacuucgagaacgccuucugcaagauccagcccuccaucucccagaaggagcucgacauguacgucgaguggaacaagauguucggcugcucccaguga

SEQ ID NO: 43230 - RNA, 3651 nt, Artificial Sequence
  derived and/or modified sequence opt2 from FILIP1__Homo_sapiens__NP_001276916
auggucggcaugcgcucccgcaaccagggcggcgaguccgccuccgacggccacaucuccugccccaagcccuccaucaucggcaacgccggcgagaagucccucuccgaggacgccaagaagaagaagaaguccaaccgcaaggaggacgacgucauggccuccggcaccgucaagcgccaccucaagaccuccggcgagugcgagcgcaagaccaagaagucccucgagcucuccaaggaggaccucauccagcuccucuccaucauggagggcgagcuccaggcccgcgaggacgucauccacaugcucaagaccgagaagaccaagcccgagguccucgaggcccacuacggcuccgccgagcccgagaagguccuccgcguccuccaccgcgacgccauccucgcccaggagaaguccaucggcgaggacgucuacgagaagcccaucuccgagcucgaccgccucgaggagaagcagaaggagaccuaccgccgcaugcucgagcagcuccuccucgccgagaagugccaccgccgcaccgucuacgagcucgagaacgagaagcacaagcacaccgacuacaugaacaaguccgacgacuucaccaaccuccucgagcaggagcgcgagcgccucaagaagcuccucgagcaggagaaggccuaccaggcccgcaaggagaaggagaacgccaagcgccucaacaagcuccgcgacgagcucgucaagcucaaguccuucgcccucaugcucgucgacgagcgccagaugcacaucgagcagcucggccuccagucccagaagguccaggaccucacccagaagcuccgcgaggaggaggagaagcucaaggccaucaccuccaaguccaaggaggaccgccagaagcuccucaagcucgaggucgacuucgagcacaaggccucccgcuucucccaggagcacgaggagaugaacgccaagcucgccaaccaggagucccacaaccgccagcuccgccucaagcucgucggccucacccagcgcaucgaggagcucgaggagaccaacaagaaccuccagaaggccgaggaggagcuccaggagcuccgcgacaagaucgccaagggcgagugcggcaacuccucccucauggccgaggucgagaaccuccgcaagcgcguccucgagauggagggcaaggacgaggagaucaccaagaccgagucccagugccgcgagcuccgcaagaagcuccaggaggaggagcaccacuccaaggagcuccgccucgaggucgagaagcuccagaagcgcauguccgagcucgagaagcucgaggaggccuucuccaaguccaaguccgagugcacccagcuccaccucaaccucgagaaggagaagaaccucaccaaggaccuccucaacgagcucgaggucgucaagucccgcgucaaggagcucgagugcuccgagucccgccucgagaaggccgagcucucccucaaggacgaccucaccaagcucaaguccuucaccgucaugcucgucgacgagcgcaagaacaugauggagaagaucaagcaggaggagcgcaaggucgacggccucaacaagaacuucaaggucgagcagggcaaggucauggacgucaccgagaagcucaucgaggaguccaagaagcuccucaagcucaaguccgagauggaggagaaggucuacaaccucacccgcgagcgcgacgagcucaucggcaagcucaaguccgaggaggagaaguccuccgagcucuccugcuccgucgaccuccucaagaagcgccucgacggcaucgaggaggucgagcgcgagaucacccgcggccgcucccgcaagggcuccgagcucaccugccccgaggacaacaagaucaaggagcucacccucgagaucgagcgccucaagaagcgccuccagcagcucgaggucgucgagggcgaccucaugaagaccgaggacgaguacgaccagcucgagcagaaguuccgcaccgagcaggacaaggccaacuuccucucccagcagcucgaggagaucaagcaccagaucgccaagaacaaggccaucgagaagggcgaggucgucucccaggaggccgagcuccgccaccgcuuccgccucgaggaggccaagucccgcgaccucaaggccgagguccaggcccucaaggagaagauccacgagcucaugaacaaggaggaccagcucucccagcuccaggucgacuacuccguccuccagcagcgcuucauggaggaggagaacaagaacaagaacaugggccaggagguccucaaccucaccaaggagcucgagcucuccaagcgcuacucccgcgcccuccgccccuccgucaacggccgccgcauggucgacguccccgucaccuccaccggcguccagaccgacgccgucuccggcgaggccgccgaggaggagacccccgccgucuucauccgcaaguccuuccaggaggagaaccacaucauguccaaccuccgccaggucggccucaagaagcccgucgagcgcuccuccguccucgaccgcuacccccccgccgccaacgagcucaccaugcgcaaguccuggauccccuggaugcgcaagcgcgagaacggccccuccaucacccaggagaagggcccccgcaccaacuccucccccggccaccccggcgaggucguccucucccccaagcagggccagccccuccacauccgcgucacccccgaccacgagaacuccaccgccacccucgagaucaccucccccaccuccgaggaguucuucuccuccaccaccgucauccccacccucggcaaccagaagccccgcaucaccaucauccccucccccaacgucaugccccagaagcagaaguccggcgacaccacccucggccccgagcgcgccaugucccccgucaccaucaccaccuucucccgcgagaagacccccgaguccggccgcggcgccuucgccgaccgccccaccucccccauccagaucaugaccgucuccaccuccgccgcccccgccgagaucgccgucucccccgagucccaggagaugcccaugggccgcaccauccucaaggucacccccgagaagcagaccguccccacccccguccgcaaguacaacuccaacgccaacaucaucaccaccgaggacaacaagauccacauccaccucggcucccaguucaagcgcucccccggcaccuccggcgagggcgucucccccgucaucaccguccgccccgucaacgucaccgccgagaaggaggucuccaccggcaccguccuccgcuccccccgcaaccaccucuccucccgccccggcgccuccaaggucaccuccaccaucaccaucacccccgucaccaccuccuccgcccgcggcacccaguccgucuccggccaggacggcuccucccagcgccccacccccacccgcauccccauguccaagggcaugaaggccggcaagcccgucgucgccgcccccggcgccggcaaccucaccaaguucgagccccgcgccgagacccaguccaugaagaucgagcucaagaaguccgccgccuccuccaccaccucccucggcggcggcaagggcuga

SEQ ID NO: 43231 - RNA, 3402 nt, Artificial Sequence
  derived and/or modified sequence opt2 from FILIP1L__Homo_sapiens__NP_001035924
augcgcucccgcggcuccgacaccgagggcuccgcccagaagaaguucccccgccacaccaagggccacuccuuccagggccccaagaacaugaagcaccgccagcaggacaaggacucccccuccgaguccgacgucauccuccccugccccaaggccgagaagccccacuccggcaacggccaccaggccgaggaccucucccgcgacgaccuccucuuccuccucuccauccucgagggcgagcuccaggcccgcgacgaggucaucggcauccucaaggccgagaagauggaccucgcccuccucgaggcccaguacggcuucgucacccccaagaagguccucgaggcccuccagcgcgacgccuuccaggccaaguccacccccuggcaggaggacaucuacgagaagcccaugaacgagcucgacaaggucgucgagaagcacaaggaguccuaccgccgcauccucggccagcuccucgucgccgagaagucccgccgccagaccauccucgagcucgaggaggagaagcgcaagcacaaggaguacauggagaaguccgacgaguucaucugccuccucgagcaggagugcgagcgccucaagaagcucaucgaccaggagaucaagucccaggaggagaaggagcaggagaaggagaagcgcgucaccacccucaaggaggagcucaccaagcucaaguccuucgcccucauggucgucgacgagcagcagcgccucaccgcccagcucacccuccagcgccagaagauccaggagcucaccaccaacgccaaggagacccacaccaagcucgcccucgccgaggcccgcguccaggaggaggagcagaaggccacccgccucgagaaggagcuccagacccagaccaccaaguuccaccaggaccaggacaccaucauggccaagcucaccaacgaggacucccagaaccgccagcuccagcagaagcucgccgcccucucccgccagaucgacgagcucgaggagaccaaccgcucccuccgcaaggccgaggaggagcuccaggacaucaaggagaagaucuccaagggcgaguacggcaacgccggcaucauggccgaggucgaggagcuccgcaagcgcguccucgacauggagggcaaggacgaggagcucaucaagauggaggagcagugccgcgaccucaacaagcgccucgagcgcgagacccuccaguccaaggacuucaagcucgaggucgagaagcucuccaagcgcaucauggcccucgagaagcucgaggacgccuucaacaaguccaagcaggagugcuacucccucaagugcaaccucgagaaggagcgcaugaccaccaagcagcucucccaggagcucgagucccucaagguccgcaucaaggagcucgaggccaucgagucccgccucgagaagaccgaguucacccucaaggaggaccucaccaagcucaagacccucaccgucauguucgucgacgagcgcaagaccauguccgagaagcucaagaagaccgaggacaagcuccaggccgccuccucccagcuccaggucgagcagaacaaggucaccaccgucaccgagaagcucaucgaggagaccaagcgcgcccucaaguccaagaccgacgucgaggagaagauguacuccgucaccaaggagcgcgacgaccucaagaacaagcucaaggccgaggaggagaagggcaacgaccuccucucccgcgucaacaugcucaagaaccgccuccagucccucgaggccaucgagaaggacuuccucaagaacaagcucaaccaggacuccggcaaguccaccaccgcccuccaccaggagaacaacaagaucaaggagcucucccaggaggucgagcgccucaagcucaagcucaaggacaugaaggccaucgaggacgaccucaugaagaccgaggacgaguacgagacccucgagcgccgcuacgccaacgagcgcgacaaggcccaguuccucuccaaggagcucgagcacgucaagauggagcucgccaaguacaagcucgccgagaagaccgagaccucccacgagcaguggcucuucaagcgccuccaggaggaggaggccaaguccggccaccucucccgcgaggucgacgcccucaaggagaagauccacgaguacauggccaccgaggaccucaucugccaccuccagggcgaccacuccguccuccagaagaagcucaaccagcaggagaaccgcaaccgcgaccucggccgcgagaucgagaaccucaccaaggagcucgagcgcuaccgccacuucuccaagucccuccgccccucccucaacggccgccgcaucuccgacccccaggucuucuccaaggagguccagaccgaggccgucgacaacgagccccccgacuacaagucccucaucccccucgagcgcgccgucaucaacggccagcucuacgaggaguccgagaaccaggacgaggaccccaacgacgagggcuccguccucuccuucaagugcucccaguccacccccugccccgucaaccgcaagcucuggauccccuggaugaaguccaaggagggccaccuccagaacggcaagaugcagaccaagcccaacgccaacuucguccagcccggcgaccucguccucucccacacccccggccagccccuccacaucaaggucacccccgaccacguccagaacaccgccacccucgagaucaccucccccaccaccgaguccccccacuccuacaccuccaccgccgucauccccaacugcggcacccccaagcagcgcaucaccauccuccagaacgccuccaucacccccgucaaguccaagaccuccaccgaggaccucaugaaccucgagcagggcaugucccccaucaccauggccaccuucgcccgcgcccagacccccgaguccugcggcucccucacccccgagcgcaccaugucccccauccagguccucgccgucaccggcuccgccuccucccccgagcagggccgcucccccgagcccaccgagaucuccgccaagcacgccaucuuccgcgucucccccgaccgccaguccuccuggcaguuccagcgcuccaacuccaacuccuccuccgucaucaccaccgaggacaacaagauccacauccaccucggcucccccuacaugcaggccgucgccucccccguccgccccgccucccccuccgccccccuccaggacaaccgcacccagggccucaucaacggcgcccucaacaagaccaccaacaaggucaccuccuccaucaccaucacccccaccgccaccccccucccccgccagucccagaucaccgucuccaacaucuacaacuga

SEQ ID NO: 43232 - RNA, 1767 nt, Artificial Sequence
  derived and/or modified sequence opt2 from FIP1L1__Homo_sapiens__NP_001128409
auguccgccggcgaggucgagcgccucgucuccgagcucuccggcggcaccggcggcgacgaggaggaggaguggcucuacggcgacgagaacgaggucgagcgccccgaggaggagaacgccuccgccaacccccccuccggcaucgaggacgagaccgccgagaacggcguccccaagcccaaggucaccgagaccgaggacgacuccgacuccgacuccgacgacgacgaggacgacguccacgucaccaucggcgacaucaagaccggcgccccccaguacggcuccuacggcaccgcccccgucaaccucaacaucaagaccggcggccgcgucuacggcaccaccggcaccaaggucaagggcgucgaccucgacgcccccggcuccaucaacggcgucccccuccucgaggucgaccucgacuccuucgaggacaagcccuggcgcaagcccggcgccgaccucuccgacuacuucaacuacggcuucaacgaggacaccuggaaggccuacugcgagaagcagaagcgcauccgcaugggccucgaggucauccccgucaccuccaccaccaacaagaucaccgccgaggacugcaccauggaggucacccccggcgccgagauccaggacggccgcuucaaccucuucaagguccagcagggccgcaccggcaacuccgagaaggagaccgcccuccccuccaccaaggccgaguucaccuccccccccucccucuucaagaccggccucccccccucccgcaacuccaccuccucccagucccagaccuccaccgccucccgcaaggccaacuccuccgucggcaaguggcaggaccgcuacggccgcgccgagucccccgaccuccgccgccuccccggcgccaucgacgucaucggccagaccaucaccaucucccgcgucgagggccgccgccgcgccaacgagaacuccaacauccagguccucuccgagcgcuccgccaccgaggucgacaacaacuucuccaagcccccccccuucuucccccccggcgccccccccacccaccucccccccccccccuuccucccccccccccccaccgucuccaccgcccccccccucauccccccccccggcauccccaucaccguccccccccccggcuucccccccccccccggcgcccccccccccucccucauccccaccaucgaguccggccacuccuccggcuacgacucccgcuccgcccgcgccuuccccuacggcaacgucgccuucccccaccuccccggcuccgcccccuccuggcccucccucgucgacaccuccaagcagugggacuacuacgcccgccgcgagaaggaccgcgaccgcgagcgcgaccgcgaccgcgagcgcgaccgcgaccgcgaccgcgagcgcgagcgcacccgcgagcgcgagcgcgagcgcgaccacucccccacccccuccgucuucaacuccgacgaggagcgcuaccgcuaccgcgaguacgccgagcgcggcuacgagcgccaccgcgccucccgcgagaaggaggagcgccaccgcgagcgccgccaccgcgagaaggaggagacccgccacaaguccucccgcuccaacucccgccgccgccacgaguccgaggagggcgacucccaccgccgccacaagcacaagaaguccaagcgcuccaaggagggcaaggaggccggcuccgagcccgcccccgagcaggaguccaccgaggccacccccgccgaguga

SEQ ID NO: 43233 - RNA, 459 nt, Artificial Sequence
  derived and/or modified sequence opt2 from FIS1__Homo_sapiens__NP_057152
auggaggccguccucaacgagcucgucuccgucgaggaccuccucaaguucgagaagaaguuccaguccgagaaggccgccggcuccgucuccaaguccacccaguucgaguacgccuggugccucguccgcuccaaguacaacgacgacauccgcaagggcaucguccuccucgaggagcuccuccccaagggcuccaaggaggagcagcgcgacuacgucuucuaccucgccgucggcaacuaccgccucaaggaguacgagaaggcccucaaguacguccgcggccuccuccagaccgagccccagaacaaccaggccaaggagcucgagcgccucaucgacaaggccaugaagaaggacggccucgucggcauggccaucgucggcggcauggcccucggcgucgccggccucgccggccucaucggccucgccgucuccaaguccaaguccuga

SEQ ID NO: 43234 - RNA, 879 nt, Artificial Sequence
  derived and/or modified sequence opt2 from FITM1__Homo_sapiens__NP_981947
auggagcgcggccccgucgucggcgccggccucggcgccggcgcccgcauccaggcccuccucggcugccuccucaagguccuccucugggucgccuccgcccuccucuacuucggcuccgagcaggccgcccgccuccucggcucccccugccuccgccgccucuaccacgccuggcucgccgccgucgucaucuucggcccccuccuccaguuccacgucaacccccgcaccaucuucgccucccacggcaacuucuucaacaucaaguucgucaacuccgccuggggcuggaccugcaccuuccucggcggcuucguccuccucgucgucuuccucgccacccgccgcgucgccgucaccgcccgccaccucucccgccucgucgucggcgccgccgucuggcgcggcgccggccgcgccuuccuccucaucgaggaccucaccggcuccugcuucgagccccucccccagggccuccuccuccacgagcuccccgaccgccgcuccugccucgccgccggccaccaguggcgcggcuacaccgucuccucccacaccuuccuccucaccuucugcugccuccucauggccgaggaggccgccgucuucgccaaguaccucgcccacggccuccccgccggcgccccccuccgccucgucuuccuccucaacguccuccuccucggccucuggaacuuccuccuccucugcaccgucaucuacuuccaccaguacacccacaaggucgucggcgccgccgucggcaccuucgccugguaccucaccuacggcuccugguaccaccagcccuggucccccggcucccccggccacggccucuucccccgcccccacuccucccgcaagcacaacuga

SEQ ID NO: 43235 - RNA, 789 nt, Artificial Sequence
  derived and/or modified sequence opt2 from FITM2__Homo_sapiens__NP_001073941
auggagcaccucgagcgcugcgaguggcuccuccgcggcacccucguccgcgccgccguccgccgcuaccuccccugggcccucgucgccuccaugcucgccggcucccuccucaaggagcucuccccccuccccgaguccuaccucuccaacaagcgcaacguccucaacgucuacuucgucaaggucgccugggccuggaccuucugccuccuccuccccuucaucgcccucaccaacuaccaccucaccggcaaggccggccucguccuccgccgccucuccacccuccucgucggcaccgccaucugguacaucugcaccuccaucuucuccaacaucgagcacuacaccggcuccugcuaccagucccccgcccucgagggcguccgcaaggagcaccaguccaagcagcagugccaccaggagggcggcuucuggcacggcuucgacaucuccggccacuccuuccuccucaccuucugcgcccucaugaucgucgaggagauguccguccuccacgaggucaagaccgaccgcucccacugccuccacaccgccaucaccacccucgucgucgcccucggcauccucaccuucaucuggguccucauguuccucugcaccgccgucuacuuccacaaccucucccagaaggucuucggcacccucuucggccuccucuccugguacggcaccuacggcuucugguaccccaaggccuucucccccggccuccccccccaguccugcucccucaaccucaagcaggacuccuacaagaaguga

SEQ ID NO: 43236 - RNA, 1314 nt, Artificial Sequence
  derived and/or modified sequence opt2 from FJX1__Homo_sapiens__NP_055159
augggccgccgcaugcgcggcgccgccgccaccgccggccucuggcuccucgcccucggcucccuccucgcccucuggggcggccuccuccccccccgcaccgagcuccccgccucccgcccccccgaggaccgccucccccgccgccccgcccgcuccggcggccccgcccccgccccccgcuucccccucccccccccccucgccugggacgcccgcggcggcucccucaagaccuuccgcgcccuccucacccucgccgccggcgccgacggccccccccgccagucccgcuccgagccccgcuggcacgucuccgcccgccagccccgccccgaggaguccgccgccguccacggcggcgucuucuggucccgcggccucgaggagcaggucccccccggcuucuccgaggcccaggccgccgccuggcucgaggccgcccgcggcgcccgcauggucgcccucgagcgcggcggcugcggccgcuccuccaaccgccucgcccgcuucgccgacggcacccgcgccugcguccgcuacggcaucaaccccgagcagauccagggcgaggcccucuccuacuaccucgcccgccuccucggccuccagcgccacguccccccccucgcccucgcccgcgucgaggcccgcggcgcccagugggcccagguccaggaggagcuccgcgccgcccacuggaccgagggcuccgucgucucccucacccgcuggcuccccaaccucaccgacgucgucguccccgcccccuggcgcuccgaggacggccgccuccgcccccuccgcgacgccggcggcgagcucgccaaccucucccaggccgagcucgucgaccucguccaguggaccgaccucauccucuucgacuaccucaccgccaacuucgaccgccucgucuccaaccucuucucccuccagugggacccccgcgucaugcagcgcgccaccuccaaccuccaccgcggccccggcggcgcccucgucuuccucgacaacgaggccggccucguccacggcuaccgcgucgccggcaugugggacaaguacaacgagccccuccuccaguccgucugcgucuuccgcgagcgcaccgcccgccgcguccucgagcuccaccgcggccaggacgccgccgcccgccuccuccgccucuaccgccgccacgagccccgcuuccccgagcucgccgcccucgccgacccccacgcccagcuccuccagcgccgccucgacuuccucgccaagcacauccuccacugcaaggccaaguacggccgccgcuccggcaccuga

SEQ ID NO: 43237 - RNA, 1749 nt, Artificial Sequence
  derived and/or modified sequence opt2 from FKBP10__Homo_sapiens__NP_068758
auguuccccgccggcccccccucccacucccuccuccgccucccccuccuccagcuccuccuccucgucguccaggccgucggccgcggccucggccgcgccucccccgccggcggcccccucgaggacgucgucaucgagcgcuaccacaucccccgcgccugcccccgcgagguccagaugggcgacuucguccgcuaccacuacaacggcaccuucgaggacggcaagaaguucgacuccuccuacgaccgcaacacccucgucgccaucgucgucggcgucggccgccucaucaccggcauggaccgcggccucaugggcaugugcgucaacgagcgccgccgccucaucguccccccccaccucggcuacggcuccaucggccucgccggccucaucccccccgacgccacccucuacuucgacgucguccuccucgacgucuggaacaaggaggacaccguccaggucuccacccuccuccgccccccccacugcccccgcaugguccaggacggcgacuucguccgcuaccacuacaacggcacccuccucgacggcaccuccuucgacaccuccuacuccaagggcggcaccuacgacaccuacgucggcuccggcuggcucaucaagggcauggaccagggccuccucggcaugugccccggcgagcgccgcaagaucaucaucccccccuuccucgccuacggcgagaagggcuacggcaccgucauccccccccaggccucccucgucuuccacguccuccucaucgacguccacaaccccaaggacgccguccagcucgagacccucgagcucccccccggcugcguccgccgcgccggcgccggcgacuucaugcgcuaccacuacaacggcucccucauggacggcacccucuucgacuccuccuacucccgcaaccacaccuacaacaccuacaucggccagggcuacaucauccccggcauggaccagggccuccagggcgccugcaugggcgagcgccgccgcaucaccauccccccccaccucgccuacggcgagaacggcaccggcgacaagauccccggcuccgccguccucaucuucaacguccacgucaucgacuuccacaaccccgccgacgucgucgagauccgcacccucucccgccccuccgagaccugcaacgagaccaccaagcucggcgacuucguccgcuaccacuacaacugcucccuccucgacggcacccagcucuucaccucccacgacuacggcgccccccaggaggccacccucggcgccaacaaggucaucgagggccucgacaccggccuccagggcaugugcgucggcgagcgccgccagcucaucguccccccccaccucgcccacggcgaguccggcgcccgcggcguccccggcuccgccguccuccucuucgaggucgagcucgucucccgcgaggacggccuccccaccggcuaccucuucgucuggcacaaggacccccccgccaaccucuucgaggacauggaccucaacaaggacggcgaggucccccccgaggaguucuccaccuucaucaaggcccaggucuccgagggcaagggccgccucaugcccggccaggaccccgagaagaccaucggcgacauguuccagaaccaggaccgcaaccaggacggcaagaucaccgucgacgagcucaagcucaaguccgacgaggacgaggagcgcguccacgaggagcucuga

SEQ ID NO: 43238 - RNA, 300 nt, Artificial Sequence
  derived and/or modified sequence opt2 from FKBP11__Homo_sapiens__NP_001137253
augugcgucggcgagaagcgccgcgccaucauccccucccaccucgccuacggcaagcgcggcuucccccccuccguccccgccgacgccgucguccaguacgacgucgagcucaucgcccucauccgcgccaacuacuggcucaagcucgucaagggcauccucccccucgucggcauggccaugguccccgcccuccucggccucaucggcuaccaccucuaccgcaaggccaaccgccccaaggucuccaagaagaagcucaaggaggagaagcgcaacaaguccaagaagaaguga

SEQ ID NO: 43239 - RNA, 636 nt, Artificial Sequence
  derived and/or modified sequence opt2 from FKBP14__Homo_sapiens__NP_060416
augcgccucuuccucuggaacgccguccucacccucuucgucaccucccucaucggcgcccucauccccgagcccgaggucaagaucgagguccuccagaagcccuucaucugccaccgcaagaccaagggcggcgaccucaugcucguccacuacgagggcuaccucgagaaggacggcucccucuuccacuccacccacaagcacaacaacggccagcccaucugguucacccucggcauccucgaggcccucaagggcugggaccagggccucaagggcaugugcgucggcgagaagcgcaagcucaucaucccccccgcccucggcuacggcaaggagggcaagggcaagaucccccccgaguccacccucaucuucaacaucgaccuccucgagauccgcaacggcccccgcucccacgaguccuuccaggagauggaccucaacgacgacuggaagcucuccaaggacgaggucaaggccuaccucaagaaggaguucgagaagcacggcgccgucgucaacgagucccaccacgacgcccucgucgaggacaucuucgacaaggaggacgaggacaaggacggcuucaucuccgcccgcgaguucaccuacaagcacgacgagcucuga

SEQ ID NO: 43240 - RNA, 3660 nt, Artificial Sequence
  derived and/or modified sequence opt2 from FKBP15__Homo_sapiens__NP_056073
auguucggcgccggcgacgaggacgacaccgacuuccucucccccuccggcggcgcccgccucgccucccucuucggccucgaccaggccgccgccggccacggcaacgaguucuuccaguacaccgcccccaagcagcccaagaagggccagggcaccgccgccaccggcaaccaggccacccccaagaccgcccccgccaccauguccacccccaccauccucgucgccaccgccguccacgccuaccgcuacaccaacggccaguacgucaagcagggcaaguucggcgccgccguccucggcaaccacaccgcccgcgaguaccgcauccuccucuacaucucccagcagcagcccgucaccgucgcccgcauccacgucaacuucgagcucaugguccgccccaacaacuacuccaccuucuacgacgaccagcgccagaacugguccaucauguucgaguccgagaaggccgccgucgaguucaacaagcaggucugcaucgccaagugcaacuccaccuccucccucgacgccguccucucccaggaccucaucgucgccgacggccccgccgucgaggucggcgacucccucgaggucgccuacaccggcuggcucuuccagaaccacguccucggccaggucuucgacuccaccgccaacaaggacaagcuccuccgccucaagcucggcuccggcaaggucaucaagggcugggaggacggcaugcucggcaugaagaagggcggcaagcgccuccucaucgucccccccgccugcgccgucggcuccgagggcgucaucggcuggacccaggccaccgacuccauccucgucuucgaggucgagguccgccgcgucaaguucgcccgcgacuccggcuccgacggccacuccgucuccucccgcgacuccgccgcccccucccccauccccggcgccgacaaccucuccgccgaccccgucgucuccccccccaccuccauccccuucaaguccggcgagcccgcccuccgcaccaaguccaacucccucuccgagcagcucgccaucaacaccucccccgacgccgucaaggccaagcucaucucccgcauggccaagaugggccagcccaugcuccccauccuccccccccagcucgacuccaacgacuccgagaucgaggacgucaacacccuccagggcggcggccagcccgucgucacccccuccguccagcccucccuccaccccgcccaccccgcccucccccagaugaccucccaggccccccagcccuccgucaccggccuccaggcccccuccgccgcccucaugcaggucuccucccucgacucccacuccgccgucuccggcaacgcccaguccuuccagcccuacgccggcaugcaggccuacgccuacccccaggccuccgccgucaccucccagcuccagcccguccgcccccucuaccccgccccccucucccagcccccccacuuccagggcuccggcgacauggccuccuuccucaugaccgaggcccgccagcacaacaccgagauccgcauggccgucuccaaggucgccgacaagauggaccaccucaugaccaaggucgaggagcuccagaagcacuccgccggcaacuccaugcucauccccuccauguccgucaccauggagaccuccaugaucauguccaacauccagcgcaucauccaggagaacgagcgccucaagcaggagauccucgagaaguccaaccgcaucgaggagcagaacgacaagaucuccgagcucaucgagcgcaaccagcgcuacgucgagcaguccaaccucaugauggagaagcgcaacaacucccuccagaccgccaccgagaacacccaggcccgcguccuccacgccgagcaggagaaggccaaggucaccgaggagcucgccgccgccaccgcccaggucucccaccuccagcucaagaugaccgcccaccagaagaaggagaccgagcuccagaugcagcucaccgagucccucaaggagaccgaccuccuccgcggccagcucaccaagguccaggccaagcucuccgagcuccaggagaccuccgagcaggcccaguccaaguucaaguccgagaagcagaaccgcaagcagcucgagcucaaggucaccucccucgaggaggagcucaccgaccuccgcgucgagaaggagucccucgagaagaaccucuccgagcgcaagaagaaguccgcccaggagcgcucccaggccgaggaggagaucgacgagauccgcaaguccuaccaggaggagcucgacaagcuccgccagcuccucaagaagacccgcgucuccaccgaccaggccgccgccgagcagcucucccucguccaggccgagcuccagacccagugggaggccaagugcgagcaccuccucgccuccgccaaggacgagcaccuccagcaguaccaggaggucugcgcccagcgcgacgccuaccagcagaagcucguccagcuccaggagaagugccucgcccuccaggcccagaucaccgcccucaccaagcagaacgagcagcacaucaaggagcucgagaagaacaagucccagauguccggcgucgaggccgccgccuccgaccccuccgagaaggucaagaagaucaugaaccaggucuuccagucccuccgccgcgaguucgagcucgaggaguccuacaacggccgcaccauccucggcaccaucaugaacaccaucaagauggucacccuccagcuccucaaccagcaggagcaggagaaggaggaguccuccuccgaggaggaggaggagaaggccgaggagcgcccccgccgccccucccaggagcaguccgccuccgccuccuccggccagccccaggccccccucaaccgcgagcgccccgagucccccaugguccccuccgagcaggucgucgaggaggccgucccccuccccccccaggcccucaccaccucccaggacggccaccgccgcaagggcgacuccgaggccgaggcccucuccgagaucaaggacggcucccucccccccgagcucuccugcauccccucccaccgcguccucggcccccccaccuccaucccccccgagccccucggccccgucuccauggacuccgagugcgaggagucccucgccgccucccccauggccgccaagcccgacaaccccuccggcaaggucugcguccgcgaggucgcccccgacggcccccuccaggaguccuccacccgccucucccucaccuccgaccccgaggagggcgacccccucgcccucggccccgagucccccggcgagccccagcccccccagcucaagaaggacgacgucaccuccuccaccggcccccacaaggagcucuccuccaccgaggccggcuccaccgucgccggcgccgcccuccgccccucccaccacucccagcgcuccucccucuccggcgacgaggaggacgagcucuucaagggcgccacccucaaggcccuccgccccaaggcccagcccgaggaggaggacgaggacgaggucuccaugaagggccgccccccccccaccccccucuucggcgacgacgacgacgacgacgacaucgacuggcucggcuga

SEQ ID NO: 43241 - RNA, 327 nt, Artificial Sequence
  derived and/or modified sequence opt2 from FKBP1A__Homo_sapiens__NP_000792
augggcguccaggucgagaccaucucccccggcgacggccgcaccuuccccaagcgcggccagaccugcgucguccacuacaccggcaugcucgaggacggcaagaaguucgacuccucccgcgaccgcaacaagcccuucaaguucaugcucggcaagcaggaggucauccgcggcugggaggagggcgucgcccagauguccgucggccagcgcgccaagcucaccaucucccccgacuacgccuacggcgccaccggccaccccggcaucauccccccccacgccacccucgucuucgacgucgagcuccucaagcucgaguga

SEQ ID NO: 43242 - RNA, 327 nt, Artificial Sequence
  derived and/or modified sequence opt2 from FKBP1B__Homo_sapiens__NP_004107
augggcgucgagaucgagaccaucucccccggcgacggccgcaccuuccccaagaagggccagaccugcgucguccacuacaccggcaugcuccagaacggcaagaaguucgacuccucccgcgaccgcaacaagcccuucaaguuccgcaucggcaagcaggaggucaucaagggcuucgaggagggcgccgcccagaugucccucggccagcgcgccaagcucaccugcacccccgacgucgccuacggcgccaccggccaccccggcgucaucccccccaacgccacccucaucuucgacgucgagcuccucaaccucgaguga

SEQ ID NO: 43243 - RNA, 429 nt, Artificial Sequence
  derived and/or modified sequence opt2 from FKBP2__Homo_sapiens__NP_004461
augcgccucuccugguuccgcguccucaccguccucuccaucugccucuccgccgucgccaccgccaccggcgccgagggcaagcgcaagcuccagaucggcgucaagaagcgcgucgaccacugccccaucaagucccgcaagggcgacguccuccacaugcacuacaccggcaagcucgaggacggcaccgaguucgacuccucccucccccagaaccagcccuucgucuucucccucggcaccggccaggucaucaagggcugggaccagggccuccucggcaugugcgagggcgagaagcgcaagcucgucauccccuccgagcucggcuacggcgagcgcggcgccccccccaagauccccggcggcgccacccucgucuucgaggucgagcuccucaagaucgagcgccgcaccgagcucuga

SEQ ID NO: 43244 - RNA, 675 nt, Artificial Sequence
  derived and/or modified sequence opt2 from FKBP3__Homo_sapiens__NP_002004
auggccgccgccgucccccagcgcgccuggaccgucgagcagcuccgcuccgagcagcuccccaagaaggacaucaucaaguuccuccaggagcacggcuccgacuccuuccucgccgagcacaagcuccucggcaacaucaagaacgucgccaagaccgccaacaaggaccaccucgucaccgccuacaaccaccucuucgagaccaagcgcuucaagggcaccgaguccaucuccaaggucuccgagcaggucaagaacgucaagcucaacgaggacaagcccaaggagaccaaguccgaggagacccucgacgagggcccccccaaguacaccaaguccguccucaagaagggcgacaagaccaacuuccccaagaagggcgacgucguccacugcugguacaccggcacccuccaggacggcaccgucuucgacaccaacauccagaccuccgccaagaagaagaagaacgccaagccccucuccuucaaggucggcgucggcaaggucauccgcggcugggacgaggcccuccucaccauguccaagggcgagaaggcccgccucgagaucgagcccgagugggccuacggcaagaagggccagcccgacgccaagaucccccccaacgccaagcucaccuucgaggucgagcucgucgacaucgacuga

SEQ ID NO: 43245 - RNA, 1380 nt, Artificial Sequence
  derived and/or modified sequence opt2 from FKBP4__Homo_sapiens__NP_002005
augaccgccgaggagaugaaggccaccgaguccggcgcccaguccgccccccuccccauggagggcgucgacaucucccccaagcaggacgagggcguccucaaggucaucaagcgcgagggcaccggcaccgagaugcccaugaucggcgaccgcgucuucguccacuacaccggcuggcuccucgacggcaccaaguucgacuccucccucgaccgcaaggacaaguucuccuucgaccucggcaagggcgaggucaucaaggccugggacaucgccaucgccaccaugaaggucggcgaggucugccacaucaccugcaagcccgaguacgccuacggcuccgccggcuccccccccaagaucccccccaacgccacccucgucuucgaggucgagcucuucgaguucaagggcgaggaccucaccgaggaggaggacggcggcaucauccgccgcauccagacccgcggcgagggcuacgccaagcccaacgagggcgccaucgucgaggucgcccucgagggcuacuacaaggacaagcucuucgaccagcgcgagcuccgcuucgagaucggcgagggcgagaaccucgaccuccccuacggccucgagcgcgccauccagcgcauggagaagggcgagcacuccaucgucuaccucaagcccuccuacgccuucggcuccgucggcaaggagaaguuccagaucccccccaacgccgagcucaaguacgagcuccaccucaaguccuucgagaaggccaaggaguccugggagaugaacuccgaggagaagcucgagcaguccaccaucgucaaggagcgcggcaccgucuacuucaaggagggcaaguacaagcaggcccuccuccaguacaagaagaucgucuccuggcucgaguacgaguccuccuucuccaacgaggaggcccagaaggcccaggcccuccgccucgccucccaccucaaccucgccaugugccaccucaagcuccaggccuucuccgccgccaucgaguccugcaacaaggcccucgagcucgacuccaacaacgagaagggccucuuccgccgcggcgaggcccaccucgccgucaacgacuucgagcucgcccgcgccgacuuccagaagguccuccagcucuaccccaacaacaaggccgccaagacccagcucgccgucugccagcagcgcauccgccgccagcucgcccgcgagaagaagcucuacgccaacauguucgagcgccucgccgaggaggagaacaaggccaaggccgaggccuccuccggcgaccaccccaccgacaccgagaugaaggaggagcagaaguccaacaccgccggcucccagucccaggucgagaccgaggccuga

SEQ ID NO: 43246 - RNA, 1374 nt, Artificial Sequence
  derived and/or modified sequence opt2 from FKBP5__Homo_sapiens__NP_001139247
augaccaccgacgagggcgccaagaacaacgaggagucccccaccgccaccgucgccgagcagggcgaggacaucaccuccaagaaggaccgcggcguccucaagaucgucaagcgcgucggcaacggcgaggagacccccaugaucggcgacaaggucuacguccacuacaagggcaagcucuccaacggcaagaaguucgacuccucccacgaccgcaacgagcccuucgucuucucccucggcaagggccaggucaucaaggccugggacaucggcgucgccaccaugaagaagggcgagaucugccaccuccucugcaagcccgaguacgccuacggcuccgccggcucccuccccaagauccccuccaacgccacccucuucuucgagaucgagcuccucgacuucaagggcgaggaccucuucgaggacggcggcaucauccgccgcaccaagcgcaagggcgagggcuacuccaaccccaacgagggcgccaccgucgagauccaccucgagggccgcugcggcggccgcauguucgacugccgcgacgucgccuucaccgucggcgagggcgaggaccacgacauccccaucggcaucgacaaggcccucgagaagaugcagcgcgaggagcagugcauccucuaccucggcccccgcuacggcuucggcgaggccggcaagcccaaguucggcaucgagcccaacgccgagcucaucuacgaggucacccucaaguccuucgagaaggccaaggaguccugggagauggacaccaaggagaagcucgagcaggccgccaucgucaaggagaagggcaccgucuacuucaagggcggcaaguacaugcaggccgucauccaguacggcaagaucgucuccuggcucgagauggaguacggccucuccgagaaggaguccaaggccuccgaguccuuccuccucgccgccuuccucaaccucgccaugugcuaccucaagcuccgcgaguacaccaaggccgucgagugcugcgacaaggcccucggccucgacuccgccaacgagaagggccucuaccgccgcggcgaggcccagcuccucaugaacgaguucgaguccgccaagggcgacuucgagaagguccucgaggucaacccccagaacaaggccgcccgccuccagaucuccaugugccagaagaaggccaaggagcacaacgagcgcgaccgccgcaucuacgccaacauguucaagaaguucgccgagcaggacgccaaggaggaggccaacaaggccaugggcaagaagaccuccgagggcgucaccaacgagaagggcaccgacucccaggccauggaggaggagaagcccgagggccacgucuga

SEQ ID NO: 43247 - RNA, 969 nt, Artificial Sequence
  derived and/or modified sequence opt2 from FKBP6__Homo_sapiens__NP_001128683
auguccgccuccuccuggccccagaacggcaugccccccuccucccucuacgagcgccucucccagcgcaugcucgacaucuccggcgaccgcggcguccucaaggacgucauccgcgagggcgccggcgaccucgucgcccccgacgccuccguccucgucaaguacuccggcuaccucgagcacauggaccgccccuucgacuccaacuacuuccgcaagaccccccgccucaugaagcucggcgaggacaucacccucuggggcauggagcucggccuccucuccaugcgccgcggcgagcucgcccgcuuccucuucaagcccaacuacgccuacggcacccucggcugccccccccucaucccccccaacaccaccguccucuucgagaucgagcuccucgacuuccucgacugcgccgaguccgacaaguucugcgcccucuccgccgagcagcaggaccaguucccccuccagaagguccucaaggucgccgccaccgagcgcgaguucggcaacuaccucuuccgccagaaccgcuucuacgacgccaagguccgcuacaagcgcgcccuccuccuccuccgccgccgcuccgccccccccgaggagcagcaccucgucgaggccgccaagcuccccguccuccucaaccucuccuucaccuaccucaagcucgaccgccccaccaucgcccucugcuacggcgagcaggcccucaucaucgaccagaagaacgccaaggcccucuuccgcugcggccaggccugccuccuccucaccgaguaccagaaggcccgcgacuuccucguccgcgcccagaaggagcagcccuucaaccacgacaucaacaacgagcucaagaagcucgccuccugcuaccgcgacuacgucgacaaggagaaggagauguggcaccgcauguucgcccccugcggcgacggcuccaccgccggcgaguccuga

SEQ ID NO: 43248 - RNA, 666 nt, Artificial Sequence
  derived and/or modified sequence opt2 from FKBP7__Homo_sapiens__NP_001128684
augcccaagaccaugcacuuccucuuccgcuucaucgucuucuucuaccucuggggccucuucaccgcccagcgccagaagaaggaggaguccaccgaggaggucaagaucgagguccuccaccgccccgagaacugcuccaagaccuccaagaagggcgaccuccucaacgcccacuacgacggcuaccucgccaaggacggcuccaaguucuacugcucccgcacccagaacgagggccaccccaagugguucguccucggcgucggccaggucaucaagggccucgacaucgccaugaccgacaugugccccggcgagaagcgcaaggucgucaucccccccuccuucgccuacggcaaggagggcuacgagggcaagaucccccccgacgccacccucaucuucgagaucgagcucuacgccgucaccaagggcccccgcuccaucgagaccuucaagcagaucgacauggacaacgaccgccagcucuccaaggccgagaucaaccucuaccuccagcgcgaguucgagaaggacgagaagccccgcgacaaguccuaccaggacgccguccucgaggacaucuucaagaagaacgaccacgacggcgacggcuucaucucccccaaggaguacaacgucuaccagcacgacgagcucuga

SEQ ID NO: 43249 - RNA, 1242 nt, Artificial Sequence
  derived and/or modified sequence opt2 from FKBP8__Homo_sapiens__NP_036313
auggccuccugcgccgagcccuccgagcccuccgccccccuccccgccggcguccccccccucgaggacuucgagguccucgacggcgucgaggacgccgagggcgaggaggaggaggaggaggaggaggaggaggaggacgaccucuccgagcuccccccccucgaggacaugggccagccccccgccgaggaggccgagcagcccggcgcccucgcccgcgaguuccucgccgccauggagcccgagcccgcccccgcccccgcccccgaggaguggcucgacauccucggcaacggccuccuccgcaagaagacccucguccccggcccccccggcuccucccgccccgucaagggccaggucgucaccguccaccuccagaccucccucgagaacggcacccgcguccaggaggagcccgagcucgucuucacccucggcgacugcgacgucauccaggcccucgaccucuccgucccccucauggacgucggcgagaccgccauggucaccgccgacuccaaguacugcuacggcccccagggcucccgcucccccuacauccccccccacgccgcccucugccucgaggucacccucaagaccgccgucgacggccccgaccucgagaugcucaccggccaggagcgcgucgcccucgccaaccgcaagcgcgagugcggcaacgcccacuaccagcgcgccgacuucguccucgccgccaacuccuacgaccucgccaucaaggccaucaccuccuccgccaaggucgacaugaccuucgaggaggaggcccagcuccuccagcucaaggucaagugccucaacaaccucgccgccucccagcucaagcucgaccacuaccgcgccgcccuccgcuccugcucccucguccucgagcaccagcccgacaacaucaaggcccucuuccgcaagggcaagguccucgcccagcagggcgaguacuccgaggccauccccauccuccgcgccgcccucaagcucgagcccuccaacaagaccauccacgccgagcucuccaagcucgucaagaagcacgccgcccagcgcuccaccgagaccgcccucuaccgcaagaugcucggcaaccccucccgccuccccgccaagugccccggcaagggcgccugguccauccccuggaaguggcucuucggcgccaccgccgucgcccucggcggcgucgcccucuccgucgucaucgccgcccgcaacuga

SEQ ID NO: 43250 - RNA, 1872 nt, Artificial Sequence
  derived and/or modified sequence opt2 from FKBP9__Homo_sapiens__NP_001271270
auggccuuccgcggcuggcgcccccccccccccccccuccuccuccuccuccucugggucaccggccaggccgcccccgucgccggccucggcuccgacgccgagcuccagaucgagcgccgcuucguccccgacgagugcccccgcaccguccgcuccggcgacuucguccgcuaccacuacgucggcaccuuccccgacggccagaaguucgacucccgcuacugggacaccgccgaggacaaggccgacaagucccccugcccccagguccgcgucggcgucaacaccucccccuccugccgccucaagcagaagggcgucggcaucuacuggaaggaccuccaguuccucguccgcguccagaaccacggccucuccuacgaccgcgacuccaccuucaacgucuucgucggcaagggccagcucaucaccggcauggaccaggcccucgucggcaugugcgucaacgagcgccgcuucgucaagaucccccccaagcucgccuacggcaacgagggcgucuccggcgucaucccccccaacuccguccuccacuucgacguccuccucauggacaucuggaacuccgaggaccagguccagauccacaccuacuucaagccccccuccugcccccgcaccauccaggucuccgacuucguccgcuaccacuacaacggcaccuuccucgacggcacccucuucgacuccucccacaaccgcaugaagaccuacgacaccuacgucggcaucggcuggcucauccccggcauggacaagggccuccucggcaugugcgucggcgagaagcgcaucaucaccaucccccccuuccucgccuacggcgaggacggcgacggcaaggacauccccggccaggccucccucgucuucgacgucgcccuccucgaccuccacaaccccaaggacuccaucuccaucgagaacaaggucguccccgagaacugcgagcgcaucucccaguccggcgacuuccuccgcuaccacuacaacggcacccuccucgacggcacccucuucgacuccuccuacucccgcaaccgcaccuucgacaccuacaucggccagggcuacgucauccccggcauggacgagggccuccucggcgucugcaucggcgagaagcgccgcaucgucguccccccccaccucggcuacggcgaggagggccgcggcaacauccccggcuccgccguccucgucuucgacauccacgucaucgacuuccacaaccccuccgacuccaucuccaucaccucccacuacaagccccccgacugcuccguccucuccaagaagggcgacuaccucaaguaccacuacaacgccucccuccucgacggcacccuccucgacuccaccuggaaccucggcaagaccuacaacaucguccucggcuccggccaggucguccucggcauggacaugggccuccgcgagaugugcgucggcgagaagcgcaccgucaucauccccccccaccucggcuacggcgaggccggcgucgacggcgagguccccggcuccgccguccucgucuucgacaucgagcuccucgagcucgucgccggccuccccgagggcuacauguucaucuggaacggcgaggucucccccaaccucuucgaggagaucgacaaggacggcaacggcgagguccuccucgaggaguucuccgaguacauccacgcccaggucgccuccggcaagggcaagcucgcccccggcuucgacgccgagcucaucgucaagaacauguucaccaaccaggaccgcaacggcgacggcaaggucaccgccgaggaguucaagcucaaggaccaggaggccaagcacgacgagcucuga

SEQ ID NO: 43251 - RNA, 1050 nt, Artificial Sequence
  derived and/or modified sequence opt2 from FKBPL__Homo_sapiens__NP_071393
auggagaccccccccgucaacaccaucggcgagaaggacaccucccagccccagcaggagugggagaagaaccuccgcgagaaccucgacuccgucauccagauccgccagcagccccgcgacccccccaccgagacccucgagcucgaggucucccccgaccccgccucccagauccucgagcacacccagggcgccgagaagcucgucgccgagcucgagggcgacucccacaagucccacggcuccaccucccagaugcccgaggcccuccaggccuccgaccucugguacugccccgacggcuccuucgucaagaagaucgucauccgcggccacggccucgacaagcccaagcucggcuccugcugccgcguccucgcccucggcuuccccuucggcuccggcccccccgagggcuggaccgagcucaccaugggcgucggccccuggcgcgaggagaccuggggcgagcucaucgagaagugccucgaguccaugugccagggcgaggaggccgagcuccagcuccccggccacuccggcccccccguccgccucacccucgccuccuucacccagggccgcgacuccugggagcucgagaccuccgagaaggaggcccucgcccgcgaggagcgcgcccgcggcaccgagcucuuccgcgccggcaaccccgagggcgccgcccgcugcuacggccgcgcccuccgccuccuccucacccuccccccccccggcccccccgagcgcaccguccuccacgccaaccucgccgccugccagcuccuccucggccagccccagcucgccgcccaguccugcgaccgcguccucgagcgcgagcccggccaccucaaggcccucuaccgccgcggcgucgcccaggccgcccucggcaaccucgagaaggccaccgccgaccucaagaagguccucgccaucgaccccaagaaccgcgccgcccaggaggagcucggcaaggucgucauccagggcaagaaccaggacgccggccucgcccagggccuccgcaagauguucggcuga

SEQ ID NO: 43252 - RNA, 1488 nt, Artificial Sequence
  derived and/or modified sequence opt2 from FKRP__Homo_sapiens__XP_011525609
augcgccucacccgcugccaggccgcccucgccgccgccaucacccucaaccuccucguccucuucuacgucuccuggcuccagcaccagccccgcaacucccgcgcccgcggcccccgccgcgccuccgccgccggcccccgcgucaccguccucguccgcgaguucgaggccuucgacaacgccguccccgagcucgucgacuccuuccuccagcaggaccccgcccagcccgucgucgucgccgccgacacccuccccuaccccccccucgcccucccccgcauccccaacguccgccucgcccuccuccagcccgcccucgaccgccccgccgccgccucccgccccgagaccuacgucgccaccgaguucgucgcccucguccccgacggcgcccgcgccgaggcccccggccuccucgagcgcauggucgaggcccuccgcgccggcuccgcccgccucgucgccgcccccgucgccaccgccaaccccgcccgcugccucgcccucaacgucucccuccgcgaguggaccgcccgcuacggcgccgcccccgccgccccccgcugcgacgcccucgacggcgacgccgucguccuccuccgcgcccgcgaccucuucaaccucuccgccccccucgcccgccccgucggcaccucccucuuccuccagaccgcccuccgcggcugggccguccagcuccucgaccucaccuucgccgccgcccgccagcccccccucgccaccgcccacgcccgcuggaaggccgagcgcgagggccgcgcccgccgcgccgcccuccuccgcgcccucggcauccgccucgucuccugggagggcggccgccucgagugguucggcugcaacaaggagaccacccgcugcuucggcaccgucgucggcgacacccccgccuaccucuacgaggagcgcuggaccccccccugcugccuccgcgcccuccgcgagaccgcccgcuacgucgucggcguccucgaggccgccggcguccgcuacuggcucgagggcggcucccuccucggcgccgcccgccacggcgacaucauccccugggacuacgacgucgaccucggcaucuaccucgaggacgucggcaacugcgagcagcuccgcggcgccgaggccggcuccgucgucgacgagcgcggcuucgucugggagaaggccgucgagggcgacuucuuccgcguccaguacuccgaguccaaccaccuccacgucgaccucuggcccuucuacccccgcaacggcgucaugaccaaggacaccuggcucgaccaccgccaggacgucgaguuccccgagcacuuccuccagccccucgucccccuccccuucgccggcuucgucgcccaggcccccaacaacuaccgccgcuuccucgagcucaaguucggccccggcgucaucgagaacccccaguaccccaaccccgcccuccucucccucaccggcuccggcuga

SEQ ID NO: 43253 - RNA, 1386 nt, Artificial Sequence
  derived and/or modified sequence opt2 from FKTN__Homo_sapiens__NP_001073270
augucccgcaucaacaagaacgucguccucgcccuccucacccucaccuccuccgccuuccuccucuuccagcucuacuacuacaagcacuaccucuccaccaagaacggcgccggccucuccaaguccaagggcucccgcaucggcuucgacuccacccaguggcgcgccgucaagaaguucaucaugcucaccuccaaccagaacguccccgucuuccucaucgacccccucauccucgagcucaucaacaagaacuucgagcaggucaagaacaccucccacggcuccaccucccagugcaaguucuucugcgucccccgcgacuucaccgccuucgcccuccaguaccaccucuggaagaacgaggagggcugguuccgcaucgccgagaacaugggcuuccagugccucaagaucgaguccaaggacccccgccucgacggcaucgacucccucuccggcaccgagaucccccuccacuacaucugcaagcucgccacccacgccauccaccucgucgucuuccacgagcgcuccggcaacuaccucuggcacggccaccuccgccucaaggagcacaucgaccgcaaguucguccccuuccgcaagcuccaguucggccgcuaccccggcgccuucgaccgccccgagcuccagcaggucaccgucgacggccucgagguccucauccccaaggaccccaugcacuucgucgaggaggucccccacucccgcuucaucgagugccgcuacaaggaggcccgcgccuucuuccagcaguaccucgacgacaacaccgucgaggccgucgccuuccgcaaguccgccaaggagcuccuccagcucgccgccaagacccucaacaagcucggcguccccuucuggcucuccuccggcaccugccucggcugguaccgccagugcaacaucauccccuacuccaaggacgucgaccucggcaucuucauccaggacuacaaguccgacaucauccucgccuuccaggacgccggccucccccucaagcacaaguucggcaaggucgaggacucccucgagcucuccuuccagggcaaggacgacgucaagcucgacgucuucuucuucuacgaggagaccgaccacauguggaacggcggcacccaggccaagaccggcaagaaguucaaguaccucuuccccaaguucacccucugcuggaccgaguucgucgacaugaagguccacguccccugcgagacccucgaguacaucgaggccaacuacggcaagaccuggaagauccccgucaagaccugggacuggaagcgcuccccccccaacguccagcccaacggcaucuggcccaucuccgagugggacgaggucauccagcucuacuga

SEQ ID NO: 43254 - RNA, 1341 nt, Artificial Sequence
  derived and/or modified sequence opt2 from FLAD1__Homo_sapiens__NP_001171820
augaccucccgcgccuccgagcucucccccggccgcuccgucaccgccggcaucaucaucgucggcgacgagauccucaagggccacacccaggacaccaacaccuucuuccucugccgcacccuccgcucccucggcguccaggucugccgcgucuccgucguccccgacgaggucgccaccaucgccgccgaggucaccuccuucuccaaccgcuucacccacguccucaccgccggcggcaucggccccacccacgacgacgucaccuucgaggccgucgcccaggccuucggcgacgagcucaagccccaccccaagcucgaggccgccaccaaggcccucggcggcgagggcugggagaagcucucccucguccccuccuccgcccgccuccacuacggcaccgaccccugcaccggccagcccuuccgcuucccccucgucuccguccgcaacgucuaccucuuccccggcauccccgagcuccuccgccgcguccucgagggcaugaagggccucuuccagaaccccgccguccaguuccacuccaaggagcucuacgucgccgccgacgaggccuccaucgcccccauccucgccgaggcccaggcccacuucggccgccgccucggccucggcuccuaccccgacuggggcuccaacuacuaccaggucaagcucacccucgacuccgaggaggagggcccccucgaggagugccucgccuaccucaccgcccgccucccccagggcucccucguccccuacaugcccaacgccgucgagcaggccuccgaggccgucuacaagcucgccgaguccggcuccucccucggcaagaaggucgccggcgcccuccagaccaucgagaccucccucgcccaguacucccucacccagcucugcgucggcuucaacggcggcaaggacugcaccgcccuccuccaccucuuccacgccgccguccagcgcaagcuccccgacguccccaacccccuccagauccucuacauccgcuccaucucccccuuccccgagcucgagcaguuccuccaggacaccaucaagcgcuacaaccuccagaugcucgaggccgagggcuccaugaagcaggcccucggcgagcuccaggcccgccacccccagcucgaggccguccucaugggcacccgccgcaccgaccccuacuccugcucccucugccccuucucccccaccgaccccggcuggcccgccuucaugcgcaucaacccccuccucgacuggaccuaccgcgacaucugggacuuccuccgccagcucuucguccccuacugcauccucuacgaccgcggcuga

SEQ ID NO: 43255 - RNA, 1029 nt, Artificial Sequence
  derived and/or modified sequence opt2 from FLCN__Homo_sapiens__NP_653207
augaacgccaucgucgcccucugccacuucugcgagcuccacggcccccgcacccucuucugcaccgagguccuccacgccccccucccccagggcgacggcaacgaggacucccccggccagggcgagcaggccgaggaggaggagggcggcauccagaugaacucccgcaugcgcgcccacucccccgccgagggcgccuccgucgaguccuccucccccggccccaagaaguccgacaugugcgagggcugccgcucccucgccgccggccaccccggcuacaucucccacgacaaggagaccuccaucaaguacgucucccaccagcaccccucccacccccagcucuucuccaucguccgccaggccugcguccgcucccucuccugcgaggucugccccggccgcgagggccccaucuucuucggcgacgagcagcacggcuucgucuucucccacaccuucuucaucaaggacucccucgcccgcggcuuccagcgcugguacuccaucaucaccaucaugauggaccgcaucuaccucaucaacuccuggcccuuccuccucggcaagguccgcggcaucaucgacgagcuccagggcaaggcccucaaggucuucgaggccgagcaguucggcugcccccagcgcgcccagcgcaugaacaccgccuucacccccuuccuccaccagcgcaacggcaacgccgcccgcucccucaccucccucaccuccgacgacaaccucugggccugccuccacaccuccuucgccuggcuccucaaggccugcggcucccgccucaccgagaagcuccucgagggcgcccccaccgaggacacccucguccagauggagaagcucgccggcgaggccggcguccuccuccccggccccuggcccggcuggcccuggggcggcaccuccugccuccucuccuggcaggagucccuccgcgagggcaacgccgcccucaaccagccccgcaccucccuccgcgaggcccacccccccaucuccgucuga

SEQ ID NO: 43256 - RNA, 7176 nt, Artificial Sequence
  derived and/or modified sequence opt2 from FLG2__Homo_sapiens__NP_001014364
augaccgaccuccuccgcuccgucgucaccgucaucgacgucuucuacaaguacaccaagcaggacggcgagugcggcacccucuccaagggcgagcucaaggagcuccucgagaaggagcuccaccccguccucaagaaccccgacgaccccgacaccgucgacgucaucaugcacaugcucgaccgcgaccacgaccgccgccucgacuucaccgaguuccuccucaugaucuucaagcucaccauggccugcaacaagguccucuccaaggaguacugcaaggccuccggcuccaagaagcaccgccgcggccaccgccaccaggaggaggaguccgagaccgaggaggacgaggaggacacccccggccacaaguccggcuaccgccacuccuccugguccgagggcgaggagcacggcuacuccuccggccacucccgcggcaccgucaagugccgccacggcuccaacucccgccgccucggccgccagggcaaccucuccuccuccggcaaccaggagggcucccagaagcgcuaccaccgcuccuccugcggccacuccugguccggcggcaaggaccgccacggcuccuccuccgucgagcuccgcgagcgcaucaacaagucccacaucucccccucccgcgaguccggcgaggaguacgaguccggcuccggcuccaacuccugggagcgcaagggccacggcggccucuccugcggccucgagaccuccggccacgaguccaacuccacccagucccgcauccgcgagcagaagcucggcuccuccugcuccggcuccggcgacuccggccgccgcucccacgccugcggcuacuccaacuccuccggcugcggccgcccccagaacgccuccuccuccugccagucccaccgcuucggcggccagggcaaccaguucuccuacauccaguccggcugccaguccggcaucaagggcggccagggccacggcugcgucuccggcggccagcccuccggcugcggccagcccgaguccaaccccugcucccaguccuacucccagcgcggcuacggcgcccgcgagaacggccagccccagaacugcggcggccaguggcgcaccggcuccucccaguccuccugcugcggccaguacggcuccggcggcucccaguccugcuccaacggccagcacgaguacggcuccugcggccgcuucuccaacuccuccuccuccaacgaguucuccaagugcgaccaguacggcuccggcuccucccaguccaccuccuucgagcagcacggcaccggccucucccaguccuccggcuucgagcagcacgucugcggcuccggccagaccugcggccagcacgaguccaccuccucccagucccucggcuacgaccagcacggcuccuccuccggcaagaccuccggcuucggccagcacggcuccggcuccggccaguccuccggcuucggccagugcggcuccggcuccggccaguccuccggcuucggccagcacggcuccgucuccggccaguccuccggcuucggccagcacggcuccgucuccggccaguccuccggcuucggccagcacgagucccgcucccgccaguccuccuacggccagcacggcuccggcuccucccaguccuccggcuacggccaguacggcucccgcgagaccuccggcuucggccagcacggccucggcuccggccaguccaccggcuucggccaguacggcuccggcuccggccaguccuccggcuucggccagcacggcuccggcuccggccaguccuccggcuucggccagcacgagucccgcuccggccaguccuccuacggccagcacuccuccggcuccucccaguccuccggcuacggccagcacggcucccgccagaccuccggcuucggccagcacggcuccggcuccucccaguccaccggcuucggccaguacggcuccggcuccggccaguccuccggcuucggccagcacgucuccggcuccggccaguccuccggcuucggccagcacgagucccgcuccggccacuccuccuacggccagcacggcuucggcuccucccaguccuccggcuacggccagcacggcuccuccuccggccagaccuccggcuucggccagcacgagcucuccuccggccaguccuccuccuucggccagcacggcuccggcuccggccaguccuccggcuucggccagcacggcuccggcuccggccaguccuccggcuucggccagcacgagucccgcuccggccaguccuccuacggccagcacuccuccggcuccucccaguccuccggcuacggccagcacggcucccgccagaccuccggcuucggccagcacggcuccggcuccucccaguccaccggcuucggccaguacggcuccggcuccggccaguccgccggcuucggccagcacggcuccggcuccggccaguccuccggcuucggccagcacgagucccgcucccaccaguccuccuacggccagcacggcuccggcuccucccaguccuccggcuacggccagcacggcuccuccuccggccagaccuccggcuucggccagcaccgcuccuccuccggccaguacuccggcuucggccagcacggcuccggcuccggccaguccuccggcuucggccagcacggcaccggcuccggccaguacuccggcuucggccagcacgagucccgcucccaccaguccuccuacggccagcacggcuccggcuccucccaguccuccggcuacggccagcacggcuccuccuccggccagaccuucggcuucggccagcaccgcuccggcuccggccaguccuccggcuucggccagcacggcuccggcuccggccaguccuccggcuucggccagcacgaguccggcuccggcaaguccuccggcuucggccagcacgagucccgcuccucccaguccaacuacggccagcacggcuccggcuccucccaguccuccggcuacggccagcacggcuccuccuccggccagaccaccggcuucggccagcaccgcuccuccuccggccaguacuccggcuucggccagcacggcuccggcuccgaccaguccuccggcuucggccagcacggcaccggcuccggccaguccuccggcuucggccaguacgagucccgcucccgccaguccuccuacggccagcacggcuccggcuccucccaguccuccggcuacggccagcacggcuccaacuccggccagaccuccggcuucggccagcaccgccccggcuccggccaguccuccggcuucggccaguacggcuccggcuccggccaguccuccggcuucggccagcacggcuccggcaccggcaaguccuccggcuucgcccagcacgaguaccgcuccggccaguccuccuacggccagcacggcaccggcuccucccaguccuccggcugcggccagcacgaguccggcuccggccccaccaccuccuucggccagcacgucuccggcuccgacaacuucuccuccuccggccagcacaucuccgacuccggccaguccaccggcuucggccaguacggcuccggcuccggccaguccaccggccucggccagggcgagucccagcaggucgaguccggcuccaccguccacggccgccaggagaccacccacggccagaccaucaacaccacccgccacucccaguccggccagggccaguccacccagaccggcucccgcgucacccgccgccgccgcuccucccaguccgagaacuccgacuccgagguccacuccaaggucucccaccgccacuccgagcacauccacacccaggccggcucccacuaccccaaguccggcuccaccguccgccgccgccagggcaccacccacggccagcgcggcgacaccacccgccacggccacuccggccacggccaguccacccagaccggcucccgcaccuccggccgccagcgcuucucccacuccgacgccaccgacuccgagguccacuccggcgucucccaccgcccccacucccaggagcagacccacucccaggccggcucccagcacggcgaguccgaguccaccguccacgagcgccacgagaccaccuacggccagaccggcgaggccaccggccacggccacuccggccacggccaguccacccagcgcggcucccgcaccaccggccgccgcggcuccggccacuccgaguccuccgacuccgagguccacuccggcggcucccaccgcccccagucccaggagcagacccacggccaggccggcucccagcacggcgaguccggcuccaccguccacggccgccacggcaccacccacggccagaccggcgacaccacccgccacgcccacuaccaccacggcaaguccacccagcgcggcuccuccaccaccggccgccgcggcuccggccacuccgaguccuccgacuccgagguccacuccggcggcucccacacccacuccggccacacccacggccaguccggcucccagcacggcgaguccgaguccaucauccacgaccgccaccgcaucacccacggccagaccggcgacaccacccgccacuccuacuccggccacgagcagaccacccagaccggcucccgcaccaccggccgccagcgcaccucccacuccgaguccaccgacuccgagguccacuccggcggcucccaccgcccccacucccgcgagcacaccuacggccaggccggcucccagcacgaggagcccgaguucaccguccacgagcgccacggcaccacccacggccagaucggcgacaccaccggccacucccacuccggccacggccaguccacccagcgcggcucccgcaccaccggccgccagcgcuccucccacuccgaguccuccgacuccgagguccacuccggcgucucccacacccacaccggccacacccacggccaggccggcucccagcacggccaguccgaguccaucguccccgagcgccacggcaccacccacggccagaccggcgacaccacccgccacgcccacuaccaccacggccucaccacccagaccggcucccgcaccaccggccgccgcggcuccggccacuccgaguacuccgacuccgagggcuacuccggcgucucccacacccacuccggccacacccacggccaggcccgcucccagcacggcgaguccgaguccaucguccacgagcgccacggcaccauccacggccagaccggcgacaccacccgccacgcccacuccggccacggccaguccacccagaccggcucccgcaccaccggccgccgcuccuccggccacuccgaguacuccgacuccgagggccacuccggcuucucccagcgcccccacucccgcggccacacccacggccaggccggcucccagcacggcgaguccgaguccaucgucgacgagcgccacggcaccacccacggccagaccggcgacaccuccggccacucccaguccggccacggccaguccacccaguccggcuccuccaccaccggccgccgccgcuccggccacuccgaguccuccgacuccgagguccacuccggcggcucccacacccacuccggccacacccacucccaggcccgcucccagcacggcgaguccgaguccaccguccacaagcgccaccagaccacccacggccagaccggcgacaccaccgagcacggccaccccucccacggccagaccauccagaccggcucccgcaccaccggccgccgcggcuccggccacuccgaguacuccgacuccgagggccccuccggcgucucccacacccacuccggccacacccacggccaggccggcucccacuaccccgaguccggcuccuccguccacgagcgccacggcaccacccacggccagaccgccgacaccacccgccacggccacuccggccacggccaguccacccagcgcggcucccgcaccaccggccgccgcgccuccggccacuccgaguacuccgacuccgagggccacuccggcgucucccacacccacuccggccacgcccacggccaggccggcucccagcacggcgaguccggcuccuccguccacgagcgccacggcaccacccacggccagaccggcgacaccacccgccacgcccacuccggccacggccaguccacccagcgcggcucccgcaccgccggccgccgcggcuccggccacuccgaguccuccgacuccgagguccacuccggcgucucccacacccacuccggccacaccuacggccaggcccgcucccagcacggcgaguccggcuccgccauccacggccgccagggcaccauccacggccagaccggcgacaccacccgccacggccaguccggccacggccaguccacccagaccggcucccgcaccaccggccgccagcgcuccucccacuccgaguccuccgacuccgagguccacuccgaggccucccccacccacuccggccacacccacucccaggccggcucccgccacggccaguccggcuccuccggccacggccgccagggcaccacccacggccagaccggcgacaccacccgccacgcccacuacggcuacggccaguccacccagcgcggcucccgcaccaccggccgccgcggcuccggccacuccgaguccuccgacuccgagguccacuccuggggcucccacacccacuccggccacauccagggccaggccggcucccagcagcgccagcccggcuccaccguccacggccgccucgagaccacccacggccagaccggcgacaccacccgccacggccacuccggcuacggccaguccacccagaccggcucccgcuccucccgcgccucccacuuccagucccacuccuccgagcgccagcgccacggcuccucccaggucuggaagcacggcuccuacggccccgccgaguacgacuacggccacaccggcuacggccccuccggcggcucccgcaaguccaucuccaacucccaccucuccugguccaccgacuccaccgccaacaagcagcucucccgccacuga

SEQ ID NO: 43257 - RNA, 12186 nt, Artificial Sequence
  derived and/or modified sequence opt2 from FLG__Homo_sapiens__NP_002007
auguccacccuccucgagaacaucuucgccaucaucaaccucuucaagcaguacuccaagaaggacaagaacaccgacacccucuccaagaaggagcucaaggagcuccucgagaaggaguuccgccagauccucaagaaccccgacgaccccgacauggucgacgucuucauggaccaccucgacaucgaccacaacaagaagaucgacuucaccgaguuccuccucauggucuucaagcucgcccaggccuacuacgaguccacccgcaaggagaaccuccccaucuccggccacaagcaccgcaagcacucccaccacgacaagcacgaggacaacaagcaggaggagaacaaggagaaccgcaagcgccccuccucccucgagcgccgcaacaaccgcaagggcaacaagggccgcuccaaguccccccgcgagaccggcggcaagcgccacgaguccuccuccgagaagaaggagcgcaagggcuacucccccacccaccgcgaggaggaguacggcaagaaccaccacaacuccuccaagaaggagaagaacaagaccgagaacacccgccucggcgacaaccgcaagcgccucuccgagcgccucgaggagaaggaggacaacgaggagggcgucuacgacuacgagaacaccggccgcaugacccagaaguggauccaguccggccacaucgccaccuacuacaccauccaggacgaggccuacgacaccaccgacucccuccucgaggagaacaagaucuacgagcgcucccgcuccuccgacggcaaguccuccucccaggucaaccgcucccgccacgagaacaccucccaggucccccuccaggagucccgcacccgcaagcgccgcggcucccgcgucucccaggaccgcgacuccgagggccacuccgaggacuccgagcgccacuccggcuccgccucccgcaaccaccacggcuccgccugggagcagucccgcgacggcucccgccacccccgcucccacgacgaggaccgcgccucccacggccacuccgccgacuccucccgccaguccggcacccgccacgccgagaccuccucccgcggccagaccgccuccucccacgagcaggcccgcuccucccccggcgagcgccacggcuccggccaccagcaguccgccgacuccucccgccacuccgccaccggccgcggccaggccuccuccgccgucuccgaccgcggccaccgcggcuccuccggcucccaggccuccgacuccgagggccacuccgagaacuccgacacccaguccgucuccggccacggcaaggccggccuccgccagcagucccaccaggaguccacccgcggccgcuccggcgagcgcuccggccgcuccggcuccucccucuaccaggucuccacccacgagcagcccgacuccgcccacggccgcaccggcaccuccaccggcggccgccagggcucccaccacgagcaggcccgcgacuccucccgccacuccgccucccaggagggccaggacaccauccgcggccaccccggcuccucccgcggcggccgccagggcucccaccacgagcaguccgucaaccgcuccggccacuccggcucccaccacucccacaccaccucccagggccgcuccgacgccucccacggccaguccggcucccgcuccgccucccgccagacccgcaacgaggagcaguccggcgacggcacccgccacuccggcucccgccaccacgaggccuccucccaggccgacuccucccgccacucccaggucggccagggccaguccuccggcccccgcaccucccgcaaccagggcuccuccgucucccaggacuccgacucccagggccacuccgaggacuccgagcgcugguccggcuccgccucccgcaaccaccacggcuccgcccaggagcagucccgcgacggcucccgccacccccgcucccaccacgaggaccgcgccggccacggccacuccgccgacuccucccgcaaguccggcacccgccacacccagaacuccuccuccggccaggccgccuccucccacgagcaggcccgcuccuccgccggcgagcgccacggcucccgccaccagcuccaguccgccgacuccucccgccacuccggcaccggccacggccaggccuccuccgccguccgcgacuccggccaccgcggcuccuccggcucccaggccaccgacuccgagggccacuccgaggacuccgacacccaguccgucuccggccacggccaggccggccaccaccagcagucccaccaggaguccgcccgcgaccgcuccggcgagcgcucccgccgcuccggcuccuuccucuaccaggucuccacccacaagcaguccgaguccucccacggcuggaccggccccuccaccggcguccgccagggcucccaccacgagcaggcccgcgacaacucccgccacuccgccucccaggacggccaggacaccauccgcggccaccccggcuccucccgccgcggccgccagggcucccaccacgagcaguccgucgaccgcuccggccacuccggcucccaccacucccacaccaccucccagggccgcuccgacgccucccgcggccaguccggcucccgcuccgccucccgcaccacccgcaacgaggagcagucccgcgacggcucccgccacuccggcucccgccaccacgaggccuccucccacgccgacaucucccgccacucccaggccggccagggccaguccgagggcucccgcaccucccgccgccagggcuccuccgucucccaggacuccgacuccgagggccacuccgaggacuccgagcgcugguccggcuccgccucccgcaaccaccgcggcuccgcccaggagcagucccgccacggcucccgccacccccgcucccaccacgaggaccgcgccggccacggccacuccgccgacuccucccgccaguccggcaccccccacgccgagaccuccuccggcggccaggccgccuccucccacgagcaggcccgcuccucccccggcgagcgccacggcucccgccaccagcaguccgccgacuccucccgccacuccggcaucccccgccgccaggccuccuccgccguccgcgacuccggccacuggggcuccuccggcucccaggccuccgacuccgagggccacuccgaggaguccgacacccaguccgucuccggccacggccaggacggcccccaccagcagucccaccaggaguccgcccgcgacugguccggcggccgcuccggccgcuccggcuccuucaucuaccaggucuccacccacgagcaguccgaguccgcccacggccgcacccgcaccuccaccggccgccgccagggcucccaccacgagcaggcccgcgacuccucccgccacuccgccucccaggagggccaggacaccauccgcgcccaccccggcucccgccgcggcggccgccagggcucccaccacgagcaguccgucgaccgcuccggccacuccggcucccaccacucccacaccaccucccagggccgcuccgacgccucccacggccaguccggcucccgcuccgccucccgccagacccgcaaggacaagcaguccggcgacggcucccgccacuccggcucccgccaccacgaggccgccuccugggccgacuccucccgccacucccaggucggccaggagcaguccuccggcucccgcaccucccgccaccagggcuccuccgucucccaggacuccgacuccgagcgccacuccgacgacuccgagcgccucuccggcuccgccucccgcaaccaccacggcuccucccgcgagcagucccgcgacggcucccgccaccccggcuuccaccaggaggaccgcgccucccacggccacuccgccgacuccucccgccaguccggcacccaccacaccgaguccuccucccacggccaggccgucuccucccacgagcaggcccgcuccucccccggcgagcgccacggcucccgccaccagcaguccgccgacuccucccgccacuccggcaucggccaccgccaggccuccuccgccguccgcgacuccggccaccgcggcuccuccggcucccaggucaccaacuccgagggccacuccgaggacuccgacacccaguccgucuccgcccacggccaggccggcccccaccagcagucccacaaggaguccgcccgcggccaguccggcgaguccuccggccgcucccgcuccuuccucuaccaggucuccucccacgagcaguccgaguccacccacggccagaccgcccccuccaccggcggccgccagggcucccgccacgagcaggcccgcaacuccucccgccacuccgccucccaggacggccaggacaccauccgcggccaccccggcuccucccgcggcggccgccagggcuccuaccacgagcaguccgucgaccgcuccggccacuccggcuaccaccacucccacaccaccccccagggccgcuccgacgccucccacggccaguccggcccccgcuccgccucccgccagacccgcaacgaggagcaguccggcgacggcucccgccacuccggcucccgccaccacgagcccuccacccgcgccggcuccucccgccacucccaggucggccagggcgaguccgccggcuccaagaccucccgccgccagggcuccuccgucucccaggaccgcgacuccgagggccacuccgaggacuccgagcgccgcuccgaguccgccucccgcaaccacuacggcuccgcccgcgagcagucccgccacggcucccgcaacccccgcucccaccaggaggaccgcgccucccacggccacuccgccgaguccucccgccaguccggcacccgccacgccgagaccuccuccggcggccaggccgccuccucccaggagcaggcccgcuccucccccggcgagcgccacggcucccgccaccagcaguccgccgacuccuccaccgacuccggcaccggccgccgccaggacuccuccgucgucggcgacuccggcaaccgcggcuccuccggcucccaggccuccgacuccgagggccacuccgaggaguccgacacccaguccgucuccgcccacggccaggccggcccccaccagcagucccaccaggaguccacccgcggccaguccggcgagcgcuccggccgcuccggcuccuuccucuaccaggucuccacccacgagcaguccgaguccgcccacggccgcaccggccccuccaccggcggccgccagcgcucccgccacgagcaggcccgcgacuccucccgccacuccgccucccaggagggccaggacaccauccgcggccaccccggcuccucccgcggcggccgccagggcucccacuacgagcaguccgucgacuccuccggccacuccggcucccaccacucccacaccaccucccaggagcgcuccgacgucucccgcggccaguccggcucccgcuccgucucccgccagacccgcaacgagaagcaguccggcgacggcucccgccacuccggcucccgccaccacgaggccuccucccgcgccgacuccucccgccacucccaggucggccagggccaguccuccggcccccgcaccucccgcaaccagggcuccuccgucucccaggacuccgacucccagggccacuccgaggacuccgagcgcugguccggcuccgccucccgcaaccaccucggcuccgccugggagcagucccgcgacggcucccgccaccccggcucccaccacgaggaccgcgccggccacggccacuccgccgacuccucccgccaguccggcacccgccacaccgaguccuccucccgcggccaggccgccuccucccacgagcaggcccgcuccuccgccggcgagcgccacggcucccaccaccagcuccaguccgccgacuccucccgccacuccggcaucggccacggccaggccuccuccgccguccgcgacuccggccaccgcggcuacuccggcucccaggccuccgacuccgagggccacuccgaggacuccgacacccaguccgucuccgcccagggcaaggccggcccccaccagcagucccacaaggaguccgcccgcggccaguccggcgaguccuccggccgcuccggcuccuuccucuaccaggucuccacccacgagcaguccgaguccacccacggccaguccgcccccuccaccggcggccgccagggcucccacuacgaccaggcccaggacuccucccgccacuccgccucccaggagggccaggacaccauccgcggccaccccggccccucccgcggcggccgccagggcucccaccaggagcaguccgucgaccgcuccggccacuccggcucccaccacucccacaccaccucccagggccgcuccgacgccucccgcggccaguccggcucccgcuccgccucccgcaagaccuacgacaaggagcaguccggcgacggcucccgccacuccggcucccaccaccacgaggccuccuccugggccgacuccucccgccacucccucgucggccagggccaguccuccggcccccgcaccucccgcccccgcggcuccuccgucucccaggacuccgacuccgagggccacuccgaggacuccgagcgccgcuccggcuccgccucccgcaaccaccacggcuccgcccaggagcagucccgcgacggcucccgccacccccgcucccaccacgaggaccgcgccggccacggccacuccgccgaguccucccgccaguccggcacccaccacgccgagaacuccuccggcggccaggccgccuccucccacgagcaggcccgcuccuccgccggcgagcgccacggcucccaccaccagcaguccgccgacuccucccgccacuccggcaucggccacggccaggccuccuccgccguccgcgacuccggccaccgcggcuccuccggcucccaggccuccgacuccgagggccacuccgaggacuccgacacccaguccgucuccgcccacggccaggccggcccccaccagcagucccaccaggaguccacccgcggccgcuccgccggccgcuccggccgcuccggcuccuuccucuaccaggucuccacccacgagcaguccgaguccgcccacggccgcaccggcaccuccaccggcggccgccagggcucccaccacaagcaggcccgcgacuccucccgccacuccaccucccaggagggccaggacaccauccacggccaccccggcuccuccuccggcggccgccagggcucccacuacgagcagcucgucgaccgcuccggccacuccggcucccaccacucccacaccaccucccagggccgcuccgacgccucccacggccacuccggcucccgcuccgccucccgccagacccgcaacgacgagcaguccggcgacggcucccgccacuccggcucccgccaccacgaggccuccucccgcgccgacuccuccggccacucccaggucggccagggccaguccgagggcccccgcaccucccgcaacuggggcuccuccuucucccaggacuccgacucccagggccacuccgaggacuccgagcgcugguccggcuccgccucccgcaaccaccacggcuccgcccaggagcagcuccgcgacggcucccgccacccccgcucccaccaggaggaccgcgccggccacggccacuccgccgacuccucccgccaguccggcacccgccacacccagaccuccuccggcggccaggccgccuccucccacgagcaggcccgcuccuccgccggcgagcgccacggcucccaccaccagcaguccgccgacuccucccgccacuccggcaucggccacggccaggccuccuccgccguccgcgacuccggccaccgcggcuacuccggcucccaggccuccgacaacgagggccacuccgaggacuccgacacccaguccgucuccgcccacggccaggccggcucccaccagcagucccaccaggaguccgcccgcggccgcuccggcgagaccuccggccacuccggcuccuuccucuaccaggucuccacccacgagcaguccgaguccucccacggcuggaccggccccuccacccgcggccgccagggcucccgccacgagcaggcccaggacuccucccgccacuccgccucccaggacggccaggacaccauccgcggccaccccggcuccucccgcggcggccgccagggcuaccaccacgagcacuccgucgacuccuccggccacuccggcucccaccacucccacaccaccucccagggccgcuccgacgccucccgcggccaguccggcucccgcuccgccucccgcaccacccgcaacgaggagcaguccggcgacggcucccgccacuccggcucccgccaccacgaggccuccacccacgccgacaucucccgccacucccaggccguccagggccaguccgagggcucccgccgcucccgccgccagggcuccuccgucucccaggacuccgacuccgagggccacuccgaggacuccgagcgcugguccggcuccgccucccgcaaccaccacggcuccgcccaggagcagcuccgcgacggcucccgccacccccgcucccaccaggaggaccgcgccggccacggccacuccgccgacuccucccgccaguccggcacccgccacacccagaccuccuccggcggccaggccgccuccucccacgagcaggcccgcuccuccgccggcgagcgccacggcucccaccaccagcaguccgccgacuccucccgccacuccggcaucggccacggccaggccuccuccgccguccgcgacuccggccaccgcggcuacuccggcucccaggccuccgacaacgagggccacuccgaggacuccgacacccaguccgucuccgcccacggccaggccggcucccaccagcagucccaccaggaguccgcccgcggccgcuccggcgagaccuccggccacuccggcuccuuccucuaccaggucuccacccacgagcaguccgaguccucccacggcuggaccggccccuccacccgcggccgccagggcucccgccacgagcaggcccaggacuccucccgccacuccgccucccaguacggccaggacaccauccgcggccaccccggcuccucccgcggcggccgccagggcuaccaccacgagcacuccgucgacuccuccggccacuccggcucccaccacucccacaccaccucccagggccgcuccgacgccucccgcggccaguccggcucccgcuccgccucccgcaccacccgcaacgaggagcaguccggcgacuccucccgccacuccgucucccgccaccacgaggccuccacccacgccgacaucucccgccacucccaggccguccagggccaguccgagggcucccgccgcucccgccgccagggcuccuccgucucccaggacuccgacuccgagggccacuccgaggacuccgagcgcugguccggcuccgccucccgcaaccaccgcggcuccguccaggagcagucccgccacggcucccgccacccccgcucccaccacgaggaccgcgccggccacggccacuccgccgaccgcucccgccaguccggcacccgccacgccgagaccuccuccggcggccaggccgccuccucccacgagcaggcccgcuccucccccggcgagcgccacggcucccgccaccagcaguccgccgacuccucccgccacuccggcaucccccgcggccaggccuccuccgccguccgcgacucccgccacuggggcuccuccggcucccaggccuccgacuccgagggccacuccgaggaguccgacacccaguccgucuccggccacggccaggccggcccccaccagcagucccaccaggaguccgcccgcgaccgcuccggcggccgcuccggccgcuccggcuccuuccucuaccaggucuccacccacgagcaguccgaguccgcccacggccgcacccgcaccuccaccggccgccgccagggcucccaccacgagcaggcccgcgacuccucccgccacuccgccucccaggagggccaggacaccauccgcggccaccccggcuccucccgccgcggccgccagggcucccacuacgagcaguccgucgaccgcuccggccacuccggcucccaccacucccacaccaccucccagggccgcuccgacgccucccgcggccaguccggcucccgcuccgccucccgccagacccgcaacgacgagcaguccggcgacggcucccgccacuccuggucccaccaccacgaggccuccacccaggccgacuccucccgccacucccaguccggccagggccaguccgccggcccccgcaccucccgcaaccagggcuccuccgucucccaggacuccgacucccagggccacuccgaggacuccgagcgcugguccggcuccgccucccgcaaccaccgcggcuccgcccaggagcagucccgcgacggcucccgccaccccaccucccaccacgaggaccgcgccggccacggccacuccgccgaguccucccgccaguccggcacccaccacgccgagaacuccuccggcggccaggccgccuccucccacgagcaggcccgcuccuccgccggcgagcgccacggcucccaccaccagcaguccgccgacuccucccgccacuccggcaucggccacggccaggccuccuccgccguccgcgacuccggccaccgcggcuccuccggcucccaggccuccgacuccgagggccacuccgaggacuccgacacccaguccgucuccgcccacggccaggccggcccccaccagcagucccaccaggaguccacccgcggccgcuccgccggccgcuccggccgcuccggcuccuuccucuaccaggucuccacccacgagcaguccgaguccgcccacggccgcgccggccccuccaccggcggccgccagggcucccgccacgagcaggcccgcgacuccucccgccacuccgccucccaggagggccaggacaccauccgcggccaccccggcucccgccgcggcggccgccagggcuccuaccacgagcaguccgucgaccgcuccggccacuccggcucccaccacucccacaccaccucccagggccgcuccgacgccucccacggccaguccggcucccgcuccgccucccgcgagacccgcaacgaggagcaguccggcgacggcucccgccacuccggcucccgccaccacgaggccuccacccaggccgacuccucccgccacucccaguccggccagggcgaguccgccggcucccgccgcucccgccgccagggcuccuccgucucccaggacuccgacuccgaggccuaccccgaggacuccgagcgccgcuccgaguccgccucccgcaaccaccacggcuccucccgcgagcagucccgcgacggcucccgccaccccggcuccucccaccgcgacaccgccucccacguccaguccucccccguccaguccgacuccuccaccgccaaggagcacggccacuucuccucccucucccaggacuccgccuaccacuccggcauccagucccgcggcuccccccacuccuccuccuccuaccacuaccaguccgagggcaccgagcgccagaagggccaguccggccucgucuggcgccacggcuccuacggcuccgccgacuacgacuacggcgaguccggcuuccgccacucccagcacggcuccgucuccuacaacuccaaccccgucgucuucaaggagcgcuccgacaucugcaaggccuccgccuucggcaaggaccacccccgcuacuacgccaccuacaucaacaaggaccccggccucugcggccacuccuccgacaucuccaagcagcucggcuucucccagucccagcgcuacuacuacuacgaguga

SEQ ID NO: 43258 - RNA, 1161 nt, Artificial Sequence
  derived and/or modified sequence opt2 from FLI1__Homo_sapiens__NP_001257939
auggagggcggccucgccggcgagcgcgcccgcgagucccccgucgacugcuccgucuccaagugcuccaagcucgucggcggcggcgaguccaaccccaugaacuacaacuccuacauggacgagaagaacggcccccccccccccaacaugaccaccaacgagcgccgcgucaucguccccgccgaccccacccucuggacccaggagcacguccgccaguggcucgagugggccaucaaggaguacucccucauggagaucgacaccuccuucuuccagaacauggacggcaaggagcucugcaagaugaacaaggaggacuuccuccgcgccaccacccucuacaacaccgagguccuccucucccaccucuccuaccuccgcgaguccucccuccucgccuacaacaccaccucccacaccgaccaguccucccgccucuccgucaaggaggaccccuccuacgacuccguccgccgcggcgccuggggcaacaacaugaacuccggccucaacaagucccccccccucggcggcgcccagaccaucuccaagaacaccgagcagcgcccccagcccgaccccuaccagauccucggccccaccuccucccgccucgccaaccccggcuccggccagauccagcucuggcaguuccuccucgagcuccucuccgacuccgccaacgccuccugcaucaccugggagggcaccaacggcgaguucaagaugaccgaccccgacgaggucgcccgccgcuggggcgagcgcaaguccaagcccaacaugaacuacgacaagcucucccgcgcccuccgcuacuacuacgacaagaacaucaugaccaagguccacggcaagcgcuacgccuacaaguucgacuuccacggcaucgcccaggcccuccagccccaccccaccgaguccuccauguacaaguaccccuccgacaucuccuacaugcccuccuaccacgcccaccagcagaaggucaacuucguccccccccaccccuccuccaugcccgucaccuccuccuccuucuucggcgccgccucccaguacuggaccucccccaccggcggcaucuaccccaaccccaacgucccccgccaccccaacacccacguccccucccaccucggcuccuacuacuga

SEQ ID NO: 43259 - RNA, 3645 nt, Artificial Sequence
  derived and/or modified sequence opt2 from FLII__Homo_sapiens__NP_001243194
auggaggccaccggcguccuccccuucguccgcggcgucgaccucuccggcaacgacuucaagggcggcuacuuccccgagaacgucaaggccaugaccucccuccgcuggcucaagcucaaccgcaccggccucugcuaccuccccgaggagcucgccgcccuccagaagcucgagcaccucuccgucucccacaacaaccucaccacccuccacggcgagcucuccucccuccccucccuccgcgccaucgucgcccgcgccaacucccucaagaacuccggcguccccgacgacaucuucaagcucgacgaccucuccguccucgaccucucccacaaccagcucaccgagugcccccgcgagcucgagaacgccaagaacaugcucguccucaaccucucccacaaccgccagcuccccgccaugaccgcccuccagacccuccaccuccgcuccacccagcgcacccaguccaaccuccccaccucccucgagggccucuccaaccucgccgacgucgaccucuccugcaacgaccucacccgcguccccgagugccucuacacccuccccucccuccgccgccucaaccucuccuccaaccagaucaccgagcucucccucugcaucgaccaguggguccacgucgagacccucaaccucucccgcaaccagcucaccucccuccccuccgccaucugcaagcucuccaagcucaagaagcucuaccucaacuccaacaagcucgacuucgacggccuccccuccggcaucggcaagcucaccaaccucgaggaguucauggccgccaacaacaaccucgagcucguccccgagucccucugccgcugccccaagcuccgcaagcucguccucaacaagaaccaccucgucacccuccccgaggccauccacuuccucaccgagaucgagguccucgacguccgcgagaaccccaaccucgucaugccccccaagcccgccgaccgcgccgccgagugguacaacaucgacuucucccuccagaaccagcuccgccucgccggcgccucccccgccaccgucgccgccgccgccgccggcuccggccccaaggaccccauggcccgcaagaugcgccuccgccgccgcaaggacuccgcccaggacgaccaggccaagcagguccucaagggcauguccgacgucgcccaggagaagaacaagaagcaggaggaguccgccgacgcccgcgcccccuccggcaagguccgccgcugggaccagggccucgagaagccccgccucgacuacuccgaguucuucaccgaggacgucggccagcuccccggccucaccaucuggcagaucgagaacuucguccccguccucgucgaggaggccuuccacggcaaguucuacgaggccgacugcuacaucguccucaagaccuuccucgacgacuccggcucccucaacugggagaucuacuacuggaucggcggcgaggccacccucgacaagaaggccugcuccgccauccacgccgucaaccuccgcaacuaccucggcgccgagugccgcaccguccgcgaggagaugggcgacgaguccgaggaguuccuccaggucuucgacaacgacaucuccuacaucgagggcggcaccgccuccggcuucuacaccgucgaggacacccacuacgucacccgcauguaccgcgucuacggcaagaagaacaucaagcucgagcccgucccccucaagggcaccucccucgacccccgcuucgucuuccuccucgaccgcggccucgacaucuacgucuggcgcggcgcccaggccacccucuccuccaccaccaaggcccgccucuucgccgagaagaucaacaagaacgagcgcaagggcaaggccgagaucacccuccucguccagggccaggagcuccccgaguucugggaggcccucggcggcgagcccuccgagaucaagaagcacguccccgaggacuucuggcccccccagcccaagcucuacaaggucggccucggccucggcuaccucgagcucccccagaucaacuacaagcucuccgucgagcacaagcagcgccccaaggucgagcucaugccccgcaugcgccuccuccagucccuccucgacacccgcugcgucuacauccucgacugcugguccgacgucuucaucuggcucggccgcaaguccccccgccucguccgcgccgccgcccucaagcucggccaggagcucugcggcaugcuccaccgcccccgccacgccaccgucucccgcucccucgagggcaccgaggcccaggucuucaaggccaaguucaagaacugggacgacguccucaccgucgacuacacccgcaacgccgaggccguccuccagucccccggccucuccggcaaggucaagcgcgacgccgagaagaaggaccagaugaaggccgaccucaccgcccucuuccucccccgccagccccccaugucccucgccgaggccgagcagcucauggaggaguggaacgaggaccucgacggcauggagggcuucguccucgagggcaagaaguucgcccgccuccccgaggaggaguucggccacuucuacacccaggacugcuacgucuuccucugccgcuacuggguccccgucgaguacgaggaggaggagaagaaggaggacaaggaggagaaggccgagggcaaggagggcgaggaggccaccgccgaggccgaggagaagcagcccgaggaggacuuccagugcaucgucuacuucuggcagggccgcgaggccuccaacaugggcuggcucaccuucaccuucucccuccagaagaaguucgagucccucuuccccggcaagcucgaggucguccgcaugacccagcagcaggagaaccccaaguuccucucccacuucaagcgcaaguucaucauccaccgcggcaagcgcaaggccguccagggcgcccagcagcccucccucuaccagauccgcaccaacggcuccgcccucugcacccgcugcauccagaucaacaccgacuccucccuccucaacuccgaguucugcuucauccucaagguccccuucgaguccgaggacaaccagggcaucgucuacgccugggucggccgcgccuccgaccccgacgaggccaagcucgccgaggacauccucaacaccauguucgacaccuccuacuccaagcaggucaucaacgagggcgaggagcccgagaacuucuucugggucggcaucggcgcccagaagcccuacgacgacgacgccgaguacaugaagcacacccgccucuuccgcugcuccaacgagaagggcuacuucgccgucaccgagaagugcuccgacuucugccaggacgaccucgccgacgacgacaucaugcuccucgacaacggccaggaggucuacaugugggucggcacccagaccucccaggucgagaucaagcucucccucaaggccugccaggucuacauccagcacaugcgcuccaaggagcacgagcgcccccgccgccuccgccucguccgcaagggcaacgagcagcacgccuucacccgcugcuuccacgccugguccgccuucugcaaggcccucgccuga

SEQ ID NO: 43260 - RNA, 7944 nt, Artificial Sequence
  derived and/or modified sequence opt2 from FLNA__Homo_sapiens__NP_001104026
auguccuccucccacucccgcgccggccaguccgccgccggcgccgcccccggcggcggcgucgacacccgcgacgccgagaugcccgccaccgagaaggaccucgccgaggacgcccccuggaagaagauccagcagaacaccuucacccgcuggugcaacgagcaccucaagugcgucuccaagcgcaucgccaaccuccagaccgaccucuccgacggccuccgccucaucgcccuccucgagguccucucccagaagaagaugcaccgcaagcacaaccagcgccccaccuuccgccagaugcagcucgagaacgucuccgucgcccucgaguuccucgaccgcgaguccaucaagcucgucuccaucgacuccaaggccaucgucgacggcaaccucaagcucauccucggccucaucuggacccucauccuccacuacuccaucuccaugcccaugugggacgaggaggaggacgaggaggccaagaagcagacccccaagcagcgccuccucggcuggauccagaacaagcucccccagcuccccaucaccaacuucucccgcgacuggcaguccggccgcgcccucggcgcccucgucgacuccugcgcccccggccucugccccgacugggacuccugggacgccuccaagcccgucaccaacgcccgcgaggccaugcagcaggccgacgacuggcucggcaucccccaggucaucacccccgaggagaucgucgaccccaacgucgacgagcacuccgucaugaccuaccucucccaguuccccaaggccaagcucaagcccggcgccccccuccgccccaagcucaaccccaagaaggcccgcgccuacggccccggcaucgagcccaccggcaacauggucaagaagcgcgccgaguucaccgucgagacccgcuccgccggccagggcgagguccucgucuacgucgaggaccccgccggccaccaggaggaggccaaggucaccgccaacaacgacaagaaccgcaccuucuccgucugguacguccccgaggucaccggcacccacaaggucaccguccucuucgccggccagcacaucgccaagucccccuucgaggucuacgucgacaagucccagggcgacgccuccaaggucaccgcccagggccccggccucgagcccuccggcaacaucgccaacaagaccaccuacuucgagaucuucaccgccggcgccggcaccggcgaggucgaggucgucauccaggaccccaugggccagaagggcaccgucgagccccagcucgaggcccgcggcgacuccaccuaccgcugcuccuaccagcccaccauggagggcguccacaccguccacgucaccuucgccggcguccccaucccccgcucccccuacaccgucaccgucggccaggccugcaaccccuccgccugccgcgccgucggccgcggccuccagcccaagggcguccgcgucaaggagaccgccgacuucaaggucuacaccaagggcgccggcuccggcgagcucaaggucaccgucaagggccccaagggcgaggagcgcgucaagcagaaggaccucggcgacggcgucuacggcuucgaguacuaccccaugguccccggcaccuacaucgucaccaucaccuggggcggccagaacaucggccgcucccccuucgaggucaaggucggcaccgagugcggcaaccagaagguccgcgccuggggccccggccucgagggcggcgucgucggcaaguccgccgacuucgucgucgaggccaucggcgacgacgucggcacccucggcuucuccgucgagggccccucccaggccaagaucgagugcgacgacaagggcgacggcuccugcgacguccgcuacuggccccaggaggccggcgaguacgccguccacguccucugcaacuccgaggacauccgccucucccccuucauggccgacauccgcgacgccccccaggacuuccaccccgaccgcgucaaggcccgcggccccggccucgagaagaccggcgucgccgucaacaagcccgccgaguucaccgucgacgccaagcacggcggcaaggccccccuccgcguccagguccaggacaacgagggcugccccgucgaggcccucgucaaggacaacggcaacggcaccuacuccugcuccuacgucccccgcaagcccgucaagcacaccgccauggucuccuggggcggcgucuccauccccaacucccccuuccgcgucaacgucggcgccggcucccaccccaacaaggucaaggucuacggccccggcgucgccaagaccggccucaaggcccacgagcccaccuacuucaccgucgacugcgccgaggccggccagggcgacgucuccaucggcaucaagugcgcccccggcgucgucggccccgccgaggccgacaucgacuucgacaucauccgcaacgacaacgacaccuucaccgucaaguacaccccccgcggcgccggcuccuacaccaucaugguccucuucgccgaccaggccacccccaccucccccauccgcgucaaggucgagcccucccacgacgccuccaaggucaaggccgagggccccggccucucccgcaccggcgucgagcucggcaagcccacccacuucaccgucaacgccaaggccgccggcaagggcaagcucgacguccaguucuccggccucaccaagggcgacgccguccgcgacgucgacaucaucgaccaccacgacaacaccuacaccgucaaguacacccccguccagcagggccccgucggcgucaacgucaccuacggcggcgaccccauccccaagucccccuucuccgucgccgucucccccucccucgaccucuccaagaucaaggucuccggccucggcgagaaggucgacgucggcaaggaccaggaguucaccgucaaguccaagggcgccggcggccagggcaaggucgccuccaagaucgucggccccuccggcgccgccguccccugcaaggucgagcccggccucggcgccgacaacuccgucguccgcuuccucccccgcgaggagggccccuacgaggucgaggucaccuacgacggcguccccguccccggcucccccuucccccucgaggccgucgcccccaccaagcccuccaaggucaaggccuucggccccggccuccagggcggcuccgccggcucccccgcccgcuucaccaucgacaccaagggcgccggcaccggcggccucggccucaccgucgagggccccugcgaggcccagcucgagugccucgacaacggcgacggcaccugcuccgucuccuacguccccaccgagcccggcgacuacaacaucaacauccucuucgccgacacccacauccccggcucccccuucaaggcccacgucguccccugcuucgacgccuccaaggucaagugcuccggccccggccucgagcgcgccaccgccggcgaggucggccaguuccaggucgacugcuccuccgccggcuccgccgagcucaccaucgagaucugcuccgaggccggccuccccgccgaggucuacauccaggaccacggcgacggcacccacaccaucaccuacaucccccucugccccggcgccuacaccgucaccaucaaguacggcggccagcccguccccaacuuccccuccaagcuccaggucgagcccgccgucgacaccuccggcguccagugcuacggccccggcaucgagggccagggcgucuuccgcgaggccaccaccgaguucuccgucgacgcccgcgcccucacccagaccggcggcccccacgucaaggcccgcgucgccaaccccuccggcaaccucaccgagaccuacguccaggaccgcggcgacggcauguacaaggucgaguacacccccuacgaggagggccuccacuccgucgacgucaccuacgacggcucccccguccccuccucccccuuccagguccccgucaccgagggcugcgaccccucccgcguccgcguccacggccccggcauccaguccggcaccaccaacaagcccaacaaguucaccgucgagacccgcggcgccggcaccggcggccucggccucgccgucgagggccccuccgaggccaagauguccugcauggacaacaaggacggcuccugcuccgucgaguacauccccuacgaggccggcaccuacucccucaacgucaccuacggcggccaccagguccccggcucccccuucaagguccccguccacgacgucaccgacgccuccaaggucaagugcuccggccccggccucucccccggcaugguccgcgccaaccucccccaguccuuccaggucgacaccuccaaggccggcgucgccccccuccaggucaagguccagggccccaagggccucgucgagcccgucgacgucgucgacaacgccgacggcacccagaccgucaacuacguccccucccgcgagggccccuacuccaucuccguccucuacggcgacgaggaggucccccgcucccccuucaaggucaagguccuccccacccacgacgccuccaaggucaaggccuccggccccggccucaacaccaccggcguccccgccucccuccccgucgaguucaccaucgacgccaaggacgccggcgagggccuccucgccguccagaucaccgaccccgagggcaagcccaagaagacccacauccaggacaaccacgacggcaccuacaccgucgccuacguccccgacgucaccggccgcuacaccauccucaucaaguacggcggcgacgagauccccuucucccccuaccgcguccgcgccguccccaccggcgacgccuccaagugcaccgucaccgucuccaucggcggccacggccucggcgccggcaucggccccaccauccagaucggcgaggagaccgucaucaccgucgacaccaaggccgccggcaagggcaaggucaccugcaccgucugcacccccgacggcuccgaggucgacgucgacgucgucgagaacgaggacggcaccuucgacaucuucuacaccgccccccagcccggcaaguacgucaucugcguccgcuucggcggcgagcacguccccaacucccccuuccaggucaccgcccucgccggcgaccagcccuccguccagcccccccuccgcucccagcagcucgccccccaguacaccuacgcccagggcggccagcagaccugggcccccgagcgcccccucgucggcgucaacggccucgacgucaccucccuccgccccuucgaccucgucauccccuucaccaucaagaagggcgagaucaccggcgagguccgcaugcccuccggcaaggucgcccagcccaccaucaccgacaacaaggacggcaccgucaccguccgcuacgcccccuccgaggccggccuccacgagauggacauccgcuacgacaacaugcacauccccggcuccccccuccaguucuacgucgacuacgucaacugcggccacgucaccgccuacggccccggccucacccacggcgucgucaacaagcccgccaccuucaccgucaacaccaaggacgccggcgagggcggccucucccucgccaucgagggccccuccaaggccgagaucuccugcaccgacaaccaggacggcaccugcuccgucuccuaccuccccguccuccccggcgacuacuccauccucgucaaguacaacgagcagcacguccccggcucccccuucaccgcccgcgucaccggcgacgacuccaugcgcaugucccaccucaaggucggcuccgccgccgacauccccaucaacaucuccgagaccgaccucucccuccucaccgccaccgucgucccccccuccggccgcgaggagcccugccuccucaagcgccuccgcaacggccacgucggcaucuccuucguccccaaggagaccggcgagcaccucguccacgucaagaagaacggccagcacgucgccuccucccccauccccgucgucaucucccaguccgagaucggcgacgccucccgcguccgcgucuccggccagggccuccacgagggccacaccuucgagcccgccgaguucaucaucgacacccgcgacgccggcuacggcggccucucccucuccaucgagggccccuccaaggucgacaucaacaccgaggaccucgaggacggcaccugccgcgucaccuacugccccaccgagcccggcaacuacaucaucaacaucaaguucgccgaccagcacguccccggcucccccuucuccgucaaggucaccggcgagggccgcgucaaggaguccaucacccgccgccgccgcgcccccuccgucgccaacgucggcucccacugcgaccucucccucaagauccccgagaucuccauccaggacaugaccgcccaggucaccucccccuccggcaagacccacgaggccgagaucgucgagggcgagaaccacaccuacugcauccgcuucguccccgccgagaugggcacccacaccgucuccgucaaguacaagggccagcacguccccggcucccccuuccaguucaccgucggcccccucggcgagggcggcgcccacaagguccgcgccggcggccccggccucgagcgcgccgaggccggcguccccgccgaguucuccaucuggacccgcgaggccggcgccggcggccucgccaucgccgucgagggccccuccaaggccgagaucuccuucgaggaccgcaaggacggcuccugcggcgucgccuacgucguccaggagcccggcgacuacgaggucuccgucaaguucaacgaggagcacauccccgacucccccuucgucguccccgucgccucccccuccggcgacgcccgccgccucaccgucuccucccuccaggaguccggccucaaggucaaccagcccgccuccuucgccgucucccucaacggcgccaagggcgccaucgacgccaagguccacucccccuccggcgcccucgaggagugcuacgucaccgagaucgaccaggacaaguacgccguccgcuucaucccccgcgagaacggcgucuaccucaucgacgucaaguucaacggcacccacauccccggcucccccuucaagauccgcgucggcgagcccggccacggcggcgaccccggccucgucuccgccuacggcgccggccucgagggcggcgucaccggcaaccccgccgaguucgucgucaacaccuccaacgccggcgccggcgcccucuccgucaccaucgacggccccuccaaggucaagauggacugccaggagugccccgagggcuaccgcgucaccuacacccccauggcccccggcuccuaccucaucuccaucaaguacggcggccccuaccacaucggcggcucccccuucaaggccaaggucaccggcccccgccucgucuccaaccacucccuccacgagaccuccuccgucuucgucgacucccucaccaaggccaccugcgccccccagcacggcgcccccggccccggccccgccgacgccuccaaggucgucgccaagggccucggccucuccaaggccuacgucggccagaaguccuccuucaccgucgacugcuccaaggccggcaacaacaugcuccucgucggcguccacggcccccgcacccccugcgaggagauccucgucaagcacgucggcucccgccucuacuccgucuccuaccuccucaaggacaagggcgaguacacccucgucgucaaguggggcgacgagcacauccccggcucccccuaccgcgucgucguccccuga

SEQ ID NO: 43261 - RNA, 7902 nt, Artificial Sequence
  derived and/or modified sequence opt2 from FLNB__Homo_sapiens__NP_001157789
augcccgucaccgagaaggaccucgccgaggacgcccccuggaagaagauccagcagaacaccuucacccgcuggugcaacgagcaccucaagugcgucaacaagcgcaucggcaaccuccagaccgaccucuccgacggccuccgccucaucgcccuccucgagguccucucccagaagcgcauguaccgcaaguaccaccagcgccccaccuuccgccagaugcagcucgagaacgucuccgucgcccucgaguuccucgaccgcgaguccaucaagcucgucuccaucgacuccaaggccaucgucgacggcaaccucaagcucauccucggccucgucuggacccucauccuccacuacuccaucuccaugcccgucugggaggacgagggcgacgacgacgccaagaagcagacccccaagcagcgccuccucggcuggauccagaacaagauccccuaccuccccaucaccaacuucaaccagaacuggcaggacggcaaggcccucggcgcccucgucgacuccugcgcccccggccucugccccgacugggaguccugggacccccagaagcccgucgacaacgcccgcgaggccaugcagcaggccgacgacuggcucggcgucccccaggucaucacccccgaggagaucauccaccccgacgucgacgagcacuccgucaugaccuaccucucccaguuccccaaggccaagcucaagcccggcgccccccucaagcccaagcucaaccccaagaaggcccgcgccuacggccgcggcaucgagcccaccggcaacauggucaagcagcccgccaaguucaccgucgacaccaucuccgccggccagggcgacgucauggucuucgucgaggaccccgagggcaacaaggaggaggcccaggucacccccgacuccgacaagaacaagaccuacuccgucgaguaccuccccaaggucaccggccuccacaaggucaccguccucuucgccggccagcacaucuccaagucccccuucgaggucuccgucgacaaggcccagggcgacgccuccaaggucaccgccaagggccccggccucgaggccgucggcaacaucgccaacaagcccaccuacuucgacaucuacaccgccggcgccggcgucggcgacaucggcgucgaggucgaggacccccagggcaagaacaccgucgagcuccucgucgaggacaagggcaaccaggucuaccgcugcgucuacaagcccaugcagcccggcccccacgucgucaagaucuucuucgccggcgacaccauccccaagucccccuucgucguccaggucggcgaggccugcaaccccaacgccugccgcgccuccggccgcggccuccagcccaagggcguccgcauccgcgagaccaccgacuucaaggucgacaccaaggccgccggcuccggcgagcucggcgucaccaugaagggccccaagggccucgaggagcucgucaagcagaaggacuuccucgacggcgucuacgccuucgaguacuaccccuccacccccggccgcuacuccaucgccaucaccuggggcggccaccacauccccaagucccccuucgagguccaggucggccccgaggccggcaugcagaagguccgcgccuggggccccggccuccacggcggcaucgucggccgcuccgccgacuucgucgucgaguccaucggcuccgaggucggcucccucggcuucgccaucgagggccccucccaggccaagaucgaguacaacgaccagaacgacggcuccugcgacgucaaguacuggcccaaggagcccggcgaguacgccguccacaucaugugcgacgacgaggacaucaaggacucccccuacauggccuucauccaccccgccaccggcggcuacaaccccgaccucguccgcgccuacggccccggccucgagaaguccggcugcaucgucaacaaccucgccgaguucaccgucgaccccaaggacgccggcaaggccccccucaagaucuucgcccaggacggcgagggccagcgcaucgacauccagaugaagaaccgcauggacggcaccuacgccugcuccuacacccccgucaaggccaucaagcacaccaucgccgucgucuggggcggcgucaacaucccccacucccccuaccgcgucaacaucggccagggcucccacccccagaaggucaaggucuucggccccggcgucgagcgcuccggccucaaggccaacgagcccacccacuucaccgucgacugcaccgaggccggcgagggcgacgucuccgucggcaucaagugcgacgcccgcguccucuccgaggacgaggaggacgucgacuucgacaucauccacaacgccaacgacaccuucaccgucaaguacgucccccccgccgccggccgcuacaccaucaagguccucuucgccucccaggagauccccgccucccccuuccgcgucaaggucgaccccucccacgacgccuccaaggucaaggccgagggccccggccucuccaaggccggcgucgagaacggcaagcccacccacuucaccgucuacaccaagggcgccggcaaggccccccucaacguccaguucaacuccccccuccccggcgacgccgucaaggaccucgacaucaucgacaacuacgacuacucccacaccgucaaguacacccccacccagcagggcaacaugcagguccucgucaccuacggcggcgaccccauccccaagucccccuucaccgucggcgucgccgccccccucgaccucuccaagaucaagcucaacggccucgagaaccgcgucgaggucggcaaggaccaggaguucaccgucgacacccgcggcgccggcggccagggcaagcucgacgucaccauccucucccccucccgcaaggucguccccugccucgucacccccgucaccggccgcgagaacuccaccgccaaguucaucccccgcgaggagggccucuacgccgucgacgucaccuacgacggccaccccguccccggcucccccuacaccgucgaggccucccucccccccgaccccuccaaggucaaggcccacggccccggccucgagggcggccucgucggcaagcccgccgaguucaccaucgacaccaagggcgccggcaccggcggccucggccucaccgucgagggccccugcgaggccaagaucgagugcuccgacaacggcgacggcaccugcuccgucuccuaccuccccaccaagcccggcgaguacuucgucaacauccucuucgaggagguccacauccccggcucccccuucaaggccgacaucgagaugcccuucgaccccuccaaggucgucgccuccggccccggccucgagcacggcaaggucggcgaggccggccuccucuccgucgacugcuccgaggccggccccggcgcccucggccucgaggccgucuccgacuccggcaccaaggccgaggucuccauccagaacaacaaggacggcaccuacgccgucaccuacgucccccucaccgccggcauguacacccucaccaugaaguacggcggcgagcucgucccccacuuccccgcccgcgucaaggucgagcccgccgucgacaccucccgcaucaaggucuucggccccggcaucgagggcaaggacgucuuccgcgaggccaccaccgacuucaccgucgacucccgcccccucacccaggucggcggcgaccacaucaaggcccacaucgccaaccccuccggcgccuccaccgagugcuucgucaccgacaacgccgacggcaccuaccaggucgaguacacccccuucgagaagggccuccacgucgucgaggucaccuacgacgacguccccauccccaacucccccuucaaggucgccgucaccgagggcugccagcccucccgcguccaggcccagggccccggccucaaggaggccuucaccaacaagcccaacgucuucaccgucgucacccgcggcgccggcaucggcggccucggcaucaccgucgagggccccuccgaguccaagaucaacugccgcgacaacaaggacggcuccugcuccgccgaguacauccccuucgcccccggcgacuacgacgucaacaucaccuacggcggcgcccacauccccggcucccccuuccgcguccccgucaaggacgucgucgaccccuccaaggucaagaucgccggccccggccucggcuccggcguccgcgcccgcguccuccaguccuucaccgucgacuccuccaaggccggccucgccccccucgagguccgcguccucggcccccgcgccgacgacaccgacucccaguccuggcgcuccccccucaaggcccucuccgaguucuucaagggcgaccccaagggcgacuucaacaagaccggccucgucgagcccgucaacgucgucgacaacggcgacggcacccacaccgucaccuacacccccucccaggagggccccuacauggucuccgucaaguacgccgacgaggagaucccccgcucccccuucaaggucaagguccuccccaccuacgacgccuccaaggucaccgccuccggccccggccucuccuccuacggcguccccgccucccuccccgucgacuucgccaucgacgcccgcgacgccggcgagggccuccucgccguccagaucaccgaccaggagggcaagcccaagcgcgccaucguccacgacaacaaggacggcaccuacgccgucaccuacauccccgacaagaccggccgcuacaugaucggcgucaccuacggcggcgacgacaucccccucucccccuaccgcauccgcgccacccagaccggcgacgccuccaagugccucgccaccggccccggcaucgccuccaccgucaagaccggcgaggaggucggcuucgucgucgacgccaagaccgccggcaagggcaaggucaccugcaccguccucacccccgacggcaccgaggccgaggccgacgucaucgagaacgaggacggcaccuacgacaucuucuacaccgccgccaagcccggcaccuacgucaucuacguccgcuucggcggcgucgacauccccaacucccccuucaccgucauggccaccgacggcgaggucaccgccgucgaggaggcccccgucaacgccugcccccccggcuuccgccccugggucaccgaggaggccuacguccccgucuccgacaugaacggccucggcuucaagcccuucgaccucgucauccccuucgccguccgcaagggcgagaucaccggcgagguccacaugcccuccggcaagaccgccacccccgagaucgucgacaacaaggacggcaccgucaccguccgcuacgcccccaccgaggucggccuccacgagaugcacaucaaguacaugggcucccacauccccgaguccccccuccaguucuacgucaacuaccccaacuccggcuccgucuccgccuacggccccggccucgucuacggcgucgccaacaagaccgccaccuucaccaucgucaccgaggacgccggcgagggcggccucgaccucgccaucgagggccccuccaaggccgagaucuccugcaucgacaacaaggacggcaccugcaccgucaccuaccuccccacccuccccggcgacuacuccauccucgucaaguacaacgacaagcacauccccggcucccccuucaccgccaagaucaccgacgacucccgccgcugcucccaggucaagcucggcuccgccgccgacuuccuccucgacaucuccgagaccgaccucuccucccucaccgccuccaucaaggcccccuccggccgcgacgagcccugccuccucaagcgccuccccaacaaccacaucggcaucuccuucaucccccgcgaggucggcgagcaccucgucuccaucaagaagaacggcaaccacgucgccaacucccccgucuccaucauggucguccaguccgagaucggcgacgcccgccgcgccaaggucuacggccgcggccucuccgagggccgcaccuucgagauguccgacuucaucgucgacacccgcgacgccggcuacggcggcaucucccucgccgucgagggccccuccaaggucgacauccagaccgaggaccucgaggacggcaccugcaaggucuccuacuuccccaccguccccggcgucuacaucgucuccaccaaguucgccgacgagcacguccccggcucccccuucaccgucaagaucuccggcgagggccgcgucaaggaguccaucacccgcaccucccgcgcccccuccgucgccaccgucggcuccaucugcgaccucaaccucaagauccccgagaucaacuccuccgacauguccgcccacgucaccucccccuccggccgcgucaccgaggccgagaucguccccaugggcaagaacucccacugcguccgcuucgucccccaggagaugggcguccacaccgucuccgucaaguaccgcggccagcacgucaccggcucccccuuccaguucaccgucggcccccucggcgagggcggcgcccacaagguccgcgccggcggccccggccucgagcgcggcgaggccggcguccccgccgaguucuccaucuggacccgcgaggccggcgccggcggccucuccaucgccgucgagggccccuccaaggccgagaucaccuucgacgaccacaagaacggcuccugcggcgucuccuacaucgcccaggagcccggcaacuacgaggucuccaucaaguucaacgacgagcacauccccgagucccccuaccucguccccgucaucgcccccuccgacgacgcccgccgccucaccgucaugucccuccaggaguccggccucaaggucaaccagcccgccuccuucgccauccgccucaacggcgccaagggcaagaucgacgccaagguccacucccccuccggcgccgucgaggagugccacgucuccgagcucgagcccgacaaguacgccguccgcuucaucccccacgagaacggcguccacaccaucgacgucaaguucaacggcucccacgucgucggcucccccuucaagguccgcgucggcgagcccggccaggccggcaaccccgcccucgucuccgccuacggcaccggccucgagggcggcaccaccggcauccaguccgaguucuucaucaacaccacccgcgccggccccggcacccucuccgucaccaucgagggccccuccaaggucaagauggacugccaggagacccccgagggcuacaaggucauguacacccccauggcccccggcaacuaccucaucuccgucaaguacggcggccccaaccacaucgucggcucccccuucaaggccaaggucaccggccagcgccucgucucccccggcuccgccaacgagaccuccuccauccucgucgaguccgucacccgcuccuccaccgagaccugcuacuccgccauccccaaggccuccuccgacgccuccaaggucaccuccaagggcgccggccucuccaaggccuucgucggccagaaguccuccuuccucgucgacugcuccaaggccggcuccaacaugcuccucaucggcguccacggccccaccacccccugcgaggaggucuccaugaagcacgucggcaaccagcaguacaacgucaccuacgucgucaaggagcgcggcgacuacguccucgccgucaaguggggcgaggagcacauccccggcucccccuuccacgucaccguccccuga

SEQ ID NO: 43262 - RNA, 8079 nt, Artificial Sequence
  derived and/or modified sequence opt2 from FLNC__Homo_sapiens__NP_001120959
augaugaacaacuccggcuacuccgacgccggccucggccucggcgacgagaccgacgagaugcccuccaccgagaaggaccucgccgaggacgcccccuggaagaagauccagcagaacaccuucacccgcuggugcaacgagcaccucaagugcgucggcaagcgccucaccgaccuccagcgcgaccucuccgacggccuccgccucaucgcccuccucgagguccucucccagaagcgcauguaccgcaaguuccacccccgccccaacuuccgccagaugaagcucgagaacgucuccgucgcccucgaguuccucgagcgcgagcacaucaagcucgucuccaucgacuccaaggccaucgucgacggcaaccucaagcucauccucggccucaucuggacccucauccuccacuacuccaucuccaugcccaugugggaggacgaggacgacgaggacgcccgcaagcagacccccaagcagcgccuccucggcuggauccagaacaaggucccccagcuccccaucaccaacuucaaccgcgacuggcaggacggcaaggcccucggcgcccucgucgacaacugcgcccccggccucugccccgacugggaggccugggaccccaaccagcccgucgagaacgcccgcgaggccaugcagcaggccgacgacuggcucggcgucccccaggucaucgcccccgaggagaucgucgaccccaacgucgacgagcacuccgucaugaccuaccucucccaguuccccaaggccaagcucaagcccggcgcccccguccgcuccaagcagcucaaccccaagaaggccaucgccuacggccccggcaucgagccccagggcaacaccguccuccagcccgcccacuucaccguccagaccgucgacgccggcgucggcgagguccucgucuacaucgaggaccccgagggccacaccgaggaggccaaggucguccccaacaacgacaaggaccgcaccuacgccgucuccuacguccccaaggucgccggccuccacaaggucaccguccucuucgccggccagaacaucgagcgcucccccuucgaggucaacgucggcauggcccucggcgacgccaacaaggucuccgcccgcggccccggccucgagcccgucggcaacgucgccaacaagcccaccuacuucgacaucuacaccgccggcgccggcaccggcgacgucgccgucgucaucgucgacccccagggccgccgcgacaccgucgaggucgcccucgaggacaagggcgacuccaccuuccgcugcaccuaccgccccgccauggagggcccccacaccguccacgucgccuucgccggcgcccccaucacccgcucccccuuccccguccacgucuccgaggccugcaaccccaacgccugccgcgccuccggccgcggccuccagcccaagggcguccgcgucaaggaggucgccgacuucaaggucuucaccaagggcgccggcuccggcgagcucaaggucaccgucaagggccccaagggcaccgaggagcccgucaagguccgcgaggccggcgacggcgucuucgagugcgaguacuaccccgucguccccggcaaguacgucgucaccaucaccuggggcggcuacgccaucccccgcucccccuucgagguccaggucucccccgaggccggcguccagaagguccgcgccuggggccccggccucgagaccggccaggucggcaaguccgccgacuucgucgucgaggccaucggcaccgaggucggcacccucggcuucuccaucgagggccccucccaggccaagaucgagugcgacgacaagggcgacggcuccugcgacguccgcuacuggcccaccgagcccggcgaguacgccguccacgucaucugcgacgacgaggacauccgcgacucccccuucaucgcccacauccuccccgccccccccgacugcuuccccgacaaggucaaggccuucggccccggccucgagcccaccggcugcaucgucgacaagcccgccgaguucaccaucgacgcccgcgccgccggcaagggcgaccucaagcucuacgcccaggacgccgacggcugccccaucgacaucaaggucauccccaacggcgacggcaccuuccgcugcuccuacguccccaccaagcccaucaagcacaccaucaucaucuccuggggcggcgucaacguccccaagucccccuuccgcgucaacgucggcgagggcucccaccccgagcgcgucaaggucuacggccccggcgucgagaagaccggccucaaggccaacgagcccaccuacuucaccgucgacugcuccgaggccggccagggcgacgucuccaucggcaucaagugcgcccccggcgucgucggccccgccgaggccgacaucgacuucgacaucaucaagaacgacaacgacaccuucaccgucaaguacaccccccccggcgccggccgcuacaccaucaugguccucuucgccaaccaggagauccccgccucccccuuccacaucaaggucgaccccucccacgacgccuccaaggucaaggccgagggccccggccucaaccgcaccggcgucgaggucggcaagcccacccacuucaccguccucaccaagggcgccggcaaggccaagcucgacguccaguucgccggcaccgccaagggcgaggucguccgcgacuucgagaucaucgacaaccacgacuacuccuacaccgucaaguacaccgccguccagcagggcaacauggccgucaccgucaccuacggcggcgaccccguccccaagucccccuucgucgucaacgucgcccccccccucgaccucuccaagaucaagguccagggccucaacuccaaggucgccgucggccaggagcaggccuucuccgucaacacccgcggcgccggcggccagggccagcucgacguccgcaugaccucccccucccgccgccccauccccugcaagcucgagcccggcggcggcgccgaggcccaggccguccgcuacaugccccccgaggagggccccuacaaggucgacaucaccuacgacggccaccccguccccggcucccccuucgccgucgagggcguccucccccccgaccccuccaaggucugcgccuacggccccggccucaagggcggccucgucggcacccccgcccccuucuccaucgacaccaagggcgccggcaccggcggccucggccucaccgucgagggccccugcgaggccaagaucgagugccaggacaacggcgacggcuccugcgccgucuccuaccuccccaccgagcccggcgaguacaccaucaacauccucuucgccgaggcccacauccccggcucccccuucaaggccaccauccgccccgucuucgaccccuccaagguccgcgccuccggccccggccucgagcgcggcaaggucggcgaggccgccaccuucaccgucgacugcuccgaggccggcgaggccgagcucaccaucgagauccucuccgacgccggcgucaaggccgagguccucauccacaacaacgccgacggcaccuaccacaucaccuacucccccgccuuccccggcaccuacaccaucaccaucaaguacggcggccaccccguccccaaguuccccacccgcguccacguccagcccgccgucgacaccuccggcgucaaggucuccggccccggcgucgagccccacggcguccuccgcgaggucaccaccgaguucaccgucgacgcccgcucccucaccgccaccggcggcaaccacgucaccgcccgcguccucaaccccuccggcgccaagaccgacaccuacgucaccgacaacggcgacggcaccuaccgcguccaguacaccgccuacgaggagggcguccaccucgucgagguccucuacgacgaggucgccguccccaagucccccuuccgcgucggcgucaccgagggcugcgaccccacccgcguccgcgccuucggccccggccucgagggcggccucgucaacaaggccaaccgcuucaccgucgagacccgcggcgccggcaccggcggccucggccucgccaucgagggccccuccgaggccaagauguccugcaaggacaacaaggacggcuccugcaccgucgaguacauccccuucacccccggcgacuacgacgucaacaucaccuucggcggccgccccauccccggcucccccuuccgcguccccgucaaggacgucgucgaccccggcaaggucaagugcuccggccccggccucggcgccggcguccgcgcccgcgucccccagaccuucaccgucgacugcucccaggccggccgcgccccccuccaggucgccguccucggccccaccggcgucgccgagcccgucgagguccgcgacaacggcgacggcacccacaccguccacuacacccccgccaccgacggccccuacaccgucgccgucaaguacgccgaccaggaggucccccgcucccccuucaagaucaagguccuccccgcccacgacgccuccaagguccgcgccuccggccccggccucaacgccuccggcauccccgccucccuccccgucgaguucaccaucgacgcccgcgacgccggcgagggccuccucaccguccagauccucgaccccgagggcaagcccaagaaggccaacauccgcgacaacggcgacggcaccuacaccgucuccuaccuccccgacauguccggccgcuacaccaucaccaucaaguacggcggcgacgagauccccuacucccccuuccgcauccacgcccuccccaccggcgacgccuccaagugccucgucaccgucuccaucggcggccacggccucggcgccugccucggcccccgcauccagaucggccaggagaccgucaucaccgucgacgccaaggccgccggcgagggcaaggucaccugcaccgucuccacccccgacggcgccgagcucgacgucgacgucgucgagaaccacgacggcaccuucgacaucuacuacaccgcccccgagcccggcaaguacgucaucaccauccgcuucggcggcgagcacauccccaacucccccuuccacguccucgccaccgaggagcccgucguccccgucgagcccauggaguccaugcuccgccccuucaaccucgucauccccuucgccguccagaagggcgagcucaccggcgagguccgcaugcccuccggcaagaccgcccgccccaacaucaccgacaacaaggacggcaccaucaccguccgcuacgcccccaccgagaagggccuccaccagaugggcaucaaguacgacggcaaccacauccccggcuccccccuccaguucuacgucgacgccaucaacucccgccacgucuccgccuacggccccggccucucccacggcauggucaacaagcccgccaccuucaccaucgucaccaaggacgccggcgagggcggccucucccucgccgucgagggccccuccaaggccgagaucaccugcaaggacaacaaggacggcaccugcaccgucuccuaccuccccaccgcccccggcgacuacuccaucaucguccgcuucgacgacaagcacauccccggcucccccuucaccgccaagaucaccggcgacgacuccaugcgcaccucccagcucaacgucggcaccuccaccgacgucucccucaagaucaccgaguccgaccucucccagcucaccgccuccauccgcgcccccuccggcaacgaggagcccugccuccucaagcgccuccccaaccgccacaucggcaucuccuucacccccaaggaggucggcgagcacgucgucuccguccgcaaguccggcaagcacgucaccaacucccccuucaagauccucgucggccccuccgagaucggcgacgccuccaagguccgcgucuggggcaagggccucuccgagggccacaccuuccaggucgccgaguucaucgucgacacccgcaacgccggcuacggcggccucggccucuccaucgagggccccuccaaggucgacaucaacugcgaggacauggaggacggcaccugcaaggucaccuacugccccaccgagcccggcaccuacaucaucaacaucaaguucgccgacaagcacguccccggcucccccuucaccgucaaggucaccggcgagggccgcaugaaggaguccaucacccgccgccgccaggcccccuccaucgccaccaucggcuccaccugcgaccucaaccucaagauccccggcaacugguuccagauggucuccgcccaggagcgccucacccgcaccuucacccgcuccucccacaccuacacccgcaccgagcgcaccgagaucuccaagacccgcggcggcgagaccaagcgcgagguccgcgucgaggaguccacccaggucggcggcgaccccuuccccgccgucuucggcgacuuccucggccgcgagcgccucggcuccuucggcuccaucacccgccagcaggagggcgaggccuccucccaggacaugaccgcccaggucaccucccccuccggcaaggucgaggccgccgagaucgucgagggcgaggacuccgccuacuccguccgcuucgucccccaggagaugggcccccacaccgucgccgucaaguaccgcggccagcacguccccggcucccccuuccaguucaccgucggcccccucggcgagggcggcgcccacaagguccgcgccggcggcaccggccucgagcgcggcgucgccggcguccccgccgaguucuccaucuggacccgcgaggccggcgccggcggccucuccaucgccgucgagggccccuccaaggccgagaucgccuucgaggaccgcaaggacggcuccugcggcgucuccuacgucguccaggagcccggcgacuacgaggucuccaucaaguucaacgacgagcacauccccgacucccccuucgucguccccgucgccucccucuccgacgacgcccgccgccucaccgucaccucccuccaggagaccggccucaaggucaaccagcccgccuccuucgccguccagcucaacggcgcccgcggcgucaucgacgcccgcguccacacccccuccggcgccgucgaggagugcuacgucuccgagcucgacuccgacaagcacaccauccgcuucaucccccacgagaacggcguccacuccaucgacgucaaguucaacggcgcccacauccccggcucccccuucaagauccgcgucggcgagcagucccaggccggcgaccccggccucgucuccgccuacggccccggccucgagggcggcaccaccggcgucuccuccgaguucaucgucaacacccucaacgccggcuccggcgcccucuccgucaccaucgacggccccuccaagguccagcucgacugccgcgagugccccgagggccacgucgucaccuacacccccauggcccccggcaacuaccucaucgccaucaaguacggcggcccccagcacaucgucggcucccccuucaaggccaaggucaccggcccccgccucuccggcggccacucccuccacgagaccuccaccguccucgucgagaccgucaccaaguccuccuccucccgcggcuccuccuacuccuccauccccaaguucuccuccgacgccuccaaggucgucacccgcggccccggccucucccaggccuucgucggccagaagaacuccuucaccgucgacugcuccaaggccggcaccaacaugaugauggucggcguccacggccccaagacccccugcgaggaggucuacgucaagcacaugggcaaccgcgucuacaacgucaccuacaccgucaaggagaagggcgacuacauccucaucgucaaguggggcgacgaguccguccccggcucccccuucaaggucaagguccccuga

SEQ ID NO: 43263 - RNA, 1284 nt, Artificial Sequence
  derived and/or modified sequence opt2 from FLOT1__Homo_sapiens__NP_005794
auguucuucaccugcggccccaacgaggccauggucgucuccggcuucugccgcuccccccccgucauggucgccggcggccgcgucuucguccuccccugcauccagcagauccagcgcaucucccucaacacccucacccucaacgucaaguccgagaaggucuacacccgccacggcguccccaucuccgucaccggcaucgcccaggucaagauccagggccagaacaaggagaugcucgccgccgccugccagauguuccucggcaagaccgaggccgagaucgcccacaucgcccucgagacccucgagggccaccagcgcgccaucauggcccacaugaccgucgaggagaucuacaaggaccgccagaaguucuccgagcaggucuucaaggucgccuccuccgaccucgucaacaugggcaucuccgucgucuccuacacccucaaggacauccacgacgaccaggacuaccuccacucccucggcaaggcccgcaccgcccagguccagaaggacgcccgcaucggcgaggccgaggccaagcgcgacgccggcauccgcgaggccaaggccaagcaggagaaggucuccgcccaguaccucuccgagaucgagauggccaaggcccagcgcgacuacgagcucaagaaggccgccuacgacaucgaggucaacacccgccgcgcccaggccgaccucgccuaccagcuccaggucgccaagaccaagcagcagaucgaggagcagcgcguccagguccaggucgucgagcgcgcccagcaggucgccguccaggagcaggagaucgcccgccgcgagaaggagcucgaggcccgcguccgcaagcccgccgaggccgagcgcuacaagcucgagcgccucgccgaggccgagaagucccagcucaucaugcaggccgaggccgaggccgccuccguccgcaugcgcggcgaggccgaggccuucgccaucggcgcccgcgcccgcgccgaggccgagcagauggccaagaaggccgaggccuuccagcucuaccaggaggccgcccagcucgacaugcuccucgagaagcucccccaggucgccgaggagaucuccggcccccucaccuccgccaacaagaucacccucgucuccuccggcuccggcaccaugggcgccgccaaggucaccggcgagguccucgacauccucacccgccuccccgaguccgucgagcgccucaccggcgucuccaucucccaggucaaccacaagccccuccgcaccgccuga

SEQ ID NO: 43264 - RNA, 1287 nt, Artificial Sequence
  derived and/or modified sequence opt2 from FLOT2__Homo_sapiens__NP_004466
augggcaacugccacaccgucggccccaacgaggcccucgucgucuccggcggcugcugcggcuccgacuacaagcaguacgucuucggcggcugggccugggccugguggugcaucuccgacacccagcgcaucucccucgagaucaugacccuccagccccgcugcgaggacgucgagaccgccgagggcgucgcccucaccgucaccggcgucgcccaggucaagaucaugaccgagaaggagcuccucgccgucgccugcgagcaguuccucggcaagaacguccaggacaucaagaacgucguccuccagacccucgagggccaccuccgcuccauccucggcacccucaccgucgagcagaucuaccaggaccgcgaccaguucgccaagcucguccgcgaggucgccgcccccgacgucggccgcaugggcaucgagauccucuccuucaccaucaaggacgucuacgacaaggucgacuaccucuccucccucggcaagacccagaccgccgucguccagcgcgacgccgacaucggcgucgccgaggccgagcgcgacgccggcauccgcgaggccgagugcaagaaggagaugcucgacgucaaguucauggccgacaccaagaucgccgacuccaagcgcgccuucgagcuccagaaguccgccuucuccgaggaggucaacaucaagaccgccgaggcccagcucgccuacgagcuccagggcgcccgcgagcagcagaagauccgccaggaggagaucgagaucgaggucguccagcgcaagaagcagaucgccgucgaggcccaggagauccuccgcaccgacaaggagcucaucgccaccguccgccgccccgccgaggccgaggcccaccgcauccagcagaucgccgagggcgagaaggucaagcagguccuccucgcccaggccgaggccgagaagauccgcaagaucggcgaggccgaggccgccgucaucgaggccaugggcaaggccgaggccgagcgcaugaagcucaaggccgaggccuaccagaaguacggcgacgccgccaagauggcccucguccucgaggcccucccccagaucgccgccaagaucgccgccccccucaccaaggucgacgagaucgucguccucuccggcgacaacuccaaggucaccuccgaggucaaccgccuccucgccgagcuccccgccuccguccacgcccucaccggcgucgaccucuccaagaucccccucaucaagaaggccaccggcguccaggucuga

SEQ ID NO: 43265 - RNA, 1983 nt, Artificial Sequence
  derived and/or modified sequence opt2 from FLRT2__Homo_sapiens__NP_037363
augggccuccagaccaccaaguggcccucccacggcgccuucuuccucaaguccuggcucaucaucucccucggccucuacucccaggucuccaagcuccucgccugccccuccgucugccgcugcgaccgcaacuucgucuacugcaacgagcgcucccucaccuccgucccccucggcauccccgagggcgucaccguccucuaccuccacaacaaccagaucaacaacgccggcuuccccgccgagcuccacaacguccaguccguccacaccgucuaccucuacggcaaccagcucgacgaguuccccaugaaccuccccaagaacguccgcguccuccaccuccaggagaacaacauccagaccaucucccgcgccgcccucgcccagcuccucaagcucgaggagcuccaccucgacgacaacuccaucuccaccgucggcgucgaggacggcgccuuccgcgaggccaucucccucaagcuccucuuccucuccaagaaccaccucuccuccguccccgucggccuccccgucgaccuccaggagcuccgcgucgacgagaaccgcaucgccgucaucuccgacauggccuuccagaaccucaccucccucgagcgccucaucgucgacggcaaccuccucaccaacaagggcaucgccgagggcaccuucucccaccucaccaagcucaaggaguucuccaucguccgcaacucccucucccaccccccccccgaccuccccggcacccaccucauccgccucuaccuccaggacaaccagaucaaccacaucccccucaccgccuucuccaaccuccgcaagcucgagcgccucgacaucuccaacaaccagcuccgcaugcucacccagggcgucuucgacaaccucuccaaccucaagcagcucaccgcccgcaacaaccccugguucugcgacugcuccaucaagugggucaccgaguggcucaaguacauccccuccucccucaacguccgcggcuucaugugccagggccccgagcagguccgcggcauggccguccgcgagcucaacaugaaccuccucuccugccccaccaccacccccggccucccccucuucacccccgcccccuccaccgccucccccaccacccagccccccacccucuccauccccaaccccucccgcuccuacaccccccccacccccaccaccuccaagcuccccaccauccccgacugggacggccgcgagcgcgucaccccccccaucuccgagcgcauccagcucuccauccacuucgucaacgacaccuccauccaggucuccuggcucucccucuucaccgucauggccuacaagcucaccugggucaagaugggccacucccucgucggcggcaucguccaggagcgcaucgucuccggcgagaagcagcaccucucccucgucaaccucgagccccgcuccaccuaccgcaucugccucgucccccucgacgccuucaacuaccgcgccgucgaggacaccaucugcuccgaggccaccacccacgccuccuaccucaacaacggcuccaacaccgccuccucccacgagcagaccaccucccacuccaugggcucccccuuccuccucgccggccucaucggcggcgccgucaucuucguccucgucguccuccucuccgucuucugcuggcacaugcacaagaagggccgcuacaccucccagaaguggaaguacaaccgcggccgccgcaaggacgacuacugcgaggccggcaccaagaaggacaacuccauccucgagaugaccgagaccuccuuccagaucgucucccucaacaacgaccagcuccucaagggcgacuuccgccuccagcccaucuacacccccaacggcggcaucaacuacaccgacugccacauccccaacaacaugcgcuacugcaacuccuccguccccgaccucgagcacugccacaccuga

SEQ ID NO: 43266 - RNA, 1950 nt, Artificial Sequence
  derived and/or modified sequence opt2 from FLRT3__Homo_sapiens__NP_938205
augaucuccgccgccugguccaucuuccucaucggcaccaagaucggccucuuccuccaggucgccccccucuccgucauggccaaguccugccccuccgucugccgcugcgacgccggcuucaucuacugcaacgaccgcuuccucaccuccauccccaccggcauccccgaggacgccaccacccucuaccuccagaacaaccagaucaacaacgccggcauccccuccgaccucaagaaccuccucaaggucgagcgcaucuaccucuaccacaacucccucgacgaguuccccaccaaccuccccaaguacgucaaggagcuccaccuccaggagaacaacauccgcaccaucaccuacgacucccucuccaagauccccuaccucgaggagcuccaccucgacgacaacuccgucuccgccgucuccaucgaggagggcgccuuccgcgacuccaacuaccuccgccuccucuuccucucccgcaaccaccucuccaccauccccuggggccucccccgcaccaucgaggagcuccgccucgacgacaaccgcaucuccaccaucuccucccccucccuccagggccucaccucccucaagcgccucguccucgacggcaaccuccucaacaaccacggccucggcgacaaggucuucuucaaccucgucaaccucaccgagcucucccucguccgcaacucccucaccgccgcccccgucaaccuccccggcaccaaccuccgcaagcucuaccuccaggacaaccacaucaaccgcgucccccccaacgccuucuccuaccuccgccagcucuaccgccucgacauguccaacaacaaccucuccaaccucccccagggcaucuucgacgaccucgacaacaucacccagcucauccuccgcaacaaccccugguacugcggcugcaagaugaaguggguccgcgacuggcuccagucccuccccgucaaggucaacguccgcggccucaugugccaggcccccgagaagguccgcggcauggccaucaaggaccucaacgccgagcucuucgacugcaaggacuccggcaucgucuccaccauccagaucaccaccgccauccccaacaccgucuaccccgcccagggccaguggcccgcccccgucaccaagcagcccgacaucaagaaccccaagcucaccaaggaccaccagaccaccggcucccccucccgcaagaccaucaccaucaccgucaaguccgucaccuccgacaccauccacaucuccuggaagcucgcccuccccaugaccgcccuccgccucuccuggcucaagcucggccacucccccgccuucggcuccaucaccgagaccaucgucaccggcgagcgcuccgaguaccucgucaccgcccucgagcccgacucccccuacaaggucugcaugguccccauggagaccuccaaccucuaccucuucgacgagacccccgucugcaucgagaccgagaccgccccccuccgcauguacaaccccaccaccacccucaaccgcgagcaggagaaggagcccuacaagaaccccaaccucccccucgccgccaucaucggcggcgccgucgcccucgucaccaucgcccuccucgcccucgucugcugguacguccaccgcaacggcucccucuucucccgcaacugcgccuacuccaagggccgccgccgcaaggacgacuacgccgaggccggcaccaagaaggacaacuccauccucgagauccgcgagaccuccuuccagaugcuccccaucuccaacgagcccaucuccaaggaggaguucgucauccacaccaucuucccccccaacggcaugaaccucuacaagaacaaccacuccgaguccuccuccaaccgcuccuaccgcgacuccggcauccccgacuccgaccacucccacuccuga

SEQ ID NO: 43267 - RNA, 2064 nt, Artificial Sequence
  derived and/or modified sequence opt2 from FLT1__Homo_sapiens__NP_001153392
auggucuccuacugggacaccggcguccuccucugcgcccuccucuccugccuccuccucaccggcuccuccuccggcuccaagcucaaggaccccgagcucucccucaagggcacccagcacaucaugcaggccggccagacccuccaccuccagugccgcggcgaggccgcccacaaguggucccuccccgagauggucuccaaggaguccgagcgccucuccaucaccaaguccgccugcggccgcaacggcaagcaguucugcuccacccucacccucaacaccgcccaggccaaccacaccggcuucuacuccugcaaguaccucgccguccccaccuccaagaagaaggagaccgaguccgccaucuacaucuucaucuccgacaccggccgccccuucgucgagauguacuccgagauccccgagaucauccacaugaccgagggccgcgagcucgucauccccugccgcgucaccucccccaacaucaccgucacccucaagaaguucccccucgacacccucauccccgacggcaagcgcaucaucugggacucccgcaagggcuucaucaucuccaacgccaccuacaaggagaucggccuccucaccugcgaggccaccgucaacggccaccucuacaagaccaacuaccucacccaccgccagaccaacaccaucaucgacguccagaucuccaccccccgccccgucaagcuccuccgcggccacacccucguccucaacugcaccgccaccaccccccucaacacccgcguccagaugaccugguccuaccccgacgagaagaacaagcgcgccuccguccgccgccgcaucgaccaguccaacucccacgccaacaucuucuacuccguccucaccaucgacaagaugcagaacaaggacaagggccucuacaccugccgcguccgcuccggccccuccuucaaguccgucaacaccuccguccacaucuacgacaaggccuucaucaccgucaagcaccgcaagcagcagguccucgagaccgucgccggcaagcgcuccuaccgccucuccaugaaggucaaggccuuccccucccccgaggucgucuggcucaaggacggccuccccgccaccgagaaguccgcccgcuaccucacccgcggcuacucccucaucaucaaggacgucaccgaggaggacgccggcaacuacaccauccuccucuccaucaagcaguccaacgucuucaagaaccucaccgccacccucaucgucaacgucaagccccagaucuacgagaaggccgucuccuccuuccccgaccccgcccucuacccccucggcucccgccagauccucaccugcaccgccuacggcaucccccagcccaccaucaagugguucuggcaccccugcaaccacaaccacuccgaggcccgcugcgacuucugcuccaacaacgaggaguccuucauccucgacgccgacuccaacaugggcaaccgcaucgaguccaucacccagcgcauggccaucaucgagggcaagaacaagauggccuccacccucgucgucgccgacucccgcaucuccggcaucuacaucugcaucgccuccaacaaggucggcaccgucggccgcaacaucuccuucuacaucaccgacguccccaacggcuuccacgucaaccucgagaagaugcccaccgagggcgaggaccucaagcucuccugcaccgucaacaaguuccucuaccgcgacgucaccuggauccuccuccgcaccgucaacaaccgcaccaugcacuacuccaucuccaagcagaagauggccaucaccaaggagcacuccaucacccucaaccucaccaucaugaacgucucccuccaggacuccggcaccuacgccugccgcgcccgcaacgucuacaccggcgaggagauccuccagaagaaggagaucaccauccgcggcgagcacugcaacaagaaggccgucuucucccgcaucuccaaguucaaguccacccgcaacgacugcaccacccaguccaacgucaagcacuga

SEQ ID NO: 43268 - RNA, 2982 nt, Artificial Sequence
  derived and/or modified sequence opt2 from FLT3__Homo_sapiens__NP_004110
augcccgcccucgcccgcgacggcggccagcucccccuccucgucgucuucuccgccaugaucuucggcaccaucaccaaccaggaccuccccgucaucaagugcguccucaucaaccacaagaacaacgacuccuccgucggcaaguccuccuccuaccccauggucuccgagucccccgaggaccucggcugcgcccuccgcccccaguccuccggcaccgucuacgaggccgccgccgucgaggucgacgucuccgccuccaucacccuccagguccucgucgacgcccccggcaacaucuccugccucugggucuucaagcacuccucccucaacugccagccccacuucgaccuccagaaccgcggcgucgucuccauggucauccucaagaugaccgagacccaggccggcgaguaccuccucuucauccaguccgaggccaccaacuacaccauccucuucaccgucuccauccgcaacacccuccucuacacccuccgccgccccuacuuccgcaagauggagaaccaggacgcccucgucugcaucuccgaguccguccccgagcccaucgucgaguggguccucugcgacucccagggcgaguccugcaaggaggagucccccgccgucgucaagaaggaggagaagguccuccacgagcucuucggcaccgacauccgcugcugcgcccgcaacgagcucggccgcgagugcacccgccucuucaccaucgaccucaaccagaccccccagaccacccucccccagcucuuccucaaggucggcgagccccucuggauccgcugcaaggccguccacgucaaccacggcuucggccucaccugggagcucgagaacaaggcccucgaggagggcaacuacuucgagauguccaccuacuccaccaaccgcaccaugauccgcauccucuucgccuucgucuccuccgucgcccgcaacgacaccggcuacuacaccugcuccuccuccaagcaccccucccaguccgcccucgucaccaucgucgagaagggcuucaucaacgccaccaacuccuccgaggacuacgagaucgaccaguacgaggaguucugcuucuccguccgcuucaaggccuacccccagauccgcugcaccuggaccuucucccgcaaguccuuccccugcgagcagaagggccucgacaacggcuacuccaucuccaaguucugcaaccacaagcaccagcccggcgaguacaucuuccacgccgagaacgacgacgcccaguucaccaagauguucacccucaacauccgccgcaagccccagguccucgccgaggccuccgccucccaggccuccugcuucuccgacggcuacccccuccccuccuggaccuggaagaagugcuccgacaagucccccaacugcaccgaggagaucaccgagggcgucuggaaccgcaaggccaaccgcaaggucuucggccagugggucuccuccuccacccucaacauguccgaggccaucaagggcuuccucgucaagugcugcgccuacaacucccucggcaccuccugcgagaccauccuccucaacucccccggccccuuccccuucauccaggacaacaucuccuucuacgccaccaucggcgucugccuccucuucaucgucguccucacccuccucaucugccacaaguacaagaagcaguuccgcuacgagucccagcuccagaugguccaggucaccggcuccuccgacaacgaguacuucuacgucgacuuccgcgaguacgaguacgaccucaagugggaguucccccgcgagaaccucgaguucggcaagguccucggcuccggcgccuucggcaaggucaugaacgccaccgccuacggcaucuccaagaccggcgucuccauccaggucgccgucaagaugcucaaggagaaggccgacuccuccgagcgcgaggcccucauguccgagcucaagaugaugacccagcucggcucccacgagaacaucgucaaccuccucggcgccugcacccucuccggccccaucuaccucaucuucgaguacugcugcuacggcgaccuccucaacuaccuccgcuccaagcgcgagaaguuccaccgcaccuggaccgagaucuucaaggagcacaacuucuccuucuaccccaccuuccagucccaccccaacuccuccaugcccggcucccgcgagguccagauccaccccgacuccgaccagaucuccggccuccacggcaacuccuuccacuccgaggacgagaucgaguacgagaaccagaagcgccucgaggaggaggaggaccucaacguccucaccuucgaggaccuccucugcuucgccuaccaggucgccaagggcauggaguuccucgaguucaaguccugcguccaccgcgaccucgccgcccgcaacguccucgucacccacggcaaggucgucaagaucugcgacuucggccucgcccgcgacaucauguccgacuccaacuacgucguccgcggcaacgcccgccuccccgucaaguggauggcccccgagucccucuucgagggcaucuacaccaucaaguccgacgucugguccuacggcauccuccucugggagaucuucucccucggcgucaaccccuaccccggcauccccgucgacgccaacuucuacaagcucauccagaacggcuucaagauggaccagcccuucuacgccaccgaggagaucuacaucaucaugcaguccugcugggccuucgacucccgcaagcgccccuccuuccccaaccucaccuccuuccucggcugccagcucgccgacgccgaggaggccauguaccagaacgucgacggccgcgucuccgagugcccccacaccuaccagaaccgccgccccuucucccgcgagauggaccucggccuccucuccccccaggcccaggucgaggacuccuga

SEQ ID NO: 43269 - RNA, 708 nt, Artificial Sequence
  derived and/or modified sequence opt2 from FLT3LG__Homo_sapiens__NP_001450
augaccguccucgcccccgccuggucccccaccaccuaccuccuccuccuccuccuccucuccuccggccucuccggcacccaggacugcuccuuccagcacucccccaucuccuccgacuucgccgucaagauccgcgagcucuccgacuaccuccuccaggacuaccccgucaccgucgccuccaaccuccaggacgaggagcucugcggcggccucuggcgccucguccucgcccagcgcuggauggagcgccucaagaccgucgccggcuccaagaugcagggccuccucgagcgcgucaacaccgagauccacuucgucaccaagugcgccuuccagcccccccccuccugccuccgcuucguccagaccaacaucucccgccuccuccaggagaccuccgagcagcucgucgcccucaagcccuggaucacccgccagaacuucucccgcugccucgagcuccagugccagcccgacuccuccacccuccccccccccugguccccccgcccccucgaggccaccgcccccaccgccccccagcccccccuccuccuccuccuccuccuccccgucggccuccuccuccucgccgccgccuggugccuccacuggcagcgcacccgccgccgcaccccccgccccggcgagcaggucccccccguccccuccccccaggaccuccuccucgucgagcacuga

SEQ ID NO: 43270 - RNA, 3897 nt, Artificial Sequence
  derived and/or modified sequence opt2 from FLT4__Homo_sapiens__NP_002011
augcagcgcggcgccgcccucugccuccgccucuggcucugccucggccuccucgacggccucgucuccggcuacuccaugaccccccccacccucaacaucaccgaggagucccacgucaucgacaccggcgacucccucuccaucuccugccgcggccagcacccccucgagugggccuggcccggcgcccaggaggcccccgccaccggcgacaaggacuccgaggacaccggcgucguccgcgacugcgagggcaccgacgcccgccccuacugcaagguccuccuccuccacgagguccacgccaacgacaccggcuccuacgucugcuacuacaaguacaucaaggcccgcaucgagggcaccaccgccgccuccuccuacgucuucguccgcgacuucgagcagcccuucaucaacaagcccgacacccuccucgucaaccgcaaggacgccauguggguccccugccucgucuccauccccggccucaacgucacccuccgcucccaguccuccguccucuggcccgacggccaggaggucgucugggacgaccgccgcggcaugcucgucuccaccccccuccuccacgacgcccucuaccuccagugcgagaccaccuggggcgaccaggacuuccucuccaaccccuuccucguccacaucaccggcaacgagcucuacgacauccagcuccucccccgcaagucccucgagcuccucgucggcgagaagcucguccucaacugcaccgucugggccgaguucaacuccggcgucaccuucgacugggacuaccccggcaagcaggccgagcgcggcaaguggguccccgagcgccgcucccagcagacccacaccgagcucuccuccauccucaccauccacaacgucucccagcacgaccucggcuccuacgucugcaaggccaacaacggcauccagcgcuuccgcgaguccaccgaggucaucguccacgagaaccccuucaucuccgucgaguggcucaagggccccauccucgaggccaccgccggcgacgagcucgucaagcuccccgucaagcucgccgccuaccccccccccgaguuccagugguacaaggacggcaaggcccucuccggccgccacuccccccacgcccucguccucaaggaggucaccgaggccuccaccggcaccuacacccucgcccucuggaacuccgccgccggccuccgccgcaacaucucccucgagcucgucgucaacguccccccccagauccacgagaaggaggccuccucccccuccaucuacucccgccacucccgccaggcccucaccugcaccgccuacggcgucccccucccccucuccauccaguggcacuggcgccccuggacccccugcaagauguucgcccagcgcucccuccgccgccgccagcagcaggaccucaugccccagugccgcgacuggcgcgccgucaccacccaggacgccgucaaccccaucgagucccucgacaccuggaccgaguucgucgagggcaagaacaagaccgucuccaagcucgucauccagaacgccaacgucuccgccauguacaagugcgucgucuccaacaaggucggccaggacgagcgccucaucuacuucuacgucaccaccauccccgacggcuucaccaucgaguccaagcccuccgaggagcuccucgagggccagcccguccuccucuccugccaggccgacuccuacaaguacgagcaccuccgcugguaccgccucaaccucuccacccuccacgacgcccacggcaacccccuccuccucgacugcaagaacguccaccucuucgccaccccccucgccgccucccucgaggaggucgcccccggcgcccgccacgccacccucucccucuccaucccccgcgucgcccccgagcacgagggccacuacgucugcgagguccaggaccgccgcucccacgacaagcacugccacaagaaguaccucuccguccaggcccucgaggccccccgccucacccagaaccucaccgaccuccucgucaacgucuccgacucccucgagaugcagugccucgucgccggcgcccacgcccccuccaucgucugguacaaggacgagcgccuccucgaggagaaguccggcgucgaccucgccgacuccaaccagaagcucuccauccagcgcguccgcgaggaggacgccggccgcuaccucugcuccgucugcaacgccaagggcugcgucaacuccuccgccuccgucgccgucgagggcuccgaggacaagggcuccauggagaucgucauccucgucggcaccggcgucaucgccgucuucuucuggguccuccuccuccucaucuucugcaacaugcgccgccccgcccacgccgacaucaagaccggcuaccucuccaucaucauggaccccggcgaggucccccucgaggagcagugcgaguaccucuccuacgacgccucccagugggaguucccccgcgagcgccuccaccucggccgcguccucggcuacggcgccuucggcaaggucgucgaggccuccgccuucggcauccacaagggcuccuccugcgacaccgucgccgucaagaugcucaaggagggcgccaccgccuccgagcaccgcgcccucauguccgagcucaagauccucauccacaucggcaaccaccucaacgucgucaaccuccucggcgccugcaccaagccccagggcccccucauggucaucgucgaguucugcaaguacggcaaccucuccaacuuccuccgcgccaagcgcgacgccuucucccccugcgccgagaagucccccgagcagcgcggccgcuuccgcgccauggucgagcucgcccgccucgaccgccgccgccccggcuccuccgaccgcguccucuucgcccgcuucuccaagaccgagggcggcgcccgccgcgccucccccgaccaggaggccgaggaccucuggcucuccccccucaccauggaggaccucgucugcuacuccuuccaggucgcccgcggcauggaguuccucgccucccgcaagugcauccaccgcgaccucgccgcccgcaacauccuccucuccgaguccgacgucgucaagaucugcgacuucggccucgcccgcgacaucuacaaggaccccgacuacguccgcaagggcuccgcccgccucccccucaaguggauggcccccgaguccaucuucgacaaggucuacaccacccaguccgacgucugguccuucggcguccuccucugggagaucuucucccucggcgccucccccuaccccggcguccagaucaacgaggaguucugccagcgccuccgcgacggcacccgcaugcgcgcccccgagcucgccacccccgccauccgccgcaucaugcucaacugcugguccggcgaccccaaggcccgccccgccuucuccgagcucgucgagauccucggcgaccuccuccagggccgcggccuccaggaggaggaggaggucugcauggccccccgcuccucccaguccuccgaggagggcuccuucucccaggucuccaccauggcccuccacaucgcccaggccgacgccgaggacuccccccccucccuccagcgccacucccucgccgcccgcuacuacaacugggucuccuuccccggcugccucgcccgcggcgccgagacccgcggcuccucccgcaugaagaccuucgaggaguuccccaugacccccaccaccuacaagggcuccgucgacaaccagaccgacuccggcaugguccucgccuccgaggaguucgagcagaucgagucccgccaccgccaggaguccggcuuccgcuga

SEQ ID NO: 43271 - RNA, 1668 nt, Artificial Sequence
  derived and/or modified sequence opt2 from FLVCR1__Homo_sapiens__NP_054772
auggcccgccccgacgacgaggagggcgccgccgucgcccccggccacccccucgccaagggcuaccucccccucccccgcggcgcccccgucggcaaggaguccgucgagcuccagaacggccccaaggccggcaccuuccccgucaacggcgccccccgcgacucccucgccgccgccuccggcguccucggcggcccccagaccccccucgcccccgaggaggagacccaggcccgccuccuccccgccggcgccggcgccgagacccccggcgccgaguccuccccccucccccucaccgcccucuccccccgccgcuucgucguccuccucaucuucucccucuacucccucgucaacgccuuccaguggauccaguacuccaucaucuccaacgucuucgagggcuucuacggcgucacccuccuccacaucgacuggcucuccauggucuacaugcucgccuacgucccccucaucuuccccgccaccuggcuccucgacacccgcggccuccgccucaccgcccuccucggcuccggccucaacugccucggcgccuggaucaagugcggcuccguccagcagcaccucuucugggucaccaugcucggccagugccucugcuccgucgcccaggucuucauccucggccuccccucccgcaucgccuccgucugguucggccccaaggaggucuccaccgccugcgccaccgccguccucggcaaccagcucggcaccgccgucggcuuccuccucccccccguccucguccccaacacccagaacgacaccaaccuccucgccugcaacaucuccaccauguucuacggcaccuccgccgucgccacccuccucuucauccucaccgccaucgccuucaaggagaagccccgcuacccccccucccaggcccaggccgcccuccaggacuccccccccgaggaguacuccuacaagaaguccauccgcaaccucuucaagaacauccccuucguccuccuccucaucaccuacggcaucaugaccggcgccuucuacuccgucuccacccuccucaaccagaugauccucaccuacuacgagggcgaggaggucaacgccggccgcaucggccucacccucgucgucgccggcauggucggcuccauccucugcggccucuggcucgacuacaccaagaccuacaagcagaccacccucaucgucuacauccucuccuucaucggcauggucaucuucaccuucacccucgaccuccgcuacaucaucaucgucuucgucaccggcggcguccucggcuucuucaugaccggcuaccucccccucggcuucgaguucgccgucgagaucaccuaccccgaguccgagggcaccuccuccggccuccucaacgccuccgcccagaucuucggcauccucuucacccucgcccagggcaagcucaccuccgacuacggccccaaggccggcaacaucuuccucugcgucuggauguucaucggcaucauccucaccgcccucaucaaguccgaccuccgccgccacaacaucaacaucggcaucaccaacgucgacgucaaggccauccccgccgacucccccaccgaccaggagcccaagaccgucaugcucuccaagcaguccgaguccgccaucuga

SEQ ID NO: 43272 - RNA, 966 nt, Artificial Sequence
  derived and/or modified sequence opt2 from FLVCR2__Homo_sapiens__NP_001182212
auguccgccgacaacuccuccaccaucugcgucugccgcuccguccgccaggagcucggcaucgccaucggcuuccucgucccccccguccucguccccaacaucgaggaccgcgacgagcucgccuaccacaucuccaucauguucuacaucaucggcggcgucgccacccuccuccucauccucgucaucaucgucuucaaggagaagcccaaguacccccccucccgcgcccagucccucuccuacgcccucaccucccccgacgccuccuaccucggcuccaucgcccgccucuucaagaaccucaacuucguccuccucgucaucaccuacggccucaacgccggcgccuucuacgcccucuccacccuccucaaccgcauggucaucuggcacuaccccggcgaggaggucaacgccggccgcaucggccucaccaucgucaucgccggcaugcucggcgccgucaucuccggcaucuggcucgaccgcuccaagaccuacaaggagaccacccucgucgucuacaucaugacccucgucggcauggucgucuacaccuucacccucaaccucggccaccucugggucgucuucaucaccgccggcaccaugggcuucuucaugaccggcuaccucccccucggcuucgaguucgccgucgagcucaccuaccccgaguccgagggcaucuccuccggccuccucaacaucuccgcccaggucuucggcaucaucuucaccaucucccagggccagaucaucgacaacuacggcaccaagcccggcaacaucuuccucugcgucuuccucacccucggcgccgcccucaccgccuucaucaaggccgaccuccgccgccagaaggccaacaaggagacccucgagaacaagcuccaggaggaggaggaggaguccaacaccuccaagguccccaccgccgucuccgaggaccaccucuga

SEQ ID NO: 43273 - RNA, 3591 nt, Artificial Sequence
  derived and/or modified sequence opt2 from FMN1__Homo_sapiens__NP_001096654
auggagaacgucgacaacucccucgacggcuccgacgucuccgagcccgccaagcccgaggccggccucgaggucgcccaguccauccucuccaaguucuccaugaagucccucuucggcuucaccuccaagcucgaguccgucaaccccgaggaggaggacgccguccucaaggccuuccacucccucgacgucaaccccaccucccagcaggacgacuccuccaacggccucgacccccaggaggccggcucccgcgucucccccgaccucggcaacgacgagaagaucgccuccgucgagaccgaguccgagggcucccagcgcaaggaggccggcaccucccuccucgcccaggagcuccucccccucuccacccucaagggcaccaaggacgacgucaucugcguccgcggcacccucguccacaccaccuccgacuccgacuccgacgacggcggccaggagcccgaggagggcuccuccaccaacggccccaagucccccuccggcguccucuccgagcccucccaggaguccaaggagaaccccggcggcuuccgcgagaacaccgucaccggcgagaugaacggcgccgagcucugcgccgaggacccccagcgcaucccccccgagauguccuccaagcucgaggccggcaacggcggccuccagaccgagcgccgccccucccaggaccaggucggcgaggagggcucccaggaccuccccgccgucaccaaccagaacuccuccgucggcaucaccgaguccgccuccuccaagaaggaggucuccggcgagaaguccuuccagcuccccgccuucuucuccggccuccgcguccucaagaagggcgccaccgccgagggcggcgagaccaucaccgagaucaagcccaaggacggcgaccucgcccuccucaagcucacccagcccguccagaagucccucguccaggccggccuccagaccgucaaguccgagaagaaggccaccgaccccaaggccacccccacccuccucgagcagcucucccuccuccucaacaucgacaugcccaagaccgagcccaagggcgccgaccccgaguccccccgccgcgaggagaugggcugcaacgccgaccaggagucccaguccggccccggcgucccccagacccagggcggcgaggucaagcccaagucccccgagaccgcccucgaggccuucaaggcccucuucauccgccccccccgcaagggcaccaccgccgacaccuccgagcucgaggcccucaagcgcaagaugcgccacgagaaggagucccuccgcgccgucuucgagcgcuccaacuccaagcccgccgacggccccuccgacuccaagucccccgaccacucccucaccgagcaggacgaccgcacccccggccgccuccaggccgucuggcccccccccaagaccaaggacaccgaggagaaggucggccucaaguacaccgaggccgaguaccaggccgccauccuccaccucaagcgcgagcacaaggaggagaucgagaaccuccaggcccaguucgagcuccgcgccuuccacauccgcggcgagcacgccaugaucaccgcccgccucgaggagaccaucgagaaccucaagcacgagcucgagcaccgcuggcgcggcggcugcgaggagcgcaaggacgucugcaucuccaccgacgacgacugcccccccaagaccuuccgcaacgucugcguccagaccgaccgcgagaccuuccucaagcccugcgaguccgaguccaagaccacccgcuccaaccagcucguccccaagaagcucaacaucuccucccucucccagcucuccccccccaacgaccacaaggacauccacgccgcccuccagcccauggagggcauggccuccaaccagcagaaggcccucccccccccccccgccuccaucccccccccccccccccuccccuccggccucggcucccucucccccgccccccccaugccccccgucuccgccggccccccccucccccccccccccccccccccccccccccuccccccccccuccuccgccggcccccccccccccccccccccccccccccuccccaacucccccgccccccccaaccccggcggccccccccccgccccccccccccccggccucgcccccccccccccccccggccucuucuucggccucggcuccuccuccucccagugcccccgcaagcccgccaucgagcccuccugccccaugaagccccucuacuggacccgcauccagaucuccgaccgcucccagaacgccacccccacccucugggacucccucgaggagcccgacauccgcgaccccuccgaguucgaguaccucuucuccaaggacaccacccagcagaagaagaagccccucuccgagaccuacgagaagaagaacaaggucaagaagaucaucaagcuccucgacggcaagcgcucccagaccgucggcauccucaucuccucccuccaccucgagaugaaggacauccagcaggccaucuucaacgucgacgacuccgucgucgaccucgagacccucgccgcccucuacgagaaccgcgcccaggaggacgagcucgucaagauccgcaaguacuacgagaccuccaaggaggaggagcucaagcuccucgacaagcccgagcaguuccuccacgagcucgcccagauccccaacuucgccgagcgcgcccagugcaucaucuuccgcuccgucuucuccgagggcaucaccucccuccaccgcaaggucgagaucaucacccgcgccuccaaggaccuccuccacgucaaguccgucaaggacauccucgcccucauccucgccuucggcaacuacaugaacggcggcaaccgcacccgcggccaggccgacggcuacucccucgagauccuccccaagcucaaggacgucaagucccgcgacaacggcaucaaccucgucgacuacgucgucaaguacuaccuccgcuacuacgaccaggaggccggcaccgagaaguccgucuucccccuccccgagccccaggacuucuuccucgccucccaggucaaguucgaggaccucaucaaggaccuccgcaagcucaagcgccagcucgaggccuccgagaagcagauggucgucgucugcaaggagucccccaaggaguaccuccagcccuucaaggacaagcucgaggaguucuuccagaaggccaagaaggagcacaagauggaggagucccaccucgagaacgcccagaaguccuucgagaccaccguccgcuacuucggcaugaagcccaaguccggcgagaaggagaucacccccuccuacgucuucauggucugguacgaguucugcuccgacuucaagaccaucuggaagcgcgaguccaagaacaucuccaaggagcgccucaagauggcccaggaguccgucuccaagcucaccuccgagaagaaggucgagaccaagaagaucaaccccaccgccucccucaaggagcgccuccgccagaaggaggccuccgucaccaccaacuga

SEQ ID NO: 43274 - RNA, 5169 nt, Artificial Sequence
  derived and/or modified sequence opt2 from FMN2__Homo_sapiens__NP_064450
augggcaaccaggacggcaagcucaagcgcuccgccggcgacgcccuccacgagggcggcggcggcgccgaggacgcccucggcccccgcgacgucgaggccaccaagaagggcuccggcggcaagaaggcccucggcaagcacggcaagggcggcggcggcggcggcggcggcggcgaguccggcaagaagaaguccaaguccgacucccgcgccuccgucuucuccaaccuccgcauccgcaagaaccucuccaagggcaagggcgccggcggcucccgcgaggacguccucgacucccaggcccuccagaccggcgagcucgacuccgcccacucccuccucaccaagacccccgaccucucccucuccgccgacgaggccggccucuccgacaccgagugcgccgaccccuucgaggucaccggccccggcggccccggccccgccgaggcccgcgucggcggccgccccaucgccgaggacgucgagaccgccgccggcgcccaggacggccagcgcaccuccuccggcuccgacaccgacaucuacuccuuccacuccgccaccgagcaggaggaccuccucuccgacauccagcaggccauccgccuccagcagcagcagcagcagcagcuccagcuccagcuccagcagcagcagcagcagcagcagcuccagggcgccgaggagcccgccgccccccccaccgccgucuccccccagcccggcgccuuccucggccucgaccgcuuccuccucggccccuccggcggcgccggcgaggcccccggcucccccgacaccgagcaggcccucuccgcccucuccgaccuccccgagucccucgccgccgagccccgcgagccccagcagccccccucccccggcggccuccccgucuccgaggcccccucccuccccgccgcccagcccgccgccaaggacucccccuccuccaccgccuuccccuuccccgaggccggccccggcgaggaggccgccggcgcccccguccgcggcgccggcgacaccgacgaggagggcgaggaggacgccuucgaggacgccccccgcggcucccccggcgaggagugggcccccgaggucggcgaggacgccccccagcgccucggcgaggagcccgaggaggaggcccagggccccgacgcccccgccgccgccucccuccccggcucccccgcccccucccagcgcugcuucaagcccuacccccucaucacccccugcuacaucaagaccaccacccgccagcucuccucccccaaccacucccccucccagucccccaaccaguccccccgcaucaagcgccgccccgagcccucccucucccgcggcucccgcaccgcccucgccuccgucgccgcccccgccaagaagcaccgcgccgacggcggccucgccgccggccucucccgcuccgccgacuggaccgaggagcucggcgcccgcaccccccgcgucggcggcuccgcccaccuccucgagcgcggcgucgccuccgacuccggcggcggcgucucccccgcccucgccgccaaggccuccggcgcccccgccgccgccgacggcuuccagaacgucuucaccggccgcacccuccucgagaagcucuucucccagcaggagaacggcccccccgaggaggccgagaaguucugcucccgcaucaucgccaugggccuccuccuccccuucuccgacugcuuccgcgagcccugcaaccagaacgcccagaccaacgccgccuccuucgaccaggaccagcucuacaccugggccgccgucucccagcccacccacucccucgacuacuccgagggccaguucccccgccgcguccccuccaugggcccccccuccaagccccccgacgaggagcaccgccucgaggacgccgagaccgagucccaguccgccgucuccgagaccccccagaagcgcuccgacgccguccagaaggaggucgucgacaugaaguccgagggccaggccaccgucauccagcagcucgagcagaccaucgaggaccuccgcaccaagaucgccgagcucgagcgccaguaccccgcccucgacaccgaggucgccuccggccaccagggccucgagaacggcgucaccgccuccggcgacgucugccucgaggcccuccgccucgaggagaaggagguccgccaccaccgcauccucgaggccaaguccauccagaccucccccaccgaggagggcggcguccucacccucccccccgucgacggccuccccggccgcccccccugcccccccggcgccgaguccggcccccagaccaaguucugcuccgagaucucccucaucgucuccccccgccgcaucuccguccagcucgacucccaccagcccacccaguccaucucccagcccccccccccccccucccuccucugguccgccggccagggccagcccggcucccagcccccccacuccaucuccaccgaguuccagaccucccacgagcacuccgucuccuccgccuucaagaacuccugcaacauccccuccccccccccccuccccugcaccgaguccuccuccuccaugcccggccucggcaugguccccccccccccccccccccuccccggcaugaccguccccacccuccccuccaccgccaucccccagccccccccccuccagggcaccgagaugcuccccccccccccccccccccuccccggcgccggcaucccccccccccccccccuccccggcgccggcauccucccccuccccccccuccccggcgccggcaucccccccccccccccccuccccggcgccgccaucccccccccccccccccuccccggcgccggcaucccccucccccccccccuccccggcgccggcaucccccccccccccccccuccccggcgccggcaucccccccccccccccccuccccggcgccggcaucccccccccccccccccuccccggcgccggcaucccccccccccccccccuccccggcgccggcaucccccccccccccccccuccccggcgccggcaucccccccccccccccccuccccggcgccggcaucccccccccccccccccuccccggcgccggcaucccccccccccccccccuccccggcgccggcaucccccccccccccccccuccccggcgccggcaucccccccccccccccccuccccggcgccggcaucccccccccccccccccuccccggcgccggcaucccccccccccccccccuccccggcgucggcaucccccccccccccccccuccccggcgccggcaucccccccccccccccccuccccggcgccggcaucccccccccccccccccuccccggcgccggcaucccccccccccccccccucccccgcgucggcaucccccccccccccccccuccccggcgccggcaucccccccccccccccccuccccggcgccggcaucccccccccccccccccuccccggcgucggcaucccccccccccccccccuccccggcgucggcaucccccccccccccccccuccccggcgccggcaucccccccccccccccccuccccggcaugggcaucccccccgcccccgcccccccccuccccccccccggcaccggcauccccccccccccccuccuccccgucuccggccccccccuccucccccaggucggcuccuccacccuccccaccccccaggucugcggcuuccucccccccccccuccccuccggccucuucggccucggcaugaaccaggacaagggcucccgcaagcagcccaucgagcccugccgccccaugaagccccucuacuggacccgcauccagcuccacuccaagcgcgacuccuccaccucccucaucugggagaagaucgaggagcccuccaucgacugccacgaguucgaggagcucuucuccaagaccgccgucaaggagcgcaagaagcccaucuccgacaccaucuccaagaccaaggccaagcaggucgucaagcuccucuccaacaagcgcucccaggccgucggcauccucauguccucccuccaccucgacaugaaggacauccagcacgccgucgucaaccucgacaacuccgucgucgaccucgagacccuccaggcccucuacgagaaccgcgcccaguccgacgagcucgagaagaucgagaagcacggccgcuccuccaaggacaaggagaacgccaagucccucgacaagcccgagcaguuccucuacgagcucucccucauccccaacuucuccgagcgcgucuucugcauccucuuccaguccaccuucuccgaguccaucugcuccauccgccgcaagcucgagcuccuccagaagcucugcgagacccucaagaacggccccggcgucaugcagguccucggccucguccucgccuucggcaacuacaugaacggcggcaacaagacccgcggccaggccgacggcuucggccucgacauccuccccaagcucaaggacgucaaguccuccgacaacucccgcucccuccucuccuacaucgucuccuacuaccuccgcaacuucgacgaggacgccggcaaggagcagugccucuucccccuccccgagccccaggaccucuuccaggccucccagaugaaguucgaggacuuccagaaggaccuccgcaagcucaagaaggaccucaaggccugcgaggucgaggccggcaaggucuaccaggucuccuccaaggagcacaugcagcccuucaaggagaacauggagcaguucaucauccaggccaagaucgaccaggaggccgaggagaacucccucaccgagacccacaagugcuuccucgagaccaccgccuacuucuucaugaagcccaagcucggcgagaaggaggucucccccaacgccuucuucuccaucuggcacgaguucuccuccgacuucaaggacuucuggaagaaggagaacaagcuccuccuccaggagcgcgucaaggaggccgaggaggucugccgccagaagaagggcaagucccucuacaagaucaagccccgccacgacuccggcaucaaggccaagaucuccaugaagaccuga

SEQ ID NO: 43275 - RNA, 3303 nt, Artificial Sequence
  derived and/or modified sequence opt2 from FMNL1__Homo_sapiens__NP_005883
augggcaacgccgccggcuccgccgagcagcccgccggccccgccgcccccccccccaagcagcccgccccccccaagcagcccaugcccgccgccggcgagcucgaggagcgcuucaaccgcgcccucaacugcaugaaccucccccccgacaagguccagcuccucucccaguacgacaacgagaagaagugggagcucaucugcgaccaggagcgcuuccaggucaagaacccccccgccgccuacauccagaagcucaaguccuacgucgacaccggcggcgucucccgcaaggucgccgccgacuggauguccaaccucggcuucaagcgccgcguccaggaguccacccagguccuccgcgagcucgagaccucccuccgcaccaaccacaucggcuggguccaggaguuccucaacgaggagaaccgcggccucgacguccuccucgaguaccucgccuucgcccagugcuccgucaccuacgacauggaguccaccgacaacggcgccuccaacuccgagaagaacaagccccucgagcaguccgucgaggaccucuccaagggcccccccuccuccguccccaagucccgccaccucaccaucaagcucacccccgcccacucccgcaaggcccuccgcaacucccgcaucgucucccagaaggacgacguccacgucugcaucaugugccuccgcgccaucaugaacuaccaguccggcuucucccucgucaugaaccaccccgccugcgucaacgagaucgcccucucccucaacaacaagaacccccgcaccaaggcccucguccucgagcuccucgccgccgucugccucguccgcggcggccacgacaucauccucgccgccuucgacaacuucaaggaggucugcggcgagcagcaccgcuucgagaagcucauggaguacuuccgcaacgaggacuccaacaucgacuucauggucgccugcaugcaguucaucaacaucgucguccacuccgucgagaacaugaacuuccgcgucuuccuccaguacgaguucacccaccucggccucgaccucuaccucgagcgccuccgccucaccgaguccgacaagcuccagguccagauccaggccuaccucgacaacaucuucgacgucggcgcccuccucgaggacaccgagaccaagaacgccguccucgagcacauggaggagcuccaggagcaggucgcccuccucaccgagcgccuccgcgacgccgagaacgaguccauggccaagaucgccgagcucgagaagcagcucucccaggcccgcaaggagcucgagacccuccgcgagcgcuucuccgaguccaccgccaugggcgccucccgccgcccccccgagcccgagaaggccccccccgccgcccccacccgccccuccgcccucgagcucaaggucgaggagcucgaggagaagggccucauccgcauccuccgcggccccggcgacgccgucuccaucgagauccuccccgucgccgucgccacccccuccggcggcgacgcccccacccccggcguccccaccggcucccccucccccgaccucgcccccgccgccgagcccgcccccggcgccgcccccccccccccccccccccuccccggccuccccuccccccaggaggccccccccuccgcccccccccaggcccccccccuccccggcucccccgagcccccccccgcccccccccuccccggcgaccuccccccccccccccccccccccccccccccccccggcaccgacggccccguccccccccccccccccccccccccccccccccccggcggcccccccgacgcccucggccgccgcgacuccgagcucggccccggcgucaaggccaagaagcccauccagaccaaguuccgcaugccccuccucaacugggucgcccucaagcccucccagaucaccggcaccgucuucaccgagcucaacgacgagaagguccuccaggagcucgacauguccgacuucgaggagcaguucaagaccaagucccagggccccucccucgaccucuccgcccucaaguccaaggccgcccagaaggcccccuccaaggccacccucaucgaggccaaccgcgccaagaaccucgccaucacccuccgcaagggcaaccucggcgccgagcgcaucugccaggccaucgaggccuacgaccuccaggcccucggccucgacuuccucgagcuccucaugcgcuuccuccccaccgaguacgagcgcucccucaucacccgcuucgagcgcgagcagcgccccauggaggagcucuccgaggaggaccgcuucaugcucugcuucucccgcaucccccgccuccccgagcgcaugaccacccucaccuuccucggcaacuuccccgacaccgcccagcuccucaugccccagcucaacgccaucaucgccgccuccauguccaucaaguccuccgacaagcuccgccagauccucgagaucguccucgccuucggcaacuacaugaacuccuccaagcgcggcgccgccuacggcuuccgccuccagucccucgacgcccuccucgagaugaaguccaccgaccgcaagcagacccuccuccacuaccucgucaaggucaucgccgagaaguacccccagcucaccggcuuccacuccgaccuccacuuccucgacaaggccggcuccgucucccucgacuccguccucgccgacguccgcucccuccagcgcggccucgagcucacccagcgcgaguucguccgccaggacgacugcaugguccucaaggaguuccuccgcgccaacucccccaccauggacaagcuccucgccgacuccaagaccgcccaggaggccuucgaguccgucgucgaguacuucggcgagaaccccaagaccaccucccccggccucuucuucucccucuucucccgcuucaucaaggccuacaagaaggccgagcaggaggucgagcaguggaagaaggaggccgccgcccaggaggccggcgccgacacccccggcaagggcgagccccccgcccccaaguccccccccaaggcccgccgcccccagauggaccucaucuccgagcucaagcgccgccagcagaaggagccccucaucuacgaguccgaccgcgacggcgccaucgaggacaucaucaccgucaucaagaccguccccuucaccgcccgcaccggcaagcgcaccucccgccuccucugcgaggccucccucggcgaggagaugccccucuga

SEQ ID NO: 43276 - RNA, 3279 nt, Artificial Sequence
  derived and/or modified sequence opt2 from FMNL2__Homo_sapiens__NP_443137
augggcaacgccggcuccauggacucccagcagaccgacuuccgcgcccacaacgucccccucaagcuccccaugcccgagcccggcgagcucgaggagcgcuucgccaucguccucaacgccaugaaccucccccccgacaaggcccgccuccuccgccaguacgacaacgagaagaagugggagcucaucugcgaccaggagcgcuuccaggucaagaaccccccccacaccuacauccagaagcucaagggcuaccucgaccccgccgucacccgcaagaaguuccgccgccgcguccaggaguccacccagguccuccgcgagcucgagaucucccuccgcaccaaccacaucggcuggguccgcgaguuccucaacgaggagaacaagggccucgacguccucgucgaguaccucuccuucgcccaguacgccgucaccuucgacuucgaguccgucgaguccaccgucgaguccuccgucgacaaguccaagcccuggucccgcuccaucgaggaccuccaccgcggcuccaaccuccccucccccgucggcaacuccgucucccgcuccggccgccacuccgcccuccgcuacaacacccuccccucccgccgcacccucaagaacucccgccucgucuccaagaaggacgacguccacgucugcaucaugugccuccgcgccaucaugaacuaccaguacggcuucaacauggucaugucccacccccacgccgucaacgagaucgcccucucccucaacaacaagaacccccgcaccaaggcccucguccucgagcuccucgccgccgucugccucguccgcggcggccacgagaucauccucuccgccuucgacaacuucaaggaggucugcggcgagaagcagcgcuucgagaagcucauggagcacuuccgcaacgaggacaacaacaucgacuucauggucgccuccaugcaguucaucaacaucgucguccacuccgucgaggacaugaacuuccgcguccaccuccaguacgaguucaccaagcucggccucgacgaguaccucgacaagcucaagcacaccgaguccgacaagcuccagguccagauccaggccuaccucgacaacgucuucgacgucggcgcccuccucgaggacgccgagaccaagaacgccgcccucgagcgcgucgaggagcucgaggagaacaucucccaccucuccgagaagcuccaggacaccgagaacgaggccauguccaagaucgucgagcucgagaagcagcucaugcagcgcaacaaggagcucgacgucguccgcgagaucuacaaggacgccaacacccagguccacacccuccgcaagauggucaaggagaaggaggaggccauccagcgccaguccacccucgagaagaagauccacgagcucgagaagcagggcaccaucaagauccagaagaagggcgacggcgacaucgccauccuccccgucgucgccuccggcacccucuccaugggcuccgaggucgucgccggcaacuccgucggccccaccaugggcgccgccuccuccggcccccuccccccccccccccccccccucccccccuccuccgacacccccgagaccguccagaacggccccgucaccccccccaugccccccccccccccccccccccccccccccccccccccccccccccccccccccccccccccccuccccggccccgccgccgagaccguccccgcccccccccucgcccccccccuccccuccgcccccccccuccccggcaccuccucccccaccgucgucuucaacuccggccucgccgccgucaagaucaagaagcccaucaagaccaaguuccgcaugcccgucuucaacugggucgcccucaagcccaaccagaucaacggcaccgucuucaacgagaucgacgacgagcgcauccucgaggaccucaacgucgacgaguucgaggagaucuucaagaccaaggcccagggccccgccaucgaccucuccuccuccaagcagaagaucccccagaagggcuccaacaaggucacccuccucgaggccaaccgcgccaagaaccucgccaucacccuccgcaaggccggcaagaccgccgacgagaucugcaaggccauccacgucuucgaccucaagacccuccccgucgacuucgucgagugccucaugcgcuuccuccccaccgagaacgaggucaagguccuccgccucuacgagcgcgagcgcaagccccucgagaaccucuccgacgaggaccgcuucaugaugcaguucuccaagaucgagcgccucaugcagaagaugaccaucauggccuucaucggcaacuucgccgaguccauccagaugcucaccccccagcuccacgccaucaucgccgccuccgucuccaucaaguccucccagaagcucaagaagauccucgagaucauccucgcccucggcaacuacaugaacuccuccaagcgcggcgccgucuacggcuucaagcuccagucccucgaccuccuccucgacaccaaguccaccgaccgcaagcagacccuccuccacuacaucuccaacgucgucaaggagaaguaccaccaggucucccucuucuacaacgagcuccacuacgucgagaaggccgccgccgucucccucgagaacguccuccucgacgucaaggagcuccagcgcggcauggaccucaccaagcgcgaguacaccaugcacgaccacaacacccuccucaaggaguucauccucaacaacgagggcaagcucaagaagcuccaggacgacgccaagaucgcccaggacgccuucgacgacgucgucaaguacuucggcgagaaccccaagaccaccccccccuccgucuucuuccccgucuucguccgcuucgucaaggccuacaagcaggccgaggaggagaacgagcuccgcaagaagcaggagcaggcccucauggagaagcuccucgagcaggaggcccucauggagcagcaggaccccaagucccccucccacaaguccaagcgccagcagcaggagcucaucgccgagcuccgccgccgccaggucaaggacaaccgccacgucuacgagggcaaggacggcgccaucgaggacaucaucaccgaccuccgcaaccagcccuaccgccgcgccgacgccguccgccgcuccguccgccgccgcuucgacgaccagaaccuccgcuccgucaacggcgccgagaucaccauguga

SEQ ID NO: 43277 - RNA, 3084 nt, Artificial Sequence
  derived and/or modified sequence opt2 from FMNL3__Homo_sapiens__NP_783863
augggcaaccucgaguccgccgagggcguccccggcgagccccccuccgucccccuccuccucccccccggcaagaugcccaugcccgagcccugcgagcucgaggagcgcuucgcccucguccucuccuccaugaaccucccccccgacaaggcccgccuccuccgccaguacgacaacgagaagaagugggaccucaucugcgaccaggagcgcuuccaggucaagaaccccccccacaccuacauccagaagcuccaguccuuccucgaccccuccgucacccgcaagaaguuccgccgccgcguccaggaguccaccaagguccuccgcgagcucgagaucucccuccgcaccaaccacaucggcuggguccgcgaguuccucaacgacgagaacaagggccucgacguccucgucgacuaccucuccuucgcccagugcuccgucauguucgacuucgagggccucgaguccggcgacgacggcgccuucgacaagcuccgcuccuggucccgcuccaucgaggaccuccagccccccuccgcccucuccgcccccuucaccaacucccucgcccgcuccgcccgccaguccguccuccgcuacuccacccuccccggccgccgcgcccucaagaacucccgccucgucucccagaaggacgacguccacgucugcauccucugccuccgcgccaucaugaacuaccaguacggcuucaaccucgucaugucccacccccacgccgucaacgagaucgcccucucccucaacaacaagaacccccgcaccaaggcccucguccucgagcuccucgccgccgucugccucguccgcggcggccacgagaucauccucgccgccuucgacaacuucaaggaggucugcaaggagcuccaccgcuucgagaagcucauggaguacuuccgcaacgaggacuccaacaucgacuucauggucgccugcaugcaguucaucaacaucgucguccacuccgucgaggacaugaacuuccgcguccaccuccaguacgaguucaccaagcucggccucgaggaguuccuccagaagucccgccacaccgaguccgagaagcuccagguccagauccaggccuaccucgacaacgucuucgacgucggcggccuccucgaggacgccgagaccaagaacgucgcccucgagaaggucgaggagcucgaggagcacgucucccaccucaccgagaagcuccucgaccucgagaacgagaacaugaugcgcgucgccgagcucgagaagcagcuccuccagcgcgagaaggagcucgaguccaucaaggagaccuacgagaacaccucccaccagguccacacccuccgccgccucaucaaggagaaggaggaggccuuccagcgccgcugccaccucgagcccaacguccgcggccucgaguccgucgacuccgaggcccucgcccgcgucggccccgccgagcucuccgagggcaugccccccuccgaccucgaccuccucgcccccgcccccccccccgaggagguccucccccucccccccccccccgcccccccccuccccccccccccccccccccuccccgacaagugcccccccgcccccccccuccccggcgccgcccccuccgucguccucaccgucggccucuccgccauccgcaucaagaagcccaucaagaccaaguuccgccuccccgucuucaacuggaccgcccucaagcccaaccagaucuccggcaccgucuucuccgagcucgacgacgagaagauccucgaggaccucgaccucgacaaguucgaggagcucuucaagaccaaggcccagggccccgcccucgaccucaucugcuccaagaacaagaccgcccagaaggccgccuccaaggucacccuccucgaggccaaccgcgccaagaaccucgccaucacccuccgcaaggccggccgcuccgccgaggagaucugccgcgccauccacaccuucgaccuccagacccuccccgucgacuucgucgagugccucaugcgcuuccuccccaccgaggccgaggucaagcuccuccgccaguacgagcgcgagcgccagccccucgaggagcucgccgccgaggaccgcuucaugcuccucuucuccaaggucgagcgccucacccagcgcauggccggcauggccuuccucggcaacuuccaggacaaccuccagaugcucaccccccagcucaacgccaucaucgccgccuccgccuccgucaaguccucccagaagcucaagcagaugcucgagaucauccucgcccucggcaacuacaugaacuccuccaagcgcggcgccgucuacggcuucaagcuccagucccucgaccuccuccucgacaccaaguccaccgaccgcaagaugacccuccuccacuucaucgcccucaccgucaaggagaaguaccccgaccucgccaacuucuggcacgagcuccacuucgucgagaaggccgccgccgucucccucgagaacguccuccucgacgucaaggagcucggccgcggcauggagcucauccgccgcgagugcuccauccacgacaacuccguccuccgcaacuuccucuccaccaacgagggcaagcucgacaagcuccagcgcgacgccaagaccgccgaggaggccuacaacgccgucguccgcuacuucggcgagucccccaagaccaccccccccuccgucuucuuccccgucuucguccgcuucauccgcuccuacaaggaggccgagcaggagaacgaggcccgcaagaagcaggaggaggucaugcgcgagaagcagcucgcccaggaggccaagaagcucgacgccaagacccccucccagcgcaacaaguggcagcagcaggagcucaucgccgagcuccgccgccgccaggccaaggagcaccgccccgucuacgagggcaaggacggcaccaucgaggacaucaucaccggccuccacugccagcccauggucguccgccaccaggcccgcuccgccgccccccccuccggccccccccgcgcccccggcccccacuga

SEQ ID NO: 43278 - RNA, 1611 nt, Artificial Sequence
  derived and/or modified sequence opt2 from FMO1__Homo_sapiens__NP_001269621
augcaggagaacauggccaagcgcgucgccaucgucggcgccggcgucuccggccucgccuccaucaagugcugccucgaggagggccucgagcccaccugcuucgagcgcuccgacgaccucggcggccucuggcgcuucaccgagcacgucgaggagggccgcgccucccucuacaaguccgucgucuccaacuccugcaaggagauguccugcuacuccgacuuccccuuccccgaggacuaccccaacuacguccccaacucccaguuccucgaguaccucaagauguacgccaaccacuucgaccuccucaagcacauccaguucaagaccaaggucugcuccgucaccaagugcuccgacuccgccgucuccggccagugggaggucgucaccaugcacgaggagaagcaggaguccgccaucuucgacgccgucauggucugcaccggcuuccucaccaaccccuaccucccccucgacuccuuccccggcaucaacgccuucaagggccaguacuuccacucccgccaguacaagcaccccgacaucuucaaggacaagcgcguccucgucaucggcaugggcaacuccggcaccgacaucgccgucgaggccucccaccucgccgagaaggucuuccucuccaccaccggcggcggcugggucaucucccgcaucuucgacuccggcuaccccugggacauggucuucaugacccgcuuccagaacaugcuccgcaacucccuccccacccccaucgucaccuggcucauggagcgcaagaucaacaacuggcucaaccacgccaacuacggccucauccccgaggaccgcacccagcucaaggaguucguccucaacgacgagcuccccggccgcaucaucaccggcaaggucuucauccgccccuccaucaaggaggucaaggagaacuccgucaucuucaacaacaccuccaaggaggagcccaucgacaucaucgucuucgccaccggcuacaccuucgccuuccccuuccucgacgaguccgucgucaaggucgaggacggccaggccucccucuacaaguacaucuuccccgcccaccuccagaagcccacccucgccaucaucggccucaucaagccccucggcuccaugauccccaccggcgagacccaggcccgcugggccguccgcguccucaagggcgucaacaagcuccccccccccuccgucaugaucgaggagaucaacgcccgcaaggagaacaagcccuccugguucggccucugcuacugcaaggcccuccaguccgacuacaucaccuacaucgacgagcuccucaccuacaucaacgccaagcccaaccucuucuccaugcuccucaccgacccccaccucgcccucaccgucuucuucggccccugcucccccuaccaguuccgccucaccggccccggcaagugggagggcgcccgcaacgccaucaugacccagugggaccgcaccuucaaggucaucaaggcccgcgucguccaggagucccccucccccuucgaguccuuccucaaggucuucuccuuccucgcccuccucgucgccaucuuccucaucuuccucuga

SEQ ID NO: 43279 - RNA, 1608 nt, Artificial Sequence
  derived and/or modified sequence opt2 from FMO2__Homo_sapiens__NP_001451
auggccaagaaggucgccgucaucggcgccggcgucuccggccucaucucccucaagugcugcgucgacgagggccucgagcccaccugcuucgagcgcaccgaggacaucggcggcgucuggcgcuucaaggagaacgucgaggacggccgcgccuccaucuaccaguccgucgucaccaacaccuccaaggagauguccugcuucuccgacuuccccaugcccgaggacuuccccaacuuccuccacaacuccaagcuccucgaguacuuccgcaucuucgccaagaaguucgaccuccucaaguacauccaguuccagaccaccguccucuccguccgcaagugccccgacuucuccuccuccggccaguggaaggucgucacccaguccaacggcaaggagcaguccgccgucuucgacgccgucauggucugcuccggccaccacauccucccccacaucccccucaaguccuuccccggcauggagcgcuucaagggccaguacuuccacucccgccaguacaagcaccccgacggcuucgagggcaagcgcauccucgucaucggcaugggcaacuccggcuccgacaucgccgucgagcucuccaagaacgccgcccaggucuucaucuccacccgccacggcaccugggucaugucccgcaucuccgaggacggcuaccccugggacuccgucuuccacacccgcuuccgcuccaugcuccgcaacguccucccccgcaccgccgucaaguggaugaucgagcagcagaugaaccgcugguucaaccacgagaacuacggccucgagccccagaacaaguacaucaugaaggagcccguccucaacgacgacguccccucccgccuccucugcggcgccaucaaggucaaguccaccgucaaggagcucaccgagaccuccgccaucuucgaggacggcaccgucgaggagaacaucgacgucaucaucuucgccaccggcuacuccuucuccuuccccuuccucgaggacucccucgucaaggucgagaacaacauggucucccucuacaaguacaucuuccccgcccaccucgacaaguccacccucgccugcaucggccucauccagccccucggcuccaucuuccccaccgccgagcuccaggcccgcugggucacccgcgucuucaagggccucugcucccuccccuccgagcgcaccaugaugauggacaucaucaagcgcaacgagaagcgcaucgaccucuucggcgagucccagucccagacccuccagaccaacuacgucgacuaccucgacgagcucgcccucgagaucggcgccaagcccgacuucugcucccuccucuucaaggaccccaagcucgccguccgccucuacuucggccccugcaacuccuaccaguaccgccucgucggccccggccagugggagggcgcccgcaacgccaucuucacccagaagcagcgcauccucaagccccucaagacccgcgcccucaaggacuccuccaacuucuccgucuccuuccuccucaagauccucggccuccucgccgucgucgucgccuucuucugccagcuccagugguccuga

SEQ ID NO: 43280 - RNA, 1599 nt, Artificial Sequence
  derived and/or modified sequence opt2 from FMO3__Homo_sapiens__NP_008825
augggcaagaaggucgccaucaucggcgccggcgucuccggccucgccuccauccgcuccugccucgaggagggccucgagcccaccugcuucgagaaguccaacgacaucggcggccucuggaaguucuccgaccacgccgaggagggccgcgccuccaucuacaaguccgucuucuccaacuccuccaaggagaugaugugcuuccccgacuuccccuuccccgacgacuuccccaacuucaugcacaacuccaagauccaggaguacaucaucgccuucgccaaggagaagaaccuccucaaguacauccaguucaagaccuucgucuccuccgucaacaagcaccccgacuucgccaccaccggccagugggacgucaccaccgagcgcgacggcaagaaggaguccgccgucuucgacgccgucauggucugcuccggccaccacgucuaccccaaccuccccaaggaguccuuccccggccucaaccacuucaagggcaagugcuuccacucccgcgacuacaaggagcccggcgucuucaacggcaagcgcguccucgucgucggccucggcaacuccggcugcgacaucgccaccgagcucucccgcaccgccgagcaggucaugaucuccucccgcuccggcuccugggucaugucccgcgucugggacaacggcuaccccugggacaugcuccucgucacccgcuucggcaccuuccucaagaacaaccuccccaccgccaucuccgacuggcucuacgucaagcagaugaacgcccgcuucaagcacgagaacuacggccucaugccccucaacggcguccuccgcaaggagcccgucuucaacgacgagcuccccgccuccauccucugcggcaucgucuccgucaagcccaacgucaaggaguucaccgagaccuccgccaucuucgaggacggcaccaucuucgagggcaucgacugcgucaucuucgccaccggcuacuccuucgccuaccccuuccucgacgaguccaucaucaagucccgcaacaacgagaucauccucuucaagggcgucuuccccccccuccucgagaaguccaccaucgccgucaucggcuucguccagucccucggcgccgccauccccaccgucgaccuccagucccgcugggccgcccaggucaucaagggcaccugcacccuccccuccauggaggacaugaugaacgacaucaacgagaagauggagaagaagcgcaagugguucggcaaguccgagaccauccagaccgacuacaucgucuacauggacgagcucuccuccuucaucggcgccaagcccaacauccccuggcucuuccucaccgaccccaagcucgccauggaggucuacuucggccccugcucccccuaccaguuccgccucgucggccccggccaguggcccggcgcccgcaacgccauccucacccagugggaccgcucccucaagcccaugcagacccgcgucgucggccgccuccagaagcccugcuucuucuuccacuggcucaagcucuucgccauccccauccuccucaucgccgucuuccucguccucaccuga

SEQ ID NO: 43281 - RNA, 1677 nt, Artificial Sequence
  derived and/or modified sequence opt2 from FMO4__Homo_sapiens__NP_002013
auggccaagaaggucgccgucaucggcgccggcgucuccggccucuccuccaucaagugcugcgucgacgaggaccucgagcccaccugcuucgagcgcuccgacgacaucggcggccucuggaaguucaccgaguccuccaaggacggcaugacccgcgucuacaagucccucgucaccaacgucugcaaggagauguccugcuacuccgacuuccccuuccacgaggacuaccccaacuucaugaaccacgagaaguucugggacuaccuccaggaguucgccgagcacuucgaccuccucaaguacauccaguucaagaccaccgucugcuccaucaccaagcgccccgacuucuccgagaccggccagugggacgucgucaccgagaccgagggcaagcagaaccgcgccgucuucgacgccgucauggucugcaccggccacuuccucaacccccaccucccccucgaggccuuccccggcauccacaaguucaagggccagauccuccacucccaggaguacaagauccccgagggcuuccagggcaagcgcguccucgucaucggccucggcaacaccggcggcgacaucgccgucgagcucucccgcaccgccgcccagguccuccucuccacccgcaccggcaccuggguccucggccgcuccuccgacuggggcuaccccuacaacaugauggucacccgccgcugcugcuccuucaucgcccagguccuccccucccgcuuccucaacuggauccaggagcgcaagcucaacaagcgcuucaaccacgaggacuacggccucuccaucaccaagggcaagaaggccaaguucaucgucaacgacgagcuccccaacugcauccucugcggcgccaucaccaugaagaccuccgucaucgaguucaccgagaccuccgccgucuucgaggacggcaccgucgaggagaacaucgacgucgucaucuucaccaccggcuacaccuucuccuuccccuucuucgaggagccccucaagucccucugcaccaagaagaucuuccucuacaagcaggucuucccccucaaccucgagcgcgccacccucgccaucaucggccucaucggccucaagggcuccauccucuccggcaccgagcuccaggcccgcugggucacccgcgucuucaagggccucugcaagaucccccccucccagaagcucaugauggaggccaccgagaaggagcagcucaucaagcgcggcgucuucaaggacaccuccaaggacaaguucgacuacaucgccuacauggacgacaucgccgccugcaucggcaccaagcccuccaucccccuccucuuccucaaggacccccgccucgccugggaggucuucuucggccccugcacccccuaccaguaccgccucaugggccccggcaagugggacggcgcccgcaacgccauccucacccagugggaccgcacccucaagccccucaagacccgcaucguccccgacuccuccaagcccgccuccaugucccacuaccucaaggccuggggcgcccccguccuccucgccucccuccuccucaucugcaaguccucccucuuccucaagcucguccgcgacaagcuccaggaccgcaugucccccuaccucgucucccucuggcgcggcuga

SEQ ID NO: 43282 - RNA, 1131 nt, Artificial Sequence
  derived and/or modified sequence opt2 from FMOD__Homo_sapiens__NP_002014
augcaguggaccucccuccuccuccucgccggccucuucucccucucccaggcccaguacgaggacgacccccacuggugguuccacuaccuccgcucccagcaguccaccuacuacgaccccuacgaccccuaccccuacgagaccuacgagcccuaccccuacggcgucgacgagggccccgccuacaccuacggcucccccuccccccccgacccccgcgacugcccccaggagugcgacugcccccccaacuuccccaccgccauguacugcgacaaccgcaaccucaaguaccuccccuucguccccucccgcaugaaguacgucuacuuccagaacaaccagaucaccuccauccaggagggcgucuucgacaacgccaccggccuccucuggaucgcccuccacggcaaccagaucaccuccgacaaggucggccgcaaggucuucuccaagcuccgccaccucgagcgccucuaccucgaccacaacaaccucacccgcaugcccggcccccucccccgcucccuccgcgagcuccaccucgaccacaaccagaucucccgcguccccaacaacgcccucgagggccucgagaaccucaccgcccucuaccuccagcacaacgagauccaggaggucggcuccuccaugcgcggccuccgcucccucauccuccucgaccucuccuacaaccaccuccgcaagguccccgacggccuccccuccgcccucgagcagcucuacauggagcacaacaacgucuacaccguccccgacuccuacuuccgcggcgcccccaagcuccucuacguccgccucucccacaacucccucaccaacaacggccucgccuccaacaccuucaacuccuccucccuccucgagcucgaccucuccuacaaccagcuccagaagaucccccccgucaacaccaaccucgagaaccucuaccuccagggcaaccgcaucaacgaguucuccaucuccuccuucugcaccgucgucgacgucgucaacuucuccaagcuccagguccuccgccucgacggcaacgagaucaagcgcuccgccaugcccgccgacgccccccucugccuccgccucgccucccucaucgagaucuga

SEQ ID NO: 43283 - RNA, 1614 nt, Artificial Sequence
  derived and/or modified sequence opt2 from FMR1__Homo_sapiens__NP_001172004
auggaggagcucgucgucgagguccgcggcuccaacggcgccuucuacaaggccuucgucaaggacguccacgaggacuccaucaccgucgccuucgagaacaacuggcagcccgaccgccagauccccuuccacgacguccgcuuccccccccccgucggcuacaacaaggacaucaacgaguccgacgaggucgaggucuacucccgcgccaacgagaaggagcccugcugcugguggcucgccaagguccgcaugaucaagggcgaguucuacgucaucgaguacgccgccugcgacgccaccuacaacgagaucgucaccaucgagcgccuccgcuccgucaaccccaacaagcccgccaccaaggacaccuuccacaagaucaagcucgacguccccgaggaccuccgccagaugugcgccaaggaggccgcccacaaggacuucaagaaggccgucggcgccuucuccgucaccuacgaccccgagaacuaccagcucgucauccucuccaucaacgaggucaccuccaagcgcgcccacaugcucaucgacaugcacuuccgcucccuccgcaccaagcucucccucaucaugcgcaacgaggaggccuccaagcagcucgaguccucccgccagcucgccucccgcuuccacgagcaguucaucguccgcgaggaccucaugggccucgccaucggcacccacggcgccaacauccagcaggcccgcaagguccccggcgucaccgccaucgaccucgacgaggacaccugcaccuuccacaucuacggcgaggaccaggacgccgucaagaaggcccgcuccuuccucgaguucgccgaggacgucauccaggucccccgcaaccucgucggcaaggucaucggcaagaacggcaagcucauccaggagaucgucgacaaguccggcgucguccgcguccgcaucgaggccgagaacgagaagaacgucccccaggaggaggagaucaugccccccaacucccuccccuccaacaacucccgcgucggccccaacgcccccgaggagaagaagcaccucgacaucaaggagaacuccacccacuucucccagcccaacuccaccaagguccagcgcguccucgucgccuccuccgucgucgccggcgagucccagaagcccgagcucaaggccuggcagggcaugguccccuucgucuucgucggcaccaaggacuccaucgccaacgccaccguccuccucgacuaccaccucaacuaccucaagcuccagcagcgcaagcgcggccgcgccuccugcgccgaggagaccgacggcggcgucgagggcgaggaggaggacaaggaggaggaggacgucgaggaggccuccaaggagaccaccaucacccccgagcagaucaucguccacgucauccaggagcgccucaaggaggagcagcagauggaccccuuccgcuccgagcucaccgccaucaugaagggcgucuccacccucaagcacuaccgcaucccccccgucaaggucgucggcugcgcccgcgucaagaucgucacccgccgcaagcgcucccagaccgccuggauggucuccaaccacuccuga

SEQ ID NO: 43284 - RNA, 7068 nt, Artificial Sequence
  derived and/or modified sequence opt2 from FN1__Homo_sapiens__NP_002017
augcuccgcggccccggccccggccuccuccuccucgccguccagugccucggcaccgccguccccuccaccggcgccuccaaguccaagcgccaggcccagcagaugguccagccccagucccccgucgccgucucccaguccaagcccggcugcuacgacaacggcaagcacuaccagaucaaccagcagugggagcgcaccuaccucggcaacgcccucgucugcaccugcuacggcggcucccgcggcuucaacugcgaguccaagcccgaggccgaggagaccugcuucgacaaguacaccggcaacaccuaccgcgucggcgacaccuacgagcgccccaaggacuccaugaucugggacugcaccugcaucggcgccggccgcggccgcaucuccugcaccaucgccaaccgcugccacgagggcggccaguccuacaagaucggcgacaccuggcgccgcccccacgagaccggcggcuacaugcucgagugcgucugccucggcaacggcaagggcgaguggaccugcaagcccaucgccgagaagugcuucgaccacgccgccggcaccuccuacgucgucggcgagaccugggagaagcccuaccagggcuggaugauggucgacugcaccugccucggcgagggcuccggccgcaucaccugcaccucccgcaaccgcugcaacgaccaggacacccgcaccuccuaccgcaucggcgacaccugguccaagaaggacaaccgcggcaaccuccuccagugcaucugcaccggcaacggccgcggcgaguggaagugcgagcgccacaccuccguccagaccaccuccuccggcuccggccccuucaccgacguccgcgccgccgucuaccagccccagccccacccccagcccccccccuacggccacugcgucaccgacuccggcgucgucuacuccgucggcaugcaguggcucaagacccagggcaacaagcagaugcucugcaccugccucggcaacggcgucuccugccaggagaccgccgucacccagaccuacggcggcaacuccaacggcgagcccugcguccuccccuucaccuacaacggccgcaccuucuacuccugcaccaccgagggccgccaggacggccaccucuggugcuccaccaccuccaacuacgagcaggaccagaaguacuccuucugcaccgaccacaccguccucguccagacccgcggcggcaacuccaacggcgcccucugccacuuccccuuccucuacaacaaccacaacuacaccgacugcaccuccgagggccgccgcgacaacaugaaguggugcggcaccacccagaacuacgacgccgaccagaaguucggcuucugccccauggccgcccacgaggagaucugcaccaccaacgagggcgucauguaccgcaucggcgaccagugggacaagcagcacgacaugggccacaugaugcgcugcaccugcgucggcaacggccgcggcgaguggaccugcaucgccuacucccagcuccgcgaccagugcaucgucgacgacaucaccuacaacgucaacgacaccuuccacaagcgccacgaggagggccacaugcucaacugcaccugcuucggccagggccgcggccgcuggaagugcgaccccgucgaccagugccaggacuccgagaccggcaccuucuaccagaucggcgacuccugggagaaguacguccacggcguccgcuaccagugcuacugcuacggccgcggcaucggcgaguggcacugccagccccuccagaccuaccccuccuccuccggccccgucgaggucuucaucaccgagacccccucccagcccaacucccaccccauccaguggaacgccccccagcccucccacaucuccaaguacauccuccgcuggcgccccaagaacuccgucggccgcuggaaggaggccaccauccccggccaccucaacuccuacaccaucaagggccucaagcccggcgucgucuacgagggccagcucaucuccauccagcaguacggccaccaggaggucacccgcuucgacuucaccaccaccuccaccuccacccccgucaccuccaacaccgucaccggcgagaccacccccuucuccccccucgucgccaccuccgaguccgucaccgagaucaccgccuccuccuucgucgucuccugggucuccgccuccgacaccgucuccggcuuccgcgucgaguacgagcucuccgaggagggcgacgagccccaguaccucgaccuccccuccaccgccaccuccgucaacauccccgaccuccuccccggccgcaaguacaucgucaacgucuaccagaucuccgaggacggcgagcagucccucauccucuccaccucccagaccaccgcccccgacgccccccccgaccccaccgucgaccaggucgacgacaccuccaucgucguccgcuggucccgcccccaggcccccaucaccggcuaccgcaucgucuacucccccuccgucgagggcuccuccaccgagcucaaccuccccgagaccgccaacuccgucacccucuccgaccuccagcccggcguccaguacaacaucaccaucuacgccgucgaggagaaccaggaguccacccccgucgucauccagcaggagaccaccggcaccccccgcuccgacaccguccccuccccccgcgaccuccaguucgucgaggucaccgacgucaaggucaccaucauguggaccccccccgaguccgccgucaccggcuaccgcgucgacgucauccccgucaaccuccccggcgagcacggccagcgccuccccaucucccgcaacaccuucgccgaggucaccggccucucccccggcgucaccuacuacuucaaggucuucgccgucucccacggccgcgaguccaagccccucaccgcccagcagaccaccaagcucgacgcccccaccaaccuccaguucgucaacgagaccgacuccaccguccucguccgcuggacccccccccgcgcccagaucaccggcuaccgccucaccgucggccucacccgccgcggccagccccgccaguacaacgucggccccuccgucuccaaguacccccuccgcaaccuccagcccgccuccgaguacaccgucucccucgucgccaucaagggcaaccaggagucccccaaggccaccggcgucuucaccacccuccagcccggcuccuccaucccccccuacaacaccgaggucaccgagaccaccaucgucaucaccuggacccccgccccccgcaucggcuucaagcucggcguccgccccucccagggcggcgaggccccccgcgaggucaccuccgacuccggcuccaucgucgucuccggccucacccccggcgucgaguacgucuacaccauccagguccuccgcgacggccaggagcgcgacgcccccaucgucaacaaggucgucaccccccucuccccccccaccaaccuccaccucgaggccaaccccgacaccggcguccucaccgucuccugggagcgcuccaccacccccgacaucaccggcuaccgcaucaccaccacccccaccaacggccagcagggcaacucccucgaggaggucguccacgccgaccaguccuccugcaccuucgacaaccucucccccggccucgaguacaacgucuccgucuacaccgucaaggacgacaaggaguccguccccaucuccgacaccaucauccccgccguccccccccccaccgaccuccgcuucaccaacaucggccccgacaccaugcgcgucaccugggcccccccccccuccaucgaccucaccaacuuccucguccgcuacucccccgucaagaacgaggaggacgucgccgagcucuccaucucccccuccgacaacgccgucguccucaccaaccuccuccccggcaccgaguacgucgucuccgucuccuccgucuacgagcagcacgaguccaccccccuccgcggccgccagaagaccggccucgacucccccaccggcaucgacuucuccgacaucaccgccaacuccuucaccguccacuggaucgccccccgcgccaccaucaccggcuaccgcauccgccaccaccccgagcacuucuccggccgcccccgcgaggaccgcgucccccacucccgcaacuccaucacccucaccaaccucacccccggcaccgaguacgucgucuccaucgucgcccucaacggccgcgaggaguccccccuccucaucggccagcaguccaccgucuccgacgucccccgcgaccucgaggucgucgccgccacccccaccucccuccucaucuccugggacgcccccgccgucaccguccgcuacuaccgcaucaccuacggcgagaccggcggcaacucccccguccaggaguucaccguccccggcuccaaguccaccgccaccaucuccggccucaagcccggcgucgacuacaccaucaccgucuacgccgucaccggccgcggcgacucccccgccuccuccaagcccaucuccaucaacuaccgcaccgagaucgacaagcccucccagaugcaggucaccgacguccaggacaacuccaucuccgucaaguggcuccccuccuccucccccgucaccggcuaccgcgucaccaccacccccaagaacggccccggccccaccaagaccaagaccgccggccccgaccagaccgagaugaccaucgagggccuccagcccaccgucgaguacgucgucuccgucuacgcccagaaccccuccggcgagucccagccccucguccagaccgccgucaccaacaucgaccgccccaagggccucgccuucaccgacgucgacgucgacuccaucaagaucgccugggaguccccccagggccaggucucccgcuaccgcgucaccuacuccucccccgaggacggcauccacgagcucuuccccgcccccgacggcgaggaggacaccgccgagcuccagggccuccgccccggcuccgaguacaccgucuccgucgucgcccuccacgacgacauggagucccagccccucaucggcacccaguccaccgccauccccgcccccaccgaccucaaguucacccaggucacccccaccucccucuccgcccaguggaccccccccaacguccagcucaccggcuaccgcguccgcgucacccccaaggagaagaccggccccaugaaggagaucaaccucgcccccgacuccuccuccgucgucgucuccggccucauggucgccaccaaguacgaggucuccgucuacgcccucaaggacacccucaccucccgccccgcccagggcgucgucaccacccucgagaacgucucccccccccgccgcgcccgcgucaccgacgccaccgagaccaccaucaccaucuccuggcgcaccaagaccgagaccaucaccggcuuccaggucgacgccguccccgccaacggccagacccccauccagcgcaccaucaagcccgacguccgcuccuacaccaucaccggccuccagcccggcaccgacuacaagaucuaccucuacacccucaacgacaacgcccgcuccucccccgucgucaucgacgccuccaccgccaucgacgcccccuccaaccuccgcuuccucgccaccacccccaacucccuccucgucuccuggcagcccccccgcgcccgcaucaccggcuacaucaucaaguacgagaagcccggcucccccccccgcgaggucgucccccgcccccgccccggcgucaccgaggccaccaucaccggccucgagcccggcaccgaguacaccaucuacgucaucgcccucaagaacaaccagaaguccgagccccucaucggccgcaagaagaccgacgagcucccccagcucgucacccucccccaccccaaccuccacggccccgagauccucgacguccccuccaccguccagaagacccccuucgucacccaccccggcuacgacaccggcaacggcauccagcuccccggcaccuccggccagcagcccuccgucggccagcagaugaucuucgaggagcacggcuuccgccgcaccaccccccccaccaccgccacccccauccgccaccgcccccgccccuacccccccaacgucggccaggaggcccucucccagaccaccaucuccugggcccccuuccaggacaccuccgaguacaucaucuccugccaccccgucggcaccgacgaggagccccuccaguuccgcguccccggcaccuccaccuccgccacccucaccggccucacccgcggcgccaccuacaacaucaucgucgaggcccucaaggaccagcagcgccacaagguccgcgaggaggucgucaccgucggcaacuccgucaacgagggccucaaccagcccaccgacgacuccugcuucgaccccuacaccgucucccacuacgccgucggcgacgagugggagcgcauguccgaguccggcuucaagcuccucugccagugccucggcuucggcuccggccacuuccgcugcgacuccucccgcuggugccacgacaacggcgucaacuacaagaucggcgagaagugggaccgccagggcgagaacggccagaugauguccugcaccugccucggcaacggcaagggcgaguucaagugcgacccccacgaggccaccugcuacgacgacggcaagaccuaccacgucggcgagcaguggcagaaggaguaccucggcgccaucugcuccugcaccugcuucggcggccagcgcggcuggcgcugcgacaacugccgccgccccggcggcgagcccucccccgagggcaccaccggccaguccuacaaccaguacucccagcgcuaccaccagcgcaccaacaccaacgucaacugccccaucgagugcuucaugccccucgacguccaggccgaccgcgaggacucccgcgaguga

SEQ ID NO: 43285 - RNA, 930 nt, Artificial Sequence
  derived and/or modified sequence opt2 from FN3K__Homo_sapiens__NP_071441
auggagcagcuccuccgcgccgagcuccgcaccgccacccuccgcgccuucggcggccccggcgccggcugcaucuccgagggccgcgccuacgacaccgacgccggccccgucuucgucaaggucaaccgccgcacccaggcccgccagauguucgagggcgaggucgccucccucgaggcccuccgcuccaccggccucguccgcgucccccgccccaugaaggucaucgaccuccccggcggcggcgccgccuucgucauggagcaccucaagaugaagucccucuccucccaggccuccaagcucggcgagcagauggccgaccuccaccucuacaaccagaagcuccgcgagaagcucaaggaggaggagaacaccgucggccgccgcggcgagggcgccgagccccaguacgucgacaaguucggcuuccacaccgucaccugcugcggcuucaucccccaggucaacgaguggcaggacgacuggcccaccuucuucgcccgccaccgccuccaggcccagcucgaccucaucgagaaggacuacgccgaccgcgaggcccgcgagcucuggucccgccuccaggucaagauccccgaccucuucugcggccucgagaucguccccgcccuccuccacggcgaccucugguccggcaacgucgccgaggacgacgucggccccaucaucuacgaccccgccuccuucuacggccacuccgaguucgagcucgccaucgcccucauguucggcggcuucccccgcuccuucuucaccgccuaccaccgcaagauccccaaggcccccggcuucgaccagcgccuccuccucuaccagcucuucaacuaccucaaccacuggaaccacuucggccgcgaguaccgcucccccucccucggcaccaugcgccgccuccucaaguga

SEQ ID NO: 43286 - RNA, 930 nt, Artificial Sequence
  derived and/or modified sequence opt2 from FN3KRP__Homo_sapiens__NP_078895
auggaggagcuccuccgccgcgagcucggcugcuccuccguccgcgccaccggccacuccggcggcggcugcaucucccagggccgcuccuacgacaccgaccagggccgcgucuucgucaaggucaaccccaaggccgaggcccgccgcauguucgagggcgagauggccucccucaccgccauccucaagaccaacaccgucaagguccccaagcccaucaagguccucgacgcccccggcggcggcuccguccucgucauggagcacauggacaugcgccaccucuccucccacgccgccaagcucggcgcccagcucgccgaccuccaccucgacaacaagaagcucggcgagaugcgccucaaggaggccggcaccgucggccgcggcggcggccaggaggagcgccccuucgucgcccgcuucggcuucgacgucgucaccugcugcggcuaccucccccaggucaacgacuggcaggaggacugggucgucuucuacgcccgccagcgcauccagccccagauggacauggucgagaaggaguccggcgaccgcgaggcccuccagcucugguccgcccuccagcucaagauccccgaccucuuccgcgaccucgagaucauccccgcccuccuccacggcgaccucuggggcggcaacgucgccgaggacuccuccggccccgucaucuucgaccccgccuccuucuacggccacuccgaguacgagcucgccaucgccggcauguucggcggcuucuccuccuccuucuacuccgccuaccacggcaagauccccaaggcccccggcuucgagaagcgccuccagcucuaccagcucuuccacuaccucaaccacuggaaccacuucggcuccggcuaccgcggcuccucccucaacaucaugcgcaaccucgucaaguga

SEQ ID NO: 43287 - RNA, 1854 nt, Artificial Sequence
  derived and/or modified sequence opt2 from FNBP1__Homo_sapiens__NP_055848
auguccuggggcaccgagcucugggaccaguucgacaaccucgagaagcacacccaguggggcaucgacauccucgagaaguacaucaaguucgucaaggagcgcaccgagaucgagcucuccuacgccaagcagcuccgcaaccucuccaagaaguaccagcccaagaagaacuccaaggaggaggaggaguacaaguacaccuccugcaaggccuucaucuccaaccucaacgagaugaacgacuacgccggccagcacgaggucaucuccgagaacauggccucccagaucaucgucgaccucgcccgcuacguccaggagcucaagcaggagcgcaaguccaacuuccacgacggccgcaaggcccagcagcacaucgagaccugcuggaagcagcucgaguccuccaagcgccgcuucgagcgcgacugcaaggaggccgaccgcgcccagcaguacuucgagaagauggacgccgacaucaacgucaccaaggccgacgucgagaaggcccgccagcaggcccagauccgccaccagauggccgaggacuccaaggccgacuacuccuccauccuccagaaguucaaccacgagcagcacgaguacuaccacacccacauccccaacaucuuccagaagauccaggagauggaggagcgccgcaucguccgcaugggcgaguccaugaagaccuacgccgaggucgaccgccaggucauccccaucaucggcaagugccucgacggcaucgucaaggccgccgaguccaucgaccagaagaacgacucccagcucgucaucgaggccuacaaguccggcuucgagccccccggcgacaucgaguucgaggacuacacccagcccaugaagcgcaccgucuccgacaacucccucuccaacucccgcggcgagggcaagcccgaccucaaguucggcggcaaguccaagggcaagcucuggcccuucaucaagaagaacaagcucaugucccuccucaccuccccccaccagccccccccccccccccccgccuccgccucccccuccgccguccccaacggcccccagucccccaagcagcagaaggagccccucucccaccgcuucaacgaguucaugaccuccaagcccaagauccacugcuuccgcucccucaagcgcggccucucccucaagcucggcgccacccccgaggacuucuccaaccucccccccgagcagcgccgcaagaagcuccagcagaaggucgacgagcucaacaaggagauccagaaggagauggaccagcgcgacgccaucaccaagaugaaggacgucuaccucaagaacccccagaugggcgaccccgccucccucgaccacaagcucgccgaggucucccagaacaucgagaagcuccgcgucgagacccagaaguucgaggccuggcucgccgaggucgagggccgccuccccgcccgcuccgagcaggcccgccgccaguccggccucuacgacucccagaacccccccaccgucaacaacugcgcccaggaccgcgagucccccgacggcuccuacaccgaggagcagucccaggaguccgagaugaagguccucgccaccgacuucgacgacgaguucgacgacgaggagccccuccccgccaucggcaccugcaaggcccucuacaccuucgagggccagaacgagggcaccaucuccgucgucgagggcgagacccucuacgucaucgaggaggacaagggcgacggcuggacccgcauccgccgcaacgaggacgaggagggcuacguccccaccuccuacgucgaggucugccucgacaagaacgccaaggacuccuga

SEQ ID NO: 43288 - RNA, 5685 nt, Artificial Sequence
  derived and/or modified sequence opt2 from FNDC1__Homo_sapiens__NP_115921
auggcccccgaggccggcgccacccuccgcgccccccgccgccucuccugggccgcccuccuccuccucgccgcccuccuccccgucgccuccuccgccgccgccuccgucgaccacccccucaagccccgccacgucaagcuccucuccaccaagaugggccucaaggucaccugggacccccccaaggacgccaccucccgccccgucgagcacuacaacaucgccuacggcaagucccucaagucccucaaguacaucaaggucaacgccgagaccuacuccuuccucaucgaggacgucgagcccggcgucgucuacuucguccuccucaccgccgagaaccacuccggcgucucccgccccgucuaccgcgccgaguccccccccggcggcgaguggaucgagaucgacggcuuccccaucaagggccccggccccuucaacgagaccgucaccgagaaggagguccccaacaagccccuccgcguccgcguccgcuccuccgacgaccgccucuccgucgccuggaaggccccccgccucuccggcgccaaguccccccgccgcucccgcggcuuccuccucggcuacggcgaguccggccgcaagaugaacuacgucccccucacccgcgacgagcgcacccacgagaucaagaagcucgccuccgaguccgucuacgucgucucccuccaguccaugaacucccagggccgcucccagcccgucuaccgcgccgcccucaccaagcgcaagaucuccgaggaggacgagcucgacguccccgacgacaucuccguccgcgucauguccucccaguccguccucgucuccugggucgaccccguccucgagaagcagaagaaggucgucgccucccgccaguacaccguccgcuaccgcgagaagggcgagcucgcccgcugggacuacaagcagaucgccaaccgccgcguccucaucgagaaccucauccccgacaccgucuacgaguucgccguccgcaucucccagggcgagcgcgacggcaagugguccaccuccgucuuccagcgcacccccgaguccgcccccaccaccgcccccgagaaccucaacgucuggcccgucaacggcaagcccaccgucgucgccgccuccugggacgcccuccccgagaccgagggcaaggucaaggaguacauccucuccuacgcccccgcccucaagcccuucggcgccaagucccucaccuaccccggcgacaccaccuccgcccucgucgacggccuccagcccggcgagcgcuaccucuucaagauccgcgccaccaaccgccgcggccucggcccccacuccaaggccuucaucgucgccaugcccaccaccuccaaggccgacgucgagcagaacaccgaggacaacggcaagcccgagaagcccgagcccuccucccccuccccccgcgcccccgccuccucccagcaccccuccguccccgccuccccccagggccgcaacgccaaggaccuccuccucgaccucaagaacaagauccucgccaacggcggcgccccccgcaagccccagcuccgcgccaagaaggccgaggagcucgaccuccaguccaccgagaucaccggcgaggaggagcucggcucccgcgaggacucccccaugucccccuccgacacccaggaccagaagcgcacccuccgcccccccucccgccacggccacuccgucgucgcccccggccgcaccgccguccgcgcccgcaugcccgcccucccccgccgcgagggcgucgacaagcccggcuucucccucgccacccagccccgccccggcgccccccccuccgccuccgccucccccgcccaccacgccuccacccagggcaccucccaccgccccucccuccccgccucccucaacgacaacgaccucgucgacuccgacgaggacgagcgcgccgucggcucccuccaccccaagggcgccuucgcccagccccgccccgcccucucccccucccgccagucccccuccuccguccuccgcgaccgcuccuccguccaccccggcgccaagcccgccucccccgcccgccgcaccccccacuccggcgccgccgaggaggacuccuccgccuccgccccccccucccgccucucccccccccacggcggcuccucccgccuccuccccacccagccccaccucuccuccccccucuccaagggcggcaaggacggcgaggacgcccccgccaccaacuccaacgcccccucccgcuccaccauguccuccuccgucuccucccaccucuccucccgcacccaggucuccgagggcgccgaggccuccgacggcgagucccacggcgacggcgaccgcgaggacggcggccgccaggccgaggccaccgcccagacccuccgcgcccgccccgccuccggccacuuccaccuccuccgccacaagcccuucgccgccaacggccgcucccccucccgcuucuccaucggccgcggcccccgccuccagcccuccuccuccccccaguccaccguccccucccgcgcccacccccgcguccccucccacuccgacucccaccccaagcucuccuccggcauccacggcgacgaggaggacgagaagccccuccccgccaccgucgucaacgaccacguccccuccuccucccgccagcccaucucccgcggcugggaggaccuccgccgcuccccccagcgcggcgccucccuccaccgcaaggagcccauccccgagaaccccaaguccaccggcgccgacacccacccccagggcaaguacuccucccucgccuccaaggcccaggacguccagcaguccaccgacgccgacaccgagggccacucccccaaggcccagcccggcuccaccgaccgccacgccucccccgcccgcccccccgccgcccgcucccagcagcaccccuccgucccccgccgcaugacccccggccgcgccccccagcagcagccccccccccccgucgccaccucccagcaccaccccggcccccagucccgcgacgccggccgcucccccucccagccccgccucucccucacccaggccggccgcccccgccccaccucccagggccgcucccacuccuccuccgaccccuacaccgccuccucccgcggcaugcuccccaccgcccuccagaaccaggacgaggacgcccagggcuccuacgacgacgacuccaccgaggucgaggcccaggacguccgcgcccccgcccacgccgcccgcgccaaggaggccgccgccucccuccccaagcaccagcaggucgagucccccaccggcgccggcgccggcggcgaccaccgcucccagcgcggccacgccgccucccccgcccgccccucccgccccggcggcccccagucccgcgcccgcguccccucccgcgccgcccccggcaaguccgagccccccuccaagcgcccccucuccuccaagucccagcaguccgucuccgccgaggacgacgaggaggaggacgccggcuucuucaagggcggcaaggaggaccuccucuccuccuccguccccaaguggcccuccuccuccaccccccgcggcggcaaggacgccgacggcucccucgccaaggaggagcgcgagcccgccaucgcccucgccccccgcggcggcucccucgcccccgucaagcgcccccucccccccccccccggcuccuccccccgcgccucccacguccccucccgccuccccccccgcuccgccgccaccgucucccccgucgccggcacccaccccuggccccaguacaccacccgcgccccccccggccacuucuccaccacccccaugcucucccuccgccagcgcaugaugcacgcccgcuuccgcaacccccucucccgccagcccgcccgccccuccuaccgccagggcuacaacggccgccccaacgucgagggcaagguccuccccggcuccaacggcaagcccaacggccagcgcaucaucaacggcccccagggcaccaagugggucgucgaccucgaccgcggccucguccucaacgccgagggccgcuaccuccaggacucccacggcaacccccuccgcaucaagcucggcggcgacggccgcaccaucgucgaccucgagggcacccccgucgucucccccgacggccucccccucuucggccagggccgccacggcaccccccucgccaacgcccaggacaagcccauccucucccucggcggcaagccccucgucggccucgaggucaucaagaagaccacccacccccccaccaccaccaugcagcccaccaccaccaccaccccccuccccaccaccaccaccccccgccccaccaccgccaccacccgccgcaccaccaccacccgccgcaccaccacccgccgccccaccaccaccguccgcaccaccacccgcaccaccaccaccaccacccccacccccaccacccccauccccaccugcccccccggcacccucgagcgccacgacgacgacggcaaccucaucauguccuccaacggcauccccgagugcuacgccgaggaggacgaguucuccggccucgagaccgacaccgccguccccaccgaggaggccuacgucaucuacgacgaggacuacgaguucgagaccucccgcccccccaccaccaccgagcccuccaccaccgccaccaccccccgcgucauccccgaggagggcgccaucuccuccuuccccgaggaggaguucgaccucgccggccgcaagcgcuucgucgcccccuacgucaccuaccucaacaaggaccccuccgcccccugcucccucaccgacgcccucgaccacuuccaggucgacucccucgacgagaucauccccaacgaccucaagaaguccgaccuccccccccagcacgccccccgcaacaucaccgucgucgccgucgagggcugccacuccuucgucaucgucgacugggacaaggccacccccggcgacgucgucaccggcuaccucgucuacuccgccuccuacgaggacuucauccgcaacaagugguccacccaggccuccuccgucacccaccuccccaucgagaaccucaagcccaacacccgcuacuacuucaagguccaggcccagaacccccacggcuacggccccaucucccccuccgucuccuucgucaccgaguccgacaacccccuccucgucguccgcccccccggcggcgagcccaucuggauccccuucgccuucaagcacgaccccuccuacaccgacugccacggccgccaguacgucaagcgcaccugguaccgcaaguucgucggcgucguccucugcaacucccuccgcuacaagaucuaccucuccgacaaccucaaggacaccuucuacuccaucggcgacuccuggggccgcggcgaggaccacugccaguucgucgacucccaccucgacggccgcaccggcccccaguccuacgucgaggcccuccccaccauccagggcuacuaccgccaguaccgccaggagcccguccgcuucggcaacaucggcuucggcacccccuacuacuacgucggcugguacgagugcggcgucuccauccccggcaagugguga

SEQ ID NO: 43289 - RNA, 3597 nt, Artificial Sequence
  derived and/or modified sequence opt2 from FNDC3A__Homo_sapiens__NP_001073141
auggccgagcaccccccccuccucgacaccacccagauccucuccuccgacaucucccuccucuccgcccccaucgucuccgccgacggcacccagcaggucauccucguccaggucaaccccggcgaggccuucaccauccgccgcgaggacggccaguuccagugcaucaccggccccgcccagguccccaugaugucccccaacggcuccgucccccccaucuacgucccccccggcuacgccccccaggucaucgaggacaacggcguccgccgcgucgucgucgucccccaggcccccgaguuccaccccggcucccacaccguccuccaccgcuccccccaccccccccuccccggcuucauccccguccccaccaugaugcccccccccccccgccacauguacucccccgucaccggcgccggcgacaugaccacccaguacaugccccaguaccaguccucccaggucuacggcgacgucgacgcccacuccacccacggccgcuccaacuuccgcgacgagcgcuccuccaagaccuacgagcgccuccagaagaagcucaaggaccgccagggcacccagaaggacaagauguccuccccccccuccuccccccagaagugccccucccccaucaacgagcacaacggccucaucaagggccagaucgccggcggcaucaacaccggcuccgccaagaucaaguccggcaagggcaagggcggcacccaggucgacaccgagaucgaggagaaggacgaggagaccaaggccuucgaggcccuccucuccaacaucgucaagcccgucgccuccgacauccaggcccgcaccgucguccucaccugguccccccccuccucccucaucaacggcgagaccgacgaguccuccguccccgagcucuacggcuacgagguccucaucuccuccaccggcaaggacggcaaguacaaguccgucuacgucggcgaggagaccaacaucacccucaacgaccucaagcccgccauggacuaccacgccaagguccaggccgaguacaacuccaucaagggcacccccuccgaggccgagaucuucaccacccucuccugcgagcccgacauccccaaccccccccgcaucgccaaccgcaccaagaacucccucacccuccaguggaaggcccccuccgacaacggcuccaagauccagaacuucguccucgagugggacgagggcaagggcaacggcgaguucugccagugcuacaugggcucccagaagcaguucaagaucaccaagcucucccccgccaugggcugcaaguuccgccucuccgcccgcaacgacuacggcaccuccggcuucuccgaggagguccucuacuacaccuccggcugcgcccccuccaugcccgccucccccguccucaccaaggccggcaucaccuggcucucccuccagugguccaagcccuccggcacccccuccgacgagggcaucuccuacauccucgagauggaggaggagaccuccggcuacggcuucaagcccaaguacgacggcgaggaccucgccuacaccgucaagaaccuccgccgcuccaccaaguacaaguucaaggucaucgccuacaacuccgagggcaaguccaaccccuccgaggucgucgaguucaccaccugccccgacaagcccggcauccccgucaagcccuccgucaagggcaagauccacucccacuccuucaagaucaccugggacccccccaaggacaacggcggcgccaccaucaacaaguacgucgucgagauggccgagggcuccaacggcaacaagugggagaugaucuacuccggcgccacccgcgagcaccucugcgaccgccucaaccccggcugcuucuaccgccuccgcgucuacugcaucuccgacggcggccaguccgccgucuccgagucccuccucguccagacccccgccgucccccccggccccugccuccccccccgccuccagggccgccccaaggccaaggagauccagcuccgcuggggccccccccucgucgacggcggcucccccaucuccugcuacuccgucgagaugucccccaucgagaaggacgagccccgcgaggucuaccagggcuccgaggucgagugcaccgucuccucccuccuccccggcaagaccuacuccuuccgccuccgcgccgccaacaagaugggcuucggccccuucuccgagaagugcgacaucaccaccgcccccggcccccccgaccagugcaagcccccccaggucaccugccgcuccgccaccugcgcccaggucaacugggaggucccccucuccaacggcaccgacgucaccgaguaccgccucgaguggggcggcgucgagggcuccaugcagaucugcuacugcggccccggccucuccuacgagaucaagggccucucccccgccaccaccuacuacugccgcguccaggcccucuccgucgucggcgccggccccuucuccgaggucgucgccugcgucaccccccccuccguccccggcaucgucaccugccuccaggagaucuccgacgacgagaucgagaacccccacuacucccccuccaccugccucgccaucuccugggagaagcccugcgaccacggcuccgagauccucgccuacuccaucgacuucggcgacaagcagucccucaccgucggcaaggucaccuccuacaucaucaacaaccuccagcccgacaccaccuaccgcauccgcauccaggcccucaacucccucggcgccggccccuucucccacaugaucaagcucaagaccaagccccucccccccgaccccccccgccucgagugcgucgccuucucccaccagaaccucaagcucaaguggggcgagggcacccccaagacccucuccaccgacuccauccaguaccaccuccagauggaggacaagaacggccgcuucgucucccucuaccgcggccccugccacaccuacaagguccagcgccucaacgaguccaccuccuacaaguucugcauccaggccugcaacgaggccggcgagggcccccucucccaggaguacaucuucaccacccccaaguccguccccgccgcccucaaggcccccaagaucgagaaggucaacgaccacaucugcgagaucaccugggagugccuccagcccaugaagggcgaccccgucaucuacucccuccaggucaugcucggcaaggacuccgaguucaagcagaucuacaagggccccgacuccuccuuccgcuacuccucccuccagcucaacugcgaguaccgcuuccgcgucugcgccauccgccagugccaggacucccucggccaccaggaccucgucggccccuacuccaccaccguccucuucaucucccagcgcaccgagccccccgccuccaccaaccgcgacaccgucgaguccacccgcacccgccgcgcccucuccgacgagcagugcgccgccgucauccucguccucuucgccuucuucuccauccucaucgccuucaucauccaguacuucgucaucaaguga

SEQ ID NO: 43290 - RNA, 3615 nt, Artificial Sequence
  derived and/or modified sequence opt2 from FNDC3B__Homo_sapiens__NP_001128567
auguacgucaccaugaugaugaccgaccagaucccccucgagcuccccccccuccucaacggcgaggucgccaugaugccccaccucgucaacggcgacgccgcccagcaggucauccucguccaggucaaccccggcgagaccuucaccauccgcgccgaggacggcacccuccagugcauccagggccccgccgagguccccaugaugucccccaacggcuccaucccccccauccacgucccccccggcuacaucucccaggucaucgaggacuccaccggcguccgccgcgucgucgucaccccccagucccccgagugcuacccccccuccuaccccuccgccaugucccccacccaccaccucccccccuaccucacccaccacccccacuucauccacaacucccacaccgccuacuacccccccgucaccggccccggcgacaugcccccccaguucuucccccagcaccaccucccccacaccaucuacggcgagcaggagaucauccccuucuacggcauguccaccuacaucacccgcgaggaccaguacuccaagcccccccacaagaagcucaaggaccgccagaucgaccgccagaaccgccucaacuccccccccuccuccaucuacaaguccuccugcaccaccgucuacaacggcuacggcaagggccacuccggcggcuccggcggcggcggcuccggcuccggccccggcaucaagaagaccgagcgccgcgcccgcuccucccccaaguccaacgacuccgaccuccaggaguacgagcucgaggucaagcgcguccaggacauccucuccggcaucgagaagccccaggucuccaacauccaggcccgcgccgucguccucuccugggccccccccgucggccucuccugcggcccccacuccggccucuccuuccccuacuccuacgaggucgcccucuccgacaagggccgcgacggcaaguacaagaucaucuacuccggcgaggagcucgagugcaaccucaaggaccuccgccccgccaccgacuaccacguccgcgucuacgccauguacaacuccgucaagggcuccugcuccgagcccgucuccuucaccacccacuccugcgcccccgagugccccuucccccccaagcucgcccaccgcuccaaguccucccucacccuccaguggaaggcccccaucgacaacggcuccaagaucaccaacuaccuccucgagugggacgagggcaagcgcaacuccggcuuccgccagugcuucuucggcucccagaagcacugcaagcucaccaagcucugccccgccaugggcuacaccuuccgccucgccgcccgcaacgacaucggcaccuccggcuacucccaggaggucgucugcuacacccucggcaacaucccccagaugcccuccgccccccgccucguccgcgccggcaucaccugggucacccuccagugguccaagcccgagggcugcucccccgaggaggucaucaccuacacccucgagauccaggaggacgagaacgacaaccucuuccaccccaaguacaccggcgaggaccucaccugcaccgucaagaaccucaagcgcuccacccaguacaaguuccgccucaccgccuccaacaccgagggcaaguccugccccuccgagguccucgucugcaccaccucccccgaccgccccggcccccccacccgcccccucgucaagggccccgucaccucccacggcuucuccgucaagugggacccccccaaggacaacggcggcuccgagauccucaaguaccuccucgagaucaccgacggcaacuccgaggccaaccagugggaggucgccuacuccggcuccgccaccgaguacaccuucacccaccucaagcccggcacccucuacaagcuccgcgccugcugcaucuccaccggcggccacucccagugcuccgagucccuccccguccgcacccucuccaucgcccccggccagugccgccccccccgcguccucggccgccccaagcacaaggagguccaccucgagugggacguccccgccuccgaguccggcugcgaggucuccgaguacuccgucgagaugaccgagcccgaggacgucgccuccgaggucuaccacggccccgagcucgagugcaccgucggcaaccuccuccccggcaccgucuaccgcuuccgcguccgcgcccucaacgacggcggcuacggccccuacuccgacgucuccgagaucaccaccgccgccggcccccccggccagugcaaggcccccugcaucuccugcacccccgacggcugcguccucgucggcugggagucccccgacuccuccggcgccgacaucuccgaguaccgccucgaguggggcgaggacgaggagucccucgagcucaucuaccacggcaccgacacccgcuucgagauccgcgaccuccuccccgccgcccaguacugcugccgccuccaggccuucaaccaggccggcgccggccccuacuccgagcucguccucugccagacccccgccuccgcccccgaccccgucuccacccucugcguccucgaggaggagccccucgacgccuaccccgacucccccuccgccugccucguccucaacugggaggagcccugcaacaacggcuccgagauccucgccuacaccaucgaccucggcgacaccuccaucaccgucggcaacaccaccaugcacgucaugaaggaccuccuccccgagaccaccuaccgcauccgcauccaggccaucaacgagaucggcgccggccccuucucccaguucaucaaggccaagacccgcccccuccccccccuccccccccgccucgagugcgccgccgccggcccccagucccucaagcucaaguggggcgacuccaacuccaagacccacgccgccgaggacaucgucuacacccuccagcucgaggaccgcaacaagcgcuucaucuccaucuaccgcggccccucccacaccuacaagguccagcgccucaccgaguucaccugcuacuccuuccgcauccaggccgccuccgaggccggcgagggccccuucuccgagaccuacaccuucuccaccaccaaguccgucccccccaccaucaaggccccccgcgucacccagcucgagggcaacuccugcgagauccucugggagaccguccccuccaugaagggcgaccccgucaacuacauccuccagguccucgucggccgcgaguccgaguacaagcaggucuacaagggcgaggaggccaccuuccagaucuccggccuccagaccaacaccgacuaccgcuuccgcgucugcgccugccgccgcugccucgacaccucccaggagcucuccggcgccuucucccccuccgccgccuucguccuccagcgcuccgaggucaugcucaccggcgacaugggcucccucgacgaccccaagaugaaguccaugaugcccaccgacgagcaguucgccgccaucaucguccucggcuucgccacccucuccauccucuucgccuucauccuccaguacuuccucaugaaguga

SEQ ID NO: 43291 - RNA, 705 nt, Artificial Sequence
  derived and/or modified sequence opt2 from FNDC4__Homo_sapiens__NP_073734
augcccuccggcugccacuccuccccccccuccggccuccgcggcgacauggccucccucgucccccucucccccuaccucucccccaccguccuccuccucgucuccugcgaccucggcuucguccgcgccgaccgcccccccucccccgucaacgucaccgucacccaccuccgcgccaacuccgccaccgucuccugggacguccccgagggcaacaucgucaucggcuacuccaucucccagcagcgccagaacggccccggccagcgcgucauccgcgaggucaacaccaccacccgcgccugcgcccucuggggccucgccgaggacuccgacuacaccguccagguccgcuccaucggccuccgcggcgaguccccccccggcccccgcguccacuuccgcacccucaagggcuccgaccgccuccccuccaacuccuccucccccggcgacaucaccgucgagggccucgacggcgagcgcccccuccagaccggcgaggucgucaucaucgucgucguccuccucaugugggccgccgucaucggccucuucugccgccaguacgacaucaucaaggacaacgacuccaacaacaaccccaaggagaagggcaagggccccgagcaguccccccagggccgccccgucggcacccgccagaagaagucccccuccaucaacaccaucgacgucuga

SEQ ID NO: 43292 - RNA, 1140 nt, Artificial Sequence
  derived and/or modified sequence opt2 from FNTA__Homo_sapiens__NP_002018
auggccgccaccgagggcgucggcgaggccgcccagggcggcgagcccggccagcccgcccagccccccccccagccccaccccccccccccccagcagcagcacaaggaggagauggccgccgaggccggcgaggccgucgccucccccauggacgacggcuucgucucccucgacucccccuccuacguccucuaccgcgaccgcgccgagugggccgacaucgaccccgucccccagaacgacggccccaaccccgucguccagaucaucuacuccgacaaguuccgcgacgucuacgacuacuuccgcgccguccuccagcgcgacgagcgcuccgagcgcgccuucaagcucacccgcgacgccaucgagcucaacgccgccaacuacaccgucuggcacuuccgccgcguccuccucaagucccuccagaaggaccuccacgaggagaugaacuacaucaccgccaucaucgaggagcagcccaagaacuaccaggucuggcaccaccgccgcguccucgucgaguggcuccgcgaccccucccaggagcucgaguucaucgccgacauccucaaccaggacgccaagaacuaccacgccuggcagcaccgccagugggucauccaggaguucaagcucugggacaacgagcuccaguacgucgaccagcuccucaaggaggacguccgcaacaacuccgucuggaaccagcgcuacuucgucaucuccaacaccaccggcuacaacgaccgcgccguccucgagcgcgagguccaguacacccucgagaugaucaagcucgucccccacaacgaguccgccuggaacuaccucaagggcauccuccaggaccgcggccucuccaaguaccccaaccuccucaaccagcuccucgaccuccagcccucccacuccucccccuaccucaucgccuuccucgucgacaucuacgaggacaugcucgagaaccagugcgacaacaaggaggacauccucaacaaggcccucgagcucugcgagauccucgccaaggagaaggacaccauccgcaaggaguacuggcgcuacaucggccgcucccuccaguccaagcacuccaccgagaacgacucccccaccaacguccagcaguga

SEQ ID NO: 43293 - RNA, 1314 nt, Artificial Sequence
  derived and/or modified sequence opt2 from FNTB__Homo_sapiens__NP_002019
auggccucccccuccuccuucaccuacuacugcccccccuccuccucccccgucugguccgagccccucuacucccuccgccccgagcacgcccgcgagcgccuccaggacgacuccgucgagaccgucaccuccaucgagcaggccaaggucgaggagaagauccaggaggucuucuccuccuacaaguucaaccaccucgucccccgccucguccuccagcgcgagaagcacuuccacuaccucaagcgcggccuccgccagcucaccgacgccuacgagugccucgacgccucccgccccuggcucugcuacuggauccuccacucccucgagcuccucgacgagcccaucccccagaucgucgccaccgacgucugccaguuccucgagcucugccagucccccgagggcggcuucggcggcggccccggccaguacccccaccucgcccccaccuacgccgccgucaacgcccucugcaucaucggcaccgaggaggccuacgacaucaucaaccgcgagaagcuccuccaguaccucuacucccucaagcagcccgacggcuccuuccucaugcacgucggcggcgaggucgacguccgcuccgccuacugcgccgccuccgucgccucccucaccaacaucaucacccccgaccucuucgagggcaccgccgaguggaucgcccgcugccagaacugggagggcggcaucggcggcguccccggcauggaggcccacggcggcuacaccuucugcggccucgccgcccucgucauccucaagcgcgagcgcucccucaaccucaagucccuccuccagugggucaccucccgccagaugcgcuucgagggcggcuuccagggccgcugcaacaagcucgucgacggcugcuacuccuucuggcaggccggccuccucccccuccuccaccgcgcccuccacgcccagggcgaccccgcccucuccaugucccacuggauguuccaccagcaggcccuccaggaguacauccucaugugcugccagugccccgccggcggccuccucgacaagcccggcaagucccgcgacuucuaccacaccugcuacugccucuccggccucuccaucgcccagcacuucggcuccggcgccaugcuccacgacgucguccucggcguccccgagaacgcccuccagcccacccaccccgucuacaacaucggccccgacaaggucauccaggccaccaccuacuuccuccagaagcccguccccggcuucgaggagcucaaggacgagaccuccgccgagcccgccaccgacuga

SEQ ID NO: 43294 - RNA, 5406 nt, Artificial Sequence
  derived and/or modified sequence opt2 from FOCAD__Homo_sapiens__NP_060264
auguccgacgacauccgcaagcgcuucgaguuccccaacucccucauccagucccaggccgucggccaccucaucgccgccguccucaaggagaacggcuucuccgagaagauccaccaguccaccaaccagacccccgcccucaaccuccucugggagaagugcugcuccgacaacgucgucguccgcaccgccugcugcgagggccucgucgcccucgucgcccaggaccacgccgaguucuccuacguccucaacggcauccucaaccucauccccuccacccgcaacacccacggccucaucaaggccaucaugcaccuccuccagaugcaggcccucaaggagggccagggcggcgagaagaacauccaguccaucuacaccauccgcaaccacccccacccccucaucaccguccucgagcaccgccccgacugcuggcccgucuuccuccagcagcucaccgccuucuuccagcagugccccgagcgccucgaggucuccugcauccagaucauggcccccuuccucugguaccucuacugcgagcccucccagcuccaggaguacgccaagcuccgccucgcccuccucaagguccuccuccagccccagguccucugcgacaaggaccagcccuccauccucgagcagcagauccuccagcucugcugcgacaucguccccugccuccaggucaaggaccucauccagaccaccgaggccaugauguucaucgaggaggucugccucucccuccuccgccaccccgucuucuggaagauccagcucacccagaugucccuccagcuccucugcgucuccgaggucucccucaagaucaccggcgagugcuccuccuccauccaccuccucgagcacuccgucgagcuccucaaggaggacuuccccgucgagcucgucaucaucggcaucgcccuccuccuccuccagacccccgccucccagcagaagcccauccucaaccucgcccucaagcuccucuccgucaccgaggaccagaagauccccaaguccucccuccuccucgucaugcccauccuccagauccucuccuccaccgcccucgaggacugcaucuccgucgacgaggagggccccucccgccagcagcucgcccucaaccuccucgagaugauccagcaggagugcuaccgcgacgaccaccagaagcucuccuacaagcucgucugccccgucaccuccauguacggcaccaucuucaccgccuggcgcauccucgaggucaugaccgacuccuccgccgccuccgacuggcucgccuccgucgagucccuccuccccaucaccgccgucauccccgcccccgccuuccuccuccucgcccaccuccucgucgaggacaagggccagaaccuccaccagauccucaaggucaccaccgagcucgcccaggccgacuccucccagguccccaaccucauccccguccucauguucaagcucggccgcccccucgagcccauccucuacaacgacauccucuacacccuccccaagcucggcguccacaaggucugcaucggccagauccuccgcaucauccagcuccucggcaccaccccccgccuccgcgccgucacccuccgccuccucaccucccucugggagaagcaggaccgcgucuaccccgagcuccagcgcuucauggccgucuccgacguccccucccucuccgucggcaaggagguccagugggagaagcucaucgccaaggccgccuccauccgcgacaucugcaagcagcgccccuaccagcacggcgccgacaugcucgccgccaucucccagguccucaacgagugcaccaagcccgaccaggccacccccgccgcccucguccuccagggccuccacgcccucugccaggccgaggucgucugcauccgcuccaccuggaacgcccucucccccaagcucuccugcgacacccgcccccucauccucaagacccucuccgagcucuucucccucguccccucccucaccgucaacaccaccgaguacgagaacuucaagguccagguccucuccuuccucuggacccacacccagaacaaggaccccaucgucgccaacgccgccuaccgcucccucgccaacuucuccgccggcgagcacaccauccuccaccuccccgagaagauccgccccgagauccccauccccgaggagcucgacgacgacgaggacgucgaggacgucgaccucuccguccccggcuccugcuaccucaagcuccucucccucacccccccccucguccuccccgcccucgaggaguucuucaccucccucgucaagcaggagauggucaacaugccccgcggcaucuaccacuccgcccucaagggcggcgcccgcuccgaccagggcaagaccgucgccggcauccccaacuucauccucaagauguacgagaccaacaagcagcccggccucaagcccggccucgccggcggcaugcucuucugcuacgacgucuccauguaccaguccaaggacggcaagccccucaaccgccucauggccucccgcggccgcuccuucaagcagaccucccucgcccucguccacgagguccacauccagcucuccgaguggcaccgcgccaucuuccucccccaggccuggcucgccuacaugaaccgcgccuaccacgccauccuccagggccgccucggcgagcucgagcuccagcucaagcacggcaaggaggagcccgaggagguccaguacaagaaguccaccgccuggcucuggguccgcgacaugcucaccgacgagaucaccaaggccgccgccaaggagucccccgucgucaagggcaacgcccuccucgcccucuccucccucgccgucgucgucucccgccacgaggccucccucuccuccgacuccgacggccuccucgagguccagcccaacuuccucuccaugaaggagugggucuccaugguccucgacacccuccucgucaucgucgacucccacuaccagccccgcggccagcuccucuccugguucuacuacaaguccuacuccggcgagaacaccgccuccgccaucgcccgcuccgccgccgccaccgcccucucccuccucguccccgucuucaucaucuccugcaaggagaaggucgaggagauccucaacaugcucaccgcccgccuccccggcaagcccuccgccgacgagucccaggccguccagauccacaugggccucgcccucggcauguuccucucccgccucugcgaggagaagcucuccgacaucuccggccaggagaugaaccuccuccucaugaagucccucgacgcccucgagaacugcugcuucgacaccucccucgaguacaacaccggcugcauccucggcgucggccucguccucucccucaugucccacuccucccagaugcagucccgcguccacgucgccgcccuccuccgcaagcucuccgcccacgucgacgacuccggcucccagucccgcaccuuccaggagguccucgccuacacccucuccugcgucugcaccuccgccuucuccgccggcaucaucgaggccaccgaggccgaggacgucaugaacaagcuccgccuccucgucgagaacucccagcagaccuccggcuucgcccucgcccucggcaacaucguccacggccucuccgucugcggccacggcaaggccgaggaccucggcuccaagcuccuccccgccuggauccgcaucguccucaccgagggcacccccaccaugcucugccucgccgcccuccacggcauggucgcccucgucggcuccgagggcgacgucaugcagcucaaguccgaggccauccagaccucccacuuccagggccgccucaacgaggucauccgcacccucacccaggucaucuccgucuccggcgucaucggccuccaguccaacgccgucuggcuccucggccaccuccaccucuccacccucuccuccucccagucccgcgccuccguccccaccgacuacuccuaccuccccgaguccuccuucaucggcgccgccaucggcuucuucaucaccggcggcaagaagggccccgaguccgucccccccucccuccucaaggucgucaugaagcccaucgccaccgucggcgaguccuaccaguacccccccgucaacugggccgcccuccucuccccccucaugcgccucaacuucggcgaggagauccagcagcucugccucgagaucauggucacccaggcccaguccucccagaacgccgccgcccuccucggccucugggucacccccccccucauccacucccucucccucaacaccaagcgcuaccuccucaucuccgccccccucuggaucaagcacaucuccgacgagcagauccucggcuucgucgagaaccucauggucgccgucuucaaggccgccuccccccucggcucccccgagcucugccccuccgcccuccacggccucucccaggccaugaagcuccccucccccgcccaccaccucuggucccuccucuccgaggccaccggcaagaucuucgaccuccuccccaacaagauccgccgcaaggaccucgagcucuacaucuccaucgccaagugccuccucgagaugaccgacgacgacgccaaccgcaucgcccaggucaccaaguccaacaucgagaaggccgccuucgucaagcucuaccucgucucccagggccgcuucccccucgucaaccucaccgacaugcucuccgucgccguccagcaccgcgagaaggagguccucgccuggaugauccuccacucccucuaccaggcccgcaucgucucccacgccaacaccggcguccucaagcgcauggaguggcuccucgagcucaugggcuacauccgcaacgucgccuaccaguccaccuccuuccacaacaccgcccucgacaaggcccucgacuucuuccuccucaucuucgccaccgccgucgucgccugggccgaccacaccgccccccuccuccucggccucuccgccuccuggcuccccuggcaccaggagaacggccccgccggccccguccccuccuuccucggccgcucccccaugcaccgcgucacccuccaggagguccucacccuccuccccaacuccauggcccuccuccuccagaaggagcccuggaaggagcagacccagaaguucaucgacuggcucuucuccaucauggagucccccaaggaggcccucuccgcccagucccgcgaccuccucaaggccacccuccucucccuccgcguccuccccgaguucaagaagaaggccgucuggacccgcgccuacggcugguga

SEQ ID NO: 43295 - RNA, 2160 nt, Artificial Sequence
  derived and/or modified sequence opt2 from FOLH1__Homo_sapiens__NP_001014986
auguggaaccuccuccacgagaccgacuccgccgucgccaccgcccgccgcccccgcuggcucugcgccggcgcccucguccucgccggcggcuucuuccuccucggcuuccucuucggcugguucaucaaguccuccaacgaggccaccaacaucacccccaagcacaacaugaaggccuuccucgacgagcucaaggccgagaacaucaagaaguuccucuacaacuucacccagaucccccaccucgccggcaccgagcagaacuuccagcucgccaagcagauccagucccaguggaaggaguucggccucgacuccgucgagcucgcccacuacgacguccuccucuccuaccccaacaagacccaccccaacuacaucuccaucaucaacgaggacggcaacgagaucuucaacaccucccucuucgagccccccccccccggcuacgagaacgucuccgacaucgucccccccuucuccgccuucuccccccagggcaugcccgagggcgaccucgucuacgucaacuacgcccgcaccgaggacuucuucaagcucgagcgcgacaugaagaucaacugcuccggcaagaucgucaucgcccgcuacggcaaggucuuccgcggcaacaaggucaagaacgcccagcucgccggcgccaagggcgucauccucuacuccgaccccgccgacuacuucgcccccggcgucaaguccuaccccgacggcuggaaccuccccggcggcggcguccagcgcggcaacauccucaaccucaacggcgccggcgacccccucacccccggcuaccccgccaacgaguacgccuaccgccgcggcaucgccgaggccgucggccuccccuccauccccguccaccccaucggcuacuacgacgcccagaagcuccucgagaagaugggcggcuccgccccccccgacuccuccuggcgcggcucccucaagguccccuacaacgucggccccggcuucaccggcaacuucuccacccagaaggucaagaugcacauccacuccaccaacgaggucacccgcaucuacaacgucaucggcacccuccgcggcgccgucgagcccgaccgcuacgucauccucggcggccaccgcgacuccugggucuucggcggcaucgacccccaguccggcgccgccgucguccacgagaucguccgcuccuucggcacccucaagaaggagggcuggcgcccccgccgcaccauccucuucgccuccugggacgccgaggaguucggccuccucggcuccaccgagugggccgaggagaacucccgccuccuccaggagcgcggcgucgccuacaucaacgccgacuccuccaucgagggcaacuacacccuccgcgucgacugcaccccccucauguacucccucguccacaaccucaccaaggagcucaagucccccgacgagggcuucgagggcaagucccucuacgaguccuggaccaagaagucccccucccccgaguucuccggcaugccccgcaucuccaagcucggcuccggcaacgacuucgaggucuucuuccagcgccucggcaucgccuccggccgcgcccgcuacaccaagaacugggagaccaacaaguucuccggcuacccccucuaccacuccgucuacgagaccuacgagcucgucgagaaguucuacgaccccauguucaaguaccaccucaccgucgcccagguccgcggcggcauggucuucgagcucgccaacuccaucguccuccccuucgacugccgcgacuacgccgucguccuccgcaaguacgccgacaagaucuacuccaucuccaugaagcacccccaggagaugaagaccuacuccgucuccuucgacucccucuucuccgccgucaagaacuucaccgagaucgccuccaaguucuccgagcgccuccaggacuucgacaaguccaagcacgucaucuacgcccccuccucccacaacaaguacgccggcgaguccuuccccggcaucuacgacgcccucuucgacaucgaguccaaggucgaccccuccaaggccuggggcgaggucaagcgccagaucuacgucgccgccuucaccguccaggccgccgccgagacccucuccgaggucgccuga

SEQ ID NO: 43296 - RNA, 774 nt, Artificial Sequence
  derived and/or modified sequence opt2 from FOLR1__Homo_sapiens__NP_000793
auggcccagcgcaugaccacccagcuccuccuccuccucgucugggucgccgucgucggcgaggcccagacccgcaucgccugggcccgcaccgagcuccucaacgucugcaugaacgccaagcaccacaaggagaagcccggccccgaggacaagcuccacgagcagugccgccccuggcgcaagaacgccugcugcuccaccaacaccucccaggaggcccacaaggacgucuccuaccucuaccgcuucaacuggaaccacugcggcgagauggcccccgccugcaagcgccacuucauccaggacaccugccucuacgagugcucccccaaccucggccccuggauccagcaggucgaccaguccuggcgcaaggagcgcguccucaacgucccccucugcaaggaggacugcgagcaguggugggaggacugccgcaccuccuacaccugcaaguccaacuggcacaagggcuggaacuggaccuccggcuucaacaagugcgccgucggcgccgccugccagcccuuccacuucuacuuccccacccccaccguccucugcaacgagaucuggacccacuccuacaaggucuccaacuacucccgcggcuccggccgcugcauccagaugugguucgaccccgcccagggcaaccccaacgaggaggucgcccgcuucuacgccgccgccauguccggcgccggccccugggccgccuggcccuuccuccucucccucgcccucaugcuccucuggcuccucuccuga

SEQ ID NO: 43297 - RNA, 768 nt, Artificial Sequence
  derived and/or modified sequence opt2 from FOLR2__Homo_sapiens__NP_001107008
auggucuggaaguggaugccccuccuccuccuccucgucugcgucgccaccaugugcuccgcccaggaccgcaccgaccuccucaacgucugcauggacgccaagcaccacaagaccaagcccggccccgaggacaagcuccacgaccagugcucccccuggaagaagaacgccugcugcaccgccuccaccucccaggagcuccacaaggacaccucccgccucuacaacuucaacugggaccacugcggcaagauggagcccgccugcaagcgccacuucauccaggacaccugccucuacgagugcucccccaaccucggccccuggauccagcaggucaaccaguccuggcgcaaggagcgcuuccucgacgucccccucugcaaggaggacugccagcgcuggugggaggacugccacaccucccacaccugcaaguccaacuggcaccgcggcugggacuggaccuccggcgucaacaagugccccgccggcgcccucugccgcaccuucgaguccuacuuccccacccccgccgcccucugcgagggccucuggucccacuccuacaaggucuccaacuacucccgcggcuccggccgcugcauccagaugugguucgacuccgcccagggcaaccccaacgaggaggucgcccgcuucuacgccgccgccaugcacgucaacgccggcgagaugcuccacggcaccggcggccuccuccucucccucgcccucaugcuccagcucuggcuccucggcuga

SEQ ID NO: 43298 - RNA, 738 nt, Artificial Sequence
  derived and/or modified sequence opt2 from FOLR3__Homo_sapiens__NP_000795
auggacauggccuggcagaugaugcagcuccuccuccucgcccucgucaccgccgccggcuccgcccagccccgcuccgcccgcgcccgcaccgaccuccucaacgucugcaugaacgccaagcaccacaagacccagcccucccccgaggacgagcucuacggccagugcucccccuggaagaagaacgccugcugcaccgccuccaccucccaggagcuccacaaggacaccucccgccucuacaacuucaacugggaccacugcggcaagauggagcccaccugcaagcgccacuucauccaggacuccugccucuacgagugcucccccaaccucggccccuggauccgccaggucaaccaguccuggcgcaaggagcgcauccucaacgucccccucugcaaggaggacugcgagcgcuggugggaggacugccgcaccuccuacaccugcaaguccaacuggcacaagggcuggaacuggaccuccggcaucaacgagugccccgccggcgcccucugcuccaccuucgaguccuacuuccccacccccgccgcccucugcgagggccucuggucccacuccuucaaggucuccaacuacucccgcggcuccggccgcugcauccagaugugguucgacuccgcccagggcaaccccaacgaggaggucgccaaguucuacgccgccgccaugaacgccggcgcccccucccgcggcaucaucgacuccuga

SEQ ID NO: 43299 - RNA, 525 nt, Artificial Sequence
  derived and/or modified sequence opt2 from FOPNL__Homo_sapiens__NP_653201
auggccaccgucgccgagcucaaggccguccucaaggacacccucgagaagaagggcguccucggccaccucaaggcccgcauccgcgccgaggucuucaacgcccucgacgacgaccgcgagccccgccccucccucucccacgagaaccuccucaucaacgagcucauccgcgaguaccucgaguucaacaaguacaaguacaccgccuccguccucaucgccgaguccggccagcccgucgucccccucgaccgccaguuccucauccacgagcucaacgccuucgaggaguccaaggacaacaccaucccccuccucuacggcauccucgcccacuuccuccgcggcaccaaggacggcauccagaacgccuuccucaagggccccucccuccagcccuccgaccccucccucggccgccagcccucccgccgcaagcccauggacgaccaccuccgcaaggaggagcagaaguccaccaacaucgaggaccuccacgucucccaggccgucaaccgcuga

SEQ ID NO: 43300 - RNA, 909 nt, Artificial Sequence
  derived and/or modified sequence opt2 from FOSB__Homo_sapiens__NP_001107643
auguuccaggccuuccccggcgacuacgacuccggcucccgcugcuccuccucccccuccgccgagucccaguaccucuccuccgucgacuccuucggcuccccccccaccgccgccgccucccaggagugcgccggccucggcgagaugcccggcuccuucguccccaccgucaccgccaucaccaccucccaggaccuccaguggcucguccagcccacccucaucuccuccauggcccagucccagggccagccccucgccucccagccccccgucgucgaccccuacgacaugcccggcaccuccuacuccacccccggcauguccggcuacuccuccggcggcgccuccggcuccggcggccccuccaccuccggcaccaccuccggccccggccccgcccgccccgcccgcgcccgcccccgccgcccccgcgaggagaccgagaccgaccagcucgaggaggagaaggccgagcucgaguccgagaucgccgagcuccagaaggagaaggagcgccucgaguucguccucgucgcccacaagcccggcugcaagauccccuacgaggagggccccggccccggcccccucgccgagguccgcgaccuccccggcuccgcccccgccaaggaggacggcuucuccuggcuccucccccccccccccccccccccccuccccuuccagaccucccaggacgccccccccaaccucaccgccucccucuucacccacuccgagguccagguccucggcgaccccuuccccgucgucaaccccuccuacaccuccuccuucguccucaccugccccgaggucuccgccuucgccggcgcccagcgcaccuccggcuccgaccagcccuccgacccccucaacucccccucccuccucgcccucuga

SEQ ID NO: 43301 - RNA, 1143 nt, Artificial Sequence
  derived and/or modified sequence opt2 from FOS__Homo_sapiens__NP_005243
augauguucuccggcuucaacgccgacuacgaggccuccuccucccgcugcuccuccgccucccccgccggcgacucccucuccuacuaccacucccccgccgacuccuucuccuccaugggcucccccgucaacgcccaggacuucugcaccgaccucgccgucuccuccgccaacuucauccccaccgucaccgccaucuccaccucccccgaccuccaguggcucguccagcccgcccucgucuccuccgucgcccccucccagacccgcgccccccaccccuucggcguccccgcccccuccgccggcgccuacucccgcgccggcgucgucaagaccaugaccggcggccgcgcccaguccaucggccgccgcggcaaggucgagcagcucucccccgaggaggaggagaagcgccgcauccgccgcgagcgcaacaagauggccgccgccaagugccgcaaccgccgccgcgagcucaccgacacccuccaggccgagaccgaccagcucgaggacgagaaguccgcccuccagaccgagaucgccaaccuccucaaggagaaggagaagcucgaguucauccucgccgcccaccgccccgccugcaagauccccgacgaccucggcuuccccgaggagauguccgucgccucccucgaccucaccggcggccuccccgaggucgccacccccgaguccgaggaggccuucacccucccccuccucaacgaccccgagcccaagcccuccgucgagcccgucaaguccaucuccuccauggagcucaagaccgagcccuucgacgacuuccucuuccccgccuccucccgccccuccggcuccgagaccgcccgcuccguccccgacauggaccucuccggcuccuucuacgccgccgacugggagccccuccacuccggcucccucggcaugggccccauggccaccgagcucgagccccucugcacccccgucgucaccugcacccccuccugcaccgccuacaccuccuccuucgucuucaccuaccccgaggccgacuccuuccccuccugcgccgccgcccaccgcaagggcuccuccuccaacgagcccuccuccgacucccucuccucccccacccuccucgcccucuga

SEQ ID NO: 43302 - RNA, 408 nt, Artificial Sequence
  derived and/or modified sequence opt2 from FOSL1__Homo_sapiens__NP_001287784
auguuccgcgacuucggcgagcccggccccuccuccggcaacggcggcggcuacggcggccccgcccagccccccgccgccgcccaggccgcccagcagaaguuccaccucguccccuccaucaacaccauguccggcucccaggagcuccaguggaugguccagccccacuuccucggccccuccuccuacccccgcccccucaccuacccccaguacucccccccccagccccgccccggcgucauccgcgcccucggccccccccccggcguccgccgccgccccugcgagcagcccggcggccgcggcgccccccccuccaaggcccgcgccgagcaggccggcugcggccagguccaggagcccgaggagggcaccgaccgccuccccgccggcggcgacuga

SEQ ID NO: 43303 - RNA, 981 nt, Artificial Sequence
  derived and/or modified sequence opt2 from FOSL2__Homo_sapiens__NP_005244
auguaccaggacuaccccggcaacuucgacaccuccucccgcggcuccuccggcucccccgcccacgccgaguccuacuccuccggcggcggcggccagcagaaguuccgcgucgacaugcccggcuccggcuccgccuucauccccaccaucaacgccaucaccaccucccaggaccuccaguggaugguccagcccaccgucaucaccuccauguccaaccccuacccccgcucccaccccuacuccccccuccccggccucgccuccguccccggccacauggcccucccccgccccggcgucaucaagaccaucggcaccaccgucggccgccgccgccgcgacgagcagcucucccccgaggaggaggagaagcgccgcauccgccgcgagcgcaacaagcucgccgccgccaagugccgcaaccgccgccgcgagcucaccgagaagcuccaggccgagaccgaggagcucgaggaggagaaguccggccuccagaaggagaucgccgagcuccagaaggagaaggagaagcucgaguucaugcucgucgcccacggccccgucugcaagaucucccccgaggagcgccgcuccccccccgcccccggccuccagcccaugcgcuccggcggcggcuccgucggcgccgucgucgucaagcaggagccccucgaggaggacucccccuccuccuccuccgccggccucgacaaggcccagcgcuccgucaucaagcccaucuccaucgccggcggcuucuacggcgaggagccccuccacacccccaucgucgucaccuccacccccgccgucacccccggcaccuccaaccucgucuucaccuaccccuccguccucgagcaggagucccccgccucccccuccgaguccugcuccaaggcccaccgccgcuccuccuccuccggcgaccaguccuccgacucccucaacucccccacccuccucgcccucuga

SEQ ID NO: 43304 - RNA, 1419 nt, Artificial Sequence
  derived and/or modified sequence opt2 from FOXA1__Homo_sapiens__NP_004487
augcucggcaccgucaagauggagggccacgagaccuccgacuggaacuccuacuacgccgacacccaggaggccuacuccuccguccccgucuccaacaugaacuccggccucggcuccaugaacuccaugaacaccuacaugaccaugaacaccaugaccaccuccggcaacaugacccccgccuccuucaacauguccuacgccaaccccggccucggcgccggccucucccccggcgccgucgccggcaugcccggcggcuccgccggcgccaugaacuccaugaccgccgccggcgucaccgccaugggcaccgcccucucccccuccggcaugggcgccaugggcgcccagcaggccgccuccaugaacggccucggccccuacgccgccgccaugaaccccugcaugucccccauggccuacgcccccuccaaccucggccgcucccgcgccggcggcggcggcgacgccaagaccuucaagcgcuccuacccccacgccaagccccccuacuccuacaucucccucaucaccauggccauccagcaggcccccuccaagaugcucacccucuccgagaucuaccaguggaucauggaccucuuccccuacuaccgccagaaccagcagcgcuggcagaacuccauccgccacucccucuccuucaacgacugcuucgucaaggucgcccgcucccccgacaagcccggcaagggcuccuacuggacccuccaccccgacuccggcaacauguucgagaacggcugcuaccuccgccgccagaagcgcuucaagugcgagaagcagcccggcgccggcggcggcggcggcuccggcuccggcggcuccggcgccaagggcggccccgagucccgcaaggaccccuccggcgccuccaaccccuccgccgacuccccccuccaccgcggcguccacggcaagaccggccagcucgagggcgcccccgcccccggccccgccgccuccccccagacccucgaccacuccggcgccaccgccaccggcggcgccuccgagcucaagacccccgccuccuccaccgccccccccaucuccuccggccccggcgcccucgccuccguccccgccucccaccccgcccacggccucgccccccacgagucccagcuccaccucaagggcgacccccacuacuccuucaaccaccccuucuccaucaacaaccucauguccuccuccgagcagcagcacaagcucgacuucaaggccuacgagcaggcccuccaguacucccccuacggcuccacccuccccgccucccucccccucggcuccgccuccgucaccacccgcucccccaucgagcccuccgcccucgagcccgccuacuaccagggcgucuacucccgccccguccucaacaccuccuga

SEQ ID NO: 43305 - RNA, 1392 nt, Artificial Sequence
  derived and/or modified sequence opt2 from FOXA2__Homo_sapiens__NP_068556
augcacuccgccuccuccaugcucggcgccgucaagauggagggccacgagcccuccgacugguccuccuacuacgccgagcccgagggcuacuccuccgucuccaacaugaacgccggccucggcaugaacggcaugaacaccuacauguccauguccgccgccgccaugggcuccggcuccggcaacauguccgccggcuccaugaacauguccuccuacgucggcgccggcaugucccccucccucgccggcaugucccccggcgccggcgccauggccggcaugggcggcuccgccggcgccgccggcgucgccggcaugggcccccaccucucccccucccucuccccccucggcggccaggccgccggcgccaugggcggccucgcccccuacgccaacaugaacuccaugucccccauguacggccaggccggccucucccgcgcccgcgaccccaagaccuaccgccgcuccuacacccacgccaagccccccuacuccuacaucucccucaucaccauggccauccagcagucccccaacaagaugcucacccucuccgagaucuaccaguggaucauggaccucuuccccuucuaccgccagaaccagcagcgcuggcagaacuccauccgccacucccucuccuucaacgacugcuuccucaaggucccccgcucccccgacaagcccggcaagggcuccuucuggacccuccaccccgacuccggcaacauguucgagaacggcugcuaccuccgccgccagaagcgcuucaagugcgagaagcagcucgcccucaaggaggccgccggcgccgccggcuccggcaagaaggccgccgccggcgcccaggccucccaggcccagcucggcgaggccgccggccccgccuccgagacccccgccggcaccgaguccccccacuccuccgccucccccugccaggagcacaagcgcggcggccucggcgagcucaagggcacccccgccgccgcccucuccccccccgagcccgcccccucccccggccagcagcagcaggccgccgcccaccuccucggccccccccaccaccccggccucccccccgaggcccaccucaagcccgagcaccacuacgccuucaaccaccccuucuccaucaacaaccucauguccuccgagcagcagcaccaccacucccaccaccaccaccagccccacaagauggaccucaaggccuacgagcaggucaugcacuaccccggcuacggcucccccaugcccggcucccucgccaugggccccgucaccaacaagaccggccucgacgccuccccccucgccgccgacaccuccuacuaccagggcgucuacucccgccccaucaugaacuccuccuga

SEQ ID NO: 43306 - RNA, 1053 nt, Artificial Sequence
  derived and/or modified sequence opt2 from FOXA3__Homo_sapiens__NP_004488
augcucggcuccgucaagauggaggcccacgaccucgccgagugguccuacuaccccgaggccggcgaggucuacucccccgucacccccguccccaccauggccccccucaacuccuacaugacccucaacccccucuccucccccuacccccccggcggccuccccgccuccccccuccccuccggcccccucgccccccccgcccccgccgccccccucggccccaccuuccccggccucggcgucuccggcggcuccuccuccuccggcuacggcgcccccggccccggccucguccacggcaaggagaugcccaagggcuaccgccgcccccucgcccacgccaagccccccuacuccuacaucucccucaucaccauggccauccagcaggcccccggcaagaugcucacccucuccgagaucuaccaguggaucauggaccucuuccccuacuaccgcgagaaccagcagcgcuggcagaacuccauccgccacucccucuccuucaacgacugcuucgucaaggucgcccgcucccccgacaagcccggcaagggcuccuacugggcccuccaccccuccuccggcaacauguucgagaacggcugcuaccuccgccgccagaagcgcuucaagcucgaggagaaggucaagaagggcggcuccggcgccgccaccaccacccgcaacggcaccggcuccgccgccuccaccaccacccccgccgccaccgucaccucccccccccagccccccccccccgcccccgagcccgaggcccagggcggcgaggacgucggcgcccucgacugcggcucccccgccuccuccacccccuacuucaccggccucgagcuccccggcgagcucaagcucgacgcccccuacaacuucaaccaccccuucuccaucaacaaccucauguccgagcagacccccgccccccccaagcucgacgucggcuucggcggcuacggcgccgagggcggcgagcccggcgucuacuaccagggccucuacucccgcucccuccucaacgccuccuga

SEQ ID NO: 43307 - RNA, 978 nt, Artificial Sequence
  derived and/or modified sequence opt2 from FOXB1__Homo_sapiens__NP_036314
augccccgccccggccgcaacaccuacuccgaccagaagccccccuacuccuacaucucccucaccgccauggccauccaguccucccccgagaagaugcucccccucuccgagaucuacaaguucaucauggaccgcuuccccuacuaccgcgagaacacccagcgcuggcagaacucccuccgccacaaccucuccuucaacgacugcuucaucaagaucccccgccgccccgaccagcccggcaagggcuccuucugggcccuccaccccuccugcggcgacauguucgagaacggcuccuuccuccgccgccgcaagcgcuucaagguccucaaguccgaccaccucgcccccuccaagcccgccgacgccgcccaguaccuccagcagcaggccaagcuccgccucuccgcccucgccgccuccggcacccaccucccccagaugcccgccgccgccuacaaccucggcggcgucgcccagcccuccggcuucaagcaccccuucgccaucgagaacaucaucgcccgcgaguacaagaugcccggcggccucgccuucuccgccaugcagcccguccccgccgccuacccccuccccaaccagcucaccaccaugggcuccucccucggcaccggcuggccccacgucuacggcuccgccggcaugaucgacuccgccacccccaucuccauggccuccggcgacuacuccgccuacggcgucccccucaagccccucugccacgccgccggccagacccuccccgccauccccguccccaucaagcccacccccgccgccguccccgcccuccccgcccuccccgcccccauccccacccuccucuccaacuccccccccucccucucccccaccuccucccagaccgccaccucccaguccucccccgccacccccuccgagacccucaccucccccgccuccgcccuccacuccgucgccguccacuga

SEQ ID NO: 43308 - RNA, 1662 nt, Artificial Sequence
  derived and/or modified sequence opt2 from FOXC1__Homo_sapiens__NP_001444
augcaggcccgcuacuccgucuccucccccaacucccucggcgucguccccuaccucggcggcgagcaguccuacuaccgcgccgccgccgccgccgccggcggcggcuacaccgccaugcccgcccccauguccgucuacucccaccccgcccacgccgagcaguaccccggcggcauggcccgcgccuacggccccuacaccccccagccccagcccaaggacauggucaagccccccuacuccuacaucgcccucaucaccauggccauccagaacgcccccgacaagaagaucacccucaacggcaucuaccaguucaucauggaccgcuuccccuucuaccgcgacaacaagcagggcuggcagaacuccauccgccacaaccucucccucaacgagugcuucgucaaggucccccgcgacgacaagaagcccggcaagggcuccuacuggacccucgaccccgacuccuacaacauguucgagaacggcuccuuccuccgccgccgccgccgcuucaagaagaaggacgccgucaaggacaaggaggagaaggaccgccuccaccucaaggagccccccccccccggccgccagcccccccccgccccccccgagcaggccgacggcaacgcccccggcccccagcccccccccguccgcauccaggacaucaagaccgagaacggcaccugccccucccccccccagccccucucccccgccgccgcccucggcuccggcuccgccgccgccguccccaagaucgagucccccgacuccuccuccuccucccucuccuccggcuccuccccccccggcucccuccccuccgcccgcccccucucccucgacggcgccgacuccgccccccccccccccgcccccuccgccccccccccccaccacucccagggcuucuccgucgacaacaucaugaccucccuccgcggcuccccccaguccgccgccgccgagcucuccuccggccuccucgccuccgccgccgccuccucccgcgccggcaucgcccccccccucgcccucggcgccuacucccccggccaguccucccucuacuccucccccugcucccagaccuccuccgccggcuccuccggcggcggcggcggcggcgccggcgccgccggcggcgccggcggcgccggcaccuaccacugcaaccuccaggccaugucccucuacgccgccggcgagcgcggcggccaccuccagggcgcccccggcggcgccggcggcuccgccgucgacgacccccuccccgacuacucccucccccccgucaccuccuccuccuccuccucccucucccacggcggcggcggcggcggcggcggcggcggccaggaggccggccaccaccccgccgcccaccagggccgccucaccuccugguaccucaaccaggccggcggcgaccucggccaccucgccuccgccgccgccgccgccgccgccgccggcuaccccggccagcagcagaacuuccacuccguccgcgagauguucgagucccagcgcaucggccucaacaacucccccgucaacggcaacuccuccugccagauggccuuccccuccucccagucccucuaccgcaccuccggcgccuucgucuacgacugcuccaaguucuga

SEQ ID NO: 43309 - RNA, 1506 nt, Artificial Sequence
  derived and/or modified sequence opt2 from FOXC2__Homo_sapiens__NP_005242
augcaggcccgcuacuccgucuccgaccccaacgcccucggcgucguccccuaccucuccgagcagaacuacuaccgcgccgccggcuccuacggcggcauggccucccccaugggcgucuacuccggccaccccgagcaguacuccgccggcaugggccgcuccuacgcccccuaccaccaccaccagcccgccgcccccaaggaccucgucaagccccccuacuccuacaucgcccucaucaccauggccauccagaacgcccccgagaagaagaucacccucaacggcaucuaccaguucaucauggaccgcuuccccuucuaccgcgagaacaagcagggcuggcagaacuccauccgccacaaccucucccucaacgagugcuucgucaaggucccccgcgacgacaagaagcccggcaagggcuccuacuggacccucgaccccgacuccuacaacauguucgagaacggcuccuuccuccgccgccgccgccgcuucaagaagaaggacgucuccaaggagaaggaggagcgcgcccaccucaaggagcccccccccgccgccuccaagggcgcccccgccaccccccaccucgccgacgcccccaaggaggccgagaagaaggucgucaucaaguccgaggccgccucccccgcccuccccgucaucaccaaggucgagacccucucccccgaguccgcccuccagggcuccccccgcuccgccgccuccacccccgccggcucccccgacggcucccuccccgagcaccacgccgccgcccccaacggccuccccggcuucuccgucgagaacaucaugacccuccgcaccuccccccccggcggcgagcucucccccggcgccggccgcgccggccucgucguccccccccucgcccuccccuacgccgccgccccccccgccgccuacggccagcccugcgcccagggccucgaggccggcgccgccggcggcuaccagugcuccaugcgcgccaugucccucuacaccggcgccgagcgccccgcccacaugugcgucccccccgcccucgacgaggcccucuccgaccaccccuccggccccaccuccccccucuccgcccucaaccucgccgccggccaggagggcgcccucgccgccaccggccaccaccaccagcaccacggccaccaccacccccaggcccccccccccccccccgccccccagccccagcccaccccccagcccggcgccgccgccgcccaggccgccuccugguaccucaaccacuccggcgaccucaaccaccuccccggccacaccuucgccgcccagcagcagaccuuccccaacguccgcgagauguucaacucccaccgccucggcaucgagaacuccacccucggcgagucccaggucuccggcaacgccuccugccagcuccccuaccgcuccacccccccccucuaccgccacgccgcccccuacuccuacgacugcaccaaguacuga

SEQ ID NO: 43310 - RNA, 1398 nt, Artificial Sequence
  derived and/or modified sequence opt2 from FOXD1__Homo_sapiens__NP_004463
augacccucuccaccgagauguccgacgccuccggccucgccgaggagaccgacaucgacgucgucggcgagggcgaggacgaggaggacgaggaggaggaggacgacgacgagggcggcggcggcggcccccgccucgccguccccgcccagcgccgccgccgccgccgcuccuacgccggcgaggacgagcucgaggaccucgaggaggaggaggacgacgacgacauccuccucgccccccccgccggcggcucccccgccccccccggccccgcccccgccgccggcgccggcgccggcggcggcggcggcggcggcggcgccggcggcggcggcuccgccggcuccggcgccaagaacccccucgucaagccccccuacuccuacaucgcccucaucaccauggccauccuccagucccccaagaagcgccucacccucuccgagaucugcgaguucaucuccggccgcuuccccuacuaccgcgagaaguuccccgccuggcagaacuccauccgccacaaccucucccucaacgacugcuucgucaagaucccccgcgagcccggcaaccccggcaagggcaacuacuggacccucgaccccgaguccgccgacauguucgacaacggcuccuuccuccgccgccgcaagcgcuucaagcgccagccccuccucccccccaacgccgccgccgccgagucccuccuccuccgcggcgccggcgccgccggcggcgccggcgaccccgccgccgccgccgcccucuucccccccgccccccccccccccccccacgccuacggcuacggccccuacggcugcggcuacggccuccagcucccccccuacgccccccccuccgcccucuucgccgccgccgccgccgccgccgccgccgccgccuuccacccccacuccccccccccccccccccccccccacggcgccgccgccgagcucgcccgcaccgccuucggcuaccgcccccacccccucggcgccgcccuccccggcccccuccccgccuccgccgccaaggccggcggccccggcgccuccgcccucgcccgcucccccuucuccaucgaguccaucaucggcggcucccucggccccgccgccgccgccgccgccgccgcccaggccgccgccgccgcccaggccucccccucccccucccccgucgccgccccccccgcccccggcuccuccggcggcggcugcgccgcccaggccgccgucggccccgccgccgcccucacccgcucccucgucgccgccgccgccgccgccgccuccuccgucuccuccuccgccgcccucggcacccuccaccagggcaccgcccucuccuccgucgagaacuucaccgcccgcaucuccaacugcuga

SEQ ID NO: 43311 - RNA, 1122 nt, Artificial Sequence
  derived and/or modified sequence opt2 from FOXE1__Homo_sapiens__NP_004464
augaccgccgaguccggccccccccccccccagcccgagguccucgccaccgucaaggaggagcgcggcgagaccgccgccggcgccggcguccccggcgaggccaccggccgcggcgccggcggccgccgccgcaagcgcccccuccagcgcggcaagccccccuacuccuacaucgcccucaucgccauggccaucgcccacgcccccgagcgccgccucacccucggcggcaucuacaaguucaucaccgagcgcuuccccuucuaccgcgacaaccccaagaaguggcagaacuccauccgccacaaccucacccucaacgacugcuuccucaagaucccccgcgaggccggccgccccggcaagggcaacuacugggcccucgaccccaacgccgaggacauguucgaguccggcuccuuccuccgccgccgcaagcgcuucaagcgcuccgaccucuccaccuaccccgccuacaugcacgacgccgccgccgccgccgccgccgccgccgccgccgccgccgccgccgccaucuuccccggcgccguccccgccgcccgcccccccuaccccggcgccgucuacgccggcuacgccccccccucccucgccgcccccccccccgucuacuaccccgccgccucccccggccccugccgcgucuucggccucguccccgagcgcccccucucccccgagcucggccccgcccccuccggccccggcggcuccugcgccuucgccuccgccggcgcccccgccaccaccaccggcuaccagcccgccggcugcaccggcgcccgccccgccaaccccuccgccuacgccgccgccuacgccggccccgacggcgccuacccccagggcgccggcuccgccaucuucgccgccgccggccgccucgccggccccgccuccccccccgccggcggcuccuccggcggcgucgagaccaccgucgacuucuacggccgcaccucccccggccaguucggcgcccucggcgccugcuacaaccccggcggccagcucggcggcgccuccgccggcgccuaccacgcccgccacgccgccgccuaccccggcggcaucgaccgcuucgucuccgccauguga

SEQ ID NO: 43312 - RNA, 1140 nt, Artificial Sequence
  derived and/or modified sequence opt2 from FOXF1__Homo_sapiens__NP_001442
auguccuccgcccccgagaagcagcagcccccccacggcggcggcggcggcggcggcggcggcggcggcgccgccauggaccccgccuccuccggccccuccaaggccaagaagaccaacgccggcauccgccgccccgagaagccccccuacuccuacaucgcccucaucgucauggccauccaguccucccccaccaagcgccucacccucuccgagaucuaccaguuccuccagucccgcuuccccuucuuccgcggcuccuaccagggcuggaagaacuccguccgccacaaccucucccucaacgagugcuucaucaagcuccccaagggccucggccgccccggcaagggccacuacuggaccaucgaccccgccuccgaguucauguucgaggagggcuccuuccgccgccgcccccgcggcuuccgccgcaagugccaggcccucaagcccauguacuccaugaugaacggccucggcuucaaccaccuccccgacaccuacggcuuccagggcuccgccggcggccucuccugcccccccaacucccucgcccucgagggcggccucggcaugaugaacggccaccuccccggcaacgucgacggcauggcccuccccucccacuccgucccccaccuccccuccaacggcggccacuccuacaugggcggcugcggcggcgccgccgccggcgaguacccccaccacgacuccuccguccccgccuccccccuccuccccaccggcgccggcggcgucauggagccccacgccgucuacuccggcuccgccgccgccuggccccccuccgccuccgccgcccucaacuccggcgccuccuacaucaagcagcagccccucucccccugcaaccccgccgccaacccccucuccggcucccucuccacccacucccucgagcagcccuaccuccaccagaacucccacaacgcccccgccgagcuccagggcaucccccgcuaccacucccagucccccuccaugugcgaccgcaaggaguucgucuucuccuucaacgccauggccuccuccuccaugcacuccgccggcggcggcuccuacuaccaccagcaggucaccuaccaggacaucaagcccugcgucauguga

SEQ ID NO: 43313 - RNA, 1335 nt, Artificial Sequence
  derived and/or modified sequence opt2 from FOXF2__Homo_sapiens__NP_001443
augaccaccgagggcggccccccccccgccccccuccgccgcgccugcucccccguccccggcgcccuccaggccgcccucaugucccccccccccgccgccgccgccgccgccgccgccgcccccgagaccaccuccuccuccuccuccuccuccuccgccuccugcgccuccuccuccuccuccuccaacuccgccuccgcccccuccgccgccugcaaguccgccggcggcggcggcgccggcgccggcuccggcggcgccaagaaggccuccuccggccuccgccgccccgagaagccccccuacuccuacaucgcccucaucgucauggccauccaguccucccccuccaagcgccucacccucuccgagaucuaccaguuccuccaggcccgcuuccccuucuuccgcggcgccuaccagggcuggaagaacuccguccgccacaaccucucccucaacgagugcuucaucaagcuccccaagggccucggccgccccggcaagggccacuacuggaccaucgaccccgccuccgaguucauguucgaggagggcuccuuccgccgccgcccccgcggcuuccgccgcaagugccaggcccucaagcccauguaccaccgcgucgucuccggccucggcuucggcgccucccuccucccccagggcuucgacuuccaggccccccccuccgccccccucggcugccacucccagggcggcuacggcggccucgacaugaugcccgccggcuacgacgccggcgccggcgcccccucccacgcccacccccaccaccaccaccaccaccacgucccccacaugucccccaaccccggcuccaccuacauggccuccugccccguccccgccggccccggcggcgucggcgccgccggcggcggcggcggcggcgacuacggccccgacuccuccuccucccccguccccuccucccccgccauggccuccgccaucgagugccacucccccuacaccucccccgccgcccacugguccucccccggcgccucccccuaccucaagcagccccccgcccucacccccuccuccaaccccgccgccuccgccggccuccacuccuccauguccuccuacucccucgagcaguccuaccuccaccagaacgcccgcgaggaccucuccgucggccucccccgcuaccagcaccacuccacccccgucugcgaccgcaaggacuucguccucaacuucaacggcaucuccuccuuccaccccuccgccuccggcuccuacuaccaccaccaccaccaguccgucugccaggacaucaagcccugcgucauguga

SEQ ID NO: 43314 - RNA, 1470 nt, Artificial Sequence
  derived and/or modified sequence opt2 from FOXG1__Homo_sapiens__NP_005240
augcucgacaugggcgaccgcaaggaggucaagaugauccccaaguccuccuucuccaucaacucccucguccccgaggccguccagaacgacaaccaccacgccucccacggccaccacaacucccaccacccccagcaccaccaccaccaccaccaccaccaccaccacccccccccccccgccccccagccccccccccccccccagcagcagcagcccccccccccccccccccccgccccccagcccccccagacccgcggcgcccccgccgccgacgacgacaagggcccccagcagcuccuccucccccccccccccccccccccccccgccgccgcccucgacggcgccaaggccgacggccucggcggcaagggcgagcccggcggcggccccggcgagcucgcccccgucggccccgacgagaaggagaagggcgccggcgccggcggcgaggagaagaagggcgccggcgagggcggcaaggacggcgagggcggcaaggagggcgagaagaagaacggcaaguacgagaagccccccuucuccuacaacgcccucaucaugauggccauccgccagucccccgagaagcgccucacccucaacggcaucuacgaguucaucaugaagaacuuccccuacuaccgcgagaacaagcagggcuggcagaacuccauccgccacaaccucucccucaacaagugcuucgucaaggucccccgccacuacgacgaccccggcaagggcaacuacuggaugcucgaccccuccuccgacgacgucuucaucggcggcaccaccggcaagcuccgccgccgcuccaccaccucccgcgccaagcucgccuucaagcgcggcgcccgccucaccuccaccggccucaccuucauggaccgcgccggcucccucuacuggcccaugucccccuuccucucccuccaccacccccgcgccuccuccacccucuccuacaacggcaccaccuccgccuaccccucccaccccaugcccuacuccuccguccucacccagaacucccucggcaacaaccacuccuucuccaccgccaacggccucuccgucgaccgccucgucaacggcgagauccccuacgccacccaccaccucaccgccgccgcccucgccgccuccguccccugcggccucuccguccccugcuccggcaccuacucccucaaccccugcuccgucaaccuccucgccggccagaccuccuacuucuucccccacgucccccaccccuccaugaccucccaguccuccaccuccauguccgcccgcgccgccuccuccuccaccuccccccaggcccccuccacccuccccugcgagucccuccgccccucccuccccuccuucaccaccggccucuccggcggccucuccgacuacuucacccaccagaaccagggcuccuccuccaacccccucauccacuga

SEQ ID NO: 43315 - RNA, 1098 nt, Artificial Sequence
  derived and/or modified sequence opt2 from FOXH1__Homo_sapiens__NP_003914
augggccccugcuccggcucccgccucggcccccccgaggccgagucccccucccagccccccaagcgccgcaagaagcgcuaccuccgccacgacaagccccccuacaccuaccucgccaugaucgcccucgucauccaggccgcccccucccgccgccucaagcucgcccagaucauccgccagguccaggccgucuuccccuucuuccgcgaggacuacgagggcuggaaggacuccauccgccacaaccucuccuccaaccgcugcuuccgcaagguccccaaggaccccgccaagccccaggccaagggcaacuucugggccgucgacgucucccucauccccgccgaggcccuccgccuccagaacaccgcccucugccgccgcuggcagaacggcggcgcccgcggcgccuucgccaaggaccucggccccuacguccuccacggccgccccuaccgcccccccucccccccccccccccccuccgagggcuucuccaucaagucccuccucggcggcuccggcgagggcgcccccuggcccggccucgccccccaguccucccccguccccgccggcaccggcaacuccggcgaggaggccguccccacccccccccuccccuccuccgagcgcccccucuggccccucugcccccuccccggccccacccgcgucgagggcgagaccguccagggcggcgccaucggccccuccacccucucccccgagccccgcgccuggccccuccaccuccuccagggcaccgccguccccggcggccgcuccuccggcggccaccgcgccucccucuggggccagcuccccaccuccuaccuccccaucuacacccccaacgucgucaugccccucgcccccccccccaccuccugcccccagugccccuccaccucccccgccuacuggggcgucgcccccgagacccgcggcccccccggccuccucugcgaccucgacgcccucuuccagggcgucccccccaacaaguccaucuacgacgucugggucucccacccccgcgaccucgccgcccccggccccggcuggcuccucuccuggugcucccucuga

SEQ ID NO: 43316 - RNA, 1137 nt, Artificial Sequence
  derived and/or modified sequence opt2 from FOXI1__Homo_sapiens__NP_036320
auguccuccuucgaccuccccgcccccucccccccccgcugcuccccccaguuccccuccaucggccaggagccccccgagaugaaccucuacuacgagaacuucuuccacccccagggcguccccuccccccagcgccccuccuucgagggcggcggcgaguacggcgccacccccaaccccuaccucugguucaacggccccaccaugacccccccccccuaccuccccggccccaacgccucccccuuccucccccaggccuacggcguccagcgcccccuccuccccuccgucuccggccucggcggcuccgaccucggcuggcuccccauccccucccaggaggagcucaugaagcucguccgcccccccuacuccuacuccgcccucaucgccauggccauccacggcgcccccgacaagcgccucacccucucccagaucuaccaguacgucgccgacaacuuccccuucuacaacaaguccaaggccggcuggcagaacuccauccgccacaaccucucccucaacgacugcuucaagaaggucccccgcgacgaggacgaccccggcaagggcaacuacuggacccucgaccccaacugcgagaagauguucgacaacggcaacuuccgccgcaagcgcaagcgcaaguccgacgucuccuccuccaccgccucccucgcccucgagaagaccgaguccucccuccccgucgacucccccaagaccaccgagccccaggacauccucgacggcgccucccccggcggcaccaccuccucccccgagaagcgccccucccccccccccuccggcgcccccugccucaacuccuuccucuccuccaugaccgccuacgucuccggcggcucccccaccucccacccccucgucacccccggccucucccccgagcccuccgacaagaccggccagaacucccucaccuucaacuccuucuccccccucaccaaccucuccaaccacuccggcggcggcgacugggccaaccccaugcccaccaacaugcucuccuacggcggcuccguccucucccaguucuccccccacuucuacaacuccgucaacaccuccggcguccucuacccccgcgagggcaccgaggucuga

SEQ ID NO: 43317 - RNA, 1266 nt, Artificial Sequence
  derived and/or modified sequence opt2 from FOXJ1__Homo_sapiens__NP_001445
auggccgaguccuggcuccgccucuccggcgccggccccgccgaggaggccggccccgagggcggccucgaggagcccgacgcccucgacgacucccucaccucccuccaguggcuccaggaguucuccauccucaacgccaaggcccccgcccucccccccggcggcaccgacccccacggcuaccaccagguccccggcuccgccgcccccggcuccccccucgccgccgaccccgccugccucggccagccccacacccccggcaagcccaccuccuccugcaccucccgcuccgccccccccggccuccaggcccccccccccgacgacgucgacuacgccaccaacccccacgucaagccccccuacuccuacgccacccucaucugcauggccaugcaggccuccaaggccaccaagaucacccucuccgccaucuacaaguggaucaccgacaacuucugcuacuuccgccacgccgaccccaccuggcagaacuccauccgccacaaccucucccucaacaagugcuucaucaaggucccccgcgagaaggacgagcccggcaagggcggcuucuggcgcaucgacccccaguacgccgagcgccuccucuccggcgccuucaagaagcgccgccucccccccguccacauccaccccgccuucgcccgccaggccgcccaggagcccuccgccgucccccgcgccggcccccucaccgucaacaccgaggcccagcagcuccuccgcgaguucgaggaggccaccggcgaggccggcuggggcgccggcgagggccgccucggccacaagcgcaagcagccccuccccaagcgcgucgccaaggucccccgcccccccuccacccuccuccccacccccgaggagcagggcgagcucgagccccucaagggcaacuucgacugggaggccaucuucgacgccggcacccucggcggcgagcucggcgcccucgaggcccucgagcucucccccccccucucccccgccucccacgucgacgucgaccucaccauccacggccgccacaucgacugccccgccaccuggggccccuccgucgagcaggccgccgacucccucgacuucgacgagaccuuccucgccaccuccuuccuccagcaccccugggacgaguccggcuccggcugccucccccccgagccccucuucgaggccggcgacgccacccucgccuccgaccuccaggacugggccuccgucggcgccuuccucuga

SEQ ID NO: 43318 - RNA, 1725 nt, Artificial Sequence
  derived and/or modified sequence opt2 from FOXJ2__Homo_sapiens__NP_060886
auggccuccgaccucgaguccucccucaccuccaucgacuggcucccccagcucacccuccgcgccaccaucgagaagcucggcuccgccucccaggccggcccccccggcuccucccgcaagugcucccccggcucccccaccgaccccaacgccacccucuccaaggacgaggccgccguccaccaggacggcaagccccgcuacuccuacgccacccucaucaccuacgccaucaacuccucccccgccaagaagaugacccucuccgagaucuaccgcuggaucugcgacaacuuccccuacuacaagaacgccggcaucggcuggaagaacuccauccgccacaaccucucccucaacaagugcuuccgcaaggucccccgcccccgcgacgaccccggcaagggcuccuacuggaccaucgacaccugccccgacaucucccgcaagcgccgccacccccccgacgacgaccucucccaggacucccccgagcaggaggccuccaaguccccccgcggcggcgucgccggcuccggcgaggccucccucccccccgagggcaacccccagaugucccuccagucccccaccuccaucgccuccuacucccagggcaccggcuccgucgacggcggcgccgucgccgccggcgccuccggccgcgaguccgccgagggcccccccccccucuacaacaccaaccacgacuucaaguucuccuacuccgagaucaacuuccaggaccucuccugguccuuccgcaaccucuacaaguccaugcucgagaaguccuccuccuccucccagcacggcuucuccucccuccucggcgacaucccccccuccaacaacuacuacauguaccagcagcagcagcccccccccccccagcagcagcagcagcagcagcagcccccccagccccccccccagcagucccagccccagcagcagcaggcccccgcccagggccccuccgccgucggcggcgcccccccccuccacacccccuccaccgacggcugcaccccccccggcggcaagcaggccggcgccgagggcuacggccccccccccgucauggccaugcacccccccccccuccagcacggcggcuaccacccccaccagcaccacccccacucccaccccgcccagcagcccccccccccccagccccaggcccagggccaggcccccaucaacaacaccggcuucgccuuccccuccgacuggugcuccaacaucgacucccucaaggaguccuucaagauggucaaccgccucaacugguccuccaucgagcagucccaguucuccgagcucauggagucccuccgccaggccgagcagaagaacuggacccucgaccagcaccacaucgccaaccucugcgacucccucaaccacuuccucacccagaccggccacguccccccccagggcggcacccaccgcccccccgcccccgcccgcaucgccgacuccugcgcccucaccuccggcaagcaggaguccgccaugucccaggucaacuccuacggccacccccaggccccccaccucuaccccggccccucccccauguaccccauccccacccaggacuccgccggcuacaaccgccccgcccaccacauggucccccgccccuccguccccccccccggcgccaacgaggagauccccgacgacuucgacugggaccucaucaccuga

SEQ ID NO: 43319 - RNA, 2202 nt, Artificial Sequence
  derived and/or modified sequence opt2 from FOXK1__Homo_sapiens__NP_001032242
auggccgaggucggcgaggacuccggcgcccgcgcccuccucgcccuccgcuccgcccccugcucccccguccucugcgccgccgccgccgccgccgccuuccccgccgccgcccccccccccgcccccgcccagccccagcccccccccggccccccccccccccccccccccccccucccccccggcgccaucgccggcgccggcuccuccggcggcuccuccggcgucuccggcgacuccgccgucgccggcgccgcccccgcccucgucgccgccgccgccgccuccguccgccagucccccggccccgcccucgcccgccucgagggccgcgaguucgaguuccucaugcgccagcccuccgucaccaucggccgcaacuccucccagggcuccgucgaccucuccaugggccucuccuccuucaucucccgccgccaccuccagcucuccuuccaggagccccacuucuaccuccgcugccucggcaagaacggcgucuucgucgacggcgccuuccagcgccgcggcgcccccgcccuccagcuccccaagcagugcaccuuccgcuuccccuccaccgccaucaagauccaguucaccucccucuaccacaaggaggaggcccccgccuccccccuccgcccccucuacccccagaucuccccccucaagauccacauccccgagcccgaccuccgcuccauggucucccccguccccucccccaccggcaccaucuccguccccaacuccugccccgccuccccccgcggcgccggcuccuccuccuaccgcuucguccagaacgucaccuccgaccuccagcucgccgccgaguucgccgccaaggccgccuccgagcagcaggccgacaccuccggcggcgacucccccaaggacgaguccaagccccccuucuccuacgcccagcucaucguccaggccaucuccuccgcccaggaccgccagcucacccucuccggcaucuacgcccacaucaccaagcacuaccccuacuaccgcaccgccgacaagggcuggcagaacuccauccgccacaaccucucccucaaccgcuacuucaucaaggucccccgcucccaggaggagcccggcaagggcuccuucuggcgcaucgaccccgccuccgaggccaagcucgucgagcaggccuuccgcaagcgccgccagcgcggcgucuccugcuuccgcacccccuucggcccccucuccucccgcuccgcccccgccucccccacccaccccggccucauguccccccgcuccggcggccuccagacccccgagugccucucccgcgagggcucccccaucccccacgaccccgaguucggcuccaagcucgccuccguccccgaguaccgcuacucccaguccgcccccggcucccccgucuccgcccagcccgucaucauggccguccccccccgccccuccucccucgucgccaagcccgucgccuacaugcccgccuccaucgucaccucccagcagcccgccggccacgccauccacgucguccagcaggcccccaccgucaccaugguccgcgucgucaccaccuccgccaacuccgccaacggcuacauccucaccucccagggcgccgccggcggcucccacgacgccgccggcgccgccguccucgaccucggcuccgaggcccgcggccucgaggagaagcccaccaucgccuucgccaccauccccgccgccggcggcgucauccagaccgucgccucccagauggcccccggcguccccggccacaccgucaccauccuccagcccgccacccccgucacccucggccagcaccaccuccccguccgcgccgucacccagaacggcaagcacgccguccccaccaacucccucgccggcaacgccuacgcccucaccuccccccuccagcuccucgccacccaggccuccuccuccgcccccgucgucgucacccgcgucugcgaggucggccccaaggagcccgccgccgccgucgccgccaccgccaccaccacccccgccaccgccaccaccgccuccgccuccgccuccuccaccggcgagcccgaggucaagcgcucccgcgucgaggagcccuccggcgccgucaccacccccgccggcgucaucgccgccgccggcccccagggccccggcaccggcgaguga

SEQ ID NO: 43320 - RNA, 1983 nt, Artificial Sequence
  derived and/or modified sequence opt2 from FOXK2__Homo_sapiens__NP_004505
auggccgccgccgccgccgcccucuccggcgccggcaccccccccgccggcggcggcgccggcggcggcggcgccggcggcggcggcuccccccccggcggcugggccgucgcccgccucgagggccgcgaguucgaguaccucaugaagaagcgcuccgucaccaucggccgcaacuccucccagggcuccgucgacgucuccaugggccacuccuccuucaucucccgccgccaccucgagaucuucaccccccccggcggcggcggccacggcggcgccgcccccgagcucccccccgcccagccccgccccgacgccggcggcgacuucuaccuccgcugccucggcaagaacggcgucuucgucgacggcgucuuccagcgccgcggcgcccccccccuccagcucccccgcgucugcaccuuccgcuuccccuccaccaacaucaagaucaccuucaccgcccucuccuccgagaagcgcgagaagcaggaggccuccgagucccccgucaaggccguccagccccacaucuccccccucaccaucaacauccccgacaccauggcccaccucaucuccccccuccccucccccaccggcaccaucuccgccgccaacuccugccccuccuccccccgcggcgccggcuccuccggcuacaaggucggccgcgucaugcccuccgaccucaaccucauggccgacaacucccagcccgagaacgagaaggaggccuccggcggcgacucccccaaggacgacuccaagccccccuacuccuacgcccagcucaucguccaggccaucaccauggcccccgacaagcagcucacccucaacggcaucuacacccacaucaccaagaacuaccccuacuaccgcaccgccgacaagggcuggcagaacuccauccgccacaaccucucccucaaccgcuacuucaucaaggucccccgcucccaggaggagcccggcaagggcuccuucuggcgcaucgaccccgccuccgaguccaagcucaucgagcaggccuuccgcaagcgccgcccccgcggcguccccugcuuccgcaccccccucggcccccucuccucccgcuccgcccccgccucccccaaccacgccggcguccucuccgcccacuccuccggcgcccagacccccgagucccucucccgcgagggcucccccgccccccucgagcccgagcccggcgccgcccagcccaagcucgccgucauccaggaggcccgcuucgcccaguccgcccccggcuccccccucuccucccagcccguccucaucaccguccagcgccagcucccccaggccaucaagcccgucaccuacaccgucgccacccccgucaccaccuccaccucccagccccccgucguccagaccguccacgucguccaccagauccccgccgucuccgucaccuccgucgccggccucgcccccgccaacaccuacaccgucuccggccaggccgucgucacccccgccgccguccucgccccccccaaggccgaggcccaggagaacggcgaccaccgcgaggucaaggucaaggucgagcccauccccgccaucggccacgccacccucggcaccgccucccgcaucauccagaccgcccagaccacccccguccagaccgucaccaucguccagcaggccccccucggccagcaccagcuccccaucaagaccgucacccagaacggcacccacgucgccuccguccccaccgccguccacggccaggucaacaacgccgccgccuccccccuccacaugcucgccacccacgccuccgccuccgccucccuccccaccaagcgccacaacggcgaccagcccgagcagcccgagcucaagcgcaucaagaccgaggacggcgagggcaucgucaucgcccucuccgucgacaccccccccgccgccguccgcgagaagggcguccagaacuga

SEQ ID NO: 43321 - RNA, 1038 nt, Artificial Sequence
  derived and/or modified sequence opt2 from FOXL1__Homo_sapiens__NP_005241
augucccaccucuucgacccccgccuccccgcccucgccgccucccccaugcucuaccucuacggccccgagcgccccggccucccccucgccuucgcccccgccgccgcccucgccgccuccggccgcgccgagaccccccagaagccccccuacuccuacaucgcccucaucgccauggccauccaggacgcccccgagcagcgcgucacccucaacggcaucuaccaguucaucauggaccgcuuccccuucuaccacgacaaccgccagggcuggcagaacuccauccgccacaaccucucccucaacgacugcuucgucaaggucccccgcgagaagggccgccccggcaagggcuccuacuggacccucgacccccgcugccucgacauguucgagaacggcaacuaccgccgccgcaagcgcaagcccaagcccggccccggcgcccccgaggccaagcgcccccgcgccgagacccaccagcgcuccgccgaggcccagcccgaggccggcuccggcgccggcggcuccggccccgccaucucccgccuccaggccgcccccgccggccccuccccccuccucgacggccccuccccccccgccccccuccacuggcccggcaccgccucccccaacgaggacgccggcgacgccgcccagggcgccgccgccgucgccgucggccaggccgcccgcaccggcgacggccccggcuccccccuccgccccgccucccgcuccucccccaaguccuccgacaaguccaaguccuucuccaucgacuccauccucgccggcaagcagggccagaagccccccuccggcgacgagcuccucggcggcgccaagcccggccccggcggccgccucggcgccucccuccucgccgccuccuccucccuccgcccccccuucaacgccucccucaugcucgacccccacguccagggcggcuucuaccagcucggcauccccuuccucuccuacuucccccuccagguccccgacaccguccuccacuuccaguga

SEQ ID NO: 43322 - RNA, 1131 nt, Artificial Sequence
  derived and/or modified sequence opt2 from FOXL2__Homo_sapiens__NP_075555
augauggccuccuaccccgagcccgaggacgccgccggcgcccuccucgcccccgagaccggccgcaccgucaaggagcccgagggccccccccccucccccggcaagggcggcggcggcggcggcggcaccgcccccgagaagcccgaccccgcccagaagccccccuacuccuacgucgcccucaucgccauggccauccgcgaguccgccgagaagcgccucacccucuccggcaucuaccaguacaucaucgccaaguuccccuucuacgagaagaacaagaagggcuggcagaacuccauccgccacaaccucucccucaacgagugcuucaucaaggucccccgcgagggcggcggcgagcgcaagggcaacuacuggacccucgaccccgccugcgaggacauguucgagaagggcaacuaccgccgccgccgccgcaugaagcgccccuuccgccccccccccgcccacuuccagcccggcaagggccucuucggcgccggcggcgccgccggcggcugcggcgucgccggcgccggcgccgacggcuacggcuaccucgccccccccaaguaccuccaguccggcuuccucaacaacuccuggccccucccccagccccccucccccaugcccuacgccuccugccagauggccgccgccgccgccgccgccgccgccgccgccgccgccgccggccccggcucccccggcgccgccgccgucgucaagggccucgccggccccgccgccuccuacggccccuacacccgcguccaguccauggcccucccccccggcgucgucaacuccuacaacggccucggcggcccccccgccgccccccccccccccccccacccccacccccacccccacgcccaccaccuccacgccgccgccgcccccccccccgcccccccccaccacggcgccgccgcccccccccccggccagcucucccccgccucccccgccaccgccgccccccccgcccccgcccccaccuccgcccccggccuccaguucgccugcgcccgccagcccgagcucgccaugaugcacugcuccuacugggaccacgacuccaagaccggcgcccuccacucccgccucgaccucuga

SEQ ID NO: 43323 - RNA, 2292 nt, Artificial Sequence
  derived and/or modified sequence opt2 from FOXM1__Homo_sapiens__NP_068772
augaagaccuccccccgccgcccccucauccucaagcgccgccgccucccccuccccguccagaacgcccccuccgagaccuccgaggaggagcccaagcgcucccccgcccagcaggaguccaaccaggccgaggccuccaaggaggucgccgaguccaacuccugcaaguuccccgccggcaucaagaucaucaaccaccccaccaugcccaacacccaggucgucgccauccccaacaacgccaacauccacuccaucaucaccgcccucaccgccaagggcaaggaguccggcuccuccggccccaacaaguucauccucaucuccugcggcggcgcccccacccagccccccggccuccgcccccagacccagaccuccuacgacgccaagcgcaccgaggucacccucgagacccucggccccaagcccgccgcccgcgacgucaaccucccccgcccccccggcgcccucugcgagcagaagcgcgagaccugcgccgacggcgaggccgccggcugcaccaucaacaacucccucuccaacauccaguggcuccgcaagauguccuccgacggccucggcucccgcuccaucaagcaggagauggaggagaaggagaacugccaccucgagcagcgccaggucaaggucgaggagcccucccgccccuccgccuccuggcagaacuccgucuccgagcgcccccccuacuccuacauggccaugauccaguucgccaucaacuccaccgagcgcaagcgcaugacccucaaggacaucuacaccuggaucgaggaccacuuccccuacuucaagcacaucgccaagcccggcuggaagaacuccauccgccacaaccucucccuccacgacauguucguccgcgagaccuccgccaacggcaaggucuccuucuggaccauccaccccuccgccaaccgcuaccucacccucgaccaggucuucaagccccucgaccccggcuccccccagcuccccgagcaccucgagucccagcagaagcgccccaaccccgagcuccgccgcaacaugaccaucaagaccgagcucccccucggcgcccgccgcaagaugaagccccuccucccccgcgucuccuccuaccucguccccauccaguuccccgucaaccagucccucguccuccagcccuccgucaaggucccccucccccucgccgccucccucauguccuccgagcucgcccgccacuccaagcgcguccgcaucgcccccaagguccuccucgccgaggagggcaucgccccccucuccuccgccggccccggcaaggaggagaagcuccucuucggcgagggcuucuccccccuccuccccguccagaccaucaaggaggaggagauccagcccggcgaggagaugccccaccucgcccgccccaucaaggucgagucccccccccucgaggaguggcccucccccgcccccuccuucaaggaggaguccucccacuccugggaggacuccucccagucccccaccccccgccccaagaaguccuacuccggccuccgcucccccacccgcugcgucuccgagaugcucgucauccagcaccgcgagcgccgcgagcgcucccgcucccgccgcaagcagcaccuccucccccccugcgucgacgagcccgagcuccucuucuccgagggccccuccaccucccgcugggccgccgagcuccccuuccccgccgacuccuccgaccccgccucccagcucuccuacucccaggaggucggcggccccuucaagacccccaucaaggagacccuccccaucuccuccacccccuccaaguccguccucccccgcacccccgaguccuggcgccucaccccccccgccaaggucggcggccucgacuucucccccguccagaccucccagggcgccuccgacccccuccccgacccccucggccucauggaccucuccaccaccccccuccaguccgcccccccccucgaguccccccagcgccuccucuccuccgagccccucgaccucaucuccguccccuucggcaacuccucccccuccgacaucgacguccccaagcccggcucccccgagccccaggucuccggccucgccgccaaccgcucccucaccgagggccucguccucgacaccaugaacgacucccucuccaagauccuccucgacaucuccuuccccggccucgacgaggacccccucggccccgacaacaucaacuggucccaguucauccccgagcuccaguga

SEQ ID NO: 43324 - RNA, 1947 nt, Artificial Sequence
  derived and/or modified sequence opt2 from FOXN1__Homo_sapiens__XP_005258103
auggucucccucccccccccccaguccgacgucacccuccccggccccacccgccucgagggcgagcgccagggcgaccucaugcaggcccccggccuccccggcucccccgccccccaguccaagcacgccggcuucuccugcuccuccuucgucuccgacggcccccccgagcgcacccccucccuccccccccacuccccccgcaucgccucccccggccccgagcagguccagggccacugccccgccggccccggccccggccccuuccgccucucccccuccgacaaguaccccggcuucggcuucgaggaggccgccgccuccucccccggccgcuuccucaagggcucccacgcccccuuccaccccuacaagcgccccuuccacgaggacgucuuccccgaggccgagaccacccucgcccucaagggccacuccuucaagacccccggcccccucgaggccuucgaggagauccccgucgacgucgccgaggccgaggccuuccuccccggcuucuccgccgaggccuggugcaacggccuccccuaccccucccaggagcacggcccccagguccucggcuccgaggucaaggucaagccccccguccucgaguccggcgccggcauguucugcuaccagcccccccuccagcacauguacugcuccucccagccccccuuccaccaguacucccccggcggcggcuccuaccccauccccuaccucggcuccucccacuaccaguaccagcgcauggccccccaggccuccaccgacggccaccagccccucuuccccaagcccaucuacuccuacuccauccucaucuucauggcccucaagaacuccaagaccggcucccuccccgucuccgagaucuacaacuucaugaccgagcacuuccccuacuucaagaccgcccccgacggcuggaagaacuccguccgccacaaccucucccucaacaagugcuucgagaaggucgagaacaaguccggcuccuccucccgcaagggcugccucugggcccucaaccccgccaagaucgacaagaugcaggaggagcuccagaaguggaagcgcaaggaccccaucgccguccgcaaguccauggccaagcccgaggagcucgacucccucaucggcgacaagcgcgagaagcucggcuccccccuccucggcugccccccccccggccucuccggcuccggccccauccgcccccucgccccccccgccggccucucccccccccuccacucccuccaccccgcccccggccccauccccggcaagaacccccuccaggaccuccucaugggccacacccccuccugcuacggccagaccuaccuccaccucucccccggccucgccccccccggccccccccagccccucuucccccagcccgacggccaccucgagcuccgcgcccagcccggcaccccccaggacuccccccuccccgcccacaccccccccucccacuccgccaagcuccucgccgagcccucccccgcccgcaccaugcacgacacccuccuccccgacggcgaccucggcaccgaccucgacgccaucaaccccucccucaccgacuucgacuuccagggcaaccucugggagcagcucaaggacgacucccucgcccucgacccccucguccucgucaccuccucccccaccuccuccuccaugccccccccccagccccccccccacugcuucccccccggccccugccucaccgagaccggcuccggcgccggcgaccucgccgcccccggcuccggcggcuccggcgcccucggcgaccuccaccucaccacccucuacuccgccuucauggagcucgagcccaccccccccaccgcccccgccggccccuccgucuaccucucccccuccuccaagcccgucgcccucgccuga

SEQ ID NO: 43325 - RNA, 1296 nt, Artificial Sequence
  derived and/or modified sequence opt2 from FOXN2__Homo_sapiens__NP_002149
augggccccgucaucggcaugacccccgacaagcgcgccgagacccccggcgccgagaagaucgccggccucucccagaucuacaagaugggcucccuccccgaggccgucgacgccgcccgccccaaggccacccucgucgacuccgaguccgccgacgacgagcucaccaaccucaacuggcuccacgaguccaccaaccuccucaccaacuucucccucggcuccgagggccuccccaucgucuccccccucuacgacaucgagggcgacgacguccccuccuucggccccgccugcuaccagaaccccgagaagaaguccgccaccuccaagccccccuacuccuucucccuccucaucuacauggccaucgagcacucccccaacaagugccuccccgucaaggagaucuacuccuggauccucgaccacuuccccuacuucgccaccgcccccaccggcuggaagaacuccguccgccacaaccucucccucaacaagugcuuccagaaggucgagcgcucccacggcaaggucaacggcaagggcucccucuggugcgucgaccccgaguacaagcccaaccucauccaggcccucaagaagcagcccuucuccuccgccuccucccagaacggcucccucuccccccacuaccucuccuccgucaucaagcagaaccagguccgcaaccucaaggaguccgacaucgacgccgccgccgccaugaugcuccucaacaccuccaucgagcagggcauccucgagugcgagaagccccucccccucaagaccgcccuccagaagaagcgcuccuacggcaacgccuuccaccaccccuccgccguccgccuccaggaguccgacucccucgccaccuccaucgaccccaaggaggaccacaacuacuccgccuccuccauggccgcccagcgcugcgccucccgcuccuccgucuccucccucuccuccgucgacgaggucuacgaguucauccccaagaacucccacgucggcuccgacggcuccgagggcuuccacuccgaggaggacaccgacgucgacuacgaggacgacccccucggcgacuccggcuacgccucccagcccugcgccaagaucuccgagaagggccaguccggcaagaagaugcgcaagcagaccugccaggagaucgacgaggagcucaaggaggccgccggcucccuccuccaccucgccggcauccgcaccugccucggcucccucaucuccaccgccaagacccagaaccagaagcagcgcaagaaguga

SEQ ID NO: 43326 - RNA, 1473 nt, Artificial Sequence
  derived and/or modified sequence opt2 from FOXN3__Homo_sapiens__NP_001078940
augggccccgucaugccccccuccaagaagcccgaguccuccggcaucuccgucuccuccggccucucccagugcuacggcggcuccggcuucuccaaggcccuccaggaggacgacgaccucgacuucucccuccccgacauccgccucgaggagggcgccauggaggacgaggagcucaccaaccucaacuggcuccacgaguccaagaaccuccucaaguccuucggcgaguccguccuccgcuccgucucccccguccaggaccucgacgacgacaccccccccucccccgcccacuccgacaugcccuacgacgcccgccagaaccccaacugcaagccccccuacuccuucuccugccucaucuucauggccaucgaggacucccccaccaagcgccuccccgucaaggacaucuacaacuggauccucgagcacuuccccuacuucgccaacgcccccaccggcuggaagaacuccguccgccacaaccucucccucaacaagugcuucaagaaggucgacaaggagcgcucccaguccaucggcaagggcucccucuggugcaucgaccccgaguaccgccagaaccucauccaggcccucaagaagacccccuaccacccccacccccacgucuucaacaccccccccaccugcccccaggccuaccaguccaccuccggcccccccaucuggcccggcuccaccuucuucaagcgcaacggcgcccuccuccaggaccccgacaucgacgccgccuccgccaugaugcuccucaacaccccccccgagauccaggccggcuucccccccggcgucauccagaacggcgcccgcguccucucccgcggccucuuccccggcguccgcccccuccccaucacccccaucggcgucaccgccgccaugcgcaacggcaucaccuccugccgcaugcgcaccgaguccgagcccuccugcggcucccccgucgucuccggcgaccccaaggaggaccacaacuacuccuccgccaaguccuccaacgcccgcuccaccucccccaccuccgacuccaucuccuccuccuccuccuccgccgacgaccacuacgaguucgccaccaagggcucccaggagggcuccgagggcuccgagggcuccuuccgcucccacgagucccccuccgacaccgaggaggacgaccgcaagcacucccagaaggagcccaaggacucccucggcgacuccggcuacgccucccagcacaagaagcgccagcacuucgccaaggcccgcaagguccccuccgacacccucccccucaagaagcgccgcaccgagaagccccccgaguccgacgacgaggagaugaaggaggccgccggcucccuccuccaccucgccggcauccgcuccugccucaacaacaucaccaaccgcaccgccaagggccagaaggagcagaaggagaccaccaagaacuga

SEQ ID NO: 43327 - RNA, 1968 nt, Artificial Sequence
  derived and/or modified sequence opt2 from FOXO1__Homo_sapiens__NP_002006
auggccgaggccccccaggucgucgagaucgaccccgacuucgagccccucccccgcccccgcuccugcaccuggccccucccccgccccgaguucucccaguccaacuccgccaccuccucccccgcccccuccggcuccgccgccgccaaccccgacgccgccgccggccuccccuccgccuccgccgccgccgucuccgccgacuucauguccaaccucucccuccucgaggaguccgaggacuucccccaggcccccggcuccgucgccgccgccgucgccgccgccgccgccgccgccgccaccggcggccucugcggcgacuuccagggccccgaggccggcugccuccaccccgcccccccccagccccccccccccggcccccucucccagcacccccccgucccccccgccgccgccggcccccucgccggccagccccgcaaguccuccuccucccgccgcaacgccuggggcaaccucuccuacgccgaccucaucaccaaggccaucgaguccuccgccgagaagcgccucacccucucccagaucuacgaguggauggucaaguccguccccuacuucaaggacaagggcgacuccaacuccuccgccggcuggaagaacuccauccgccacaaccucucccuccacuccaaguucauccgcguccagaacgagggcaccggcaaguccuccugguggaugcucaaccccgagggcggcaaguccggcaaguccccccgccgccgcgccgccuccauggacaacaacuccaaguucgccaagucccgcucccgcgccgccaagaagaaggccucccuccaguccggccaggagggcgccggcgacucccccggcucccaguucuccaaguggcccgccucccccggcucccacuccaacgacgacuucgacaacugguccaccuuccgcccccgcaccuccuccaacgccuccaccaucuccggccgccucucccccaucaugaccgagcaggacgaccucggcgagggcgacguccacuccauggucuacccccccuccgccgccaagauggccuccacccuccccucccucuccgagaucuccaaccccgagaacauggagaaccuccucgacaaccucaaccuccucuccucccccaccucccucaccgucuccacccaguccucccccggcaccaugaugcagcagacccccugcuacuccuucgccccccccaacaccucccucaacucccccucccccaacuaccagaaguacaccuacggccaguccuccauguccccccucccccagaugcccauccagacccuccaggacaacaaguccuccuacggcggcaugucccaguacaacugcgcccccggccuccucaaggagcuccucaccuccgacucccccccccacaacgacaucaugacccccgucgaccccggcgucgcccagcccaacucccgcguccucggccagaacgucaugaugggccccaacuccgucauguccaccuacggcucccaggccucccacaacaagaugaugaaccccuccucccacacccaccccggccacgcccagcagaccuccgccgucaacggccgcccccucccccacaccgucuccaccaugccccacaccuccggcaugaaccgccucacccaggucaagacccccguccaggucccccucccccaccccaugcagauguccgcccucggcggcuacuccuccgucuccuccugcaacggcuacggccgcaugggccuccuccaccaggagaagcuccccuccgaccucgacggcauguucaucgagcgccucgacugcgacauggaguccaucauccgcaacgaccucauggacggcgacacccucgacuucaacuucgacaacguccuccccaaccaguccuucccccacuccgucaagaccaccacccacuccugggucuccggcuga

SEQ ID NO: 43328 - RNA, 2022 nt, Artificial Sequence
  derived and/or modified sequence opt2 from FOXO3__Homo_sapiens__NP_963853
auggccgaggcccccgccucccccgccccccucuccccccucgaggucgagcucgaccccgaguucgagccccagucccgcccccgcuccugcaccuggccccuccagcgccccgagcuccaggccucccccgccaagcccuccggcgagaccgccgccgacuccaugauccccgaggaggaggacgacgaggacgacgaggacggcggcggccgcgccggcuccgccauggccaucggcggcggcggcggcuccggcacccucggcuccggccuccuccucgaggacuccgcccgcguccucgcccccggcggccaggaccccggcuccggccccgccaccgccgccggcggccucuccggcggcacccaggcccuccuccagccccagcagccccucccccccccccagcccggcgccgccggcggcuccggccagccccgcaagugcuccucccgccgcaacgccuggggcaaccucuccuacgccgaccucaucacccgcgccaucgaguccucccccgacaagcgccucacccucucccagaucuacgaguggaugguccgcugcguccccuacuucaaggacaagggcgacuccaacuccuccgccggcuggaagaacuccauccgccacaaccucucccuccacucccgcuucaugcgcguccagaacgagggcaccggcaaguccuccugguggaucaucaaccccgacggcggcaaguccggcaaggccccccgccgccgcgccgucuccauggacaacuccaacaaguacaccaagucccgcggccgcgccgccaagaagaaggccgcccuccagaccgcccccgaguccgccgacgacucccccucccagcucuccaaguggcccggcucccccaccucccgcuccuccgacgagcucgacgccuggaccgacuuccgcucccgcaccaacuccaacgccuccaccgucuccggccgccucucccccaucauggccuccaccgagcucgacgagguccaggacgacgacgccccccucucccccaugcucuacuccuccuccgccucccucucccccuccgucuccaagcccugcaccgucgagcucccccgccucaccgacauggccggcaccaugaaccucaacgacggccucaccgagaaccucauggacgaccuccucgacaacaucacccucccccccucccagcccucccccaccggcggccucaugcagcgcuccuccuccuuccccuacaccaccaagggcuccggccucggcucccccaccuccuccuucaacuccaccgucuucggccccuccucccucaacucccuccgccagucccccaugcagaccauccaggagaacaagcccgccaccuucuccuccaugucccacuacggcaaccagacccuccaggaccuccucaccuccgacucccucucccacuccgacgucaugaugacccaguccgacccccucaugucccaggccuccaccgccgucuccgcccagaacucccgccgcaacgucaugcuccgcaacgaccccaugauguccuucgccgcccagcccaaccagggcucccucgucaaccagaaccuccuccaccaccagcaccagacccagggcgcccucggcggcucccgcgcccucuccaacuccgucuccaacaugggccucuccgaguccuccucccucggcuccgccaagcaccagcagcagucccccgucucccaguccaugcagacccucuccgacucccucuccggcuccucccucuacuccaccuccgccaaccuccccgucaugggccacgagaaguuccccuccgaccucgaccucgacauguucaacggcucccucgagugcgacauggaguccaucauccgcuccgagcucauggacgccgacggccucgacuucaacuucgacucccucaucuccacccagaacgucgucggccucaacgucggcaacuucaccggcgccaagcaggccuccucccaguccuggguccccggcuga

SEQ ID NO: 43329 - RNA, 1353 nt, Artificial Sequence
  derived and/or modified sequence opt2 from FOXO4__Homo_sapiens__NP_001164402
auggaccccggcaacgagaacuccgccaccgaggccgccgccaucaucgaccucgaccccgacuucgagccccagucccgcccccgcuccugcaccuggccccucccccgccccgagaucgccaaccagcccuccgagccccccgaggucgagcccgaccucggcgagaaggccaucgaguccgcccccgagaagcgccucacccucgcccagaucuacgaguggaugguccgcaccguccccuacuucaaggacaagggcgacuccaacuccuccgccggcuggaagaacuccauccgccacaaccucucccuccacuccaaguucaucaagguccacaacgaggccaccggcaaguccuccugguggaugcucaaccccgagggcggcaaguccggcaaggccccccgccgccgcgccgccuccauggacuccuccuccaagcuccuccgcggccgcuccaaggcccccaagaagaagcccuccguccuccccgccccccccgagggcgccacccccaccucccccgucggccacuucgccaagugguccggcucccccugcucccgcaaccgcgaggaggccgacauguggaccaccuuccgcccccgcuccuccuccaacgccuccuccgucuccacccgccucuccccccuccgccccgaguccgagguccucgccgaggagauccccgccuccgucuccuccuacgccggcggcgucccccccacccucaacgagggccucgagcuccucgacggccucaaccucaccuccucccacucccuccucucccgcuccggccucuccggcuucucccuccagcaccccggcgucaccggcccccuccacaccuacuccuccucccucuucucccccgccgagggcccccucuccgccggcgagggcugcuucuccuccucccaggcccucgaggcccuccucaccuccgacaccccccccccccccgccgacguccucaugacccaggucgaccccauccucucccaggcccccacccuccuccuccucggcggccuccccuccuccuccaagcucgccaccggcgucggccucugccccaagccccucgaggcccccggccccuccucccucguccccacccucuccaugaucgcccccccccccgucauggccuccgcccccauccccaaggcccucggcacccccguccucaccccccccaccgaggccgccucccaggaccgcaugccccaggaccucgaccucgacauguacauggagaaccucgagugcgacauggacaacaucaucuccgaccucauggacgagggcgagggccucgacuucaacuucgagcccgaccccuga

SEQ ID NO: 43330 - RNA, 1680 nt, Artificial Sequence
  derived and/or modified sequence opt2 from FOXO6__Homo_sapiens__NP_001278210
auggccgccaagcuccgcgcccaccaggucgacgucgaccccgacuucgccccccagucccgcccccgcuccugcaccuggccccucccccagcccgaccucgccggcgacgaggacggcgcccucggcgccggcgucgccgagggcgccgaggacugcggccccgagcgccgcgccaccgcccccgccauggcccccgcccccccccucggcgccgaggucggcccccuccgcaaggccaaguccucccgccgcaacgccuggggcaaccucuccuacgccgaccucaucaccaaggccaucgaguccgcccccgacaagcgccucacccucucccagaucuacgacuggaugguccgcuacguccccuacuucaaggacaagggcgacuccaacuccuccgccggcuggaagaacuccauccgccacaaccucucccuccacacccgcuucauccgcguccagaacgagggcaccggcaaguccuccugguggaugcucaaccccgagggcggcaagaccggcaagaccccccgccgccgcgccgucuccauggacaacggcgccaaguuccuccgcaucaagggcaaggccuccaagaagaagcagcuccaggcccccgagcgcucccccgacgacuccucccccuccgcccccgcccccggccccguccccgccgccgccaagugggccgccucccccgccucccacgccuccgacgacuacgaggccugggccgacuuccgcggcggcggccgcccccuccucggcgaggccgccgagcucgaggacgacgaggcccucgaggcccucgcccccuccuccccccucauguaccccucccccgccuccgcccucucccccgcccucggcucccgcugccccggcgagcucccccgccucgccgagcucggcggcccccucggccuccacggcggcggcggcgccggccuccccgagggccuccucgacggcgcccaggacgccuacggcccccgcgcccgcgccggcacccccgccuacuucggcggcugcaagggcggcgccuacggcggcggcggcggcuucggcccccccgccaugggcgcccuccgccgccuccccaugcagaccauccaggagaacaagcaggccuccuucguccccgccgccgcccccuuccgccccggcgcccuccccgcccuccuccccccccccccccccgccccccgccccggccccguccucggcgcccccggcgagcucgcccucgccggcgccgccgccgccuaccccggcaagggcgccgcccccuacgccccccccgcccccucccgcuccgcccucgcccaccccaucucccucaugacccuccccggcgaggccggcgccgccggccucgcccccuccggccacgccgccgccuucggcggcccccccggcggccuccuccucgacgcccuccccggccccuacgccgccgccgccgccggcccccucggcgccgcccccgaccgcuuccccgccgaccucgaccucgacauguucuccggcucccucgagugcgacgucgaguccaucauccucaacgacuucauggacuccgacgagauggacuucaacuucgacuccgcccuccccccccccccccccggccucgccggcgcccccccccccaaccaguccuggguccccggcuga

SEQ ID NO: 43331 - RNA, 345 nt, Artificial Sequence
  derived and/or modified sequence opt2 from FOXP1__Homo_sapiens__NP_001012523
augaugcaggaguccggcaccgagaccaaguccaacggcuccgccauccagaacggcuccggcggcuccaaccaccuccucgagugcggcggccuccgcgagggccgcuccaacggcgagacccccgccgucgacaucggcgccgccgaccucgcccacgcccagcagcagcagcagcaguggcaccucaucaaccaccagcccucccgcucccccuccuccuggcucaagcgccucaucuccucccccugggagcucgagguccuccaggucccccucuggggcgccgucgccgagaccaagauguccggccccgucugccagcccaaccccucccccuucuga

SEQ ID NO: 43332 - RNA, 2145 nt, Artificial Sequence
  derived and/or modified sequence opt2 from FOXP2__Homo_sapiens__NP_001166237
augaugcaggaguccgccaccgagaccaucuccaacuccuccaugaaccagaacggcauguccacccucuccucccagcucgacgccggcucccgcgacggccgcuccuccggcgacaccuccuccgaggucuccaccgucgagcuccuccaccuccagcagcagcaggcccuccaggccgcccgccagcuccuccuccagcagcagaccuccggccucaagucccccaaguccuccgacaagcagcgcccccuccagguccccgucuccgucgccaugaugaccccccaggucaucaccccccagcagaugcagcagauccuccagcagcagguccucuccccccagcagcuccaggcccuccuccagcagcagcaggccgucaugcuccagcagcagcagcuccaggaguucuacaagaagcagcaggagcagcuccaccuccagcuccuccagcagcagcagcagcagcagcagcagcagcagcagcagcagcagcagcagcagcagcagcagcagcagcagcagcagcagcagcagcagcagcagcagcagcagcagcagcagcagcagcaccccggcaagcaggccaaggagcagcagcagcagcagcagcagcagcagcucgccgcccagcagcucgucuuccagcagcagcuccuccagaugcagcagcuccagcagcagcagcaccuccucucccuccagcgccagggccucaucuccaucccccccggccaggccgcccuccccguccagucccucccccaggccggccucucccccgccgagauccagcagcucuggaaggaggucaccggcguccacuccauggaggacaacggcaucaagcacggcggccucgaccucaccaccaacaacuccuccuccaccaccuccuccaacaccuccaaggccuccccccccaucacccaccacuccaucgucaacggccaguccuccguccucuccgcccgccgcgacuccuccucccacgaggagaccggcgccucccacacccucuacggccacggcgucugcaaguggcccggcugcgaguccaucugcgaggacuucggccaguuccucaagcaccucaacaacgagcacgcccucgacgaccgcuccaccgcccagugccgcguccagaugcaggucguccagcagcucgagauccagcucuccaaggagcgcgagcgccuccaggccaugaugacccaccuccacaugcgccccuccgagcccaagcccucccccaagccccucaaccucgucuccuccgucaccauguccaagaacaugcucgagaccuccccccagucccucccccagacccccaccacccccaccgcccccgucacccccaucacccagggccccuccgucaucacccccgccuccguccccaacgucggcgccauccgccgccgccacuccgacaaguacaacauccccauguccuccgagaucgcccccaacuacgaguucuacaagaacgccgacguccgcccccccuucaccuacgccacccucauccgccaggccaucauggaguccuccgaccgccagcucacccucaacgagaucuacuccugguucacccgcaccuucgccuacuuccgccgcaacgccgccaccuggaagaacgccguccgccacaaccucucccuccacaagugcuucguccgcgucgagaacgucaagggcgccgucuggaccgucgacgaggucgaguaccagaagcgccgcucccagaagaucaccggcucccccacccucgucaagaacauccccaccucccucggcuacggcgccgcccucaacgccucccuccaggccgcccucgccgaguccucccucccccuccucuccaaccccggccucaucaacaacgccuccuccggccuccuccaggccguccacgaggaccucaacggcucccucgaccacaucgacuccaacggcaacuccucccccggcugcuccccccagccccacauccacuccauccacgucaaggaggagcccgucaucgccgaggacgaggacugccccaugucccucgucaccaccgccaaccacucccccgagcucgaggacgaccgcgagaucgaggaggagccccucuccgaggaccucgaguga

SEQ ID NO: 43333 - RNA, 1191 nt, Artificial Sequence
  derived and/or modified sequence opt2 from FOXP3__Homo_sapiens__NP_001107849
augcccaacccccgccccggcaagcccuccgcccccucccucgcccucggccccucccccggcgccucccccuccuggcgcgccgcccccaaggccuccgaccuccucggcgcccgcggccccggcggcaccuuccagggccgcgaccuccgcggcggcgcccacgccuccuccuccucccucaaccccaugccccccucccagcuccagcucuccaccgucgacgcccacgcccgcacccccguccuccagguccacccccucgagucccccgccaugaucucccucaccccccccaccaccgccaccggcgucuucucccucaaggcccgccccggccucccccccggcaucaacgucgccucccucgagugggucucccgcgagcccgcccuccucugcaccuuccccaaccccuccgccccccgcaaggacuccacccucuccgccgucccccaguccuccuacccccuccucgccaacggcgucugcaaguggcccggcugcgagaaggucuucgaggagcccgaggacuuccucaagcacugccaggccgaccaccuccucgacgagaagggccgcgcccagugccuccuccagcgcgagaugguccagucccucgagcagcagcucguccucgagaaggagaagcucuccgccaugcaggcccaccucgccggcaagauggcccucaccaaggccuccuccgucgccuccuccgacaagggcuccugcugcaucgucgccgccggcucccagggccccgucguccccgccugguccggcccccgcgaggcccccgacucccucuucgccguccgccgccaccucuggggcucccacggcaacuccaccuuccccgaguuccuccacaacauggacuacuucaaguuccacaacaugcgcccccccuucaccuacgccacccucauccgcugggccauccucgaggcccccgagaagcagcgcacccucaacgagaucuaccacugguucacccgcauguucgccuucuuccgcaaccaccccgccaccuggaagaacgccauccgccacaaccucucccuccacaagugcuucguccgcgucgaguccgagaagggcgccgucuggaccgucgacgagcucgaguuccgcaagaagcgcucccagcgccccucccgcugcuccaaccccacccccggccccuga

SEQ ID NO: 43334 - RNA, 2043 nt, Artificial Sequence
  derived and/or modified sequence opt2 from FOXP4__Homo_sapiens__NP_001012426
augauggucgaguccgccuccgagaccauccgcuccgcccccuccggccagaacggcgucggcucccucuccggccaggccgacggcuccuccggcggcgccaccggcaccaccgccuccggcaccggccgcgaggucaccaccggcgccgacuccaacggcgagaugucccccgccgagcuccuccacuuccagcagcagcaggcccuccaggucgcccgccaguuccuccuccagcaggccuccggccucuccucccccggcaacaacgacuccaagcaguccgccuccgccguccagguccccgucuccgucgccaugauguccccccagaugcucaccccccagcagaugcagcagauccucucccccccccagcuccaggcccuccuccagcagcagcaggcccucaugcuccagcagcuccaggaguacuacaagaagcagcaggagcagcuccaccuccagcuccucacccagcagcaggccggcaagccccagcccaaggaggcccucggcaacaagcagcucgccuuccagcagcagcuccuccagaugcagcagcuccagcagcagcaccuccucaaccuccagcgccagggccucgucucccuccagcccaaccaggccuccggcccccuccagacccucccccaggccgccgucugccccaccgaccucccccagcucuggaagggcgagggcgcccccggccagcccgccgaggacuccgucaagcaggagggccucgaccucaccggcaccgccgccaccgccaccuccuucgccgccccccccaaggucucccccccccucucccaccacacccuccccaacggccagcccaccguccucaccucccgccgcgacuccuccucccacgaggagacccccggcucccacccccucuacggccacggcgagugcaaguggcccggcugcgagacccucugcgaggaccucggccaguucaucaagcaccucaacaccgagcacgcccucgacgaccgcuccaccgcccagugccgcguccagaugcaggucguccagcagcucgagauccagcucgccaaggaguccgagcgccuccaggccaugauggcccaccuccacaugcgccccuccgagcccaagcccuucucccagccccucaaccccguccccggcuccuccuccuucuccaaggucaccgucuccgccgccgacuccuuccccgacggccucguccacccccccaccuccgccgccgcccccgucaccccccuccgcccccccggccucggcuccgccucccuccacggcggcggccccgcccgccgccgcuccuccgacaaguucugcucccccaucuccuccgagcucgcccagaaccacgaguucuacaagaacgccgacguccgcccccccuucaccuacgccucccucauccgccaggccauccucgagacccccgaccgccagcucacccucaacgagaucuacaacugguucacccgcauguucgccuacuuccgccgcaacaccgccaccuggaagaacgccguccgccacaaccucucccuccacaagugcuucguccgcgucgagaacgucaagggcgccgucuggaccgucgacgagcgcgaguaccagaagcgccgcccccccaagaugaccggcucccccacccucgucaagaacaugaucuccggccucuccuacggcgcccucaacgccuccuaccaggccgcccucgccgaguccuccuucccccuccucaacucccccggcaugcucaaccccggcuccgccuccucccuccucccccucucccacgacgacgucggcgcccccgucgagccccuccccuccaacggcuccuccucccccccccgccucucccccccccaguacucccaccagguccaggucaaggaggagcccgccgaggccgaggaggaccgccagcccggccccccccucggcgcccccaaccccuccgccuccggcccccccgaggaccgcgaccucgaggaggagcuccccggcgaggagcucuccuga

SEQ ID NO: 43335 - RNA, 1212 nt, Artificial Sequence
  derived and/or modified sequence opt2 from FOXQ1__Homo_sapiens__NP_150285
augaagcucgaggucuucgucccccgcgccgcccacggcgacaagcagggcuccgaccucgagggcgccggcggcuccgacgcccccuccccccucuccgccgccggcgacgacucccucggcuccgacggcgacugcgccgccaacucccccgccgccggcggcggcgcccgcgacacccagggcgacggcgagcaguccgccggcggcggccccggcgccgaggaggccauccccgccgccgccgccgccgccgucgucgccgagggcgccgaggccggcgccgccggccccggcgccggcggcgccggcuccggcgagggcgcccgcuccaagcccuacacccgccgccccaagccccccuacuccuacaucgcccucaucgccauggccauccgcgacuccgccggcggccgccucacccucgccgagaucaacgaguaccucaugggcaaguuccccuucuuccgcggcuccuacaccggcuggcgcaacuccguccgccacaaccucucccucaacgacugcuucgucaagguccuccgcgaccccucccgccccuggggcaaggacaacuacuggaugcucaaccccaacuccgaguacaccuucgccgacggcgucuuccgccgccgccgcaagcgccucucccaccgcgcccccguccccgcccccggccuccgccccgaggaggcccccggccuccccgccgcccccccccccgcccccgccgcccccgccuccccccgcaugcgcucccccgcccgccaggaggagcgcgccucccccgccggcaaguucuccuccuccuucgccaucgacuccauccuccgcaagcccuuccgcucccgccgccuccgcgacaccgcccccggcaccacccuccaguggggcgccgcccccugccccccccuccccgccuuccccgcccuccuccccgccgcccccugccgcgcccuccucccccucugcgccuacggcgccggcgagcccgcccgccucggcgcccgcgaggccgaggucccccccaccgcccccccccuccuccucgccccccuccccgccgccgcccccgccaagccccuccgcggccccgccgccggcggcgcccaccucuacugcccccuccgccuccccgccgcccuccaggccgccuccguccgccgccccggcccccaccuccccuaccccgucgagacccuccucgccuga

SEQ ID NO: 43336 - RNA, 879 nt, Artificial Sequence
  derived and/or modified sequence opt2 from FOXR1__Homo_sapiens__NP_859072
augggcaacgagcucuuccucgccuucaccaccucccaccucccccucgccgagcagaagcucgcccgcuacaagcuccgcaucgucaagccccccaagcucccccucgagaagaagcccaaccccgacaaggacggccccgacuacgagcccaaccucuggaugugggucaaccccaacaucgucuacccccccggcaagcucgaggucuccggccgccgcaagcgcgaggaccucaccuccacccuccccuccucccagcccccccagaaggaggaggacgccuccugcuccgaggccgccggcgucgagucccucucccaguccuccuccaagcgcucccccccccgcaagcgcuucgccuucucccccuccaccugggagcucaccgaggaggaggaggccgaggaccaggaggacuccuccuccauggcccuccccuccccccacaagcgcgccccccuccagucccgccgccuccgccaggccuccucccaggccggccgccucuggucccgccccccccucaacuacuuccaccucaucgcccucgcccuccgcaacuccucccccugcggccucaacguccagcagaucuacuccuucacccgcaagcacuuccccuucuuccgcaccgcccccgagggcuggaagaacaccguccgccacaaccucugcuuccgcgacuccuucgagaagguccccgucuccaugcagggcggcgccuccacccgcccccgcuccugccucuggaagcucaccgaggagggccaccgccgcuucgccgaggaggcccgcgcccucgccuccacccgccucgaguccauccagcagugcaugucccagcccgacgucaugcccuuccucuucgaccucuga

SEQ ID NO: 43337 - RNA, 936 nt, Artificial Sequence
  derived and/or modified sequence opt2 from FOXR2__Homo_sapiens__NP_940853
auggaccucaagcucaaggacugcgaguucugguacucccuccacggccagguccccggccuccucgacugggacaugcgcaacgagcucuuccuccccugcaccaccgaccagugcucccucgccgagcagauccucgccaaguaccgcgucggcgucaugaagccccccgagaugccccagaagcgccgccccucccccgacggcgacggcccccccugcgagcccaaccucuggaugugggucgaccccaacauccucugcccccucggcucccaggaggcccccaagcccuccggcaaggaggaccucaccaacaucucccccuucccccagcccccccagaaggacgagggcuccaacugcuccgaggacaaggucgucgagucccuccccuccuccuccuccgagcaguccccccuccagaagcagggcauccacucccccuccgacuucgagcucaccgaggaggaggccgaggagcccgacgacaacucccuccagucccccgagaugaagugcuaccagucccagaagcucuggcagaucaacaaccaggagaaguccuggcagcgccccccccucaacugcucccaccucaucgcccucgcccuccgcaacaacccccacugcggccucuccguccaggagaucuacaacuucacccgccagcacuuccccuucuucuggaccgcccccgacggcuggaaguccaccauccacuacaaccucugcuuccucgacuccuucgagaagguccccgacucccucaaggacgaggacaacgcccgcccccgcuccugccucuggaagcucaccaaggagggccaccgccgcuucugggaggagacccgcguccucgccuucgcccagcgcgagcgcauccaggagugcaugucccagcccgagcuccucaccucccucuucgaccucuga

SEQ ID NO: 43338 - RNA, 1461 nt, Artificial Sequence
  derived and/or modified sequence opt2 from FOXRED1__Homo_sapiens__NP_060017
augauccgccgcguccucccccacggcaugggccgcggccuccucacccgccgccccggcacccgccgcggcggcuucucccucgacugggacggcaaggucuccgagaucaagaagaagaucaaguccauccuccccggccgcuccugcgaccuccuccaggacaccucccaccucccccccgagcacuccgacgucgucaucgucggcggcggcguccucggccucuccgucgccuacuggcucaagaagcucgagucccgccgcggcgccauccgcguccucgucgucgagcgcgaccacaccuacucccaggccuccaccggccucuccgucggcggcaucugccagcaguucucccuccccgagaacauccagcucucccucuucuccgccuccuuccuccgcaacaucaacgaguaccucgccgucgucgacgcccccccccucgaccuccgcuucaaccccuccggcuaccuccuccucgccuccgagaaggacgccgccgccauggaguccaacgucaagguccagcgccaggagggcgccaaggucucccucaugucccccgaccagcuccgcaacaaguuccccuggaucaacaccgagggcgucgcccucgccuccuacggcauggaggacgagggcugguucgaccccuggugccuccuccagggccuccgccgcaagguccagucccucggcguccucuucugccagggcgaggucacccgcuucgucuccuccucccagcgcaugcucaccaccgacgacaaggccgucguccucaagcgcauccacgagguccacgucaagauggaccgcucccucgaguaccagcccgucgagugcgccaucgucaucaacgccgccggcgccugguccgcccagaucgccgcccucgccggcgucggcgagggcccccccggcacccuccagggcaccaagcuccccgucgagccccgcaagcgcuacgucuacgucuggcacugcccccagggccccggccucgagaccccccucgucgccgacaccuccggcgccuacuuccgccgcgagggccucggcuccaacuaccucggcggccgcucccccaccgagcaggaggagcccgaccccgccaaccucgaggucgaccacgacuucuuccaggacaaggucuggccccaccucgcccuccgcguccccgccuucgagacccucaagguccaguccgccugggccggcuacuacgacuacaacaccuucgaccagaacggcgucgucggcccccacccccucgucgucaacauguacuucgccaccggcuucuccggccacggccuccagcaggcccccggcaucggccgcgccgucgccgagaugguccucaagggccgcuuccagaccaucgaccucucccccuuccucuucacccgcuucuaccucggcgagaagauccaggagaacaacaucaucuga

SEQ ID NO: 43339 - RNA, 1686 nt, Artificial Sequence
  derived and/or modified sequence opt2 from FPGS__Homo_sapiens__NP_001275732
augucccgcgcccgcucccaccuccgcgccgcccucuuccucgccgccgccuccgcccgcggcaucaccacccaggucgccgcccgccgcggccucuccgccuggcccgucccccaggagcccuccauggaguaccaggacgccguccgcaugcucaacacccuccagaccaacgccggcuaccucgagcaggucaagcgccagcgcggcgacccccagacccagcucgaggccauggagcucuaccucgcccgcuccggccuccaggucgaggaccucgaccgccucaacaucauccacgucaccggcaccaagggcaagggcuccaccugcgccuucaccgagugcauccuccgcuccuacggccucaagaccggcuucuucuccuccccccaccucguccagguccgcgagcgcauccgcaucaacggccagcccaucucccccgagcucuucaccaaguacuucuggcgccucuaccaccgccucgaggagaccaaggucgaccucgccgucgucgaggucggcaucggcggcgccuacgacugcaccaacaucauccgcaagcccgucgucugcggcgucuccucccucggcaucgaccacaccucccuccucggcgacaccgucgagaagaucgccuggcagaagggcggcaucuucaagcagggcguccccgccuucaccguccuccagcccgagggcccccucgccguccuccgcgaccgcgcccagcagaucuccugcccccucuaccucugccccaugcucgaggcccucgaggagggcggccccccccucacccucggccucgagggcgagcaccagcgcuccaacgccgcccucgcccuccagcucgcccacugcuggcuccagcgccaggaccgccacggcgccggcgagcccaaggccucccgccccggccuccucuggcagcucccccucgcccccgucuuccagcccaccucccacaugcgccucggccuccgcaacaccgaguggcccggccgcacccagguccuccgccgcggcccccucaccugguaccucgacggcgcccacaccgccuccuccgcccaggccugcguccgcugguuccgccaggcccuccagggccgcgagcgccccuccggcggccccgagguccgcguccuccucuucaacgccaccggcgaccgcgaccccgccgcccuccucaagcuccuccagcccugccaguucgacuacgccgucuucugccccaaccucaccgaggucuccuccaccggcaacgccgaccagcagaacuucaccgucacccucgaccagguccuccuccgcugccucgagcaccagcagcacuggaaccaccucgacgaggagcaggccucccccgaccucugguccgcccccucccccgagcccggcggcuccgccucccuccuccucgccccccaccccccccacaccugcuccgccuccucccucgucuucuccugcaucucccacgcccuccaguggaucucccagggccgcgaccccaucuuccagccccccuccccccccaagggccuccucacccaccccgucgcccacuccggcgccuccauccuccgcgaggccgccgccauccacguccucgucaccggcucccuccaccucgucggcggcguccucaagcuccucgagcccgcccucucccaguga

SEQ ID NO: 43340 - RNA, 1053 nt, Artificial Sequence
  derived and/or modified sequence opt2 from FPR1__Homo_sapiens__NP_001180235
auggagaccaacuccucccuccccaccaacaucuccggcggcacccccgccgucuccgccggcuaccucuuccucgacaucaucaccuaccucgucuucgccgucaccuucguccucggcguccucggcaacggccucgucaucugggucgccggcuuccgcaugacccacaccgucaccaccaucuccuaccucaaccucgccgucgccgacuucugcuucaccuccacccuccccuucuucaugguccgcaaggccaugggcggccacuggcccuucggcugguuccucugcaaguucgucuucaccaucgucgacaucaaccucuucggcuccgucuuccucaucgcccucaucgcccucgaccgcugcgucugcguccuccaccccgucuggacccagaaccaccgcaccgucucccucgccaagaaggucaucaucggccccugggucauggcccuccuccucacccuccccgucaucauccgcgucaccaccguccccggcaagaccggcaccgucgccugcaccuucaacuucucccccuggaccaacgaccccaaggagcgcaucaacgucgccgucgccaugcucaccguccgcggcaucauccgcuucaucaucggcuucuccgcccccauguccaucgucgccgucuccuacggccucaucgccaccaagauccacaagcagggccucaucaaguccucccgcccccuccgcguccucuccuucgucgccgccgccuucuuccucugcuggucccccuaccaggucgucgcccucaucgccaccguccgcauccgcgagcuccuccagggcauguacaaggagaucggcaucgccgucgacgucaccuccgcccucgccuucuucaacuccugccucaaccccaugcucuacgucuucaugggccaggacuuccgcgagcgccucauccacgcccuccccgccucccucgagcgcgcccucaccgaggacuccacccagaccuccgacaccgccaccaacuccacccuccccuccgccgaggucgagcuccaggccaaguga

SEQ ID NO: 43341 - RNA, 1056 nt, Artificial Sequence
  derived and/or modified sequence opt2 from FPR2__Homo_sapiens__XP_006723183
auggagaccaacuucuccaccccccucaacgaguacgaggaggucuccuacgaguccgccggcuacaccguccuccgcauccucccccucgucguccucggcgucaccuucguccucggcguccucggcaacggccucgucaucugggucgccggcuuccgcaugacccgcaccgucaccaccaucugcuaccucaaccucgcccucgccgacuucuccuucaccgccacccuccccuuccucaucgucuccauggccaugggcgagaaguggcccuucggcugguuccucugcaagcucauccacaucgucgucgacaucaaccucuucggcuccgucuuccucaucggcuucaucgcccucgaccgcugcaucugcguccuccaccccgucugggcccagaaccaccgcaccgucucccucgccaugaaggucaucgucggccccuggauccucgcccucguccucacccuccccgucuuccucuuccucaccaccgucaccauccccaacggcgacaccuacugcaccuucaacuucgccuccuggggcggcacccccgaggagcgccucaaggucgccaucaccaugcucaccgcccgcggcaucauccgcuucgucaucggcuucucccuccccauguccaucgucgccaucugcuacggccucaucgccgccaagauccacaagaagggcaugaucaaguccucccgcccccuccgcguccucaccgccgucgucgccuccuucuucaucugcugguuccccuuccagcucgucgcccuccucggcaccgucuggcucaaggagaugcucuucuacggcaaguacaagaucaucgacauccucgucaaccccaccuccucccucgccuucuucaacuccugccucaaccccaugcucuacgucuucgucggccaggacuuccgcgagcgccucauccacucccuccccaccucccucgagcgcgcccucuccgaggacuccgcccccaccaacgacaccgccgccaacuccgccuccccccccgccgagaccgagcuccaggccauguga

SEQ ID NO: 43342 - RNA, 1062 nt, Artificial Sequence
  derived and/or modified sequence opt2 from FPR3__Homo_sapiens__NP_002021
auggagaccaacuucuccaucccccucaacgagaccgaggagguccuccccgagcccgccggccacaccguccucuggaucuucucccuccucguccacggcgucaccuucgucuucggcguccucggcaacggccucgucaucugggucgccggcuuccgcaugacccgcaccgucaacaccaucugcuaccucaaccucgcccucgccgacuucuccuucuccgccauccuccccuuccgcauggucuccgucgccaugcgcgagaaguggcccuucggcuccuuccucugcaagcucguccacgucaugaucgacaucaaccucuucgucuccgucuaccucaucaccaucaucgcccucgaccgcugcaucugcguccuccaccccgccugggcccagaaccaccgcaccaugucccucgccaagcgcgucaugaccggccucuggaucuucaccaucguccucacccuccccaacuucaucuucuggaccaccaucuccaccaccaacggcgacaccuacugcaucuucaacuucgccuucuggggcgacaccgccgucgagcgccucaacgucuucaucaccauggccaaggucuuccucauccuccacuucaucaucggcuucuccguccccauguccaucaucaccgucugcuacggcaucaucgccgccaagauccaccgcaaccacaugaucaaguccucccgcccccuccgcgucuucgccgccgucgucgccuccuucuucaucugcugguuccccuacgagcucaucggcauccucauggccgucuggcucaaggagaugcuccucaacggcaaguacaagaucauccucguccucaucaaccccaccuccucccucgccuucuucaacuccugccucaaccccauccucuacgucuucaugggccgcaacuuccaggagcgccucauccgcucccuccccaccucccucgagcgcgcccucaccgagguccccgacuccgcccagaccuccaacaccgacaccaccuccgccuccccccccgaggagaccgagcuccaggccauguga

SEQ ID NO: 43343 - RNA, 5931 nt, Artificial Sequence
  derived and/or modified sequence opt2 from FRAS1__Homo_sapiens__NP_001159605
augggcguccucaaggucuggcucggccucgcccucgcccucgccgaguucgccguccucccccaccacuccgagggcgccugcgucuaccaggacucccuccucgccgacgccaccaucuggaagcccgacuccugccaguccugccgcugccacggcgacaucgucaucugcaagcccgccgucugccgcaacccccagugcgccuucgagaagggcgagguccuccagaucgccgccaaccagugcugccccgagugcguccuccgcacccccggcuccugccaccacgagaagaagauccacgagcacggcaccgagugggccuccucccccugcuccgucugcuccugcaaccacggcgagguccgcugcaccccccagcccugccccccccucuccugcggccaccaggagcucgccuucauccccgagggcuccugcugccccgucugcgucggccucggcaagcccugcuccuacgagggccacgucuuccaggacggcgaggacuggcgccucucccgcugcgccaagugccucugccgcaacggcgucgcccagugcuucaccgcccagugccagccccucuucugcaaccaggacgagaccgucguccgcguccccggcaagugcugcccccagugcuccgcccgcuccugcuccgccgccggccaggucuacgagcacggcgagcagugguccgagaacgccugcaccaccugcaucugcgaccgcggcgagguccgcugccacaagcaggccugccucccccuccgcugcggcaagggccagucccgcgcccgccgccacggccagugcugcgaggagugcgucucccccgccggcuccugcuccuacgacggcgucguccgcuaccaggacgagauguggaagggcuccgccugcgaguucugcaugugcgaccacggccaggucaccugccagaccggcgagugcgccaaggucgagugcgcccgcgacgaggagcucauccaccucgacggcaagugcugccccgagugcaucucccgcaacggcuacugcgucuacgaggagaccggcgaguucauguccuccaacgccuccgaggucaagcgcauccccgagggcgagaagugggaggacggccccugcaaggucugcgagugccgcggcgcccaggucaccugcuacgagcccuccugcccccccugccccgucggcacccucgcccucgaggucaagggccagugcugccccgacugcaccuccguccacugccaccccgacugccucaccugcucccagucccccgaccacugcgaccucugccaggaccccaccaagcuccuccagaacggcuggugcguccacuccugcggccucggcuucuaccaggccggcucccucugccucgccugccagccccagugcuccaccugcaccuccggccucgagugcuccuccugccagcccccccuccucaugcgccacggccagugcguccccaccugcggcgacggcuucuaccaggaccgccacuccugcgccgucugccacgaguccugcgccggcugcuggggccccaccgagaagcacugccucgccugccgcgacccccuccacguccuccgcgacggcggcugcgaguccuccugcggcaagggcuucuacaaccgccagggcaccugcuccgccugcgaccaguccugcgacuccugcggccccuccuccccccgcugccucaccugcaccgagaagaccguccuccacgacggcaagugcauguccgagugccccggcggcuacuacgccgacgccaccggccgcugcaaggucugccacaacuccugcgccuccugcuccggccccacccccucccacugcaccgccugcuccccccccaaggcccuccgccagggccacugccucccccgcugcggcgagggcuucuacuccgaccacggcgucugcaaggccugccacuccuccugccucgccugcaugggccccgcccccucccacugcaccggcugcaagaagcccgaggagggccuccaggucgagcagcucuccgacgucggcauccccuccggcgagugccucgcccagugccgcgcccacuucuaccucgaguccaccggcaucugcgaggccugccaccaguccugcuuccgcugcgccggcaaguccccccacaacugcaccgacugcggccccucccacguccuccucgacggccagugccucucccagugccccgacggcuacuuccaccaggagggcuccugcaccgagugccaccccaccugccgccagugccacggcccccucgaguccgacugcaucuccugcuacccccacaucucccucaccaacggcaacugccgcaccuccugccgcgaggagcaguuccucaaccucgucggcuacugcgccgacugccaccaccucugccagcacugcgccgccgaccuccacaacaccggcuccaucugccuccgcugccagaacgcccacuaccuccuccucggcgaccacugcguccccgacugccccuccggcuacuacgccgagcgcggcgccugcaagaagugccacuccuccugccgcaccugccagggccgcggccccuucuccugcuccuccugcgacaccaaccucguccucucccacaccggcaccugcuccaccaccugcuuccccggccacuaccucgacgacaaccacgucugccagcccugcaacacccacugcggcuccugcgacucccaggccuccugcaccuccugccgcgaccccaacaagguccuccucuucggcgagugccaguacgaguccugcgccccccaguacuaccucgacuucuccaccaacaccugcaaggagugcgacugguccugcuccgccugcuccggcccccucaagaccgacugccuccagugcauggacggcuacguccuccaggacggcgccugcgucgagcagugccucuccuccuucuaccaggacuccggccucugcaagaacugcgacuccuacugccuccagugccagggcccccacgagugcacccgcugcaagggccccuuccuccuccucgaggcccagugcguccaggagugcggcaagggcuacuucgccgaccacgccaagcacaagugcaccgccugcccccagggcugccuccagugcucccaccgcgaccgcugccaccucugcgaccacggcuucuuccucaaguccggccucugcgucuacaacugcguccccggcuucuccguccacaccuccaacgagaccugcuccggcaagauccacacccccucccuccacgucaacggcucccucauccuccccaucggcuccaucaagccccucgacuucucccuccucaacguccaggaccaggagggccgcgucgaggaccuccucuuccacgucgucuccacccccaccaacggccagcucguccucucccgcaacggcaaggagguccagcucgacaaggccggccgcuucuccuggaaggacgucaacgagaagaagguccgcuucguccacuccaaggagaagcuccgcaagggcuaccucuuccucaagaucuccgaccagcaguucuucuccgagccccagcucaucaacauccaggccuucuccacccaggcccccuacguccuccgcaacgagguccuccacaucucccgcggcgagcgcgccaccaucaccacccagaugcucgacauccgcgacgacgacaacccccaggacgucgucaucgagaucaucgaccccccccuccacggccagcuccuccagacccuccagucccccgccacccccaucuaccaguuccagcucgacgagcucucccgcggccuccuccacuacgcccacgacggcuccgacuccaccuccgacgucgccguccuccaggccaacgacggccacuccuuccacaacauccucuuccaggucaagaccgucccccagaacgaccgcggccuccagcucgucgccaacuccauggucuggguccccgagggcggcaugcuccagaucaccaaccgcauccuccaggccgaggcccccggcgccuccgccgaggagaucaucuacaagaucacccaggacuacccccaguucggcgaggucguccuccucgucaacaugcccgccgacucccccgccgacgagggccagcaccuccccgacggccgcaccgccacccccaccuccaccuucacccagcaggacaucaacgagggcaucgucugguaccgccacuccggcgcccccgcccaguccgacuccuuccgcuucgaggucuccuccgccuccaacgcccagacccgccucgagucccacauguucaacaucgccauccucccccagacccccgaggcccccaaggucucccucgaggccucccuccacaugaccgcccgcgaggacggccucaccgucauccagccccacucccucuccuucaucaacuccgagaagcccuccggcaagaucgucuacaacaucacccucccccuccaccccaaccagggcaucaucgagcaccgcgaccacccccacucccccauccgcuacuucacccaggaggacaucaaccagggcaaggucauguaccgccccccccccgccgccccccaccuccaggagcucauggccuucuccuucgccggccuccccgaguccgucaaguuccacuucaccgucuccgacggcgagcacaccucccccgagaugguccucaccauccaccuccuccccuccgaccagcagcuccccgucuuccaggucaccgccccccgccucgccgucucccccggcggcuccaccuccgucggccuccaggucgucguccgcgacgccgagaccgcccccaaggagcucuucuucgagcuccgccgccccccccagcacggcguccuccucaagcacaccgccgaguuccgccgccccauggccaccggcgacaccuucaccuacgaggacgucgagaagaacgcccuccaguacauccacgacggcuccuccacccgcgaggacuccauggagaucuccgucaccgacggccucaccgucaccaugcucgagguccgcgucgaggucucccucuccgaggaccgcggcccccgccucgccgccggcuccucccucuccaucaccgucgccuccaaguccaccgccaucaucacccgcucccaccucgccuacgucgacgacuccucccccgaccccgagaucuggauccagcucaacuaccuccccuccuacggcacccuccuccgcaucuccggcuccgaggucgaggagcucuccgaggucuccaacuucaccauggaggacaucaacaacaagaagauccgcuacuccgccgucuucgagaccgacggccaccucgucaccgacuccuucuacuucuccgucuccgacauggaccacaaccaccucgacaaccagaucuucaccaucaugaucacccccgccgagaaccccccccccgucaucgccuucgccgaccucaucaccgucgacgagggcggccgcgccccccucuccuuccaccacuucuucgccaccgacgacgacgacaaccuccagcgcgacgccaucaucaagcucuccgcccuccccaaguacggcugcaucgagaacaccggcaccggcgaccgcuucggccccgagaccgccuccgaccucgaggccuccuuccccauccaggacguccucgagaacuacaucuacuacuuccaguccguccacgaguccaucgagcccacccacgacaucuucuccuucuacgucuccgacggcaccucccgcuccgagauccacuccaucaacaucaccaucgaggucaagacccucgaggucggcaaggucgagccccucaccaccaucuuccacaccauccgcgagcucucccucuga

SEQ ID NO: 43344 - RNA, 840 nt, Artificial Sequence
  derived and/or modified sequence opt2 from FRAT1__Homo_sapiens__NP_005470
augcccugccgccgcgaggaggaggaggaggccggcgaggaggccgagggcgaggaggaggaggaggacuccuuccuccuccuccagcaguccgucgcccucggcuccuccggcgaggucgaccgccucgucgcccagaucggcgagacccuccagcucgacgccgcccagcacucccccgccucccccugcggcccccccggcgccccccuccgcgcccccggcccccucgccgccgccguccccgccgacaaggcccgcucccccgccgucccccuccuccucccccccgcccucgccgagaccgucggccccgccccccccggcguccuccgcugcgcccucggcgaccgcggccgcguccgcggccgcgccgcccccuacugcgucgccgagcucgccaccggccccuccgcccucuccccccuccccccccaggccgaccucgacggcccccccggcgccggcaagcagggcaucccccagccccucuccggccccugccgccgcggcuggcuccgcggcgccgccgccucccgccgccuccagcagcgccgcggcucccagcccgagacccgcaccggcgacgacgacccccaccgccuccuccagcagcucguccucuccggcaaccucaucaaggaggccguccgccgccuccacucccgccgccuccagcuccgcgccaagcucccccagcgcccccuccucggcccccucuccgcccccguccacgagccccccuccccccgcuccccccgcgccgccugcuccgaccccggcgccuccggccgcgcccagcuccgcaccggcgacggcguccucguccccggcuccuga

SEQ ID NO: 43345 - RNA, 702 nt, Artificial Sequence
  derived and/or modified sequence opt2 from FRAT2__Homo_sapiens__NP_036215
augcccugccgccgcgaggaggaggaggaggccggcgaggaggccgagggcgaggaggaggaggacgacuccuuccuccuccuccagcaguccgucacccucggcuccuccggcgaggucgaccgccucgucgcccagaucggcgagacccuccagcucgacgccgcccaggacucccccgccucccccugcgccccccccggcgucccccuccgcgcccccggcccccucgccgccgccguccccgccgacaaggcccgcccccccgccgucccccuccuccucccccccgccuccgccgagaccgucggccccgcccccuccggcgcccuccgcugcgcccucggcgaccgcggccgcguccgcggccgcgccgcccccuacugcgucgccgaggucgccgccggccccuccgcccuccccggccccugccgccgcggcuggcuccgcgacgccgucaccucccgccgccuccagcagcgccgcuggacccaggccggcgcccgcgccggcgacgacgacccccaccgccuccuccagcagcucguccucuccggcaaccucaucaaggaggccguccgccgccuccagcgcgccgucgccgccgucgccgccaccggccccgccuccgcccccggccccggcggcggccgcuccggccccgaccgcaucgcccuccagcccuccggcucccuccucuga

SEQ ID NO: 43346 - RNA, 2148 nt, Artificial Sequence
  derived and/or modified sequence opt2 from FREM1__Homo_sapiens__XP_006716792
auggucacccaggaguccaugcucaaggccgcccucccccucuucacccgcuucaucaucuccaacggccuccgcaccgagcacggcgucuucgagaucacccucgagaccgucgaccgcgcccuccccgucgucacccgcaacaagggccuccgccucgcccagggcgccgucggccuccucucccccgaccuccuccagcucaccgaccccgacacccccgccgagaaccucaccuuccuccucguccagcucccccagcacggccagcucuaccucuggggcaccggccuccuccagcacaacuucacccagcaggacgucgacuccaagaacgucgccuaccgccacuccggcggcgacucccagaccgacugcuucaccuucauggccaccgacggcaccaaccagggcuucaucgucaacggccgcgucugggaggagcccguccucuucaccauccaggucgaccagcucgacaagaccgccccccgcaucacccuccuccacucccccucccaggucggccuccucaagaacggcugcuacggcaucuacaucaccucccgcguccucaaggccuccgaccccgacaccgaggacgaccagaucaucuucaagauccuccagggccccaagcacggccaccucgagaacaccaccaccggcgaguucauccacgagaaguucucccagaaggaccucaacuccaagaccauccucuacaucaucaaccccucccucgaggucaacuccgacaccgucgaguuccagaucauggaccccaccggcaacuccgccaccccccagauccucgagcucaaguggucccacaucgaguggucccagaccgaguacgaggucugcgagaacgucggccuccucccccucgagaucauccgccgcggcuacuccauggacuccgccuucgucggcaucaaggucaaccaggucuccgccgccgucggcaaggacuucaccgucauccccuccaagcucauccaguucgaccccggcauguccaccaagauguggaacaucgccaucaccuacgacggccucgaggaggacgacgaggucuucgaggucauccucaacucccccgucaacgccguccucggcaccaagaccaaggccgccgucaagauccucgacuccaagggcggccagugccaccccuccuacuccuccaaccaguccaagcacuccaccugggagaagggcaucuggcaccuccucccccccggcuccuccuccuccaccaccuccggcuccuuccaccucgagcgccgcccccuccccuccuccaugcagcucgccgucauccgcggcgacacccuccgcggcuucgacuccaccgaccucucccagcgcaagcuccgcacccgcggcaacggcaagaccguccgccccuccuccgucuaccgcaacggcaccgacaucaucuacaacuaccacggcaucgucucccucaagcucgaggacgacuccuuccccacccacaagcgcaaggccaaggucuccaucaucucccagccccagaagaccaucaaggucgccgagcucccccaggccgacaaggucgaguccaccaccgacucccacuucccccgccaggaccagcuccccuccuuccccaagaacugcacccucgagcucaagggccucuuccacuucgaggagggcauccagaagcucuaccagugcaacggcaucgccuggaaggccugguccccccagaccaaggacgucgaggacaaguccugccccgccggcuggcaccagcacuccggcuacugccacauccucaucaccgagcagaagggcaccuggaacgccgccgcccaggccugccgcgagcaguaccucggcaaccucgucaccgucuucucccgccagcacaugcgcuggcucugggacaucggcggccgcaaguccuucuggaucggccucaacgaccagguccacgccggccacugggaguggaucggcggcgagcccgucgccuucaccaacggccgccgcggccccucccagcgcuccaagcucggcaaguccugcguccucguccagcgccagggcaaguggcagaccaaggacugccgccgcgccaagccccacaacuacgucugcucccgcaagcucuga

SEQ ID NO: 43347 - RNA, 9510 nt, Artificial Sequence
  derived and/or modified sequence opt2 from FREM2__Homo_sapiens__NP_997244
augcacuccgccggcacccccggccucuccucccgccgcaccggcaacuccaccuccuuccagcccggcccccccccccccccccgccuccuccuccuccuccuccuccuccucucccucgucucccgcguccccgcccagcccgccgccuucggccgcgcccuccucucccccggccucgccggcgccgccggcguccccgccgaggaggccaucguccucgccaaccgcggccuccgcguccccuucggccgcgaggucuggcucgacccccuccacgaccucguccuccagguccagcccggcgaccgcugcgccgucuccguccucgacaacgacgcccucgcccagcgccccggccgccucucccccaagcgcuuccccugcgacuucggccccggcgagguccgcuacucccaccucggcgcccgcucccccucccgcgaccgcguccgccuccagcuccgcuacgacgcccccggcggcgccgucguccucccccucguccucgaggucgaggucgucuucacccagcucgaggucgucacccgcaaccucccccucgucgucgaggagcuccucggcaccuccaacgcccucgacgcccgcucccucgaguucgccuuccagcccgagaccgaggagugccgcgucggcauccucuccggccucggcgcccucccccgcuacggcgagcuccuccacuacccccagguccccggcggcgcccgcgagggcggcgcccccgagacccuccucauggacugcaaggccuuccaggagcucggcguccgcuaccgccacaccgccgccucccgcucccccaaccgcgacuggauccccauggucgucgagcuccgcucccgcggcgcccccgucggcucccccgcccucaagcgcgagcacuuccagguccucguccgcauccgcggcggcgccgagaacaccgcccccaagcccuccuucgucgccaugaugaugauggaggucgaccaguucguccucaccgcccucacccccgacaugcucgccgccgaggacgccgagucccccuccgaccuccucaucuucaaccucaccucccccuuccagcccggccagggcuaccucgucuccaccgacgaccgcucccucccccucuccuccuucacccagcgcgaccuccgccuccucaagaucgccuaccagccccccuccgaggacuccgaccaggagcgccucuucgagcucgagcucgaggucgucgaccucgagggcgccgccuccgaccccuucgccuucauggucgucgucaagcccaugaacaccauggcccccgucgucacccgcaacaccggccucauccucuacgagggccagucccgcccccucaccggccccgccggcuccggcccccagaaccucgucaucuccgacgaggacgaccucgaggccguccgccucgaggucgucgccggccuccgccacggccaccucgucauccucggcgccuccuccggcuccuccgcccccaaguccuucaccgucgccgagcucgccgccggccaggucgucuaccagcacgacgaccgcgacggcucccucuccgacaaccucguccuccgcauggucgacggcggcggccgccaccagguccaguuccucuuccccaucacccucguccccgucgacgaccagccccccguccucaacgccaacaccggccucacccucgccgagggcgagaccguccccauccucccccucucccucuccgccaccgacauggacuccgacgacucccuccuccucuucguccucgagucccccuuccucaccaccggccaccuccuccuccgccagacccaccccccccacgagaagcaggagcuccuccgcggccucuggcgcaaggagggcgccuucuacgagcgcaccgucaccgaguggcagcagcaggacaucaccgagggccgccucuucuaccgccacuccggcccccacucccccggccccgucaccgaccaguucaccuuccgcguccaggacaaccacgacccccccaaccaguccggccuccagcgcuucgucauccgcauccaccccgucgaccgccucccccccgagcucggcuccggcugcccccuccgcauggucguccaggagucccagcucaccccccuccgcaagaaguggcuccgcuacaccgaccucgacaccgacgaccgcgagcuccgcuacaccgucacccagccccccaccgacaccgacgagaaccaccuccccgccccccucggcacccucguccucaccgacaaccccuccgucgucgucacccacuucacccaggcccagaucaaccaccacaagaucgccuaccgcccccccggccaggagcucggcgucgccacccgcgucgcccaguuccaguuccaggucgaggaccgcgccggcaacgucgcccccggcaccuucacccucuaccuccaccccgucgacaaccagccccccgagauccucaacaccggcuucaccauccaggagaagggccaccacauccucuccgagaccgagcuccacgucaacgacgucgacaccgacgucgcccacaucuccuucacccucacccaggcccccaagcacggccacaugcgcgucuccggccagauccuccacgucggcggccucuuccaccucgaggacaucaagcagggccgcgucuccuacgcccacaacggcgacaagucccucaccgacuccugcucccucgaggucuccgaccgccaccacgucguccccaucacccuccgcgucaacguccgccccgucgacgacgagguccccauccucucccaccccaccggcacccucgaguccuaccucgacguccucgagaacggcgccaccgagaucaccgccaacgucaucaagggcaccaacgaggagaccgacgaccucaugcucaccuuccuccucgaggaccccccccucuacggcgagauccucgucaacggcauccccgccgagcaguucacccagcgcgacauccucgagggcuccgucgucuacacccacaccuccggcgagaucggccuccuccccaaggccgacuccuucaaccucucccucuccgacaugucccaggaguggcgcaucggcggcaacaccauccagggcgucaccaucugggucaccauccuccccgucgacucccaggcccccgagaucuucgucggcgagcagcucaucgucauggagggcgacaaguccgucaucaccuccguccacaucuccgccgaggacgucgacucccucaacgacgacauccucugcaccaucgucauccagcccaccuccggcuacgucgagaacaucucccccgcccccggcuccgagaagucccgcgccggcaucgccaucuccgccuucaaccucaaggaccuccgccagggccacaucaacuacguccaguccguccacaagggcgucgagcccgucgaggaccgcuucgucuuccgcugcuccgacggcaucaacuucuccgagcgccaguucuuccccaucgucaucauccccaccaacgacgagcagcccgagauguucaugcgcgaguucauggucauggagggcaugucccucgucaucgacacccccauccucaacgccgccgacgccgacgucccccucgacgaccucaccuucaccaucacccaguuccccacccacggccacaucaugaaccagcucaucaacggcaccguccucgucgaguccuucacccucgaccagaucaucgaguccuccuccaucaucuacgagcacgacgacuccgagacccaggaggacuccuucgucaucaagcucaccgacggcaagcacuccgucgagaagaccguccucaucaucgucauccccgucgacgacgagaccccccgcaugaccaucaacaacggccucgagaucgagaucggcgacaccaagaucaucaacaacaagauccucauggccaccgaccucgacuccgaggacaagucccucgucuacaucauccgcuacggccccggccacggccuccuccagcgccgcaagcccaccggcgccuucgagaacaucacccucggcaugaacuucacccaggacgaggucgaccgcaaccucauccaguacguccaccucggccaggagggcauccgcgaccucaucaaguucgacgucaccgacggcaucaacccccucaucgaccgcuacuucuacgucuccaucggcuccaucgacaucgucuuccccgacgucaucuccaagggcgucucccucaaggagggcggcaaggucacccucaccaccgaccuccucuccaccuccgaccucaacucccccgacgagaaccucgucuucaccaucacccgcgcccccaugcgcggccaccucgagugcaccgaccagcccggcgucuccaucaccuccuucacccagcuccagcucgccggcaacaagaucuacuacauccacaccgccgacgacgaggucaagauggacuccuucgaguuccaggucaccgacggccgcaaccccgucuuccgcaccuuccgcaucuccaucuccgacgucgacaacaagaagcccgucgucaccauccacaagcucgucgucuccgaguccgagaacaagcucaucacccccuucgagcucaccgucgaggaccgcgacacccccgacaagcuccucaaguucaccaucacccagguccccauccacggccaccuccucuucaacaacacccgccccgucauggucuucaccaagcaggaccucaacgagaaccucaucuccuacaagcacgacggcaccgaguccuccgaggacuccuucuccuucaccgucaccgacggcacccacaccgacuucuacgucuuccccgacaccgucuucgagacccgccgcccccaggucaugaagauccagguccucgccgucgacaacuccgucccccagaucgccgucaacaagggcgccuccacccuccgcacccucgccaccggccaccucggcuucaugaucaccuccaagauccucaaggucgaggaccgcgacucccuccacaucucccuccgcuucaucgucaccgaggccccccagcacggcuaccuccucaaccucgacaagggcaaccacuccaucacccaguucacccaggccgacaucgacgacaugaagaucugcuacguccuccgcgagggcgccaacgccaccuccgacauguucuacuucgccgucgaggacggcggcggcaacaagcucaccuaccagaacuuccgccucaacugggccuggaucuccuucgagaaggaguacuaccucgucaacgaggacuccaaguuccucgacgucguccucaagcgccgcggcuaccucggcgagaccuccuucaucuccaucggcacccgcgaccgcaccgccgagaaggacaaggacuucaagggcaaggcccagaagcagguccaguucaaccccggccagacccgcgccaccuggcgcguccgcauccucuccgacggcgagcacgagcaguccgagaccuuccaggucguccucuccgagcccguccucgccgcccucgaguuccccaccgucgccaccgucgagaucgucgaccccggcgacgagcccaccgucuucaucccccaguccaaguacuccgucgaggaggacgucggcgagcucuucauccccauccgccgcuccggcgacgucucccaggagcucauggucgucugcuacacccagcagggcaccgccaccggcaccguccccaccuccguccucuccuacuccgacuacaucucccgccccgaggaccacaccuccgucguccgcuucgacaaggacgagcgcgagaagcucugccgcaucgucaucaucgacgacucccucuacgaggaggaggagaccuuccacguccuccucuccaugcccaugggcggccgcaucggcuccgaguuccccggcgcccaggucaccaucguccccgacaaggacgacgagcccaucuucuacuucggcgacgucgaguacuccgucgacgaguccgccggcuacgucgagguccaggucuggcgcaccggcaccgaccucuccaaguccuccuccgucaccguccgcucccgcaagaccgacccccccuccgccgacgccggcaccgacuacgucggcaucucccgcaaccucgacuucgcccccggcgucaacaugcagcccguccgcgucgucauccucgacgaccucggccagcccgcccucgagggcaucgagaaguucgagcucguccuccgcaugcccaugaacgccgcccucggcgagcccuccaaggccaccgucuccaucaacgacuccgucuccgaccuccccaagaugcaguucaaggagcgcaucuacaccggcuccgaguccgacggccagaucgucaccaugauccaccgcaccggcgacguccaguaccgcuccuccguccgcugcuacacccgccagggcuccgcccaggucaugauggacuucgaggagcgccccaacaccgacaccuccaucaucaccuuccuccccggcgagaccgagaagcccugcauccucgagcucauggacgacguccucuacgaggaggucgaggagcuccgccucguccucggcaccccccaguccaacucccccuucggcgccgccgucggcgagcagaacgagacccucauccgcauccgcgacgacgccgacaagaccgucaucaaguucggcgagaccaaguucuccgucaccgagcccaaggagcccggcgaguccgucgucauccgcauccccgucauccgccagggcgacaccuccaaggucuccaucguccgcguccacaccaaggacggcuccgccaccuccggcgaggacuaccaccccgucuccgaggagaucgaguucaaggagggcgagacccagcacgucgucgagaucgaggucaccuucgacggcguccgcgagaugcgcgaggccuucaccguccaccucaagcccgacgagaacaugaucgccgagaugcagcucaccaaggccaucgucuacaucgaggagauguccuccauggccgacgucaccuuccccuccgucccccagaucgucucccuccucauguacgacgacaccuccaaggccaaggaguccgccgagcccauguccggcuaccccgucaucugcaucaccgccugcaaccccaaguacuccgacuacgacaagaccggcuccaucugcgccuccgagaacaucaacgacacccucacccgcuaccgcuggcucaucuccgcccccgccggccccgacggcgucaccucccccaugcgcgaggucgacuucgacaccuucuucaccuccuccaagauggucacccucgacuccaucuacuuccagcccggcucccgcguccagugcgccgcccgcgccgucaacaccaacggcgacgagggccucgagcucaugucccccaucgucaccaucucccgcgaggagggccucugccagccccgcguccccggcgucgucggcgccgagcccuucuccgccaagcuccgcuacaccggccccgaggacgccgacuacaccaaccucaucaagcucaccgucaccaugccccacaucgacggcaugcuccccgucaucuccacccgcgagcucuccaacuucgagcucacccucucccccgacggcacccgcgucggcaaccacaagugcuccaaccuccucgacuacaccgaggucaagacccacuacggcuuccucaccgacgccaccaagaaccccgagaucaucggcgagaccuaccccuaccaguacucccucuccauccgcggcuccaccacccuccgcuucuaccgcaaccucaaccucgaggccugccucugggaguucgucuccuacuacgacauguccgagcuccucgccgacugcggcggcaccaucggcaccgacggccagguccucaaccucguccaguccuacgucacccuccgcgucccccucuacgucuccuacgucuuccacucccccgucggcgucggcggcuggcagcacuucgaccucaaguccgagcuccgccucaccuucgucuacgacaccgccauccucuggaacgacggcaucggcuccccccccgaggccgagcuccagggcucccucuaccccaccuccaugcgcaucggcgacgagggccgccucgccguccacuucaagaccgaggcccaguuccacggccucuucguccucucccaccccgccuccuucaccuccuccgucaucauguccgccgaccaccccggccucaccuucucccuccgccucauccgcuccgagcccaccuacaaccagcccguccagcagugguccuucgucuccgacuucgccguccgcgacuacuccggcaccuacaccgucaagcucguccccugcaccgcccccucccaccaggaguaccgccuccccgucaccugcaacccccgcgagcccgucaccuucgaccucgacauccgcuuccagcaggucuccgaccccgucgccgccgaguucucccucaacacccagauguaccuccucuccaagaagucccucuggcucuccgacggcuccaugggcuucggccaggaguccgacgucgccuucgccgagggcgacaucaucuacggccgcgucauggucgaccccguccagaaccucggcgacuccuucuacugcuccaucgagaaggucuuccucugcaccggcgccgacggcuacguccccaaguacucccccaugaacgccgaguacggcugccucgccgacucccccucccuccucuaccgcuucaagaucgucgacaaggcccagcccgagacccaggccaccuccuucggcaacguccucuucaacgccaagcucgccgucgacgaccccgaggccauccuccucgucaaccagcccggcuccgacggcuucaaggucgacuccaccccccucuuccaggucgcccucggccgcgagugguacauccacaccaucuacaccguccgcuccaaggacaacgccaaccgcggcaucggcaagcgcuccgucgaguaccacucccucgucucccagggcaagccccaguccaccaccaagucccgcaagaagcgcgagauccgcuccacccccucccucgccugggagaucggcgccgagaacucccgcggcaccaacauccagcacaucgcccucgaccgcaccaagcgccagaucccccacggccgcgccccccccgacggcauccuccccugggagcucaacucccccuccuccgccgucucccucgucaccgucgucggcggcaccaccgucggccuccucaccaucugccucaccgucaucgccguccucaugugccgcggcaaggaguccuuccgcggcaaggacgcccccaagggcuccuccuccuccgagcccaugguccccccccagucccaccacaacgacuccuccgaggucuga

SEQ ID NO: 43348 - RNA, 6420 nt, Artificial Sequence
  derived and/or modified sequence opt2 from FREM3__Homo_sapiens__NP_001161707
auggccggcgccucccgccaccccaccggcaccccccgccagcuccucgucgcccucgccugccuccuccucucccgccccgcccuccagggccgcgccuccucccucggcaccgagcccgaccccgcccucuaccuccccgcccgcggcgcccucgacggcacccgccccgacggccccuccguccucaucgccaaccccggccuccgcgucccccucggccgcucccucuggcucgacccccuccgcgaccucgucaucggcguccagcccggcgaccgcugcgaggucaccguccucgacgcccucccccgccucaagggcgcccucuccccccgccgcuuccccugcaccuucggcccccgccagguccaguacacccacuucggcucccacucccccggccgcgcccgcguccuccuccagcuccgcuacgacgcccccacccacacccucguccuccccuucacccucgccgucgaccucgucuucucccagcucgagcucgucacccgcaaccgcccccucgucgucgagaagcuccgcuccuggucccgcgccaucgaccgccgcguccucgacuucgccucccucaaguccggcgccaccgccacccgccgcugccgccucaccccccucccccacgaggacggcccccuccccaaguacggccgccucgucgacgccgucggcgccccccucccccgcggcaagggcgucgacugcgaggccuuccuccgcgccggcguccgcuaccagcacaccgccaccuccucccccaaccgcgacuacguccccaugauggucgagcuccucggccccgagggccaggacgccggcuccgccggcguccucguccgcgagcacuuccagcuccucguccgcauccgcggcggcgccgagaacacccccccccgccccuccuucauggccaccaugaugauggaggucgacccccucguccucaccgcccucacccccgacgcccucgccgccgaggacgucgaguccgaccccggcgaccucgucuucaacauccucaacgcccccacccacccccccggccaccccggccagcagggcuacgucgucuccaccgacgacccccucggccuccccgucuccuucuucacccagcaggagcuccgcgagcucaagaucgccuaccagccccccgccgagaacucccacggcgagcgccucuuccagcucgagcucgaggucgucgacggcgacggcgccgccuccgaccccuucgccuucauggucaccgucaaguccaugaacacccucguccccgucgccucccacaaccgcggccucguccucuucgagggccagucccgcccccucuccuccacccacuccauccccaucuccgacaaggacaaccucgaggaggucaagauggccgccguccgcggccuccgccacggccagcucgucgucuucggcgcccccgccggcugcaaguacuucacccccgccgaccucgccgccggccgcgucgucuaccagcacgacggcuccaacaccuacuccgacaacaucaucuuccgcauggaggacggccaccaccaggucgacuuccucuucccccucaccauccuccccgucgacgacgagccccccauggucaacaccaacaccggccucucccucaccgagggccaggucguccagaucucccccuucguccucuccgccaccgacaucgacuccgaggacuccaccauccacuucguccucgagaaccagccccucaagggcaacgaggaggagccccagugggagcucgcccccggcuccucccacuccggccacuaccucggcgaccuccuccuccagcaggccgagcucccccucuccaccgaggacgaggacuggcacuacauggagaaggagggccucuacgagaaggucgucaccgaguggcuccagcgcgacaucauggagggccgccucuucuaccgccaccucggcccccacuccccccaguccgucaugguccagcucgccuuccacguccaggacgaccacgacccccccaaccucuccaagcagcacaucuucaccaucaagguccagcccgucgacauccucuccccccagcucuaccccggcaccacccucgagaugaccguccaggaguaccagcucacccacuuccagaagaacuuccuccgcuacaucgaccaggacuccgacgaccagaaccucugguacacccuccucacccuccccaccgacaccgacggcaaccaccagguccgcgccggcgagaucguccucaccgacucccccgacacccucaucaugcacuucacccaggcccaggucaaccagcacaaggucgccuaccagcccccccagaagcucggcaucgccccccgcgucguccaguucaccuaccaggucgaggacgccgccggcaacuccguccccggcaccuucacccucuuccuccagcccgucgacaaccagccccccgaggucaccaaccgcggcuucgccauccucgagggcggcuccuucaaccucuccuccaacgagcuccacgucaccgaccccgacaccgacaucgaccagaucgucuucauccucguccgcggcccccagcacggccaccuccaguacuucaagcgcugcaugguccccggcgaguccuucaugcaggccgacgucaucaacggcuccgucuccuaccagcacggccgcgaccagaccaccaccuccgacaccuuccaccucgaggucuccgacggcguccaccacauccccaucaccauccccaucuccguccaccccaacgucgccaaccgcuccccccgcaucucccuccgcuccuccucccuccucgacgucuccaucgacguccucgagaacaaggccaccgagaucaccaugggcgucauccacggcaagcgcaaggacgucggcgaccucaugcucuccuucaucgucaaggacucccccaagcucggcaccauccucgucaacggccuccccaccgagcgcuucacccaggaggaccucaucaacggccgcgucgccuacgcccacaccgccggcgaggucggcuuccagaagcagcacgacgccuucucccucauccucuccaaggacuccuaccagugggucgucggcaacuccaucaucgagaagguccagguccaggucaccguccuccccgucgacaacgucggccccaaggucuucgucggcgaguccuucaucgucuacgagggcgagaagaacucccucacccuccagcaccuccacgucgaggacgucgacacccaccaggacgagcuccucugcaccgucaccucccagcccgccuccggcuaccucgagaagaucgccuccgcccccggcuccaagaugucccaguccggcucccccaucuccgccuucucccuccgcgacauccagguccgccacaucaacuacguccaguccauccacaagggcgucgagccccaggaggaccaguucaccuucuacugcuccgacggcaucaacuucucccccaacgucuucuuccccaucaucauccuccccaccaacgacgagcagcccaagcucuucgcccacgaguucaagguccucgagggcaugucccucgucaucgacacccagcuccucaacggcgccgacgccgaccucccccccaacgagcuccacuuccagcucaccgcccucccccgccacggccgcaucauccagcagcucgccaccggcucccagcccauccacuccuucacccucaaggagauccaggaggccuccaccaucgucuacgagcacgacgacuccgagaccaaggaggacuccuucgaggucuggcucuccgacggcaagcacaccacccaccgcaagguccccaucgucgucacccucgucgacgacgagaccccccaccucaccgucaacaacggccucaaggucgagaagggccacuccgagaucaucaccaaccgcauccucaaggccaccgaccucgacuccgacgacaagucccucuccuucguccuccacuccggcccccagcagggccuccuccagcgccuccgcaagccccgcggcgagguccgcaacaaccucacccucggcaugaacuucacccaggacgagaucaaccgcggccucaucugcuacauccacaccggccaggagggcaucgucgacaucaucaaguucgacgucaccgacggcgucaacacccucaccgaccacuacuucuacgucaccaucggcaaccucgacuccgucuuccccgaggucaucuccaagcgcaucacccucaucgagggcgcccgcgucacccucaccaacaaccuccucaccaacuccgacaucaacuccuccgacgagcaccacuucuccaucacccgcgcccccucccucggccaccucgaguccuccgacuacgccggcgagcccaucgccuccuucacccagcuccagcucgccuccaacaagaucuccuacguccacaccuccaacgacgagaagaagauggacuccuucgaguuccaggucaucggcgagcucuaccccgucuuccgcaccuuccgcaucuucaucaccgacgucgacaacaagaagcccauccucaccauccaccgccucacccuccagaaggaggacucccagcucaucacccuccucgagcucaccgucgaggacuccgacacccccgacgaccucauccucuucaccaucacccagguccccaugcacggcaagauccucuacaacggcucccgccccgucaccaccuucaccaagcaggaccucaacaagaaccucaucuccuacaagcacgacggcuccgagaccaccgaggacuccuucucccucaccgucaccgacggcacccacaccgacuucuacguccuccccgacaccgcccucgccacccacaagccccaggucaugcgcguccagauccgcucccucgacaaccgccucccccagaucaccaccaaccgcggcgcccccgcccucaagcgccuccacaccggccacaugggcuuccucaucaccuccaagucccucaaggccgaggaccaggacuccccccaccgccuccucaaguacaaggucacccgcggccccgagcacggcuucaucaucaagaccggccucggcaaccaguccacccgcgucuucacccaggccgacaucgacgagaugaagaucuccuacguccucaacgagggcuccaacgccuccaaggacaucuucuacuucuccgucgaggacaacggcggcaacaagcucaccaaccagcccuuccaccucaacugggccuggaucugccucgagaaggaguacuacaucgucgacgaggacuccaccuuccucgaggucacccucacccgccgcggcuaccucggcgagaccuccuucaucuccaucggcaccaaggacgagaccgccaagaaggacaaggacuucaaguggaagaccaacaagcagauccaguucaaccccggccagaccaccgccaccuggcgcguccgcaucauccccgacaacgaguacgagaccuccgagaccuuccagaucauccucuccgagccccucauggccguccucgaguuccccgagauggccaccgucgagaucgucgaccccggcgacgaguccaccgucuacauccccgaggccgaguacaagaucgaggaggacaucggcgagcuccucauccccguccgccgcuccggcgacgccucccaggagcucaucgucaucugcuccacccgccagggcuccgccaccggcaccaucuccuccaccguccucuucuccgacuacaucucccgccccgaggaccacaccuccauccuccacuucgacaagaacgagacccagaagaccugccagguccucaucaucgacgacucccucuacgaggaggaggaguccuucuccgucucccuccgccuccccgucggcggccagcucggcgcccgcuuccccaccaccaaggucaccauccucgccgaccgcuacgacgagcccguccuccacuucggcgacgccgaguaccacgucaacgaguccgcccgcuacgucgaggucugcgucuggcgccgcggcaccgaccucucccagcccuccuccaucgccguccgcucccgcaaguccgagcaggaguccgccgaggccggcaccgacuacgucggcaucucccgcaaccucgacuucgcccccggcguccgcaugcagaccuuccaggucaccauccucgacgaccucggccagcccacccucgagggccccgagaaguucgagcuccuccuccagaugcccaugggcgccguccucggcgagcccaacaagaccaccaucuucaucgaggacaccaucaccgacugcaagcaguccgccugcuccuccuucgacuga

SEQ ID NO: 43349 - RNA, 777 nt, Artificial Sequence
  derived and/or modified sequence opt2 from FRG1__Homo_sapiens__NP_004468
auggccgaguacuccuacgucaaguccaccaagcucguccucaagggcaccaagaccaaguccaagaagaagaaguccaaggacaagaagcgcaagcgcgaggaggacgaggagacccagcucgacaucgucggcaucugguggaccgucaccaacuucggcgagaucuccggcaccaucgccaucgagauggacaagggcaccuacauccacgcccucgacaacggccucuucacccucggcgccccccacaaggaggucgacgagggccccuccccccccgagcaguucaccgccgucaagcucuccgacucccgcaucgcccucaaguccggcuacggcaaguaccucggcaucaacuccgacggccucgucgucggccgcuccgacgccaucggcccccgcgagcagugggagcccgucuuccagaacggcaagauggcccuccucgccuccaacuccugcuucauccgcugcaacgaggccggcgacaucgaggccaaguccaagaccgccggcgaggaggagaugaucaagauccgcuccugcgccgagcgcgagaccaagaagaaggacgacauccccgaggaggacaagggcaacgucaagcagugcgagaucaacuacgucaagaaguuccaguccuuccaggaccacaagcucaagaucuccaaggaggacuccaagauccucaagaaggcccgcaaggacggcuuccuccacgagacccuccucgaccgccgcgccaagcucaaggccgaccgcuacugcaaguga

SEQ ID NO: 43350 - RNA, 837 nt, Artificial Sequence
  derived and/or modified sequence opt2 from FRG2__Homo_sapiens__NP_001005217
augggcaagggcaacgaggacuccgaccuccacugcuccuccauccagugcuccaccgaccagccccccuuccagcagaucuccuucaccgagaagggcuccgacgagaagaagcccuucaaggagaagggcaagaccgccuucucccacuccuccgagaagcacauccagcgccagggcuccgagcccaaccccaacaaggagaacuccgaggagaccaagcucaaggccggcaacuccaccgccggcuccgagcccgaguccuccuccuaccgcgagaacugccgcaagcgcaagauguccuccaaggacuccugccaggacaccgccggcaacugccccgagaaggagugcucccucucccucaacaagaagucccgcuccuccaccgccguccacaacuccgagauccaggagaccugcgacgcccaccaccgcggccacucccgcgccugcaccggccacuccaagcgccaccgcucccgcgcccucggcguccagacccccuccauccgcaagucccucgucaccuccguccgcgccauguccgaggccgucuaccaggaccucgcccaggucugggcccagcagauccacuccccccucaccugcgagcagcucacccuccucacccgccuccgcggcccccucugcgcccagguccagacccucuacuccauggccacccaggccgccuacgucuuccccgccgaguccuggcucguccccgccacccuccccggccccggcgaguccgcccucgaccgcgaggcccaccccuuccccggccaggagaucaccgagaccgucuccggcuccgacgaggccaagcucuga

SEQ ID NO: 43351 - RNA, 1518 nt, Artificial Sequence
  derived and/or modified sequence opt2 from FRK__Homo_sapiens__XP_011533957
auguccaacaucugccagcgccucugggaguaccucgagcccuaccuccccugccucuccaccgaggccgacaaguccaccgucaucgagaaccccggcgcccucugcuccccccagucccagcgccacggccacuacuucgucgcccucuucgacuaccaggcccgcaccgccgaggaccucuccuuccgcgccggcgacaagcuccagguccucgacacccuccacgagggcuggugguucgcccgccaccucgagaagcgccgcgacggcuccucccagcagcuccagggcuacauccccuccaacuacgucgccgaggaccgcucccuccaggccgagcccugguucuucggcgccaucggccgcuccgacgccgagaagcagcuccucuacuccgagaacaagaccggcuccuuccucauccgcgaguccgagucccagaagggcgaguucucccucuccguccucgacggcgccgucgucaagcacuaccgcaucaagcgccucgacgagggcggcuucuuccucacccgccgccgcaucuucuccacccucaacgaguucgucucccacuacaccaagaccuccgacggccucugcgucaagcucggcaagcccugccucaagauccagguccccgcccccuucgaccucuccuacaagaccgucgaccagugggagaucgaccgcaacuccauccagcuccucaagcgccucggcuccggccaguucggcgaggucugggagggccucuggaacaacaccacccccgucgccgucaagacccucaagcccggcuccauggaccccaacgacuuccuccgcgaggcccagaucaugaagaaccuccgccaccccaagcucauccagcucuacgccgucugcacccucgaggaccccaucuacaucaucaccgagcucaugcgccacggcucccuccaggaguaccuccagaacgacaccggcuccaagauccaccucacccagcaggucgacauggccgcccaggucgccuccggcauggccuaccucgagucccgcaacuacauccaccgcgaccucgccgcccgcaacguccucgucggcgagcacaacaucuacaaggucgccgacuucggccucgcccgcgucuucaaggucgacaacgaggacaucuacgagucccgccacgagaucaagcuccccgucaaguggaccgcccccgaggccauccgcuccaacaaguucuccaucaaguccgacgucugguccuucggcauccuccucuacgagaucaucaccuacggcaagaugcccuacuccggcaugaccggcgcccaggucauccagaugcucgcccagaacuaccgccucccccagcccuccaacugcccccagcaguucuacaacaucaugcucgagugcuggaacgccgagcccaaggagcgccccaccuucgagacccuccgcuggaagcucgaggacuacuucgagaccgacuccuccuacuccgacgccaacaacuucauccgcuga

SEQ ID NO: 43352 - RNA, 1671 nt, Artificial Sequence
  derived and/or modified sequence opt2 from FRMD3__Homo_sapiens__NP_001231888
auguucgccuccugccacugcgucccccgcggccgccgcaccaugaagaugauccacuuccgcuccuccuccgucaagucccucucccaggagaugcgcugcaccauccgccuccucgacgacuccgagaucuccugccacauccagcgcgagaccaagggccaguuccucaucgaccacaucugcaacuacuacucccuccucgagaaggacuacuucggcauccgcuacgucgaccccgagaagcagcgccacuggcucgagcccaacaaguccaucuucaagcagaugaagacccacccccccuacaccaugugcuuccgcgucaaguucuacccccacgagccccucaagaucaaggaggagcucacccgcuaccuccucuaccuccagaucaagcgcgacaucuuccacggccgccuccucugcuccuucuccgacgccgccuaccucggcgccugcaucguccaggccgagcucggcgacuacgaccccgacgagcaccccgagaacuacaucuccgaguucgagaucuuccccaagcagucccagaagcucgagcgcaagaucgucgagauccacaagaacgagcuccgcggccaguccccccccgucgccgaguucaaccuccuccucaaggcccacacccucgagaccuacggcgucgacccccaccccugcaaggacuccaccggcaccaccaccuuccucggcuucaccgccgccggcuucgucgucuuccagggcaacaagcgcauccaccucaucaaguggcccgacgucugcaagcucaaguucgagggcaagaccuucuacgucaucggcacccagaaggagaagaaggccaugcucgccuuccacaccuccacccccgccgccugcaagcaccucuggaagugcggcgucgagaaccaggccuucuacaaguacgccaaguccucccagaucaagaccgucuccuccuccaagaucuucuucaagggcucccgcuuccgcuacuccggcaaggucgccaaggaggucgucgaggccuccuccaagauccagcgcgagccccccgagguccaccgcgccaacaucacccagucccgcuccucccacucccucaacaagcagcucaucaucaacauggagccccuccagccccuccuccccucccccuccgagcaggaggaggagcucccccucggcgagggcgucccccuccccaaggaggagaacaucuccgccccccucaucuccuccucccccgucaaggccgcccgcgaguacgaggacccccccuccgaggaggaggacaagaucaaggaggagccccucaccaucuccgagcucgucuacaaccccuccgccucccuccuccccacccccgucgacgacgacgagaucgacaugcucuucgacugccccucccgccucgagcucgagcgcgaggacaccgacuccuucgaggaccucgaggccgacgagaacgccuuccucaucgccgaggaggaggagcucaaggaggcccgccgcgcccucuccugguccuacgacauccucaccggccacauccgcgucaacccccucgucaaguccuucucccgccuccucgucgucggccucggccuccuccucuucgucuucccccuccuccuccuccuccucgaguccgucuccaugcaguga

SEQ ID NO: 43353 - RNA, 3120 nt, Artificial Sequence
  derived and/or modified sequence opt2 from FRMD4A__Homo_sapiens__NP_060497
auggccguccagcucguccccgacuccgcccucggccuccucaugaugaccgagggccgccgcugccagguccaccuccucgacgaccgcaagcucgagcuccucguccagcccaagcuccucgccaaggagcuccucgaccucgucgccucccacuucaaccucaaggagaaggaguacuucggcaucgccuucaccgacgagaccggccaccucaacuggcuccagcucgaccgccgcguccucgagcacgacuuccccaagaaguccggccccgucguccucuacuucugcguccgcuucuacaucgaguccaucuccuaccucaaggacaacgccaccaucgagcucuucuuccucaacgccaaguccugcaucuacaaggagcucaucgacgucgacuccgaggucgucuucgagcucgccuccuacauccuccaggaggccaagggcgacuucuccuccaacgaggucguccgcuccgaccucaagaagcuccccgcccuccccacccaggcccucaaggagcaccccucccucgccuacugcgaggaccgcgucaucgagcacuacaagaagcucaacggccagacccgcggccaggccaucgucaacuacauguccaucgucgagucccuccccaccuacggcguccacuacuacgccgucaaggacaagcagggcauccccugguggcucggccucuccuacaagggcaucuuccaguacgacuaccacgacaaggucaagccccgcaagaucuuccaguggcgccagcucgagaaccucuacuuccgcgagaagaaguucuccgucgagguccacgacccccgccgcgccuccgucacccgccgcaccuucggccacuccggcaucgccguccacaccugguacgccugccccgcccucaucaaguccaucugggccauggccaucucccagcaccaguucuaccucgaccgcaagcaguccaaguccaagauccacgccgcccgcucccucuccgagaucgccaucgaccucaccgagaccggcacccucaagaccuccaagcucgccaacaugggcuccaagggcaagaucaucuccggcuccuccggcucccuccucuccuccggcucccaggaguccgacuccucccaguccgccaagaaggacaugcucgccgcccucaagucccgccaggaggcccucgaggagacccuccgccagcgccucgaggagcucaagaagcucugccuccgcgaggccgagcucaccggcaagcuccccgucgaguacccccucgaccccggcgaggagccccccaucguccgccgccgcaucggcaccgccuucaagcucgacgagcagaagauccuccccaagggcgaggaggccgagcucgagcgccucgagcgcgaguucgccauccagucccagaucaccgaggccgcccgccgccucgccuccgaccccaacgucuccaagaagcucaagaagcagcgcaagaccuccuaccucaacgcccucaagaagcuccaggagaucgagaacgccaucaacgagaaccgcaucaaguccggcaagaagcccacccagcgcgccucccucaucaucgacgacggcaacaucgccuccgaggacuccucccucuccgacgcccucguccucgaggacgaggacucccaggucaccuccaccaucuccccccuccacuccccccacaagggccuccccccccgcccccccucccacaaccgccccccccccccccagucccucgagggccuccgccagaugcacuaccaccgcaacgacuacgacaagucccccaucaagcccaagaugugguccgaguccucccucgacgagcccuacgagaaggucaagaagcgcuccucccacucccacuccuccucccacaagcgcuuccccuccaccggcuccugcgccgaggccggcggcggcuccaacucccuccagaacucccccauccgcggccucccccacuggaacucccaguccuccaugcccuccacccccgaccuccgcguccgcuccccccacuacguccacuccacccgcuccgucgacaucucccccacccgccuccacucccucgcccuccacuuccgccaccgcuccuccucccucgagucccagggcaagcuccucggcuccgagaacgacaccggcucccccgacuucuacaccccccgcacccgcuccuccaacggcuccgaccccauggacgacugcuccuccugcaccucccacuccuccuccgagcacuacuaccccgcccagaugaacgccaacuacuccacccucgccgaggacucccccuccaaggcccgccagcgccagcgccagcgccagcgcgccgccggcgcccucggcuccgccuccuccggcuccaugcccaaccucgccgcccgcggcggcgccggcggcgccggcggcgccggcggcggcgucuaccuccacucccagucccagcccuccucccaguaccgcaucaaggaguacccccucuacaucgagggcggcgccacccccgucgucguccgcucccucgaguccgaccaggagggccacuacuccgucaaggcccaguucaagaccuccaacuccuacaccgccggcggccucuucaaggaguccuggcgcggcggcggcggcgacgagggcgacaccggccgccucacccccucccgcucccagauccuccgcacccccucccucggccgcgagggcgcccacgacaagggcgccggccgcgccgccgucuccgacgagcuccgccagugguaccagcgcuccaccgccucccacaaggagcacucccgccucucccacaccuccuccaccuccuccgacuccggcucccaguacuccaccuccucccaguccaccuucgucgcccacucccgcgucacccgcaugccccagaugugcaaggccaccuccgccgcccucccccagucccagcgcuccuccacccccuccuccgagaucggcgccaccccccccuccuccccccaccacauccucaccuggcagaccggcgaggccaccgagaacucccccauccucgacggcuccgagucccccccccaccaguccaccgacgaguga

SEQ ID NO: 43354 - RNA, 3105 nt, Artificial Sequence
  derived and/or modified sequence opt2 from FRMD4B__Homo_sapiens__NP_055938
auggccuccgucuucaugugcggcgucgaggaccuccucuucuccggcucccgcuucgucuggaaccucaccgucuccacccuccgccgcugguacaccgagcgccuccgcgccugccaccagguccuccgcaccuggugcggccuccaggacgucuaccagaugaccgagggccgccacugccagguccaccuccucgacgaccgccgccucgagcuccucguccagcccaagcuccucgcccgcgagcuccucgaccucgucgccucccacuucaaccucaaggagaaggaguacuucggcaucaccuucaucgacgacaccggccagcagaacuggcuccagcucgaccaccgcguccucgaccacgaccuccccaagaagcccggccccaccauccuccacuucgccguccgcuucuacaucgaguccaucuccuuccucaaggacaagaccaccgucgagcucuucuuccucaacgccaaggccugcguccacaagggccagaucgaggucgaguccgagaccaucuucaagcucgccgccuucauccuccaggaggccaagggcgacuacaccuccgacgagaacgcccgcaaggaccucaagacccuccccgccuuccccaccaagacccuccaggagcaccccucccucgccuacugcgaggaccgcgucaucgagcacuaccucaagaucaagggccucacccgcggccaggccgucguccaguacaugaagaucgucgaggcccuccccaccuacggcguccacuacuacgccgucaaggacaagcagggccuccccugguggcucggcaucuccuacaagggcaucggccaguacgacauccaggacaaggucaagccccgcaagcucuuccaguggaagcagcucgagaaccucuacuuccgcgagaagaaguucgccgucgagguccacgacccccgccgcaucuccgucucccgccgcaccuucggccaguccggccucuucguccagaccugguacgccaacuccucccucaucaaguccaucugggucauggccaucucccagcaccaguucuaccucgaccgcaagcaguccaaggccaagauccccuccgcccgcucccucgacgagaucgccauggaccucaccgagaccggcacccagcgcgccuccaagcucgucacccucgaggccaagucccaguucaucauggccuccaacggcucccucaucuccuccggcucccaggacuccgaggucuccgaggagcagaagcgcgagaagauccucgagcucaagaagaaggagaagcuccuccaggagaagcuccucaagaaggucgaggagcucaagaagaucugccuccgcgaggccgagcucaccggcaagaugcccaaggaguacccccucaacaucggcgagaagcccccccagguccgccgccgcgucggcaccgccuucaagcucgacgacaaccuccuccccuccgaggaggaccccgcccuccaggagcucgaguccaacuuccucauccagcagaagcucgucgaggccgccaagaagcucgccaacgagcccgaccucugcaagaccgucaagaagaagcgcaagcaggacuacaccgacgccaugaagaagcuccaggagaucgagaacgccaucaacgaguaccgcauccgcugcggcaagaagcccucccagaaggccaccguccuccccgaggacaucauccccuccgaguccuccucccucuccgacaccaccaccuacgacgaccccuccgacgccuucaccuuccccggccagcgcuccuccuccgucccccacuccccccgcauccucccccccaagucccucggcaucgagcgcauccacuuccgcaaguccuccaucaacgagcaguucgucgacacccgccagucccgcgagaugcucuccacccacuccucccccuacaagacccucgagcgccgcccccagggcggccgcuccaugcccaccacccccguccucacccgcaacgccuacuccuccucccaccucgagcccgaguccuccucccagcacugccgccagcgcuccggcucccucgagucccagucccaccuccucuccgagauggacuccgacaagcccuucuucucccucuccaagucccagcgcuccuccuccaccgagauccucgacgacggcuccuccuacaccucccaguccuccaccgaguacuacugcgucacccccgucaccggccccuacuacaccacccagacccucgacacccgcacccgcggccgccgccgcuccaagaagcagaacgucuccaccuccaacuccggcuccaugcccaaccucgcccagaaggacucccuccgcaacggcgucuacuccaagucccaggagccccccuccuccuccuacuacaucgccggcuacacccccuacgccgagugcgacuucuacuacuccggcggcuacgucuacgagaacgacaccgagggccaguacuccgucaaccccuccuaccgcuccuccgcccacuacggcuacgagcgccagcgcgacuacucccgcuccuuccacgaggacgaggucgaccgcgucccccacaaccccuacgccacccuccgccucccccgcaaggccgccgccaaguccgagcacaucaccaagaacauccacaaggcccucgucgccgagcaccuccgcggcugguaccagcgcgccuccggccagaaggaccagggccacuccccccagaccuccuucgacuccgaccgcggcucccagcgcugccucggcuucgccggccuccagguccccugcucccccuccucccgcgccuccuccuacuccuccgucuccuccaccaacgccuccggcaacuggcgcacccagcucaccaucggccucuccgacuacgagacccccgcccacuccuccuacaccuccugcuacggcaacgucuacaacccccuccccucccccucccgccaguacaccgagaucucccagcucgacggcaccgacggcaaccagcucgaggacaaccucgaguccuccgagcagcgccucuucuggcacgaggacuccaagcccggcacccucgucuga

SEQ ID NO: 43355 - RNA, 1245 nt, Artificial Sequence
  derived and/or modified sequence opt2 from FRMD5__Homo_sapiens__NP_001273419
augugcuuccgcgucaaguucuaccccgccgaccccgccgcccucaaggaggagaucacccgcuaccucgucuuccuccagaucaagcgcgaccucuaccacggccgccuccucugcaagaccuccgacgccgcccuccucgccgccuacauccuccaggccgagaucggcgacuacgacuccggcaagcaccccgagggcuacuccuccaaguuccaguucuuccccaagcacuccgagaagcucgagcgcaagaucgccgagauccacaagaccgagcucuccggccagacccccgccaccuccgagcucaacuuccuccgcaaggcccagacccucgagaccuacggcgucgacccccaccccugcaaggacgucuccggcaacgccgccuuccucgccuucacccccuucggcuucgucguccuccagggcaacaagcgcguccacuucaucaaguggaacgaggucaccaagcucaaguucgagggcaagaccuucuaccucuacgagaagaagaucauccucaccuacuucgcccccacccccgaggccugcaagcaccucuggaagugcggcaucgagaaccaggccuucuacaagcucgagaaguccucccagguccgcaccgucuccuccuccaaccucuucuucaagggcucccgcuuccgcuacuccggccgcgucgccaaggaggucauggaguccuccgccaagaucaagcgcgagccccccgagauccaccgcgccggcaugguccccucccgcuccugccccuccaucacccacggcccccgccucuccuccgucccccgcacccgccgccgcgccguccacaucuccaucauggagggccucgagucccuccgcgacuccgcccacuccacccccguccgcuccaccucccacggcgacaccuuccucccccacguccgcuccucccgcaccgacuccaacgagcgcgucgccgucaucgccgacgaggccuacucccccgccgacuccguccuccccacccccgucgccgagcacucccucgagcucaugcuccucucccgccagaucaacggcgccaccugcuccaucgaggaggagaaggaguccgaggccuccacccccaccgccaccgaggucgaggcccucggcggcgagcuccgcgcccucugccagggccacuccggccccgaggaggagcaggccauggucugccuccagaacccccucuccggcgagcccgcccacuga

SEQ ID NO: 43356 - RNA, 795 nt, Artificial Sequence
  derived and/or modified sequence opt2 from FRMD6__Homo_sapiens__NP_001253976
auggaccagcucgagaagcgcucccgcgccuccggcuccuccgccggcuccaugaagcacaagcgccucucccgccacuccaccgccucccacuccuccucccacaccuccggcaucgaggccgacaccaagccccgcgacaccggccccgaggacuccuacuccuccuccgccauccaccgcaagcucaagaccugcuccuccaugaccucccacggcuccucccacaccuccggcgucgaguccggcggcaaggaccgccucgaggaggaccuccaggacgacgagaucgagaugcucgucgacgacccccgcgaccucgagcagaugaacgaggagucccucgaggucucccccgacaugugcaucuacaucaccgaggacaugcucaugucccgcaagcucaacggccacuccggccucaucgucaaggagaucggcuccuccaccuccuccuccuccgagaccgucgucaagcuccgcggccaguccaccgacucccucccccagaccaucugccgcaagcccaagaccuccaccgaccgccacucccucucccucgacgacauccgccucuaccagaaggacuuccuccgcaucgccggccucugccaggacaccgcccaguccuacaccuucggcugcggccacgagcucgacgaggagggccucuacugcaacuccugccucgcccagcagugcaucaacauccaggacgccuuccccgucaagcgcaccuccaaguacuucucccucgaccucacccacgacgagguccccgaguucgucgucuga

SEQ ID NO: 43357 - RNA, 2145 nt, Artificial Sequence
  derived and/or modified sequence opt2 from FRMD7__Homo_sapiens__NP_919253
augcuccaccucaagguccaguuccucgacgacucccagaagaucuucgucgucgaccagaaguccuccggcaaggcccucuucaaccucuccugcucccaccucaaccucgccgagaaggaguacuucggccucgaguucugcucccacuccggcaacaacgucuggcucgagcuccucaagcccaucaccaagcaggucaagaaccccaaggagaucgucuucaaguucauggucaaguucuuccccgucgaccccggccaccuccgcgaggagcucacccgcuaccucuucacccuccagaucaagaaggaccucgcccucggccgccuccccugcuccgacaacugcaccgcccucauggucucccacauccuccaguccgagcucggcgacuuccacgaggagaccgaccgcaagcaccucgcccagacccgcuaccuccccaaccaggacugccucgagggcaagaucaugcacuuccaccagaagcacaucggccgcucccccgccgaguccgacauccuccuccucgacaucgcccgcaagcucgacauguacggcauccgcccccaccccgccuccgacggcgagggcaugcagauccaccucgccgucgcccacaugggcguccucguccuccgcggcaacaccaagaucaacaccuucaacugggccaagauccgcaagcucuccuucaagcgcaagcacuuccucaucaagcuccacgccaacauccucguccucugcaaggacacccucgaguucaccauggccucccgcgacgccugcaaggccuucuggaagaccugcgucgaguaccacgccuucuuccgccucuccgaggagcccaaguccaagcccaagacccuccucugcuccaagggcuccuccuuccgcuacuccggccgcacccagcgccagcuccucgaguacggccgcaagggccgccucaagucccuccccuucgagcgcaagcacuaccccucccaguaccacgagcgccagugccgcuccucccccgaccuccucuccgacgucuccaagcaggucgaggaccuccgccucgccuacggcggcggcuacuaccagaacgucaacggcguccacgccuccgagcccguccucgagucccgccgccgcaacuccgcccucgaggucaccuucgccaccgagcucgagcacuccaagcccgaggccgaccccacccuccuccaccagucccaguccuccuccuccuuccccuucaucuacauggaccccgucuucaacaccgagcccaaccccaaccccgacccccgcgacaucuucuccgagcgcuccucccucuccuccuuccagaccuccugcaaguucuccggcaaccacauguccaucuacuccggccucaccuccaagguccgccccgccaagcagcucaccuacaccgacguccccuacauccccugcaccggccagcaggucggcaucaugcccccccaggucuucuucuacgucgacaagcccccccaggucccccgcuggucccccauccgcgccgaggagcgcaccuccccccacuccuacgucgagcccaccgccaugaagcccgccgagcgcuccccccgcaacauccgcaugaaguccuuccagcaggaccuccagguccuccaggaggccaucgcccgcaccuccggccgcuccaacaucaacgucggccucgaggaggaggaccccaaccucgaggacgccuucgucugcaacauccaggagcagacccccaagcgcucccagucccaguccgacaugaagaccauccgcuuccccuucggcuccgaguuccgcccccucggccccugccccgcccucucccacaaggccgaccucuucaccgacauguucgccgagcaggagcuccccgccguccucauggaccaguccaccgccgagcgcuacgucgccuccgaguccuccgacuccgaguccgagauccucaagcccgacuacuacgcccucuacggcaaggagauccgcucccccauggcccgcauccgccucuccuccggcucccuccagcucgacgaggaggacgaggacgccuacuucaacacccccaccgccgaggaccgcaccucccucaagcccugcaacuacuuccucgccuga

SEQ ID NO: 43358 - RNA, 4737 nt, Artificial Sequence
  derived and/or modified sequence opt2 from FRMPD1__Homo_sapiens__NP_055722
auggaggagcucgagaccucccucuuccagacccgcaaggcccaccgcaucgagcagauggucgcccgcuggcuccgccgcucccgcgacuccuccgcccgcgccaaggucgccgccgccgacggccccgcccgcaaccccacccagacccucauccccguccgccacaccgucaagaucgacaaggacacccuccuccaggacuacggcuuccacaucuccgagucccucccccucaccgucgucgccgucaccgccggcggcuccgcccacggcaagcucuuccccggcgaccagauccuccagaugaacaacgagcccgccgaggaccucuccugggagcgcgccgucgacauccuccgcgaggccgaggacucccucuccaucaccgucguccgcugcaccuccggcguccccaaguccuccuuccucaccgaggagaagcgcgcccgccucaagaccaaccccgucaagguccacuucgccgaggagguccucaucuccggccacucccagggcaacucccuccucugcaugcccaacguccucaagcucuaccucgagaacggccagaccaaggccuucaaguucgaggccaacaccaccgucaaggacaucauccucaccgucaaggagaagcucuccauccgcuccaucgaguacuucgcccucgcccucgaggagcaguacuccaucucccgccuccaccuccuccacgaggaggagcucauccagcaggucgucgagcgcgaggagucccacgacuaccgcugccucuuccgcgucugcuucguccccaaggacccccucgaccuccucaaggaggaccccgucgccuucgaguaccucuaccuccaguccugcuccgacguccuccaggagcgcuucgccgucgagaugaagugcuccuccgcccuccgccucgccgcccuccacauccaggagcgcaucuacgccugcgcccagccccagaagaucucccucaaguacaucgagaaggacuggggcaucgagaacuucaucucccccacccuccuccgcaacaugaagggcaaggacaucaagaaggccaucuccuuccacaugaagcgcaaccagaaccuccucgagccccgccagaagcagcucaucuccgccgcccagcuccgccucaacuaccuccagauccucggcgagcucaagaccuacggcggccgcaucuucaacgccacccucaugcuccaggaccgcgaguccuacaucgcccuccucgucggcgccaaguacggcaucucccaggucaucaacuccaagcucaacaucauguccacccucgccgaguucgccaacaucucccgcgucgagcucaccgaggaguccgagaaggucuccgucgucaaggucuaccuccaggacgucaagguccucacccuccuccucgaguccaacuccgccaaggaccucgccugccucaucgccggcuacuaccgccuccucgucgaccccgucaccuccaucuuccucuggcccggcaacaagcagcaggcccaccgcgucuccgccgaggagggcuacgagucccgcgccugcuccgacuccgaggaguccuccgaggucgacugcguccucgagccccucuccgaccgccgccucgucaagcucgcccccugccgcucccucaucaaggaggagcagccccccggcaacucccccacccccgaggucgcccgccgcggccccuccaccugcggcgccuccuccaccaccgacuccgccgaguccgaggccuccgacuccgccaacaccgagucccgcggcuaccgcaccuccggcuccuccgaguccauggacgcccucgaggaggacgaccucgacaccugcuccuccucccgcuccaccuucuuccacuucggcucccccggccucgccgaguccaucgacuccgacucccaggaggagcgcuccggcaucgagaccuccggcuuccucugccuccucgaccucgcccagcgcgccaacccccagugccagaagaccgaguucuccgaguccgccgcccucgagaccuucggcugggcccccgagcucuccaccguccgccucgacccccgccucuacgagggcucccacgccgacuacuacucccucugcuccuccgucucccccgccuccuaccucuccgacuccuccgaguccaccgccucccgccagggcggcgccccccccgccuggggccagcagggcuggaccgaggcccagcccuccuccaugcucgagccccucgcccuccaccccccccucgccuucgaggacggcuccuccgacgaggaguacuacgacgccgccgacaagcucaccccccccggcccccccuccggcccccgcgacgucuccaccgccgagcccuccgccaccucccuccagaacaaggccuccaccuccucccccgagaacucccuccccugcggccccgacggccgccagcccucccgccgcggcggcgucaagaaguacgccaagacccuccgcaagcgccgcuccuuccuccagaccgacuacaccucccaggucuccuucccccucguccccuccgccucccucgaguccgucgacgacgucugcuacuacgaccgcgagcccuaccucgcccucggcgcccccucccccaccgucuccucccuccaggacaugcagggcgagcccggccuccucgagaccaaggcccucggccuccucgccccccuccgcgagaccaaguccaccaaccccgccucccgcgucauggagauggagcccgagaccauggagaccaaguccgucaucgacucccgcgucuccuccaucuccgccauccgcuuccgcaucgaccccaacaacaaggagaacuccggcgucguccccgccgccuccuccuccgccuccaccccccacugcuccaaccccggcuccuccggccccgacaccgcccaggcccgccccucccagauccucccccucucccaggaccucgacggcaucgcccccaaggagcccaccaucgagcacggcgacuccuccuucucccucuccuccggcgaccccaaccccgaccgcgccugccucgccuccaaccccggccucaacaacgucucccagggcgacacccucgagcuccagcucgagccccacguccagcucgagaugggccucgaguccuucugcaccaaccacauccaggagaccgcccccaaguacaccgagccccuccucuccccccgcgacgagccccgcuccgacgagugcggcaucaaccccggcgagaagaucgccuccauccccaccaaggaggagccccagggccagcucucccucgagcgcgaccgcgaggucaccaacaagaacggcaccaacgucuuccaggaggagucccgcaaggacuccggcgacucccccggcgacgucuccaacaacgucucccagacccucgacaucuccucccccgccggcaagaucgucaccucccucucccucgacgcccccgucaccggcaccgagcagauccccccccaccccccccgcgacccccagggccagucccgcgagccccccggccagggcugccaggcccaggagcagaagcucuucgucgagcucgaccucgaccccgacuucuuccucggcaagcagaccgucucccccgccgucccccccgagggcaucaaggccgaggcccccaaccacgucaccggccaggacaucgccccccgcgacucccccgagugggucugcuucaaccccgagcccucccuccccgagccccuccccugcccccaggaggacccccaccucgagaccuccaaccacugccuccucuccgagggcaaguccgacuccuccuccaucugccucuccgccgagaaguccuuccucugcuucgcccccgagucccaccccgaggucuccgccucccuccgcgucgccaccucccucggcuucgccggcaugaacgagauggucgccccccgcaucggcauggaccagugcuccugccaguucuccuacgccaccugcuuccgcggcccccagcccgagaccgaggaggaggaccgcgaccucgaggcccaccccauggccccccucaccuccccccccuccgccggcucccccgucguccuccccuggcgccccgcccgcgcccacuccugcaccaccgccccccucucccgcaagucccacaucuggcccgaguacugcucccgcgcccuccgccagcucaaggccacccccgccuccacccccgagggcuucauccagcucauggagucccuccucgagcuccaggacauccucgagaccuccuggggcgucggcaacaagcacccccccgagaagugcaccuggcacuucaccgagucccgcucccgccucugcaugggcucccagaagcuccucuccuccugccgccacgucauccgcauggaccagucccccgaggagaugcagggcgccguccgcgacaccuuccagcaccucguccagcucgccggccucugcuuccaguucaccgacugcucccgcugcuccgcccgccaccgcgaggccgccggcaaccuccgcgacgucgucuacaccuaccaccaguucaucgaggccgccaaguccaccugcgagcgcggcuaccacgaccucuccgucaagcuccucgcccgccagugcaccgcccucaccgccgccgucuucugccucacccagaaguuccgcgccuccaccgcccucuga

SEQ ID NO: 43359 - RNA, 3930 nt, Artificial Sequence
  derived and/or modified sequence opt2 from FRMPD2__Homo_sapiens__NP_001018081
augcagccccucaccaaggacgccggcaugucccucuccuccgucacccucgccuccgcccuccagguccgcggcgaggcccucuccgaggaggagaucuggucccuccucuuccucgccgccgagcagcuccucgaggaccuccgcaacgacuccuccgacuacgucgucugccccugguccgcccuccucuccgccgccggcucccucuccuuccagggccgcgucucccacaucgaggccgcccccuucaaggcccccgagcuccuccagggccaguccgaggacgagcagcccgacgccucccagaugcacgucuacucccucggcaugacccucuacugguccgccggcuuccacguccccccccaccagccccuccagcucugcgagccccuccacuccauccuccucaccaugugcgaggaccagccccaccgccgcugcacccuccaguccguccucgaggccugccgcguccacgagaaggaggucuccgucuaccccgcccccgccggccuccacauccgccgccucgucggccucguccucggcaccaucuccgaggucgagaagcgcgucgucgaggaguccuccuccguccagcagaaccgcuccuaccuccuccgcaagcgccuccgcggcaccuccuccgagucccccgccgcccaggcccccgagugccuccaccccugccgcgucuccgagcgcuccaccgagacccaguccucccccgagccccacugguccacccucacccacucccacugcucccuccucgucaaccgcgcccuccccggcgccgacccccaggaccagcaggccggccgccgccucuccuccggcuccguccacuccgccgccgacuccuccuggcccaccacccccucccagcgcggcuuccuccagcgccgcuccaaguucucccgccccgaguucauccuccucgccggcgaggcccccaugacccuccaccuccccggcuccgucgucaccaagaagggcaaguccuaccucgcccuccgcgaccucugcgucguccuccucaacggccagcaccucgaggucaagugcgacgucgaguccaccgucggcgccgucuucaacgccgucaccuccuucgccaaccucgaggagcucaccuacuucggccucgccuacaugaaguccaaggaguucuucuuccucgacuccgagacccgccucugcaagaucgcccccgagggcuggcgcgagcagccccagaagaccuccaugaacaccuucacccucuuccuccgcaucaaguucuucgucucccacuacggccuccuccagcacucccucacccgccaccaguucuaccuccagcuccgcaaggacauccucgaggagcgccucuacugcaacgaggagauccuccuccagcucggcguccucgcccuccaggccgaguucggcaacuaccccaaggagcaggucgaguccaagcccuacuuccacgucgaggacuacauccccgccucccucaucgagcgcaugaccgcccuccgcguccaggucgaggucuccgagaugcaccgccucuccuccgcccucuggggcgaggacgccgagcucaaguuccuccgcgucacccagcagcuccccgaguacggcguccucguccaccaggucuucuccgagaagcgccgccccgaggaggagauggcccucggcaucugcgccaagggcgucaucgucuacgaggucaagaacaacucccgcaucgccaugcuccgcuuccaguggcgcgagaccggcaagaucuccaccuaccagaagaaguucaccaucaccuccuccgucaccggcaagaagcacaccuucgucaccgacuccgccaagaccuccaaguaccuccucgaccucugcuccgcccagcacggcuucaacgcccagaugggcuccggccagcccucccacguccucuucgaccacgacaaguucguccagauggccaaccucucccccgcccaccaggcccgcuccaagccccucaucuggauccagcgccucuccugcuccgagaacgagcucuucgucucccgccuccagggcgccgccggcggccuccucuccaccuccauggacaacuucaacgucgacggcuccaaggaggccggcgccgagggcaucggccgcucccccugcaccggccgcgagcagcucaaguccgccugcgucauccagaagcccaugaccugggacucccucuccggcccccccguccaguccaugcacgccggcuccaagaacaaccgccgcaaguccuucaucgccgagcccggccgcgagaucguccgcgucacccucaagcgcgacccccaccgcggcuucggcuucgucaucaacgagggcgaguacuccggccaggccgaccccggcaucuucaucuccuccaucauccccggcggccccgccgagaaggccaagaccaucaagcccggcggccagauccucgcccucaaccacaucucccucgagggcuucaccuucaacauggccguccgcaugauccagaacucccccgacaacaucgagcucaucaucucccaguccaagggcgucggcggcaacaaccccgacgaggagaagaacuccaccgccaacuccggcgucuccuccaccgacauccucuccuucggcuaccagggcucccuccucucccacacccaggaccaggaccgcaacaccgaggagcucgacauggccggcguccagucccucgucccccgccuccgccaccagcucuccuuccucccccucaagggcgccggcuccuccugcccccccuccccccccgagaucuccgccggcgagaucuacuucgucgagcucgucaaggaggacggcacccucggcuucuccgucaccggcggcaucaacaccuccguccccuacggcggcaucuacgucaaguccaucguccccggcggccccgccgccaaggagggccagauccuccagggcgaccgccuccuccaggucgacggcgucauccucugcggccucacccacaagcaggccguccagugccucaagggccccggccaggucgcccgccucguccucgagcgccgcgucccccgcuccacccagcagugccccuccgccaacgacuccaugggcgacgagcgcaccgccgucucccucgucaccgcccuccccggccgccccuccuccugcgucuccgucaccgacggccccaaguucgaggucaagcucaagaagaacgccaacggccucggcuucuccuucguccagauggagaaggaguccugcucccaccucaaguccgaccucguccgcaucaagcgccucuuccccggccagcccgccgaggagaacggcgccaucgccgccggcgacaucauccucgccgucaacggccgcuccaccgagggccucaucuuccaggagguccuccaccuccuccgcggcgccccccaggaggucacccuccuccucugccgccccccccccggcgcccuccccgagcucgagcaggaguggcagacccccgagcucuccgccgacaaggaguucacccgcgccaccugcaccgacuccugcaccucccccauccucgaccaggaggacuccuggcgcgacuccgccucccccgacgccggcgagggccucggccuccgccccgaguccucccagaaggccauccgcgaggcccaguggggccagaaccgcgagcgccccugggccuccucccucacccacucccccgagucccacccccaccucugcaagcuccaccaggagcgcgacgaguccacccucgccaccucccucgagaaggacguccgccagaacugcuacuccgucugcgacaucaugcgccucggccgcuacuccuucuccuccccccucacccgccucuccaccgacaucuucuga

SEQ ID NO: 43360 - RNA, 3969 nt, Artificial Sequence
  derived and/or modified sequence opt2 from FRMPD4__Homo_sapiens__NP_055543
auggacgucuucuccuucgucaagaucgccaagcucuccucccaccgcaccaaguccuccggcuggcccccccccuccggcaccuggggccucucccaggucccccccuacggcugggagaugaccgccaaccgcgacggccgcgacuacuucaucaaccacaugacccaggccauccccuucgacgacccccgccucgaguccugccagaucaucccccccgccccccgcaaggucgagaugcgccgcgaccccguccucggcuucggcuucgucgccggcuccgagaagcccgucgucguccgcuccgucacccccggcggccccuccgagggcaagcucauccccggcgaccagaucgucaugaucaacgacgagcccgucuccgccgccccccgcgagcgcgucaucgaccucguccgcuccugcaaggaguccauccuccucaccgucauccagcccuaccccucccccaaguccgccuucaucuccgccgccaagaaggcccgccucaaguccaaccccgucaagguccgcuucuccgaggaggucaucaucaacggccaggucuccgagaccgucaaggacaacucccuccucuucaugcccaacguccucaaggucuaccucgagaacggccagaccaaguccuuccgcuucgacugcuccaccuccaucaaggacgucauccucacccuccaggagaagcucuccaucaagggcaucgagcacuucucccucaugcucgagcagcgcaccgagggcgccggcaccaagcuccuccuccuccacgagcaggagacccucacccaggucacccagcgccccuccucccacaagaugcgcugccucuuccgcaucuccuucguccccaaggaccccaucgaccuccuccgccgcgaccccgucgccuucgaguaccucuacguccaguccugcaacgacgucguccaggagcgcuucggccccgagcucaaguacgacaucgcccuccgccucgccgcccuccagauguacaucgccaccgucaccaccaagcagacccagaagaucucccucaaguacaucgagaaggaguggggccucgagaccuuccuccccuccgccguccuccaguccaugaaggagaagaacaucaagaaggcccucucccaccucgucaaggccaaccagaaccucgucccccccggcaagaagcucuccgcccuccaggccaagguccacuaccucaaguuccucuccgaccuccgccucuacggcggccgcgucuucaaggccacccucguccaggccgagaagcgcuccgaggucacccuccucgucggcccccgcuacggcaucucccacgucaucaacaccaagaccaaccucgucgcccuccucgccgacuucucccacgucaaccgcaucgagauguucuccgaggaggagucccucguccgcgucgagcuccacguccucgacgucaagcccaucacccuccucauggaguccuccgacgccaugaaccucgccugccucaccgccggcuacuaccgccuccucgucgacucccgccgcuccaucuucaacauggccaacaagaagaacaccgccacccaggagaccggccccgagaacaagggcaagcacaaccuccucggccccgacuggaacugcaucccccagaugaccaccuucaucggcgagggcgagcaggaggcccagaucaccuacaucgacuccaagcagaagaccgucgagaucaccgacuccaccaugugccccaaggagcaccgccaccucuacaucgacaacgccuacuccuccgacggccucaaccagcagcucucccagcccggcgaggcccccugcgaggccgacuaccgcucccucgcccagcgcucccuccucacccucuccggccccgagacccucaagaaggcccaggaguccccccgcggcgccaaggucuccuucaucuucggcgacuucgcccucgacgacggcaucuccccccccacccucggcuacgagacccuccucgacgagggccccgagaugcucgagaagcagcgcaaccucuacaucggcuccgccaacgacaugaagggccucgaccucacccccgaggccgagggcauccaguucgucgagaacuccgucuacgccaacaucggcgacgucaaguccuuccaggccgccgagggcaucgaggagccccuccuccacgacaucugcuacgccgagaacaccgacgacgccgaggacgaggacgaggucuccugcgaggaggaccucgucgucggcgagaugaaccagcccgccauccucaaccucuccggcuccuccgacgacaucaucgaccucaccucccuccccccccccgagggcgacgacaacgaggacgacuuccuccuccgcucccucaacauggccaucgccgcccccccccccggcuuccgcgacuccuccgacgaggaggacucccagucccaggccgccuccuuccccgaggacaaggagaagggcuccucccuccagaacgacgagauccccgucucccucaucgacgccguccccaccuccgccgagggcaagugcgagaagggccucgacaacgccgucgucuccacccucggcgcccucgaggcccucuccgucuccgaggagcagcagaccuccgacaacuccggcgucgccauccuccgcgccuacucccccgaguccuccuccgacuccggcaacgagaccaacuccuccgagaugaccgaguccuccgagcucgccaccgcccagaagcaguccgagaaccucucccgcauguuccucgccacccacgagggcuaccacccccucgccgaggagcagaccgaguuccccgccuccaagacccccgccggcggccucccccccaaguccucccacgcccucgccgcccgccccgccaccgaccucccccccaaggucguccccuccaagcagcuccuccacuccgaccacauggagauggagcccgagaccauggagaccaaguccgucaccgacuacuucuccaagcuccacaugggcuccgucgccuacuccugcaccuccaagcgcaaguccaagcucgccgacggcgagggcaaggccccccccaacggcaacaccaccggcaagaagcagcagggcaccaagaccgccgagauggaggaggaggccuccggcaaguucggcaccgucuccucccgcgacucccagcaccucuccaccuucaaccucgagcgcaccgccuuccgcaaggacucccagcgcugguacgucgccaccgagggcggcauggccgagaaguccggccucgaggccgccaccggcaagaccuucccccgcgccuccggccucggcgcccgcgaggccgagggcaaggaggagggcgcccccgacggcgagaccuccgacggcuccggccucggccagggcgaccgcuuccucaccgacgucaccugcgccuccuccgccaaggaccucgacaaccccgaggacgccgacuccuccaccugcgaccaccccuccaagcuccccgaggccgacgaguccgucgcccgccucugcgacuaccaccucgccaagcgcauguccucccuccaguccgagggccacuucucccuccaguccucccagggcuccuccgucgacgccggcugcggcaccggcuccuccggcuccgccugcgccacccccgucgaguccccccucugccccucccucggcaagcaccucauccccgacgccuccggcaagggcgucaacuacauccccuccgaggagcgcgcccccggccuccccaaccacggcgccaccuucaaggagcuccacccccagaccgagggcaugugcccccgcaugaccguccccgcccuccacaccgccaucaacaccgagccccucuucggcacccuccgcgacggcugccaccgccuccccaagaucaaggagaccaccgucuga

SEQ ID NO: 43361 - RNA, 1035 nt, Artificial Sequence
  derived and/or modified sequence opt2 from FRRS1L__Homo_sapiens__NP_055149
augcgccgcccccgccagggcggcggcggcgccggcggcuccgccgccgcccgcgcccgcgccggcggccucggcggcggcuccguccccgcccgcgcccgcggcgcccccgccgccgcccgcgccgccuggcuccgcgaccucugcgcccgcauggcccgccccccccgccagcaccccggcgucugggccucccuccuccuccuccuccucaccggccccgccgccugcgccgccucccccgccgacgacggcgccggccccggcggccgcggcccccgcggccgcgcccgcggcgacaccggcgccgacgaggccgucccccgccacgacuccuccuacggcaccuucgccggcgaguucuacgaccuccgcuaccucuccgaggagggcuaccccuuccccaccgccccccccgucgaccccuucgccaagaucaaggucgacgacugcggcaagaccaagggcugcuuccgcuacggcaagcccggcugcaacgccgagaccugcgacuacuuccucuccuaccgcaugaucggcgccgacgucgaguucgagcucuccgccgacaccgacggcugggucgccgucggcuucuccuccgacaagaagaugggcggcgacgacgucauggccugcguccacgacgacaacggccgcguccgcauccagcacuucuacaacgucggccagugggccaaggagauccagcgcaaccccgcccgcgacgaggagggcgucuucgagaacaaccgcgucaccugccgcuucaagcgccccgucaacgucccccgcgacgagaccaucgucgaccuccaccucuccugguacuaccucuucgccuggggccccgccauccagggcuccaucacccgccacgacaucgacuccccccccgccuccgagcgcgucgucuccaucuacaaguacgaggacaucuucaugcccuccgccgccuaccagaccuucuccucccccuucugccuccuccucaucgucgcccucaccuucuaccuccucaugggcacccccuga

SEQ ID NO: 43362 - RNA, 1527 nt, Artificial Sequence
  derived and/or modified sequence opt2 from FRS2__Homo_sapiens__NP_001265286
augggcuccugcugcuccugccccgacaaggacaccguccccgacaaccaccgcaacaaguucaaggucaucaacgucgacgacgacggcaacgagcucggcuccggcaucauggagcucaccgacaccgagcucauccucuacacccgcaagcgcgacuccgucaaguggcacuaccucugccuccgccgcuacggcuacgacuccaaccucuucuccuucgaguccggccgccgcugccagaccggccagggcaucuucgccuucaagugcgcccgcgccgaggagcucuucaacaugcuccaggagaucaugcagaacaacuccaucaacgucgucgaggagcccgucgucgagcgcaacaaccaccagaccgagcucgaggucccccgcaccccccgcacccccaccacccccggcuucgccgcccagaaccuccccaacggcuacccccgcuaccccuccuucggcgacgccuccucccaccccuccucccgccaccccuccgucggcuccgcccgccuccccuccgucggcgaggaguccacccacccccuccucgucgccgaggagcagguccacaccuacgucaacaccaccggcguccaggaggagcgcaagaaccgcaccuccguccacgucccccucgaggcccgcgucuccaacgccgaguccuccacccccaaggaggagcccuccuccaucgaggaccgcgacccccagauccuccucgagcccgagggcgucaaguucguccucggccccacccccguccagaagcagcucauggagaaggagaagcucgagcagcucggccgcgaccaggucuccggcuccggcgccaacaacaccgagugggacaccggcuacgacuccgacgagcgccgcgacgcccccuccgucaacaagcucgucuacgagaacaucaacggccucuccauccccuccgccuccggcguccgccgcggccgccucaccuccaccuccaccuccgacacccagaacaucaacaacuccgcccagcgccgcaccgcccuccucaacuacgagaaccuccccucccucccccccgucugggaggcccgcaagcucucccgcgacgaggacgacaaccucggccccaagacccccucccucaacggcuaccacaacaaccucgaccccaugcacaacuacgucaacaccgagaacgucaccguccccgccuccgcccacaagaucgaguacucccgccgccgcgacugcacccccaccgucuucaacuucgacauccgccgccccucccucgagcaccgccagcucaacuacauccaggucgaccucgagggcggcuccgacuccgacaacccccagacccccaagacccccaccaccccccucccccagacccccacccgccgcaccgagcucuacgccgucaucgacaucgagcgcaccgccgccauguccaaccuccagaaggcccucccccgcgacgacggcaccucccgcaagacccgccacaacuccaccgaccuccccauguga

SEQ ID NO: 43363 - RNA, 1479 nt, Artificial Sequence
  derived and/or modified sequence opt2 from FRS3__Homo_sapiens__XP_011512557
augggcuccugcugcuccugccucaaccgcgacuccguccccgacaaccaccccaccaaguucaaggucaccaacgucgacgacgagggcgucgagcucggcuccggcgucauggagcucacccaguccgagcucguccuccaccuccaccgccgcgaggccguccgcuggcccuaccucugccuccgccgcuacggcuacgacuccaaccucuucuccuucgaguccggccgccgcugccagaccggccagggcaucuucgccuucaagugcucccgcgccgaggagaucuucaaccuccuccaggaccucaugcagugcaacuccaucaacgucauggaggagcccgucaucaucacccgcaacucccaccccgccgagcucgaccucccccgcgccccccagccccccaacgcccucggcuacaccgucuccuccuucuccaacggcugccccggcgagggcccccgcuucuccgccccccgccgccucuccaccuccucccuccgccaccccucccucggcgaggaguccacccacgcccucaucgcccccgacgagcagucccacaccuacgucaacacccccgccuccgaggacgaccaccgccgcggccgccacugccuccagccccuccccgagggccaggcccccuuccucccccaggcccgcggccccgaccagcgcgacccccaggucuuccuccagcccggccaggucaaguucguccucggccccacccccgcccgccgccacauggucaagugccagggccucugccccucccuccacgaccccccccaccacaacaacaacaacgaggcccccuccgagugccccgcccagcccaagugcaccuacgagaacgucaccggcggccucuggcgcggcgccggcuggcgccucucccccgaggagcccggcuggaacggccucgcccaccgccgcgccgcccuccuccacuacgagaaccuccccccccucccccccgucugggagucccaggcccagcagcucggcggcgaggccggcgacgacggcgacucccgcgacggccucacccccuccuccaacggcuuccccgacggcgaggaggacgagaccccccuccagaagcccaccuccacccgcgccgccauccgcucccacggcuccuuccccgucccccucacccgccgccgcggcuccccccgcgucuucaacuucgacuuccgccgccccggccccgagcccccccgccagcucaacuacauccaggucgagcucaagggcuggggcggcgaccgccccaagggcccccagaaccccuccuccccccaggcccccaugcccaccacccaccccgcccgcuccuccgacuccuacgccgucaucgaccucaagaagaccgucgccauguccaaccuccagcgcgcccucccccgcgacgacggcaccgcccgcaagacccgccacaacuccaccgaccucccccucuga

SEQ ID NO: 43364 - RNA, 9042 nt, Artificial Sequence
  derived and/or modified sequence opt2 from FRY__Homo_sapiens__NP_075463
auggccucccagcaggacuccggcuucuucgagaucuccaucaaguaccuccucaaguccugguccaacaccucccccgucggcaacggcuacaucaagccccccgucccccccgccuccggcacccaccgcgagaagggcccccccaccaugcuccccaucaacgucgaccccgacuccaagcccggcgaguacguccucaagucccucuucgucaacuucaccacccaggccgagcgcaagauccgcaucaucauggccgagccccucgagaagccccucaccaagucccuccagcgcggcgaggacccccaguucgaccaggucaucuccuccauguccucccucuccgaguacugccuccccuccauccuccgcacccucuucgacugguacaagcgccagaacggcaucgaggacgagucccacgaguaccgcccccgcaccuccaacaaguccaaguccgacgagcagcagcgcgacuaccucauggagcgccgcgaccucgccaucgacuucaucuucucccucguccucaucgagguccucaagcagaucccccuccaccccgucaucgacucccucauccacgacgucaucaaccucgccuucaagcacuucaaguacaaggagggcuaccucggccccaacaccggcaacaugcacaucgucgccgaccucuacgccgaggucaucggcguccucgcccaggccaaguuccccgccgucaagaagaaguucauggccgagcucaaggagcuccgccacaaggagcagaaccccuacgucguccaguccaucaucucccucaucaugggcaugaaguucuuccgcaucaagauguaccccgucgaggacuucgaggccucccuccaguucaugcaggagugcgcccacuacuuccucgaggucaaggacaaggacaucaagcacgcccucgccggccucuucgucgagauccucguccccgucgccgccgccgucaagaacgaggucaacguccccugccuccgcaacuucgucgagucccucuacgacaccacccucgagcucuccucccgcaagaagcacucccucgcccucuacccccucgucaccugccuccucugcgucucccagaagcagcucuuccucaaccgcuggcacaucuuccucaacaacugccucuccaaccucaagaacaaggaccccaagauggcccgcgucgcccucgagucccucuaccgccuccucugggucuacaugauccgcaucaagugcgaguccaacaccgccacccagucccgccucaucaccaucaucaccacccucuuccccaagggcucccgcggcgucgucccccgcgacaugccccucaacaucuucgucaagaucauccaguucaucgcccaggagcgccucgacuucgccaugaaggagaucaucuucgacuuccucugcgucggcaagcccgccaaggccuucucccucaaccccgagcgcaugaacaucggccuccgcgccuuccucgucaucgccgacucccuccagcagaaggacggcgagccccccaugcccgucaccggcgccguccuccccuccggcaacacccuccgcgucaagaagaccuaccucuccaagacccucaccgaggaggaggccaagaugaucggcaugucccucuacuacucccagguccgcaaggccgucgacaacauccuccgccaccucgacaaggaggucggccgcugcaugaugcucaccaacguccagaugcucaacaaggagcccgaggacaugaucaccggcgagcgcaagcccaagaucgaccucuuccgcaccugcgucgccgccaucccccgccuccuccccgacggcauguccaagcucgagcucaucgaccuccucgcccgccucuccauccacauggacgacgagcuccgccacaucgcccagaacucccuccagggccuccucgucgacuucuccgacuggcgcgaggacguccucuucggcuucaccaacuuccuccuccgcgaggucaacgacaugcaccacacccuccucgacuccucccucaagcuccuccuccagcuccucacccaguggaagcucgucauccagacccagggcaaggucuacgagcaggccaacaagauccgcaacuccgagcucaucgccaacggcuccucccaccgcauccaguccgagcgcggcccccacugcuccguccuccacgccgucgagggcuucgcccucguccuccucugcuccuuccaggucgccacccgcaagcucuccguccucauccucaaggagauccgcgcccucuucaucgcccucggccagcccgaggacgacgaccgccccaugaucgacgucauggaccagcucuccuccuccauccucgaguccuucauccacgucgccgucuccgacuccgccacccucccccucacccacaacgucgaccuccaguggcucgucgaguggaacgccguccucgucaacucccacuacgacgucaagucccccucccacgucuggaucuucgcccaguccgucaaggaccccuggguccucugccucuucuccuuccuccgccaggagaaccuccccaagcacugccccaccgcccucuccuacgccuggcccuacgccuucacccgccuccaguccgucaugccccucgucgaccccaacucccccaucaacgccaagaagaccuccaccgccggcuccggcgacaacuacgucacccucuggcgcaacuaccucauccucugcuucggcgucgccaagcccuccaucaugucccccggccaccuccgcgccuccacccccgagaucauggccaccacccccgacggcaccgucuccuacgacaacaaggccaucggcacccccuccgucggcguccuccucaagcagcucgucccccucaugcgccucgaguccaucgagaucaccgagucccucguccucggcuucggccgcaccaacucccucgucuuccgcgagcucgucgaggagcuccacccccucaugaaggaggcccucgagcgccgccccgagaacaagaagcgccgcgagcgccgcgaccuccuccgccuccagcuccuccgcaucuucgagcuccucgccgacgccggcgucaucuccgacuccaccaacggcgcccucgagcgcgacacccucgcccucggcgcccucuuccucgaguacgucgaccucacccgcaugcuccucgaggccgagaacgacaaggaggucgagauccucaaggacauccgcgcccacuucuccgccauggucgccaaccucauccagugcguccccguccaccaccgccgcuuccucuucccccagcagucccuccgccaccaccucuucauccucuucucccagugggccggccccuucuccaucauguucaccccccucgaccgcuacuccgaccgcaaccaccagaucacccgcuaccaguacugcgcccucaaggccauguccgccguccucugcugcggccccgucuucgacaacgucggccucucccccgacggcuaccucuacaaguggcucgacaacauccucgccugccaggaccuccgcguccaccagcucggcugcgaggucgucguccuccuccucgagcucaaccccgaccagaucaaccucuucaacugggccaucgaccgcugcuacaccggcuccuaccagcucgccuccggcugcuucaaggccaucgccaccgucugcggcucccgcaacuaccccuucgacaucgucacccuccucaaccucguccucuucaaggccuccgacaccaaccgcgagaucuacgagaucuccaugcagcucaugcagauccucgaggccaagcucuucgucuacuccaagaaggucgccgagcagcgccccggcuccauccucuacggcacccacggcccccuccccccccucuacuccgucucccucgcccuccucuccugcgagcucgcccgcauguaccccgagcucacccucccccucuucuccgaggucucccagcgcuuccccaccacccaccccaacggccgccagaucaugcucaccuaccuccuccccuggcuccacaacaucgagcucgucgacucccgccuccuccuccccggcuccucccccuccucccccgaggacgaggucaaggaccgcgagggcgacgucaccgccucccacggccuccgcggcaacggcuggggcucccccgaggccaccucccucguccucaacaaccucauguacaugaccgccaaguacggcgacgagguccccggccccgagauggagaacgccuggaacgcccucgccaacaacgagaagugguccaacaaccuccgcaucacccuccaguuccucaucucccucugcggcgucuccuccgacaccguccuccuccccuacaucaagaaggucgccaucuaccucugccgcaacaacaccauccagaccauggaggagcuccucuucgagcuccagcagaccgagcccgucaaccccaucguccagcacugcgacaacccccccuucuaccgcuucaccgccuccuccaaggccuccgccgccgccuccggcaccaccuccuccuccaacaccgucgucgccggccaggagaacuuccccgacgccgaggagaacaagauccucaaggaguccgacgagcgcuucuccaacgucauccgcgcccacacccgccucgagucccgcuacuccaacuccuccggcggcuccuacgacgaggacaagaacgaccccaucucccccuacaccggcuggcuccucaccaucaccgagaccaagcagccccagccccuccccaugcccugcaccggcggcugcugggccccccucgucgacuaccuccccgagaccaucaccccccgcggcccccuccaccgcugcaacaucgccgucaucuucaugaccgagauggucgucgaccacuccguccgcgaggacugggcccuccaccucccccuccuccuccacgccgucuuccucggccucgaccacuaccgccccgaggucuucgagcacuccaagaagcuccuccuccaccuccucaucgcccucuccugcaacuccaacuuccacuccaucgccuccguccuccuccagacccgcgagaugggcgaggccaagacccucaccguccagcccgccuaccagcccgaguaccucuacaccggcggcuucgacuuccuccgcgaggaccaguccucccccguccccgacuccggccucuccuccuccuccaccuccuccuccaucucccucggcggcuccuccggcaaccucccccagaugacccaggaggucgaggacgucgacaccgccgccgagaccgacgagaaggccaacaagcucaucgaguuccucaccacccgcgccuucggcccccucuggugccacgaggacaucacccccaagaaccagaacuccaaguccgccgagcagcucaccaacuuccuccgccacgucgucuccgucuucaaggacuccaaguccggcuuccaccucgagcaccagcucuccgaggucgcccuccagaccgcccucgccuccuccucccgccacuacgccggccgcuccuuccagaucuuccgcgcccucaagcagccccucuccgcccacgcccucuccgaccuccucucccgccucgucgaggucaucggcgagcacggcgacgagauccagggcuacgucauggaggcccuccucacccucgaggccgccgucgacaaccucuccgacugccucaagaacuccgaccuccucaccguccucucccgcuccuccucccccgaccucuccuccuccuccaagcucaccgccucccgcaaguccaccggccagcucaacaugaaccccggcaccaccuccggcaacaccgccaccgccgagcgcucccgccaccagcgcuccuucuccguccccaagaaguucggcgucaucgaccgcuccuccgaccccccccgcuccgccacccucgaccgcauccaggccugcacccagcagggccucuccuccaagacccgcuccuccuccucccucaaggacucccucaccgaccccucccacaucaaccaccccaccaaccuccucgccaccaucuucugggucaccgucgcccucauggaguccgacuucgaguucgaguaccucauggcccuccgccuccucucccgccuccucgcccacaugccccucgacaaggccgagaaccgcgagaagcucgagaagcuccaggcccagcucaagugggccgacuucuccggccuccagcagcuccuccucaagggcuucaccucccucaccaccaccgaccucacccuccagcucuucucccuccucacccccgucuccaagaucuccauggucgacgccucccacgccaucggcuucccccucaacguccucugccuccucccccagcucauccagcacuucgagaaccccaaccaguucugcaaggacaucgccgagcgcaucgcccaggucugccucgaggagaagaaccccaagcucuccaaccucgcccacgucaugacccucuacaagacccacuccuacacccgcgacugcgccaccugggucaacgucgucugccgcuaccuccacgaggccuacgccgacaucacccucaacauggucaccuaccucgccgagcuccucgagaagggccuccccuccguccagcagccccuccuccaggucaucuacucccuccucuccuacauggaccucuccgucguccccgucaagcaguucaacgucgagguccucaagaccaucgagaaguacguccaguccguccacuggcgcgaggcccucaacauccucaagcucgucgucucccgcuccgccucccucguccuccccuccuaccagcacuccgaccucuccaagaucgagauccaccgcgucuggaccuccgccuccaaggagcuccccggcaagacccucgacuuccacuucgacaucuccgagacccccaucaucggccgccgcuacgacgagcuccagaacuccuccggccgcgacggcaagccccgcgccauggccgucacccgcuccaccuccuccaccuccuccggcuccaacuccaacguccucguccccgucuccuggaagcgcccccaguacucccagaagcgcaccaaggagaagcucguccacguccucucccucugcggccaggaggucggccucuccaagaaccccuccgucaucuucuccuccugcggcgaccucgaccuccucgagcaccagaccucccucgucuccuccgaggacggcgcccgcgagcaggagaacauggacgacaccaacuccgagcagcaguuccgcgucuuccgcgacuucgacuuccucgacgucgagcucgaggacggcgagggcgaguccauggacaacuucaacuggggcguccgccgccgcucccucgacucccucgacaagugcgacaugcagauccucgaggagcgccagcucuccggcuccacccccucccucaacaagaugcaccacgaggacuccgacgaguccuccgaggaggaggaccucaccgccucccagauccucgagcacuccgaccucaucaugacccucucccccuccgaggagaccaaccccauggagcuccucaccaccgccugcgacuccacccccgccgagccccacuccuucaacacccgcauguccuccuucgacgccucccuccccgacaugaacaaccuccagaucuccgagggcuccaaggccgaggccguccgcgaggaggaggacaccaccguccacgaggacgaccucuccuccuccaucaacgagcuccccgccgccuucgagugcuccgacuccuucucccucgacaugaccgagggcgaggagaagggcaaccgcgcccucgaccaguucacccucgccuccuucggcgagggcgaccgcggcgucucccccccccccucccccuucuucuccgccauccucgccgccuuccagcccgccgccugcgacgacgccgaggaggccuggcgcucccacaucaaccagcucaugugcgacuccgacggcuccugcgccgucuacaccuuccacgucuucuccucccucuucaagaacauccagaagcgcuucugcuuccucaccugcgacgccgccuccuaccucggcgacaaccuccgcggcaucggcuccaaguucgucuccuccucccagaugcucaccuccugcuccgagugccccacccucuucgucgacgccgagacccuccucuccugcggccuccucgacaagcucaaguucuccguccucgagcuccaggaguaccucgacaccuacaacaaccgcaaggaggccacccucuccuggcucgccaacugcaaggccaccuucgccggcggcucccgcgacggcgucaucaccugccagcccggcgacuccgaggagaagcagcucgagcucugccagcgccucuacaagcuccacuuccagcuccuccuccucuuccaguccuacugcaagcucaucggccagguccacgaggucuccuccaugcccgagcuccucaacaugucccgcgagcucuccgaccucaagaagcaccucaaggaggccuccgccgucaucgccgccgacccccucuacuccgacggcgccugguccgagcccaccuucaccuccaccgaggccgccauccaguccaugcucgagugccucaagaacaacgagcucggcaaggcccuccgccagauccgcgagugccgcucccucuggcccaacgacaucuucggcuccuccuccgacgacgagguccagacccuccucaacaucuacuuccgccaccagacccucggccagaccggcaccuacgcccucgucggcuccaaccagucccucaccgagaucugcaccaagcucauggagcucaacauggagauccgcgacaugauccgccgcgcccaguccuaccgcguccucaccaccuuccuccccgacuccuccgucuccggcaccucccucuga

SEQ ID NO: 43365 - RNA, 9042 nt, Artificial Sequence
  derived and/or modified sequence opt2 from FRYL__Homo_sapiens__NP_055845
auguccaacaucaccaucgaccccgacgucaagcccggcgaguacgucaucaagucccucuucgccgaguucgccguccaggccgagaagaagaucgaggucgucauggccgagccccucgagaagcuccucucccgcucccuccagcgcggcgaggaccuccaguucgaccagcucaucuccuccauguccuccgucgccgagcacugccuccccucccuccuccgcacccucuucgacugguaccgccgccagaacggcaccgaggacgaguccuacgaguaccgcccccgcuccuccaccaaguccaagggcgacgagcagcagcgcgagcgcgacuaccuccucgagcgccgcgaccucgccgucgacuucaucuucugccucguccucgucgagguccucaagcagauccccguccaccccguccccgacccccucguccacgagguccucaaccucgccuucaagcacuucaagcacaaggagggcuacuccggcaccaacaccggcaacguccacaucaucgccgaccucuacgccgaggucaucggcguccucgcccaguccaaguuccaggccguccgcaagaaguucgucaccgagcucaaggagcuccgccagaaggagcaguccccccacgucguccaguccgucaucucccucaucaugggcaugaaguucuuccgcgucaagauguaccccgucgaggacuucgaggccuccuuccaguucaugcaggagugcgcccaguacuuccucgaggucaaggacaaggacaucaagcacgcccucgccggccucuucgucgagauccucauccccgucgccgccgccgucaagaacgaggucaacguccccugccucaagaacuucgucgagaugcucuaccagaccaccuucgagcucuccucccgcaagaagcacucccucgcccucuacccccucaucaccugccuccucugcgucucccagaagcaguucuuccucaacaacuggcacaucuuccuccagaacugccucucccaccucaagaacaaggaccccaagaugucccgcgucgcccucgagucccucuaccgccuccucugggucuacgucauccgcaucaagugcgaguccaacaccgucacccagucccgccucauguccaucgucuccgcccucuuccccaagggcucccgcuccgucgucccccgcgacaccccccucaacaucuucgucaagaucauccaguucaucgcccaggagcgccucgacuucgccaugaaggagaucaucuucgaccuccucuccgucggcaaguccaccaagaccuucaccaucaaccccgagcgcaugaacaucggccuccgcgucuuccucgucaucgccgacucccuccagcagaaggacggcgagccccccaugcccaccaccggcgucauccuccccuccggcaacacccuccgcgucaagaagaucuuccucaacaagacccucaccgacgaggaggccaaggucaucggcauguccgucuacuacccccagguccgcaaggcccucgacuccauccuccgccaccucgacaaggaggucggccgccccaugugcaugaccuccguccagauguccaacaaggagcccgaggacaugaucaccggcgagcgcaagcccaagaucgaccucuuccgcaccugcaucgccgccaucccccgccucauccccgacggcaugucccgcaccgaccucaucgagcuccucgcccgccucaccauccacauggacgaggagcuccgcgcccucgccuucaacacccuccaggcccucaugcucgacuuccccgacuggcgcgaggacguccucuccggcuucgucuacuucaucguccgcgaggucaccgacguccaccccacccuccucgacaacgccgucaagaugcucguccagcucaucaaccaguggaagcaggccgcccagaugcacaacaagaaccaggacacccagcacggcgucgccaacggcgccucccacccccccccccucgagcgcucccccuacuccaacgucuuccacgucgucgagggcuucgcccucgucauccucugcuccucccgccccgccacccgccgccucgccgucuccguccuccgcgagauccgcgcccucuucgcccuccucgagauccccaagggcgacgacgagcucgccaucgacgucauggaccgccucucccccuccauccucgaguccuucauccaccucaccggcgccgaccagaccacccuccucuacugccccuccuccaucgaccuccagacccucgccgaguggaacuccucccccaucucccaccaguucgacgucaucucccccucccacaucuggaucuucgcccacgucacccagggccaggaccccuggaucaucucccucuccuccuuccucaagcaggagaaccuccccaagcacugcuccaccgccgucuccuacgccuggauguucgccuacacccgccuccagcuccucuccccccaggucgacaucaacucccccaucaacgccaagaaggucaacaccaccaccuccuccgacuccuacaucggccucuggcgcaacuaccucauccucugcugcuccgccgccaccuccuccuccuccaccuccgccggcuccguccgcugcuccccccccgagacccucgccuccacccccgacuccggcuacuccaucgacuccaagaucaucggcauccccucccccuccucccucuucaagcacaucguccccaugaugcgcuccgaguccauggagaucaccgagucccucguccucggccucggccgcaccaaccccggcgccuuccgcgagcucaucgaggagcuccaccccaucaucaaggaggcccucgagcgccgccccgagaacaugaagcgccgccgccgccgcgacauccuccgcguccagcucguccgcaucuucgagcuccucgccgacgccggcgucaucucccacuccgccuccggcggccucgacaacgagacccacuuccucaacaacacccuccucgaguacgucgaccucacccgccagcuccucgaggccgagaacgagaaggacuccgacacccucaaggacauccgcugccacuucuccgcccucgucgccaacaucauccagaacguccccguccaccagcgccgcuccaucuucccccagcagucccuccgccacucccucuucaugcucuucucccacugggccggccccuucuccaucauguucaccccccucgaccgcuacuccgaccgcaacaugcagaucaaccgccaccaguacugcgcccucaaggccauguccgccguccucugcugcggccccgucgccgacaacgucggccucuccuccgacggcuaccucuacaaguggcucgacaacauccucgacucccucgacaagaagguccaccagcucggcugcgaggccgucacccuccuccucgagcucaaccccgaccaguccaaccucauguacugggccgucgaccgcugcuacaccggcuccggccgcgucgccgccggcugcuucaaggccaucgccaacgucuuccagaaccgcgacuaccagugcgacaccgucaugcuccucaaccucauccucuucaaggccgccgacuccucccgcuccaucuacgaggucgccaugcagcuccuccagauccucgagcccaagauguuccgcuacgcccacaagcucgagguccagcgcaccgacggcguccucucccagcucuccccccucccccaccucuacuccgucuccuacuaccagcucuccgaggagcucgcccgcgccuaccccgagcucacccucgccaucuucuccgagaucucccagcgcauccagaccgcccaccccgccggccgccaggucaugcuccacuaccuccuccccuggaugaacaacaucgagcucgucgaccucaagccccuccccaccgcccgccgccacgacgaggacgaggacgacucccucaaggaccgcgagcucauggucaccucccgccgcuggcuccgcggcgagggcuggggcuccccccaggccaccgccaugguccucaacaaccucauguacaugaccgccaaguacggcgacgagcucgccugguccgaggucgagaacgucuggaccacccucgccgacggcuggcccaagaaccucaagaucauccuccacuuccucaucuccaucugcggcgucaacuccgagcccucccuccuccccuacgucaagaaggucaucgucuaccucggccgcgacaagaccaugcagcuccucgaggagcucgucuccgagcuccagcucaccgaccccgucuccuccggcgucacccacauggacaacccccccuacuaccgcaucaccuccuccuacaagauccccuccgucaccuccggcaccaccuccuccuccaacaccauggucgcccccaccgacggcaaccccgacaacaagcccaucaaggagaacaucgaggaguccuacguccaccucgacaucuacuccggccucaacucccaccucaaccgccagcaccaccgccucgagucccgcuacuccuccuccuccggcggcuccuacgaggaggagaaguccgacuccaugccccucuacuccaacuggcgccucaaggucauggagcacaaccagggcgagccccuccccuucccccccgccggcggcugcugguccccccucgucgacuacguccccgagaccuccucccccggccucccccuccaccgcugcaacaucgccgucauccuccucaccgaccucaucaucgaccacuccgucaaggucgaguggggcuccuaccuccaccuccuccuccacgccaucuucaucggcuucgaccacugccaccccgaggucuacgagcacugcaagcgccuccuccuccaccuccucaucgucaugggccccaacuccaacauccgcaccgucgccuccguccuccuccgcaacaaggaguucaacgagccccgcguccucaccgucaagcaggucgcccaccucgacuacaacuucaccgccggcaucaacgacuucauccccgacuaccagcccucccccaugaccgacuccggccucuccuccuccuccaccuccuccuccaucucccucggcaacaacuccgccgccaucucccaccuccacaccaccauccucaacgaggucgacaucuccgucgagcaggacggcaaggucaagacccucauggaguucaucaccucccgcaagcgcggcccccucuggaaccacgaggacgucuccgccaagaaccccuccaucaaguccgccgagcagcucaccaccuuccucaagcacgucgucuccgucuucaagcaguccuccuccgagggcauccaccucgagcaccaccucuccgaggucgcccuccagaccgcccucuccugcuccucccgccacuacgccggccgcuccuuccagaucuuccgcgcccucaagcagccccucaccgccaccacccucuccgacguccucucccgccucgucgagaccgucggcgaccccggcgaggacgcccagggcuucgucaucgagcuccuccucacccucgaguccgccaucgacacccucgccgagaccaugaagcacuacgaccuccucuccgcccucucccagaccuccuaccacgaccccaucaugggcaacaaguacgccgccaaccgcaaguccaccggccagcucaaccucuccaccucccccaucaacuccuccuccuaccucggcuacaacuccaacgcccgcuccaacucccuccgccucucccucaucggcgaccgccgcggcgaccgccgccgcuccaacacccucgacaucauggacggccgcaucaaccacuccuccucccucgcccgcacccgcucccucuccucccuccgcgagaagggcauguacgacguccaguccaccaccgagcccaccaaccucauggccaccaucuucuggaucgccgccucccuccucgaguccgacuacgaguacgaguaccuccucgcccuccgccuccucaacaagcuccucauccaccucccccucgacaaguccgagucccgcgagaagaucgagaacguccaguccaagcucaaguggaccaacuuccccggccuccagcagcucuuccucaagggcuucaccuccgccuccacccaggagaugaccguccaccuccucuccaagcucaucuccgucuccaagcacacccucgucgaccccucccagcucuccggcuucccccucaacauccucugccuccucccccaccucauccagcacuucgacucccccacccaguucugcaaggagaccgccucccgcaucgccaaggucugcgccgaggagaagugccccacccucgucaaccucgcccacaugaugucccucuacuccacccacaccuacucccgcgacugcuccaacuggaucaacgucgucugccgcuaccuccacgacuccuucuccgacaccaccuucaaccucgucaccuaccucgccgagcuccucgagaagggccucuccuccaugcagcagucccuccuccagaucaucuacucccuccucucccacaucgaccucuccgccgcccccgccaagcaguucaaccucgagaucaucaagaucaucggcaaguacguccagucccccuacuggaaggaggcccucaacauccucaagcucgucgucucccgcuccgccucccucgucguccccuccgacauccccaagaccuacggcggcgacaccggcucccccgagaucuccuucaccaagaucuucaacaacgucuccaaggagcuccccggcaagacccucgacuuccacuucgacaucuccgagacccccaucaucggcaacaaguacggcgaccagcacuccgccgccggccgcaacggcaagcccaaggucaucgccgucacccgcuccaccuccuccaccuccuccggcuccaacuccaacgcccucguccccgucuccuggaagcgcccccagcucucccagcgccgcacccgcgagaagcucaugaacguccucucccucugcggccccgaguccggccuccccaagaaccccuccgucgucuucuccuccaacgaggaccucgaggucggcgaccagcagaccucccucaucuccaccaccgaggacaucaaccaggaggaggaggucgccgucgaggacaacuccuccgagcagcaguucggcgucuucaaggacuucgacuuccucgacgucgagcucgaggacgccgagggcgaguccauggacaacuucaacuggggcguccgccgccgcucccucgacuccaucgacaagggcgacacccccucccuccaggaguaccagugcuccuccuccacccccucccucaaccucaccaaccaggaggacaccgacgaguccuccgaggaggaggccgcccucaccgccucccagauccucucccgcacccagaugcucaacuccgacuccgccaccgacgagaccauccccgaccaccccgaccuccuccuccaguccgaggacuccaccggcuccaucaccaccgaggagguccuccagauccgcgacgagacccccacccucgaggccucccucgacaacgccaacucccgccuccccgaggacaccaccuccguccucaaggaggagcacgucaccaccuucgaggacgagggcuccuacaucauccaggagcagcaggagucccucgucugccagggcauccucgaccucgaggagaccgagaugcccgagccccucgcccccgaguccuaccccgaguccgucugcgaggaggacgucacccucgcccucaaggagcucgacgagcgcugcgaggaggaggaggccgacuucuccggccucuccucccaggacgaggaggagcaggacggcuuccccgagguccagaccuccccccuccccucccccuuccucuccgccaucaucgccgccuuccagcccgucgccuacgacgacgaggaggaggccuggcgcugccacgucaaccagaugcucuccgacaccgacggcuccuccgccgucuucaccuuccacgucuucucccgccucuuccagaccauccagcgcaaguucggcgagaucaccaacgaggccgucuccuuccucggcgacucccuccagcgcaucggcaccaaguucaaguccucccucgaggucaugaugcucugcuccgagugccccaccgucuucgucgacgccgagacccucauguccugcggccuccucgagacccucaaguucggcguccucgagcuccaggagcaccucgacaccuacaacgucaagcgcgaggccgccgagcaguggcucgacgacugcaagcgcaccuucggcgccaaggaggacauguaccgcaucaacaccgacgcccagcagauggagauccucgccgagcucgagcucugccgccgccucuacaagcuccacuuccagcuccuccuccucuuccaggccuacugcaagcucaucaaccaggucaacaccaucaagaacgaggccgaggucaucaacauguccgaggagcucgcccagcucgaguccauccucaaggaggccgaguccgccuccgagaacgaggagaucgacaucuccaaggccgcccagaccaccaucgagaccgccauccacucccucaucgagacccucaagaacaaggaguucaucuccgccgucgcccaggucaaggccuuccgcucccucuggcccuccgacaucuucggcuccugcgaggacgaccccguccagacccuccuccacaucuacuuccaccaccagacccucggccagaccggcuccuucgccgucaucggcuccaaccucgacauguccgaggccaacuacaagcucauggagcucaaccucgagauccgcgagucccuccgcaugguccaguccuaccagcuccucgcccaggccaagcccaugggcaacauggucuccaccggcuucuga

SEQ ID NO: 43366 - RNA, 978 nt, Artificial Sequence
  derived and/or modified sequence opt2 from FRZB__Homo_sapiens__NP_001454
auggucugcggcucccccggcggcaugcuccuccuccgcgccggccuccucgcccucgccgcccucugccuccuccgcguccccggcgcccgcgccgccgccugcgagcccguccgcaucccccucugcaagucccuccccuggaacaugaccaagaugcccaaccaccuccaccacuccacccaggccaacgccauccucgccaucgagcaguucgagggccuccucggcacccacugcucccccgaccuccucuucuuccucugcgccauguacgcccccaucugcaccaucgacuuccagcacgagcccaucaagcccugcaaguccgucugcgagcgcgcccgccagggcugcgagcccauccucaucaaguaccgccacuccuggcccgagaaccucgccugcgaggagcuccccgucuacgaccgcggcgucugcaucucccccgaggccaucgucaccgccgacggcgccgacuuccccauggacuccuccaacggcaacugccgcggcgccuccuccgagcgcugcaagugcaagcccauccgcgccacccagaagaccuacuuccgcaacaacuacaacuacgucauccgcgccaaggucaaggagaucaagaccaagugccacgacgucaccgccgucgucgaggucaaggagauccucaaguccucccucgucaacaucccccgcgacaccgucaaccucuacaccuccuccggcugccucugccccccccucaacgucaacgaggaguacaucaucaugggcuacgaggacgaggagcgcucccgccuccuccucgucgagggcuccaucgccgagaaguggaaggaccgccucggcaagaaggucaagcgcugggacaugaagcuccgccaccucggccucuccaaguccgacuccuccaacuccgacuccacccagucccagaaguccggccgcaacuccaacccccgccaggcccgcaacuga

SEQ ID NO: 43367 - RNA, 900 nt, Artificial Sequence
  derived and/or modified sequence opt2 from FSBP__Homo_sapiens__NP_001243070
auggucggcaaggcccgcuccuccaacuucacccucuccgagaagcucgaccuccucaagcucgucaagcccuacgucaagauccucgaggagcacaccaacaagcacuccgucaucgucgagaagaaccgcugcugggacaucaucgccgucaacuacaacgccaucggcgucgaccgccccccccgcaccgcccagggccuccgcacccucuacaagcgccucaaggaguacgccaagcaggagcuccuccagcagaaggagacccaguccgacuucaaguccaacaucuccgagcccaccaagaaggucauggagaugaucccccagaucuccuccuucugccucguccgcgaccgcaaccacauccaguccgccaaccucgacgaggaggcccaggccggcaccuccucccuccaggucaugcucgaccaccaccccgucgccaucaccgucgaggucaagcaggaggaggacaucaagcccccccccccccucguccucaacucccagcaguccgacacccucgagcagcgcgaggagcacgagcucguccacgucauggagcgcucccucucccccucccucuccuccgucgacaugcgcaugaccuccucccccuccuccaucccccgccgcgacgacuucuuccgccacgaguccggcgagcacuuccgcucccuccucggcuacgacccccagauccuccagaugcucaaggaggagcaccagaucauccucgagaaccagaagaacuucggccucuacguccaggagaagcgcgacggccucaagcgccgccagcagcucgaggaggagcuccuccgcgccaagaucgaggucgagaagcucaaggccauccgccuccgccacgaccuccccgaguacaacucccucuga

SEQ ID NO: 43368 - RNA, 2478 nt, Artificial Sequence
  derived and/or modified sequence opt2 from FSCB__Homo_sapiens__NP_115511
auggucggcaagucccagcagaccgacgucaucgagaagaagaagcacauggccauccccaaguccuccucccccaaggccacccaccgcaucggcaacaccuccggcuccaagggcuccuacuccgccaaggccuacgaguccauccgcgucuccuccgagcuccagcagaccuggaccaagcgcaagcacggccaggagaugaccuccaagucccuccagaccgacaccaucgucgaggagaagaaggaggucaagcucgucgaggagaccgucguccccgaggagaaguccgccgacguccgcgaggccgccaucgagcuccccgaguccguccaggacgucgagaucccccccaacauccccuccguccagcucaagauggaccgcucccagcagaccucccgcaccggcuacuggaccaugaugaacaucccccccgucgagaaggucgacaaggagcagcagaccuacuucuccgaguccgagaucgucgucaucucccgccccgacuccuccuccaccaaguccaaggaggacgcccucaagcacaaguccuccggcaagaucuucgccuccgagcaccccgaguuccagcccgccaccaacuccaacgaggagaucggccagaagaacaucucccgcaccuccuucacccaggagaccaagaagggcccccccguccuccucgaggacgagcuccgcgaggaggucaccguccccgucguccaggagggcuccgccgucaagaaggucgccuccgccgagaucgagccccccuccaccgagaaguuccccgccaagauccagcccccccucgucgaggaggccaccgccaaggccgagccccgccccgccgaggagacccacguccagguccagcccuccaccgaggagacccccgacgccgaggccgccaccgccgucgccgagaacuccgucaagguccagcccccccccgccgaggaggccccccucgucgaguuccccgccgagauccagccccccuccgccgaggagucccccuccgucgagcuccucgccgagauccucccccccuccgccgaggagucccccuccgaggagccccccgccgagauccuccccccccccgccgagaagucccccuccgucgagcuccucggcgagauccgcucccccuccgcccagaaggcccccaucgagguccagccccuccccgccgagggcgcccucgaggaggcccccgccaaggucgagccccccaccgucgaggagacccucgccgacguccagccccuccuccccgaggaggccccccgcgaggaggcccgcgagcuccagcucuccaccgccauggagacccccgccgaggaggcccccaccgaguuccaguccccccuccccaaggagaccaccgccgaggaggccuccgccgagauccagcuccucgccgccaccgagccccccgccgacgagacccccgccgaggcccgcuccccccucuccgaggagaccuccgccgaggaggcccacgccgagguccaguccccccucgccgaggagaccaccgccgaggaggccuccgccgagauccagcuccucgccgccaucgaggcccccgccgacgagacccccgccgaggcccaguccccccucuccgaggagaccuccgccgaggaggcccccgccgagguccagucccccuccgccaagggcgucuccaucgaggaggccccccucgagcuccagccccccuccggcgaggagaccaccgccgaggaggccuccgccgccauccagcuccucgccgccaccgaggccuccgccgaggaggcccccgccgagguccagcccccccccgccgaggaggcccccgccgagguccagcccccccccgccgaggaggcccccgccgagguccagcccccccccgccgaggaggcccccgccgagguccagcccccccccgccgaggaggcccccgccgagguccagcccccccccgccgaggaggcccccgccgagguccagcccccccccgccgaggaggcccccgccgagguccagucccuccccgccgaggagacccccaucgaggagacccucgccgccguccacuccccccccgccgacgacguccccgccgaggaggccuccgucgacaagcacuccccccccgccgaccuccuccucaccgaggaguuccccaucggcgaggccuccgccgaggucucccccccccccuccgagcagacccccgaggacgaggcccucgucgagaacgucuccaccgaguuccaguccccccaggucgccggcauccccgccgucaagcucggcuccgucguccucgagggcgaggccaaguucgaggaggucuccaagaucaacuccguccucaaggaccucuccaacaccaacgacggccaggcccccacccucgagaucgaguccgucuuccacaucgagcucaagcagcgcccccccgagcucuga

SEQ ID NO: 43369 - RNA, 1482 nt, Artificial Sequence
  derived and/or modified sequence opt2 from FSCN1__Homo_sapiens__NP_003079
augaccgccaacggcaccgccgaggccguccagauccaguucggccucaucaacugcggcaacaaguaccucaccgccgaggccuucggcuucaaggucaacgccuccgccuccucccucaagaagaagcagaucuggacccucgagcagccccccgacgaggccggcuccgccgccgucugccuccgcucccaccucggccgcuaccucgccgccgacaaggacggcaacgucaccugcgagcgcgagguccccggccccgacugccgcuuccucaucgucgcccacgacgacggccgcuggucccuccaguccgaggcccaccgccgcuacuucggcggcaccgaggaccgccucuccugcuucgcccagaccgucucccccgccgagaagugguccguccacaucgccaugcacccccaggucaacaucuacuccgucacccgcaagcgcuacgcccaccucuccgcccgccccgccgacgagaucgccgucgaccgcgacguccccuggggcgucgacucccucaucacccucgccuuccaggaccagcgcuacuccguccagaccgccgaccaccgcuuccuccgccacgacggccgccucgucgcccgccccgagcccgccaccggcuacacccucgaguuccgcuccggcaaggucgccuuccgcgacugcgagggccgcuaccucgcccccuccggccccuccggcacccucaaggccggcaaggccaccaaggucggcaaggacgagcucuucgcccucgagcaguccugcgcccaggucguccuccaggccgccaacgagcgcaacgucuccacccgccagggcauggaccucuccgccaaccaggacgaggagaccgaccaggagaccuuccagcucgagaucgaccgcgacaccaagaagugcgccuuccgcacccacaccggcaaguacuggacccucaccgccaccggcggcguccaguccaccgccuccuccaagaacgccuccugcuacuucgacaucgaguggcgcgaccgccgcaucacccuccgcgccuccaacggcaaguucgucaccuccaagaagaacggccagcucgccgccuccgucgagaccgccggcgacuccgagcucuuccucaugaagcucaucaaccgccccaucaucgucuuccgcggcgagcacggcuucaucggcugccgcaaggucaccggcacccucgacgccaaccgcuccuccuacgacgucuuccagcucgaguucaacgacggcgccuacaacaucaaggacuccaccggcaaguacuggaccgucggcuccgacuccgccgucaccuccuccggcgacacccccgucgacuucuucuucgaguucugcgacuacaacaaggucgccaucaaggucggcggccgcuaccucaagggcgaccacgccggcguccucaaggccuccgccgagaccgucgaccccgccucccucugggaguacuga

SEQ ID NO: 43370 - RNA, 1551 nt, Artificial Sequence
  derived and/or modified sequence opt2 from FSCN2__Homo_sapiens__XP_011522894
augcccaccaacggccuccaccagguccucaagauccaguucggccucgucaacgacaccgaccgcuaccucaccgccgaguccuucggcuucaaggucaacgccuccgcccccucccucaagcgcaagcagaccuggguccucgagcccgaccccggccagggcaccgccguccuccuccgcuccucccaccucggccgcuaccucuccgccgaggaggacggccgcgucgccugcgaggccgagcagcccggccgcgacugccgcuuccucguccucccccagcccgacggccgcuggguccuccgcuccgagccccacggccgcuucuucggcggcaccgaggaccagcucuccugcuucgccaccgccgucucccccgccgagcucuggaccguccaccucgccauccacccccaggcccaccuccucuccgucucccgccgccgcuacguccaccucugcccccgcgaggacgagauggccgccgacggcgacaagcccuggggcgucgacgcccuccucacccucaucuuccgcucccgccgcuacugccucaaguccugcgacucccgcuaccuccgcuccgacggccgccucgucugggagcccgagccccgcgccugcuacacccucgaguucaaggccggcaagcucgccuucaaggacugcgacggccacuaccucgcccccgucggccccgccggcacccucaaggccggccgcaacacccgccccggcaaggacgagcucuucgaccucgaggagucccacccccaggucguccucgucgccgccaaccaccgcuacgucuccguccgccagggcgucaacgucuccgccaaccaggacgacgagcucgaccacgagaccuuccucaugcagaucgaccaggagaccaagaagugcaccuucuacuccuccaccggcggcuacuggacccucgucacccacggcggcauccacgccaccgccacccaggucuccgccaacaccauguucgagauggaguggcgcggccgccgcgucgcccucaaggccuccaacggccgcuacgucugcaugaagaagaacggccagcucgccgccaucuccgacuucgucggcccccccccccgccccgccuggaccggcaaggucgccggcggcgccgcccagcagacccucuccccccccggcaaggacgaggaguucacccucaagcucaucaaccgccccauccucguccuccgcggccucgacggcuucgucugccaccaccgcggcuccaaccagcucgacaccaaccgcuccgucuacgacgucuuccaccucuccuucuccgacggcgccuaccgcauccgcggccgcgacggcggcuucugguacaccggcucccacggcuccgucugcuccgacggcgagcgcgccgaggacuucgucuucgaguuccgcgagcgcggccgccucgccauccgcgcccgcuccggcaaguaccuccgcggcggcgccuccggccuccuccgcgccgacgccgacgcccccgccggcaccgcccucugggaguacuga

SEQ ID NO: 43371 - RNA, 1491 nt, Artificial Sequence
  derived and/or modified sequence opt2 from FSD1__Homo_sapiens__NP_077309
auggaggagcagcgcgaggcccuccgcaagaucaucaagacccucgccgucaagaacgaggagauccaguccuucaucuacucccucaagcagaugcuccucaacgucgaggccaacuccgccaagguccaggaggaccucgaggccgaguuccagucccucuucucccuccucgaggagcucaaggagggcaugcucaugaagaucaagcaggaccgcgccucccgcaccuacgagcuccagaaccagcucgccgccugcacccgcgcccucgaguccuccgaggagcuccucgagaccgccaaccagacccuccaggccauggacuccgaggacuucccccaggccgccaagcagaucaaggacggcgucaccauggcccccgccuuccgccucucccucaaggccaaggucuccgacaacaugucccaccucauggucgacuucgcccaggagcgccagaugcuccaggcccucaaguuccuccccguccccuccgcccccgucaucgaccucgccgagucccucgucgccgacaacugcgucacccucgucuggcgcaugcccgacgaggacuccaagaucgaccacuacguccucgaguaccgccgcaccaacuucgagggccccccccgccucaaggaggaccagcccuggauggucaucgagggcauccgccagaccgaguacacccucaccggccucaaguucgacaugaaguacaugaacuuccgcgucaaggccugcaacaaggccgucgccggcgaguucuccgagcccgucacccucgagacccccgccuucauguuccgccucgacgccuccaccucccaccagaaccuccgcgucgacgaccucuccgucgagugggacgccaugggcggcaagguccaggacaucaaggcccgcgagaaggacggcaagggccgcaccgccucccccaucaacucccccgcccgcggcacccccucccccaagcgcaugcccuccggccgcggcggccgcgaccgcuucaccgccgaguccuacaccguccucggcgacacccucaucgacggcggcgagcacuacugggagguccgcuacgagcccgacuccaaggccuucggcgucggcgucgccuaccgcucccucggccgcuucgagcagcucggcaagaccgccgccuccuggugccuccacgucaacaacuggcuccaggucuccuucaccgccaagcacgccaacaaggucaagguccucgacgcccccguccccgacugccucggcguccacugcgacuuccaccagggccuccucuccuucuacaacgcccgcaccaagcagguccuccacaccuucaagacccgcuucacccagccccuccuccccgccuucaccgucuggugcggcuccuuccaggucaccaccggccuccagguccccuccgccguccgcugccuccagaagcgcggcuccgccaccuccuccuccaacaccucccucaccuga

SEQ ID NO: 43372 - RNA, 1593 nt, Artificial Sequence
  derived and/or modified sequence opt2 from FSD1L__Homo_sapiens__NP_001138785
auggacucccagaaguacugcuucaaggagaacgagaacgucaccgucgacaaggccugcuuccucaucuccaacaucaccaucggccccgaguccaucaaccuccagcaggaggcccuccagcgcaucaucuccacccucgccaacaagaacgacgagauccagaacuucaucgacacccuccaccacacccucaagggcguccaggagaacuccuccaacauccucuccgagcucgacgaggaguucgacucccucuacuccauccucgacgaggucaaggaguccaugaucaacugcaucaagcaggagcaggcccgcaagucccaggagcuccagucccagaucucccagugcaacaacgcccucgagaacuccgaggagcuccucgaguucgccacccgcucccucgacaucaaggagcccgaggaguucuccaaggccgcccgccagaucaaggaccgcgucaccauggccuccgccuuccgccucucccucaagcccaaggucuccgacaacaugacccaccucauggucgacuucucccaggagcgccagaugcuccagacccucaaguuccuccccguccccaaggcccccgagaucgaccccgucgagugccucgucgccgacaacuccgucaccgucgccuggcgcaugcccgaggaggacaacaagaucgaccacuucauccucgagcaccgcaagaccaacuucgacggccucccccgcgucaaggacgagcgcugcugggagaucaucgacaacaucaagggcaccgaguacacccucuccggccucaaguucgacuccaaguacaugaacuuccgcguccgcgccugcaacaaggccgucgccggcgaguacuccgaccccgucacccucgagaccaaggcccucaacuucaaccucgacaacuccuccucccaccucaaccucaaggucgaggacaccugcgucgagugggaccccaccggcggcaagggccaggaguccaagaucaagggcaaggagaacaagggccgcuccggcacccccucccccaagcgcaccuccgucggcucccgcccccccgccguccgcggcucccgcgaccgcuucaccggcgaguccuacaccguccucggcgacaccgccaucgaguccggccagcacuacugggaggucaaggcccagaaggacugcaaguccuacuccgucggcgucgccuacaagacccucggcaaguucgaccagcucggcaagaccaacaccuccuggugcauccacgucaacaacuggcuccagaacaccuucgccgccaagcacaacaacaaggucaaggcccucgacgucaccguccccgagaagaucggcgucuucugcgacuucgacggcggccagcucuccuucuacgacgccaacuccaagcagcuccucuacuccuucaagaccaaguucacccagcccguccuccccggcuucauggucuggugcggcggccucucccucuccaccggcaugcagguccccuccgccguccgcacccuccagaaguccgagaacggcaugaccggcuccgccuccucccucaacaacgucgucacccaguga

SEQ ID NO: 43373 - RNA, 2250 nt, Artificial Sequence
  derived and/or modified sequence opt2 from FSD2__Homo_sapiens__NP_001007123
auggaggaggaguccggcgaggagcucggccucgaccgcuccacccccaaggacuuccacuucuaccacauggaccucuacgacuccgaggaccgccuccaccucuuccccgaggagaacacccgcaugcgcaaggucguccaggccgagauggccaacgagucccgcggcgccggcgacggcaaggcccagcgcgaccuccaggaggaggucgacgagcucguccaccucuacggccucgaggacgaccacgagcucggcgacgaguucgucgacgagaacaucccccgcaccggcgucuccgaguacccccccuacaugaugaagcgccgcgaccccgcccgcgagcagcgcgacuggcgccucuccggcgaggccgccgaggccgaggaccucggcuucggcggcuggggcuccgccggccagugccaggaccuccgcgaggccuaccgcuacacccacggccgcgccuccgaggaguacgagugcuacgucauccccgaggaggaggacgaggaggaggccgccgacgucuucugcgucaccugcaagacccccauccgcgccuuccagaaggucuucgacgagcacaaggagcacgaggucaucccccucaacgaggcccucgaguccgccaaggacgagauccacaagaacauguacaagcucgagaagcagaucaucgagauggagaacuucgccaaccaccucgaggaggucuucaucaccgucgaggagaacuucggcaagcaggagcagaacuucgagucccacuacaacgagauccucgagacccucgcccagaaguacgaggagaagauccaggcccucggcgagaagaagaaggagaagcucgaggcccucuacggccagcucgucuccugcggcgagaaccucgacaccugcaaggagcucauggagaccaucgaggagaugugccacgaggagaaggucgacuucaucaaggacgccgucgccauggccgaccgccucggcaaguuccucaagaccaagaccgacgucgagaucuccgcccagcccgaguucgaggaccagacccucgacuucuccgacgucgagcagcucaugggcuccaucaacaccauccccgcccccuccgcccccgucaucaacccccagguccccaacuccgccaccggcuccuccguccgcgucugcuggucccucuacuccgacgacaccgucgaguccuaccagcucuccuaccgccccguccaggacuccucccccggcaccgaccaggccgaguucaccgucaccgucaaggagaccuacugcuccgucaccaaccucguccccaacacccaguacgaguucugggucaccgcccacaaccgcgccggccccucccccuccuccgagcgcgccgucuacaugaccgcccccuccccccccaucaucaagaccaaggagauccgcuccugcgaggaggccguccucaucugcugggaguccggcaaccucaaccccgucgacuccuacaccgucgagcucacccaggccgagucccccgaggccuccggcgucaccgaguccgucgucggcauccccaccugcgaguccgucguccagcuccagcccggccgcuccuacaucaucuacguccgcgcccucaacaugggcggccccuccguccgcuccgagcccgccaccguccacaccaucggcuccuacuuccgccucaacaaggacaccugccaccccuggcucaccaucuccgaggacggccucaccgccguccgcuccgagcgccgcacccccgcccgcgagcucucccccuccgacacccacuucacccgcugcgucgccgucaugggcaaccucauccccguccgcggccaccacuacugggaggucgaggucgacgagcaccucgacuaccgcgucggcgucgccuucgccgacguccgcaagcaggaggaccucggcgccaacugccucuccuggugcaugcgccacaccuucgccuccucccgccacaaguacgaguuccuccacaaccgcaccacccccgacauccgcaucaccgucccccccaagaagaucggcauccuccucgacuacgagcacuccaagcucuccuucuucaacgucgaccucucccagcaccucuacaccuucuccugccagcuccacgaguucguccaccccugcuucucccucgagaagcccggcugccucaagguccacaacggcaucuccaugcccaagcacgucaccuucuacuga

SEQ ID NO: 43374 - RNA, 390 nt, Artificial Sequence
  derived and/or modified sequence opt2 from FSHB__Homo_sapiens__NP_001018090
augaagacccuccaguucuucuuccucuucugcugcuggaaggccaucugcugcaacuccugcgagcucaccaacaucaccaucgccaucgagaaggaggagugccgcuucugcaucuccaucaacaccaccuggugcgccggcuacugcuacacccgcgaccucgucuacaaggaccccgcccgccccaagauccagaagaccugcaccuucaaggagcucgucuacgagaccguccgcguccccggcugcgcccaccacgccgacucccucuacaccuaccccgucgccacccagugccacugcggcaagugcgacuccgacuccaccgacugcaccguccgcggccucggccccuccuacugcuccuucggcgagaugaaggaguga

SEQ ID NO: 43375 - RNA, 2088 nt, Artificial Sequence
  derived and/or modified sequence opt2 from FSHR__Homo_sapiens__NP_000136
auggcccuccuccucgucucccuccucgccuuccucucccucggcuccggcugccaccaccgcaucugccacugcuccaaccgcgucuuccucugccaggaguccaaggucaccgagauccccuccgaccucccccgcaacgccaucgagcuccgcuucguccucaccaagcuccgcgucauccagaagggcgccuucuccggcuucggcgaccucgagaagaucgagaucucccagaacgacguccucgaggucaucgaggccgacgucuucuccaaccuccccaagcuccacgagauccgcaucgagaaggccaacaaccuccucuacaucaaccccgaggccuuccagaaccuccccaaccuccaguaccuccucaucuccaacaccggcaucaagcaccuccccgacguccacaagauccacucccuccagaagguccuccucgacauccaggacaacaucaacauccacaccaucgagcgcaacuccuucgucggccucuccuucgaguccgucauccucuggcucaacaagaacggcauccaggagauccacaacugcgccuucaacggcacccagcucgacgagcucaaccucuccgacaacaacaaccucgaggagcuccccaacgacgucuuccacggcgccuccggccccgucauccucgacaucucccgcacccgcauccacucccuccccuccuacggccucgagaaccucaagaagcuccgcgcccgcuccaccuacaaccucaagaagcuccccacccucgagaagcucgucgcccucauggaggccucccucaccuaccccucccacugcugcgccuucgccaacuggcgccgccagaucuccgagcuccaccccaucugcaacaaguccauccuccgccaggaggucgacuacaugacccaggcccgcggccagcgcuccucccucgccgaggacaacgaguccuccuacucccgcggcuucgacaugaccuacaccgaguucgacuacgaccucugcaacgaggucgucgacgucaccugcucccccaagcccgacgccuucaaccccugcgaggacaucaugggcuacaacauccuccgcguccucaucugguucaucuccauccucgccaucaccggcaacaucaucguccucgucauccucaccaccucccaguacaagcucaccgucccccgcuuccucaugugcaaccucgccuucgccgaccucugcaucggcaucuaccuccuccucaucgccuccgucgacauccacaccaagucccaguaccacaacuacgccaucgacuggcagaccggcgccggcugcgacgccgccggcuucuucaccgucuucgccuccgagcucuccgucuacacccucaccgccaucacccucgagcgcuggcacaccaucacccacgccaugcagcucgacugcaagguccagcuccgccacgccgccuccgucauggucaugggcuggaucuucgccuucgccgccgcccucuuccccaucuucggcaucuccuccuacaugaaggucuccaucugccuccccauggacaucgacuccccccucucccagcucuacgucaugucccuccucguccucaacguccucgccuucgucgucaucugcggcugcuacauccacaucuaccucaccguccgcaaccccaacaucgucuccuccuccuccgacacccgcaucgccaagcgcauggccaugcucaucuucaccgacuuccucugcauggcccccaucuccuucuucgccaucuccgccucccucaaggucccccucaucaccgucuccaaggccaagauccuccucguccucuuccaccccaucaacuccugcgccaaccccuuccucuacgccaucuucaccaagaacuuccgccgcgacuucuucauccuccucuccaagugcggcugcuacgagaugcaggcccagaucuaccgcaccgagaccuccuccaccguccacaacacccacccccgcaacggccacugcuccuccgccccccgcgucaccuccggcuccaccuacauccucgucccccucucccaccucgcccagaacuga

SEQ ID NO: 43376 - RNA, 1746 nt, Artificial Sequence
  derived and/or modified sequence opt2 from FSIP1__Homo_sapiens__XP_011519608
auggacaucaucaagggcaaccucgacggcaucuccaagcccgccuccaacucccgcauccgccccggcucccgcuccuccaacgccucccucgagguccucuccaccgagcccggcuccuucaaggucgacaccgccuccaaccucaacuccggcaaggaggaccacuccgaguccuccaacaccgagaaccgccgcaccuccaacgacgacaagcaggaguccugcuccgagaagaucaagcucgccgaggagggcuccgacgaggaccucgaccucguccagcaccagaucaucuccgagugcuccgacgagcccaagcucaaggagcucgacucccagcuccaggacgccauccagaagaugaagaagcucgacaagauccucgccaagaagcagcgccgcgagaaggagaucaagaagcagggccucgagaugcgcaucaagcucugggaggagaucaaguccgccaaguacuccgaggccuggcaguccaaggaggagauggagaacaccaagaaguuccucucccucaccgccgucuccgaggagaccgucggccccucccacgaggaggaggacaccuucuccuccgucuuccacacccagaucccccccgaggaguacgagaugcagaugcagaagcucaacaaggacuucaccugcgacgucgagcgcaacgagucccucaucaaguccggcaagaagcccuucuccaacaccgagaagaucgagcuccgcggcaagcacaaccaggacuucaucaagcgcaacaucgagcucgccaaggagucccgcaaccccgucgucauggucgaccgcgagaagaagcgccucgucgagcuccucaaggaccucgacgagaaggacuccggccucuccuccuccgagggcgaccaguccggcugggucguccccgucaagggcuacgagcucgccgucacccagcaccagcagcucgccgagaucgacaucaagcuccaggagcucuccgccgccucccccaccaucuccuccuucuccccccgccucgagaaccgcaacaaccagaagcccgaccgcgacggcgagcgcaacauggaggucacccccggcgagaagauccuccgcaacaccaaggagcagcgcgaccuccacaaccgccuccgcgagaucgacgagaagcucaagaugaugaaggagaacguccucgaguccaccuccugccucuccgaggagcagcucaagugccuccucgacgagugcauccucaagcagaaguccaucaucaagcucuccuccgagcgcaagaaggaggacaucgaggacgucacccccgucuucccccagcucucccgcuccaucaucuccaagcuccucaacgaguccgagaccaagguccagaagaccgaggucgaggacgccgacaugcucgaguccgaggagugcgaggccuccaagggcuacuaccucaccaaggcccucaccggccacaacauguccgaggcccucgucaccgaggccgagaacaugaagugccuccaguucuccaaggacgucaucaucuccgacaccaaggacuacuucauguccaagacccucggcaucggccgccucaagcgccccuccuuccucgacgacccccucuacggcaucuccgucucccucuccuccgaggaccagcaccucaagcucuccucccccgagaacaccaucgccgacgagcaggagaccaaggacgccgccgaggagugcaaggagcccuga

SEQ ID NO: 43377 - RNA, 954 nt, Artificial Sequence
  derived and/or modified sequence opt2 from FST__Homo_sapiens__NP_006341
augguccgcgcccgccaccagcccggcggccucugccuccuccuccuccuccucugccaguucauggaggaccgcuccgcccaggccggcaacugcuggcuccgccaggccaagaacggccgcugccagguccucuacaagaccgagcucuccaaggaggagugcugcuccaccggccgccucuccaccuccuggaccgaggaggacgucaacgacaacacccucuucaaguggaugaucuucaacggcggcgcccccaacugcauccccugcaaggagaccugcgagaacgucgacugcggccccggcaagaagugccgcaugaacaagaagaacaagccccgcugcgucugcgcccccgacugcuccaacaucaccuggaagggccccgucugcggccucgacggcaagaccuaccgcaacgagugcgcccuccucaaggcccgcugcaaggagcagcccgagcucgagguccaguaccagggccgcugcaagaagaccugccgcgacgucuucugccccggcuccuccaccugcgucgucgaccagaccaacaacgccuacugcgucaccugcaaccgcaucugccccgagcccgccuccuccgagcaguaccucugcggcaacgacggcgucaccuacuccuccgccugccaccuccgcaaggccaccugccuccucggccgcuccaucggccucgccuacgagggcaagugcaucaaggccaaguccugcgaggacauccagugcaccggcggcaagaagugccucugggacuucaaggucggccgcggccgcugcucccucugcgacgagcucugccccgacuccaaguccgacgagcccgucugcgccuccgacaacgccaccuacgccuccgagugcgccaugaaggaggccgccugcuccuccggcguccuccucgaggucaagcacuccggcuccugcaacuga

SEQ ID NO: 43378 - RNA, 927 nt, Artificial Sequence
  derived and/or modified sequence opt2 from FSTL1__Homo_sapiens__NP_009016
auguggaagcgcuggcucgcccucgcccucgcccucgucgccgucgccuggguccgcgccgaggaggagcuccgcuccaaguccaagaucugcgccaacgucuucugcggcgccggccgcgagugcgccgucaccgagaagggcgagcccaccugccucugcaucgagcagugcaagccccacaagcgccccgucugcggcuccaacggcaagaccuaccucaaccacugcgagcuccaccgcgacgccugccucaccggcuccaagauccaggucgacuacgacggccacugcaaggagaagaaguccgucucccccuccgccucccccgucgucugcuaccaguccaaccgcgacgagcuccgccgccgcaucauccaguggcucgaggccgagaucauccccgacggcugguucuccaagggcuccaacuacuccgagauccucgacaaguacuucaagaacuucgacaacggcgacucccgccucgacuccuccgaguuccucaaguucgucgagcagaacgagaccgccaucaacaucaccaccuaccccgaccaggagaacaacaagcuccuccgcggccucugcgucgacgcccucaucgagcucuccgacgagaacgccgacuggaagcucuccuuccaggaguuccucaagugccucaaccccuccuucaacccccccgagaagaagugcgcccucgaggacgagaccuacgccgacggcgccgagaccgaggucgacugcaaccgcugcgucugcgccugcggcaacugggucugcaccgccaugaccugcgacggcaagaaccagaagggcgcccagacccagaccgaggaggagaugacccgcuacguccaggagcuccagaagcaccaggagaccgccgagaagaccaagcgcgucuccaccaaggagaucuga

SEQ ID NO: 43379 - RNA, 792 nt, Artificial Sequence
  derived and/or modified sequence opt2 from FSTL3__Homo_sapiens__NP_005851
augcgccccggcgcccccggcccccucuggccccuccccuggggcgcccucgccugggccgucggcuucgucuccuccaugggcuccggcaaccccgcccccggcggcgucugcuggcuccagcagggccaggaggccaccugcucccucguccuccagaccgacgucacccgcgccgagugcugcgccuccggcaacaucgacaccgccugguccaaccucacccaccccggcaacaagaucaaccuccucggcuuccucggccucguccacugccuccccugcaaggacuccugcgacggcgucgagugcggccccggcaaggccugccgcaugcucggcggccgcccccgcugcgagugcgcccccgacugcuccggccuccccgcccgccuccaggucugcggcuccgacggcgccaccuaccgcgacgagugcgagcuccgcgccgcccgcugccgcggccaccccgaccucuccgucauguaccgcggccgcugccgcaaguccugcgagcacgucgucugcccccgcccccaguccugcgucgucgaccagaccggcuccgcccacugcgucgucugccgcgccgcccccugccccguccccuccucccccggccaggagcucugcggcaacaacaacgucaccuacaucuccuccugccacaugcgccaggccaccugcuuccucggccgcuccaucggcguccgccacgccggcuccugcgccggcacccccgaggagccccccggcggcgaguccgccgaggaggaggagaacuucgucuga

SEQ ID NO: 43380 - RNA, 2529 nt, Artificial Sequence
  derived and/or modified sequence opt2 from FSTL4__Homo_sapiens__NP_055897
augaagcccggcggcuucuggcuccaccucacccuccucggcgccucccuccccgccgcccucggcuggauggaccccggcaccucccgcggccccgacgucggcgucggcgagucccaggccgaggagccccgcuccuucgaggucacccgccgcgagggccucuccucccacaacgagcuccucgccuccugcggcaagaaguucugcucccgcggcucccgcugcguccucucccgcaagaccggcgagcccgagugccagugccucgaggccugccgccccuccuacguccccgucugcggcuccgacggccgcuucuacgagaaccacugcaagcuccaccgcgccgccugccuccucggcaagcgcaucaccgucauccacuccaaggacugcuuccucaagggcgacaccugcaccauggccggcuacgcccgccucaagaacguccuccucgcccuccagacccgccuccagccccuccaggagggcgacucccgccaggaccccgccucccagaagcgccuccucgucgagucccucuuccgcgaccucgacgccgacggcaacggccaccucuccuccuccgagcucgcccagcacguccucaagaagcaggaccucgacgaggaccuccucggcugcucccccggcgaccuccuccgcuucgacgacuacaacuccgacuccucccucacccuccgcgaguucuacauggccuuccaggucguccagcucucccucgcccccgaggaccgcgucuccgucaccaccgucaccgucggccucuccaccguccucaccugcgccguccacggcgaccuccgcccccccaucaucuggaagcgcaacggccucacccucaacuuccucgaccucgaggacaucaacgacuucggcgaggacgacucccucuacaucaccaaggucaccaccauccacaugggcaacuacaccugccacgccuccggccacgagcagcucuuccagacccacguccuccaggucaacgucccccccgucauccgcgucuaccccgagucccaggcccaggagcccggcgucgccgccucccuccgcugccacgccgagggcauccccaugccccgcaucaccuggcucaagaacggcgucgacgucuccacccagauguccaagcagcucucccuccucgccaacggcuccgagcuccacaucuccuccguccgcuacgaggacaccggcgccuacaccugcaucgccaagaacgaggucggcgucgacgaggacaucuccucccucuucaucgaggacuccgcccgcaagacccucgccaacauccucuggcgcgaggagggccucuccgucggcaacauguucuacgucuucuccgacgacggcaucaucgucauccaccccgucgacugcgagauccagcgccaccucaagcccaccgagaagaucuucauguccuacgaggagaucugcccccagcgcgagaagaacgccacccagcccugccagugggucuccgccgucaacguccgcaaccgcuacaucuacgucgcccagcccgcccucucccgcguccucgucgucgacauccaggcccagaagguccuccaguccaucggcgucgacccccuccccgccaagcucuccuacgacaagucccacgaccaggucuggguccucuccuggggcgacguccacaagucccgccccucccuccaggucaucaccgaggccuccaccggccagucccagcaccucauccgcacccccuucgccggcgucgacgacuucuucaucccccccaccaaccucaucaucaaccacauccgcuucggcuucaucuucaacaaguccgaccccgccguccacaaggucgaccucgagaccaugaugccccucaagaccaucggccuccaccaccacggcugcgucccccaggccauggcccacacccaccucggcggcuacuucuucauccagugccgccaggacucccccgccuccgccgcccgccagcuccucgucgacuccgucaccgacuccguccucggccccaacggcgacgucaccggcaccccccacaccucccccgacggccgcuucaucgucuccgccgccgccgacucccccuggcuccacguccaggagaucaccguccgcggcgagauccagacccucuacgaccuccagaucaacuccggcaucuccgaccucgccuuccagcgcuccuucaccgaguccaaccaguacaacaucuacgccgcccuccacaccgagcccgaccuccucuuccucgagcucuccaccggcaaggucggcaugcucaagaaccucaaggagccccccgccggccccgcccagcccuggggcggcacccaccgcaucaugcgcgacuccggccucuucggccaguaccuccucacccccgcccgcgagucccucuuccucaucaacggccgccagaacacccuccgcugcgaggucuccggcaucaagggcggcaccaccgucgucugggucggcgaggucuga

SEQ ID NO: 43381 - RNA, 2541 nt, Artificial Sequence
  derived and/or modified sequence opt2 from FSTL5__Homo_sapiens__NP_001121899
auguucaagugcugguccgucguccucguccucggcuucaucuuccucgaguccgagggccgccccaccaaggagggcggcuacggccucaaguccuaccagccccucaugcgccuccgccacaaggagaagaaccaggaguccucccgcgucaagggcuucaugauccaggacggccccuucggcuccugcgagaacaaguacugcggccucggccgccacugcgucaccucccgcgagaccggccaggccgagugcgccugcauggaccucugcaagcgccacuacaagcccgucugcggcuccgacggcgaguucuacgagaaccacugcgagguccaccgcgccgccugccucaagaagcagaagaucaccaucguccacaacgaggacugcuucuucaagggcgacaagugcaagaccaccgaguacuccaagaugaagaacaugcuccucgaccuccagaaccagaaguacaucaugcaggagaacgagaaccccaacggcgacgacaucucccgcaagaagcuccucgucgaccagauguucaaguacuucgacgccgacuccaacggccucgucgacaucaacgagcucacccaggucaucaagcaggaggagcucggcaaggaccucuucgacugcacccucuacguccuccucaaguacgacgacuucaacgccgacaagcaccucgcccucgaggaguucuaccgcgccuuccaggucauccagcucucccuccccgaggaccagaagcucuccaucaccgccgccaccgucggccaguccgccguccucuccugcgccauccagggcacccuccgcccccccaucaucuggaagcgcaacaacaucauccucaacaaccucgaccucgaggacaucaacgacuucggcgacgacggcucccucuacaucaccaaggucaccaccacccacgucggcaacuacaccugcuacgccgacggcuacgagcaggucuaccagacccacaucuuccaggucaacgucccccccgucauccgcgucuaccccgagucccaggcccgcgagcccggcgucaccgccucccuccgcugccacgccgagggcauccccaagccccagcucggcuggcucaagaacggcaucgacaucacccccaagcucuccaagcagcucacccuccaggccaacggcuccgagguccacaucuccaacguccgcuacgaggacaccggcgccuacaccugcaucgccaagaacgaggccggcgucgacgaggacaucuccucccucuucgucgaggacuccgcccgcaagacccucgccaacauccucuggcgcgaggagggccucggcaucggcaacauguucuacgucuucuacgaggacggcaucaaggucauccagcccaucgagugcgaguuccagcgccacaucaagcccuccgagaagcuccucggcuuccaggacgaggucugccccaaggccgagggcgacgagguccagcgcugcgucugggccuccgccgucaacgucaaggacaaguucaucuacgucgcccagcccacccucgaccgcguccucaucgucgacguccagucccagaaggucguccaggccgucuccaccgaccccguccccgucaagcuccacuacgacaagucccacgaccaggucuggguccucuccuggggcacccucgagaagaccucccccacccuccaggucaucacccucgccuccggcaacgucccccaccacaccauccacacccagcccgucggcaagcaguucgaccgcgucgacgacuucuucauccccaccaccacccucaucaucacccacaugcgcuucggcuucauccuccacaaggacgaggccgcccuccagaagaucgaccucgagaccauguccuacaucaagaccaucaaccucaaggacuacaagugcgucccccagucccucgccuacacccaccucggcggcuacuacuucaucggcugcaagcccgacuccaccggcgccgucuccccccaggucauggucgacggcgucaccgacuccgucaucggcuucaacuccgacgucaccggcacccccuacgucucccccgacggccacuaccucgucuccaucaacgacgucaagggccucguccgcguccaguacaucaccauccgcggcgagauccaggaggccuucgacaucuacaccaaccuccacaucuccgaccucgccuuccagcccuccuucaccgaggcccaccaguacaacaucuacggcuccuccuccacccagaccgacguccucuucgucgagcucuccuccggcaaggucaagaugaucaagucccucaaggagccccucaaggccgaggaguggcccuggaaccgcaagaaccgccagauccaggacuccggccucuucggccaguaccucaugacccccuccaaggacucccucuucauccucgacggccgccucaacaagcucaacugcgagaucaccgaggucgagaagggcaacaccgucaucugggucggcgacgccuga

SEQ ID NO: 43382 - RNA, 1626 nt, Artificial Sequence
  derived and/or modified sequence opt2 from FTCD__Homo_sapiens__NP_996848
augucccagcucgucgagugcguccccaacuucuccgagggcaagaaccaggaggucaucgacgccaucuccggcgccaucacccagacccccggcugcguccuccucgacgucgacgccggccccuccaccaaccgcaccgucuacaccuucgucggcccccccgagugcgucgucgagggcgcccucaacgccgcccgcgucgccucccgccucaucgacaugucccgccaccagggcgagcacccccgcaugggcgcccucgacgucugccccuucauccccguccgcggcgucuccgucgacgagugcguccucugcgcccaggccuucggccagcgccucgccgaggagcucgacguccccgucuaccucuacggcgaggccgcccgcauggacucccgccgcacccuccccgccauccgcgccggcgaguacgaggcccuccccaagaagcuccagcaggccgacugggcccccgacuucggccccuccuccuucguccccuccuggggcgccaccgccaccggcgcccgcaaguuccucaucgccuucaacaucaaccuccucggcaccaaggagcaggcccaccgcaucgcccucaaccuccgcgagcagggccgcggcaaggaccagcccggccgccucaagaagguccagggcaucggcugguaccucgacgagaagaaccucgcccaggucuccaccaaccuccucgacuucgaggucaccgcccuccacaccgucuacgaggagaccugccgcgaggcccaggagcucucccuccccgucgucggcucccagcucgucggccucgucccccucaaggcccuccucgacgccgccgccuucuacugcgagaaggagaaccucuucauccucgaggaggagcagcgcauccgccucgucgucucccgccucggccucgacucccucugccccuucucccccaaggagcgcaucaucgaguaccucguccccgagcgcggccccgagcgcggccucggcuccaagucccuccgcgccuucgucggcgaggucggcgcccgcuccgccgcccccggcggcggcuccgucgccgccgccgccgccgccaugggcgccgcccucggcuccauggucggccucaugaccuacggccgccgccaguuccagucccucgacaccaccaugcgccgccucaucccccccuuccgcgaggccuccgccaagcucaccacccucgucgacgccgacgccgaggccuucaccgccuaccucgaggccaugcgccuccccaagaacacccccgaggagaaggaccgccgcaccgccgcccuccaggagggccuccgccgcgccgucuccgucccccucacccucgccgagaccgucgccucccucuggcccgcccuccaggagcucgcccgcugcggcaaccucgccugccgcuccgaccuccaggucgccgccaaggcccucgagaugggcgucuucggcgccuacuucaacguccucaucaaccuccgcgacaucaccgacgaggccuucaaggaccagauccaccaccgcgucuccucccuccuccaggaggccaagacccaggccgcccucguccucgacugccucgagacccgccaggaguga

SEQ ID NO: 43383 - RNA, 552 nt, Artificial Sequence
  derived and/or modified sequence opt2 from FTH1__Homo_sapiens__NP_002023
augaccaccgccuccaccucccagguccgccagaacuaccaccaggacuccgaggccgccaucaaccgccagaucaaccucgagcucuacgccuccuacgucuaccucuccauguccuacuacuucgaccgcgacgacgucgcccucaagaacuucgccaaguacuuccuccaccagucccacgaggagcgcgagcacgccgagaagcucaugaagcuccagaaccagcgcggcggccgcaucuuccuccaggacaucaagaagcccgacugcgacgacugggaguccggccucaacgccauggagugcgcccuccaccucgagaagaacgucaaccagucccuccucgagcuccacaagcucgccaccgacaagaacgacccccaccucugcgacuucaucgagacccacuaccucaacgagcaggucaaggccaucaaggagcucggcgaccacgucaccaaccuccgcaagaugggcgcccccgaguccggccucgccgaguaccucuucgacaagcacacccucggcgacuccgacaacgaguccuga

SEQ ID NO: 43384 - RNA, 528 nt, Artificial Sequence
  derived and/or modified sequence opt2 from FTL__Homo_sapiens__NP_000137
auguccucccagauccgccagaacuacuccaccgacgucgaggccgccgucaacucccucgucaaccucuaccuccaggccuccuacaccuaccucucccucggcuucuacuucgaccgcgacgacgucgcccucgagggcgucucccacuucuuccgcgagcucgccgaggagaagcgcgagggcuacgagcgccuccucaagaugcagaaccagcgcggcggccgcgcccucuuccaggacaucaagaagcccgccgaggacgaguggggcaagacccccgacgccaugaaggccgccauggcccucgagaagaagcucaaccaggcccuccucgaccuccacgcccucggcuccgcccgcaccgacccccaccucugcgacuuccucgagacccacuuccucgacgaggaggucaagcucaucaagaagaugggcgaccaccucaccaaccuccaccgccucggcggccccgaggccggccucggcgaguaccucuucgagcgccucacccucaagcacgacuga

SEQ ID NO: 43385 - RNA, 729 nt, Artificial Sequence
  derived and/or modified sequence opt2 from FTMT__Homo_sapiens__NP_803431
augcucuccugcuuccgccuccucucccgccacaucucccccucccucgccucccuccgccccguccgcugcugcuucgcccucccccuccgcugggcccccggccgcccccucgacccccgccagaucgccccccgccgcccccucgccgccgccgccuccucccgcgaccccaccggccccgccgccggccccucccgcguccgccagaacuuccaccccgacuccgaggccgccaucaaccgccagaucaaccucgagcucuacgccuccuacgucuaccucuccauggccuacuacuucucccgcgacgacgucgcccucaacaacuucucccgcuacuuccuccaccagucccgcgaggagaccgagcacgccgagaagcucaugcgccuccagaaccagcgcggcggccgcauccgccuccaggacaucaagaagcccgagcaggacgacugggaguccggccuccacgccauggagugcgcccuccuccucgagaagaacgucaaccagucccuccucgagcuccacgcccucgccuccgacaagggcgacccccaccucugcgacuuccucgagaccuacuaccucaacgagcaggucaaguccaucaaggagcucggcgaccacguccacaaccucgucaagaugggcgcccccgacgccggccucgccgaguaccucuucgacacccacacccucggcaacgagaacaagcagaacuga

SEQ ID NO: 43386 - RNA, 1518 nt, Artificial Sequence
  derived and/or modified sequence opt2 from FTO__Homo_sapiens__NP_001073901
augaagcgcacccccaccgccgaggagcgcgagcgcgaggccaagaagcuccgccuccucgaggagcucgaggacaccuggcuccccuaccucacccccaaggacgacgaguucuaccagcaguggcagcucaaguaccccaagcucauccuccgcgaggccuccuccgucuccgaggagcuccacaaggagguccaggaggccuuccucacccuccacaagcacggcugccucuuccgcgaccucguccgcauccagggcaaggaccuccucacccccgucucccgcauccucaucggcaaccccggcugcaccuacaaguaccucaacacccgccucuucaccguccccuggcccgucaagggcuccaacaucaagcacaccgaggccgagaucgccgccgccugcgagaccuuccucaagcucaacgacuaccuccagaucgagaccauccaggcccucgaggagcucgccgccaaggagaaggccaacgaggacgccgucccccucugcauguccgccgacuucccccgcgucggcaugggcuccuccuacaacggccaggacgaggucgacaucaagucccgcgccgccuacaacgucacccuccucaacuucauggacccccagaagaugcccuaccucaaggaggagcccuacuucggcaugggcaagauggccgucuccuggcaccacgacgagaaccucgucgaccgcuccgccgucgccgucuacuccuacuccugcgagggccccgaggaggaguccgaggacgacucccaccucgagggccgcgaccccgacaucuggcacgucggcuucaagaucuccugggacaucgagacccccggccucgccaucccccuccaccagggcgacugcuacuucaugcucgacgaccucaacgccacccaccagcacugcguccucgccggcucccagccccgcuucuccuccacccaccgcgucgccgagugcuccaccggcacccucgacuacauccuccagcgcugccagcucgcccuccagaacgucugcgacgacgucgacaacgacgacgucucccucaaguccuucgagcccgccguccucaagcagggcgaggagauccacaacgaggucgaguucgaguggcuccgccaguucugguuccagggcaaccgcuaccgcaagugcaccgacugguggugccagcccauggcccagcucgaggcccucuggaagaagauggagggcgucaccaacgccguccuccacgaggucaagcgcgagggccuccccgucgagcagcgcaacgagauccucaccgccauccucgccucccucaccgcccgccagaaccuccgccgcgaguggcacgcccgcugccagucccgcaucgcccgcacccuccccgccgaccagaagcccgagugccgccccuacugggagaaggacgacgccuccaugccccuccccuucgaccucaccgacaucgucuccgagcuccgcggccagcuccucgaggccaagcccuga

SEQ ID NO: 43387 - RNA, 579 nt, Artificial Sequence
  derived and/or modified sequence opt2 from FTSJ1__Homo_sapiens__NP_001269086
auggcccucaacaucgccacccacguccucaagcccggcggcugcuucgucgccaagaucuuccgcggccgcgacgucacccuccucuacucccagcuccaggucuucuucuccuccguccucugcgccaagccccgcuccucccgcaacuccuccaucgaggccuucgccgucugccagggcuacgacccccccgagggcuucauccccgaccucuccaagccccuccucgaccacuccuacgaccccgacuucaaccagcucgacggccccacccgcaucaucguccccuucgucaccugcggcgaccucuccuccuacgacuccgaccgcuccuacccccucgaccucgagggcggcuccgaguacaaguacaccccccccacccagccccccaucuccccccccuaccaggaggccugcacccucaagcgcaagggccagcucgccaaggagauccgcccccaggacugccccaucucccgcgucgacaccuucccccagccccucgccgccccccagugccacacccuccucgcccccgagauggaggacaacgagauguccugcucccccuga

SEQ ID NO: 43388 - RNA, 741 nt, Artificial Sequence
  derived and/or modified sequence opt2 from FTSJ2__Homo_sapiens__NP_037525
auggccggcuaccucaagcucgucugcgucuccuuccagcgccagggcuuccacaccgucggcucccgcugcaagaaccgcaccggcgccgagcaccucuggcucacccgccaccuccgcgaccccuucgucaaggccgccaaggucgaguccuaccgcugccgcuccgccuucaagcuccucgaggucaacgagcgccaccagauccuccgccccggccuccgcguccucgacugcggcgccgcccccggcgccuggucccaggucgccguccagaaggucaacgccgccggcaccgaccccuccucccccgucggcuucguccucggcgucgaccuccuccacaucuucccccucgagggcgccaccuuccucugccccgccgacgucaccgacccccgcaccucccagcgcauccucgagguccuccccggccgccgcgccgacgucauccucuccgacauggcccccaacgccaccggcuuccgcgaccucgaccacgaccgccucaucucccucugccucacccuccucuccgucacccccgacauccuccagcccggcggcaccuuccucugcaagaccugggccggcucccagucccgccgccuccagcgccgccucaccgaggaguuccagaacguccgcaucaucaagcccgaggccucccgcaaggaguccuccgaggucuacuuccucgccacccaguaccacggccgcaagggcaccgucaagcaguga

SEQ ID NO: 43389 - RNA, 2544 nt, Artificial Sequence
  derived and/or modified sequence opt2 from FTSJ3__Homo_sapiens__NP_060117
augggcaagaagggcaaggucggcaagucccgccgcgacaaguucuaccaccucgccaaggagaccggcuaccgcucccgcuccgccuucaagcucauccagcucaaccgccgcuuccaguuccuccagaaggcccgcgcccuccucgaccucugcgccgcccccggcggcuggcuccaggucgccgccaaguucaugcccgucuccucccucaucgucggcgucgaccucguccccaucaagccccuccccaacgucgucacccuccagcaggacaucaccaccgagcgcugccgccaggcccuccgcaaggagcucaagaccuggaaggucgacgucguccucaacgacggcgcccccaacgucggcgccuccuggguccacgacgccuacucccaggcccaccucacccucauggcccuccgccucgccugcgacuuccucgcccgcggcggcuccuucaucaccaaggucuuccgcucccgcgacuaccagccccuccucuggaucuuccagcagcucuuccgccgcguccaggccaccaagccccaggccucccgccacgaguccgccgagaucuucgucgucugccagggcuuccucgcccccgacaaggucgacuccaaguucuucgaccccaaguucgccuucaaggaggucgagguccaggccaagaccgucaccgagcucgucaccaagaagaagcccaaggccgagggcuacgccgagggcgaccucacccucuaccaccgcaccuccgucaccgacuuccuccgcgccgccaaccccgucgacuuccucuccaaggccuccgagaucauggucgacgacgaggagcucgcccagcaccccgccaccaccgaggacauccgcgucugcugccaggacauccgcguccucggccgcaaggagcuccgcucccuccucaacuggcgcaccaagcuccgccgcuacgucgccaagaagcucaaggagcaggccaaggcccucgacaucucccucuccuccggcgaggaggacgagggcgacgaggaggacuccaccgccggcaccaccaagcagcccuccaaggaggaggaggaggaggaggaggaggagcagcucaaccagacccucgccgagaugaaggcccaggaggucgccgagcucaagcgcaagaagaagaagcuccuccgcgagcagcgcaagcagcgcgagcgcgucgagcucaagauggaccuccccggcgucuccaucgccgacgagggcgagaccggcauguucucccucuccaccauccgcggccaccagcuccucgaggaggucacccagggcgacauguccgccgccgacaccuuccucuccgaccucccccgcgacgacaucuacgucuccgacgucgaggacgacggcgacgacaccucccucgacuccgaccucgaccccgaggagcucgccggcguccgcggccaccagggccuccgcgaccagaagcgcaugcgccucaccgagguccaggacgacaaggaggaggaggaggaggagaacccccuccucgucccccucgaggagaaggccguccuccaggaggagcaggccaaccucugguucuccaagggcuccuucgccggcaucgaggacgacgccgacgaggcccucgagaucucccaggcccagcuccucuucgagaaccgccgcaagggccgccagcagcagcagaagcagcagcucccccagaccccccccuccugccucaagaccgagaucauguccccccucuaccaggacgaggcccccaagggcaccgaggccuccuccggcaccgaggccgccaccggccucgagggcgaggagaaggacggcaucuccgacuccgacuccuccaccuccuccgaggaggaggaguccugggagccccuccgcggcaagaagcgcucccgcggccccaaguccgacgacgacggcuucgagaucguccccaucgaggaccccgccaagcaccgcauccucgaccccgagggccucgcccucggcgccgucaucgccuccuccaagaaggccaagcgcgaccucaucgacaacuccuucaaccgcuacaccuucaacgaggacgagggcgagcuccccgagugguucguccaggaggagaagcagcaccgcauccgccagcuccccgucggcaagaaggaggucgagcacuaccgcaagcgcuggcgcgagaucaacgcccgccccaucaagaaggucgccgaggccaaggcccgcaagaagcgccgcaugcucaagcgccucgagcagacccgcaagaaggccgaggccgucgucaacaccgucgacaucuccgagcgcgagaaggucgcccagcuccgcucccucuacaagaaggccggccucggcaaggagaagcgccacgucaccuacgucgucgccaagaagggcgucggccgcaagguccgccgccccgccggcguccgcggccacuucaaggucgucgacucccgcaugaagaaggaccagcgcgcccagcagcgcaaggagcagaagaagaagcacaagcgcaaguga

SEQ ID NO: 43390 - RNA, 1998 nt, Artificial Sequence
  derived and/or modified sequence opt2 from FUBP1__Homo_sapiens__NP_001290362
auggccgacuacuccaccguccccccccccuccuccggcuccgccggcggcggcggcggcggcggcggcggcggcggcgucaacgacgccuucaaggacgcccuccagcgcgcccgccagaucgccgccaagaucggcggcgacgccggcaccucccucaacuccaacgacuacggcuacggcggccagaagcgcccccucgaggacggcgacggcuccuggaccucccccuccuccaccacccacugggagggcaugcccucccccuucaaggaccagcccgacgccaagaaggucgccccccagaacgacuccuucggcacccagcucccccccaugcaccagcagcagucccgcuccgucaugaccgaggaguacaagguccccgacggcauggucggcuucaucaucggccgcggcggcgagcagaucucccgcauccagcaggaguccggcugcaagauccagaucgcccccgacuccggcggccuccccgagcgcuccugcaugcucaccggcacccccgaguccguccaguccgccaagcgccuccucgaccagaucgucgagaagggccgccccgcccccggcuuccaccacggcgacggccccggcaacgccguccaggagaucaugauccccgccuccaaggccggccucgucaucggcaagggcggcgagaccaucaagcagcuccaggagcgcgccggcgucaagauggucaugauccaggacggcccccagaacaccggcgccgacaagccccuccgcaucaccggcgaccccuacaagguccagcaggccaaggagaugguccucgagcucauccgcgaccagggcggcuuccgcgagguccgcaacgaguacggcucccgcaucggcggcaacgagggcaucgacguccccaucccccgcuucgccgucggcaucgucaucggccgcaacggcgagaugaucaagaagauccagaacgacgccggcguccgcauccaguucaagcccgacgacggcaccacccccgagcgcaucgcccagaucaccggcccccccgaccgcugccagcacgccgccgagaucaucaccgaccuccuccgcuccguccaggccggcaaccccggcggccccggccccggcggccgcggccgcggccgcggccagggcaacuggaacaugggcccccccggcggccuccaggaguucaacuucaucguccccaccggcaagaccggccucaucaucggcaagggcggcgagaccaucaaguccaucucccagcaguccggcgcccgcaucgagcuccagcgcaaccccccccccaacgccgaccccaacaugaagcucuucaccauccgcggcaccccccagcagaucgacuacgcccgccagcucaucgaggagaagaucggcggccccgucaacccccucggcccccccgucccccacggcccccacggcguccccggcccccacggcccccccggcccccccggccccggcacccccaugggccccuacaaccccgcccccuacaaccccggcccccccggccccgccccccacggcccccccgcccccuacgccccccagggcuggggcaacgccuacccccacuggcagcagcaggccccccccgaccccgccaaggccggcaccgaccccaacuccgccgccugggccgccuacuacgcccacuacuaccagcagcaggcccagcccccccccgccgcccccgccggcgcccccaccaccacccagaccaacggccagggcgaccagcagaaccccgcccccgccggccaggucgacuacaccaaggccugggaggaguacuacaagaagaugggccaggccguccccgcccccaccggcgccccccccggcggccagcccgacuacuccgccgccugggccgaguacuaccgccagcaggccgccuacuacgcccagaccuccccccagggcaugccccagcacccccccgccccccagggccaguga

SEQ ID NO: 43391 - RNA, 1719 nt, Artificial Sequence
  derived and/or modified sequence opt2 from FUBP3__Homo_sapiens__NP_003925
auggccgagcucguccagggccaguccgcccccgucggcaugaaggccgagggcuucgucgacgcccuccaccgcguccgccagaucgccgccaagaucgacuccaucccccaccucaacaacuccaccccccucgucgaccccuccgucuacggcuacggcguccagaagcgcccccucgacgacggcgucggcaaccagcucggcgcccucguccaccagcgcaccgucaucaccgaggaguucaagguccccgacaagauggucggcuucaucaucggccgcggcggcgagcagaucucccgcauccaggccgaguccggcugcaagauccagaucgccuccgaguccuccggcauccccgagcgccccugcguccucaccggcacccccgaguccaucgagcaggccaagcgccuccucggccagaucgucgaccgcugccgcaacggccccggcuuccacaacgacaucgacuccaacuccaccauccaggagauccucauccccgccuccaaggucggccucgucaucggccgcggcggcgagaccaucaagcagcuccaggagcgcaccggcgucaagauggucaugauccaggacggcccccuccccaccggcgccgacaagccccuccgcaucaccggcgacgccuucaagguccagcaggcccgcgagaugguccucgagaucauccgcgagaaggaccaggccgacuuccgcggcguccgcggcgacuucaacucccgcaugggcggcggcuccaucgaggucuccgucccccgcuucgccgucggcaucgucaucggccgcaacggcgagaugaucaagaagauccagaacgacgccggcguccgcauccaguucaagcccgacgacggcaucucccccgagcgcgccgcccaggucaugggcccccccgaccgcugccagcacgccgcccacaucaucuccgagcucauccucaccgcccaggagcgcgacggcuucggcggccucgccgccgcccgcggccgcggccgcggccgcggcgacugguccgucggcgcccccggcggcguccaggagaucaccuacaccguccccgccgacaagugcggccucgucaucggcaagggcggcgagaacaucaaguccaucaaccagcaguccggcgcccacgucgagcuccagcgcaaccccccccccaacuccgaccccaaccuccgccgcuucaccauccgcggcgucccccagcagaucgaggucgcccgccagcucaucgacgagaaggucggcggcaccaaccucggcgcccccggcgccuucggccagucccccuucucccagccccccgcccccccccaccagaacaccuuccccccccgcuccuccggcugcuuccccaacauggccgccaaggucaacggcaacccccacuccacccccgucuccggcccccccgccuuccucacccagggcuggggcuccaccuaccaggccuggcagcagcccacccagcagguccccucccagcagucccagccccaguccucccagcccaacuacuccaaggccugggaggacuacuacaagaagcagucccacgccgccuccgccgccccccaggccuccuccccccccgacuacaccauggccugggccgaguacuaccgccagcaggucgccuucuacggccagacccucggccaggcccaggcccacucccaggagcaguga

SEQ ID NO: 43392 - RNA, 768 nt, Artificial Sequence
  derived and/or modified sequence opt2 from FUCA1__Homo_sapiens__XP_011539469
augcccgagcucuacgaccucgucaacuccuacaagcccgaccucaucugguccgacggcgagugggagugccccgacaccuacuggaacuccaccaacuuccucuccuggcucuacaacgacucccccgucaaggacgaggucgucgucaacgaccgcuggggccagaacugcuccugccaccacggcggcuacuacaacugcgaggacaaguucaagccccagucccuccccgaccacaagugggagaugugcaccuccaucgacaaguucuccuggggcuaccgccgcgacauggcccucuccgacgucaccgaggaguccgagaucaucuccgagcucguccagaccgucucccucggcggcaacuaccuccucaacaucggccccaccaaggacggccucaucguccccaucuuccaggagcgccuccucgccgucggcaaguggcucuccaucaacggcgaggccaucuacgccuccaagcccuggcgcguccagugggagaagaacaccaccuccgucugguacaccuccaagggcuccgccgucuacgccaucuuccuccacuggcccgagaacggcguccucaaccucgagucccccaucaccaccuccaccaccaagaucaccaugcucggcauccagggcgaccucaagugguccaccgaccccgacaagggccucuucaucucccucccccagcucccccccuccgccguccccgccgaguucgccuggaccaucaagcucaccggcgucaaguga

SEQ ID NO: 43393 - RNA, 1404 nt, Artificial Sequence
  derived and/or modified sequence opt2 from FUCA2__Homo_sapiens__NP_114409
augcgcccccaggagcucccccgccucgccuucccccuccuccuccuccuccuccuccuccucccccccccccccugccccgcccacuccgccacccgcuucgaccccaccugggagucccucgacgcccgccagcuccccgccugguucgaccaggccaaguucggcaucuucauccacuggggcgucuucuccguccccuccuucggcuccgagugguucuggugguacuggcagaaggagaagauccccaaguacgucgaguucaugaaggacaacuacccccccuccuucaaguacgaggacuucggcccccucuucaccgccaaguucuucaacgccaaccagugggccgacaucuuccaggccuccggcgccaaguacaucguccucaccuccaagcaccacgagggcuucacccucuggggcuccgaguacuccuggaacuggaacgccaucgacgagggccccaagcgcgacaucgucaaggagcucgaggucgccauccgcaaccgcaccgaccuccgcuucggccucuacuacucccucuucgagugguuccacccccucuuccucgaggacgaguccuccuccuuccacaagcgccaguuccccgucuccaagacccuccccgagcucuacgagcucgucaacaacuaccagcccgagguccucugguccgacggcgacggcggcgcccccgaccaguacuggaacuccaccggcuuccucgccuggcucuacaacgagucccccguccgcggcaccgucgucaccaacgaccgcuggggcgccggcuccaucugcaagcacggcggcuucuacaccugcuccgaccgcuacaaccccggccaccuccucccccacaagugggagaacugcaugaccaucgacaagcucuccuggggcuaccgccgcgaggccggcaucuccgacuaccucaccaucgaggagcucgucaagcagcucgucgagaccgucuccugcggcggcaaccuccucaugaacaucggccccacccucgacggcaccaucuccgucgucuucgaggagcgccuccgccagaugggcuccuggcucaaggucaacggcgaggccaucuacgagacccacaccuggcgcucccagaacgacaccgucacccccgacgucugguacaccuccaagcccaaggagaagcucgucuacgccaucuuccucaaguggcccaccuccggccagcucuuccucggccaccccaaggccauccucggcgccaccgaggucaagcuccucggccacggccagccccucaacuggaucucccucgagcagaacggcaucauggucgagcucccccagcucaccauccaccagaugcccugcaaguggggcugggcccucgcccucaccaacgucaucuga

SEQ ID NO: 43394 - RNA, 468 nt, Artificial Sequence
  derived and/or modified sequence opt2 from FUNDC1__Homo_sapiens__NP_776155
auggccacccgcaacccccccccccaggacuacgaguccgacgacgacuccuacgagguccucgaccucaccgaguacgcccgccgccaccagugguggaaccgcgucuucggccacuccuccggccccauggucgagaaguacuccgucgccacccagaucgucaugggcggcgucaccggcuggugcgccggcuuccucuuccagaaggucggcaagcucgccgccaccgccgucggcggcggcuuccuccuccuccagaucgccucccacuccggcuacguccagaucgacuggaagcgcgucgagaaggacgucaacaaggccaagcgccagaucaagaagcgcgccaacaaggccgcccccgagaucaacaaccucaucgaggaggccaccgaguucaucaagcagaacaucgucaucuccuccggcuucgucggcggcuuccuccucggccucgccuccuga

SEQ ID NO: 43395 - RNA, 570 nt, Artificial Sequence
  derived and/or modified sequence opt2 from FUNDC2__Homo_sapiens__NP_076423
auggagaccuccgccccccgcgccggcucccaggucgucgccaccaccgcccgccacuccgccgccuaccgcgccgacccccuccgcgucuccucccgcgacaagcucaccgagauggccgccuccucccagggcaacuucgagggcaacuucgagucccucgaccucgccgaguucgccaagaagcagcccugguggcgcaagcucuucggccaggaguccggccccuccgccgagaaguacuccgucgccacccagcucuucaucggcggcgucaccggcuggugcaccggcuucaucuuccagaaggucggcaagcucgccgccaccgccgucggcggcggcuucuuccuccuccagcucgccaaccacaccggcuacaucaaggucgacuggcagcgcgucgagaaggacaugaagaaggccaaggagcagcucaagauccgcaaguccaaccagauccccaccgagguccgcuccaaggccgaggaggucgucuccuucgucaagaagaacguccucgucaccggcggcuucuucggcggcuuccuccucggcauggccuccuga

SEQ ID NO: 43396 - RNA, 2385 nt, Artificial Sequence
  derived and/or modified sequence opt2 from FURIN__Homo_sapiens__NP_001276752
auggagcuccgccccuggcuccucugggucgucgccgccaccggcacccucguccuccucgccgccgacgcccagggccagaaggucuucaccaacaccugggccguccgcauccccggcggccccgccgucgccaacuccgucgcccgcaagcacggcuuccucaaccucggccagaucuucggcgacuacuaccacuucuggcaccgcggcgucaccaagcgcucccucuccccccaccgcccccgccacucccgccuccagcgcgagccccagguccaguggcucgagcagcaggucgccaagcgccgcaccaagcgcgacgucuaccaggagcccaccgaccccaaguucccccagcagugguaccucuccggcgucacccagcgcgaccucaacgucaaggccgccugggcccagggcuacaccggccacggcaucgucgucuccauccucgacgacggcaucgagaagaaccaccccgaccucgccggcaacuacgaccccggcgccuccuucgacgucaacgaccaggaccccgacccccagccccgcuacacccagaugaacgacaaccgccacggcacccgcugcgccggcgaggucgccgccgucgccaacaacggcgucugcggcgucggcgucgccuacaacgcccgcaucggcggcguccgcaugcucgacggcgaggucaccgacgccgucgaggcccgcucccucggccucaaccccaaccacauccacaucuacuccgccuccuggggccccgaggacgacggcaagaccgucgacggccccgcccgccucgccgaggaggccuucuuccgcggcgucucccagggccgcggcggccucggcuccaucuucgucugggccuccggcaacggcggccgcgagcacgacuccugcaacugcgacggcuacaccaacuccaucuacacccucuccaucuccuccgccacccaguucggcaacguccccugguacuccgaggccugcuccuccacccucgccaccaccuacuccuccggcaaccagaacgagaagcagaucgucaccaccgaccuccgccagaagugcaccgagucccacaccggcaccuccgccuccgccccccucgccgccggcaucaucgcccucacccucgaggccaacaagaaccucaccuggcgcgacaugcagcaccucgucguccagaccuccaagcccgcccaccucaacgccaacgacugggccaccaacggcgucggccgcaaggucucccacuccuacggcuacggccuccucgacgccggcgccauggucgcccucgcccagaacuggaccaccgucgccccccagcgcaagugcaucaucgacauccucaccgagcccaaggacaucggcaagcgccucgagguccgcaagaccgucaccgccugccucggcgagcccaaccacaucacccgccucgagcacgcccaggcccgccucacccucuccuacaaccgccgcggcgaccucgccauccaccucgucucccccaugggcacccgcuccacccuccucgccgcccgcccccacgacuacuccgccgacggcuucaacgacugggccuucaugaccacccacuccugggacgaggaccccuccggcgaguggguccucgagaucgagaacaccuccgaggccaacaacuacggcacccucaccaaguucacccucguccucuacggcaccgcccccgagggccuccccgucccccccgaguccuccggcugcaagacccucaccuccucccaggccugcgucgucugcgaggagggcuucucccuccaccagaaguccugcguccagcacugcccccccggcuucgccccccagguccucgacacccacuacuccaccgagaacgacgucgagaccauccgcgccuccgucugcgcccccugccacgccuccugcgccaccugccagggccccgcccucaccgacugccucuccugccccucccacgccucccucgaccccgucgagcagaccugcucccgccagucccaguccucccgcgagucccccccccagcagcagcccccccgccucccccccgaggucgaggccggccagcgccuccgcgccggccuccuccccucccaccuccccgaggucgucgccggccucuccugcgccuucaucguccucgucuucgucaccgucuuccucguccuccagcuccgcuccggcuucuccuuccgcggcgucaaggucuacaccauggaccgcggccucaucuccuacaagggccucccccccgaggccuggcaggaggagugccccuccgacuccgaggaggacgagggccgcggcgagcgcaccgccuucaucaaggaccaguccgcccucuga

SEQ ID NO: 43397 - RNA, 1569 nt, Artificial Sequence
  derived and/or modified sequence opt2 from FUS__Homo_sapiens__NP_001164408
auggccuccaacgacuacacccagcaggccacccaguccuacggcgccuaccccacccagcccggccagggcuacucccagcaguccucccagcccuacggccagcaguccuacuccggcuacucccaguccaccgacaccuccggcuacggccaguccuccuacuccuccuacggccagucccagaacaccggcuacggcacccaguccaccccccagggcuacggcuccaccggcggcuacggcuccucccaguccucccaguccuccuacggccagcaguccuccuaccccggcuacggccagcagcccgcccccuccuccaccuccggcuccuacggcuccuccucccaguccuccuccuacggccagccccaguccggcuccuacucccagcagcccuccuacggcggccagcagcaguccuacggccagcagcaguccuacaaccccccccagggcuacggccagcagaaccaguacaacuccuccuccggcggcggcggcggcggcaacuacggccaggaccaguccuccauguccuccggcggcggcuccggcggcggcuacggcaaccaggaccaguccggcggcggcggcuccggcggcuacggccagcaggaccgcggcggccgcggccgcggcggcuccggcggcggcggcggcggcggcggcggcggcuacaaccgcuccuccggcggcuacgagccccgcggccgcggcggcggccgcggcggccgcggcggcaugggcggcuccgaccgcggcggcuucaacaaguucggcggcccccgcgaccagggcucccgccacgacuccgagcaggacaacuccgacaacaacaccaucuucguccagggccucggcgagaacgucaccaucgaguccgucgccgacuacuucaagcagaucggcaucaucaagaccaacaagaagaccggccagcccaugaucaaccucuacaccgaccgcgagaccggcaagcucaagggcgaggccaccgucuccuucgacgacccccccuccgccaaggccgccaucgacugguucgacggcaaggaguucuccggcaaccccaucaaggucuccuucgccacccgccgcgccgacuucaaccgcggcggcggcaacggccgcggcggccgcggccgcggcggccccaugggccgcggcggcuacggcggcggcggcuccggcggcggcggccgcggcggcuuccccuccggcggcggcggcggcggcggccagcagcgcgccggcgacuggaagugccccaaccccaccugcgagaacaugaacuucuccuggcgcaacgagugcaaccagugcaaggcccccaagcccgacggccccggcggcggccccggcggcucccacaugggcggcaacuacggcgacgaccgccgcggcggccgcggcggcuacgaccgcggcggcuaccgcggccgcggcggcgaccgcggcggcuuccgcggcggccgcggcggcggcgaccgcggcggcuucggccccggcaagauggacucccgcggcgagcaccgccaggaccgccgcgagcgccccuacuga

SEQ ID NO: 43398 - RNA, 1440 nt, Artificial Sequence
  derived and/or modified sequence opt2 from FUT10__Homo_sapiens__NP_116053
augguccgcauccagcgccgcaagcuccucgccuccugccucugcgucaccgccaccgucuuccuccucgucacccuccaggucauggucgagcucggcaaguucgagcgcaaggaguucaaguccuccucccuccaggacggccacaccaagauggaggaggcccccacccaccucaacuccuuccucaagaaggagggccucaccuucaaccgcaagcgcaagugggagcucgacuccuaccccaucaugcucuggugguccccccucaccggcgagaccggccgccucggccagugcggcgccgacgccugcuucuucaccaucaaccgcaccuaccuccaccaccacaugaccaaggccuuccucuucuacggcaccgacuucaacaucgacucccucccccucccccgcaaggcccaccacgacugggccgucuuccacgaggagucccccaagaacaacuacaagcucuuccacaagcccgucaucacccucuucaacuacaccgccaccuucucccgccacucccaccucccccucaccacccaguaccucgaguccaucgagguccucaagucccuccgcuaccucgucccccuccaguccaagaacaagcuccgcaagcgccucgccccccucgucuacguccaguccgacugcgacccccccuccgaccgcgacuccuacguccgcgagcucaugaccuacaucgaggucgacuccuacggcgagugccuccgcaacaaggaccucccccagcagcucaagaaccccgccuccauggacgccgacggcuucuaccgcaucaucgcccaguacaaguucauccucgccuucgagaacgccgucugcgacgacuacaucaccgagaaguucuggcgcccccucaagcucggcgucguccccgucuacuacggcucccccuccaucaccgacuggcuccccuccaacaaguccgccauccucgucuccgaguucucccacccccgcgagcucgccuccuacauccgccgccucgacuccgacgaccgccucuacgaggccuacgucgaguggaagcucaagggcgagaucuccaaccagcgccuccucaccgcccuccgcgagcgcaaguggggcguccaggacgucaaccaggacaacuacaucgacgccuucgagugcauggucugcaccaaggucugggccaacauccgccuccaggagaagggccucccccccaagcgcugggaggccgaggacacccaccucuccugccccgagcccaccgucuucgccuucuccccccuccgcacccccccccucuccucccuccgcgagauguggaucuccuccuucgagcaguccaagaaggaggcccaggcccuccgcuggcucgucgaccgcaaccagaacuucuccucccaggaguucuggggccucgucuucaaggacuga

SEQ ID NO: 43399 - RNA, 1431 nt, Artificial Sequence
  derived and/or modified sequence opt2 from FUT11__Homo_sapiens__NP_001271123
auggccgccggccccauccgcgucguccucguccuccucggcguccucuccgucugcgccgccuccggccacggcuccgucgccgagcgcgaggccggcggcgaggccgagugggccgagcccugggacggcgccgucuuccgcccccccuccgcccucggcgccgucggcgucacccgcuccuccggcaccccccgccccggccgcgaggaggccggcgaccuccccguccuccucugguggucccccggccucuucccccacuuccccggcgacuccgagcgcaucgagugcgcccgcggcgccugcgucgccucccgcaaccgccgcgcccuccgcgacucccgcacccgcgcccuccucuucuacggcaccgacuuccgcgccuccgccgccccccucccccgccucgcccaccaguccugggcccuccuccacgaggaguccccccucaacaacuuccuccucucccacggccccggcauccgccucuucaaccucaccuccaccuucucccgccacuccgacuacccccucucccuccaguggcuccccggcaccgccuaccuccgccgccccguccccccccccauggagcgcgccgaguggcgccgccgcggcuacgccccccuccucuaccuccagucccacugcgacguccccgccgaccgcgaccgcuacguccgcgagcucaugcgccacauccccgucgacuccuacggcaagugccuccagaaccgcgagcuccccaccgcccgccuccaggacaccgccaccgccaccaccgaggaccccgagcuccucgccuuccucucccgcuacaaguuccaccucgcccucgagaacgccaucugcaacgacuacaugaccgagaagcucuggcgccccaugcaccucggcgccguccccgucuaccgcggcucccccuccguccgcgacuggaugcccaacaaccacuccgucauccucaucgacgacuucgaguccccccagaagcucgccgaguucaucgacuuccucgacaagaacgacgaggaguacaugaaguaccucgccuacaagcagcccggcggcaucaccaaccaguuccuccucgacucccucaagcaccgcgaguggggcgucaacgacccccuccuccccaacuaccucaacggcuucgagugcuucgucugcgacuacgagcucgcccgccucgacgccgagaaggcccacgccgccucccccggcgacucccccgucuucgagccccacaucgcccagcccucccacauggacugccccguccccacccccggcuucggcaacgucgaggagauccccgagaacgacuccucccucguccagguccgcgaccacugcaucugccuccgcuuccucuggccccacuccgagaagggccgcacccacaacuacgccgccguccccuga

SEQ ID NO: 43400 - RNA, 1098 nt, Artificial Sequence
  derived and/or modified sequence opt2 from FUT1__Homo_sapiens__NP_000139
auguggcuccgcucccaccgccagcucugccucgccuuccuccucgucugcguccucuccgucaucuucuuccuccacauccaccaggacuccuucccccacggccucggccucuccauccucugccccgaccgccgccucgucaccccccccgucgccaucuucugccuccccggcaccgccaugggccccaacgccuccuccuccugcccccagcaccccgccucccucuccggcaccuggaccgucuaccccaacggccgcuucggcaaccagaugggccaguacgccacccuccucgcccucgcccagcucaacggccgccgcgccuucauccuccccgccaugcacgccgcccucgcccccgucuuccgcaucacccuccccguccucgcccccgaggucgacucccgcacccccuggcgcgagcuccagcuccacgacuggauguccgaggaguacgccgaccuccgcgaccccuuccucaagcucuccggcuuccccugcuccuggaccuucuuccaccaccuccgcgagcagauccgccgcgaguucacccuccacgaccaccuccgcgaggaggcccaguccguccucggccagcuccgccucggccgcaccggcgaccgcccccgcaccuucgucggcguccacguccgccgcggcgacuaccuccaggucaugccccagcgcuggaagggcgucgucggcgacuccgccuaccuccgccaggccauggacugguuccgcgcccgccacgaggcccccgucuucgucgucaccuccaacggcauggaguggugcaaggagaacaucgacaccucccagggcgacgucaccuucgccggcgacggccaggaggccacccccuggaaggacuucgcccuccucacccagugcaaccacaccaucaugaccaucggcaccuucggcuucugggccgccuaccucgccggcggcgacaccgucuaccucgccaacuucacccuccccgacuccgaguuccucaagaucuucaagcccgaggccgccuuccuccccgagugggucggcaucaacgccgaccucuccccccucuggacccucgccaagcccuga

SEQ ID NO: 43401 - RNA, 1032 nt, Artificial Sequence
  derived and/or modified sequence opt2 from FUT2__Homo_sapiens__NP_001091107
augcucgucguccagaugcccuucuccuuccccauggcccacuucauccucuucgucuucaccgucuccaccaucuuccacguccagcagcgccucgccaagauccaggccaugugggagcuccccguccagauccccguccucgccuccaccuccaaggcccucggccccucccagcuccgcggcauguggaccaucaacgccaucggccgccucggcaaccagaugggcgaguacgccacccucuacgcccucgccaagaugaacggccgccccgccuucauccccgcccagaugcacuccacccucgcccccaucuuccgcaucacccuccccguccuccacuccgccaccgccucccgcauccccuggcagaacuaccaccucaacgacuggauggaggaggaguaccgccacauccccggcgaguacguccgcuucaccggcuaccccugcuccuggaccuucuaccaccaccuccgccaggagauccuccaggaguucacccuccacgaccacguccgcgaggaggcccagaaguuccuccgcggccuccaggucaacggcucccgccccggcaccuucgucggcguccacguccgccgcggcgacuacguccacgucaugcccaaggucuggaagggcgucgucgccgaccgccgcuaccuccagcaggcccucgacugguuccgcgcccgcuacuccucccucaucuucgucgucaccuccaacggcauggccuggugccgcgagaacaucgacaccucccacggcgacgucgucuucgccggcgacggcaucgagggcucccccgccaaggacuucgcccuccucacccagugcaaccacaccaucaugaccaucggcaccuucggcaucugggccgccuaccucaccggcggcgacaccaucuaccucgccaacuacacccuccccgacucccccuuccucaagaucuucaagcccgaggccgccuuccuccccgaguggaccggcaucgccgccgaccucuccccccuccucaagcacuga

SEQ ID NO: 43402 - RNA, 1086 nt, Artificial Sequence
  derived and/or modified sequence opt2 from FUT3__Homo_sapiens__XP_011526169
auggacccccucggcgccgccaagccccaguggcccuggcgccgcugccucgccgcccuccucuuccagcuccucgucgccgucugcuucuucuccuaccuccgcgucucccgcgacgacgccaccggcuccccccgcgcccccuccggcuccucccgccaggacaccacccccacccgccccacccuccucauccuccuccgcaccuggcccuuccacauccccgucgcccucucccgcugcuccgagaugguccccggcaccgccgacugccacaucaccgccgaccgcaaggucuacccccaggccgacauggucaucguccaccacugggacaucauguccaaccccaagucccgccucccccccuccccccgcccccagggccagcgcuggaucugguucaaccucgagcccccccccaacugccagcaccucgaggcccucgaccgcuacuucaaccucaccauguccuaccgcuccgacuccgacaucuucacccccuacggcuggcucgagcccugguccggccagcccgcccaccccccccucaaccucuccgccaagaccgagcucgucgccugggccgucuccaacuggaagcccgacuccgcccgcguccgcuacuaccagucccuccaggcccaccucaaggucgacgucuacggccgcucccacaagccccuccccaagggcaccaugauggagacccucucccgcuacaaguucuaccucgccuucgagaacucccuccaccccgacuacaucaccgagaagcucuggcgcaacgcccucgaggccugggccguccccgucguccucggccccucccgcuccaacuacgagcgcuuccucccccccgacgccuucauccacgucgacgacuuccagucccccaaggaccucgcccgcuaccuccaggagcucgacaaggaccacgcccgcuaccucuccuacuuccgcuggcgcgagacccuccgcccccgcuccuucuccugggcccucgacuucugcaaggccugcuggaagcuccagcaggagucccgcuaccagaccguccgcuccaucgccgccugguucaccuga

SEQ ID NO: 43403 - RNA, 1593 nt, Artificial Sequence
  derived and/or modified sequence opt2 from FUT4__Homo_sapiens__NP_002024
augcgccgccucuggggcgccgcccgcaagcccuccggcgccggcugggagaaggagugggccgaggccccccaggaggcccccggcgccugguccggccgccucggccccggccgcuccggccgcaagggccgcgccguccccggcugggccuccuggcccgcccaccucgcccucgccgcccgccccgcccgccaccucggcggcgccggccagggcccccgcccccuccacuccggcaccgcccccuuccacucccgcgccuccggcgagcgccagcgccgccucgagccccagcuccagcacgagucccgcugccgcuccuccacccccgccgacgccuggcgcgccgaggccgcccuccccguccgcgccaugggcgcccccuggggcucccccaccgccgccgccggcggccgccgcggcuggcgccgcggccgcggccuccccuggaccgucugcguccucgccgccgccggccucaccugcaccgcccucaucaccuacgccugcuggggccagcuccccccccuccccugggccucccccacccccucccgccccgucggcguccuccucuggugggagcccuucggcggccgcgacuccgccccccgccccccccccgacugccgccuccgcuucaacaucuccggcugccgccuccucaccgaccgcgccuccuacggcgaggcccaggccguccucuuccaccaccgcgaccucgucaagggcccccccgacuggcccccccccuggggcauccaggcccacaccgccgaggaggucgaccuccgcguccucgacuacgaggaggccgccgccgccgccgaggcccucgccaccuccuccccccgcccccccggccagcgcugggucuggaugaacuucgagucccccucccacucccccggccuccgcucccucgccuccaaccucuucaacuggacccucuccuaccgcgccgacuccgacgucuucguccccuacggcuaccucuacccccgcucccaccccggcgacccccccuccggccucgcccccccccucucccgcaagcagggccucgucgccugggucgucucccacugggacgagcgccaggcccgcguccgcuacuaccaccagcucucccagcacgucaccgucgacgucuucggccgcggcggccccggccagcccguccccgagaucggccuccuccacaccgucgcccgcuacaaguucuaccucgccuucgagaacucccagcaccucgacuacaucaccgagaagcucuggcgcaacgcccuccucgccggcgccguccccgucguccucggccccgaccgcgccaacuacgagcgcuucgucccccgcggcgccuucauccacgucgacgacuuccccuccgccuccucccucgccuccuaccuccucuuccucgaccgcaaccccgccgucuaccgccgcuacuuccacuggcgccgcuccuacgccguccacaucaccuccuucugggacgagcccuggugccgcgucugccaggccguccagcgcgccggcgaccgccccaaguccauccgcaaccucgccuccugguucgagcgcuga

SEQ ID NO: 43404 - RNA, 1125 nt, Artificial Sequence
  derived and/or modified sequence opt2 from FUT5__Homo_sapiens__NP_002025
auggacccccucggccccgccaagccccaguggcucuggcgccgcugccucgccggccuccucuuccagcuccucgucgccgucugcuucuucuccuaccuccgcgucucccgcgacgacgccaccggcuccccccgccccggccucauggccgucgagcccgucaccggcgcccccaacggcucccgcugccaggacuccauggccacccccgcccaccccacccuccucauccuccucuggaccuggcccuucaacacccccgucgcccucccccgcugcuccgagaugguccccggcgccgccgacugcaacaucaccgccgacuccuccgucuacccccaggccgacgccgucaucguccaccacugggacaucauguacaaccccuccgccaaccuccccccccccacccgcccccagggccagcgcuggaucugguucuccauggagucccccuccaacugccgccaccucgaggcccucgacggcuacuucaaccucaccauguccuaccgcuccgacuccgacaucuucacccccuacggcuggcucgagcccugguccggccagcccgcccaccccccccucaaccucuccgccaagaccgagcucgucgccugggccgucuccaacuggaagcccgacuccgcccgcguccgcuacuaccagucccuccaggcccaccucaaggucgacgucuacggccgcucccacaagccccuccccaagggcaccaugauggagacccucucccgcuacaaguucuaccucgccuucgagaacucccuccaccccgacuacaucaccgagaagcucuggcgcaacgcccucgaggccugggccguccccgucguccucggccccucccgcuccaacuacgagcgcuuccucccccccgacgccuucauccacgucgacgacuuccagucccccaaggaccucgcccgcuaccuccaggagcucgacaaggaccacgcccgcuaccucuccuacuuccacuggcgcgagacccuccgcccccgcuccuucuccugggcccucgccuucugcaaggccugcuggaagcuccagcaggagucccgcuaccagaccguccgcuccaucgccgccugguucaccuga

SEQ ID NO: 43405 - RNA, 1080 nt, Artificial Sequence
  derived and/or modified sequence opt2 from FUT6__Homo_sapiens__NP_001035791
auggacccccucggccccgccaagccccagugguccuggcgcugcugccucaccacccuccucuuccagcuccucauggccgucugcuucuucuccuaccuccgcgucucccaggacgaccccaccgucuaccccaacggcucccgcuuccccgacuccaccggcacccccgcccacuccaucccccucauccuccucuggaccuggcccuucaacaagcccaucgcccucccccgcugcuccgagaugguccccggcaccgccgacugcaacaucaccgccgaccgcaaggucuacccccaggccgacgccgucaucguccaccaccgcgaggucauguacaaccccuccgcccagcucccccgcuccccccgccgccagggccagcgcuggaucugguucuccauggagucccccucccacugcuggcagcucaaggccauggacggcuacuucaaccucaccauguccuaccgcuccgacuccgacaucuucacccccuacggcuggcucgagcccugguccggccagcccgcccaccccccccucaaccucuccgccaagaccgagcucgucgccugggccgucuccaacuggggccccaacuccgcccgcguccgcuacuaccagucccuccaggcccaccucaaggucgacgucuacggccgcucccacaagccccucccccagggcaccaugauggagacccucucccgcuacaaguucuaccucgccuucgagaacucccuccaccccgacuacaucaccgagaagcucuggcgcaacgcccucgaggccugggccguccccgucguccucggccccucccgcuccaacuacgagcgcuuccucccccccgacgccuucauccacgucgacgacuuccagucccccaaggaccucgcccgcuaccuccaggagcucgacaaggaccacgcccgcuaccucuccuacuuccgcuggcgcgagacccuccgcccccgcuccuucuccugggcccucgccuucugcaaggccugcuggaagcuccaggaggagucccgcuaccagacccgcggcaucgccgccugguucaccuga

SEQ ID NO: 43406 - RNA, 1029 nt, Artificial Sequence
  derived and/or modified sequence opt2 from FUT7__Homo_sapiens__NP_004470
augaacaacgccggccacggccccacccgccgccuccgcggccucggcguccucgccggcgucgcccuccucgccgcccucuggcuccucuggcuccucggcuccgccccccgcggcacccccgccccccagcccaccaucaccauccucgucuggcacuggcccuucaccgaccagccccccgagcuccccuccgacaccugcacccgcuacggcaucgcccgcugccaccucuccgccaaccgcucccuccucgccuccgccgacgccgucgucuuccaccaccgcgagcuccagacccgccgcucccaccucccccucgcccagcgcccccgcggccagcccugggucugggccuccauggagucccccucccacacccacggccucucccaccuccgcggcaucuucaacuggguccucuccuaccgccgcgacuccgacaucuucguccccuacggccgccucgagccccacuggggccccucccccccccuccccgccaagucccgcgucgccgccugggucgucuccaacuuccaggagcgccagcuccgcgcccgccucuaccgccagcucgccccccaccuccgcgucgacgucuucggccgcgccaacggccgcccccucugcgccuccugccucguccccaccgucgcccaguaccgcuucuaccucuccuucgagaacucccagcaccgcgacuacaucaccgagaaguucuggcgcaacgcccucgucgccggcaccguccccgucguccucggccccccccgcgccaccuacgaggccuucguccccgccgacgccuucguccacgucgacgacuucggcuccgcccgcgagcucgccgccuuccucaccggcaugaacgagucccgcuaccagcgcuucuucgccuggcgcgaccgccuccgcguccgccucuucaccgacuggcgcgagcgcuucugcgccaucugcgaccgcuacccccaccucccccgcucccaggucuacgaggaccucgagggcugguuccaggccuga

SEQ ID NO: 43407 - RNA, 1239 nt, Artificial Sequence
  derived and/or modified sequence opt2 from FUT8__Homo_sapiens__NP_004471
augaccgaccucuacuaccucucccagaccgacggcgccggcgacuggcgcgagaaggaggccaaggaccucaccgagcucguccagcgccgcaucaccuaccuccagaaccccaaggacugcuccaaggccaagaagcucgucugcaacaucaacaagggcugcggcuacggcugccagcuccaccacgucgucuacugcuucaugaucgccuacggcacccagcgcacccucauccucgagucccagaacuggcgcuacgccaccggcggcugggagaccgucuuccgccccgucuccgagaccugcaccgaccgcuccggcaucuccaccggccacugguccggcgaggucaaggacaagaacguccaggucgucgagcuccccaucgucgacucccuccacccccgcccccccuaccucccccucgccguccccgaggaccucgccgaccgccucguccgcguccacggcgaccccgccgucuggugggucucccaguucgucaaguaccucauccgcccccagcccuggcucgagaaggagaucgaggaggccaccaagaagcucggcuucaagcaccccgucaucggcguccacguccgccgcaccgacaaggucggcaccgaggccgccuuccaccccaucgaggaguacaugguccacgucgaggagcacuuccagcuccucgcccgccgcaugcaggucgacaagaagcgcgucuaccucgccaccgacgaccccucccuccucaaggaggccaagaccaaguaccccaacuacgaguucaucuccgacaacuccaucuccugguccgccggccuccacaaccgcuacaccgagaacucccuccgcggcgucauccucgacauccacuuccucucccaggccgacuuccucgucugcaccuucuccucccaggucugccgcgucgccuacgagaucaugcagacccuccaccccgacgccuccgccaacuuccacucccucgacgacaucuacuacuucggcggccagaacgcccacaaccagaucgccaucuacgcccaccagccccgcaccgccgacgagauccccauggagcccggcgacaucaucggcgucgccggcaaccacugggacggcuacuccaagggcgucaaccgcaagcucggccgcaccggccucuaccccuccuacaagguccgcgagaagaucgagaccgucaaguaccccaccuaccccgaggccgagaaguga

SEQ ID NO: 43408 - RNA, 1080 nt, Artificial Sequence
  derived and/or modified sequence opt2 from FUT9__Homo_sapiens__XP_011533687
augaccuccaccuccaagggcauccuccgccccuuccucaucgucugcaucauccucggcugcuucauggccugccuccucaucuacaucaagcccaccaacuccuggaucuucucccccauggaguccgccuccuccguccucaagaugaagaacuucuucuccaccaagaccgacuacuucaacgagaccaccauccucgucugggucuggcccuucggccagaccuucgaccucaccuccugccaggccauguucaacauccagggcugccaccucaccaccgaccgcucccucuacaacaagucccacgccguccucauccaccaccgcgacaucuccugggaccucaccaaccucccccagcaggcccgcccccccuuccagaaguggaucuggaugaaccucgagucccccacccacaccccccagaaguccggcaucgagcaccucuucaaccucacccucaccuaccgccgcgacuccgacauccagguccccuacggcuuccucaccgucuccaccaaccccuucgucuucgagguccccuccaaggagaagcucgucugcugggucgucuccaacuggaaccccgagcacgcccgcgucaaguacuacaacgagcucuccaaguccaucgagauccacaccuacggccaggccuucggcgaguacgucaacgacaagaaccucauccccaccaucuccaccugcaaguucuaccucuccuucgagaacuccauccacaaggacuacaucaccgagaagcucuacaacgccuuccucgccggcuccguccccgucguccucggccccucccgcgagaacuacgagaacuacauccccgccgacuccuucauccacgucgaggacuacaacucccccuccgagcucgccaaguaccucaaggaggucgacaagaacaacaagcucuaccucuccuacuucaacuggcgcaaggacuucaccgucaaccucccccgcuucugggagucccacgccugccucgccugcgaccacgucaagcgccaccaggaguacaaguccgucggcaaccucgagaagugguucuggaacuga

SEQ ID NO: 43409 - RNA, 1149 nt, Artificial Sequence
  derived and/or modified sequence opt2 from FUZ__Homo_sapiens__NP_001165408
augggcgaggagggcaccggcggcaccguccaccuccucugccucgccgccuccuccggcgucccccucuucugccgcuccucccgcggcggcgcccccgcccgccagcagcuccccuucuccgucaucggcucccucaacggcguccacauguucggccagaaccucgagguccagcucuccuccgcccgcaccgagaacaccaccgucguccuccucgucggccucgaggagcucaccaacauccgcaacgucgagcgccucaagaaggaccuccgcgccuccuacugccucaucgacuccuuccucggcgacuccgagcucaucggcgaccucacccagugcgucgacugcgucaucccccccgagggcucccuccuccaggaggcccucuccggcuucgccgaggccgccggcaccaccuucgucucccucgucgucuccggccgcgucgucgccgccaccgagggcugguggcgccucggcacccccgaggccguccuccuccccuggcucgucggcucccuccccccccagaccgcccgcgacuaccccgucuaccucccccacggcucccccaccgucccccaccgccuccucacccucacccuccuccccucccucgagcucugccuccucugcggccccucccccccccucucccagcucuacccccagcuccucgagcgcugguggcagccccuccucgacccccuccgcgccugccucccccucggcccccgcgcccuccccuccggcuucccccuccacaccgacauccucggccuccuccuccuccaccucgagcucaagcgcugccucuucaccgucgagccccucggcgacaaggagcccucccccgagcagcgccgccgccuccuccgcaacuucuacacccucgucaccuccacccacuucccccccgagcccggcccccccgagaagaccgaggacgaggucuaccaggcccagcucccccgcgccugcuaccucguccucggcaccgaggagcccggcaccggcguccgccucgucgcccuccagcucggccuccgccgccuccuccuccuccucuccccccagucccccacccacggccuccgcucccucgccacccacacccuccacgcccucaccccccuccucuga

SEQ ID NO: 43410 - RNA, 633 nt, Artificial Sequence
  derived and/or modified sequence opt2 from FXN__Homo_sapiens__NP_000135
auguggacccucggccgccgcgccgucgccggccuccucgccucccccucccccgcccaggcccagacccucacccgcgucccccgccccgccgagcucgccccccucugcggccgccgcggccuccgcaccgacaucgacgccaccugcaccccccgccgcgccuccuccaaccagcgcggccucaaccagaucuggaacgucaagaagcaguccgucuaccucaugaaccuccgcaaguccggcacccucggccaccccggcucccucgacgagaccaccuacgagcgccucgccgaggagacccucgacucccucgccgaguucuucgaggaccucgccgacaagcccuacaccuucgaggacuacgacgucuccuucggcuccggcguccucaccgucaagcucggcggcgaccucggcaccuacgucaucaacaagcagacccccaacaagcagaucuggcucuccucccccuccuccggccccaagcgcuacgacuggaccggcaagaacugggucuacucccacgacggcgucucccuccacgagcuccucgccgccgagcucaccaaggcccucaagaccaagcucgaccucuccucccucgccuacuccggcaaggacgccuga

SEQ ID NO: 43411 - RNA, 1620 nt, Artificial Sequence
  derived and/or modified sequence opt2 from FXR1__Homo_sapiens__NP_001013456
auggccgagcucaccgucgagguccgcggcuccaacggcgccuucuacaagggcuucaucaaggacguccacgaggacucccucaccgucgucuucgagaacaacuggcagcccgagcgccagguccccuucaacgagguccgccucccccccccccccgacaucaagaaggagaucuccgagggcgacgaggucgaggucuacucccgcgccaacgaccaggagcccugcggcugguggcucgccaagguccgcaugaugaagggcgaguucuacgucaucgaguacgccgccugcgacgccaccuacaacgagaucgucaccuucgagcgccuccgccccgucaaccagaacaagaccgucaagaagaacaccuucuucaagugcaccgucgacguccccgaggaccuccgcgaggccugcgccaacgagaacgcccacaaggacuucaagaaggccgucggcgccugccgcaucuucuaccaccccgagaccacccagcucaugauccucuccgccuccgaggccaccgucaagcgcgucaacauccucuccgacaugcaccuccgcuccauccgcaccaagcucaugcucaugucccgcaacgaggaggccaccaagcaccucgagugcaccaagcagcucgccgccgccuuccacgaggaguucgucguccgcgaggaccucaugggccucgccaucggcacccacggcuccaacauccagcaggcccgcaagguccccggcgucaccgccaucgagcucgacgaggacaccggcaccuuccgcaucuacggcgaguccgccgacgccgucaagaaggcccgcggcuuccucgaguucgucgaggacuucauccaggucccccgcaaccucgucggcaaggucaucggcaagaacggcaaggucauccaggagaucgucgacaaguccggcgucguccgcguccgcaucgagggcgacaacgagaacaagcucccccgcgaggacggcaugguccccuucgucuucgucggcaccaaggaguccaucggcaacguccagguccuccucgaguaccacaucgccuaccucaaggaggucgagcagcuccgcauggagcgccuccagaucgacgagcagcuccgccagaucggcucccgcuccuacuccggccgcggccgcggccgccgcggccccaacuacaccuccggcuacggcaccaacuccgagcucuccaaccccuccgagaccgaguccgagcgcaaggacgagcucuccgacuggucccucgccggcgaggacgaccgcgacucccgccaccagcgcgacucccgccgccgccccggcggccgcggccgcuccgucuccggcggccgcggccgcggcggcccccgcggcggcaaguccuccaucuccuccguccucaaggaccccgacuccaaccccuacucccuccucgacaacaccgaguccgaccagaccgccgacaccgacgccuccgagucccaccacuccaccaaccgccgccgccgcucccgccgccgccgcaccgacgaggacgccguccucauggacggcaugaccgaguccgacaccgccuccgucaacgagaacggccucggcaagcgcugcgacuga

SEQ ID NO: 43412 - RNA, 2022 nt, Artificial Sequence
  derived and/or modified sequence opt2 from FXR2__Homo_sapiens__NP_004851
augggcggccucgccuccggcggcgacgucgagcccggccuccccgucgagguccgcggcuccaacggcgccuucuacaagggcuucgucaaggacguccacgaggacuccgucaccaucuucuucgagaacaacuggcaguccgagcgccagauccccuucggcgacguccgccuccccccccccgccgacuacaacaaggagaucaccgagggcgacgaggucgaggucuacucccgcgccaacgagcaggagcccugcggcugguggcucgcccgcguccgcaugaugaagggcgacuucuacgucaucgaguacgccgccugcgacgccaccuacaacgagaucgucacccucgagcgccuccgccccgucaaccccaacccccucgccaccaagggcuccuucuucaaggucaccauggccguccccgaggaccuccgcgaggccugcuccaacgagaacguccacaaggaguucaagaaggcccucggcgccaacugcaucuuccucaacaucaccaacuccgagcucuucauccucuccaccaccgaggcccccgucaagcgcgccucccuccucggcgacaugcacuuccgcucccuccgcaccaagcuccuccucaugucccgcaacgaggaggccaccaagcaccucgagaccuccaagcagcucgccgccgccuuccaggaggaguucaccguccgcgaggaccucaugggccucgccaucggcacccacggcgccaacauccagcaggcccgcaagguccccggcgucaccgccaucgagcucggcgaggagaccugcaccuuccgcaucuacggcgagacccccgaggccugccgccaggcccgcuccuaccucgaguucuccgaggacuccguccaggucccccgcaaccucgucggcaaggucaucggcaagaacggcaaggucauccaggagaucgucgacaaguccggcgucguccgcguccgcgucgagggcgacaacgacaagaagaacccccgcgaggagggcaugguccccuucaucuucgucggcacccgcgagaacaucuccaacgcccaggcccuccucgaguaccaccucuccuaccuccaggaggucgagcagcuccgccucgagcgccuccagaucgacgagcagcuccgccagaucggccucggcuuccgcccccccggcuccggccgcggcuccggcggcuccgacaaggccggcuacuccaccgacgaguccuccuccuccucccuccacgccacccgcaccuacggcggcuccuacggcggccgcggccgcggccgccgcaccggcggccccgccuacggccccuccuccgacgucuccaccgccuccgagaccgaguccgagaagcgcgaggagcccaaccgcgccggccccggcgaccgcgacccccccacccgcggcgaggagucccgccgccgccccaccggcggccgcggccgcggccccccccccgccccccgccccaccucccgcuacaacuccuccuccaucuccuccguccucaaggaccccgacuccaaccccuacucccuccucgacaccuccgagcccgagccccccgucgacuccgagcccggcgagcccccccccgccuccgcccgccgccgccgcucccgccgccgccgcaccgacgaggaccgcaccgucauggacggcggccucgaguccgacggccccaacaugaccgagaacggccucgaggacgagucccgcccccagcgccgcaaccgcucccgccgccgccgcaaccgcggcaaccgcaccgacggcuccaucuccggcgaccgccagcccgucaccgucgccgacuacaucucccgcgccgagucccagucccgccagcgccccccccucgagcgcaccaagcccuccgaggacucccucuccggccagaagggcgacuccgucuccaagcuccccaagggccccuccgagaacggcgagcucuccgccccccucgagcucggcuccauggucaacggcgucuccuga

SEQ ID NO: 43413 - RNA, 279 nt, Artificial Sequence
  derived and/or modified sequence opt2 from FXYD1__Homo_sapiens__NP_001265647
auggccucccucggccacauccucgucuucugcgucggccuccucaccauggccaaggccgagucccccaaggagcacgaccccuucaccuacgacuaccagucccuccagaucggcggccucgucaucgccggcauccucuucauccucggcauccucaucguccucucccgccgcugccgcugcaaguucaaccagcagcagcgcaccggcgagcccgacgaggaggagggcaccuuccgcuccuccauccgccgccucuccacccgccgccgcuga

SEQ ID NO: 43414 - RNA, 201 nt, Artificial Sequence
  derived and/or modified sequence opt2 from FXYD2__Homo_sapiens__NP_001671
augaccggccucuccauggacggcggcggcucccccaagggcgacgucgaccccuucuacuacgacuacgagaccguccgcaacggcggccucaucuucgccggccucgccuucaucgucggccuccucauccuccucucccgccgcuuccgcugcggcggcaacaagaagcgccgccagaucaacgaggacgagcccuga

SEQ ID NO: 43415 - RNA, 435 nt, Artificial Sequence
  derived and/or modified sequence opt2 from FXYD3__Homo_sapiens__NP_001129479
augggccgcggcuacuccggcgcccuccaggcccgcggcggccucgaggagccccucgagcgcggccuccgcggccccuccuucacccaguccccccuccacggcgccgccgccgccuaccucuccgcccagcgcgacgccucccuccccguccccggccagcgcuccgacaugcagaaggucacccucggccuccucgucuuccucgccggcuuccccguccucgacgccaacgaccucgaggacaagaacucccccuucuacuacgacuggcacucccuccaggucggcggccucaucugcgccggcguccucugcgccaugggcaucaucaucgucauguccgccaagugcaagugcaaguucggccagaaguccggccaccaccccggcgagacccccccccucaucacccccggcuccgcccaguccuga

SEQ ID NO: 43416 - RNA, 537 nt, Artificial Sequence
  derived and/or modified sequence opt2 from FXYD5__Homo_sapiens__NP_659003
augucccccuccggccgccucugccuccucaccaucgucggccucauccuccccacccgcggccagacccucaaggacaccaccuccuccuccuccgccgacuccaccaucauggacauccagguccccacccgcgcccccgacgccgucuacaccgagcuccagcccaccucccccacccccaccuggcccgccgacgagaccccccagccccagacccagacccagcagcucgagggcaccgacggcccccucgucaccgaccccgagacccacaaguccaccaaggccgcccaccccaccgacgacaccaccacccucuccgagcgccccucccccuccaccgacguccagaccgacccccagacccucaagcccuccggcuuccacgaggacgaccccuucuucuacgacgagcacacccuccgcaagcgcggccuccucgucgccgccguccucuucaucaccggcaucaucauccucaccuccggcaagugccgccagcucucccgccucugccgcaaccgcugccgcuga

SEQ ID NO: 43417 - RNA, 288 nt, Artificial Sequence
  derived and/or modified sequence opt2 from FXYD6__Homo_sapiens__NP_001158303
auggagcucguccucgucuuccucugcucccuccucgcccccaugguccucgccuccgccgccgagaaggagaaggagauggaccccuuccacuacgacuaccagacccuccgcaucggcggccucgucuucgccgucguccucuucuccgucggcauccuccucauccucucccgccgcugcaagugcuccuucaaccagaagccccgcgcccccggcgacgaggaggcccaggucgagaaccucaucaccgccaacgccaccgagccccagaaggccgagaacuga

SEQ ID NO: 43418 - RNA, 2520 nt, Artificial Sequence
  derived and/or modified sequence opt2 from FYB__Homo_sapiens__NP_001230022
auggacggcaaggccgacgucaagucccucauggccaaguacaacaccggcggcaaccccaccgaggacgucuccgucaacucccgccccuuccgcgucaccggccccaacuccuccuccggcauccaggcccgcaagaaccucuucaacaaccagggcaacgccuccccccccgccggccccuccaacguccccaaguucggcucccccaagccccccgucgccgucaagcccuccuccgaggagaagcccgacaaggagcccaagccccccuuccucaagcccaccggcgccggccagcgcuucggcacccccgccucccucaccacccgcgaccccgaggccaaggucggcuuccucaagcccgucggccccaagcccaucaaccuccccaaggaggacuccaagcccaccuuccccuggccccccggcaacaagcccucccuccacuccgucaaccaggaccacgaccucaagccccucggccccaaguccggccccaccccccccaccuccgagaacgagcagaagcaggccuuccccaagcucaccggcgucaagggcaaguucauguccgccucccaggaccucgagcccaagccccucuuccccaagcccgccuucggccagaagcccccccucuccaccgagaacucccacgaggacgagucccccaugaagaacgucuccuccuccaagggcucccccgccccccucggcguccgcuccaaguccggcccccucaagcccgcccgcgaggacuccgagaacaaggaccacgccggcgagaucuccucccuccccuuccccggcgucguccucaagcccgccgccucccgcggcggccccggccucuccaagaacggcgaggagaagaaggaggaccgcaagaucgacgccgccaagaacaccuuccaguccaagaucaaccaggaggagcucgccuccggcaccccccccgcccgcuuccccaaggcccccuccaagcucaccgucggcggccccuggggccagucccaggagaaggagaagggcgacaagaacuccgccacccccaagcagaagccccuccccccccucuucacccucggcccccccccccccaagcccaaccgcccccccaacgucgaccucaccaaguuccacaagaccuccuccggcaacuccaccuccaagggccagaccuccuacuccaccaccucccuccccccccccccccccucccaccccgccucccagcccccccuccccgccucccaccccucccagccccccguccccucccuccccccccgcaacaucaagccccccuucgaccucaagucccccgucaacgaggacaaccaggacggcgucacccacuccgacggcgccggcaaccucgacgaggagcaggacuccgagggcgagaccuacgaggacaucgaggccuccaaggagcgcgagaagaagcgcgagaaggaggagaagaagcgccucgagcucgagaagaaggagcagaaggagaaggagaagaaggagcaggagaucaagaagaaguucaagcucaccggccccauccaggucauccaccucgccaaggccugcugcgacgucaagggcggcaagaacgagcucuccuucaagcagggcgagcagaucgagaucauccgcaucaccgacaaccccgagggcaaguggcucggccgcaccgcccgcggcuccuacggcuacaucaagaccaccgccgucgagaucgacuacgacucccucaagcucaagaaggacucccucggcgcccccucccgccccaucgaggacgaccaggaggucuacgacgacgucgccgagcaggacgacaucuccucccacucccaguccggcuccggcggcaucuucccccccccccccgacgacgacaucuacgacggcaucgaggaggaggacgccgacgacggcuccacccuccagguccaggagaaguccaacaccugguccuggggcauccucaagaugcucaagggcaaggacgaccgcaagaaguccauccgcgagaagcccaaggucuccgacuccgacaacaacgagggcuccuccuuccccgccccccccaagcagcucgacaugggcgacgaggucuacgacgacgucgacaccuccgacuuccccgucuccuccgccgagaugucccagggcaccaacgucggcaaggccaagaccgaggagaaggaccucaagaagcucaagaagcaggagaaggaggagaaggacuuccgcaagaaguucaaguacgacggcgagauccgcguccucuacuccaccaaggucaccaccuccaucaccuccaagaaguggggcacccgcgaccuccaggucaagcccggcgagucccucgaggucauccagaccaccgacgacaccaagguccucugccgcaacgaggagggcaaguacggcuacguccuccgcuccuaccucgccgacaacgacggcgagaucuacgacgacaucgccgacggcugcaucuacgacaacgacuga

SEQ ID NO: 43419 - RNA, 4437 nt, Artificial Sequence
  derived and/or modified sequence opt2 from FYCO1__Homo_sapiens__NP_078789
auggccuccaccaacgccgagucccagcuccagcgcaucauccgcgaccuccaggacgccgucaccgagcucuccaaggaguuccaggaggccggcgagcccaucaccgacgacuccaccucccuccacaaguucuccuacaagcucgaguaccuccuccaguucgaccagaaggagaaggccacccuccucggcaacaagaaggacuacugggacuacuucugcgccugccucgccaaggucaagggcgccaacgacggcauccgcuucgucaaguccaucuccgagcuccgcaccucccucggcaagggccgcgccuucauccgcuacucccucguccaccagcgccucgccgacacccuccagcagugcuucaugaacaccaaggucaccuccgacugguacuacgcccgcucccccuuccuccagcccaagcucuccuccgacaucgucggccagcucuacgagcucaccgagguccaguucgaccucgccucccgcggcuucgaccucgacgccgccuggcccaccuucgcccgccgcacccucaccaccggcuccuccgccuaccucuggaagccccccucccgcuccuccuccauguccucccucgucuccuccuaccuccagacccaggagauggucuccaacuucgaccucaacuccccccucaacaacgaggcccucgagggcuucgacgagaugcgccucgagcucgaccagcucgagguccgcgagaagcagcuccgcgagcgcaugcagcagcucgaccgcgagaaccaggagcuccgcgccgccgucucccagcagggcgagcagcuccagaccgagcgcgagcgcggccgcaccgccgccgaggacaacguccgccucaccugccucgucgccgagcuccagaagcagugggaggucacccaggccacccagaacaccgucaaggagcuccagaccugccuccagggccucgagcucggcgccgccgagaaggaggaggacuaccacaccgcccuccgccgccucgaguccaugcuccagccccucgcccaggagcucgaggccacccgcgacucccucgacaagaagaaccagcaccucgccuccuuccccggcuggcucgccauggcccagcagaaggccgacaccgccuccgacaccaagggccgccaggagcccauccccuccgacgccgcccaggagaugcaggagcucggcgagaagcuccaggcccucgagcgcgagcgcaccaaggucgaggaggucaaccgccagcaguccgcccagcucgagcagcucgucaaggagcuccagcucaaggaggacgcccgcgccucccucgagcgccucgucaaggagauggccccccuccaggaggagcucuccggcaagggccaggaggccgaccagcucuggcgccgccuccaggagcuccucgcccacaccuccuccugggaggaggagcucgccgagcuccgccgcgagaagaagcagcagcaggaggagaaggagcuccucgagcaggagguccgcucccucacccgccagcuccaguuccucgagacccagcucgcccaggucucccagcacgucuccgaccucgaggagcagaagaagcagcucauccaggacaaggaccaccucucccagcaggucggcaugcucgagcgccucgccggcccccccggccccgagcuccccgucgccggcgagaagaacgaggcccucguccccgucaacuccucccuccaggaggccuggggcaagcccgaggaggagcagcgcggccuccaggaggcccagcucgacgacaccaagguccaggagggcucccaggaggaggagcuccgccaggccaaccgcgagcucgagaaggagcuccagaacgucgucggccgcaaccagcuccucgagggcaagcuccaggcccuccaggccgacuaccaggcccuccagcagcgcgaguccgccauccagggcucccucgccucccucgaggccgagcaggccuccauccgccaccucggcgaccagauggaggccucccuccucgccguccgcaaggccaaggaggccaugaaggcccagauggccgagaaggaggccauccuccaguccaaggagggcgagugccagcagcuccgcgaggaggucgagcagugccagcagcucgccgaggcccgccaccgcgagcuccgcgcccucgagucccagugccagcagcagacccagcucaucgagguccucaccgccgagaagggccagcagggcgucggcccccccaccgacaacgaggcccgcgagcucgccgcccagcucgcccucucccaggcccagcucgagguccaccagggcgagguccagcgccuccaggcccaggucgucgaccuccaggccaagaugcgcgccgcccucgacgaccaggacaagguccagucccagcucuccauggccgaggccguccuccgcgagcacaagacccucguccagcagcucaaggagcagaacgaggcccucaaccgcgcccacguccaggagcuccuccagugcuccgagcgcgagggcgcccuccaggaggagcgcgccgacgaggcccagcagcgcgaggaggagcuccgcgcccuccaggaggagcucucccaggccaagugcuccuccgaggaggcccagcucgagcacgccgagcuccaggagcagcuccaccgcgccaacaccgacaccgccgagcucggcauccaggucugcgcccucaccgucgagaaggagcgcgucgaggaggcccucgccugcgccguccaggagcuccaggacgccaaggaggccgccucccgcgagcgcgagggccucgagcgccaggucgccggccuccagcaggagaaggagucccuccaggagaagcucaaggccgccaaggccgccgccggcucccuccccggccuccaggcccagcucgcccaggccgagcagcgcgcccagucccuccaggaggccgcccaccaggagcucaacacccucaaguuccagcucuccgccgagaucauggacuaccagucccgccucaagaacgccggcgaggagugcaagucccuccgcggccagcucgaggagcagggccgccagcuccaggccgccgaggaggccgucgagaagcucaaggccacccaggccgacaugggcgagaagcucuccugcaccuccaaccaccucgccgagugccaggccgccaugcuccgcaaggacaaggagggcgccgcccuccgcgaggaccucgagcgcacccagaaggagcucgagaaggccaccaccaagauccaggaguacuacaacaagcucugccaggaggucaccaaccgcgagcgcaacgaccagaagaugcucgccgaccucgacgaccucaaccgcaccaagaaguaccucgaggagcgccucaucgagcuccuccgcgacaaggacgcccucuggcagaaguccgacgcccucgaguuccagcagaagcucuccgccgaggagcgcuggcucggcgacaccgaggccaaccacugccucgacugcaagcgcgaguucuccuggaugguccgccgccaccacugccgcaucugcggccgcaucuucugcuacuacugcugcaacaacuacguccucuccaagcacggcggcaagaaggagcgcugcugccgcgccugcuuccagaagcucuccgagggccccggcucccccgacuccuccggcuccggcaccucccagggcgagcccucccccgcccucucccccgccucccccggcccccaggccaccggcggccagggcgccaacaccgacuaccgcccccccgacgacgccgucuucgacaucaucaccgacgaggagcucugccagauccaggaguccggcuccucccuccccgagacccccaccgagaccgacucccucgaccccaacgccgccgagcaggacaccaccuccaccucccucacccccgaggacaccgaggacaugcccgucggccaggacuccgagaucugccuccucaaguccggcgagcucaugaucaaggucccccucaccgucgacgagaucgccuccuucggcgagggcucccgcgagcucuucguccgcuccuccaccuacucccucauccccaucaccgucgccgaggccggccucaccaucuccugggucuucuccuccgaccccaaguccaucuccuucuccgucgucuuccaggaggccgaggacaccccccucgaccagugcaagguccucauccccaccacccgcugcaacucccacaaggagaacauccagggccagcucaagguccgcacccccggcaucuacaugcucaucuucgacaacaccuucucccgcuucgucuccaagaaggucuucuaccaccucaccgucgaccgccccgucaucuacgacggcuccgacuuccucuga

SEQ ID NO: 43420 - RNA, 1614 nt, Artificial Sequence
  derived and/or modified sequence opt2 from FYN__Homo_sapiens__NP_002028
augggcugcguccagugcaaggacaaggaggccaccaagcucaccgaggagcgcgacggcucccucaaccaguccuccggcuaccgcuacggcaccgaccccaccccccagcacuaccccuccuucggcgucaccuccauccccaacuacaacaacuuccacgccgccggcggccagggccucaccgucuucggcggcgucaacuccuccucccacaccggcacccuccgcacccgcggcggcaccggcgucacccucuucgucgcccucuacgacuacgaggcccgcaccgaggacgaccucuccuuccacaagggcgagaaguuccagauccucaacuccuccgagggcgacuggugggaggcccgcucccucaccaccggcgagaccggcuacauccccuccaacuacgucgcccccgucgacuccauccaggccgaggagugguacuucggcaagcucggccgcaaggacgccgagcgccagcuccucuccuucggcaacccccgcggcaccuuccucauccgcgaguccgagaccaccaagggcgccuacucccucuccauccgcgacugggacgacaugaagggcgaccacgucaagcacuacaagauccgcaagcucgacaacggcggcuacuacaucaccacccgcgcccaguucgagacccuccagcagcucguccagcacuacuccgagcgcgccgccggccucugcugccgccucgucguccccugccacaagggcaugccccgccucaccgaccucuccgucaagaccaaggacgucugggagaucccccgcgagucccuccagcucaucaagcgccucggcaacggccaguucggcgaggucuggaugggcaccuggaacggcaacaccaaggucgccaucaagacccucaagcccggcaccaugucccccgaguccuuccucgaggaggcccagaucaugaagaagcucaagcacgacaagcucguccagcucuacgccgucgucuccgaggagcccaucuacaucgucaccgaguacaugaacaagggcucccuccucgacuuccucaaggacggcgagggccgcgcccucaagcuccccaaccucgucgacauggccgcccaggucgccgccggcauggccuacaucgagcgcaugaacuacauccaccgcgaccuccgcuccgccaacauccucgucggcaacggccucaucugcaagaucgccgacuucggccucgcccgccucaucgaggacaacgaguacaccgcccgccagggcgccaaguuccccaucaaguggaccgcccccgaggccgcccucuacggccgcuucaccaucaaguccgacgucugguccuucggcauccuccucaccgagcucgucaccaagggccgcguccccuaccccggcaugaacaaccgcgagguccucgagcaggucgagcgcggcuaccgcaugcccugcccccaggacugccccaucucccuccacgagcucaugauccacugcuggaagaaggaccccgaggagcgccccaccuucgaguaccuccaguccuuccucgaggacuacuucaccgccaccgagccccaguaccagcccggcgagaaccucuga

SEQ ID NO: 43421 - RNA, 1746 nt, Artificial Sequence
  derived and/or modified sequence opt2 from FZD10__Homo_sapiens__NP_009128
augcagcgccccggcccccgccucuggcucguccuccaggucaugggcuccugcgccgccaucuccuccauggacauggagcgccccggcgacggcaagugccagcccaucgagauccccaugugcaaggacaucggcuacaacaugacccgcaugcccaaccucaugggccacgagaaccagcgcgaggccgccauccagcuccacgaguucgccccccucgucgaguacggcugccacggccaccuccgcuucuuccucugcucccucuacgcccccaugugcaccgagcaggucuccacccccauccccgccugccgcgucaugugcgagcaggcccgccucaagugcucccccaucauggagcaguucaacuucaaguggcccgacucccucgacugccgcaagcuccccaacaagaacgaccccaacuaccucugcauggaggcccccaacaacggcuccgacgagcccacccgcggcuccggccucuuccccccccucuuccgcccccagcgcccccacuccgcccaggagcacccccucaaggacggcggccccggccgcggcggcugcgacaaccccggcaaguuccaccacgucgagaaguccgccuccugcgccccccucugcacccccggcgucgacgucuacuggucccgcgaggacaagcgcuucgccgucgucuggcucgccaucugggccguccucugcuucuucuccuccgccuucaccguccucaccuuccucaucgaccccgcccgcuuccgcuaccccgagcgccccaucaucuuccucuccaugugcuacugcgucuacuccgucggcuaccucauccgccucuucgccggcgccgaguccaucgccugcgaccgcgacuccggccagcucuacgucauccaggagggccucgaguccaccggcugcacccucgucuuccucguccucuacuacuucggcauggccuccucccucuggugggucguccucacccucaccugguuccucgccgccggcaagaaguggggccacgaggccaucgaggccaacuccuccuacuuccaccucgccgccugggccauccccgccgucaagaccauccucauccucgucaugcgccgcgucgccggcgacgagcucaccggcgucugcuacgucggcuccauggacgucaacgcccucaccggcuucguccucaucccccucgccugcuaccucgucaucggcaccuccuucauccucuccggcuucgucgcccucuuccacauccgccgcgucaugaagaccggcggcgagaacaccgacaagcucgagaagcucaugguccgcaucggccucuucuccguccucuacaccguccccgccaccugcgucaucgccugcuacuucuacgagcgccucaacauggacuacuggaagauccucgccgcccagcacaagugcaagaugaacaaccagaccaagacccucgacugccucauggccgccuccauccccgccgucgagaucuucauggucaagaucuucaugcuccucgucgucggcaucaccuccggcauguggaucuggaccuccaagacccuccaguccuggcagcaggucugcucccgccgccucaagaagaagucccgccgcaagcccgccuccgucaucaccuccggcggcaucuacaagaaggcccagcacccccagaagacccaccacggcaaguacgagauccccgcccagucccccaccugcgucuga

SEQ ID NO: 43422 - RNA, 1944 nt, Artificial Sequence
  derived and/or modified sequence opt2 from FZD1__Homo_sapiens__NP_003496
auggccgaggaggaggcccccaagaagucccgcgccgccggcggcggcgccuccugggagcucugcgccggcgcccucuccgcccgccucgccgaggagggcuccggcgacgccggcggccgccgccgcccccccgucgacccccgccgccucgcccgccagcuccuccuccuccucuggcuccucgaggccccccuccuccucggcguccgcgcccaggccgccggccagggccccggccagggccccggccccggccagcagccccccccccccccccagcagcagcaguccggccagcaguacaacggcgagcgcggcaucuccguccccgaccacggcuacugccagcccaucuccaucccccucugcaccgacaucgccuacaaccagaccaucaugcccaaccuccucggccacaccaaccaggaggacgccggccucgagguccaccaguucuacccccucgucaagguccagugcuccgccgagcucaaguucuuccucugcuccauguacgcccccgucugcaccguccucgagcaggcccucccccccugccgcucccucugcgagcgcgcccgccagggcugcgaggcccucaugaacaaguucggcuuccaguggcccgacacccucaagugcgagaaguuccccguccacggcgccggcgagcucugcgucggccagaacaccuccgacaagggcacccccacccccucccuccuccccgaguucuggaccuccaacccccagcacggcggcggcggccaccgcggcggcuuccccggcggcgccggcgccuccgagcgcggcaaguucuccugcccccgcgcccucaagguccccuccuaccucaacuaccacuuccucggcgagaaggacugcggcgcccccugcgagcccaccaaggucuacggccucauguacuucggccccgaggagcuccgcuucucccgcaccuggaucggcaucugguccguccucugcugcgccuccacccucuucaccguccucaccuaccucgucgacaugcgccgcuucuccuaccccgagcgccccaucaucuuccucuccggcugcuacaccgccgucgccgucgccuacaucgccggcuuccuccucgaggaccgcgucgucugcaacgacaaguucgccgaggacggcgcccgcaccgucgcccagggcaccaagaaggagggcugcaccauccucuucaugaugcucuacuucuucuccauggccuccuccaucuggugggucauccucucccucaccugguuccucgccgccggcaugaaguggggccacgaggccaucgaggccaacucccaguacuuccaccucgccgccugggccguccccgccaucaagaccaucaccauccucgcccucggccaggucgacggcgacguccucuccggcgucugcuucgucggccucaacaacgucgacgcccuccgcggcuucguccucgccccccucuucgucuaccucuucaucggcaccuccuuccuccucgccggcuucgucucccucuuccgcauccgcaccaucaugaagcacgacggcaccaagaccgagaagcucgagaagcucaugguccgcaucggcgucuucuccguccucuacaccguccccgccaccaucgucaucgccugcuacuucuacgagcaggccuuccgcgaccagugggagcgcuccugggucgcccaguccugcaaguccuacgccauccccugcccccaccuccaggccggcggcggcgcccccccccacccccccaugucccccgacuucaccgucuucaugaucaaguaccucaugacccucaucgucggcaucaccuccggcuucuggaucugguccggcaagacccucaacuccuggcgcaaguucuacacccgccucaccaacuccaagcagggcgagaccaccgucuga

SEQ ID NO: 43423 - RNA, 1698 nt, Artificial Sequence
  derived and/or modified sequence opt2 from FZD2__Homo_sapiens__NP_001457
augcgcccccgcuccgcccucccccgccuccuccucccccuccuccuccuccccgccgccggccccgcccaguuccacggcgagaagggcaucuccauccccgaccacggcuucugccagcccaucuccaucccccucugcaccgacaucgccuacaaccagaccaucaugcccaaccuccucggccacaccaaccaggaggacgccggccucgagguccaccaguucuacccccucgucaagguccagugcucccccgagcuccgcuucuuccucugcuccauguacgcccccgucugcaccguccucgagcaggccaucccccccugccgcuccaucugcgagcgcgcccgccagggcugcgaggcccucaugaacaaguucggcuuccaguggcccgagcgccuccgcugcgagcacuucccccgccacggcgccgagcagaucugcgucggccagaaccacuccgaggacggcgcccccgcccuccucaccaccgcccccccccccggccuccagcccggcgccggcggcacccccggcggccccggcggcggcggcgcccccccccgcuacgccacccucgagcaccccuuccacugcccccgcguccucaagguccccuccuaccucuccuacaaguuccucggcgagcgcgacugcgccgcccccugcgagcccgcccgccccgacggcuccauguucuucucccaggaggagacccgcuucgcccgccucuggauccucaccugguccguccucugcugcgccuccaccuucuucaccgucaccaccuaccucgucgacaugcagcgcuuccgcuaccccgagcgccccaucaucuuccucuccggcugcuacaccauggucuccgucgccuacaucgccggcuucguccuccaggagcgcgucgucugcaacgagcgcuucuccgaggacggcuaccgcaccgucguccagggcaccaagaaggagggcugcaccauccucuucaugaugcucuacuucuucuccauggccuccuccaucuggugggucauccucucccucaccugguuccucgccgccggcaugaaguggggccacgaggccaucgaggccaacucccaguacuuccaccucgccgccugggccguccccgccgucaagaccaucaccauccucgccaugggccagaucgacggcgaccuccucuccggcgucugcuucgucggccucaacucccucgacccccuccgcggcuucguccucgccccccucuucgucuaccucuucaucggcaccuccuuccuccucgccggcuucgucucccucuuccgcauccgcaccaucaugaagcacgacggcaccaagaccgagaagcucgagcgccucaugguccgcaucggcgucuucuccguccucuacaccguccccgccaccaucgucaucgccugcuacuucuacgagcaggccuuccgcgagcacugggagcgcuccugggucucccagcacugcaagucccucgccauccccugccccgcccacuacaccccccgcaugucccccgacuucaccgucuacaugaucaaguaccucaugacccucaucgucggcaucaccuccggcuucuggaucugguccggcaagacccuccacuccuggcgcaaguucuacacccgccucaccaacucccgccacggcgagaccaccgucuga

SEQ ID NO: 43424 - RNA, 2001 nt, Artificial Sequence
  derived and/or modified sequence opt2 from FZD3__Homo_sapiens__NP_665873
auggccaugaccuggaucgucuucucccucuggccccucaccgucuucaugggccacaucggcggccacucccucuucuccugcgagcccaucacccuccgcaugugccaggaccuccccuacaacaccaccuucaugcccaaccuccucaaccacuacgaccagcagaccgccgcccucgccauggagcccuuccaccccauggucaaccucgacugcucccgcgacuuccgccccuuccucugcgcccucuacgcccccaucugcauggaguacggccgcgucacccuccccugccgccgccucugccagcgcgccuacuccgagugcuccaagcucauggagauguucggcguccccuggcccgaggacauggagugcucccgcuuccccgacugcgacgagcccuacccccgccucgucgaccucaaccucgccggcgagcccaccgagggcgcccccgucgccguccagcgcgacuacggcuucuggugcccccgcgagcucaagaucgaccccgaccucggcuacuccuuccuccacguccgcgacugcuccccccccugccccaacauguacuuccgccgcgaggagcucuccuucgcccgcuacuucaucggccucaucuccaucaucugccucuccgccacccucuucaccuuccucaccuuccucaucgacgucacccgcuuccgcuaccccgagcgccccaucaucuucuacgccgucugcuacaugauggucucccucaucuucuucaucggcuuccuccucgaggaccgcgucgccugcaacgccuccauccccgcccaguacaaggccuccaccgucacccagggcucccacaacaaggccugcaccaugcucuucaugauccucuacuucuucaccauggccggcuccgucuggugggucauccucaccaucaccugguuccucgccgccguccccaaguggggcuccgaggccaucgagaagaaggcccuccucuuccacgccuccgccuggggcauccccggcacccucaccaucauccuccucgccaugaacaagaucgagggcgacaacaucuccggcgucugcuucgucggccucuacgacgucgacgcccuccgcuacuucguccucgccccccucugccucuacgucgucgucggcgucucccuccuccucgccggcaucaucucccucaaccgcguccgcaucgagaucccccucgagaaggagaaccaggacaagcucgucaaguucaugauccgcaucggcgucuucuccauccucuaccucgucccccuccucgucgucaucggcugcuacuucuacgagcaggccuaccgcggcaucugggagaccaccuggauccaggagcgcugccgcgaguaccacauccccugccccuaccaggucacccagaugucccgccccgaccucauccucuuccucaugaaguaccucauggcccucaucgucggcauccccuccgucuucugggucggcuccaagaagaccugcuucgagugggccuccuucuuccacggccgccgcaagaaggagaucgucaacgagucccgccagguccuccaggagcccgacuucgcccagucccuccuccgcgaccccaacacccccaucauccgcaagucccgcggcaccuccacccagggcaccuccacccacgccuccuccacccagcucgccauggucgacgaccagcgcuccaaggccggcuccauccacuccaaggucuccuccuaccacggcucccuccaccgcucccgcgacggccgcuacacccccugcuccuaccgcggcauggaggagcgccucccccacggcuccaugucccgccucaccgaccacucccgccacuccuccucccaccgccucaacgagcagucccgccacuccuccauccgcgaccucuccaacaaccccaugacccacaucacccacggcaccuccaugaaccgcgucaucgaggaggacggcaccuccgccuga

SEQ ID NO: 43425 - RNA, 1614 nt, Artificial Sequence
  derived and/or modified sequence opt2 from FZD4__Homo_sapiens__NP_036325
auggccuggcgcggcgccggccccuccguccccggcgcccccggcggcgucggccucucccucggccuccuccuccagcuccuccuccuccucggccccgcccgcggcuucggcgacgaggaggagcgccgcugcgaccccauccgcaucuccaugugccagaaccucggcuacaacgucaccaagaugcccaaccucgucggccacgagcuccagaccgacgccgagcuccagcucaccaccuucaccccccucauccaguacggcugcuccucccagcuccaguucuuccucugcuccgucuacguccccaugugcaccgagaagaucaacauccccaucggccccugcggcggcaugugccucuccgucaagcgccgcugcgagcccguccucaaggaguucggcuucgccuggcccgagucccucaacugcuccaaguuccccccccagaacgaccacaaccacaugugcauggagggccccggcgacgaggaggucccccucccccacaagacccccauccagcccggcgaggagugccacuccgucggcaccaacuccgaccaguacaucugggucaagcgcucccucaacugcguccucaagugcggcuacgacgccggccucuacucccgcuccgccaaggaguucaccgacaucuggauggccgucugggccucccucugcuucaucuccaccgccuucaccguccucaccuuccucaucgacuccucccgcuucuccuaccccgagcgccccaucaucuuccucuccaugugcuacaacaucuacuccaucgccuacaucguccgccucaccgucggccgcgagcgcaucuccugcgacuucgaggaggccgccgagcccguccucauccaggagggccucaagaacaccggcugcgccaucaucuuccuccucauguacuucuucggcauggccuccuccaucuggugggucauccucacccucaccugguuccucgccgccggccucaaguggggccacgaggccaucgagaugcacuccuccuacuuccacaucgccgccugggccauccccgccgucaagaccaucgucauccucaucaugcgccucgucgacgccgacgagcucaccggccucugcuacgucggcaaccagaaccucgacgcccucaccggcuucgucgucgccccccucuucaccuaccucgucaucggcacccucuucaucgccgccggccucgucgcccucuucaagauccgcuccaaccuccagaaggacggcaccaagaccgacaagcucgagcgccucauggucaagaucggcgucuucuccguccucuacaccguccccgccaccugcgucaucgccugcuacuucuacgagaucuccaacugggcccucuuccgcuacuccgccgacgacuccaacauggccgucgagaugcucaagaucuucaugucccuccucgucggcaucaccuccggcauguggaucugguccgccaagacccuccacaccuggcagaagugcuccaaccgccucgucaacuccggcaaggucaagcgcgagaagcgcggcaacggcugggucaagcccggcaagggcuccgagaccgucgucuga

SEQ ID NO: 43426 - RNA, 1758 nt, Artificial Sequence
  derived and/or modified sequence opt2 from FZD5__Homo_sapiens__NP_003459
auggcccgccccgaccccuccgccccccccucccuccuccuccuccuccucgcccagcucgucggccgcgccgccgccgccuccaaggcccccgucugccaggagaucaccguccccaugugccgcggcaucggcuacaaccucacccacaugcccaaccaguucaaccacgacacccaggacgaggccggccucgagguccaccaguucuggccccucgucgagauccagugcucccccgaccuccgcuucuuccucugcuccauguacacccccaucugccuccccgacuaccacaagccccucccccccugccgcuccgucugcgagcgcgccaaggccggcugcuccccccucaugcgccaguacggcuucgccuggcccgagcgcauguccugcgaccgccuccccguccucggccgcgacgccgagguccucugcauggacuacaaccgcuccgaggccaccaccgcccccccccgccccuuccccgccaagcccacccuccccggcccccccggcgcccccgccuccggcggcgagugccccgccggcggccccuucgucugcaagugccgcgagcccuucguccccauccucaaggagucccacccccucuacaacaagguccgcaccggccagguccccaacugcgccguccccugcuaccagcccuccuucuccgccgacgagcgcaccuucgccaccuucuggaucggccucugguccguccucugcuucaucuccaccuccaccaccgucgccaccuuccucaucgacauggagcgcuuccgcuaccccgagcgccccaucaucuuccucuccgccugcuaccucugcgucucccucggcuuccucguccgccucgucgucggccacgccuccgucgccugcucccgcgagcacaaccacauccacuacgagaccaccggccccgcccucugcaccaucgucuuccuccucgucuacuucuucggcauggccuccuccaucuggugggucauccucucccucaccugguuccucgccgccggcaugaaguggggcaacgaggccaucgccggcuacgcccaguacuuccaccucgccgccuggcucauccccuccgucaaguccaucaccgcccucgcccucuccuccgucgacggcgaccccgucgccggcaucugcuacgucggcaaccagaaccucaacucccuccgcggcuucguccucggcccccucguccucuaccuccucgucggcacccucuuccuccucgccggcuucgucucccucuuccgcauccgcuccgucaucaagcagggcggcaccaagaccgacaagcucgagaagcucaugauccgcaucggcaucuucacccuccucuacaccguccccgccuccaucgucgucgccugcuaccucuacgagcagcacuaccgcgaguccugggaggccgcccucaccugcgccugccccggccacgacaccggccagccccgcgccaagcccgaguacuggguccucaugcucaaguacuucaugugccucgucgucggcaucaccuccggcgucuggaucugguccggcaagaccgucgaguccuggcgccgcuucaccucccgcugcugcugccgcccccgccgcggccacaaguccggcggcgccauggccgccggcgacuaccccgaggccuccgccgcccucaccggccgcaccggcccccccggccccgccgccaccuaccacaagcaggucucccucucccacgucuga

SEQ ID NO: 43427 - RNA, 2025 nt, Artificial Sequence
  derived and/or modified sequence opt2 from FZD6__Homo_sapiens__NP_001158088
augaagauggccuacaacaugaccuucuuccccaaccucaugggccacuacgaccaguccaucgccgccgucgagauggagcacuuccucccccucgccaaccucgagugcucccccaacaucgagaccuuccucugcaaggccuucguccccaccugcaucgagcagauccacgucgucccccccugccgcaagcucugcgagaaggucuacuccgacugcaagaagcucaucgacaccuucggcauccgcuggcccgaggagcucgagugcgaccgccuccaguacugcgacgagaccguccccgucaccuucgacccccacaccgaguuccucggcccccagaagaagaccgagcagguccagcgcgacaucggcuucuggugcccccgccaccucaagaccuccggcggccagggcuacaaguuccucggcaucgaccagugcgccccccccugccccaacauguacuucaaguccgacgagcucgaguucgccaaguccuucaucggcaccgucuccaucuucugccucugcgccacccucuucaccuuccucaccuuccucaucgacguccgccgcuuccgcuaccccgagcgccccaucaucuacuacuccgucugcuacuccaucgucucccucauguacuucaucggcuuccuccucggcgacuccaccgccugcaacaaggccgacgagaagcucgagcucggcgacaccgucguccucggcucccagaacaaggccugcaccguccucuucaugcuccucuacuucuucaccauggccggcaccgucuggugggucauccucaccaucaccugguuccucgccgccggccgcaagugguccugcgaggccaucgagcagaaggccgucugguuccacgccgucgccuggggcacccccggcuuccucaccgucaugcuccucgccaugaacaaggucgagggcgacaacaucuccggcgucugcuucgucggccucuacgaccucgacgccucccgcuacuucguccuccucccccucugccucugcgucuucgucggccucucccuccuccucgccggcaucaucucccucaaccacguccgccaggucauccagcacgacggccgcaaccaggagaagcucaagaaguucaugauccgcaucggcgucuucuccggccucuaccucgucccccucgucacccuccucggcugcuacgucuacgagcaggucaaccgcaucaccugggagaucaccugggucuccgaccacugccgccaguaccacauccccugccccuaccaggccaaggccaaggcccgccccgagcucgcccucuucaugaucaaguaccucaugacccucaucgucggcaucuccgccgucuucugggucggcuccaagaagaccugcaccgagugggccggcuucuucaagcgcaaccgcaagcgcgaccccaucuccgagucccgccgcguccuccaggaguccugcgaguucuuccucaagcacaacuccaaggucaagcacaagaagaagcacuacaagcccuccucccacaagcucaaggucaucuccaaguccaugggcaccuccaccggcgccaccgccaaccacggcaccuccgccgucgccaucaccucccacgacuaccucggccaggagacccucaccgagauccagaccucccccgagaccuccaugcgcgaggucaaggccgacggcgccuccaccccccgccuccgcgagcaggacugcggcgagcccgccucccccgccgccuccaucucccgccucuccggcgagcaggucgacggcaagggccaggccggcuccgucuccgaguccgcccgcuccgagggccgcaucucccccaaguccgacaucaccgacaccggccucgcccaguccaacaaccuccagguccccuccuccuccgagcccuccucccucaagggcuccaccucccuccucguccaccccgucuccggcguccgcaaggagcagggcggcggcugccacuccgacaccuga

SEQ ID NO: 43428 - RNA, 1725 nt, Artificial Sequence
  derived and/or modified sequence opt2 from FZD7__Homo_sapiens__NP_003498
augcgcgaccccggcgccgccgccccccucuccucccucggccucugcgcccucguccucgcccuccucggcgcccucuccgccggcgccggcgcccagcccuaccacggcgagaagggcaucuccguccccgaccacggcuucugccagcccaucuccaucccccucugcaccgacaucgccuacaaccagaccauccuccccaaccuccucggccacaccaaccaggaggacgccggccucgagguccaccaguucuacccccucgucaagguccagugcucccccgagcuccgcuucuuccucugcuccauguacgcccccgucugcaccguccucgaccaggccaucccccccugccgcucccucugcgagcgcgcccgccagggcugcgaggcccucaugaacaaguucggcuuccaguggcccgagcgccuccgcugcgagaacuuccccguccacggcgccggcgagaucugcgucggccagaacaccuccgacggcuccggcggccccggcggcggccccaccgccuaccccaccgcccccuaccuccccgaccuccccuucaccgcccucccccccggcgccuccgacggccgcggccgccccgccuuccccuucuccugcccccgccagcucaaggucccccccuaccucggcuaccgcuuccucggcgagcgcgacugcggcgcccccugcgagcccggccgcgccaacggccucauguacuucaaggaggaggagcgccgcuucgcccgccucugggucggcgucugguccguccucugcugcgccuccacccucuucaccguccucaccuaccucgucgacaugcgccgcuucuccuaccccgagcgccccaucaucuuccucuccggcugcuacuucauggucgccgucgcccacgucgccggcuuccuccucgaggaccgcgccgucugcgucgagcgcuucuccgacgacggcuaccgcaccgucgcccagggcaccaagaaggagggcugcaccauccucuucaugguccucuacuucuucggcauggccuccuccaucuggugggucauccucucccucaccugguuccucgccgccggcaugaaguggggccacgaggccaucgaggccaacucccaguacuuccaccucgccgccugggccguccccgccgucaagaccaucaccauccucgccaugggccaggucgacggcgaccuccucuccggcgucugcuacgucggccucuccuccgucgacgcccuccgcggcuucguccucgccccccucuucgucuaccucuucaucggcaccuccuuccuccucgccggcuucgucucccucuuccgcauccgcaccaucaugaagcacgacggcaccaagaccgagaagcucgagaagcucaugguccgcaucggcgucuucuccguccucuacaccguccccgccaccaucguccucgccugcuacuucuacgagcaggccuuccgcgagcacugggagcgcaccuggcuccuccagaccugcaaguccuacgccguccccugcccccccggccacuucccccccaugucccccgacuucaccgucuucaugaucaaguaccucaugaccaugaucgucggcaucaccaccggcuucuggaucugguccggcaagacccuccaguccuggcgccgcuucuaccaccgccucucccacuccuccaagggcgagaccgccgucuga

SEQ ID NO: 43429 - RNA, 2085 nt, Artificial Sequence
  derived and/or modified sequence opt2 from FZD8__Homo_sapiens__NP_114072
auggaguggggcuaccuccucgaggucaccucccuccucgccgcccucgcccuccuccagcgcuccuccggcgccgccgccgccuccgccaaggagcucgccugccaggagaucaccgucccccucugcaagggcaucggcuacaacuacaccuacaugcccaaccaguucaaccacgacacccaggacgaggccggccucgagguccaccaguucuggccccucgucgagauccagugcucccccgaccucaaguucuuccucugcuccauguacacccccaucugccucgaggacuacaagaagccccucccccccugccgcuccgucugcgagcgcgccaaggccggcugcgccccccucaugcgccaguacggcuucgccuggcccgaccgcaugcgcugcgaccgccuccccgagcagggcaaccccgacacccucugcauggacuacaaccgcaccgaccucaccaccgccgcccccucccccccccgccgccuccccccccccccccccggcgagcagccccccuccggcuccggccacggccgcccccccggcgcccgccccccccaccgcggcggcggccgcggcggcggcggcggcgacgccgccgccccccccgcccgcggcggcggcggcggcggcaaggcccgcccccccggcggcggcgccgcccccugcgagcccggcugccagugccgcgcccccauggucuccgucuccuccgagcgccacccccucuacaaccgcgucaagaccggccagaucgccaacugcgcccuccccugccacaaccccuucuucucccaggacgagcgcgccuucaccgucuucuggaucggccucugguccguccucugcuucgucuccaccuucgccaccgucuccaccuuccucaucgacauggagcgcuucaaguaccccgagcgccccaucaucuuccucuccgccugcuaccucuucgucuccgucggcuaccucguccgccucgucgccggccacgagaaggucgccugcuccggcggcgcccccggcgccggcggcgccggcggcgccggcggcgccgccgccggcgccggcgccgccggcgccggcgccggcggccccggcggccgcggcgaguacgaggagcucggcgccgucgagcagcacguccgcuacgagaccaccggccccgcccucugcaccgucgucuuccuccucgucuacuucuucggcauggccuccuccaucuggugggucauccucucccucaccugguuccucgccgccggcaugaaguggggcaacgaggccaucgccggcuacucccaguacuuccaccucgccgccuggcucguccccuccgucaaguccaucgccguccucgcccucuccuccgucgacggcgaccccgucgccggcaucugcuacgucggcaaccagucccucgacaaccuccgcggcuucguccucgccccccucgucaucuaccucuucaucggcaccauguuccuccucgccggcuucgucucccucuuccgcauccgcuccgucaucaagcagcaggacggccccaccaagacccacaagcucgagaagcucaugauccgccucggccucuucaccguccucuacaccguccccgccgccgucgucgucgccugccucuucuacgagcagcacaaccgcccccgcugggaggccacccacaacugccccugccuccgcgaccuccagcccgaccaggcccgccgccccgacuacgccgucuucaugcucaaguacuucaugugccucgucgucggcaucaccuccggcgucugggucugguccggcaagacccucgaguccuggcgcucccucugcacccgcugcugcugggccuccaagggcgccgccgucggcggcggcgccggcgccaccgccgccggcggcggcggcggccccggcggcggcggcggcggcggccccggcggcggcggcggccccggcggcggcggcggcucccucuacuccgacgucuccaccggccucaccuggcgcuccggcaccgccuccuccgucuccuaccccaagcagaugccccucucccaggucuga

SEQ ID NO: 43430 - RNA, 1776 nt, Artificial Sequence
  derived and/or modified sequence opt2 from FZD9__Homo_sapiens__NP_003499
auggccgucgccccccuccgcggcgcccuccuccucuggcagcuccucgccgccggcggcgccgcccucgagaucggccgcuucgaccccgagcgcggccgcggcgccgcccccugccaggccgucgagauccccaugugccgcggcaucggcuacaaccucacccgcaugcccaaccuccucggccacaccucccagggcgaggccgccgccgagcucgccgaguucgccccccucguccaguacggcugccacucccaccuccgcuucuuccucugcucccucuacgcccccaugugcaccgaccaggucuccacccccauccccgccugccgccccaugugcgagcaggcccgccuccgcugcgcccccaucauggagcaguucaacuucggcuggcccgacucccucgacugcgcccgccuccccacccgcaacgacccccacgcccucugcauggaggcccccgagaacgccaccgccggccccgccgagccccacaagggccucggcaugcuccccgucgccccccgccccgcccgcccccccggcgaccucggccccggcgccggcggcuccggcaccugcgagaaccccgagaaguuccaguacgucgagaagucccgcuccugcgccccccgcugcggccccggcgucgaggucuucuggucccgccgcgacaaggacuucgcccucgucuggauggccgucugguccgcccucugcuucuucuccaccgccuucaccguccucaccuuccuccucgagccccaccgcuuccaguaccccgagcgccccaucaucuuccucuccaugugcuacaacgucuacucccucgccuuccucauccgcgccgucgccggcgcccaguccgucgccugcgaccaggaggccggcgcccucuacgucauccaggagggccucgagaacaccggcugcacccucgucuuccuccuccucuacuacuucggcauggccuccucccucuggugggucguccucacccucaccugguuccucgccgccggcaagaaguggggccacgaggccaucgaggcccacggcuccuacuuccacauggccgccuggggccuccccgcccucaagaccaucgucauccucacccuccgcaaggucgccggcgacgagcucaccggccucugcuacgucgccuccaccgacgccgccgcccucaccggcuucguccucgucccccucuccggcuaccucguccucggcuccuccuuccuccucaccggcuucgucgcccucuuccacauccgcaagaucaugaagaccggcggcaccaacaccgagaagcucgagaagcucauggucaagaucggcgucuucuccauccucuacaccguccccgccaccugcgucaucgucugcuacgucuacgagcgccucaacauggacuucuggcgccuccgcgccaccgagcagcccugcgccgccgccgccggccccggcggccgccgcgacugcucccuccccggcggcuccguccccaccgucgccgucuucaugcucaagaucuucaugucccucgucgucggcaucaccuccggcgucugggucugguccuccaagaccuuccagaccuggcagucccucugcuaccgcaagaucgccgccggccgcgcccgcgccaaggccugccgcgcccccggcuccuacggccgcggcacccacugccacuacaaggcccccaccgucguccuccacaugaccaagaccgaccccucccucgagaaccccacccaccucuga

SEQ ID NO: 43431 - RNA, 1215 nt, Artificial Sequence
  derived and/or modified sequence opt2 from FZR1__Homo_sapiens__NP_001129669
auggaccaggacuacgagcgccgccuccuccgccagaucgucauccagaacgagaacaccaugccccgcgucaccgagaugcgccgcacccucacccccgccuccucccccgucuccucccccuccaagcacggcgaccgcuucauccccucccgcgccggcgccaacugguccgucaacuuccaccgcaucaacgagaacgagaagucccccucccagaaccgcaaggccaaggacgccaccuccgacaacggcaaggacggccucgccuacuccgcccuccucaagaacgagcuccucggcgccggcaucgagaagguccaggacccccagaccgaggaccgccgccuccagcccuccacccccgagaagaagggccucuucaccgucacccgccucugcgaccucuccgucgagggcgacuccgucaccuccgucggcugguccgagcgcggcaaccucgucgccgucggcacccacaagggcuucguccagaucugggacgccgccgccggcaagaagcucuccaugcucgagggccacaccgcccgcgucggcgcccucgccuggaacgccgagcagcucuccuccggcucccgcgaccgcaugauccuccagcgcgacauccgcacccccccccuccaguccgagcgccgccuccagggccaccgccaggaggucugcggccucaagugguccaccgaccaccagcuccucgccuccggcggcaacgacaacaagcuccucgucuggaaccacuccucccucucccccguccagcaguacaccgagcaccucgccgccgucaaggccaucgccugguccccccaccagcacggccuccucgccuccggcggcggcaccgccgaccgcugcauccgcuucuggaacacccucaccggccagccccuccagugcaucgacaccggcucccaggucugcaaccucgccugguccaagcacgccaacgagcucgucuccacccacggcuacucccagaaccagauccucgucuggaaguaccccucccucacccaggucgccaagcucaccggccacuccuaccgcguccucuaccucgccaugucccccgacggcgaggccaucgucaccggcgccggcgacgagacccuccgcuucuggaacgucuucuccaagacccgcuccaccaaggaguccgucuccguccucaaccucuucacccgcauccgcuga

SEQ ID NO: 43432 - RNA, 312 nt, Artificial Sequence
  derived and/or modified sequence opt2 from G0S2__Homo_sapiens__NP_056529
auggagaccguccaggagcucaucccccucgccaaggagaugauggcccagaagcgcaagggcaagauggucaagcucuacguccucggcuccguccucgcccucuucggcgucguccucggccucauggagaccgucugcucccccuucaccgccgcccgccgccuccgcgaccaggaggccgccgucgccgagcuccaggccgcccucgagcgccaggcccuccagaagcaggcccuccaggagaagggcaagcagcaggacaccguccucggcggccgcgcccucuccaaccgccagcacgccuccuga

SEQ ID NO: 43433 - RNA, 2121 nt, Artificial Sequence
  derived and/or modified sequence opt2 from G2E3__Homo_sapiens__NP_060239
augaacgaguccaagcccggcgacucccagaaccucgccugcgucuucugccgcaagcacgacgacugccccaacaaguacggcgagaagaagaccaaggagaaguggaaccucaccguccacuacuacugccuccucauguccuccggcaucuggcagcgcggcaaggaggaggagggcgucuacggcuuccucaucgaggacauccgcaaggaggucaaccgcgccuccaagcucaagugcugcgucugcaagaagaacggcgccuccaucggcugcgucgccccccgcugcaagcgcuccuaccacuuccccugcggccuccagcgcgagugcaucuuccaguucaccggcaacuucgccuccuucugcugggaccaccgccccguccagaucaucaccuccaacaacuaccgcgagucccuccccugcaccaucugccucgaguucaucgagcccauccccuccuacaacauccuccgcucccccugcugcaagaacgccugguuccaccgcgacugccuccagguccaggccaucaacgccggcgucuucuucuuccgcugcaccaucugcaacaacuccgacaucuuccagaaggagaugcuccgcaugggcauccacauccccgagaaggacgccuccugggagcucgaggagaacgccuaccaggagcuccuccagcacuacgagcgcugcgacguccgccgcugccgcugcaaggagggccgcgacuacaacgcccccgacuccaagugggagaucaagcgcugccagugcugcggcuccuccggcacccaccucgccugcuccucccuccgcuccugggagcagaacugggagugccucgagugccgcggcaucaucuacaacuccggcgaguuccagaaggccaagaagcacguccuccccaacuccaacaacgucggcaucaccgacugccuccucgaggaguccucccccaagcucccccgccagucccccggcucccaguccaaggaccuccuccgccagggcuccaaguuccgccgcaacgucuccacccuccucaucgagcucggcuuccagaucaagaagaagaccaagcgccucuacaucaacaaggccaacaucuggaacuccgcccucgacgccuuccgcaaccgcaacuucaaccccuccuacgccaucgaggucgccuacgucaucgagaacgacaacuucggcuccgagcaccccggcuccaagcaggaguuccucucccuccucaugcagcaccucgagaacuccucccucuucgagggcucccucuccaagaaccucucccucaacucccaggcccucaaggagaaccucuacuacgaggccggcaagaugcucgccaucucccucguccacggcggccccucccccggcuucuucuccaagacccucuucaacugccucgucuacggccccgagaacacccagcccauccucgacgacgucuccgacuucgacgucgcccagaucaucauccgcaucaacaccgccaccaccgucgccgaccucaaguccaucaucaacgagugcuacaacuaccucgagcucaucggcugccuccgccucaucaccacccucuccgacaaguacaugcucgucaaggacauccucggcuaccacgucauccagcgcguccacacccccuucgaguccuucaagcagggccucaagacccucggcguccucgagaagauccaggccuaccccgaggccuucugcuccauccucugccacaagcccgagucccucuccgccaagauccucuccgagcucuucaccguccacacccuccccgacgucaaggcccucggcuucuggaacuccuaccuccaggccgucgaggacggcaaguccaccaccaccauggaggacauccucaucuucgccaccggcugcuccuccaucccccccgccggcuucaagcccacccccuccaucgagugccuccacgucgacuuccccgucggcaacaagugcaacaacugccucgccauccccaucaccaacaccuacaaggaguuccaggagaacauggacuucaccauccgcaacacccuccgccucgagaaggaggaguccucccacuacaucggccacuga

SEQ ID NO: 43434 - RNA, 1401 nt, Artificial Sequence
  derived and/or modified sequence opt2 from G3BP1__Homo_sapiens__XP_006714813
auggucauggagaagcccuccccccuccucgucggccgcgaguucguccgccaguacuacacccuccucaaccaggcccccgacaugcuccaccgcuucuacggcaagaacuccuccuacguccacggcggccucgacuccaacggcaagcccgccgacgccgucuacggccagaaggagauccaccgcaaggucaugucccagaacuucaccaacugccacaccaagauccgccacgucgacgcccacgccacccucaacgacggcgucgucguccaggucaugggccuccucuccaacaacaaccaggcccuccgccgcuucaugcagaccuucguccucgcccccgagggcuccgucgccaacaaguucuacguccacaacgacaucuuccgcuaccaggacgaggucuucggcggcuucgucaccgagccccaggaggaguccgaggaggaggucgaggagcccgaggagcgccagcagacccccgaggucguccccgacgacuccggcaccuucuacgaccaggccgucgucuccaacgacauggaggagcaccucgaggagcccgucgccgagcccgagcccgaccccgagcccgagcccgagcaggagcccgucuccgagauccaggaggagaagcccgagcccguccucgaggagaccgcccccgaggacgcccagaaguccuccucccccgcccccgccgacaucgcccagaccguccaggaggaccuccgcaccuucuccugggccuccgucaccuccaagaaccucccccccuccggcgccguccccgucaccggcauccccccccacgucgucaagguccccgccucccagccccgccccgaguccaagcccgagucccagauccccccccagcgcccccagcgcgaccagcgcguccgcgagcagcgcaucaacauccccccccagcgcggcccccgccccauccgcgaggccggcgagcagggcgacaucgagccccgccgcaugguccgccaccccgacucccaccagcucuucaucggcaaccucccccacgaggucgacaaguccgagcucaaggacuucuuccaguccuacggcaacgucgucgagcuccgcaucaacuccggcggcaagcuccccaacuucggcuucgucgucuucgacgacuccgagcccguccagaagguccucuccaaccgccccaucauguuccgcggcgagguccgccucaacgucgaggagaagaagacccgcgccgcccgcgagggcgaccgccgcgacaaccgccuccgcggccccggcggcccccgcggcggccucggcggcggcaugcgcggccccccccgcggcggcaugguccagaagcccggcuucggcgucggccgcggccucgccccccgccaguga

SEQ ID NO: 43435 - RNA, 465 nt, Artificial Sequence
  derived and/or modified sequence opt2 from G6PC2__Homo_sapiens__NP_001075155
auggacuuccuccaccgcaacggcguccucaucauccagcaccuccagaaggacuaccgcgccuacuacaccuuccucaacuucauguccaacgucggcgacccccgcaacaucuucuucaucuacuucccccucugcuuccaguucaaccagaccgucggcaccaagaugaucugggucgccgucaucggcgacuggcucaaccucaucuucaaguggauccucuucggccaccgccccuacugguggguccaggagacccagaucuaccccaaccacuccucccccugccucgagcaguuccccaccaccugcgagaccggccccggcucccccuccggccacgccaugggcgccuccugcgucugguacgucauggucaccgccgcccucucccacaccgucugcggcauggacaaguucuccaucacccuccaccgccacgccggcggccgcggccucuga

SEQ ID NO: 43436 - RNA, 1041 nt, Artificial Sequence
  derived and/or modified sequence opt2 from G6PC3__Homo_sapiens__NP_612396
auggaguccacccucggcgccggcaucgucaucgccgaggcccuccagaaccagcucgccuggcucgagaacgucuggcucuggaucaccuuccucggcgaccccaagauccucuuccucuucuacuuccccgccgccuacuacgccucccgccgcgucggcaucgccguccucuggaucucccucaucaccgaguggcucaaccucaucuucaagugguuccucuucggcgaccgccccuucugguggguccacgaguccggcuacuacucccaggcccccgcccagguccaccaguuccccuccuccugcgagaccggccccggcucccccuccggccacugcaugaucaccggcgccgcccucuggcccaucaugaccgcccucuccucccaggucgccacccgcgcccgcucccgcuggguccgcgucaugcccucccucgccuacugcaccuuccuccucgccgucggccucucccgcaucuucauccucgcccacuucccccaccagguccucgccggccucaucaccggcgccguccucggcuggcucaugaccccccgcguccccauggagcgcgagcucuccuucuacggccucaccgcccucgcccucaugcucggcaccucccucaucuacuggacccucuucacccucggccucgaccucuccugguccaucucccucgccuucaaguggugcgagcgccccgaguggauccacgucgacucccgccccuucgccucccucucccgcgacuccggcgccgcccucggccucggcaucgcccuccacucccccugcuacgcccagguccgccgcgcccagcucggcaacggccagaagaucgccugccucguccucgccaugggccuccucggcccccucgacuggcucggccaccccccccagaucucccucuucuacaucuucaacuuccucaaguacacccucuggcccugccucguccucgcccucguccccugggccguccacauguucuccgcccaggaggccccccccauccacuccuccuga

SEQ ID NO: 43437 - RNA, 1074 nt, Artificial Sequence
  derived and/or modified sequence opt2 from G6PC__Homo_sapiens__NP_000142
auggaggagggcaugaacguccuccacgacuucggcauccaguccacccacuaccuccaggucaacuaccaggacucccaggacugguucauccucgucuccgucaucgccgaccuccgcaacgccuucuacguccucuuccccaucugguuccaccuccaggaggccgucggcaucaagcuccucugggucgccgucaucggcgacuggcucaaccucgucuucaaguggauccucuucggccagcgccccuacugguggguccucgacaccgacuacuacuccaacaccuccgucccccucaucaagcaguuccccgucaccugcgagaccggccccggcucccccuccggccacgccaugggcaccgccggcgucuacuacgucauggucaccuccacccucuccaucuuccagggcaagaucaagcccaccuaccgcuuccgcugccucaacgucauccucuggcucggcuucugggccguccagcucaacgucugccucucccgcaucuaccucgccgcccacuucccccaccaggucgucgccggcguccucuccggcaucgccgucgccgagaccuucucccacauccacuccaucuacaacgccucccucaagaaguacuuccucaucaccuucuuccucuucuccuucgccaucggcuucuaccuccuccucaagggccucggcgucgaccuccucuggacccucgagaaggcccagcgcuggugcgagcagcccgaguggguccacaucgacaccacccccuucgccucccuccucaagaaccucggcacccucuucggccucggccucgcccucaacuccuccauguaccgcgaguccugcaagggcaagcucuccaaguggcuccccuuccgccucuccuccaucgucgccucccucguccuccuccacgucuucgacucccucaagccccccucccaggucgagcucgucuucuacguccucuccuucugcaaguccgccgucgucccccucgccuccgucuccgucauccccuacugccucgcccagguccucggccagccccacaagaagucccucuga

SEQ ID NO: 43438 - RNA, 1638 nt, Artificial Sequence
  derived and/or modified sequence opt2 from G6PD__Homo_sapiens__NP_000393
augggccgccgcggcuccgcccccggcaacggccgcacccuccgcggcugcgagcgcggcggccgccgccgccgcuccgccgacuccgucauggccgagcaggucgcccucucccgcacccaggucugcggcauccuccgcgaggagcucuuccagggcgacgccuuccaccaguccgacacccacaucuucaucaucaugggcgccuccggcgaccucgccaagaagaagaucuaccccaccaucugguggcucuuccgcgacggccuccuccccgagaacaccuucaucgucggcuacgcccgcucccgccucaccgucgccgacauccgcaagcaguccgagcccuucuucaaggccacccccgaggagaagcucaagcucgaggacuucuucgcccgcaacuccuacgucgccggccaguacgacgacgccgccuccuaccagcgccucaacucccacaugaacgcccuccaccucggcucccaggccaaccgccucuucuaccucgcccucccccccaccgucuacgaggccgucaccaagaacauccacgaguccugcaugucccagaucggcuggaaccgcaucaucgucgagaagcccuucggccgcgaccuccaguccuccgaccgccucuccaaccacaucuccucccucuuccgcgaggaccagaucuaccgcaucgaccacuaccucggcaaggagaugguccagaaccucaugguccuccgcuucgccaaccgcaucuucggccccaucuggaaccgcgacaacaucgccugcgucauccucaccuucaaggagcccuucggcaccgagggccgcggcggcuacuucgacgaguucggcaucauccgcgacgucaugcagaaccaccuccuccagaugcucugccucgucgccauggagaagcccgccuccaccaacuccgacgacguccgcgacgagaaggucaagguccucaagugcaucuccgagguccaggccaacaacgucguccucggccaguacgucggcaaccccgacggcgagggcgaggccaccaagggcuaccucgacgaccccaccgucccccgcggcuccaccaccgccaccuucgccgccgucguccucuacgucgagaacgagcgcugggacggcguccccuucauccuccgcugcggcaaggcccucaacgagcgcaaggccgagguccgccuccaguuccacgacgucgccggcgacaucuuccaccagcagugcaagcgcaacgagcucgucauccgcguccagcccaacgaggccgucuacaccaagaugaugaccaagaagcccggcauguucuucaaccccgaggaguccgagcucgaccucaccuacggcaaccgcuacaagaacgucaagcuccccgacgccuacgagcgccucauccucgacgucuucugcggcucccagaugcacuucguccgcuccgacgagcuccgcgaggccuggcgcaucuucaccccccuccuccaccagaucgagcucgagaagcccaagcccauccccuacaucuacggcucccgcggccccaccgaggccgacgagcucaugaagcgcgucggcuuccaguacgagggcaccuacaagugggucaacccccacaagcucuga

SEQ ID NO: 43439 - RNA, 2859 nt, Artificial Sequence
  derived and/or modified sequence opt2 from GAA__Homo_sapiens__XP_005257251
augggcguccgccacccccccugcucccaccgccuccucgccgucugcgcccucgucucccucgccaccgccgcccuccucggccacauccuccuccacgacuuccuccucgucccccgcgagcucuccggcuccucccccguccucgaggagacccaccccgcccaccagcagggcgccucccgccccggcccccgcgacgcccaggcccaccccggccgcccccgcgccguccccacccagugcgacgucccccccaacucccgcuucgacugcgcccccgacaaggccaucacccaggagcagugcgaggcccgcggcugcugcuacauccccgccaagcagggccuccagggcgcccagaugggccagcccuggugcuucuucccccccuccuaccccuccuacaagcucgagaaccucuccuccuccgagaugggcuacaccgccacccucacccgcaccacccccaccuucuuccccaaggacauccucacccuccgccucgacgucaugauggagaccgagaaccgccuccacuucaccaucaaggaccccgccaaccgccgcuacgaggucccccucgagaccccccacguccacucccgcgcccccuccccccucuacuccgucgaguucuccgaggagcccuucggcgucaucguccgccgccagcucgacggccgcguccuccucaacaccaccgucgccccccucuucuucgccgaccaguuccuccagcucuccaccucccuccccucccaguacaucaccggccucgccgagcaccucuccccccucaugcucuccaccuccuggacccgcaucacccucuggaaccgcgaccucgcccccacccccggcgccaaccucuacggcucccaccccuucuaccucgcccucgaggacggcggcuccgcccacggcgucuuccuccucaacuccaacgccauggacgucguccuccagcccucccccgcccucuccuggcgcuccaccggcggcauccucgacgucuacaucuuccucggccccgagcccaaguccgucguccagcaguaccucgacgucgucggcuaccccuucaugccccccuacuggggccucggcuuccaccucugccgcuggggcuacuccuccaccgccaucacccgccaggucgucgagaacaugacccgcgcccacuucccccucgacguccaguggaacgaccucgacuacauggacucccgccgcgacuucaccuucaacaaggacggcuuccgcgacuuccccgccaugguccaggagcuccaccagggcggccgccgcuacaugaugaucgucgaccccgccaucuccuccuccggccccgccggcuccuaccgccccuacgacgagggccuccgccgcggcgucuucaucaccaacgagaccggccagccccucaucggcaaggucuggcccggcuccaccgccuuccccgacuucaccaaccccaccgcccucgccuggugggaggacauggucgccgaguuccacgaccagguccccuucgacggcauguggaucgacaugaacgagcccuccaacuucauccgcggcuccgaggacggcugccccaacaacgagcucgagaacccccccuacguccccggcgucgucggcggcacccuccaggccgccaccaucugcgccuccucccaccaguuccucuccacccacuacaaccuccacaaccucuacggccucaccgaggccaucgccucccaccgcgcccucgucaaggcccgcggcacccgccccuucgucaucucccgcuccaccuucgccggccacggccgcuacgccggccacuggaccggcgacgucugguccuccugggagcagcucgccuccuccguccccgagauccuccaguucaaccuccucggcgucccccucgucggcgccgacgucugcggcuuccucggcaacaccuccgaggagcucugcguccgcuggacccagcucggcgccuucuaccccuucaugcgcaaccacaacucccuccucucccucccccaggagcccuacuccuucuccgagcccgcccagcaggccaugcgcaaggcccucacccuccgcuacgcccuccucccccaccucuacacccucuuccaccaggcccacgucgccggcgagaccgucgcccgcccccucuuccucgaguuccccaaggacuccuccaccuggaccgucgaccaccagcuccucuggggcgaggcccuccucaucacccccguccuccaggccggcaaggccgaggucaccggcuacuucccccucggcaccugguacgaccuccagaccguccccgucgaggcccucggcucccucccccccccccccgccgccccccgcgagcccgccauccacuccgagggccagugggucacccuccccgccccccucgacaccaucaacguccaccuccgcgccggcuacaucaucccccuccagggccccggccucaccaccaccgagucccgccagcagcccauggcccucgccgucgcccucaccaagggcggcgaggcccgcggcgagcucuucugggacgacggcgagucccucgagguccucgagcgcggcgccuacacccaggucaucuuccucgcccgcaacaacaccaucgucaacgagcucguccgcgucaccuccgagggcgccggccuccagcuccagaaggucaccguccucggcgucgccaccgccccccagcagguccucuccaacggcguccccgucuccaacuucaccuacucccccgacaccaagguccucgacaucugcgucucccuccucaugggcgagcaguuccucgucuccuggugcuga

SEQ ID NO: 43440 - RNA, 2085 nt, Artificial Sequence
  derived and/or modified sequence opt2 from GAB1__Homo_sapiens__NP_002030
auguccggcggcgaggucgucugcuccggcuggcuccgcaaguccccccccgagaagaagcucaagcgcuacgccuggaagcgccgcugguucguccuccgcuccggccgccucaccggcgaccccgacguccucgaguacuacaagaacgaccacgccaagaagcccauccgcaucaucgaccucaaccucugccagcaggucgacgccggccucaccuucaacaagaaggaguucgagaacuccuacaucuucgacaucaacaccaucgaccgcaucuucuaccucgucgccgacuccgaggaggagaugaacaaguggguccgcugcaucugcgacaucugcggcuucaaccccaccgaggaggaccccgucaagccccccggcuccucccuccaggcccccgccgaccucccccucgccaucaacaccgccccccccuccacccaggccgacuccuccuccgccacccuccccccccccuaccagcucaucaacguccccccccaccucgagacccucggcauccaggaggacccccaggacuaccuccuccucaucaacugccaguccaagaagcccgagcccacccgcacccacgccgacuccgccaaguccaccuccuccgagaccgacugcaacgacaacguccccucccacaagaaccccgccuccucccaguccaagcacggcaugaacggcuucuuccagcagcagaugaucuacgacuccccccccucccgcgcccccuccgccuccgucgacuccucccucuacaaccucccccgcuccuacucccacgacguccuccccaaggucucccccuccuccaccgaggccgacggcgagcucuacgucuucaacacccccuccggcaccuccuccgucgagacccagaugcgccacgucuccaucuccuacgacaucccccccacccccggcaacaccuaccagaucccccgcaccuuccccgagggcacccucggccagaccuccaagcucgacaccauccccgacaucccccccccccgcccccccaagccccaccccgcccacgaccgcucccccgucgagaccugcuccaucccccgcaccgccuccgacaccgacuccuccuacugcauccccaccgccggcaugucccccucccgcuccaacaccaucuccaccgucgaccucaacaagcuccgcaaggacgccuccucccaggacugcuacgacaucccccgcgccuuccccuccgaccgcuccuccucccucgagggcuuccacaaccacuucaaggucaagaacguccucaccgucggcuccgucuccuccgaggagcucgacgagaacuacguccccaugaaccccaacucccccccccgccagcacuccuccuccuucaccgagcccauccaggaggccaacuacguccccaugacccccggcaccuucgacuucuccuccuucggcaugcagguccccccccccgcccacaugggcuuccgcuccucccccaagacccccccccgccgccccguccccgucgccgacugcgagcccccccccgucgaccgcaaccucaagcccgaccgcaaggucaagcccgccccccucgagaucaagccccuccccgagugggaggagcuccaggcccccguccgcucccccaucacccgcuccuucgcccgcgacuccucccgcuuccccauguccccccgccccgacuccguccacuccaccaccuccuccuccgacucccacgacuccgaggagaacuacguccccaugaaccccaaccucuccuccgaggaccccaaccucuucggcuccaacucccucgacggcggcuccucccccaugaucaagcccaagggcgacaagcaggucgaguaccucgaccucgaccucgacuccggcaaguccacccccccccgcaagcagaaguccuccggcuccggcuccuccgucgccgacgagcgcgucgacuacgucgucgucgaccagcagaagacccucgcccucaaguccacccgcgaggccuggaccgacggccgccaguccaccgaguccgagacccccgccaaguccgucaaguga

SEQ ID NO: 43441 - RNA, 1917 nt, Artificial Sequence
  derived and/or modified sequence opt2 from GAB2__Homo_sapiens__NP_036428
auguccggcgaccccgacguccucgaguacuacaagaacgaccacuccaagaagccccuccgcaucaucaaccucaacuucugcgagcaggucgacgccggccucaccuucaacaagaaggagcuccaggacuccuucgucuucgacaucaagaccuccgagcgcaccuucuaccucgucgccgagaccgaggaggacaugaacaaguggguccaguccaucugccagaucugcggcuucaaccaggccgaggaguccaccgacucccuccgcaacgucuccuccgccggccacggcccccgcuccucccccgccgagcucuccuccuccucccagcaccuccuccgcgagcgcaaguccuccgcccccucccacuccucccagcccacccucuucaccuucgagccccccgucuccaaccacaugcagcccacccucuccaccuccgccccccaggaguaccucuaccuccaccagugcaucucccgccgcgccgagaacgcccgcuccgccuccuucucccagggcacccgcgccuccuuccucaugcgcuccgacaccgccguccagaagcucgcccagggcaacggccacugcgucaacggcaucuccggccagguccacggcuucuacucccuccccaagcccucccgccacaacaccgaguuccgcgacuccaccuacgaccucccccgcucccucgccucccacggccacaccaagggcucccucaccggcuccgagaccgacaacgaggacgucuacaccuucaagacccccuccaacacccucugccgcgaguucggcgaccuccucgucgacaacauggacguccccgccaccccccucuccgccuaccagaucccccgcaccuucacccucgacaagaaccacaacgccaugaccgucgccacccccggcgacuccgccaucgccccccccccccgcccccccaagcccucccaggccgagaccccccgcuggggcuccccccagcagcgcccccccaucuccgagaacucccgcuccgucgccgccaccaucccccgccgcaacacccuccccgccauggacaacucccgccuccaccgcgccuccuccugcgagaccuacgaguacccccagcgcggcggcgaguccgccggccgcuccgccgaguccauguccgacggcgucggcuccuuccuccccggcaagaugaucgucggccgcuccgacuccaccaacuccgaggacaacuacguccccaugaaccccggcuccuccacccuccucgccauggagcgcgccggcgacaacucccaguccgucuacauccccaugucccccggcgcccaccacuucgacucccucggcuaccccuccaccacccuccccguccaccgcggccccucccgcggcuccgagauccagcccccccccgucaaccgcaaccucaagcccgaccgcaaggccaagcccaccccccucgaccuccgcaacaacaccgucaucgacgagcuccccuucaagucccccaucaccaaguccuggucccgcgccaaccacaccuucaacuccuccuccucccaguacugccgccccaucuccacccaguccaucaccuccaccgacuccggcgacuccgaggagaacuacguccccaugcagaaccccgucuccgccucccccguccccuccggcaccaacucccccgcccccaagaaguccaccggcuccgucgacuaccucgcccucgacuuccagcccuccucccccuccccccaccgcaagcccuccaccuccuccgucaccuccgacgagaaggucgacuacguccaggucgacaaggagaagacccaggcccuccagaacaccaugcaggaguggaccgacguccgccaguccuccgagcccuccaagggcgccaagcucuga

SEQ ID NO: 43442 - RNA, 1764 nt, Artificial Sequence
  derived and/or modified sequence opt2 from GAB3__Homo_sapiens__NP_001075042
auguccgccggcgacgccgucugcaccggcuggcucgucaaguccccccccgagcgcaagcuccagcgcuacgccuggcgcaagcgcugguucguccuccgccgcggccgcauguccggcaaccccgacguccucgaguacuaccgcaacaagcacuccuccaagcccauccgcgucaucgaccucuccgagugcgccgucuggaagcacgucggccccuccuucguccgcaaggaguuccagaacaacuucgucuucaucgucaagaccaccucccgcaccuucuaccucgucgccaagaccgagcaggagaugcaggucuggguccacuccaucucccaggucugcaaccucggccaccucgaggacggcgccgccgacuccauggagucccucuccuacacccccuccucccuccagcccuccuccgccuccucccuccucaccgcccacgccgccuccuccucccucccccgcgacgaccccaacaccaacgccgucgccaccgaggagacccgcuccgaguccgagcuccucuuccuccccgacuaccucguccucuccaacugcgagaccggccgccuccaccacaccucccuccccacccgcugcgacuccugguccaacuccgaccgcucccucgagcaggccuccuucgacgacgucuucgucgacugccuccagccccuccccuccucccaccucguccaccccuccugccacggcuccggcgcccaggagguccccuccucccgcccccaggccgcccucaucuggucccgcgagaucaacggccccccccgcgaccaccucuccuccuccccccuccucgaguccucccucuccuccaccauccaggucgacaagaaccagggcucccuccccugcggcgccaaggagcucgacaucauguccaacaccccccccccccgcccccccaagcccucccaccucuccgagcgccgccaggaggagugguccacccacuccggcuccaagaagcccgagugcacccucgucccccgccgcaucucccucuccggccucgacaacaugcgcaccuggaaggccgacgucgagggccagucccuccgccaccgcgacaagcgccucucccucaaccuccccugccgcuucucccccauguaccccaccgccuccgccuccaucgaggacuccuacguccccauguccccccaggccggcgccuccggccucggcccccacugcucccccgacgacuacauccccaugaacuccggcuccaucuccuccccccuccccgagcuccccgccaaccucgagcccccccccgucaaccgcgaccucaagccccagcgcaagucccgcccccccccccucgaccuccgcaaccucuccaucauccgcgagcacgccucccucacccgcacccgcaccguccccugcucccgcaccuccuuccucucccccgagcgcaacggcaucaacuccgcccgcuucuucgccaaccccgucucccgcgaggacgaggaguccuacaucgagauggaggagcaccgcaccgccuccucccucuccuccggcgcccucaccuggaccaagaaguucucccucgacuaccucgcccucgacuucaacuccgccucccccgcccccaugcagcagaagcuccuccucuccgaggagcagcgcgucgacuacguccaggucgacgagcagaagacccaggcccuccaguccaccaagcaggaguggaccgacgagcgccaguccaaggucuga

SEQ ID NO: 43443 - RNA, 354 nt, Artificial Sequence
  derived and/or modified sequence opt2 from GABARAP__Homo_sapiens__NP_009209
augaaguucgucuacaaggaggagcaccccuucgagaagcgccgcuccgagggcgagaagauccgcaagaaguaccccgaccgcguccccgucaucgucgagaaggcccccaaggcccgcaucggcgaccucgacaagaagaaguaccucguccccuccgaccucaccgucggccaguucuacuuccucauccgcaagcgcauccaccuccgcgccgaggacgcccucuucuucuucgucaacaacgucaucccccccaccuccgccaccaugggccagcucuaccaggagcaccacgaggaggacuucuuccucuacaucgccuacuccgacgaguccgucuacggccucuga

SEQ ID NO: 43444 - RNA, 354 nt, Artificial Sequence
  derived and/or modified sequence opt2 from GABARAPL1__Homo_sapiens__NP_113600
augaaguuccaguacaaggaggaccaccccuucgaguaccgcaagaaggagggcgagaagauccgcaagaaguaccccgaccgcguccccgucaucgucgagaaggcccccaaggcccgcguccccgaccucgacaagcgcaaguaccucguccccuccgaccucaccgucggccaguucuacuuccucauccgcaagcgcauccaccuccgccccgaggacgcccucuucuucuucgucaacaacaccaucccccccaccuccgccaccaugggccagcucuacgaggacaaccacgaggaggacuacuuccucuacgucgccuacuccgacgaguccgucuacggcaaguga

SEQ ID NO: 43445 - RNA, 354 nt, Artificial Sequence
  derived and/or modified sequence opt2 from GABARAPL2__Homo_sapiens__NP_009216
augaaguggauguucaaggaggaccacucccucgagcaccgcugcgucgaguccgccaagauccgcgccaaguaccccgaccgcguccccgucaucgucgagaaggucuccggcucccagaucgucgacaucgacaagcgcaaguaccucguccccuccgacaucaccgucgcccaguucauguggaucauccgcaagcgcauccagcuccccuccgagaaggccaucuuccucuucgucgacaagaccgucccccaguccucccucaccaugggccagcucuacgagaaggagaaggacgaggacggcuuccucuacgucgccuacuccggcgagaacaccuucggcuucuga

SEQ ID NO: 43446 - RNA, 2886 nt, Artificial Sequence
  derived and/or modified sequence opt2 from GABBR1__Homo_sapiens__NP_001461
augcuccuccuccuccuccucgccccccucuuccuccgcccccccggcgccggcggcgcccagacccccaacgccaccuccgagggcugccagaucauccacccccccugggagggcggcauccgcuaccgcggccucacccgcgaccaggucaaggccaucaacuuccuccccgucgacuacgagaucgaguacgucugccgcggcgagcgcgaggucgucggccccaagguccgcaagugccucgccaacggcuccuggaccgacauggacacccccucccgcugcguccgcaucugcuccaaguccuaccucacccucgagaacggcaaggucuuccucaccggcggcgaccuccccgcccucgacggcgcccgcgucgacuuccgcugcgaccccgacuuccaccucgucggcuccucccgcuccaucugcucccagggccagugguccacccccaagccccacugccaggucaaccgcaccccccacuccgagcgccgcgccgucuacaucggcgcccucuuccccauguccggcggcuggcccggcggccaggccugccagcccgccgucgagauggcccucgaggacgucaacucccgccgcgacauccuccccgacuacgagcucaagcucauccaccacgacuccaagugcgaccccggccaggccaccaaguaccucuacgagcuccucuacaacgaccccaucaagaucauccucaugcccggcugcuccuccgucuccacccucgucgccgaggccgcccgcauguggaaccucaucguccucuccuacggcuccuccucccccgcccucuccaaccgccagcgcuuccccaccuucuuccgcacccaccccuccgccacccuccacaaccccacccgcgucaagcucuucgagaaguggggcuggaagaagaucgccaccauccagcagaccaccgaggucuucaccuccacccucgacgaccucgaggagcgcgucaaggaggccggcaucgagaucaccuuccgccaguccuucuucuccgaccccgccguccccgucaagaaccucaagcgccaggacgcccgcaucaucgucggccucuucuacgagaccgaggcccgcaaggucuucugcgaggucuacaaggagcgccucuucggcaagaaguacgucugguuccucaucggcugguacgccgacaacugguucaagaucuacgaccccuccaucaacugcaccgucgacgagaugaccgaggccgucgagggccacaucaccaccgagaucgucaugcucaaccccgccaacacccgcuccaucuccaacaugaccucccaggaguucgucgagaagcucaccaagcgccucaagcgccaccccgaggagaccggcggcuuccaggaggccccccucgccuacgacgccaucugggcccucgcccucgcccucaacaagaccuccggcggcggcggccgcuccggcguccgccucgaggacuucaacuacaacaaccagaccaucaccgaccagaucuaccgcgccaugaacuccuccuccuucgagggcgucuccggccacgucgucuucgacgccuccggcucccgcauggccuggacccucaucgagcagcuccagggcggcuccuacaagaagaucggcuacuacgacuccaccaaggacgaccucuccugguccaagaccgacaaguggaucggcggcuccccccccgccgaccagacccucgucaucaagaccuuccgcuuccucucccagaagcucuucaucuccgucuccguccucuccucccucggcaucguccucgccgucgucugccucuccuucaacaucuacaacucccacguccgcuacauccagaacucccagcccaaccucaacaaccucaccgccgucggcugcucccucgcccucgccgccgucuucccccucggccucgacggcuaccacaucggccgcaaccaguuccccuucgucugccaggcccgccucuggcuccucggccucggcuucucccucggcuacggcuccauguucaccaagaucugguggguccacaccgucuucaccaagaaggaggagaagaaggaguggcgcaagacccucgagcccuggaagcucuacgccaccgucggccuccucgucggcauggacguccucacccucgccaucuggcagaucgucgacccccuccaccgcaccaucgagaccuucgccaaggaggagcccaaggaggacaucgacgucuccauccucccccagcucgagcacugcuccucccgcaagaugaacaccuggcucggcaucuucuacggcuacaagggccuccuccuccuccucggcaucuuccucgccuacgagaccaaguccgucuccaccgagaagaucaacgaccaccgcgccgucggcauggccaucuacaacgucgccguccucugccucaucaccgcccccgucaccaugauccucuccucccagcaggacgccgccuucgccuucgccucccucgccaucgucuucuccuccuacaucacccucgucguccucuucguccccaagaugcgccgccucaucacccgcggcgaguggcaguccgaggcccaggacaccaugaagaccggcuccuccaccaacaacaacgaggaggagaagucccgccuccucgagaaggagaaccgcgagcucgagaagaucaucgccgagaaggaggagcgcgucuccgagcuccgccaccagcuccagucccgccagcagcuccgcucccgccgccacccccccaccccccccgagcccuccggcggccucccccgcggcccccccgagccccccgaccgccucuccugcgacggcucccgcguccaccuccucuacaaguga

SEQ ID NO: 43447 - RNA, 2826 nt, Artificial Sequence
  derived and/or modified sequence opt2 from GABBR2__Homo_sapiens__NP_005449
auggccuccccccgcuccuccggccagcccggccccccccccccccccccccccccccccgcccgccuccuccuccuccuccuccucccccuccuccucccccucgcccccggcgccuggggcugggcccgcggcgccccccgccccccccccuccucccccccccucuccaucaugggccucaugccccucaccaaggaggucgccaagggcuccaucggccgcggcguccuccccgccgucgagcucgccaucgagcagauccgcaacgagucccuccuccgccccuacuuccucgaccuccgccucuacgacaccgagugcgacaacgccaagggccucaaggccuucuacgacgccaucaaguacggccccaaccaccucauggucuucggcggcgucugccccuccgucaccuccaucaucgccgagucccuccagggcuggaaccucguccagcucuccuucgccgccaccacccccguccucgccgacaagaagaaguaccccuacuucuuccgcaccguccccuccgacaacgccgucaaccccgccauccucaagcuccucaagcacuaccaguggaagcgcgucggcacccucacccaggacguccagcgcuucuccgagguccgcaacgaccucaccggcguccucuacggcgaggacaucgagaucuccgacaccgaguccuucuccaacgaccccugcaccuccgucaagaagcucaagggcaacgacguccgcaucauccucggccaguucgaccagaacauggccgccaaggucuucugcugcgccuacgaggagaacauguacggcuccaaguaccaguggaucauccccggcugguacgagcccuccuggugggagcagguccacaccgaggccaacuccucccgcugccuccgcaagaaccuccucgccgccauggagggcuacaucggcgucgacuucgagccccucuccuccaagcagaucaagaccaucuccggcaagaccccccagcaguacgagcgcgaguacaacaacaagcgcuccggcgucggccccuccaaguuccacggcuacgccuacgacggcaucugggucaucgccaagacccuccagcgcgccauggagacccuccacgccuccucccgccaccagcgcauccaggacuucaacuacaccgaccacacccucggccgcaucauccucaacgccaugaacgagaccaacuucuucggcgucaccggccaggucgucuuccgcaacggcgagcgcaugggcaccaucaaguucacccaguuccaggacucccgcgaggucaaggucggcgaguacaacgccgucgccgacacccucgagaucaucaacgacaccauccgcuuccagggcuccgagccccccaaggacaagaccaucauccucgagcagcuccgcaagaucucccucccccucuacuccauccucuccgcccucaccauccucggcaugaucauggccuccgccuuccucuucuucaacaucaagaaccgcaaccagaagcucaucaagauguccucccccuacaugaacaaccucaucauccucggcggcaugcucuccuacgccuccaucuuccucuucggccucgacggcuccuucgucuccgagaagaccuucgagacccucugcaccguccgcaccuggauccucaccgucggcuacaccaccgccuucggcgccauguucgccaagaccuggcgcguccacgccaucuucaagaacgucaagaugaagaagaagaucaucaaggaccagaagcuccucgucaucgucggcggcaugcuccucaucgaccucugcauccucaucugcuggcaggccgucgacccccuccgccgcaccgucgagaaguacuccauggagcccgaccccgccggccgcgacaucuccauccgcccccuccucgagcacugcgagaacacccacaugaccaucuggcucggcaucgucuacgccuacaagggccuccucaugcucuucggcugcuuccucgccugggagacccgcaacgucuccauccccgcccucaacgacuccaaguacaucggcauguccgucuacaacgucggcaucaugugcaucaucggcgccgccgucuccuuccucacccgcgaccagcccaacguccaguucugcaucgucgcccucgucaucaucuucugcuccaccaucacccucugccucgucuucguccccaagcucaucacccuccgcaccaaccccgacgccgccacccagaaccgccgcuuccaguucacccagaaccagaagaaggaggacuccaagaccuccaccuccgucaccuccgucaaccaggccuccaccucccgccucgagggccuccaguccgagaaccaccgccuccgcaugaagaucaccgagcucgacaaggaccucgaggaggucaccaugcagcuccaggacacccccgagaagaccaccuacaucaagcagaaccacuaccaggagcucaacgacauccucaaccucggcaacuucaccgaguccaccgacggcggcaaggccauccucaagaaccaccucgaccagaacccccagcuccaguggaacaccaccgagcccucccgcaccugcaaggaccccaucgaggacaucaacucccccgagcacauccagcgccgccucucccuccagcuccccauccuccaccacgccuaccuccccuccaucggcggcgucgacgccuccugcgucucccccugcgucucccccaccgccuccccccgccaccgccacgucccccccuccuuccgcgucauggucuccggccucuga

SEQ ID NO: 43448 - RNA, 1365 nt, Artificial Sequence
  derived and/or modified sequence opt2 from GABPA__Homo_sapiens__NP_002031
augaccaagcgcgaggccgaggagcucaucgagaucgagaucgacggcaccgagaaggccgagugcaccgaggaguccaucgucgagcagaccuacgcccccgccgagugcgucucccaggccaucgacaucaacgagcccaucggcaaccucaagaagcuccucgagccccgccuccagugcucccucgacgcccacgagaucugccuccaggacauccagcucgaccccgagcgcucccucuucgaccagggcgucaagaccgacggcaccguccagcucuccguccaggucaucuccuaccagggcaucgagcccaagcucaacauccucgagaucgucaagcccgccgacaccgucgaggucgucaucgaccccgacgcccaccacgccgaguccgaggcccaccucgucgaggaggcccaggucaucacccucgacggcaccaagcacaucaccaccaucuccgacgagaccuccgagcaggucacccgcugggccgccgcccucgagggcuaccgcaaggagcaggagcgccucggcauccccuacgaccccauccagugguccaccgaccagguccuccacugggucgucugggucaugaaggaguucuccaugaccgacaucgaccucaccacccucaacaucuccggccgcgagcucugcucccucaaccaggaggacuucuuccagcgcgucccccgcggcgagauccucuggucccaccucgagcuccuccgcaaguacguccucgccucccaggagcagcagaugaacgagaucgucaccaucgaccagcccguccagaucauccccgccuccguccaguccgccacccccaccaccaucaaggucaucaacuccuccgccaaggccgccaagguccagcgcgccccccgcaucuccggcgaggaccgcuccucccccggcaaccgcaccggcaacaacggccagauccagcucuggcaguuccuccucgagcuccucaccgacaaggacgcccgcgacugcaucuccugggucggcgacgagggcgaguucaagcucaaccagcccgagcucgucgcccagaaguggggccagcgcaagaacaagcccaccaugaacuacgagaagcucucccgcgcccuccgcuacuacuacgacggcgacaugaucugcaagguccagggcaagcgcuucgucuacaaguucgucugcgaccucaagacccucaucggcuacuccgccgccgagcucaaccgccucgucaccgagugcgagcagaagaagcucgccaagaugcagcuccacggcaucgcccagcccgucaccgccgucgcccucgccaccgccucccuccagaccgagaaggacaacuga

SEQ ID NO: 43449 - RNA, 1083 nt, Artificial Sequence
  derived and/or modified sequence opt2 from GABPB1__Homo_sapiens__NP_002032
augucccucgucgaccucggcaagaagcuccucgaggccgcccgcgccggccaggacgacgagguccgcauccucauggccaacggcgcccccuucaccaccgacuggcucggcaccuccccccuccaccucgccgcccaguacggccacuacuccaccaccgagguccuccuccgcgccggcgucucccgcgacgcccgcaccaaggucgaccgcaccccccuccacauggccgccuccgagggccacgccuccaucgucgagguccuccucaagcacggcgccgacgucaacgccaaggacaugcucaagaugaccgcccuccacugggccaccgagcacaaccaccaggaggucgucgagcuccucaucaaguacggcgccgacguccacacccaguccaaguucugcaagaccgccuucgacaucuccaucgacaacggcaacgaggaccucgccgagauccuccagaucgccaugcagaaccagaucaacaccaaccccgagucccccgacaccgucaccauccacgccgccaccccccaguucaucaucggccccggcggcgucgucaaccucaccggccucgucuccuccgagaacuccuccaaggccaccgacgagaccggcgucuccgccguccaguucggcaacuccuccaccuccguccucgccacccucgccgcccucgccgaggccuccgccccccucuccaacuccuccgagacccccgucgucgccaccgaggaggucgucaccgccgaguccgucgacggcgccauccagcaggucgucuccuccggcggccagcaggucaucaccaucgucaccgacggcauccagcucggcaaccuccacuccauccccaccuccggcaucggccagcccaucaucgucaccaugcccgacggccagcagguccucaccguccccgccaccgacaucgccgaggagaccgucaucuccgaggagccccccgccaagcgccagugcaucgagaucaucgagaaccgcgucgaguccgccgagaucgagguccgcucccuccuccccggcguccucugccgcucccaccccaaguga

SEQ ID NO: 43450 - RNA, 1371 nt, Artificial Sequence
  derived and/or modified sequence opt2 from GABRA1__Homo_sapiens__NP_001121120
augcgcaagucccccggccucuccgacugccucugggccuggauccuccuccucuccacccucaccggccgcuccuacggccagcccucccuccaggacgagcucaaggacaacaccaccgucuucacccgcauccucgaccgccuccucgacggcuacgacaaccgccuccgccccggccucggcgagcgcgucaccgaggucaagaccgacaucuucgucaccuccuucggccccgucuccgaccacgacauggaguacaccaucgacgucuucuuccgccaguccuggaaggacgagcgccucaaguucaagggccccaugaccguccuccgccucaacaaccucauggccuccaagaucuggacccccgacaccuucuuccacaacggcaagaaguccgucgcccacaacaugaccaugcccaacaagcuccuccgcaucaccgaggacggcacccuccucuacaccaugcgccucaccguccgcgccgagugccccaugcaccucgaggacuuccccauggacgcccacgccugcccccucaaguucggcuccuacgccuacacccgcgccgaggucgucuacgaguggacccgcgagcccgcccgcuccgucgucgucgccgaggacggcucccgccucaaccaguacgaccuccucggccagaccgucgacuccggcaucguccaguccuccaccggcgaguacgucgucaugaccacccacuuccaccucaagcgcaagaucggcuacuucgucauccagaccuaccuccccugcaucaugaccgucauccucucccaggucuccuucuggcucaaccgcgaguccguccccgcccgcaccgucuucggcgucaccaccguccucaccaugaccacccucuccaucuccgcccgcaacucccuccccaaggucgccuacgccaccgccauggacugguucaucgccgucugcuacgccuucgucuucuccgcccucaucgaguucgccaccgucaacuacuucaccaagcgcggcuacgccugggacggcaaguccgucguccccgagaagcccaagaaggucaaggacccccucaucaagaagaacaacaccuacgcccccaccgccaccuccuacacccccaaccucgcccgcggcgaccccggccucgccaccaucgccaaguccgccaccaucgagcccaaggaggucaagcccgagaccaagccccccgagcccaagaagaccuucaacuccgucuccaagaucgaccgccucucccgcaucgccuucccccuccucuucggcaucuucaaccucgucuacugggccaccuaccucaaccgcgagccccagcucaaggcccccaccccccaccaguga

SEQ ID NO: 43451 - RNA, 1356 nt, Artificial Sequence
  derived and/or modified sequence opt2 from GABRA2__Homo_sapiens__NP_000798
augaagaccaagcucaacaucuacaacaugcaguuccuccucuucgucuuccucgucugggaccccgcccgccucguccucgccaacauccaggaggacgaggccaagaacaacaucaccaucuucacccgcauccucgaccgccuccucgacggcuacgacaaccgccuccgccccggccucggcgacuccaucaccgaggucuucaccaacaucuacgucaccuccuucggccccgucuccgacaccgacauggaguacaccaucgacgucuucuuccgccagaaguggaaggacgagcgccucaaguucaagggccccaugaacauccuccgccucaacaaccucauggccuccaagaucuggacccccgacaccuucuuccacaacggcaagaaguccgucgcccacaacaugaccaugcccaacaagcuccuccgcauccaggacgacggcacccuccucuacaccaugcgccucaccguccaggccgagugccccaugcaccucgaggacuuccccauggacgcccacuccugcccccucaaguucggcuccuacgccuacaccaccuccgaggucaccuacaucuggaccuacaacgccuccgacuccguccaggucgcccccgacggcucccgccucaaccaguacgaccuccucggccaguccaucggcaaggagaccaucaaguccuccaccggcgaguacaccgucaugaccgcccacuuccaccucaagcgcaagaucggcuacuucgucauccagaccuaccuccccugcaucaugaccgucauccucucccaggucuccuucuggcucaaccgcgaguccguccccgcccgcaccgucuucggcgucaccaccguccucaccaugaccacccucuccaucuccgcccgcaacucccuccccaaggucgccuacgccaccgccauggacugguucaucgccgucugcuacgccuucgucuucuccgcccucaucgaguucgccaccgucaacuacuucaccaagcgcggcugggccugggacggcaaguccgucgucaacgacaagaagaaggagaaggccuccgucaugauccagaacaacgccuacgccgucgccgucgccaacuacgcccccaaccucuccaaggaccccguccucuccaccaucuccaaguccgccaccacccccgagcccaacaagaagcccgagaacaagcccgccgaggccaagaagaccuucaacuccgucuccaagaucgaccgcaugucccgcaucgucuuccccguccucuucggcaccuucaaccucgucuacugggccaccuaccucaaccgcgagcccguccucggcgucucccccuga

SEQ ID NO: 43452 - RNA, 1479 nt, Artificial Sequence
  derived and/or modified sequence opt2 from GABRA3__Homo_sapiens__NP_000799
augaucaucacccagaccucccacugcuacaugaccucccucggcauccucuuccucaucaacauccuccccggcaccaccggccagggcgagucccgccgccaggagcccggcgacuucgucaagcaggacaucggcggccucucccccaagcacgcccccgacauccccgacgacuccaccgacaacaucaccaucuucacccgcauccucgaccgccuccucgacggcuacgacaaccgccuccgccccggccucggcgacgccgucaccgaggucaagaccgacaucuacgucaccuccuucggccccgucuccgacaccgacauggaguacaccaucgacgucuucuuccgccagaccuggcacgacgagcgccucaaguucgacggccccaugaagauccucccccucaacaaccuccucgccuccaagaucuggacccccgacaccuucuuccacaacggcaagaaguccgucgcccacaacaugaccacccccaacaagcuccuccgccucgucgacaacggcacccuccucuacaccaugcgccucaccauccacgccgagugccccaugcaccucgaggacuuccccauggacguccacgccugcccccucaaguucggcuccuacgccuacaccaccgccgaggucgucuacuccuggacccucggcaagaacaaguccgucgaggucgcccaggacggcucccgccucaaccaguacgaccuccucggccacgucgucggcaccgagaucauccgcuccuccaccggcgaguacgucgucaugaccacccacuuccaccucaagcgcaagaucggcuacuucgucauccagaccuaccuccccugcaucaugaccgucauccucucccaggucuccuucuggcucaaccgcgaguccguccccgcccgcaccgucuucggcgucaccaccguccucaccaugaccacccucuccaucuccgcccgcaacucccuccccaaggucgccuacgccaccgccauggacugguucaucgccgucugcuacgccuucgucuucuccgcccucaucgaguucgccaccgucaacuacuucaccaagcgcuccugggccugggagggcaagaagguccccgaggcccucgagaugaagaagaagacccccgccgcccccgccaagaagaccuccaccaccuucaacaucgucggcaccaccuaccccaucaaccucgccaaggacaccgaguucuccaccaucuccaagggcgccgcccccuccgccuccuccacccccaccaucaucgccucccccaaggccaccuacguccaggacucccccaccgagaccaagaccuacaacuccgucuccaaggucgacaagaucucccgcaucaucuuccccguccucuucgccaucuucaaccucgucuacugggccaccuacgucaaccgcgaguccgccaucaagggcaugauccgcaagcaguga

SEQ ID NO: 43453 - RNA, 1665 nt, Artificial Sequence
  derived and/or modified sequence opt2 from GABRA4__Homo_sapiens__NP_000800
auggucuccgccaagaagguccccgccaucgcccucuccgccggcgucuccuucgcccuccuccgcuuccucugccucgccgucugccucaacgagucccccggccagaaccagaaggaggagaagcucugcaccgagaacuucacccgcauccucgacucccuccucgacggcuacgacaaccgccuccgccccggcuucggcggccccgucaccgaggucaagaccgacaucuacgucaccuccuucggccccgucuccgacgucgagauggaguacaccauggacgucuucuuccgccagaccuggaucgacaagcgccucaaguacgacggccccaucgagauccuccgccucaacaacaugauggucaccaaggucuggacccccgacaccuucuuccgcaacggcaagaaguccgucucccacaacaugaccgcccccaacaagcucuuccgcaucaugcgcaacggcaccauccucuacaccaugcgccucaccaucuccgccgagugccccaugcgccucgucgacuuccccauggacggccacgccugcccccucaaguucggcuccuacgccuaccccaaguccgagaugaucuacaccuggaccaagggccccgagaaguccgucgagguccccaaggaguccuccucccucguccaguacgaccucaucggccagaccgucuccuccgagaccaucaaguccaucaccggcgaguacaucgucaugaccgucuacuuccaccuccgccgcaagaugggcuacuucaugauccagaccuacauccccugcaucaugaccgucauccucucccaggucuccuucuggaucaacaaggaguccguccccgcccgcaccgucuucggcaucaccaccguccucaccaugaccacccucuccaucuccgcccgccacucccuccccaaggucuccuacgccaccgccauggacugguucaucgccgucugcuucgccuucgucuucuccgcccucaucgaguucgccgccgucaacuacuucaccaacauccagauggagaaggccaagcgcaagaccuccaagcccccccaggagguccccgccgcccccguccagcgcgagaagcaccccgaggccccccuccagaacaccaacgccaaccucaacaugcgcaagcgcaccaacgcccucguccacuccgaguccgacgucggcaaccgcaccgaggucggcaaccacuccuccaaguccuccaccgucguccaggaguccuccaagggcaccccccgcuccuaccucgccuccucccccaaccccuucucccgcgccaacgccgccgagaccaucuccgccgcccgcgcccuccccuccgccucccccaccuccauccgcaccggcuacaugccccgcaaggccuccgucggcuccgccuccacccgccacgucuucggcucccgccuccagcgcaucaagaccaccgucaacaccaucggcgccaccggcaagcucuccgccacccccccccccuccgcccccccccccuccggcuccggcaccuccaagaucgacaaguacgcccgcauccucuuccccgucaccuucggcgccuucaacauggucuacugggucgucuaccucuccaaggacaccauggagaaguccgagucccucauguga

SEQ ID NO: 43454 - RNA, 1389 nt, Artificial Sequence
  derived and/or modified sequence opt2 from GABRA5__Homo_sapiens__XP_005268315
auggacaacggcauguucuccggcuucaucaugaucaagaaccuccuccucuucugcaucuccaugaaccucuccucccacuucggcuucucccagaugcccaccuccuccgucaaggacgagaccaacgacaacaucaccaucuucacccgcauccucgacggccuccucgacggcuacgacaaccgccuccgccccggccucggcgagcgcaucacccagguccgcaccgacaucuacgucaccuccuucggccccgucuccgacaccgagauggaguacaccaucgacgucuucuuccgccaguccuggaaggacgagcgccuccgcuucaagggccccaugcagcgccucccccucaacaaccuccucgccuccaagaucuggacccccgacaccuucuuccacaacggcaagaaguccaucgcccacaacaugaccacccccaacaagcuccuccgccucgaggacgacggcacccuccucuacaccaugcgccucaccaucuccgccgagugccccaugcagcucgaggacuuccccauggacgcccacgccugcccccucaaguucggcuccuacgccuaccccaacuccgaggucgucuacgucuggaccaacggcuccaccaaguccgucgucgucgccgaggacggcucccgccucaaccaguaccaccucaugggccagaccgucggcaccgagaacaucuccaccuccaccggcgaguacaccaucaugaccgcccacuuccaccucaagcgcaagaucggcuacuucgucauccagaccuaccuccccugcaucaugaccgucauccucucccaggucuccuucuggcucaaccgcgaguccguccccgcccgcaccgucuucggcgucaccaccguccucaccaugaccacccucuccaucuccgcccgcaacucccuccccaaggucgccuacgccaccgccauggacugguucaucgccgucugcuacgccuucgucuucuccgcccucaucgaguucgccaccgucaacuacuucaccaagcgcggcugggccugggacggcaagaaggcccucgaggccgccaagaucaagaagaagcgcgaggucauccucaacaaguccaccaacgccuucaccaccggcaagaugucccacccccccaacauccccaaggagcagacccccgccggcaccuccaacaccaccuccgucuccgucaagcccuccgaggagaagaccuccgaguccaagaagaccuacaacuccaucuccaagaucgacaagaugucccgcaucgucuuccccguccucuucggcaccuucaaccucgucuacugggccaccuaccucaaccgcgagcccgucaucaagggcgccgccucccccaaguga

SEQ ID NO: 43455 - RNA, 1362 nt, Artificial Sequence
  derived and/or modified sequence opt2 from GABRA6__Homo_sapiens__NP_000802
auggccuccucccuccccuggcucugcaucauccucuggcucgagaacgcccucggcaagcucgaggucgagggcaacuucuacuccgagaacgucucccgcauccucgacaaccuccucgagggcuacgacaaccgccuccgccccggcuucggcggcgccgucaccgaggucaagaccgacaucuacgucaccuccuucggccccgucuccgacgucgagauggaguacaccauggacgucuucuuccgccagaccuggaccgacgagcgccucaaguucggcggccccaccgagauccucucccucaacaaccucauggucuccaagaucuggacccccgacaccuucuuccgcaacggcaagaaguccaucgcccacaacaugaccacccccaacaagcucuuccgcaucaugcagaacggcaccauccucuacaccaugcgccucaccaucaacgccgacugccccaugcgccucgucaacuuccccauggacggccacgccugcccccucaaguucggcuccuacgccuaccccaaguccgagaucaucuacaccuggaagaagggcccccucuacuccgucgagguccccgaggaguccuccucccuccuccaguacgaccucaucggccagaccgucuccuccgagaccaucaaguccaacaccggcgaguacgucaucaugaccgucuacuuccaccuccagcgcaagaugggcuacuucaugauccagaucuacacccccugcaucaugaccgucauccucucccaggucuccuucuggaucaacaaggaguccguccccgcccgcaccgucuucggcaucaccaccguccucaccaugaccacccucuccaucuccgcccgccacucccuccccaaggucuccuacgccaccgccauggacugguucaucgccgucugcuucgccuucgucuucuccgcccucaucgaguucgccgccgucaacuacuucaccaaccuccagacccagaaggccaagcgcaaggcccaguucgccgccccccccaccgucaccaucuccaaggccaccgagccccucgaggccgagaucguccuccaccccgacuccaaguaccaccucaagaagcgcaucaccucccucucccuccccaucgucuccuccuccgaggccaacaagguccucacccgcgcccccauccuccaguccacccccgucaccccccccccccucucccccgccuucggcggcaccuccaagaucgaccaguacucccgcauccucuuccccgucgccuucgccggcuucaaccucgucuacugggucgucuaccucuccaaggacaccauggaggucuccuccuccgucgaguga

SEQ ID NO: 43456 - RNA, 1425 nt, Artificial Sequence
  derived and/or modified sequence opt2 from GABRB1__Homo_sapiens__NP_000803
auguggaccguccagaaccgcgagucccucggccuccucuccuuccccgucaugaucaccauggucugcugcgcccacuccaccaacgagcccuccaacauguccuacgucaaggagaccgucgaccgccuccucaagggcuacgacauccgccuccgccccgacuucggcggcccccccgucgacgucggcaugcgcaucgacgucgccuccaucgacauggucuccgaggucaacauggacuacacccucaccauguacuuccagcaguccuggaaggacaagcgccucuccuacuccggcaucccccucaaccucacccucgacaaccgcgucgccgaccagcucuggguccccgacaccuacuuccucaacgacaagaaguccuucguccacggcgucaccgucaagaaccgcaugauccgccuccaccccgacggcaccguccucuacggccuccgcaucaccaccaccgccgccugcaugauggaccuccgccgcuacccccucgacgagcagaacugcacccucgagaucgaguccuacggcuacaccaccgacgacaucgaguucuacuggaacggcggcgagggcgccgucaccggcgucaacaagaucgagcucccccaguucuccaucgucgacuacaagauggucuccaagaaggucgaguucaccaccggcgccuacccccgccucucccucuccuuccgccucaagcgcaacaucggcuacuucauccuccagaccuacaugcccuccacccucaucaccauccucuccugggucuccuucuggaucaacuacgacgccuccgccgcccgcgucgcccucggcaucaccaccguccucaccaugaccaccaucuccacccaccuccgcgagacccuccccaagauccccuacgucaaggccaucgacaucuaccucaugggcugcuucgucuucgucuuccucgcccuccucgaguacgccuucgucaacuacaucuucuucggcaagggcccccagaagaagggcgccuccaagcaggaccaguccgccaacgagaagaacaagcucgagaugaacaagguccaggucgacgcccacggcaacauccuccucuccacccucgagauccgcaacgagaccuccggcuccgagguccucaccuccgucuccgaccccaaggccaccauguacuccuacgacuccgccuccauccaguaccgcaagccccucuccucccgcgaggccuacggccgcgcccucgaccgccacggcguccccuccaagggccgcauccgccgccgcgccucccagcucaaggucaagauccccgaccucaccgacgucaacuccaucgacaaguggucccgcauguucuuccccaucaccuucucccucuucaacgucgucuacuggcucuacuacguccacuga

SEQ ID NO: 43457 - RNA, 1425 nt, Artificial Sequence
  derived and/or modified sequence opt2 from GABRB2__Homo_sapiens__NP_000804
auguggcgcguccgcaagcgcggcuacuucggcaucugguccuucccccucaucaucgccgccgucugcgcccaguccgucaacgaccccuccaacaugucccucgucaaggagaccgucgaccgccuccucaagggcuacgacauccgccuccgccccgacuucggcggcccccccgucgccgucggcaugaacaucgacaucgccuccaucgacauggucuccgaggucaacauggacuacacccucaccauguacuuccagcaggccuggcgcgacaagcgccucuccuacaacgucaucccccucaaccucacccucgacaaccgcgucgccgaccagcucuggguccccgacaccuacuuccucaacgacaagaaguccuucguccacggcgucaccgucaagaaccgcaugauccgccuccaccccgacggcaccguccucuacggccuccgcaucaccaccaccgccgccugcaugauggaccuccgccgcuacccccucgacgagcagaacugcacccucgagaucgaguccuacggcuacaccaccgacgacaucgaguucuacuggcgcggcgacgacaacgccgucaccggcgucaccaagaucgagcucccccaguucuccaucgucgacuacaagcucaucaccaagaaggucgucuucuccaccggcuccuacccccgccucucccucuccuucaagcucaagcgcaacaucggcuacuucauccuccagaccuacaugcccuccauccucaucaccauccucuccugggucuccuucuggaucaacuacgacgccuccgccgcccgcgucgcccucggcaucaccaccguccucaccaugaccaccaucaacacccaccuccgcgagacccuccccaagauccccuacgucaaggccaucgacauguaccucaugggcugcuucgucuucgucuucauggcccuccucgaguacgcccucgucaacuacaucuucuucggccgcggcccccagcgccagaagaaggccgccgagaaggccgccuccgccaacaacgagaagaugcgccucgacgucaacaagauggacccccacgagaacauccuccucuccacccucgagaucaagaacgagauggccaccuccgaggccgucaugggccucggcgacccccgcuccaccaugcucgccuacgacgccuccuccauccaguaccgcaaggccggccucccccgccacuccuucggccgcaacgcccucgagcgccacgucgcccagaagaagucccgccuccgccgccgcgccucccagcucaagaucaccauccccgaccucaccgacgucaacgccaucgaccgcuggucccgcaucuucuuccccgucgucuucuccuucuucaacaucgucuacuggcucuacuacgucaacuga

SEQ ID NO: 43458 - RNA, 1422 nt, Artificial Sequence
  derived and/or modified sequence opt2 from GABRB3__Homo_sapiens__NP_000805
auguggggccucgccggcggccgccucuucggcaucuucuccgcccccguccucgucgccgucgucugcugcgcccaguccgucaacgaccccggcaacauguccuucgucaaggagaccgucgacaagcuccucaagggcuacgacauccgccuccgccccgacuucggcggcccccccgucugcgucggcaugaacaucgacaucgccuccaucgacauggucuccgaggucaacauggacuacacccucaccauguacuuccagcaguacuggcgcgacaagcgccucgccuacuccggcaucccccucaaccucacccucgacaaccgcgucgccgaccagcucuggguccccgacaccuacuuccucaacgacaagaaguccuucguccacggcgucaccgucaagaaccgcaugauccgccuccaccccgacggcaccguccucuacggccuccgcaucaccaccaccgccgccugcaugauggaccuccgccgcuacccccucgacgagcagaacugcacccucgagaucgaguccuacggcuacaccaccgacgacaucgaguucuacuggcgcggcggcgacaaggccgucaccggcgucgagcgcaucgagcucccccaguucuccaucgucgagcaccgccucgucucccgcaacgucgucuucgccaccggcgccuacccccgccucucccucuccuuccgccucaagcgcaacaucggcuacuucauccuccagaccuacaugcccuccauccucaucaccauccucuccugggucuccuucuggaucaacuacgacgccuccgccgcccgcgucgcccucggcaucaccaccguccucaccaugaccaccaucaacacccaccuccgcgagacccuccccaagauccccuacgucaaggccaucgacauguaccucaugggcugcuucgucuucgucuuccucgcccuccucgaguacgccuucgucaacuacaucuucuucggccgcggcccccagcgccagaagaagcucgccgagaagaccgccaaggccaagaacgaccgcuccaaguccgaguccaaccgcgucgacgcccacggcaacauccuccucaccucccucgagguccacaacgagaugaacgaggucuccggcggcaucggcgacacccgcaacuccgccaucuccuucgacaacuccggcauccaguaccgcaagcaguccaugccccgcgagggccacggccgcuuccucggcgaccgcucccucccccacaagaagacccaccuccgccgccgcuccucccagcucaagaucaagauccccgaccucaccgacgucaacgccaucgaccgcuggucccgcaucgucuuccccuucaccuucucccucuucaaccucgucuacuggcucuacuacgucaacuga

SEQ ID NO: 43459 - RNA, 1521 nt, Artificial Sequence
  derived and/or modified sequence opt2 from GABRE__Homo_sapiens__NP_004952
augcucuccaagguccuccccguccuccucggcauccuccucauccuccagucccgcgucgagggcccccagaccgaguccaagaacgaggccuccucccgcgacgucgucuacggcccccagccccagccccucgagaaccagcuccucuccgaggagaccaaguccaccgagaccgagaccggcucccgcgucggcaagcuccccgaggccucccgcauccucaacaccauccucuccaacuacgaccacaagcuccgccccggcaucggcgagaagcccaccgucgucaccgucgagaucuccgucaacucccucggcccccucuccauccucgacauggaguacaccaucgacaucaucuucucccagaccugguacgacgagcgccucugcuacaacgacaccuucgagucccucguccucaacggcaacgucgucucccagcucuggauccccgacaccuucuuccgcaacuccaagcgcacccacgagcacgagaucaccaugcccaaccagaugguccgcaucuacaaggacggcaagguccucuacaccauccgcaugaccaucgacgccggcugcucccuccacaugcuccgcuuccccauggacucccacuccugcccccucuccuucuccuccuucuccuaccccgagaacgagaugaucuacaagugggagaacuucaagcucgagaucaacgagaagaacuccuggaagcucuuccaguucgacuucaccggcgucuccaacaagaccgagaucaucaccacccccgucggcgacuucauggucaugaccaucuucuucaacgucucccgccgcuucggcuacgucgccuuccagaacuacguccccuccuccgucaccaccaugcucuccugggucuccuucuggaucaagaccgaguccgcccccgcccgcaccucccucggcaucaccuccguccucaccaugaccacccucggcaccuucucccgcaagaacuucccccgcgucuccuacaucaccgcccucgacuucuacaucgccaucugcuucgucuucugcuucugcgcccuccucgaguucgccguccucaacuuccucaucuacaaccagaccaaggcccacgccucccccaagcuccgccacccccgcaucaacucccgcgcccacgcccgcacccgcgcccgcucccgcgccugcgcccgccagcaccaggaggccuucgucugccagaucgucaccaccgagggcuccgacggcgaggagcgccccuccugcuccgcccagcagccccccucccccggcucccccgagggcccccgcucccucugcuccaagcucgccugcugcgaguggugcaagcgcuucaagaaguacuucugcaugguccccgacugcgagggcuccaccuggcagcagggccgccucugcauccacgucuaccgccucgacaacuacucccgcgucgucuuccccgucaccuucuucuucuucaacguccucuacuggcucgucugccucaaccucuga

SEQ ID NO: 43460 - RNA, 1398 nt, Artificial Sequence
  derived and/or modified sequence opt2 from GABRG1__Homo_sapiens__NP_775807
augggcccccucaaggccuuccucuucucccccuuccuccuccgcucccagucccgcggcguccgccucgucuuccuccuccucacccuccaccucggcaacugcgucgacaaggccgacgacgaggacgacgaggaccucaccgucaacaagaccuggguccucgcccccaagauccacgagggcgacaucacccagauccucaacucccuccuccagggcuacgacaacaagcuccgccccgacaucggcguccgccccaccgucaucgagaccgacgucuacgucaacuccaucggccccgucgaccccaucaacauggaguacaccaucgacaucaucuucgcccagaccugguucgacucccgccucaaguucaacuccaccaugaagguccucaugcucaacuccaacauggucggcaagaucuggauccccgacaccuucuuccgcaacucccgcaaguccgacgcccacuggaucaccacccccaaccgccuccuccgcaucuggaacgacggccgcguccucuacacccuccgccucaccaucaacgccgagugcuaccuccagcuccacaacuuccccauggacgagcacuccugcccccucgaguucuccuccuacggcuaccccaagaacgagaucgaguacaaguggaagaagcccuccgucgaggucgccgaccccaaguacuggcgccucuaccaguucgccuucgucggccuccgcaacuccaccgagaucacccacaccaucuccggcgacuacgucaucaugaccaucuucuucgaccucucccgccgcaugggcuacuucaccauccagaccuacauccccugcauccucaccgucguccucuccugggucuccuucuggaucaacaaggacgccguccccgcccgcaccucccucggcaucaccaccguccucaccaugaccacccucuccaccaucgcccgcaagucccuccccaaggucuccuacgucaccgccauggaccucuucgucuccgucugcuucaucuucgucuucgccgcccucauggaguacggcacccuccacuacuucaccuccaaccagaagggcaagaccgccaccaaggaccgcaagcucaagaacaaggccuccaugacccccggccuccaccccggcuccacccucauccccaugaacaacaucuccgucccccaggaggacgacuacggcuaccagugccucgagggcaaggacugcgccuccuucuucugcugcuucgaggacugccgcaccggcuccuggcgcgagggccgcauccacauccgcaucgccaagaucgacuccuacucccgcaucuucuuccccaccgccuucgcccucuucaaccucgucuacugggucggcuaccucuaccucuga

SEQ ID NO: 43461 - RNA, 1404 nt, Artificial Sequence
  derived and/or modified sequence opt2 from GABRG2__Homo_sapiens__NP_000807
auguccucccccaacaucugguccaccggcuccuccgucuacuccacccccgucuucucccagaagaugaccgucuggauccuccuccuccucucccucuaccccggcuucaccucccagaaguccgacgacgacuacgaggacuacgccuccaacaagaccuggguccucacccccaagguccccgagggcgacgucaccgucauccucaacaaccuccucgagggcuacgacaacaagcuccgccccgacaucggcgucaagcccacccucauccacaccgacauguacgucaacuccaucggccccgucaacgccaucaacauggaguacaccaucgacaucuucuucgcccagaccugguacgaccgccgccucaaguucaacuccaccaucaagguccuccgccucaacuccaacauggucggcaagaucuggauccccgacaccuucuuccgcaacuccaagaaggccgacgcccacuggaucaccacccccaaccgcaugcuccgcaucuggaacgacggccgcguccucuacacccuccgccucaccaucgacgccgagugccagcuccagcuccacaacuuccccauggacgagcacuccugcccccucgaguucuccuccuacggcuacccccgcgaggagaucgucuaccaguggaagcgcuccuccgucgaggucggcgacacccgcuccuggcgccucuaccaguucuccuucgucggccuccgcaacaccaccgaggucgucaagaccaccuccggcgacuacgucgucauguccgucuacuucgaccucucccgccgcaugggcuacuucaccauccagaccuacauccccugcacccucaucgucguccucuccugggucuccuucuggaucaacaaggacgccguccccgcccgcaccucccucggcaucaccaccguccucaccaugaccacccucuccaccaucgcccgcaagucccuccccaaggucuccuacgucaccgccauggaccucuucgucuccgucugcuucaucuucgucuucuccgcccucgucgaguacggcacccuccacuacuucgucuccaaccgcaagcccuccaaggacaaggacaagaagaagaagaaccccgcccccaccaucgacauccgcccccgcuccgccaccauccagaugaacaacgccacccaccuccaggagcgcgacgaggaguacggcuacgagugccucgacggcaaggacugcgccuccuucuucugcugcuucgaggacugccgcaccggcgccuggcgccacggccgcauccacauccgcaucgccaagauggacuccuacgcccgcaucuucuuccccaccgccuucugccucuucaaccucgucuacugggucuccuaccucuaccucuga

SEQ ID NO: 43462 - RNA, 762 nt, Artificial Sequence
  derived and/or modified sequence opt2 from GABRG3__Homo_sapiens__NP_001257802
auggcccccaagcuccuccuccuccucugccucuucuccggccuccacgcccgcucccgcaaggucgaggaggacgaguacgaggacuccuccuccaaccagaaguggguccucgcccccaagucccaggacaccgacgucacccucauccucaacaagcuccuccgcgaguacgacaagaagcuccgccccgacaucggcaucaagcccaccgucaucgacgucgacaucuacgucaacuccaucggccccgucuccuccaucaacauggaguaccagaucgacaucuucuucgcccagaccuggaccgacucccgccuccgcuucaacuccaccaugaagauccucacccucaacuccaacauggucggccucaucuggauccccgacaccaucuuccgcaacuccaagaccgccgaggcccacuggaucaccacccccaaccagcuccuccgcaucuggaacgacggcaagauccucuacacccuccgccucaccaucaacgccgagugccagcuccagcuccacaacuuccccauggacgagcacuccugcccccucaucuucuccuccuacggcuaccccaaggaggagaugaucuaccgcuggcgcaagaacuccgucgaggccgccgaccagaaguccuggcgccucuaccaguucgacuucaugggccuccgcaacaccaccgagaucgucaccaccuccgccggccgcaaccuccucaaggaggcccagcucuccaaggcccgcgaggccuga

SEQ ID NO: 43463 - RNA, 1323 nt, Artificial Sequence
  derived and/or modified sequence opt2 from GABRP__Homo_sapiens__XP_011532807
augaacuacucccuccaccucgccuucgucugccucucccucuucaccgagcgcaugugcauccagggcucccaguucaacgucgaggucggccgcuccgacaagcucucccuccccggcuucgagaaccucaccgccggcuacaacaaguuccuccgccccaacuucggcggcgagcccguccagaucgcccucacccucgacaucgccuccaucuccuccaucuccgaguccaacauggacuacaccgccaccaucuaccuccgccagcgcuggauggaccagcgccucgucuucgagggcaacaaguccuucacccucgacgcccgccucgucgaguuccucuggguccccgacaccuacaucgucgaguccaagaaguccuuccuccacgaggucaccgucggcaaccgccucauccgccucuucuccaacggcaccguccucuacgcccuccgcaucaccaccaccgucgccugcaacauggaccucuccaaguaccccauggacacccagaccugcaagcuccagcucgaguccuggggcuacgacggcaacgacgucgaguucaccuggcuccgcggcaacgacuccguccgcggccucgagcaccuccgccucgcccaguacaccaucgagcgcuacuucacccucgucacccgcucccagcaggagaccggcaacuacacccgccucguccuccaguucgagcuccgccgcaacguccucuacuucauccucgagaccuacguccccuccaccuuccucgucguccucuccugggucuccuucuggaucucccucgacuccguccccgcccgcaccugcaucggcgucaccaccguccucuccaugaccacccucaugaucggcucccgcaccucccuccccaacaccaacugcuucaucaaggccaucgacgucuaccucggcaucugcuucuccuucgucuucggcgcccuccucgaguacgccgucgcccacuacuccucccuccagcagauggccgccaaggaccgcggcaccaccaaggaggucgaggaggucuccaucaccaacaucaucaacuccuccaucuccuccuucaagcgcaagaucuccuucgccuccaucgagaucuccuccgacaacgucgacuacuccgaccucaccaugaagaccuccgacaaguucaaguucgucuuccgcgagaagaugggccgcaucgucgacuacuucaccauccagaaccccuccaacgucgaccacuacuccaagcuccucuucccccucaucuucaugcucgccaacgucuucuacugggccuacuacauguacuucuga

SEQ ID NO: 43464 - RNA, 1899 nt, Artificial Sequence
  derived and/or modified sequence opt2 from GABRQ__Homo_sapiens__NP_061028
augggcauccgcggcaugcuccgcgccgccgucauccuccuccucauccgcaccuggcucgccgagggcaacuaccccucccccauccccaaguuccacuucgaguucuccuccgccguccccgaggucguccucaaccucuucaacugcaagaacugcgccaacgaggccgucguccagaagauccucgaccgcguccucucccgcuacgacguccgccuccgccccaacuucggcggcgcccccguccccguccgcaucuccaucuacgucaccuccaucgagcagaucuccgagaugaacauggacuacaccaucaccauguucuuccaccagaccuggaaggacucccgccucgccuacuacgagaccacccucaaccucacccucgacuaccgcaugcacgagaagcucuggguccccgacugcuacuuccucaacuccaaggacgccuucguccacgacgucaccgucgagaaccgcgucuuccagcuccaccccgacggcaccguccgcuacggcauccgccucaccaccaccgccgccugcucccucgaccuccacaaguuccccauggacaagcaggccugcaaccucgucgucgaguccuacggcuacaccgucgaggacaucauccucuucugggacgacaacggcaacgccauccacaugaccgaggagcuccacaucccccaguucaccuuccucggccgcaccaucaccuccaaggaggucuacuucuacaccggcuccuacauccgccucauccucaaguuccagguccagcgcgaggucaacuccuaccucguccaggucuacuggcccaccguccucaccaccaucaccuccuggaucuccuucuggaugaacuacgacuccuccgccgcccgcgucaccaucggccucaccuccaugcucauccucaccaccaucgacucccaccuccgcgacaagcuccccaacaucuccugcaucaaggccaucgacaucuacauccucgucugccucuucuucgucuuccucucccuccucgaguacgucuacaucaacuaccucuucuacucccgcggcccccgccgccagccccgccgccaccgccgcccccgccgcgucaucgcccgcuaccgcuaccagcaggucgucgucggcaacguccaggacggccucaucaacgucgaggacggcgucuccucccuccccaucacccccgcccaggccccccucgccucccccgagucccucggcucccucaccuccaccuccgagcaggcccagcucgccaccuccgagucccucuccccccucaccucccucuccggccaggccccccucgccaccggcgagucccucuccgaccuccccuccaccuccgagcaggcccgccacuccuacggcguccgcuucaacggcuuccaggccgacgacuccaucauccccaccgagauccgcaaccgcgucgaggcccacggccacggcgucacccacgaccacgaggacuccaacgagucccucuccuccgacgagcgccacggccacggccccuccggcaagcccaugcuccaccacggcgagaagggcguccaggaggccggcugggaccucgacgacaacaacgacaaguccgacugccucgccaucaaggagcaguucaagugcgacaccaacuccaccuggggccucaacgacgacgagcucauggcccacggccaggagaaggacuccuccuccgaguccgaggacuccugcccccccucccccggcugcuccuucaccgagggcuucuccuucgaccucuucaaccccgacuacguccccaaggucgacaaguggucccgcuuccucuucccccucgccuucggccucuucaacaucgucuacugggucuaccacauguacuga

SEQ ID NO: 43465 - RNA, 1389 nt, Artificial Sequence
  derived and/or modified sequence opt2 from GABRR1__Homo_sapiens__NP_001243632
augcucgccguccccaacaugcgcuucggcaucuuccuccucugguggggcuggguccucgccaccgagucccgcaugcacuggcccggccgcgagguccacgagauguccaagaagggcucccccauccuccgccgcucccccgacaucaccaaguccccccucaccaaguccgagcagcuccuccgcaucgacgaccacgacuucuccaugcgccccggcuucggcggccccgccauccccgucggcgucgacguccaggucgagucccucgacuccaucuccgaggucgacauggacuucaccaugacccucuaccuccgccacuacuggaaggacgagcgccucuccuuccccuccaccaacaaccucuccaugaccuucgacggccgccucgucaagaagaucuggguccccgacauguucuucguccacuccaagcgcuccuucauccacgacaccaccaccgacaacgucaugcuccgcguccagcccgacggcaagguccucuacucccuccgcgucaccgucaccgccaugugcaacauggacuucucccgcuucccccucgacacccagaccugcucccucgagaucgaguccuacgccuacaccgaggacgaccucaugcucuacuggaagaagggcaacgacucccucaagaccgacgagcgcaucucccucucccaguuccucauccaggaguuccacaccaccaccaagcucgccuucuacuccuccaccggcugguacaaccgccucuacaucaacuucacccuccgccgccacaucuucuucuuccuccuccagaccuacuuccccgccacccucauggucaugcucuccugggucuccuucuggaucgaccgccgcgccguccccgcccgcgucccccucggcaucaccaccguccucaccauguccaccaucaucaccggcgucaacgccuccaugccccgcgucuccuacaucaaggccgucgacaucuaccucugggucuccuucgucuucgucuuccucuccguccucgaguacgccgccgucaacuaccucaccaccguccaggagcgcaaggagcagaagcuccgcgagaagcuccccugcaccuccggccucccccccccccgcaccgccaugcucgacggcaacuacuccgacggcgaggucaacgaccucgacaacuacaugcccgagaacggcgagaagcccgaccgcaugaugguccagcucacccucgccuccgagcgcuccuccccccagcgcaagucccagcgcuccuccuacgucuccaugcgcaucgacacccacgccaucgacaaguacucccgcaucaucuuccccgccgccuacauccucuucaaccucaucuacugguccaucuucuccuga

SEQ ID NO: 43466 - RNA, 1398 nt, Artificial Sequence
  derived and/or modified sequence opt2 from GABRR2__Homo_sapiens__NP_002034
augcccuacuucacccgccucauccucuuccucuucugccucaugguccucgucgagucccgcaagcccaagcgcaagcgcuggaccggccaggucgagaugcccaagcccucccaccucuacaagaagaaccucgacgucaccaagauccgcaagggcaagccccagcagcuccuccgcgucgacgagcacgacuucuccaugcgccccgccuucggcggccccgccauccccgucggcgucgacguccaggucgagucccucgacuccaucuccgaggucgacauggacuucaccaugacccucuaccuccgccacuacuggaaggacgagcgccucgccuucuccuccgccuccaacaaguccaugaccuucgacggccgccucgucaagaagaucuggguccccgacgucuucuucguccacuccaagcgcuccuucacccacgacaccaccaccgacaacaucaugcuccgcgucuuccccgacggccacguccucuacuccaugcgcaucaccgucaccgccaugugcaacauggacuucucccacuucccccucgacucccagaccugcucccucgagcucgaguccuacgccuacaccgacgaggaccucaugcucuacuggaagaacggcgacgagucccucaagaccgacgagaagaucucccucucccaguuccucauccagaaguuccacaccaccucccgccucgccuucuacuccuccaccggcugguacaaccgccucuacaucaacuucacccuccgccgccacaucuucuucuuccuccuccagaccuacuuccccgccacccucauggucaugcucuccugggucuccuucuggaucgaccgccgcgccguccccgcccgcgucucccucggcaucaccaccguccucaccaugaccaccaucaucaccggcgucaacgccuccaugccccgcgucuccuacgucaaggccgucgacaucuaccucugggucuccuucgucuucgucuuccucuccguccucgaguacgccgccgucaacuaccucaccaccguccaggagcgcaaggagcgcaagcuccgcgagaaguuccccugcaugugcggcaugcuccacuccaagaccaugaugcucgacggcuccuacuccgaguccgaggccaacucccucgccggcuacccccgcucccacauccucaccgaggaggagcgccaggacaagaucgucguccaccucggccucuccggcgaggccaacgccgcccgcaagaagggccuccucaagggccagaccggcuuccgcaucuuccagaacacccacgccaucgacaaguacucccgccucaucuuccccgccuccuacaucuucuucaaccucaucuacugguccgucuucuccuga

SEQ ID NO: 43467 - RNA, 1785 nt, Artificial Sequence
  derived and/or modified sequence opt2 from GAD1__Homo_sapiens__NP_000808
auggccuccuccacccccuccuccuccgccaccuccuccaacgccggcgccgaccccaacaccaccaaccuccgccccaccaccuacgacaccuggugcggcgucgcccacggcugcacccgcaagcucggccucaagaucugcggcuuccuccagcgcaccaacucccucgaggagaagucccgccucgucuccgccuucaaggagcgccaguccuccaagaaccuccucuccugcgagaacuccgaccgcgacgcccgcuuccgccgcaccgagaccgacuucuccaaccucuucgcccgcgaccuccuccccgccaagaacggcgaggagcagaccguccaguuccuccucgaggucgucgacauccuccucaacuacguccgcaagaccuucgaccgcuccaccaagguccucgacuuccaccacccccaccagcuccucgagggcauggagggcuucaaccucgagcucuccgaccaccccgagucccucgagcagauccucgucgacugccgcgacacccucaaguacggcguccgcaccggccacccccgcuucuucaaccagcucuccaccggccucgacaucaucggccucgccggcgaguggcucaccuccaccgccaacaccaacauguucaccuacgagaucgcccccgucuucguccucauggagcagaucacccucaagaagaugcgcgagaucgucggcugguccuccaaggacggcgacggcaucuucucccccggcggcgccaucuccaacauguacuccaucauggccgcccgcuacaaguacuuccccgaggucaagaccaagggcauggccgccguccccaagcucguccucuucaccuccgagcagucccacuacuccaucaagaaggccggcgccgcccucggcuucggcaccgacaacgucauccucaucaagugcaacgagcgcggcaagaucauccccgccgacuucgaggccaagauccucgaggccaagcagaagggcuacguccccuucuacgucaacgccaccgccggcaccaccgucuacggcgccuucgaccccauccaggagaucgccgacaucugcgagaaguacaaccucuggcuccacgucgacgccgccuggggcggcggccuccucaugucccgcaagcaccgccacaagcucaacggcaucgagcgcgccaacuccgucaccuggaacccccacaagaugaugggcguccuccuccagugcuccgccauccucgucaaggagaagggcauccuccagggcugcaaccagaugugcgccggcuaccucuuccagcccgacaagcaguacgacgucuccuacgacaccggcgacaaggccauccagugcggccgccacgucgacaucuucaaguucuggcucauguggaaggccaagggcaccgucggcuucgagaaccagaucaacaagugccucgagcucgccgaguaccucuacgccaagaucaagaaccgcgaggaguucgagauggucuucaacggcgagcccgagcacaccaacgucugcuucugguacaucccccagucccuccgcggcguccccgacuccccccagcgccgcgagaagcuccacaaggucgcccccaagaucaaggcccucaugauggaguccggcaccaccauggucggcuaccagccccagggcgacaaggccaacuucuuccgcauggucaucuccaaccccgccgccacccaguccgacaucgacuuccucaucgaggagaucgagcgccucggccaggaccucuga

SEQ ID NO: 43468 - RNA, 1758 nt, Artificial Sequence
  derived and/or modified sequence opt2 from GAD2__Homo_sapiens__NP_001127838
auggccucccccggcuccggcuucugguccuucggcuccgaggacggcuccggcgacuccgagaaccccggcaccgcccgcgccuggugccaggucgcccagaaguucaccggcggcaucggcaacaagcucugcgcccuccucuacggcgacgccgagaagcccgccgaguccggcggcucccagcccccccgcgccgccgcccgcaaggccgccugcgccugcgaccagaagcccugcuccugcuccaaggucgacgucaacuacgccuuccuccacgccaccgaccuccuccccgccugcgacggcgagcgccccacccucgccuuccuccaggacgucaugaacauccuccuccaguacgucgucaaguccuucgaccgcuccaccaaggucaucgacuuccacuaccccaacgagcuccuccaggaguacaacugggagcucgccgaccagccccagaaccucgaggagauccucaugcacugccagaccacccucaaguacgccaucaagaccggccacccccgcuacuucaaccagcucuccaccggccucgacauggucggccucgccgccgacuggcucaccuccaccgccaacaccaacauguucaccuacgagaucgcccccgucuucguccuccucgaguacgucacccucaagaagaugcgcgagaucaucggcuggcccggcggcuccggcgacggcaucuucucccccggcggcgccaucuccaacauguacgccaugaugaucgcccgcuucaagauguuccccgaggucaaggagaagggcauggccgcccucccccgccucaucgccuucaccuccgagcacucccacuucucccucaagaagggcgccgccgcccucggcaucggcaccgacuccgucauccucaucaagugcgacgagcgcggcaagaugauccccuccgaccucgagcgccgcauccucgaggccaagcagaagggcuucguccccuuccucgucuccgccaccgccggcaccaccgucuacggcgccuucgacccccuccucgccgucgccgacaucugcaagaaguacaagaucuggaugcacgucgacgccgccuggggcggcggccuccucaugucccgcaagcacaaguggaagcucuccggcgucgagcgcgccaacuccgucaccuggaacccccacaagaugaugggcgucccccuccagugcuccgcccuccucguccgcgaggagggccucaugcagaacugcaaccagaugcacgccuccuaccucuuccagcaggacaagcacuacgaccucuccuacgacaccggcgacaaggcccuccagugcggccgccacgucgacgucuucaagcucuggcucauguggcgcgccaagggcaccaccggcuucgaggcccacgucgacaagugccucgagcucgccgaguaccucuacaacaucaucaagaaccgcgagggcuacgagauggucuucgacggcaagccccagcacaccaacgucugcuucugguacaucccccccucccuccgcacccucgaggacaacgaggagcgcaugucccgccucuccaaggucgcccccgucaucaaggcccgcaugauggaguacggcaccaccauggucuccuaccagccccucggcgacaaggucaacuucuuccgcauggucaucuccaaccccgccgccacccaccaggacaucgacuuccucaucgaggagaucgagcgccucggccaggaccucuga

SEQ ID NO: 43469 - RNA, 483 nt, Artificial Sequence
  derived and/or modified sequence opt2 from GADD45B__Homo_sapiens__NP_056490
augacccucgaggagcucgucgccugcgacaacgccgcccagaagaugcagaccgucaccgccgccgucgaggagcuccucgucgccgcccagcgccaggaccgccucaccgucggcgucuacgaguccgccaagcucaugaacgucgaccccgacuccgucguccucugccuccucgccaucgacgaggaggaggaggacgacaucgcccuccagauccacuucacccucauccaguccuucugcugcgacaacgacaucaacaucguccgcgucuccggcaugcagcgccucgcccagcuccucggcgagcccgccgagacccagggcaccaccgaggcccgcgaccuccacugccuccucgucaccaacccccacaccgacgccuggaagucccacggccucgucgaggucgccuccuacugcgaggagucccgcggcaacaaccaguggguccccuacaucucccuccaggagcgcuga

SEQ ID NO: 43470 - RNA, 480 nt, Artificial Sequence
  derived and/or modified sequence opt2 from GADD45G__Homo_sapiens__NP_006696
augacccucgaggagguccgcggccaggacaccguccccgaguccaccgcccgcaugcagggcgccggcaaggcccuccacgagcuccuccucuccgcccagcgccagggcugccucaccgccggcgucuacgaguccgccaagguccucaacgucgaccccgacaacgucaccuucugcguccucgccgccggcgaggaggacgagggcgacaucgcccuccagauccacuucacccucauccaggccuucugcugcgagaacgacaucgacaucguccgcgucggcgacguccagcgccucgccgccaucgucggcgccggcgaggaggccggcgcccccggcgaccuccacugcauccucaucuccaaccccaacgaggacgccuggaaggaccccgcccucgagaagcucucccucuucugcgaggagucccgcuccgucaacgacuggguccccuccaucacccuccccgaguga

SEQ ID NO: 43471 - RNA, 669 nt, Artificial Sequence
  derived and/or modified sequence opt2 from GADD45GIP1__Homo_sapiens__NP_443082
auggccgccuccguccgccaggcccgcucccuccucggcgucgccgccacccucgcccccggcucccgcggcuaccgcgcccgcccccccccccgccgccgccccggcccccgcuggcccgaccccgaggaccuccucaccccccgcuggcagcucggcccccgcuacgccgccaagcaguucgcccgcuacggcgccgccuccggcgucguccccggcucccucuggcccucccccgagcagcuccgcgagcucgaggccgaggagcgcgagugguaccccucccucgccaccaugcaggagucccuccgcgucaagcagcucgccgaggagcagaagcgccgcgagcgcgagcagcacaucgccgagugcauggccaagaugccccagaugaucgucaacuggcagcagcagcagcgcgagaacugggagaaggcccaggccgacaaggagcgccgcgcccgccuccaggccgaggcccaggagcuccucggcuaccaggucgacccccgcuccgcccgcuuccaggagcuccuccaggaccucgagaagaaggagcgcaagcgccucaaggaggagaagcagaagcgcaagaaggaggcccgcgccgccgcccucgccgccgccgucgcccaggaccccgccgccuccggcgcccccuccuccuga

SEQ ID NO: 43472 - RNA, 1566 nt, Artificial Sequence
  derived and/or modified sequence opt2 from GADL1__Homo_sapiens__NP_997242
auguccuccgacuccgaccgccagugccccgucgacggcgacaucgaccagcaggagaugauccccuccaagaagaacgccguccucgucgacggcgucguccucaacggccccaccaccgacgccaaggccggcgagaaguucgucgaggaggccugccgccucaucauggaggaggucguccucaaggccaccgacgucaacgagaaggucugcgaguggcgcccccccgagcagcucaagcagcuccucgaccucgagaugcgcgacuccggcgagcccccccacaagcuccucgagcucugccgcgacgucauccacuacuccgucaagaccaaccacccccgcuucuucaaccagcucuacgccggccucgacuacuacucccucgucgcccgcuucaugaccgaggcccucaaccccuccgucuacaccuacgaggucucccccgucuuccuccucgucgaggaggccguccucaagaagaugaucgaguucaucggcuggaaggagggcgacggcaucuucaaccccggcggcuccgucuccaacauguacgccaugaaccucgcccgcuacaaguacugccccgacaucaaggagaagggccucuccggcuccccccgccucauccucuucaccuccgccgagugccacuacuccaugaagaaggccgccuccuuccucggcaucggcaccgagaacgucugcuucgucgagaccgacggccgcggcaagaugauccccgaggagcucgagaagcaggucuggcaggcccgcaaggagggcgccgcccccuuccucgucugcgccaccuccggcaccaccguccucggcgccuucgacccccucgacgagaucgccgacaucugcgagcgccacucccucuggcuccacgucgacgccuccuggggcggcuccgcccucaugucccgcaagcaccgcaagcuccuccacggcauccaccgcgccgacuccgucgccuggaacccccacaagaugcucauggccggcauccagugcugcgcccuccucgucaaggacaaguccgaccuccucaagaagugcuacuccgccaaggccuccuaccucuuccagcaggacaaguucuacgacgucuccuacgacaccggcgacaaguccauccagugcucccgccgccccgacgccuucaaguucuggaugaccuggaaggcccucggcacccucggccucgaggagcgcgucaaccgcgcccucgcccucucccgcuaccucgucgacgagaucaagaagcgcgagggcuucaagcuccucauggagcccgaguacgccaacaucugcuucugguacaucccccccucccuccgcgagauggaggagggccccgaguucugggccaagcucaaccucgucgcccccgccaucaaggagcgcaugaugaagaagggcucccucaugcucggcuaccagccccaccgcggcaaggucaacuucuuccgccaggucgucaucuccccccaggucucccgcgaggacauggacuuccuccucgacgagaucgaccuccucggcaaggacauguga

SEQ ID NO: 43473 - RNA, 351 nt, Artificial Sequence
  derived and/or modified sequence opt2 from GAGE10__Homo_sapiens__NP_001091883
auguccuggcgcggccgcuccaccuaccgcccccgcccccgccgcuacgucgagccccccgagaugaucggccccaugcuccccgagcaguucuccgacgaggucgagcccgccacccccgaggagggcgagcccgccacccagcgccaggaccccgccgccgcccaggagggcgaggacgagggcgccuccgccggccagggccccaagcccgaggccgacucccaggagcagguccaccccaagaccggcugcgagugcggcgacggccccgacggccaggagaugggccuccccaaccccgaggaggucaagcgccccgaggagggcgagaagcagucccagugcuga

SEQ ID NO: 43474 - RNA, 354 nt, Artificial Sequence
  derived and/or modified sequence opt2 from GAGE1__Homo_sapiens__NP_001035753
auguccuggcgcggccgcuccaccuacuacuggccccgcccccgccgcuacguccagccccccgagaugaucggccccaugcgccccgagcaguucuccgacgaggucgagcccgccacccccgaggagggcgagcccgccacccagcgccaggaccccgccgccgcccaggagggcgaggacgagggcgccuccgccggccagggccccaagcccgaggccgacucccaggagcagggccacccccagaccggcugcgagugcgaggacggccccgacggccaggagauggacccccccaaccccgaggaggucaagacccccgaggagggcgagggccagucccagugcuga

SEQ ID NO: 43475 - RNA, 3936 nt, Artificial Sequence
  derived and/or modified sequence opt2 from GAK__Homo_sapiens__NP_005246
augucccuccuccaguccgcccucgacuuccucgccggccccggcucccucggcggcgccuccggccgcgaccaguccgacuucgucggccagaccgucgagcucggcgagcuccgccuccgcguccgccgcguccucgccgagggcggcuucgccuucgucuacgaggcccaggacgucggcuccggccgcgaguacgcccucaagcgccuccucuccaacgaggaggagaagaaccgcgccaucauccaggaggucugcuucaugaagaagcucuccggccaccccaacaucguccaguucugcuccgccgccuccaucggcaaggaggaguccgacaccggccaggccgaguuccuccuccucaccgagcucugcaagggccagcucgucgaguuccucaagaagauggagucccgcggcccccucuccugcgacaccguccucaagaucuucuaccagaccugccgcgccguccagcacaugcaccgccagaagccccccaucauccaccgcgaccucaaggucgagaaccuccuccucuccaaccagggcaccaucaagcucugcgacuucggcuccgccaccaccaucucccacuaccccgacuacuccugguccgcccagcgccgcgcccucgucgaggaggagaucacccgcaacaccacccccauguaccgcacccccgagaucaucgaccucuacuccaacuuccccaucggcgagaagcaggacaucugggcccucggcugcauccucuaccuccucugcuuccgccagcaccccuucgaggacggcgccaagcuccgcaucgucaacggcaaguacuccauccccccccacgacacccaguacaccgucuuccacucccucauccgcgccaugcuccaggucaaccccgaggagcgccucuccaucgccgaggucguccaccagcuccaggagaucgccgccgcccgcaacgucaaccccaagucccccaucaccgagcuccucgagcagaacggcggcuacggcuccgccacccucucccgcggcccccccccccccgucggccccgccggcuccggcuacuccggcggccucgcccucgccgaguacgaccagcccuacggcggcuuccucgacauccuccgcggcggcaccgagcgccucuucaccaaccucaaggacaccuccuccaaggucauccaguccgucgccaacuacgccaagggcgaccucgacaucuccuacaucaccucccgcaucgccgucauguccuuccccgccgagggcgucgaguccgcccucaagaacaacaucgaggacguccgccucuuccucgacuccaagcaccccggccacuacgccgucuacaaccucuccccccgcaccuaccgccccucccgcuuccacaaccgcgucuccgagugcggcugggccgcccgccgcgccccccaccuccacacccucuacaacaucugccgcaacaugcacgccuggcuccgccaggaccacaagaacgucugcgucguccacugcauggacggccgcgccgccuccgccgucgccgucugcuccuuccucugcuucugccgccucuucuccaccgccgaggccgccgucuacauguucuccaugaagcgcugcccccccggcaucuggcccucccacaagcgcuacaucgaguacaugugcgacauggucgccgaggagcccaucaccccccacuccaagcccauccucguccgcgccgucgucaugacccccgucccccucuucuccaagcagcgcuccggcugccgccccuucugcgaggucuacgucggcgacgagcgcgucgccuccaccucccaggaguacgacaagaugcgcgacuucaagaucgaggacggcaaggccgucaucccccucggcgucaccguccagggcgacguccucaucgucaucuaccacgcccgcuccacccucggcggccgccuccaggccaagauggccuccaugaagauguuccagauccaguuccacaccggcuucgucccccgcaacgccaccaccgucaaguucgccaaguacgaccucgacgccugcgacauccaggagaaguaccccgaccucuuccaggucaaccucgaggucgaggucgagccccgcgaccgccccucccgcgaggccccccccugggagaacuccuccaugcgcggccucaaccccaagauccucuucuccucccgcgaggagcagcaggacauccucuccaaguucggcaagcccgagcucccccgccagcccggcuccaccgcccaguacgacgccggcgccggcucccccgaggccgagcccaccgacuccgacuccccccccuccuccuccgccgacgccucccgcuuccuccacacccucgacuggcaggaggagaaggaggccgagaccggcgccgagaacgccuccuccaaggaguccgaguccgcccucauggaggaccgcgacgaguccgaggucuccgacgagggcggcucccccaucuccuccgagggccaggagccccgcgccgaccccgagccccccggccucgccgccggccucguccagcaggaccucgucuucgaggucgagacccccgccguccuccccgagcccgucccccaggaggacggcgucgaccuccucggccuccacuccgaggucggcgccggccccgccguccccccccaggccugcaaggcccccuccuccaacaccgaccuccucuccugccuccucggcccccccgaggccgccucccagggcccccccgaggaccuccucuccgaggacccccuccuccucgccucccccgcccccccccucuccguccaguccaccccccgcggcggcccccccgccgccgccgaccccuucggcccccuccuccccuccuccggcaacaacucccagcccugcuccaaccccgaccucuucggcgaguuccucaacuccgacuccgucaccgucccccccuccuuccccuccgcccacuccgcccccccccccuccugcuccgccgacuuccuccaccucggcgaccuccccggcgagcccuccaagaugaccgccuccuccuccaaccccgaccuccucggcggcugggccgccuggaccgagaccgccgccuccgccgucgcccccacccccgccaccgagggcccccucuucucccccggcggccagcccgcccccugcggcucccaggccuccuggaccaagucccagaaccccgaccccuucgccgaccucggcgaccucuccuccggccuccagggcucccccgccggcuucccccccggcggcuucauccccaagaccgccaccacccccaagggcuccuccuccuggcagaccucccgcccccccgcccagggcgccuccuggcccccccaggccaagcccccccccaaggccugcacccagccccgccccaacuacgccuccaacuucuccgucaucggcgcccgcgaggagcgcggcguccgcgcccccuccuucgcccagaagcccaaggucuccgagaacgacuucgaggaccuccucuccaaccagggcuucuccucccgcuccgacaagaagggccccaagaccaucgccgagaugcgcaagcaggaccucgccaaggacaccgacccccucaagcucaagcuccucgacuggaucgagggcaaggagcgcaacauccgcgcccuccucuccacccuccacaccguccucugggacggcgagucccgcuggacccccgucggcauggccgaccucgucgcccccgagcaggucaagaagcacuaccgccgcgccguccucgccguccaccccgacaaggccgccggccagcccuacgagcagcacgccaagaugaucuucauggagcucaacgacgccugguccgaguucgagaaccagggcucccgcccccucuucuga

SEQ ID NO: 43476 - RNA, 2058 nt, Artificial Sequence
  derived and/or modified sequence opt2 from GALC__Homo_sapiens__NP_000144
auggccgaguggcuccucuccgccuccuggcagcgccgcgccaaggccaugaccgccgccgccggcuccgccggccgcgccgccgucccccuccuccucugcgcccuccucgcccccggcggcgccuacguccucgacgacuccgacggccucggccgcgaguucgacggcaucggcgccgucuccggcggcggcgccaccucccgccuccucgucaacuaccccgagcccuaccgcucccagauccucgacuaccucuucaagcccaacuucggcgccucccuccacauccucaaggucgagaucggcggcgacggccagaccaccgacggcaccgagcccucccacaugcacuacgcccucgacgagaacuacuuccgcggcuacgagugguggcucaugaaggaggccaagaagcgcaaccccaacaucacccucaucggccuccccugguccuuccccggcuggcucggcaagggcuucgacuggcccuacgucaaccuccagcucaccgccuacuacgucgucaccuggaucgucggcgccaagcgcuaccacgaccucgacaucgacuacaucggcaucuggaacgagcgcuccuacaacgccaacuacaucaagauccuccgcaagaugcucaacuaccagggccuccagcgcgucaagaucaucgccuccgacaaccucugggaguccaucuccgccuccaugcuccucgacgccgagcucuucaaggucgucgacgucaucggcgcccacuaccccggcacccacuccgccaaggacgccaagcucaccggcaagaagcucugguccuccgaggacuucuccacccucaacuccgacaugggcgccggcugcuggggccgcauccucaaccagaacuacaucaacggcuacaugaccuccaccaucgccuggaaccucgucgccuccuacuacgagcagcuccccuacggccgcugcggccucaugaccgcccaggagcccugguccggccacuacgucgucgagucccccgucugggucuccgcccacaccacccaguucacccagcccggcugguacuaccucaagaccgucggccaccucgagaagggcggcuccuacgucgcccucaccgacggccucggcaaccucaccaucaucaucgagaccaugucccacaagcacuccaagugcauccgccccuuccuccccuacuucaacgucucccagcaguucgccaccuucguccucaagggcuccuucuccgagauccccgagcuccaggucugguacaccaagcucggcaagaccuccgagcgcuuccucuucaagcagcucgacucccucuggcuccucgacuccgacggcuccuucacccucucccuccacgaggacgagcucuucacccucaccacccucaccaccggccgcaagggcuccuacccccucccccccaagucccagcccuuccccuccaccuacaaggacgacuucaacgucgacuaccccuucuucuccgaggcccccaacuucgccgaccagaccggcgucuucgaguacuucaccaacaucgaggaccccggcgagcaccacuucacccuccgccagguccucaaccagcgccccaucaccugggccgccgacgccuccaacaccaucuccaucaucggcgacuacaacuggaccaaccucaccaucaagugcgacgucuacaucgagacccccgacaccggcggcgucuucaucgccggccgcgucaacaagggcggcauccucauccgcuccgcccgcggcaucuucuucuggaucuucgccaacggcuccuaccgcgucaccggcgaccucgccggcuggaucaucuacgcccucggccgcgucgaggucaccgccaagaagugguacacccucacccucaccaucaagggccacuucaccuccggcaugcucaacgacaagucccucuggaccgacauccccgucaacuuccccaagaacggcugggccgccaucggcacccacuccuucgaguucgcccaguucgacaacuuccucgucgaggccacccgcuga

SEQ ID NO: 43477 - RNA, 372 nt, Artificial Sequence
  derived and/or modified sequence opt2 from GAL__Homo_sapiens__NP_057057
auggcccgcggcuccgcccuccuccucgccucccuccuccucgccgccgcccucuccgccuccgccggccucuggucccccgccaaggagaagcgcggcuggacccucaacuccgccggcuaccuccucggcccccacgccgucggcaaccaccgcuccuucuccgacaagaacggccucaccuccaagcgcgagcuccgccccgaggacgacaugaagcccggcuccuucgaccgcuccauccccgagaacaacaucaugcgcaccaucaucgaguuccucuccuuccuccaccucaaggaggccggcgcccucgaccgccuccucgaccuccccgccgccgccuccuccgaggacaucgagcgcuccuga

SEQ ID NO: 43478 - RNA, 1179 nt, Artificial Sequence
  derived and/or modified sequence opt2 from GALK1__Homo_sapiens__NP_000145
auggccgcccuccgccagccccaggucgccgagcuccucgccgaggcccgccgcgccuuccgcgaggaguucggcgccgagcccgagcucgccgucuccgcccccggccgcgucaaccucaucggcgagcacaccgacuacaaccagggccucguccuccccauggcccucgagcucaugaccguccucgucggcuccccccgcaaggacggccucgucucccuccucaccaccuccgagggcgccgacgagccccagcgccuccaguucccccuccccaccgcccagcgcucccucgagcccggcaccccccgcugggccaacuacgucaagggcgucauccaguacuaccccgccgccccccuccccggcuucuccgccgucgucgucuccuccgucccccucggcggcggccucuccuccuccgccucccucgaggucgccaccuacaccuuccuccagcagcucugccccgacuccggcaccaucgccgcccgcgcccaggucugccagcaggccgagcacuccuucgccggcaugcccugcggcaucauggaccaguucaucucccucaugggccagaagggccacgcccuccucaucgacugccgcucccucgagaccucccucgucccccucuccgaccccaagcucgccguccucaucaccaacuccaacguccgccacucccucgccuccuccgaguaccccguccgccgccgccagugcgaggaggucgcccgcgcccucggcaaggagucccuccgcgagguccagcucgaggagcucgaggccgcccgcgaccucgucuccaaggagggcuuccgccgcgcccgccacgucgucggcgagauccgccgcaccgcccaggccgccgccgcccuccgccgcggcgacuaccgcgccuucggccgccucauggucgagucccaccgcucccuccgcgacgacuacgaggucuccugccccgagcucgaccagcucgucgaggccgcccucgccguccccggcgucuacggcucccgcaugaccggcggcggcuucggcggcugcaccgucacccuccucgaggccuccgccgccccccacgccaugcgccacauccaggagcacuacggcggcaccgccaccuucuaccucucccaggccgccgacggcgccaagguccucugccucuga

SEQ ID NO: 43479 - RNA, 1344 nt, Artificial Sequence
  derived and/or modified sequence opt2 from GALK2__Homo_sapiens__NP_001001556
augcccguccucuacgaccgccuccucaagcucaaggagauguucaacuccaaguucggcuccauccccaaguucuacguccgcgcccccggccgcgucaacaucaucggcgagcacaucgacuacugcggcuacuccguccuccccauggccgucgagcaggacguccucaucgccgucgagcccgucaagaccuacgcccuccagcucgccaacaccaacccccucuaccccgacuucuccaccuccgccaacaacauccagaucgacaagaccaagccccucuggcacaacuacuuccucugcggccucaagggcauccaggagcacuucggccucuccaaccucaccggcaugaacugccucgucgacggcaacaucccccccuccuccggccucuccuccuccuccgcccucgucugcugcgccggccucgucacccucaccguccucggccgcaaccucuccaaggucgagcucgccgagaucugcgccaaguccgagcgcuacaucggcaccgagggcggcggcauggaccaguccaucuccuuccucgccgaggagggcaccgccaagcucaucgaguucuccccccuccgcgccaccgacgucaagcuccccuccggcgccgucuucgucaucgccaacuccugcgucgagaugaacaaggccgccaccucccacuucaacauccgcgucauggagugccgccucgccgccaagcuccucgccaaguacaagucccuccagugggacaagguccuccgccucgaggagguccaggccaagcucggcaucucccucgaggagaugcuccucgucaccgaggacgcccuccaccccgagcccuacaaccccgaggagaucugccgcugccucggcaucucccucgaggagcuccgcacccagauccucucccccaacacccaggacguccucaucuucaagcucuaccagcgcgccaagcacgucuacuccgaggccgcccgcguccuccaguucaagaagaucugcgaggaggcccccgagaacaugguccagcuccucggcgagcucaugaaccagucccacauguccugccgcgacauguacgagugcuccugccccgagcucgaccagcucgucgacaucugccgcaaguucggcgcccagggcucccgccucaccggcgccggcuggggcggcugcaccgucuccaugguccccgccgacaagcuccccuccuuccucgccaacguccacaaggccuacuaccagcgcuccgacggcucccucgcccccgagaagcagucccucuucgccaccaagcccggcggcggcgcccucguccuccucgaggccuga

SEQ ID NO: 43480 - RNA, 1029 nt, Artificial Sequence
  derived and/or modified sequence opt2 from GALM__Homo_sapiens__NP_620156
auggccuccgucacccgcgccgucuucggcgagcuccccuccggcggcggcaccgucgagaaguuccagcuccaguccgaccuccuccgcgucgacaucaucuccuggggcugcaccaucaccgcccucgaggucaaggaccgccagggccgcgccuccgacgucguccucggcuucgccgagcucgagggcuaccuccagaagcagcccuacuucggcgccgucaucggccgcgucgccaaccgcaucgccaagggcaccuucaaggucgacggcaaggaguaccaccucgccaucaacaaggagcccaacucccuccacggcggcguccgcggcuucgacaagguccucuggaccccccgcguccucuccaacggcguccaguucucccgcaucucccccgacggcgaggagggcuaccccggcgagcucaaggucugggucaccuacacccucgacggcggcgagcucaucgucaacuaccgcgcccaggccucccaggccacccccgucaaccucaccaaccacuccuacuucaaccucgccggccaggccucccccaacaucaacgaccacgaggucaccaucgaggccgacaccuaccuccccgucgacgagacccucauccccaccggcgaggucgcccccguccagggcaccgccuucgaccuccgcaagcccgucgagcucggcaagcaccuccaggacuuccaccucaacggcuucgaccacaacuucugccucaagggcuccaaggagaagcacuucugcgcccgcguccaccacgccgccuccggccgcguccucgaggucuacaccacccagcccggcguccaguucuacaccggcaacuuccucgacggcacccucaagggcaagaacggcgccgucuaccccaagcacuccggcuucugccucgagacccagaacuggcccgacgccgucaaccagccccgcuucccccccguccuccuccgccccggcgaggaguacgaccacaccaccugguucaaguucuccgucgccuga

SEQ ID NO: 43481 - RNA, 1569 nt, Artificial Sequence
  derived and/or modified sequence opt2 from GALNS__Homo_sapiens__NP_000503
auggccgccgucgucgccgccacccgcugguggcagcuccuccucguccucuccgccgccggcaugggcgccuccggcgccccccagccccccaacauccuccuccuccucauggacgacaugggcuggggcgaccucggcgucuacggcgagcccucccgcgagacccccaaccucgaccgcauggccgccgagggccuccucuuccccaacuucuacuccgccaacccccucugcucccccucccgcgccgcccuccucaccggccgccuccccauccgcaacggcuucuacaccaccaacgcccacgcccgcaacgccuacaccccccaggagaucgucggcggcauccccgacuccgagcagcuccuccccgagcuccucaagaaggccggcuacgucuccaagaucgucggcaaguggcaccucggccaccgcccccaguuccacccccucaagcacggcuucgacgagugguucggcucccccaacugccacuucggccccuacgacaacaaggcccgccccaacauccccgucuaccgcgacugggagauggucggccgcuacuacgaggaguuccccaucaaccucaagaccggcgaggccaaccucacccagaucuaccuccaggaggcccucgacuucaucaagcgccaggcccgccaccaccccuucuuccucuacugggccgucgacgccacccacgcccccgucuacgccuccaagcccuuccucggcaccucccagcgcggccgcuacggcgacgccguccgcgagaucgacgacuccaucggcaagauccucgagcuccuccaggaccuccacgucgccgacaacaccuucgucuucuucaccuccgacaacggcgccgcccucaucuccgcccccgagcagggcggcuccaacggccccuuccucugcggcaagcagaccaccuucgagggcggcaugcgcgagcccgcccucgccugguggcccggccacgucaccgccggccaggucucccaccagcucggcuccaucauggaccucuucaccaccucccucgcccucgccggccucaccccccccuccgaccgcgccaucgacggccucaaccuccuccccacccuccuccagggccgccucauggaccgccccaucuucuacuaccgcggcgacacccucauggccgccacccucggccagcacaaggcccacuucuggaccuggaccaacuccugggagaacuuccgccagggcaucgacuucugccccggccagaacgucuccggcgucaccacccacaaccucgaggaccacaccaagcucccccucaucuuccaccucggccgcgaccccggcgagcgcuucccccucuccuucgccuccgccgaguaccaggaggcccucucccgcaucaccuccgucguccagcagcaccaggaggcccucguccccgcccagccccagcucaacgucugcaacugggccgucaugaacugggccccccccggcugcgagaagcucggcaagugccucaccccccccgaguccauccccaagaagugccucuggucccacuga

SEQ ID NO: 43482 - RNA, 1746 nt, Artificial Sequence
  derived and/or modified sequence opt2 from GALNT12__Homo_sapiens__NP_078918
auguggggccgcaccgcccgccgccgcugcccccgcgagcuccgccgcggccgcgaggcccuccucguccuccucgcccuccucgcccucgccggccucggcuccguccuccgcgcccagcgcggcgccggcgccggcgccgccgagcccggccccccccgcaccccccgccccggccgccgcgagcccgucaugccccgcccccccguccccgccaacgcccucggcgcccgcggcgaggccguccgccuccagcuccagggcgaggagcuccgccuccaggaggaguccguccgccuccaccagaucaacaucuaccucuccgaccgcaucucccuccaccgccgccuccccgagcgcuggaacccccucugcaaggagaagaaguacgacuacgacaaccucccccgcaccuccgucaucaucgccuucuacaacgaggccugguccacccuccuccgcaccgucuacuccguccucgagaccucccccgacauccuccucgaggaggucauccucgucgacgacuacuccgaccgcgagcaccucaaggagcgccucgccaacgagcucuccggccuccccaagguccgccucauccgcgccaacaagcgcgagggccucguccgcgcccgccuccucggcgccuccgccgcccgcggcgacguccucaccuuccucgacugccacugcgagugccacgagggcuggcucgagccccuccuccagcgcauccacgaggaggaguccgccgucgucugccccgucaucgacgucaucgacuggaacaccuucgaguaccucggcaacuccggcgagccccagaucggcggcuucgacuggcgccucgucuucaccuggcacaccguccccgagcgcgagcgcauccgcaugcagucccccgucgacgucauccgcucccccaccauggccggcggccucuucgccgucuccaagaaguacuucgaguaccucggcuccuacgacaccggcauggaggucuggggcggcgagaaccucgaguucuccuuccgcaucuggcagugcggcggcguccucgagacccaccccugcucccacgucggccacgucuuccccaagcaggcccccuacucccgcaacaaggcccucgccaacuccguccgcgccgccgaggucuggauggacgaguucaaggagcucuacuaccaccgcaacccccgcgcccgccucgagcccuucggcgacgucaccgagcgcaagcagcuccgcgacaagcuccagugcaaggacuucaagugguuccucgagaccgucuaccccgagcuccacguccccgaggaccgccccggcuucuucggcaugcuccagaacaagggccucaccgacuacugcuucgacuacaacccccccgacgagaaccagaucgucggccaccaggucauccucuaccucugccacggcaugggccagaaccaguucuucgaguacaccucccagaaggagauccgcuacaacacccaccagcccgagggcugcaucgccgucgaggccggcauggacacccucaucaugcaccucugcgaggagaccgcccccgagaaccagaaguucauccuccaggaggacggcucccucuuccacgagcaguccaagaagugcguccaggccgcccgcaaggaguccuccgacuccuucgucccccuccuccgcgacugcaccaacuccgaccaccagaagugguucuucaaggagcgcaugcucuga

SEQ ID NO: 43483 - RNA, 1686 nt, Artificial Sequence
  derived and/or modified sequence opt2 from GALNT13__Homo_sapiens__NP_001288556
augcgccgcuucgucuacugcaaggucguccucgccaccucccucauguggguccucgucgacgucuuccuccuccucuacuucuccgagugcaacaagugcgacgacaagaaggagcgcucccuccuccccgcccuccgcgccgucaucucccgcaaccaggagggccccggcgagaugggcaaggccguccucauccccaaggacgaccaggagaagaugaaggagcucuucaagaucaaccaguucaaccucauggccuccgaccucaucgcccucaaccgcucccuccccgacguccgccucgagggcugcaagaccaaggucuaccccgacgagcuccccaacaccuccgucgucaucgucuuccacaacgaggccugguccacccuccuccgcaccgucuacuccgucaucaaccgcuccccccacuaccuccucuccgaggucauccucgucgacgacgccuccgagcgcgacuuccucaagcucacccucgagaacuacgucaagaaccucgagguccccgucaagaucauccgcauggaggagcgcuccggccucauccgcgcccgccuccgcggcgccgccgccuccaagggccaggucaucaccuuccucgacgcccacugcgagugcacccucggcuggcucgagccccuccucgcccgcaucaaggaggaccgcaagaccgucgucugccccaucaucgacgucaucuccgacgacaccuucgaguacauggccggcuccgacaugaccuacggcggcuucaacuggaagcucaacuuccgcugguaccccgucccccagcgcgagauggaccgccgcaagggcgaccgcacccuccccguccgcacccccaccauggccggcggccucuucuccaucgaccgcaacuacuucgaggagaucggcaccuacgacgccggcauggacaucuggggcggcgagaaccucgagauguccuuccgcaucuggcagugcggcggcucccucgagaucgucaccugcucccacgucggccacgucuuccgcaaggccacccccuacaccuuccccggcggcaccggccacgucaucaacaagaacaaccgccgccucgccgaggucuggauggacgaguucaaggacuucuucuacaucaucucccccggcgucgucaaggucgacuacggcgacgucuccguccgcaagacccuccgcgagaaccucaagugcaagcccuucuccugguaccucgagaacaucuaccccgacucccagaucccccgccgcuacuacucccucggcgagauccgcaacgucgagaccaaccagugccucgacaacaugggccgcaaggagaacgagaaggucggcaucuucaacugccacggcaugggcggcaaccaggucuucuccuacaccgccgacaaggagauccgcaccgacgaccucugccucgacgucucccgccucaacggccccgucaucaugcucaagugccaccacaugcgcggcaaccagcucugggaguacgacgccgaguccugccucuccgucaacaaggucgccgacggcucccagcaccccaccgucgagaccugcaacgacuccacccuccagaaguggcuccuccgcaacuacacccgcauggagaucuuccgcaacaucuucggcaacuccaccgacuacauccucuga

SEQ ID NO: 43484 - RNA, 1674 nt, Artificial Sequence
  derived and/or modified sequence opt2 from GALNT14__Homo_sapiens__NP_001240755
augcgccgccucacccgccgccucguccuccccgucuucggcguccucuggaucaccguccuccucuucuucugggucaccaagcgcaagcucgagguccccaccggccccgagguccagacccccaaggucuggucccucuucuucaaggucgccggcaugucccccugggccccccagguccccgucucccccaccccccccuaccagcgcggccaccuccccaccggcggccaccucgccgucugccacuuccccugccuccuccaggaggcccaguuccaccuccagacccaggucuuccuccagguccgcugcacccuccucgucuacugcaccgaccucccccccaccuccaucaucaucaccuuccacaacgaggcccgcuccacccuccuccgcaccauccgcuccguccucaaccgcacccccacccaccucauccgcgagaucauccucgucgacgacuucuccaacgaccccgacgacugcaagcagcucaucaagcuccccaaggucaagugccuccgcaacaacgagcgccagggccucguccgcucccgcauccgcggcgccgacaucgcccagggcaccacccucaccuuccucgacucccacugcgaggucaaccgcgacuggcuccagccccuccuccaccgcgucaaggaggacuacacccgcgucgucugccccgucaucgacaucaucaaccucgacaccuucaccuacaucgaguccgccuccgagcuccgcggcggcuucgacuggucccuccacuuccagugggagcagcucucccccgagcagaaggcccgccgccucgaccccaccgagcccauccgcacccccaucaucgccggcggccucuucgucaucgacaaggccugguucgacuaccucggcaaguacgacauggacauggacaucuggggcggcgagaacuucgagaucuccuuccgcgucuggaugugcggcggcucccucgagaucguccccugcucccgcgucggccacgucuuccgcaagaagcaccccuacgucuuccccgacggcaacgccaacaccuacaucaagaacaccaagcgcaccgccgaggucuggauggacgaguacaagcaguacuacuacgccgcccgccccuucgcccucgagcgccccuucggcaacgucgagucccgccucgaccuccgcaagaaccuccgcugccaguccuucaagugguaccucgagaacaucuaccccgagcucuccauccccaaggaguccuccauccagaagggcaacauccgccagcgccagaagugccucgagucccagcgccagaacaaccaggagacccccaaccucaagcucucccccugcgccaaggucaagggcgaggacgccaagucccaggucugggccuucaccuacacccagcagauccuccaggaggagcucugccucuccgucaucacccucuuccccggcgcccccgucguccucguccucugcaagaacggcgacgaccgccagcaguggaccaagaccggcucccacaucgagcacaucgccucccaccucugccucgacaccgacauguucggcgacggcaccgagaacggcaaggagaucgucgucaaccccugcgaguccucccucaugucccagcacugggacauggucuccuccuga

SEQ ID NO: 43485 - RNA, 1920 nt, Artificial Sequence
  derived and/or modified sequence opt2 from GALNT15__Homo_sapiens__NP_473451
augcuccuccgcaagcgcuaccgccaccgccccugccgccuccaguuccuccuccuccuccucaugcucggcugcguccucaugauggucgccaugcuccaccccccccaccacacccuccaccagaccgucaccgcccaggccuccaagcacucccccgaggcccgcuaccgccucgacuucggcgagucccaggacuggguccucgaggccgaggacgagggcgaggaguacuccccccucgagggccucccccccuucaucucccuccgcgaggaccagcuccucgucgccgucgcccucccccaggcccgccgcaaccagucccagggccgccgcggcggcuccuaccgccucaucaagcagccccgccgccaggacaaggaggcccccaagcgcgacuggggcgccgacgaggacggcgaggucuccgaggaggaggagcucacccccuucucccucgacccccgcggccuccaggaggcccucuccgcccgcaucccccuccagcgcgcccuccccgagguccgccacccccucugccuccagcagcacccccaggacucccuccccaccgccuccgucauccucugcuuccacgacgaggccugguccacccuccuccgcaccguccacuccauccucgacaccgucccccgcgccuuccucaaggagaucauccucgucgacgaccucucccagcagggccagcucaaguccgcccucuccgaguacgucgcccgccucgagggcgucaagcuccuccgcuccaacaagcgccucggcgccauccgcgcccgcaugcucggcgccacccgcgccaccggcgacguccucgucuucauggacgcccacugcgagugccaccccggcuggcucgagccccuccucucccgcaucgccggcgaccgcucccgcgucgucucccccgucaucgacgucaucgacuggaagaccuuccaguacuaccccuccaaggaccuccagcgcggcguccucgacuggaagcucgacuuccacugggagccccuccccgagcacguccgcaaggcccuccagucccccaucucccccauccgcucccccgucguccccggcgaggucgucgccauggaccgccacuacuuccagaacaccggcgccuacgacucccucaugucccuccgcggcggcgagaaccucgagcucuccuucaaggccuggcucugcggcggcuccgucgagauccuccccugcucccgcgucggccacaucuaccagaaccaggacucccacuccccccucgaccaggaggccacccuccgcaaccgcguccgcaucgccgagaccuggcucggcuccuucaaggagaccuucuacaagcacucccccgaggccuucucccucuccaaggccgagaagcccgacugcauggagcgccuccagcuccagcgccgccucggcugccgcaccuuccacugguuccucgccaacgucuaccccgagcucuaccccuccgagccccgccccuccuucuccggcaagcuccacaacaccggccucggccucugcgccgacugccaggccgagggcgacauccucggcugccccaugguccucgcccccugcuccgacucccgccagcagcaguaccuccagcacaccucccgcaaggagauccacuucggcuccccccagcaccucugcuucgccguccgccaggagcaggucauccuccagaacugcaccgaggagggccucgccauccaccagcagcacugggacuuccaggagaacggcaugaucguccacauccucuccggcaagugcauggaggccgucguccaggagaacaacaaggaccucuaccuccgccccugcgacggcaaggcccgccagcaguggcgcuucgaccagaucaacgccgucgacgagcgcuga

SEQ ID NO: 43486 - RNA, 1824 nt, Artificial Sequence
  derived and/or modified sequence opt2 from GALNT18__Homo_sapiens__NP_940918
auggucugcacccgcaagaccaagacccucgucuccaccugcgucauccucuccggcaugaccaacaucaucugccuccucuacgucggcugggucaccaacuacaucgccuccgucuacguccgcggccaggagcccgcccccgacaagaagcucgaggaggacaagggcgacacccucaagaucaucgagcgccucgaccaccucgagaacgucaucaagcagcacauccaggaggcccccgccaagcccgaggaggccgaggccgagcccuucaccgacuccucccucuucgcccacuggggccaggagcucucccccgagggccgccgcgucgcccucaagcaguuccaguacuacggcuacaacgccuaccucuccgaccgccucccccucgaccgcccccuccccgaccuccgccccuccggcugccgcaaccucuccuuccccgacucccuccccgaggucuccaucgucuucaucuucgucaacgaggcccucuccguccuccuccgcuccauccacuccgccauggagcgcacccccccccaccuccucaaggagaucauccucgucgacgacaacuccuccaacgaggagcucaaggagaagcucaccgaguacgucgacaaggucaacucccagaagcccggcuucaucaaggucguccgccacuccaagcaggagggccucauccgcucccgcgucuccggcuggcgcgccgccaccgcccccgucgucgcccucuucgacgcccacgucgaguucaacgucggcugggccgagcccguccucacccgcaucaaggagaaccgcaagcgcaucaucucccccuccuucgacaacaucaaguacgacaacuucgagaucgaggaguacccccucgccgcccagggcuucgacugggagcucuggugccgcuaccucaacccccccaaggccugguggaagcucgagaacuccaccgcccccauccgcucccccgcccucaucggcugcuucaucgucgaccgccaguacuuccaggagaucggccuccucgacgagggcauggaggucuacggcggcgagaacgucgagcucggcauccgcgucuggcagugcggcggcuccgucgagguccuccccugcucccgcaucgcccacaucgagcgcgcccacaagcccuacaccgaggaccucaccgcccacguccgccgcaacgcccuccgcgucgccgaggucuggauggacgaguucaagucccacgucuacauggccuggaacaucccccaggaggacuccggcaucgacaucggcgacaucaccgcccgcaaggcccuccgcaagcagcuccagugcaagaccuuccgcugguaccucgucuccgucuaccccgagaugcgcauguacuccgacaucaucgccuacggcguccuccagaacucccucaagaccgaccucugccucgaccagggccccgacaccgagaacguccccaucauguacaucugccacggcaugaccccccagaacgucuacuacaccuccucccagcagauccacgucggcauccucucccccaccgucgacgacgacgacaaccgcugccucgucgacgucaacucccgcccccgccucaucgagugcuccuacgccaaggccaagcgcaugaagcuccacuggcaguucucccagggcggccccauccagaaccgcaaguccaagcgcugccucgagcuccaggagaacuccgaccucgaguucggcuuccagcucguccuccagaagugcuccggccagcacugguccaucaccaacguccuccgcucccucgccuccuga

SEQ ID NO: 43487 - RNA, 1680 nt, Artificial Sequence
  derived and/or modified sequence opt2 from GALNT1__Homo_sapiens__XP_005258296
augcgcaaguucgccuacugcaaggucguccucgccaccucccucaucuggguccuccucgacauguuccuccuccucuacuucuccgagugcaacaagugcgacgagaagaaggagcgcggccuccccgccggcgacguccucgagcccguccagaagccccacgagggccccggcgagaugggcaagcccgucgucauccccaaggaggaccaggagaagaugaaggagauguucaagaucaaccaguucaaccucauggccuccgagaugaucgcccucaaccgcucccuccccgacguccgccucgagggcugcaagaccaaggucuaccccgacaaccuccccaccaccuccgucgucaucgucuuccacaacgaggccugguccacccuccuccgcaccguccacuccgucaucaaccgcuccccccgccacaugaucgaggagaucguccucgucgacgacgccuccgagcgcgacuuccucaagcgcccccucgaguccuacgucaagaagcucaagguccccguccacgucauccgcauggagcagcgcuccggccucauccgcgcccgccucaagggcgccgccgucuccaagggccaggucaucaccuuccucgacgcccacugcgagugcaccgucggcuggcucgagccccuccucgcccgcaucaagcacgaccgccgcaccgucgucugccccaucaucgacgucaucuccgacgacaccuucgaguacauggccggcuccgacaugaccuacggcggcuucaacuggaagcucaacuuccgcugguaccccgucccccagcgcgagauggaccgccgcaagggcgaccgcacccuccccguccgcacccccaccauggccggcggccucuucuccaucgaccgcgacuacuuccaggagaucggcaccuacgacgccggcauggacaucuggggcggcgagaaccucgagaucuccuuccgcaucuggcagugcggcggcacccucgagaucgucaccugcucccacgucggccacgucuuccgcaaggccacccccuacaccuuccccggcggcaccggccagaucaucaacaagaacaaccgccgccucgccgaggucuggauggacgaguucaagaacuucuucuacaucaucucccccggcgucaccaaggucgacuacggcgacaucuccucccgcgucggccuccgccacaagcuccagugcaagcccuucuccugguaccucgagaacaucuaccccgacucccagaucccccgccacuacuucucccucggcgagauccgcaacgucgagaccaaccagugccucgacaacauggcccgcaaggagaacgagaaggucggcaucuucaacugccacggcaugggcggcaaccaggucuucuccuacaccgccaacaaggagauccgcaccgacgaccucugccucgacgucuccaagcucaacggccccgucaccaugcucaagugccaccaccucaagggcaaccagcucugggaguacgaccccgucaagcucacccuccagcacgucaacuccaaccagugccucgacaaggccaccgaggaggacucccagguccccuccauccgcgacugcaacggcucccgcucccagcaguggcuccuccgcaacgucacccuccccgagaucuucuga

SEQ ID NO: 43488 - RNA, 1602 nt, Artificial Sequence
  derived and/or modified sequence opt2 from GALNT2__Homo_sapiens__NP_001278795
auggccgaccgcgaggacuggaacgagaucgaccccaucaagaagaaggaccuccaccacuccaacggcgaggagaaggcccaguccauggagacccucccccccggcaagguccgcuggcccgacuucaaccaggaggccuacgucggcggcaccaugguccgcuccggccaggaccccuacgcccgcaacaaguucaaccaggucgaguccgacaagcuccgcauggaccgcgccauccccgacacccgccacgaccagugccagcgcaagcaguggcgcgucgaccuccccgccaccuccgucgucaucaccuuccacaacgaggcccgcuccgcccuccuccgcaccgucgucuccguccucaagaagucccccccccaccucaucaaggagaucauccucgucgacgacuacuccaacgaccccgaggacggcgcccuccucggcaagaucgagaagguccgcguccuccgcaacgaccgccgcgagggccucaugcgcucccgcguccgcggcgccgacgccgcccaggccaagguccucaccuuccucgacucccacugcgagugcaacgagcacuggcucgagccccuccucgagcgcgucgccgaggaccgcacccgcgucgucucccccaucaucgacgucaucaacauggacaacuuccaguacgucggcgccuccgccgaccucaagggcggcuucgacuggaaccucgucuucaagugggacuacaugacccccgagcagcgccgcucccgccagggcaaccccgucgcccccaucaagacccccaugaucgccggcggccucuucgucauggacaaguucuacuucgaggagcucggcaaguacgacaugaugauggacgucuggggcggcgagaaccucgagaucuccuuccgcgucuggcagugcggcggcucccucgagaucauccccugcucccgcgucggccacgucuuccgcaagcagcaccccuacaccuuccccggcggcuccggcaccgucuucgcccgcaacacccgccgcgccgccgaggucuggauggacgaguacaagaacuucuacuacgccgccguccccuccgcccgcaacguccccuacggcaacauccagucccgccucgagcuccgcaagaagcucuccugcaagcccuucaagugguaccucgagaacgucuaccccgagcuccgcguccccgaccaccaggacaucgccuucggcgcccuccagcagggcaccaacugccucgacacccucggccacuucgccgacggcgucgucggcgucuacgagugccacaacgccggcggcaaccaggagugggcccucaccaaggagaaguccgucaagcacauggaccucugccucaccgucgucgaccgcgcccccggcucccucaucaagcuccagggcugccgcgagaacgacucccgccagaagugggagcagaucgagggcaacuccaagcuccgccacgucggcuccaaccucugccucgacucccgcaccgccaaguccggcggccucuccgucgaggucugcggccccgcccucucccagcaguggaaguucacccucaaccuccagcaguga

SEQ ID NO: 43489 - RNA, 1902 nt, Artificial Sequence
  derived and/or modified sequence opt2 from GALNT3__Homo_sapiens__NP_004473
auggcccaccucaagcgccucgucaagcuccacaucaagcgccacuaccacaagaaguucuggaagcucggcgccgucaucuucuucuucaucaucguccucguccucaugcagcgcgaggucuccguccaguacuccaaggaggagucccgcauggagcgcaacaugaagaacaagaacaagaugcucgaccucaugcucgaggccgucaacaacaucaaggacgccaugcccaagaugcagaucggcgcccccguccgccagaacaucgacgccggcgagcgccccugccuccagggcuacuacaccgccgccgagcucaagcccguccucgaccgccccccccaggacuccaacgcccccggcgccuccggcaaggccuucaagaccaccaaccucuccgucgaggagcagaaggagaaggagcgcggcgaggccaagcacugcuucaacgccuucgccuccgaccgcaucucccuccaccgcgaccucggccccgacacccgcccccccgagugcaucgagcagaaguucaagcgcugccccccccuccccaccaccuccgucaucaucgucuuccacaacgaggccugguccacccuccuccgcaccguccacuccguccucuacuccucccccgccauccuccucaaggagaucauccucgucgacgacgccuccgucgacgaguaccuccacgacaagcucgacgaguacgucaagcaguucuccaucgucaagaucguccgccagcgcgagcgcaagggccucaucaccgcccgccuccucggcgccaccgucgccaccgccgagacccucaccuuccucgacgcccacugcgagugcuucuacggcuggcucgagccccuccucgcccgcaucgccgagaacuacaccgccgucgucucccccgacaucgccuccaucgaccucaacaccuucgaguucaacaagcccucccccuacggcuccaaccacaaccgcggcaacuucgacuggucccucuccuucggcugggagucccuccccgaccacgagaagcagcgccgcaaggacgagaccuaccccaucaagacccccaccuucgccggcggccucuucuccaucuccaaggaguacuucgaguacaucggcuccuacgacgaggagauggagaucuggggcggcgagaacaucgagauguccuuccgcgucuggcagugcggcggccagcucgagaucaugcccugcuccgucgucggccacgucuuccgcuccaaguccccccacuccuuccccaagggcacccaggucaucgcccgcaaccagguccgccucgccgaggucuggauggacgaguacaaggagaucuucuaccgccgcaacaccgacgccgccaagaucgucaagcagaaggccuucggcgaccucuccaagcgcuucgagaucaagcaccgccuccagugcaagaacuucaccugguaccucaacaacaucuaccccgaggucuacguccccgaccucaaccccgucaucuccggcuacaucaaguccgucggccagccccucugccucgacgucggcgagaacaaccagggcggcaagccccucaucauguacaccugccacggccucggcggcaaccaguacuucgaguacuccgcccagcacgagauccgccacaacauccagaaggagcucugccuccacgccgcccagggccucguccagcucaaggccugcaccuacaagggccacaagaccgucgucaccggcgagcagaucugggagauccagaaggaccagcuccucuacaaccccuuccucaagaugugccucuccgccaacggcgagcaccccucccucgucuccugcaaccccuccgacccccuccagaaguggauccucucccagaacgacuga

SEQ ID NO: 43490 - RNA, 1737 nt, Artificial Sequence
  derived and/or modified sequence opt2 from GALNT4__Homo_sapiens__NP_003765
auggccguccgcuggaccugggccggcaaguccugccuccuccucgccuuccucaccgucgccuacaucuucgucgagcuccucgucuccaccuuccacgccuccgccggcgccggccgcgcccgcgagcucggcucccgccgccucuccgaccuccagaagaacaccgaggaccucucccgcccccucuacaagaagccccccgccgacucccgcgcccucggcgaguggggcaaggccuccaagcuccagcucaacgaggacgagcucaagcagcaggaggagcucaucgagcgcuacgccaucaacaucuaccucuccgaccgcaucucccuccaccgccacaucgaggacaagcgcauguacgagugcaagucccagaaguucaacuaccgcacccuccccaccaccuccgucaucaucgccuucuacaacgaggccugguccacccuccuccgcaccauccacuccguccucgagaccucccccgccguccuccucaaggagaucauccucgucgacgaccucuccgaccgcgucuaccucaagacccagcucgagaccuacaucuccaaccucgaccgcguccgccucauccgcaccaacaagcgcgagggccucguccgcgcccgccucaucggcgccaccuucgccaccggcgacguccucaccuuccucgacugccacugcgagugcaacuccggcuggcucgagccccuccucgagcgcaucggccgcgacgagaccgccgucgucugccccgucaucgacaccaucgacuggaacaccuucgaguucuacaugcagaucggcgagcccaugaucggcggcuucgacuggcgccucaccuuccaguggcacuccguccccaagcaggagcgcgaccgccgcaucucccgcaucgaccccauccgcucccccaccauggccggcggccucuucgccgucuccaagaaguacuuccaguaccucggcaccuacgacaccggcauggaggucuggggcggcgagaaccucgagcucuccuuccgcgucuggcagugcggcggcaagcucgagauccaccccugcucccacgucggccacgucuuccccaagcgcgcccccuacgcccgccccaacuuccuccagaacaccgcccgcgccgccgaggucuggauggacgaguacaaggagcacuucuacaaccgcaacccccccgcccgcaaggaggccuacggcgacaucuccgagcgcaagcuccuccgcgagcgccuccgcugcaaguccuucgacugguaccucaagaacgucuuccccaaccuccacguccccgaggaccgccccggcuggcacggcgccauccgcucccgcggcaucuccuccgagugccucgacuacaacucccccgacaacaaccccaccggcgccaaccucucccucuucggcugccacggccagggcggcaaccaguucuucgaguacaccuccaacaaggagauccgcuucaacuccgucaccgagcucugcgccgagguccccgagcagaagaacuacgucggcaugcagaacugccccaaggacggcuuccccguccccgccaacaucaucuggcacuucaaggaggacggcaccaucuuccacccccacuccggccucugccucuccgccuaccgcacccccgagggccgccccgacguccagaugcgcaccugcgacgcccucgacaagaaccagaucugguccuucgagaaguga

SEQ ID NO: 43491 - RNA, 2823 nt, Artificial Sequence
  derived and/or modified sequence opt2 from GALNT5__Homo_sapiens__NP_055383
augaaccgcauccgcaaguucuuccgcggcuccggccgcguccucgccuucaucuucgucgccuccgucaucuggcuccucuucgacauggccgcccuccgccucuccuucuccgagaucaacacccgcgucaucaaggaggacaucguccgccgcgagcgcaucggcuuccgcguccagcccgaccagggcaagaucuucuacuccuccaucaaggagaugaagcccccccuccgcggccacggcaagggcgccuggggcaaggagaacguccgcaagaccgaggaguccguccucaaggucgaggucgaccucgaccagacccagcgcgagcgcaagaugcagaacgcccucggccgcggcaaggucgucccccucuggcaccccgcccaccuccagacccuccccgucacccccaacaagcagaagaccgacggccgcggcaccaagcccgaggccuccucccaccagggcacccccaagcagaccaccgcccagggcgcccccaagaccuccuucaucgccgccaagggcacccaggucgucaagaucuccguccacaugggccgcgucucccucaagcaggagccccgcaagucccacucccccuccuccgacaccuccaagcucgccgccgagcgcgaccucaacgucaccaucucccucuccaccgaccgccccaagcagcgcucccaggccgucgccaacgagcgcgcccaccccgccuccaccgccguccccaaguccggcgaggccauggcccucaacaagaccaagacccaguccaaggaggucaacgccaacaagcacaaggccaacaccucccuccccuuccccaaguucaccgucaacuccaaccgccuccgcaagcaguccaucaacgagaccccccucggcucccucuccaaggacgacggcgcccgcggcgcccacggcaagaagcucaacuucuccgagucccaccucgucaucaucaccaaggaggaggagcagaaggccgaccccaaggaggucuccaacuccaagaccaagaccaucuuccccaagguccucggcaagucccaguccaagcacaucucccgcaaccgcuccgagauguccuccuccucccucgccccccaccgcgucccccucucccagaccaaccacgcccucaccggcggccucgagcccgccaagaucaacaucaccgccaaggcccccuccaccgaguacaaccagucccacaucaaggcccuccuccccgaggacuccggcacccaccagguccuccgcaucgacgucacccucuccccccgcgaccccaaggcccccggccaguucggccgccccgucgucgucccccacggcaaggagaaggaggccgagcgccgcuggaaggagggcaacuucaacgucuaccucuccgaccucauccccgucgaccgcgccaucgaggacacccgccccgccggcugcgccgagcagcucguccacaacaaccuccccaccaccuccgucaucaugugcuucgucgacgaggucugguccacccuccuccgcuccguccacuccgucaucaaccgcucccccccccaccucaucaaggagauccuccucgucgacgacuucuccaccaaggacuaccucaaggacaaccucgacaaguacaugucccaguuccccaagguccgcauccuccgccucaaggagcgccacggccucauccgcgcccgccucgccggcgcccagaacgccaccggcgacguccucaccuuccucgacucccacgucgagugcaacgucggcuggcucgagccccuccucgagcgcgucuaccucucccgcaagaaggucgccugccccgucaucgaggucaucaacgacaaggacauguccuacaugaccgucgacaacuuccagcgcggcaucuucgucuggcccaugaacuucggcuggcgcaccaucccccccgacgucaucgccaagaaccgcaucaaggagaccgacaccauccgcugccccgucauggccggcggccucuucuccaucgacaaguccuacuucuucgagcucggcaccuacgaccccggccucgacgucuggggcggcgagaacauggagcucuccuucaaggucuggaugugcggcggcgagaucgagaucauccccugcucccgcgucggccacaucuuccgcaacgacaaccccuacuccuuccccaaggaccgcaugaagaccgucgagcgcaaccucguccgcgucgccgaggucuggcucgacgaguacaaggagcucuucuacggccacggcgaccaccucaucgaccagggccucgacgucggcaaccucacccagcagcgcgagcuccgcaagaagcucaagugcaaguccuucaagugguaccucgagaacgucuuccccgaccuccgcgcccccaucguccgcgccuccggcguccucaucaacgucgcccucggcaagugcaucuccaucgagaacaccaccgucauccucgaggacugcgacggcuccaaggagcuccagcaguucaacuacaccuggcuccgccucaucaagugcggcgaguggugcaucgcccccauccccgacaagggcgccguccgccuccaccccugcgacaaccgcaacaagggccucaaguggcuccacaaguccaccuccgucuuccaccccgagcucgucaaccacaucgucuucgagaacaaccagcagcuccucugccucgagggcaacuucucccagaagauccucaaggucgccgccugcgaccccgucaagcccuaccagaaguggaaguucgagaaguacuacgaggccuga

SEQ ID NO: 43492 - RNA, 1869 nt, Artificial Sequence
  derived and/or modified sequence opt2 from GALNT6__Homo_sapiens__XP_006719277
augcgccuccuccgccgccgccacaugccccuccgccucgccauggucggcugcgccuucguccucuuccucuuccuccuccaccgcgacgucuccucccgcgaggaggccaccgagaagcccuggcucaagucccucgucucccgcaaggaccacguccucgaccucaugcucgaggccaugaacaaccuccgcgacuccaugcccaagcuccagauccgcgcccccgaggcccagcagacccucuucuccaucaaccaguccugccuccccggcuucuacacccccgccgagcucaagcccuucugggagcgccccccccaggaccccaacgcccccggcgccgacggcaaggccuuccagaaguccaaguggaccccccucgagacccaggagaaggaggagggcuacaagaagcacugcuucaacgccuucgccuccgaccgcaucucccuccagcgcucccucggccccgacacccgcccccccgagugcgucgaccagaaguuccgccgcugccccccccucgccaccaccuccgucaucaucgucuuccacaacgaggccugguccacccuccuccgcaccgucuacuccguccuccacaccacccccgccauccuccucaaggagaucauccucgucgacgacgccuccaccgaggagcaccucaaggagaagcucgagcaguacgucaagcagcuccaggucguccgcgucguccgccaggaggagcgcaagggccucaucaccgcccgccuccucggcgccuccgucgcccaggccgagguccucaccuuccucgacgcccacugcgagugcuuccacggcuggcucgagccccuccucgcccgcaucgccgaggacaagaccgucgucgucucccccgacaucgucaccaucgaccucaacaccuucgaguucgccaagcccguccagcgcggccgcguccacucccgcggcaacuucgacuggucccucaccuucggcugggagacccuccccccccacgagaagcagcgccgcaaggacgagaccuaccccaucaagucccccaccuucgccggcggccucuucuccaucuccaaguccuacuucgagcacaucggcaccuacgacaaccagauggagaucuggggcggcgagaacgucgagauguccuuccgcgucuggcagugcggcggccagcucgagaucauccccugcuccgucgucggccacgucuuccgcaccaaguccccccacaccuuccccaagggcaccuccgucaucgcccgcaaccagguccgccucgccgaggucuggauggacuccuacaagaagaucuucuaccgccgcaaccuccaggccgccaagauggcccaggagaaguccuucggcgacaucuccgagcgccuccagcuccgcgagcagcuccacugccacaacuucuccugguaccuccacaacgucuaccccgagauguucguccccgaccucacccccaccuucuacggcgccaucaagaaccucggcaccaaccagugccucgacgucggcgagaacaaccgcggcggcaagccccucaucauguacuccugccacggccucggcggcaaccaguacuucgaguacaccacccagcgcgaccuccgccacaacaucgccaagcagcucugccuccacgucuccaagggcgcccucggccucggcuccugccacuucaccggcaagaacucccagguccccaaggacgaggagugggagcucgcccaggaccagcucauccgcaacuccggcuccggcaccugccucaccucccaggacaagaagcccgccauggcccccugcaaccccuccgacccccaccagcucuggcucuucgucuga

SEQ ID NO: 43493 - RNA, 1974 nt, Artificial Sequence
  derived and/or modified sequence opt2 from GALNT7__Homo_sapiens__NP_059119
augcgccucaagaucggcuucauccuccgcucccuccucgucgucggcuccuuccucggccucgucguccucugguccucccucaccccccgccccgacgaccccuccccccucucccgcaugcgcgaggaccgcgacgucaacgaccccaugcccaaccgcggcggcaacggccucgcccccggcgaggaccgcuucaagcccgucguccccuggccccacgucgagggcgucgaggucgaccucgaguccauccgccgcaucaacaaggccaagaacgagcaggagcaccacgccggcggcgacucccagaaggacaucaugcagcgccaguaccucaccuucaagccccagaccuucaccuaccacgaccccguccuccgccccggcauccucggcaacuucgagcccaaggagcccgagccccccggcgucgucggcggccccggcgagaaggccaagccccucguccucggccccgaguucaagcaggccauccaggccuccaucaaggaguucggcuucaacauggucgccuccgacaugaucucccucgaccgcuccgucaacgaccuccgccaggaggagugcaaguacuggcacuacgacgagaaccuccucaccuccuccgucgucaucgucuuccacaacgagggcugguccacccucaugcgcaccguccacuccgucaucaagcgcaccccccgcaaguaccucgccgagaucguccucaucgacgacuucuccaacaaggagcaccucaaggagaagcucgacgaguacaucaagcucuggaacggccucgucaaggucuuccgcaacgagcgccgcgagggccucauccaggcccgcuccaucggcgcccagaaggccaagcucggccagguccucaucuaccucgacgcccacugcgaggucgccgucaacugguacgccccccucgucgcccccaucuccaaggaccgcaccaucugcaccgucccccucaucgacgucaucaacggcaacaccuacgagaucaucccccagggcggcggcgacgaggacggcuacgcccgcggcgccugggacugguccaugcucuggaagcgcgucccccucaccccccaggagaagcgccuccgcaagaccaagaccgagcccuaccgcucccccgccauggccggcggccucuucgccaucgagcgcgaguucuucuucgagcucggccucuacgaccccggccuccagaucuggggcggcgagaacuucgagaucuccuacaagaucuggcagugcggcggcaagcuccucuucguccccugcucccgcgucggccacaucuaccgccucgagggcuggcagggcaaccccccccccaucuacgucggcuccucccccacccucaagaacuacguccgcgucgucgaggucuggugggacgaguacaaggacuacuucuacgccucccgccccgagucccaggcccuccccuacggcgacaucuccgagcucaagaaguuccgcgaggaccacaacugcaaguccuucaagugguucauggaggagaucgccuacgacaucaccucccacuacccccucccccccaagaacgucgacuggggcgagauccgcggcuucgagaccgccuacugcaucgacuccaugggcaagaccaacggcggcuucgucgagcucggccccugccaccgcaugggcggcaaccagcucuuccgcaucaacgaggccaaccagcucaugcaguacgaccagugccucaccaagggcgccgacggcuccaaggucaugaucacccacugcaaccucaacgaguucaaggaguggcaguacuucaagaaccuccaccgcuucacccacauccccuccggcaagugccucgaccgcuccgagguccuccaccaggucuucaucuccaacugcgacuccuccaagaccacccagaagugggagaugaacaacauccacuccgucuga

SEQ ID NO: 43494 - RNA, 1914 nt, Artificial Sequence
  derived and/or modified sequence opt2 from GALNT8__Homo_sapiens__NP_059113
augauguucuggcgcaagcuccccaaggcccucuucaucggccucacccucgccaucgccgucaaccuccuccucgucuucuccuccaagggcacccuccagaaccucuucaccggcggccuccaccgcgagcucccccuccaccucaacaagcgcuacggcgccgucaucaagcgccucucccaccucgaggucgagcuccaggaccucaaggaguccaugaagcucgcccuccgccagcaggagaacgucaacuccacccucaagcgcgccaaggacgagguccgcccccuccucaaggccauggagaccaaggucaacgagaccaagaagcacaagacccagaugaagcucuucccccacucccagcucuuccgccaguggggcgaggaccucuccgaggcccagcagaaggccgcccaggaccucuuccgcaaguucggcuacaacgccuaccucuccaaccagcucccccucaaccgcaccauccccgacacccgcgacuaccgcugccuccgcaagaccuaccccucccagcuccccucccucuccgucauccucaucuucgucaacgaggcccucuccaucauccagcgcgccaucaccuccaucaucaaccgcacccccucccgccuccucaaggagaucauccucgucgacgacuucuccuccaacggcgagcucaagguccaccucgacgagaagaucaagcucuacaaccagaaguaccccggccuccucaagaucauccgccaccccgagcgcaagggccucgcccaggcccgcaacaccggcugggaggccgccaccgccgacgucgucgccauccucgacgcccacaucgaggucaacgucggcugggccgagcccauccucgcccgcauccaggaggaccgcaccgucaucgucucccccgucuucgacaacauccgcuucgacaccuucaagcucgacaaguacgagcucgccgucgacggcuucaacugggagcucuggugccgcuacgacgcccucccccaggccuggaucgaccuccacgacgucaccgcccccgucaagucccccuccaucaugggcauccucgccgccaaccgccacuuccucggcgagaucggcucccucgacggcggcaugcucaucuacggcggcgagaacgucgagcucucccuccgcgucuggcagugcggcggcaaggucgagauccuccccugcucccgcaucgcccaccucgagcgccaccacaagcccuacgcccucgaccucaccgccgcccucaagcgcaacgcccuccgcgucgccgagaucuggauggacgagcacaagcacauggucuaccucgccuggaacaucccccuccagaacuccggcaucgacuucggcgacgucuccucccgcauggcccuccgcgagaagcucaagugcaagaccuucgacugguaccucaagaacgucuacccccuccucaagccccuccacaccaucgucggcuacggccgcaugaagaaccuccucgacgagaacgucugccucgaccagggccccguccccggcaacacccccaucauguacuacugccacgaguucuccucccagaacgucuacuaccaccucaccggcgagcucuacgucggccagcucaucgccgaggccuccgccuccgaccgcugccucaccgaccccggcaaggccgagaagcccacccucgagcccugcuccaaggccgccaagaaccgccuccacaucuacugggacuucaagcccggcggcgccgucaucaaccgcgacaccaagcgcugccucgagaugaagaaggaccuccucggcucccacguccucguccuccagaccugcuccacccaggucugggagauccagcacaccguccgcgacuggggccagaccaacucccaguga

SEQ ID NO: 43495 - RNA, 1812 nt, Artificial Sequence
  derived and/or modified sequence opt2 from GALNT9__Homo_sapiens__NP_001116108
auggccgucgcccgcaagauccgcacccuccucaccgucaacauccucgucuucgucggcaucguccucuucuccgucuacugccgccuccagggccgcucccaggagcucguccgcaucgucuccggcgaccgccgcguccgcucccgccacgccaaggucggcacccucggcgaccgcgaggccauccuccagcgccucgaccaccucgaggaggucgucuacaaccagcucaacggccucgccaagcccaucggccucgucgagggccccggcggccucggccagggcggccucgccgccacccuccgcgacgacggccaggaggccgagggcaaguacgaggaguacggcuacaacgcccagcucuccgaccgcaucucccucgaccgcuccauccccgacuaccgcccccgcaagugccgccagauguccuacgcccaggaccucccccaggucuccgucgucuucaucuucgucaacgaggcccucuccgucauccuccgcuccguccacuccgucgucaaccacacccccucccagcuccucaaggaggucauccucgucgacgacaacuccgacaacgucgagcucaaguucaaccucgaccaguacgucaacaagcgcuaccccggccucgucaagaucguccgcaacucccgccgcgagggccucauccgcgcccgccuccagggcuggaaggccgccaccgcccccgucgucggcuucuucgacgcccacgucgaguucaacaccggcugggccgagcccgcccucucccgcauccgcgaggaccgccgccgcaucguccuccccgccaucgacaacaucaaguacuccaccuucgagguccagcaguacgccaacgccgcccacggcuacaacuggggccucuggugcauguacaucauccccccccaggacuggcucgaccgcggcgacgaguccgcccccauccgcacccccgccaugaucggcugcuccuucgucgucgaccgcgaguacuucggcgacaucggccuccucgaccccggcauggaggucuacggcggcgagaacgucgagcucggcaugcgcgucuggcagugcggcggcuccauggagguccuccccugcucccgcgucgcccacaucgagcgcacccgcaagcccuacaacaacgacaucgacuacuacgccaagcgcaacgcccuccgcgccgccgaggucuggauggacgacuucaagucccacgucuacauggccuggaacauccccauguccaaccccggcgucgacuucggcgacgucuccgagcgccucgcccuccgccagcgccucaagugccgcuccuucaagugguaccucgagaacgucuaccccgagaugcgcgucuacaacaacacccucaccuacggcgagguccgcaacuccaaggccuccgccuacugccucgaccagggcgccgaggacggcgaccgcgccauccucuaccccugccacggcauguccucccagcucguccgcuacuccgccgacggccuccuccagcucggcccccucggcuccaccgccuuccuccccgacuccaagugccucgucgacgacggcaccggccgcaugcccacccucaagaagugcgaggacgucgcccgccccacccagcgccucugggacuucacccaguccggccccaucgucucccgcgccaccggccgcugccucgaggucgagauguccaaggacgccaacuucggccuccgccucgucguccagcgcugcuccggccagaaguggaugauccgcaacuggaucaagcacgcccgccacuga

SEQ ID NO: 43496 - RNA, 1806 nt, Artificial Sequence
  derived and/or modified sequence opt2 from GALNTL6__Homo_sapiens__NP_001030017
augaagcgcaagcagaagcgcuuccuccagaugacccuccucuucaccgucgcccucaucuuccuccccaacgucggccucuggucccucuacaaggacaagcaccucgucaaguccgccgagcccggcgagcagcagaccuucccccucggccucggcgacggccaguucuacuccuggaccgacggccuccgccgcaaggacuggcacgacuacgaguccauccagaaggaggccaugcgcuccggcaagggcgagcacggcaagcccuacccccucaccgaggaggaccacgacgacuccgccuaccgcgagaacggcuucaacaucuucgucuccaacaacaucgcccucgagcgcucccuccccgacauccgccacgccaacugcaagcacaagauguaccucgagcgccuccccaacaccuccaucaucauccccuuccacaacgagggcuggaccucccuccuccgcaccauccacuccaucaucaaccgcacccccggcucccucaucgccgagaucauccucgucgacgacuucuccgagcgcgagcaccucaaggacaagcucgaggaguacauggcccgcuucuccaagguccgcaucguccgcaccaagaagcgcgagggccucauccgcacccgccuccucggcgccuccauggcccgcggcgagguccucaccuuccucgacucccacugcgaggucaacgucaacuggcuccccccccuccucaaccagaucgcccucaaccacaagaccaucgucugccccaugaucgacgucaucgaccacaaccacuucggcuacgaggcccaggccggcgacgccaugcgcggcgccuucgacugggagauguacuacaagcgcauccccaucccccccgagcuccagcgcgccgaccccuccgaccccuucgagucccccgucauggccggcggccucuucgccgucgaccgcaagugguucugggagcucggcggcuacgaccccggccucgagaucuggggcggcgagcaguacgagaucuccuucaaggucuggaugugcggcggcgagauguucgacguccccugcucccgcgucggccacaucuaccgcaaguacguccccuacaagguccccuccggcaccucccucgcccgcaaccucaagcgcgucgccgagaccuggauggacgaguucgccgaguacaucuaccagcgccgccccgaguaccgccaccucuccaccggcgacaucuccgcccagaaggagcuccgcaagcagcucaagugcaaggacuucaagugguucauggccgccgucgccugggacguccccaaguacuacccccccgucgagcccccccccgccgccuggggcgagauccgcaacgucgccgccaaccucugcgucgacuccaagcacggcgccaccggcaccgagcuccgccucgacaucugcgucaaggacggcuccgagcgcaccuggucccacgagcagcucuucaccuucggcuggcgcgaggacauccgccccggcgagccccuccacacccgcaaguucugcuucgacgccaucucccacaacucccccgucacccucuacgacugccacggcaugaagggcaaccagcucuggggcuaccgcaaggaccgcacccucuuccaccccgucuccaacuccugcauggacugcaaccccgccgagaagaagaucuucauggcccgcugcgacccccucuccgagacccagcaguggaucuucgagcacaucaacaugaccguccucgagaaguucaaccaccacgccaacuccuga

SEQ ID NO: 43497 - RNA, 150 nt, Artificial Sequence
  derived and/or modified sequence opt2 from GALP__Homo_sapiens__NP_001139018
auggccccccccuccgucccccucguccuccuccucguccuccuccucucccucgccgagacccccgccuccgcccccgcccaccgcuccuccaccuuccccaagugggucaccaagaccgagcgcggccgccagccccuccgcuccuga

SEQ ID NO: 43498 - RNA, 1050 nt, Artificial Sequence
  derived and/or modified sequence opt2 from GALR1__Homo_sapiens__NP_001471
auggagcucgccgucggcaaccucuccgagggcaacgccuccuggcccgagccccccgcccccgagcccggcccccucuucggcaucggcgucgagaacuucgucacccucgucgucuucggccucaucuucgcccucggcguccucggcaacucccucgucaucaccguccucgcccgcuccaagcccggcaagccccgcuccaccaccaaccucuucauccucaaccucuccaucgccgaccucgccuaccuccucuucugcauccccuuccaggccaccgucuacgcccuccccaccuggguccucggcgccuucaucugcaaguucauccacuacuucuucaccgucuccaugcucgucuccaucuucacccucgccgccauguccgucgaccgcuacgucgccaucguccacucccgccgcuccuccucccuccgcgucucccgcaacgcccuccucggcgucggcugcaucugggcccucuccaucgccauggccucccccgucgccuaccaccagggccucuuccacccccgcgccuccaaccagaccuucugcugggagcaguggcccgacccccgccacaagaaggccuacgucgucugcaccuucgucuucggcuaccuccucccccuccuccucaucugcuucugcuacgccaagguccucaaccaccuccacaagaagcucaagaacauguccaagaaguccgaggccuccaagaagaagaccgcccagaccguccucgucgucgucgucgucuucggcaucuccuggcucccccaccacaucauccaccucugggccgaguucggcgucuucccccucacccccgccuccuuccucuuccgcaucaccgcccacugccucgccuacuccaacuccuccgucaaccccaucaucuacgccuuccucuccgagaacuuccgcaaggccuacaagcaggucuucaagugccacauccgcaaggacucccaccucuccgacaccaaggaguccaagucccgcaucgacaccccccccuccaccaacugcacccacgucuga

SEQ ID NO: 43499 - RNA, 1164 nt, Artificial Sequence
  derived and/or modified sequence opt2 from GALR2__Homo_sapiens__NP_003848
augaacgucuccggcugccccggcgccggcaacgccucccaggccggcggcggcggcggcuggcaccccgaggccgucaucgucccccuccucuucgcccucaucuuccucgucggcaccgucggcaacacccucguccucgccguccuccuccgcggcggccaggccgucuccaccaccaaccucuucauccucaaccucggcgucgccgaccucugcuucauccucugcugcguccccuuccaggccaccaucuacacccucgacggcugggucuucggcucccuccucugcaaggccguccacuuccucaucuuccucaccaugcacgccuccuccuucacccucgccgccgucucccucgaccgcuaccucgccauccgcuacccccuccacucccgcgagcuccgcaccccccgcaacgcccucgccgccaucggccucaucuggggccucucccuccucuucuccggccccuaccucuccuacuaccgccagucccagcucgccaaccucaccgucugccaccccgccugguccgccccccgccgccgcgccauggacaucugcaccuucgucuucuccuaccuccuccccguccucguccucggccucaccuacgcccgcacccuccgcuaccucuggcgcgccgucgaccccgucgccgccggcuccggcgcccgccgcgccaagcgcaaggucacccgcaugauccucaucgucgccgcccucuucugccucugcuggaugccccaccacgcccucauccucugcgucugguucggccaguucccccucacccgcgccaccuacgcccuccgcauccucucccaccucgucuccuacgccaacuccugcgucaaccccaucgucuacgcccucgucuccaagcacuuccgcaagggcuuccgcaccaucugcgccggccuccucggccgcgcccccggccgcgccuccggccgcgucugcgccgccgcccgcggcacccacuccggcuccguccucgagcgcgaguccuccgaccuccuccacauguccgaggccgccggcgcccuccgccccugccccggcgccucccagcccugcauccucgagcccugccccggccccuccuggcagggccccaaggccggcgacuccauccucaccgucgacgucgccuga

SEQ ID NO: 43500 - RNA, 1107 nt, Artificial Sequence
  derived and/or modified sequence opt2 from GALR3__Homo_sapiens__XP_011528770
auggccgacgcccagaacaucucccucgacucccccggcuccgucggcgccgucgccguccccgucgucuucgcccucaucuuccuccucggcaccgucggcaacggccucguccucgccguccuccuccagcccggccccuccgccuggcaggagcccggcuccaccaccgaccucuucauccucaaccucgccgucgccgaccucugcuucauccucugcugcguccccuuccaggccaccaucuacacccucgacgccuggcucuucggcgcccucgucugcaaggccguccaccuccucaucuaccucaccauguacgccuccuccuucacccucgccgccgucuccgucgaccgcuaccucgccguccgccacccccuccgcucccgcgcccuccgcaccccccgcaacgcccgcgccgccgucggccucgucuggcuccucgccgcccucuucuccgcccccuaccucuccuacuacggcaccguccgcuacggcgcccucgagcucugcguccccgccugggaggacgcccgccgccgcgcccucgacgucgccaccuucgccgccggcuaccuccuccccgucgccgucgucucccucgccuacggccgcacccuccgcuuccucugggccgccgucggccccgccggcgccgccgccgccgaggcccgccgccgcgccaccggccgcgccggccgcgccaugcucgccgucgccgcccucuacgcccucugcuggggcccccaccacgcccucauccucugcuucugguacggccgcuucgccuucucccccgccaccuacgccugccgccucgccucccacugccucgccuacgccaacuccugccucaacccccucgucuacgcccucgccucccgccacuuccgcgcccgcuuccgccgccucuggcccugcggccgccgccgccgccaccgcgcccgccgcgcccuccgccgcguccgccccgccuccuccggcccccccggcugccccggcgacgcccgccccuccggccgccuccucgccggcggcggccagggccccgagccccgcgagggccccguccacggcggcgaggccgcccgcggccccgaguga

SEQ ID NO: 43501 - RNA, 1140 nt, Artificial Sequence
  derived and/or modified sequence opt2 from GALT__Homo_sapiens__NP_000146
augucccgcuccggcaccgacccccagcagcgccagcaggccuccgaggccgacgccgccgccgccaccuuccgcgccaacgaccaccagcacauccgcuacaacccccuccaggacgaguggguccucgucuccgcccaccgcaugaagcgccccuggcagggccaggucgagccccagcuccucaagaccgucccccgccacgacccccucaacccccucugccccggcgccauccgcgccaacggcgaggucaacccccaguacgacuccaccuuccucuucgacaacgacuuccccgcccuccagcccgacgcccccucccccggccccuccgaccacccccucuuccaggccaaguccgcccgcggcgucugcaaggucaugugcuuccaccccugguccgacgucacccucccccucauguccguccccgagauccgcgccgucgucgacgccugggccuccgucaccgaggagcucggcgcccaguaccccuggguccagaucuucgagaacaagggcgccaugaugggcugcuccaacccccacccccacugccaggucugggccuccuccuuccuccccgacaucgcccagcgcgaggagcgcucccagcaggccuacaagucccagcacggcgagccccuccucauggaguacucccgccaggagcuccuccgcaaggagcgccucguccucaccuccgagcacuggcucguccucguccccuucugggccaccuggcccuaccagacccuccuccucccccgccgccacguccgccgccuccccgagcucacccccgccgagcgcgacgaccucgccuccaucaugaagaagcuccucaccaaguacgacaaccucuucgagaccuccuuccccuacuccaugggcuggcacggcgcccccaccggcuccgaggccggcgccaacuggaaccacuggcagcuccacgcccacuacuaccccccccuccuccgcuccgccaccguccgcaaguucauggucggcuacgagaugcucgcccaggcccagcgcgaccucacccccgagcaggccgccgagcgccuccgcgcccuccccgagguccacuaccaccucggccagaaggaccgcgagaccgccaccaucgccuga

SEQ ID NO: 43502 - RNA, 711 nt, Artificial Sequence
  derived and/or modified sequence opt2 from GAMT__Homo_sapiens__NP_000147
auguccgcccccuccgccacccccaucuucgcccccggcgagaacugcucccccgccuggggcgccgcccccgccgccuacgacgccgccgacacccaccuccgcauccucggcaagcccgucauggagcgcugggagacccccuacaugcacgcccucgccgccgccgccuccuccaagggcggccgcguccucgaggucggcuucggcauggccaucgccgccuccaagguccaggaggcccccaucgacgagcacuggaucaucgagugcaacgacggcgucuuccagcgccuccgcgacugggccccccgccagacccacaaggucaucccccucaagggccucugggaggacgucgcccccacccuccccgacggccacuucgacggcauccucuacgacaccuacccccucuccgaggagaccuggcacacccaccaguucaacuucaucaagaaccacgccuuccgccuccucaagcccggcggcguccucaccuacugcaaccucaccuccuggggcgagcucaugaaguccaaguacuccgacaucaccaucauguucgaggagacccagguccccgcccuccucgaggccggcuuccgccgcgagaacauccgcaccgaggucauggcccucgucccccccgccgacugccgcuacuacgccuucccccagaugaucaccccccucgucaccaagggcuga

SEQ ID NO: 43503 - RNA, 2544 nt, Artificial Sequence
  derived and/or modified sequence opt2 from GANAB__Homo_sapiens__NP_001265123
augacccgcuuccgcaucgacgagcucgagccccgccgcccccgcuaccgcguccccgacguccucgucgccgacccccccaucgcccgccucuccgucuccggccgcgacgagaacuccgucgagcucaccauggccgagggccccuacaagaucauccucaccgcccgccccuuccgccucgaccuccucgaggaccgcucccuccuccucuccgucaacgcccgcggccuccucgaguucgagcaccagcgcgccccccgcgucucccagggcuccaaggaccccgccgagggcgacggcgcccagcccgaggagaccccccgcgacggcgacaagcccgaggagacccagggcaaggccgagaaggacgagcccggcgccugggaggagaccuucaagacccacuccgacuccaagcccuacggccccauguccgucggccucgacuucucccuccccggcauggagcacgucuacggcauccccgagcacgccgacaaccuccgccucaaggucaccgagggcggcgagcccuaccgccucuacaaccucgacgucuuccaguacgagcucuacaaccccauggcccucuacggcuccguccccguccuccucgcccacaacccccaccgcgaccucggcaucuucuggcucaacgccgccgagaccugggucgacaucuccuccaacaccgccggcaagacccucuucggcaagaugauggacuaccuccagggcuccggcgagaccccccagaccgacguccgcuggauguccgagaccggcaucaucgacgucuuccuccuccucggccccuccaucuccgacgucuuccgccaguacgccucccucaccggcacccaggcccuccccccccucuucucccucggcuaccaccagucccgcuggaacuaccgcgacgaggccgacguccucgaggucgaccagggcuucgacgaccacaaccuccccugcgacgucaucuggcucgacaucgagcacgccgacggcaagcgcuacuucaccugggaccccucccgcuucccccagccccgcaccaugcucgagcgccucgccuccaagcgccgcaagcucgucgccaucgucgacccccacaucaaggucgacuccggcuaccgcguccacgaggagcuccgcaaccucggccucuacgucaagacccgcgacggcuccgacuacgagggcuggugcuggcccggcuccgccggcuaccccgacuucaccaaccccaccaugcgcgccuggugggccaacauguucuccuacgacaacuacgagggcuccgcccccaaccucuucgucuggaacgacaugaacgagcccuccgucuucaacggccccgaggucaccaugcucaaggacgcccagcacuacggcggcugggagcaccgcgacguccacaacaucuacggccucuacguccacauggccaccgccgacggccuccgccagcgcuccggcggcauggagcgccccuucguccucgcccgcgccuucuucgccggcucccagcgcuucggcgccgucuggaccggcgacaacaccgccgagugggaccaccucaagaucuccauccccaugugccucucccucggccucgucggccucuccuucugcggcgccgacgucggcggcuucuucaagaaccccgagcccgagcuccucguccgcugguaccagaugggcgccuaccagcccuucuuccgcgcccacgcccaccucgacaccggccgccgcgagcccuggcuccuccccucccagcacaacgacaucauccgcgacgcccucggccagcgcuacucccuccuccccuucugguacacccuccucuaccaggcccaccgcgagggcauccccgucaugcgcccccucuggguccaguacccccaggacgucaccaccuucaacaucgacgaccaguaccuccucggcgacgcccuccucguccaccccgucuccgacuccggcgcccacggcguccaggucuaccuccccggccagggcgaggucugguacgacauccaguccuaccagaagcaccacggcccccagacccucuaccuccccgucacccucuccuccauccccgucuuccagcgcggcggcaccaucgucccccgcuggaugcgcguccgccgcuccuccgagugcaugaaggacgaccccaucacccucuucgucgcccucuccccccagggcaccgcccagggcgagcucuuccucgacgacggccacaccuucaacuaccagacccgccaggaguuccuccuccgccgcuucuccuucuccggcaacacccucgucuccuccuccgccgaccccgagggccacuucgagacccccaucuggaucgagcgcgucgucaucaucggcgccggcaagcccgccgccgucguccuccagaccaagggcucccccgagucccgccucuccuuccagcacgaccccgagaccuccguccucguccuccgcaagcccggcaucaacgucgccuccgacugguccauccaccuccgcuga

SEQ ID NO: 43504 - RNA, 849 nt, Artificial Sequence
  derived and/or modified sequence opt2 from GANC__Homo_sapiens__NP_001288339
auggaggccgccgucaaggaggagaucucccucgaggacgaggccgucgacaagaacaucuuccgcgacugcaacaagaucgccuucuaccgccgccagaagcaguggcucuccaagaaguccaccuaccaggcccuccucgacuccgucaccaccgacgaggacuccacccgcuuccagaucaucaacgaggccuccaagguccgcugccaggaccagucccccaccacccucgacgccuucaagggcaaggagaccaccguccaggaggagacccaggaccucuccacccgccagcaccucgcccagaaggaggccgaggagcccgacaagcagggccagaucaccugggacaucuccaacgucgcccccaagaccgagaacuucgaggaccuccucgagcagacccccugcuccgccugccuccagggcuucacccgcgacaacaccuccuccuccuucuccgaggacgccggcaucucccucuccaccuccgucaagcucccccucgccuccuccuccaagcccaacgagaacgaggcccuccccaaccagccccccucccagcagauccgccacaacuaccgccuccucgccuccaccgucuccgccgagauggcccgcaaccgccagcucaucugggagcucgcccgccaguccgaggcccaccucgaccgccccgucguccucggcgagcaggccuccgcccagcgcgaggucgccuccauccucugccgcaaguccguccucgccaucaaccagcucgccgccaccgucgagggcaccaucuccguccuccagcaguucaacgagcuccucgaccacccccucgaccccggccgcuccuga

SEQ ID NO: 43505 - RNA, 1794 nt, Artificial Sequence
  derived and/or modified sequence opt2 from GAN__Homo_sapiens__NP_071324
auggccgagggcuccgccgucuccgacccccagcacgccgcccgccuccuccgcgcccucuccuccuuccgcgaggagucccgcuucugcgacgcccaccucguccucgacggcgaggagauccccguccagaagaacauccucgccgccgccucccccuacauccgcaccaagcucaacuacaacccccccaaggacgacggcuccaccuacaagaucgagcucgagggcaucuccgucauggucaugcgcgagauccucgacuacaucuucuccggccagauccgccucaacgaggacaccauccaggacgucguccaggccgccgaccuccuccuccucaccgaccucaagacccucugcugcgaguuccucgagggcugcaucgccgccgagaacugcaucggcauccgcgacuucgcccuccacuacugccuccaccacguccacuaccucgccaccgaguaccucgagacccacuuccgcgacgucuccuccaccgaggaguuccucgagcucuccccccagaagcucaaggaggucaucucccucgagaagcucaacgucggcaacgagcgcuacgucuucgaggccgucauccgcuggaucgcccacgacaccgagauccgcaagguccacaugaaggacgucauguccgcccucugggucuccggccucgacuccuccuaccuccgcgagcagaugcucaacgagccccucguccgcgagaucgucaaggagugcuccaacaucccccucucccagccccagcagggcgaggccaugcucgccaacuucaagccccgcggcuacuccgagugcaucgucaccgucggcggcgaggagcgcgucucccgcaagcccaccgccgccaugcgcugcaugugcccccucuacgaccccaaccgccagcucuggaucgagcucgccccccucuccaugccccgcaucaaccacggcguccucuccgccgagggcuuccucuucgucuucggcggccaggacgagaacaagcagacccucuccuccggcgagaaguacgaccccgacgccaacaccuggaccgcccucccccccaugaacgaggcccgccacaacuucggcaucgucgagaucgacggcaugcucuacauccucggcggcgaggacggcgagaaggagcucaucuccauggagugcuacgacaucuacuccaagaccuggaccaagcagcccgaccucaccaugguccgcaagaucggcugcuacgccgccaugaagaagaagaucuacgccaugggcggcggcuccuacggcaagcucuucgaguccgucgagugcuacgacccccgcacccagcaguggaccgccaucugcccccucaaggagcgccgcuucggcgccgucgccugcggcgucgccauggagcucuacgucuucggcggcguccgcucccgcgaggacgcccagggcuccgagauggucaccugcaaguccgaguucuaccacgacgaguucaagcgcuggaucuaccucaacgaccagaaccucugcauccccgccuccuccuccuucgucuacggcgccguccccaucggcgccuccaucuacgucaucggcgaccucgacaccggcaccaacuacgacuacguccgcgaguucaagcgcuccaccggcaccuggcaccacaccaagccccuccuccccuccgaccuccgccgcaccggcugcgccgcccuccgcaucgccaacugcaagcucuuccgccuccagcuccagcagggccucuuccgcauccgcguccacucccccuga

SEQ ID NO: 43506 - RNA, 825 nt, Artificial Sequence
  derived and/or modified sequence opt2 from GAP43__Homo_sapiens__NP_001123536
augaccaaguccugcuccgagcucugccaccccgcccuccacuuccuccccugccucggcggccuccgcaagaaccuccagcgcgccguccgccccucccccuacucccucggcuuccucaccuucuggaucucccgcgucgagaagaacgacgacgaccagaagaucgagcaggacggcaucaagcccgaggacaaggcccacaaggccgccaccaagauccaggccuccuuccgcggccacaucacccgcaagaagcucaagggcgagaagaaggacgacguccaggccgccgaggccgaggccaacaagaaggacgaggcccccgucgccgacggcgucgagaagaagggcgagggcaccaccaccgccgaggccgcccccgccaccggcuccaagcccgacgagcccggcaaggccggcgagacccccuccgaggagaagaagggcgagggcgacgccgccaccgagcaggccgccccccaggcccccgccuccuccgaggagaaggccggcuccgccgagaccgaguccgccaccaaggccuccaccgacaacucccccuccuccaaggccgaggacgcccccgccaaggaggagcccaagcaggccgacguccccgccgccgucaccgccgccgccgccaccacccccgccgccgaggacgccgccgccaaggccaccgcccagccccccaccgagaccggcgaguccucccaggccgaggagaacaucgaggccgucgacgagaccaagcccaaggaguccgcccgccaggacgagggcaaggaggaggagcccgaggccgaccaggagcacgccuga

SEQ ID NO: 43507 - RNA, 882 nt, Artificial Sequence
  derived and/or modified sequence opt2 from GAPDH__Homo_sapiens__NP_001243728
auggucuacauguuccaguacgacuccacccacggcaaguuccacggcaccgucaaggccgagaacggcaagcucgucaucaacggcaaccccaucaccaucuuccaggagcgcgaccccuccaagaucaaguggggcgacgccggcgccgaguacgucgucgaguccaccggcgucuucaccaccauggagaaggccggcgcccaccuccagggcggcgccaagcgcgucaucaucuccgcccccuccgccgacgcccccauguucgucaugggcgucaaccacgagaaguacgacaacucccucaagaucaucuccaacgccuccugcaccaccaacugccucgccccccucgccaaggucauccacgacaacuucggcaucgucgagggccucaugaccaccguccacgccaucaccgccacccagaagaccgucgacggccccuccggcaagcucuggcgcgacggccgcggcgcccuccagaacaucauccccgccuccaccggcgccgccaaggccgucggcaaggucauccccgagcucaacggcaagcucaccggcauggccuuccgcguccccaccgccaacgucuccgucgucgaccucaccugccgccucgagaagcccgccaaguacgacgacaucaagaaggucgucaagcaggccuccgagggcccccucaagggcauccucggcuacaccgagcaccaggucgucuccuccgacuucaacuccgacacccacuccuccaccuucgacgccggcgccggcaucgcccucaacgaccacuucgucaagcucaucuccugguacgacaacgaguucggcuacuccaaccgcgucgucgaccucauggcccacauggccuccaaggaguga

SEQ ID NO: 43508 - RNA, 1227 nt, Artificial Sequence
  derived and/or modified sequence opt2 from GAPDHS__Homo_sapiens__NP_055179
auguccaagcgcgacaucguccucaccaacgucaccgucguccagcuccuccgccagcccugccccgucacccgcgccccccccccccccgagcccaaggccgaggucgagccccagccccagcccgagcccacccccguccgcgaggagaucaagccccccccccccccccuccccccccaccccgccacccccccccccaagauggucuccgucgcccgcgagcucaccgucggcaucaacggcuucggccgcaucggccgccucguccuccgcgccugcauggagaagggcgucaaggucgucgccgucaacgaccccuucaucgaccccgaguacauggucuacauguucaaguacgacuccacccacggccgcuacaagggcuccgucgaguuccgcaacggccagcucgucgucgacaaccacgagaucuccgucuaccagugcaaggagcccaagcagauccccuggcgcgccgucggcucccccuacgucgucgaguccaccggcgucuaccucuccauccaggccgccuccgaccacaucuccgccggcgcccagcgcgucgucaucuccgcccccucccccgacgcccccauguucgucaugggcgucaacgagaacgacuacaaccccggcuccaugaacaucgucuccaacgccuccugcaccaccaacugccucgccccccucgccaaggucauccacgagcgcuucggcaucgucgagggccucaugaccaccguccacuccuacaccgccacccagaagaccgucgacggccccucccgcaaggccuggcgcgacggccgcggcgcccaccagaacaucauccccgccuccaccggcgccgccaaggccgucaccaaggucauccccgagcucaagggcaagcucaccggcauggccuuccgcguccccacccccgacgucuccgucgucgaccucaccugccgccucgcccagcccgcccccuacuccgccaucaaggaggccgucaaggccgccgccaagggccccauggccggcauccucgccuacaccgaggacgaggucgucuccaccgacuuccucggcgacacccacuccuccaucuucgacgccaaggccggcaucgcccucaacgacaacuucgucaagcucaucuccugguacgacaacgaguacggcuacucccaccgcgucgucgaccuccuccgcuacauguucucccgcgacaaguga

SEQ ID NO: 43509 - RNA, 654 nt, Artificial Sequence
  derived and/or modified sequence opt2 from GAR1__Homo_sapiens__NP_061856
auguccuuccgcggcggcggccgcggcggcuucaaccgcggcggcggcggcggcggcuucaaccgcggcggcuccuccaaccacuuccgcggcggcggcggcggcggcggcggcggcaacuuccgcggcggcggccgcggcggcuucggccgcggcggcggccgcggcggcuucaacaagggccaggaccagggcccccccgagcgcgucguccuccucggcgaguuccuccaccccugcgaggacgacaucgucugcaagugcaccaccgacgagaacaagguccccuacuucaacgcccccgucuaccucgagaacaaggagcagaucggcaaggucgacgagaucuucggccagcuccgcgacuucuacuucuccgucaagcucuccgagaacaugaaggccuccuccuucaagaagcuccagaaguucuacaucgaccccuacaagcuccucccccuccagcgcuuccucccccgcccccccggcgagaagggccccccccgcggcggcggccgcggcggccgcggcggcggccgcggcggcggcggccgcggcggcggccgcggcggcggcuuccgcggcggccgcggcggcggcggcggcggcuuccgcggcggccgcggcggcggcuuccgcggccgcggccacuga

SEQ ID NO: 43510 - RNA, 2631 nt, Artificial Sequence
  derived and/or modified sequence opt2 from GAREM__Homo_sapiens__NP_001229338
auggaccccgcccccucccucggcugcucccucaaggacgucaagugguccuccgucgccgucccccucgaccuccucgucuccaccuaccgccucccccagaucgcccgccucgacaacggcgagugcgucgagggccuccgcgagaacgacuaccuccucauccacuccugccgccaguggaccaccaucaccgcccacucccucgaggagggccacuacgucaucggccccaagaucgagauccccguccacuacgccggccaguucaagcuccucgagcaggaccgcgacaucaaggagcccguccaguacuucaacuccgucgaggaggucgccaaggccuuccccgagcgcgucuacgucauggaggacaucaccuucaacgucaaggucgccuccggcgagugcaacgaggacaccgaggucuacaacaucacccucugcaccggcgacgagcucacccucaugggccaggccgagauccucuacgccaagaccuucaaggagaagucccgccucaacaccaucuucaagaagaucggcaagcucaacuccaucuccaagcucggcaagggcaagaugcccugccucaucugcaugaaccaccgcaccaacgaguccaucucccuccccuuccagugcaagggccgcuucuccacccgcuccccccucgagcuccagaugcaggagggcgagcacaccauccgcaacaucgucgagaagacccgccuccccgucaacgucaccguccccuccccccccccccgcaaccccuacgaccuccacuucauccgcgagggccaccgcuacaaguucgucaacauccagaccaagaccgucgucgucugcugcguccuccgcaacaacaagauccuccccaugcacuucccccuccaccucaccguccccaaguucucccuccccgagcaccucgucaagggcgaguccuggcccgagacccucguccaccacuggcucggcaucugccaggagcaguucgacaucgacgaguacucccgcgccguccgcgacgucaagaccgacuggaacgaggagugcaagucccccaagaagggccgcugcuccggccacaaccacguccccaacucccucuccuacgcccgcgacgagcucacccaguccuuccaccgccucuccgucugcgucuacggcaacaaccuccacggcaacuccgaggucaaccuccacggcugccgcgaccucggcggcgacugggcccccuucccccacgacauccuccccuaccaggacuccggcgacuccggcuccgacuaccucuuccccgaggccuccgaggaguccgccggcauccccggcaaguccgagcuccccuacgaggagcucuggcucgaggagggcaagcccucccaccagccccucacccgcucccucuccgagaagaaccgcugcgaccaguuccgcggcuccguccgcuccaagugcgccaccuccccccuccccauccccggcacccucggcgccgccgucaaguccuccgacaccgcccucccccccccccccgucccccccaaguccgaggccguccgcgaggagugccgccuccucaacgccccccccguccccccccgcuccgccaagccccucuccaccucccccuccauccccccccgcaccgucaagcccgcccgccagcagacccgcucccccucccccacccucuccuacuacuccuccggccuccacaacaucuccgucaccaagaccgacaccaaccccuccgaguccacccccgucuccugcuaccccugcaaccgcgucaagaccgacuccgucgaccucaagucccccuucggcucccccuccgccgaggccgucuccucccgccucuccuggcccaaccacuacuccggcgccuccgagucccagacccgcuccgacuuccuccucgaccccucccgcuccuacuccuacccccgccagaagacccccggcacccccaagcgcaacugccccgcccccuucgacuucgacggcugcgagcuccucgccucccccaccucccccgucaccgccgaguucuccuccuccgucuccggcugccccaaguccgccuccuacucccucgaguccaccgacgucaagucccucgccgccggcgucaccaagcaguccaccuccugccccgcccuccccccccgcgcccccaagcucgucgaggagaaggucgccuccgagaccuccccccucccccucaagaucgacggcgccgaggaggaccccaaguccggcucccccgaccucuccgaggaccaguacuucgucaagaagggcaugcaggacaucuucuccgccuccuaccccuucuccuccccccuccaccuccagcucgccccccgcuccugcggcgacggcucccccuggcagccccccgccgaccucuccggccucuccaucgaggaggucuccaagucccuccgcuucaucggccucuccgaggacgucaucuccuucuucgucaccgagaagaucgacggcaaccuccucguccagcucaccgaggagauccucuccgaggacuucaagcucuccaagcuccaggucaagaagaucaugcaguucaucaacggcuggcgccccaagaucuga

SEQ ID NO: 43511 - RNA, 2976 nt, Artificial Sequence
  derived and/or modified sequence opt2 from GARNL3__Homo_sapiens__NP_001273708
augaaguccuccgucuccgaggaccucggcugccgccgcggcgacuucucccgcaagcacuacggcuccgucgagcuccucaucuccuccgacgccgacggcgccauccagcgcgccggccgcuuccgcgucgagaacggcuccuccgacgagaacgccaccgcccuccccggcaccuggcgccgcaccgacguccaccucgagaaccccgaguaccacacccgcugguacuucaaguacuuccucggccagguccaccagaacuacaucggcaacgacgccgagaagucccccuucuuccucuccgucacccucuccgaccagaacaaccagcgcgucccccaguaccgcgccauccucuggcgcaagaccggcacccagaagaucugccuccccuacucccccaccaagacccucuccgucaaguccauccucuccgccaugaaccucgacaaguucgagaagggcccccgcgagaucuuccaccccgagauccagaaggaccuccucguccucgaggagcaggagggcuccgucaacuucaaguucggcguccucuucgccaaggacggccagcucaccgacgacgagauguucuccaacgagaucggcuccgagcccuuccagaaguuccucaaccuccucggcgacaccaucacccucaagggcuggaccggcuaccgcggcggccucgacaccaagaacgacaccaccggcauccacuccgucuacaccgucuaccagggccacgagaucauguuccacgucuccaccaugcuccccuacuccaaggagaacaagcagcaggucgagcgcaagcgccacaucggcaacgacaucgucaccaucgucuuccaggagggcgaggaguccucccccgccuucaagcccuccaugauccgcucccacuucacccacaucuucgcccucguccgcuacaaccagcagaacgacaacuaccgccucaagaucuucuccgaggaguccgucccccucuucggccccccccuccccaccccccccgucuucaccgaccaccaggaguuccgcgacuuccuccucgucaagcucaucaacggcgagaaggccacccucgagacccccaccuucgcccagaagcgccgccgcacccucgacaugcucauccgcucccuccaccaggaccucaugcccgaccuccacaagaacaugcucaaccgccgcuccuucuccgacguccuccccgagucccccaaguccgcccgcaagaaggaggaggcccgccaggccgaguucguccgcaucggccaggcccucaagcucaaguccaucguccgcggcgacgcccccuccucccucgccgccuccggcaucugcaagaaggagcccugggagccccagugcuucugcuccaacuucccccacgaggccgucugcgccgaccccuggggccaggcccuccucgucuccaccgacgccggcguccuccucgucgacgacgaccuccccuccguccccgucuucgaccgcacccuccccgucaagcagaugcacguccucgagacccucgaccuccucguccuccgcgccgacaagggcaaggacgcccgccucuucgucuuccgccucuccgcccuccagaagggccucgagggcaagcaggccggcaagucccgcuccgacugccgcgagaacaagcucgagaagaccaagggcugccaccucuacgccaucaacacccaccacucccgcgagcuccgcaucgucgucgccauccgcaacaagcuccuccucaucacccgcaagcacaacaagcccuccggcgucaccuccaccucccuccucuccccccucuccgagucccccgucgaggaguuccaguacauccgcgagaucugccucuccgacucccccauggucaugacccucgucgacggccccgccgaggaguccgacaaccucaucugcgucgccuaccgccaccaguucgacgucgucaacgaguccaccggcgaggccuuccgccuccaccacgucgaggccaaccgcgucaacuucgucgccgccaucgacgucuacgaggacggcgaggccggccuccuccucugcuacaacuacuccugcaucuacaagaaggucugccccuucaacggcggcuccuuccucguccagcccuccgccuccgacuuccaguucugcuggaaccaggcccccuacgccaucgucugcgccuuccccuaccuccucgccuucaccaccgacuccauggagauccgccucgucgucaacggcaaccucguccacaccgccgucgucccccagcuccagcucgucgccucccgcuccgacaucuacuucaccgccaccgccgccgucaacgaggucuccuccggcggcuccuccaagggcgccuccgcccgcaacuccccccagaccccccccggccgcgacacccccgucuuccccuccucccucggcgagggcgagauccaguccaagaaccucuacaagaucccccuccgcaaccucgucggccgcuccaucgagcgcccccucaaguccccccucgucuccaaggucaucaccccccccacccccaucuccgucggccucgccgccauccccgucacccacucccucucccucucccgcauggagaucaaggagaucgccucccgcacccgccgcgagcuccucggccucuccgacgagggcggccccaaguccgagggcgcccccaaggccaaguccaagccccgcaagcgccucgaggagucccagggcggccccaagcccggcgccguccgcuccuccuccuccgaccgcauccccuccggcucccucgaguccgccuccaccuccgaggccaaccccgagggccacuccgccuccuccgaccaggaccccgucgccgaccgcgagggcucccccgucuccggcuccucccccuuccagcucaccgccuucuccgacgaggacaucaucgaccucaaguga

SEQ ID NO: 43512 - RNA, 2220 nt, Artificial Sequence
  derived and/or modified sequence opt2 from GARS__Homo_sapiens__NP_002038
augcccuccccccgccccguccuccuccgcggcgcccgcgccgcccuccuccuccuccuccccccccgccuccucgcccgccccucccuccuccuccgccgcucccucuccgccgccuccugcccccccaucucccuccccgccgccgccucccgcuccuccauggacggcgccggcgccgaggagguccucgccccccuccgccucgccguccgccagcagggcgaccucguccgcaagcucaaggaggacaaggccccccaggucgacgucgacaaggccgucgccgagcucaaggcccgcaagcgcguccucgaggccaaggagcucgcccuccagcccaaggacgacaucgucgaccgcgccaagauggaggacacccucaagcgccgcuucuucuacgaccaggccuucgccaucuacggcggcgucuccggccucuacgacuucggccccgucggcugcgcccucaagaacaacaucauccagaccuggcgccagcacuucauccaggaggagcagauccucgagaucgacugcaccaugcucacccccgagcccguccucaagaccuccggccacgucgacaaguucgccgacuucauggucaaggacgucaagaacggcgagugcuuccgcgccgaccaccuccucaaggcccaccuccagaagcucauguccgacaagaagugcuccgucgagaagaaguccgagauggaguccguccucgcccagcucgacaacuacggccagcaggagcucgccgaccucuucgucaacuacaacgucaagucccccaucaccggcaacgaccucuccccccccgucuccuucaaccucauguucaagaccuucaucggccccggcggcaacaugcccggcuaccuccgccccgagaccgcccagggcaucuuccucaacuucaagcgccuccucgaguucaaccagggcaagcuccccuucgccgccgcccagaucggcaacuccuuccgcaacgagaucuccccccgcuccggccucauccgcguccgcgaguucaccauggccgagaucgagcacuucgucgaccccuccgagaaggaccaccccaaguuccagaacgucgccgaccuccaccucuaccucuacuccgccaaggcccaggucuccggccaguccgcccgcaagaugcgccucggcgacgccgucgagcagggcgucaucaacaacaccguccucggcuacuucaucggccgcaucuaccucuaccucaccaaggucggcaucucccccgacaagcuccgcuuccgccagcacauggagaacgagauggcccacuacgccugcgacugcugggacgccgaguccaagaccuccuacggcuggaucgagaucgucggcugcgccgaccgcuccugcuacgaccucuccugccacgcccgcgccaccaaggucccccucgucgccgagaagccccucaaggagcccaagaccgucaacgucguccaguucgagcccuccaagggcgccaucggcaaggccuacaagaaggacgccaagcucgucauggaguaccucgccaucugcgacgagugcuacaucaccgagauggagaugcuccucaacgagaagggcgaguucaccaucgagaccgagggcaagaccuuccagcucaccaaggacaugaucaacgucaagcgcuuccagaagacccucuacgucgaggaggucguccccaacgucaucgagcccuccuucggccucggccgcaucauguacaccgucuucgagcacaccuuccacguccgcgagggcgacgagcagcgcaccuucuucuccuuccccgccgucgucgcccccuucaagugcuccguccucccccucucccagaaccaggaguucaugcccuucgucaaggagcucuccgaggcccucacccgccacggcgucucccacaaggucgacgacuccuccggcuccaucggccgccgcuacgcccgcaccgacgagaucggcgucgccuucggcgucaccaucgacuucgacaccgucaacaagaccccccacaccgccacccuccgcgaccgcgacuccaugcgccagauccgcgccgagaucuccgagcuccccuccaucguccaggaccucgccaacggcaacaucaccugggccgacgucgaggcccgcuacccccucuucgagggccaggagaccggcaagaaggagaccaucgaggaguga

SEQ ID NO: 43513 - RNA, 1302 nt, Artificial Sequence
  derived and/or modified sequence opt2 from GART__Homo_sapiens__NP_780294
auggccgcccgcguccucaucaucggcuccggcggccgcgagcacacccucgccuggaagcucgcccagucccaccacgucaagcagguccucgucgcccccggcaacgccggcaccgccugcuccgagaagaucuccaacaccgccaucuccaucuccgaccacaccgcccucgcccaguucugcaaggagaagaagaucgaguucgucgucgucggccccgaggccccccucgccgccggcaucgucggcaaccuccgcuccgccggcguccagugcuucggccccaccgccgaggccgcccagcucgaguccuccaagcgcuucgccaaggaguucauggaccgccacggcauccccaccgcccaguggaaggccuucaccaagcccgaggaggccugcuccuucauccucuccgccgacuuccccgcccucgucgucaaggccuccggccucgccgccggcaagggcgucaucgucgccaaguccaaggaggaggccugcaaggccguccaggagaucaugcaggagaaggccuucggcgccgccggcgagaccaucgucaucgaggagcuccucgacggcgaggaggucuccugccucugcuucaccgacggcaagaccgucgcccccaugccccccgcccaggaccacaagcgccuccucgagggcgacggcggccccaacaccggcggcaugggcgccuacugccccgccccccaggucuccaacgaccuccuccucaagaucaaggacaccguccuccagcgcaccgucgacggcaugcagcaggagggcacccccuacaccggcauccucuacgccggcaucaugcucaccaagaacggccccaagguccucgaguucaacugccgcuucggcgaccccgagugccaggucauccucccccuccucaaguccgaccucuacgaggucauccaguccacccucgacggccuccucugcaccucccuccccgucuggcucgagaaccacaccgcccucaccgucgucauggccuccaagggcuaccccggcgacuacaccaagggcgucgagaucaccggcuuccccgaggcccaggcccucggccucgaggucuuccacgccggcaccgcccucaagaacggcaaggucgucacccacggcggccgcguccucgccgucaccgccauccgcgagaaccucaucuccgcccucgaggaggccaagaagggccucgccgccaucaaguucgagggcgccaucuaccgcaaggacgucggcuuccgcgccaucgccuuccuccagcagccccgcuga

SEQ ID NO: 43514 - RNA, 1038 nt, Artificial Sequence
  derived and/or modified sequence opt2 from GAS1__Homo_sapiens__NP_002039
auggucgccgcccuccucggcggcggcggcgaggcccgcggcggcaccguccccggcgccuggcucugccucauggcccuccuccagcuccucggcuccgccccccgcggcuccggccucgcccacggccgccgccucaucugcuggcaggcccuccuccagugccagggcgagcccgagugcuccuacgccuacaaccaguacgccgaggccugcgcccccguccucgcccagcacggcggcggcgacgcccccggcgccgccgccgccgccuuccccgccuccgccgccuccuucuccucccgcuggcgcugccccucccacugcaucuccgcccucauccagcucaaccacacccgccgcggccccgcccucgaggacugcgacugcgcccaggacgagaacugcaaguccaccaagcgcgccaucgagcccugccucccccgcaccuccggcggcggcgccggcggccccggcgccggcggcgucaugggcugcaccgaggcccgccgccgcugcgaccgcgacucccgcugcaaccucgcccucucccgcuaccucaccuacugcggcaaggucuucaacggccuccgcugcaccgacgagugccgcaccgucaucgaggacaugcucgccaugcccaaggccgcccuccucaacgacugcgucugcgacggccucgagcgccccaucugcgaguccgucaaggagaacauggcccgccucugcuucggcgccgagcucggcaacggccccggcuccuccggcuccgacggcggccucgacgacuacuacgacgaggacuacgacgacgagcagcgcaccggcggcgccggcggcgagcagccccucgacgacgacgacggcgucccccaccccccccgccccggcuccggcgccgccgccuccggcggccgcggcgaccuccccuacggccccggccgccgcuccuccggcggcggcggccgccucgccccccgcggcgccuggaccccccucgccuccauccuccuccuccuccucggcccccucuucuga

SEQ ID NO: 43515 - RNA, 942 nt, Artificial Sequence
  derived and/or modified sequence opt2 from GAS2__Homo_sapiens__NP_001137302
augugcaccgcccucucccccaagguccgcuccggccccggccucuccgacaugcaccaguacucccaguggcucgccucccgccacgaggccaaccuccuccccaugaaggaggaccucgcccucuggcucaccaaccuccucggcaaggagaucaccgccgagaccuucauggagaagcucgacaacggcgcccuccucugccagcucgccgagaccaugcaggagaaguucaaggaguccauggacgccaacaagcccaccaagaaccucccccucaagaagauccccugcaagaccuccgcccccuccggcuccuucuucgcccgcgacaacaccgccaacuuccucuccuggugccgcgaccucggcgucgacgagaccugccucuucgaguccgagggccucguccuccacaagcagccccgcgaggucugccucugccuccucgagcucggccgcaucgccgcccgcuacggcgucgagccccccggccucaucaagcucgagaaggagaucgagcaggaggagacccucuccgcccccucccccucccccucccccuccuccaaguccuccggcaagaaguccaccggcaaccuccucgacgacgccgucaagcgcaucuccgaggacccccccugcaagugccccaacaaguucugcgucgagcgccucucccagggccgcuaccgcgucggcgagaagauccucuucauccgcaugcuccacaacaagcacgucaugguccgcgucggcggcggcugggagaccuucgccggcuaccuccucaagcacgaccccugccgcaugcuccagaucucccgcgucgacggcaagaccucccccauccaguccaagucccccacccucaaggacaugaaccccgacaacuaccucgucgucuccgccuccuacaaggccaagaaggagaucaaguga

SEQ ID NO: 43516 - RNA, 1365 nt, Artificial Sequence
  derived and/or modified sequence opt2 from GAS2L1__Homo_sapiens__NP_001265659
auggccgaccccgucgccggcaucgccggcuccgccgccaaguccguccgccccuuccgcuccuccgaggccuacgucgaggccaugaaggaggaccucgccgaguggcucaacgcccucuacggccucggccuccccggcggcggcgacggcuuccucaccggccucgccaccggcaccacccucugccagcacgccaacgccgucaccgaggccgcccgcgcccucgccgccgcccgccccgcccgcggcgucgccuuccaggcccacuccgucguccccggcuccuucauggcccgcgacaacgucgccaccuucaucggcuggugccgcgucgagcucggcguccccgagguccucauguucgagaccgaggaccucguccuccgcaagaacgagaaguccgucguccucugccuccucgaggucgcccgccgcggcgcccgccucggccuccucgccccccgccucguccaguucgagcaggagaucgagcgcgagcuccgcgccgccccccccgcccccaacgcccccgccgccggcgaggacaccaccgagaccgcccccgcccccggcacccccgcccgcggcccccgcaugacccccuccgaccuccgcaaccucgacgagcucguccgcgagauccucggccgcugcaccugccccgaccaguuccccaugaucaaggucuccgagggcaaguaccgcgucggcgacuccucccuccucaucuucguccgcguccuccgcucccacgucaugguccgcgucggcggcggcugggacacccucgagcacuaccucgacaagcacgaccccugccgcugcuccuccaccgcccaccgccccccccagccccgcgucugcaccuucuccccccagcgcgucucccccaccaccuccccccgccccgccucccccguccccggcuccgagcgccgcggcucccgccccgagaugacccccgucucccuccgcuccaccaaggagggccccgagaccccccccuccuccuccuccuccucccucuccguccucggcggcaagugcggccagcccggcgacuccggccgcaccgccaacggccuccccggcccccgcucccaggcccucuccuccuccuccgacgagggcucccccugccccggcaugggcggcccccucgacgcccccggcuccccccucgccugcaccgagcccucccgcaccugggcccgcggccgcauggacacccagcccgaccgcaagcccucccgcauccccaccccccgcggcccccgccgccccuccggccccgccgagcucggcaccuggcacgcccuccacuccgucaccccccgcgccgagcccgacuccuggauguga

SEQ ID NO: 43517 - RNA, 2037 nt, Artificial Sequence
  derived and/or modified sequence opt2 from GAS6__Homo_sapiens__NP_000811
auggcccccucccucucccccggccccgccgcccuccgccgcgccccccagcuccuccuccuccuccucgccgccgagugcgcccucgccgcccuccuccccgcccgcgaggccacccaguuccuccgcccccgccagcgccgcgccuuccaggucuucgaggaggccaagcagggccaccucgagcgcgagugcgucgaggagcucugcucccgcgaggaggcccgcgaggucuucgagaacgaccccgagaccgacuacuucuacccccgcuaccucgacugcaucaacaaguacggcucccccuacaccaagaacuccggcuucgccaccugcguccagaaccuccccgaccagugcacccccaaccccugcgaccgcaagggcacccaggccugccaggaccucaugggcaacuucuucugccucugcaaggccggcuggggcggccgccucugcgacaaggacgucaacgagugcucccaggagaacggcggcugccuccagaucugccacaacaagcccggcuccuuccacugcuccugccacuccggcuucgagcucuccuccgacggccgcaccugccaggacaucgacgagugcgccgacuccgaggccugcggcgaggcccgcugcaagaaccuccccggcuccuacuccugccucugcgacgagggcuucgccuacuccucccaggagaaggccugccgcgacgucgacgagugccuccagggccgcugcgagcaggucugcgucaacucccccggcuccuacaccugccacugcgacggccgcggcggccucaagcucucccaggacauggacaccugcgaggacauccuccccugcguccccuucuccgucgccaaguccgucaagucccucuaccucggccgcauguucuccggcacccccgucauccgccuccgcuucaagcgccuccagcccacccgccucgucgccgaguucgacuuccgcaccuucgaccccgagggcauccuccucuucgccggcggccaccaggacuccaccuggaucguccucgcccuccgcgccggccgccucgagcuccagcuccgcuacaacggcgucggccgcgucaccuccuccggccccgucaucaaccacggcauguggcagaccaucuccgucgaggagcucgcccgcaaccucgucaucaaggucaaccgcgacgccgucaugaagaucgccgucgccggcgaccucuuccagcccgagcgcggccucuaccaccucaaccucaccgucggcggcauccccuuccacgagaaggaccucguccagcccaucaacccccgccucgacggcugcaugcgcuccuggaacuggcucaacggcgaggacaccaccauccaggagaccgucaaggucaacacccgcaugcagugcuucuccgucaccgagcgcggcuccuucuaccccggcuccggcuucgccuucuacucccucgacuacaugcgcaccccccucgacgucggcaccgaguccaccugggaggucgaggucgucgcccacauccgccccgccgccgacaccggcguccucuucgcccucugggcccccgaccuccgcgccgucccccucuccgucgcccucgucgacuaccacuccaccaagaagcucaagaagcagcucgucguccucgccgucgagcacaccgcccucgcccucauggagaucaaggucugcgacggccaggagcacgucgucaccgucucccuccgcgacggcgaggccacccucgaggucgacggcacccgcggccaguccgaggucuccgccgcccagcuccaggagcgccucgccguccucgagcgccaccuccgcucccccguccucaccuucgccggcggccuccccgacguccccgucaccuccgcccccgucaccgccuucuaccgcggcugcaugacccucgaggucaaccgccgccuccucgaccucgacgaggccgccuacaagcacuccgacaucaccgcccacuccugcccccccgucgagcccgccgccgccuga

SEQ ID NO: 43518 - RNA, 1239 nt, Artificial Sequence
  derived and/or modified sequence opt2 from GAS7__Homo_sapiens__NP_001124303
auggucccccccccccccggcgaggagucccagaccgucauccucccccccggcuggcaguccuaccucuccccccagggccgccgcuacuacgucaacaccaccaccaacgagaccaccugggagcgccccuccuccucccccggcauccccgccucccccggcucccaccgcuccucccucccccccaccgucaacggcuaccacgccuccggcacccccgcccacccccccgagaccgcccacauguccguccgcaaguccaccggcgacucccagaaccucggcuccuccucccccuccaagaagcaguccaaggagaacaccaucaccaucaacugcgucaccuucccccaccccgacaccaugcccgagcagcagcuccucaagcccaccgagugguccuacugcgacuacuucugggccgacaagaaggacccccagggcaacggcaccgucgccggcuucgagcuccuccuccagaagcagcucaagggcaagcagaugcagaaggagauguccgaguucauccgcgagcgcaucaagaucgaggaggacuacgccaagaaccucgccaagcucucccagaacucccucgccucccaggaggagggcucccucggcgaggccugggcccaggucaagaagucccucgccgacgaggccgagguccaccucaaguucuccgccaagcuccacuccgaggucgagaagccccucaugaacuuccgcgagaacuucaagaaggacaugaagaagugcgaccaccacaucgccgaccuccgcaagcagcucgccucccgcuacgccuccgucgagaaggcccgcaaggcccucaccgagcgccagcgcgaccucgagaugaagacccagcagcucgagaucaagcucuccaacaagaccgaggaggacaucaagaaggcccgccgcaaguccacccaggccggcgacgaccucaugcgcugcgucgaccucuacaaccaggcccaguccaagugguucgaggagauggucaccaccacccucgagcucgagcgccucgaggucgagcgcgucgagaugauccgccagcaccucugccaguacacccagcuccgccacgagaccgacauguucaaccaguccaccgucgagcccgucgaccagcuccuccgcaaggucgaccccgccaaggaccgcgagcucuggguccgcgagcacaagaccggcaacauccgccccgucgacauggagaucuga

SEQ ID NO: 43519 - RNA, 861 nt, Artificial Sequence
  derived and/or modified sequence opt2 from GAS8__Homo_sapiens__NP_001273137
augaagaugcuccgcgacgagcucgaccuccgccgcaagaccgagcuccacgaggucgaggagcgcaagaacggccagauccacacccucaugcagcgccacgaggaggccuucaccgacaucaagaacuacuacaacgacaucacccucaacaaccucgcccucaucaacucccucaaggagcagauggaggacaugcgcaagaaggaggaccaccucgagcgcgagauggccgaggucuccggccagaacaagcgccucgccgacccccuccagaaggcccgcgaggagauguccgagaugcagaagcagcucgccaacuacgagcgcgacaagcagauccuccucugcaccaaggcccgccucaagguccgcgagaaggagcucaaggaccuccagugggagcacgagguccucgagcagcgcuucaccaagguccagcaggagcgcgacgagcucuaccgcaaguucaccgccgccauccaggagguccagcagaagaccggcuucaagaaccucguccucgagcgcaagcuccaggcccucuccgccgccgucgagaagaaggagguccaguucaacgagguccucgccgccuccaaccucgaccccgccgcccucacccucgucucccgcaagcucgaggacguccucgaguccaagaacuccaccaucaaggaccuccaguacgagcucgcccaggucugcaaggcccacaacgaccuccuccgcaccuacgaggccaagcuccucgccuucggcaucccccucgacaacgucggcuucaagccccucgagaccgccgucaucggccagacccucggccagggccccgccggccucgucggcacccccaccuga

SEQ ID NO: 43520 - RNA, 306 nt, Artificial Sequence
  derived and/or modified sequence opt2 from GAST__Homo_sapiens__NP_000796
augcagcgccucugcgucuacguccucaucuucgcccucgcccucgccgccuucuccgaggccuccuggaagccccgcucccagcagcccgacgccccccucggcaccggcgccaaccgcgaccucgagcuccccuggcucgagcagcagggccccgccucccaccaccgccgccagcucggcccccagggccccccccaccucgucgccgaccccuccaagaagcagggccccuggcucgaggaggaggaggaggccuacggcuggauggacuucggccgccgcuccgccgaggacgagaacuga

SEQ ID NO: 43521 - RNA, 1242 nt, Artificial Sequence
  derived and/or modified sequence opt2 from GATA1__Homo_sapiens__NP_002040
auggaguuccccggccucggcucccucggcaccuccgagccccucccccaguucgucgaccccgcccucgucuccuccacccccgaguccggcgucuucuuccccuccggccccgagggccucgacgccgccgccuccuccaccgcccccuccaccgccaccgccgccgccgccgcccucgccuacuaccgcgacgccgaggccuaccgccacucccccgucuuccaggucuacccccuccucaacugcauggagggcauccccggcggcucccccuacgccggcugggccuacggcaagaccggccucuaccccgccuccaccgucugccccacccgcgaggacucccccccccaggccgucgaggaccucgacggcaagggcuccaccuccuuccucgagacccucaagaccgagcgccucucccccgaccuccucacccucggccccgcccuccccuccucccuccccguccccaacuccgccuacggcggccccgacuucuccuccaccuucuucucccccaccggcuccccccucaacuccgccgccuacuccucccccaagcuccgcggcacccucccccucccccccugcgaggcccgcgagugcgucaacugcggcgccaccgccaccccccucuggcgccgcgaccgcaccggccacuaccucugcaacgccugcggccucuaccacaagaugaacggccagaaccgcccccucauccgccccaagaagcgccucaucgucuccaagcgcgccggcacccagugcaccaacugccagaccaccaccaccacccucuggcgccgcaacgccuccggcgaccccgucugcaacgccugcggccucuacuacaagcuccaccaggucaaccgcccccucaccaugcgcaaggacggcauccagacccgcaaccgcaaggccuccggcaagggcaagaagaagcgcggcuccucccucggcggcaccggcgccgccgagggccccgccggcggcuucauggucgucgccggcggcuccggcuccggcaacugcggcgaggucgccuccggccucacccucggcccccccggcaccgcccaccucuaccagggccucggccccgucguccucuccggccccgucucccaccucaugcccuuccccggcccccuccucggcucccccaccggcuccuuccccaccggccccaugccccccaccaccuccaccaccgucgucgccccccucuccuccuga

SEQ ID NO: 43522 - RNA, 1443 nt, Artificial Sequence
  derived and/or modified sequence opt2 from GATA2__Homo_sapiens__NP_001139133
auggaggucgcccccgagcagccccgcuggauggcccaccccgccguccucaacgcccagcaccccgacucccaccaccccggccucgcccacaacuacauggagcccgcccagcuccucccccccgacgaggucgacgucuucuucaaccaccucgacucccagggcaaccccuacuacgccaaccccgcccacgcccgcgcccgcgucuccuacucccccgcccacgcccgccucaccggcggccagaugugccgcccccaccuccuccacucccccggccuccccuggcucgacggcggcaaggccgcccucuccgccgccgccgcccaccaccacaaccccuggaccgucucccccuucuccaagaccccccuccaccccuccgccgccggcggccccggcggcccccucuccgucuaccccggcgccggcggcggcuccggcggcggcuccggcuccuccgucgccucccucacccccaccgccgcccacuccggcucccaccucuucggcuucccccccaccccccccaaggaggucucccccgaccccuccaccaccggcgccgccucccccgccuccuccuccgccggcggcuccgccgcccgcggcgaggacaaggacggcgucaaguaccaggucucccucaccgaguccaugaagauggaguccggcuccccccuccgccccggccucgccaccaugggcacccagcccgccacccaccaccccauccccaccuaccccuccuacguccccgccgccgcccacgacuacuccuccggccucuuccaccccggcggcuuccucggcggccccgccuccuccuucacccccaagcagcgcuccaaggcccgcuccugcuccgagggccgcgagugcgucaacugcggcgccaccgccaccccccucuggcgccgcgacggcaccggccacuaccucugcaacgccugcggccucuaccacaagaugaacggccagaaccgcccccucaucaagcccaagcgccgccucuccgccgcccgccgcgccggcaccugcugcgccaacugccagaccaccaccaccacccucuggcgccgcaacgccaacggcgaccccgucugcaacgccugcggccucuacuacaagcuccacaacgucaaccgcccccucaccaugaagaaggagggcauccagacccgcaaccgcaagauguccaacaaguccaagaaguccaagaagggcgccgagugcuucgaggagcucuccaagugcaugcaggagaaguccucccccuucuccgccgccgcccucgccggccacauggcccccgucggccaccucccccccuucucccacuccggccacauccuccccacccccacccccauccaccccuccuccucccucuccuucggccacccccaccccuccuccauggucaccgccaugggcuga

SEQ ID NO: 43523 - RNA, 1332 nt, Artificial Sequence
  derived and/or modified sequence opt2 from GATA3__Homo_sapiens__NP_002042
auggaggucaccgccgaccagccccgcugggucucccaccaccaccccgccguccucaacggccagcaccccgacacccaccaccccggccucucccacuccuacauggacgccgcccaguacccccuccccgaggaggucgacguccucuucaacaucgacggccagggcaaccacgucccccccuacuacggcaacuccguccgcgccaccguccagcgcuacccccccacccaccacggcucccaggucugccgccccccccuccuccacggcucccuccccuggcucgacggcggcaaggcccucggcucccaccacaccgccucccccuggaaccucucccccuucuccaagaccuccauccaccacggcucccccggcccccucuccgucuacccccccgccuccuccuccucccucuccggcggccacgccuccccccaccucuucaccuucccccccaccccccccaaggacgucucccccgaccccucccucuccacccccggcuccgccggcuccgcccgccaggacgagaaggagugccucaaguaccaggucccccuccccgacuccaugaagcucgaguccucccacucccgcggcuccaugaccgcccucggcggcgccuccuccuccacccaccaccccaucaccaccuacccccccuacguccccgaguacuccuccggccucuucccccccuccucccuccucggcggcucccccaccggcuucggcugcaagucccgccccaaggcccgcuccuccaccggccgcgagugcgucaacugcggcgccaccuccaccccccucuggcgccgcgacggcaccggccacuaccucugcaacgccugcggccucuaccacaagaugaacggccagaaccgcccccucaucaagcccaagcgccgccucuccgccgcccgccgcgccggcaccuccugcgccaacugccagaccaccaccaccacccucuggcgccgcaacgccaacggcgaccccgucugcaacgccugcggccucuacuacaagcuccacaacaucaaccgcccccucaccaugaagaaggagggcauccagacccgcaaccgcaagauguccuccaaguccaagaagugcaagaagguccacgacucccucgaggacuuccccaagaacuccuccuucaaccccgccgcccucucccgccacauguccucccucucccacaucucccccuucucccacuccucccacaugcucaccacccccacccccaugcacccccccuccucccucuccuucggcccccaccaccccuccuccauggucaccgccaugggcuga

SEQ ID NO: 43524 - RNA, 1329 nt, Artificial Sequence
  derived and/or modified sequence opt2 from GATA4__Homo_sapiens__NP_002043
auguaccagucccucgccauggccgccaaccacggccccccccccggcgccuacgaggccggcggccccggcgccuucaugcacggcgccggcgccgccuccucccccgucuacguccccaccccccgcguccccuccuccguccucggccucuccuaccuccagggcggcggcgccggcuccgccuccggcggcgccuccggcggcuccuccggcggcgccgccuccggcgccggccccggcacccagcagggcucccccggcuggucccaggccggcgccgacggcgccgccuacacccccccccccgucuccccccgcuucuccuuccccggcaccaccggcucccucgccgccgccgccgccgccgccgccgcccgcgaggccgccgccuacuccuccggcggcggcgccgccggcgccggccucgccggccgcgagcaguacggccgcgccggcuucgccggcuccuacuccucccccuaccccgccuacauggccgacgucggcgccuccugggccgccgccgccgccgccuccgccggccccuucgacucccccguccuccacucccuccccggccgcgccaaccccgccgcccgccaccccaaccucgacauguucgacgacuucuccgagggccgcgagugcgucaacugcggcgccauguccaccccccucuggcgccgcgacggcaccggccacuaccucugcaacgccugcggccucuaccacaagaugaacggcaucaaccgcccccucaucaagccccagcgccgccucuccgccucccgccgcgucggccucuccugcgccaacugccagaccaccaccaccacccucuggcgccgcaacgccgagggcgagcccgucugcaacgccugcggccucuacaugaagcuccacggcgucccccgcccccucgccaugcgcaaggagggcauccagacccgcaagcgcaagcccaagaaccucaacaaguccaagacccccgccgcccccuccggcuccgagucccucccccccgccuccggcgccuccuccaacuccuccaacgccaccaccuccuccuccgaggagaugcgccccaucaagaccgagcccggccucuccucccacuacggccacuccuccuccgucucccagaccuucuccgucuccgccauguccggccacggccccuccauccaccccguccucuccgcccucaagcucuccccccagggcuacgccucccccgucucccaguccccccagaccuccuccaagcaggacuccuggaacucccucguccucgccgacucccacggcgacaucaucaccgccuga

SEQ ID NO: 43525 - RNA, 1194 nt, Artificial Sequence
  derived and/or modified sequence opt2 from GATA5__Homo_sapiens__XP_006723762
auguaccagucccucgcccucgccgccuccccccgccaggccgccuacgccgacuccggcuccuuccuccacgcccccggcgccggcucccccauguucgucccccccgcccgcguccccuccaugcucuccuaccucuccggcugcgagcccuccccccagccccccgagcucgccgcccgccccggcugggcccagaccgccaccgccgacuccuccgccuucggccccggcuccccccacccccccgccgcccacccccccggcgccaccgccuuccccuucgcccacucccccuccggccccggcuccggcggcuccgccggcggccgcgacggcuccgccuaccagggcgcccuccucccccgcgagcaguucgccgccccccucggccgccccgucggcaccuccuacuccgccaccuaccccgccuacgucucccccgacgucgcccaguccuggaccgccggccccuucgacggcuccguccuccacggccuccccggccgccgccccaccuucgucuccgacuuccucgaggaguuccccggcgagggccgcgagugcgucaacugcggcgcccucuccaccccccucuggcgccgcgacggcaccggccacuaccucugcaacgccugcggccucuaccacaagaugaacggcgucaaccgcccccucguccgcccccagaagcgccucuccuccucccgccgcgccggccucugcugcaccaacugccacaccaccaacaccacccucuggcgccgcaacuccgagggcgagcccgucugcaacgccugcggccucuacaugaagcuccacggcgucccccgcccccucgccaugaagaaggaguccauccagacccgcaagcgcaagcccaagaccaucgccaaggcccgcggcuccuccggcuccacccgcaacgccuccgccucccccuccgccgucgccuccaccgacuccuccgccgccaccuccaaggccaagcccucccucgccucccccgucugccccggccccuccauggccccccaggccuccggccaggaggacgacucccucgcccccggccaccucgaguucaaguucgagcccgaggacuucgccuuccccuccaccgcccccuccccccaggccggccuccgcggcgcccuccgccaggaggccuggugcgcccucgcccucgccuga

SEQ ID NO: 43526 - RNA, 1788 nt, Artificial Sequence
  derived and/or modified sequence opt2 from GATA6__Homo_sapiens__NP_005248
auggcccucaccgacggcggcuggugccuccccaagcgcuucggcgccgccggcgccgacgccuccgacucccgcgccuuccccgcccgcgagcccuccaccccccccucccccaucuccuccuccuccuccuccugcucccgcggcggcgagcgcggccccggcggcgccuccaacugcggcaccccccagcucgacaccgaggccgccgccggcccccccgcccgcucccuccuccucuccuccuacgccucccaccccuucggcgccccccacggccccuccgcccccggcgucgccggccccggcggcaaccucuccuccugggaggaccuccuccucuucaccgaccucgaccaggccgccaccgccuccaagcuccucugguccucccgcggcgccaagcucucccccuucgcccccgagcagcccgaggagauguaccagacccucgccgcccucuccucccagggccccgccgccuacgacggcgcccccggcggcuucguccacuccgccgccgccgccgccgccgccgccgccgccgccuccucccccgucuacguccccaccacccgcgucggcuccaugcuccccggccuccccuaccaccuccagggcuccggcuccggccccgccaaccacgccggcggcgccggcgcccaccccggcuggccccaggccuccgccgacuccccccccuacggcuccggcggcggcgccgccggcggcggcgccgccggccccggcggcgccggcuccgccgccgcccacgucuccgcccgcuuccccuacucccccuccccccccauggccaacggcgccgcccgcgagcccggcggcuacgccgccgccggcuccggcggcgccggcggcgucuccggcggcggcuccucccucgccgccaugggcggccgcgagccccaguacuccucccucuccgccgcccgcccccucaacggcaccuaccaccaccaccaccaccaccaccaccaccaccccucccccuacucccccuacgucggcgccccccucacccccgccuggcccgccggccccuucgagacccccguccuccacucccuccagucccgcgccggcgccccccuccccgucccccgcggccccuccgccgaccuccucgaggaccucuccgagucccgcgagugcgucaacugcggcuccauccagaccccccucuggcgccgcgacggcaccggccacuaccucugcaacgccugcggccucuacuccaagaugaacggccucucccgcccccucaucaagccccagaagcgcguccccuccucccgccgccucggccucuccugcgccaacugccacaccaccaccaccacccucuggcgccgcaacgccgagggcgagcccgucugcaacgccugcggccucuacaugaagcuccacggcgucccccgcccccucgccaugaagaaggagggcauccagacccgcaagcgcaagcccaagaacaucaacaaguccaagaccugcuccggcaacuccaacaacuccauccccaugacccccaccuccaccuccuccaacuccgacgacugcuccaagaacaccucccccaccacccagcccaccgccuccggcgccggcgcccccgucaugaccggcgccggcgaguccaccaaccccgagaacuccgagcucaaguacuccggccaggacggccucuacaucggcgucucccucgccucccccgccgaggucaccuccuccguccgccccgacuccuggugcgcccucgcccucgccuga

SEQ ID NO: 43527 - RNA, 810 nt, Artificial Sequence
  derived and/or modified sequence opt2 from GATAD1__Homo_sapiens__NP_066990
augccccucggccucaagcccaccugcuccgucugcaagaccaccuccuccuccauguggaagaagggcgcccagggcgagauccucugccaccacugcaccggccgcggcggcgccggcuccggcggcgccggcuccggcgccgccggcggcaccggcggcuccggcggcggcggcuucggcgccgccaccuucgccuccaccuccgccacccccccccaguccaacggcggcggcggcggcaagcaguccaagcaggagauccaccgccgcuccgcccgccuccgcaacaccaaguacaaguccgcccccgccgccgagaagaaggucuccaccaagggcaagggccgccgccacaucuucaagcucaagaaccccaucaaggcccccgaguccgucuccaccaucaucaccgccgaguccaucuucuacaagggcgucuacuaccagaucggcgacgucgucuccgucaucgacgagcaggacggcaagcccuacuacgcccagauccgcggcuucauccaggaccaguacugcgagaaguccgccgcccucaccuggcucauccccacccucuccuccccccgcgaccaguucgaccccgccuccuacaucaucggccccgaggaggaccucccccgcaagauggaguaccucgaguucgucugccacgcccccuccgaguacuucaagucccgcuccucccccuuccccaccguccccacccgccccgagaagggcuacaucuggacccacgucggccccacccccgccaucaccaucaaggaguccgucgccaaccaccucuga

SEQ ID NO: 43528 - RNA, 1905 nt, Artificial Sequence
  derived and/or modified sequence opt2 from GATAD2A__Homo_sapiens__NP_001287875
augaccgaggaggccugccgcacccgcucccagaagcgcgcccucgagcgcgaccccaccgaggacgacgucgaguccaagaagaucaagauggagcgcggccuccucgccuccgaccucaacaccgacggcgacaugcgcgucacccccgagcccggcgccggccccacccagggccuccuccgcgccaccgaggccaccgccauggccaugggccgcggcgagggccucgucggcgacggccccgucgacaugcgcaccucccacuccgacaugaaguccgagcgccgcccccccucccccgacgucaucguccucuccgacaacgagcagcccuccuccccccgcgucaacggccucaccaccgucgcccucaaggagaccuccaccgaggcccucaugaaguccucccccgaggagcgcgagcgcaugaucaagcagcucaaggaggagcuccgccucgaggaggccaagcucguccuccucaagaagcuccgccagucccagauccagaaggaggccaccgcccagaagcccaccggcuccgucggcuccaccgucaccaccccccccccccucguccgcggcacccagaacauccccgccggcaagcccucccuccagaccuccuccgcccgcaugcccggcuccgucaucccccccccccucguccgcggcggccagcaggccuccuccaagcucggcccccaggccuccucccaggucgucaugcccccccucguccgcggcgcccagcagauccacuccauccgccagcacuccuccaccggcccccccccccuccuccucgccccccgcgccuccguccccuccguccagauccagggccagcgcaucauccagcagggccucauccgcgucgccaacguccccaacaccucccuccucgucaacaucccccagcccacccccgccucccucaagggcaccaccgccaccuccgcccaggccaacuccacccccaccuccgucgccuccgucgucaccuccgccgagucccccgccucccgccaggccgccgccaagcucgcccuccgcaagcagcucgagaagacccuccucgagauccccccccccaagccccccgcccccgagaugaacuuccuccccuccgccgccaacaacgaguucaucuaccucgucggccucgaggaggucguccagaaccuccucgagacccaggccggccgcauguccgccgccaccguccucucccgcgagcccuacaugugcgcccagugcaagaccgacuucaccugccgcuggcgcgaggagaaguccggcgccaucaugugcgagaacugcaugaccaccaaccagaagaaggcccucaaggucgagcacaccucccgccucaaggccgccuucgucaaggcccuccagcaggagcaggagaucgagcagcgccuccuccagcagggcaccgcccccgcccaggccaaggccgagcccaccgccgccccccaccccguccucaagcaggucaucaagccccgccgcaagcucgccuuccgcuccggcgaggcccgcgacugguccaacggcgccguccuccaggccuccucccagcucucccgcggcuccgccaccaccccccgcggcguccuccacaccuucucccccucccccaagcuccagaacuccgccuccgccaccgcccucgucucccgcaccggccgccacuccgagcgcaccgucuccgccggcaagggcuccgccaccuccaacuggaagaagaccccccucuccaccggcggcacccucgccuucgucucccccucccucgccguccacaaguccuccuccgccgucgaccgccagcgcgaguaccuccucgacaugauccccccccgcuccaucccccaguccgccaccuggaaguga

SEQ ID NO: 43529 - RNA, 1782 nt, Artificial Sequence
  derived and/or modified sequence opt2 from GATAD2B__Homo_sapiens__XP_006711532
auggaccgcaugaccgaggacgcccuccgccucaaccuccucaagcgcucccucgaccccgccgacgagcgcgacgacguccucgccaagcgccucaagauggagggccacgaggccauggagcgccucaagaugcucgcccuccucaagcgcaaggaccucgccaaccucgaggucccccacgagcuccccaccaagcaggacggcuccggcgucaagggcuacgaggagaagcucaacggcaaccuccgcccccacggcgacaaccgcaccgccggccgccccggcaaggagaacaucaacgacgagcccgucgacauguccgcccgccgcuccgagcccgagcgcggccgccucacccccucccccgacaucaucguccucuccgacaacgaggccuccuccccccgcuccuccucccgcauggaggagcgccucaaggccgccaaccucgagauguucaagggcaagggcaucgaggagcgccagcagcucaucaagcagcuccgcgacgagcuccgccucgaggaggcccgccucguccuccucaagaagcuccgccagucccagcuccagaaggagaacgucguccagaagacccccgucguccagaacgccgccuccaucguccagcccucccccgcccacgucggccagcagggccucuccaagcuccccucccgccccggcgcccagggcgucgagccccagaaccuccgcacccuccagggccacuccgucauccgcuccgccaccaacaccacccucccccacaugcucaugucccagcgcgucaucgcccccaaccccgcccagcuccagggccagcgcggcccccccaagcccggccucguccgcaccaccacccccaacaugaaccccgccaucaacuaccagccccaguccuccuccuccguccccugccagcgcaccaccuccuccgccaucuacaugaaccucgccucccacauccagcccggcaccgucaaccgcgucuccuccccccuccccucccccuccgccaugaccgacgccgccaacucccaggccgccgccaagcucgcccuccgcaagcagcucgagaagacccuccucgagauccccccccccaagccccccgccccccuccuccacuuccuccccuccgccgccaacuccgaguucaucuacauggucggccucgaggaggucguccaguccgucaucgacucccagggcaaguccugcgccucccuccuccgcgucgagcccuucgucugcgcccagugccgcaccgacuucaccccccacuggaagcaggagaagaacggcaagauccucugcgagcagugcaugaccuccaaccagaagaaggcccucaaggccgagcacaccaaccgccucaagaacgccuucgucaaggcccuccagcaggagcaggagaucgagcagcgccuccagcagcaggccgcccucucccccaccaccgcccccgccgucuccuccgucuccaagcaggagaccaucaugcgccaccacacccuccgccaggccccccagccccaguccucccuccagcgcggcauccccaccuccgcccgcuccaugcucuccaacuucgcccaggccccccagcucuccguccccggcggccuccucggcaugcccggcgucaacaucgccuaccucaacaccggcaucggcggccacaagggccccucccucgccgaccgccagcgcgaguaccuccucgacaugauccccccccgcuccaucucccaguccaucuccggccagaaguga

SEQ ID NO: 43530 - RNA, 1674 nt, Artificial Sequence
  derived and/or modified sequence opt2 from GATB__Homo_sapiens__NP_004555
auggccgcccccaugcuccgcuggggcugccgcggccgccgcugggccuucgcccgcgucgacggcggcuccugccaccgccgcggcgcccccaccggcuccaccuccaaccagauccgcggcgaguccuccgucgcccagcagccccuccacaccgcccagaagacccgcaagggcgagcacaagugggccgccgucgucggccucgagauccacgcccagaucuccuccaacuccaagcucuucuccggcucccagguccgcuucuccgccccccccaacucccucgucuccuucuucgacgccucccuccccggcacccuccccguccucaaccgccgcugcgucgaggccgccgucaugaccggccucgcccucaacugccacaucaacaagaagucccucuucgaccgcaagcacuacuucuacgccgaccuccccgccggcuaccagaucacccagcagcgccuccccaucgccgucaacggcucccucaucuacggcgucugcgccggcaagaagcagucccaggucauccccaagaccguccgcaucaagcagauccagcucgagcaggacuccggcaagucccuccacgacaaccuccgcucccagacccucaucgaccucaaccgcgccggcgucggccuccucgaggucguccucgagcccgacauguccugcggcgaggaggccgccaccgccguccgcgagcuccagcucauccuccaggcccucggcaccucccaggccaacauggccgagggccagcuccgcgucgacgccaacaucuccguccaccaccccggcgagccccucggcguccgcaccgaggucaagaaccucaacuccauccgcuuccucgccaaggccaucgacuacgagauccagcgccagaucaacgagcucgagaacggcggcgagauccucaacgagacccgcuccuuccaccacaagcucggcugcaccauguccaugcgcgacaaggagggcaagcaggacuaccgcuucaugcccgagcccaaccuccccccccucguccucuacgacgccaccucccuccccgccggcgccgacccccagcaggucaucaacaucgaccagauccgcgagacccuccccgagcuccccuccgucacccgcgagaagcucguccagcaguacggcaugcuccucgagcacuccuucacccuccucaacgaggucggccuccucgaguucuuccagaacgucaucaaggagacccgcgccgagcccaagaaggucaccuccuggguccucaacaccuuccucggcuaccucaagcagcagaaccucgccgucuccgagucccccgucacccccuccgcccucgccgagcuccucgaccuccucgacucccgcaccaucuccuccuccgccgccaagcaggucuucgaggagcucuggaagcgcgagggcaagacccccggccagaucgucuccgagaagcagcucgagcucaugcaggaccagggcgcccucgagcagcucugccacuccgucauggaggcccacccccaggucgucauggacgucaagaaccgcaacccccgcgccaucaacaagcucaucggccucguccgcaaggccacccagucccgcgccgaccccgucaugaucaaggagauccucgagaagaagcucucccucuga

SEQ ID NO: 43531 - RNA, 1272 nt, Artificial Sequence
  derived and/or modified sequence opt2 from GATM__Homo_sapiens__NP_001473
augcuccgcguccgcugccuccgcggcggcucccgcggcgccgaggccguccacuacaucggcucccgccucggccgcacccucaccggcuggguccagcgcaccuuccaguccacccaggccgccaccgccuccucccgcaacuccugcgccgccgacgacaaggccaccgagccccuccccaaggacugccccgucuccuccuacaacgagugggacccccucgaggaggucaucgucggccgcgccgagaacgccugcgucccccccuucaccaucgaggucaaggccaacaccuacgagaaguacuggcccuucuaccagaagcagggcggccacuacuuccccaaggaccaccucaagaaggccgucgccgagaucgaggagaugugcaacauccucaagaccgagggcgucaccguccgccgccccgaccccaucgacuggucccucaaguacaagacccccgacuucgaguccaccggccucuacuccgccaugccccgcgacauccucaucgucgucggcaacgagaucaucgaggcccccauggccuggcgcucccgcuucuucgaguaccgcgccuaccgcuccaucaucaaggacuacuuccaccgcggcgccaaguggaccaccgcccccaagcccaccauggccgacgagcucuacaaccaggacuaccccauccacuccgucgaggaccgccacaagcucgccgcccagggcaaguucgucaccaccgaguucgagcccugcuucgacgccgccgacuucauccgcgccggccgcgacaucuucgcccagcgcucccaggucaccaacuaccucggcaucgaguggaugcgccgccaccucgcccccgacuaccgcguccacaucaucuccuucaaggaccccaaccccaugcacaucgacgccaccuucaacaucaucggccccggcaucguccucuccaaccccgaccgccccugccaccagaucgaccucuucaagaaggccggcuggaccaucaucaccccccccacccccaucauccccgacgaccacccccucuggauguccuccaaguggcucuccaugaacguccucaugcucgacgagaagcgcgucauggucgacgccaacgagguccccauccagaagauguucgagaagcucggcaucaccaccaucaaggucaacauccgcaacgccaacucccucggcggcggcuuccacugcuggaccugcgacguccgccgccgcggcacccuccaguccuaccucgacuga

SEQ ID NO: 43532 - RNA, 2784 nt, Artificial Sequence
  derived and/or modified sequence opt2 from GBA2__Homo_sapiens__NP_065995
augggcacccaggaccccggcaacaugggcaccggcguccccgccuccgagcagaucuccugcgccaaggaggacccccaggucuacugccccgaggagaccggcggcaccaaggacguccaggucaccgacugcaagucccccgaggacucccgcccccccaaggagaccgacugcugcaaccccgaggacuccggccagcucauggucuccuacgagggcaaggccaugggcuaccaggucccccccuucggcuggcgcaucugccucgcccacgaguucaccgagaagcgcaagcccuuccaggccaacaacgucucccucuccaacaugaucaagcacaucggcaugggccuccgcuaccuccaguggugguaccgcaagacccacgucgagaagaagacccccuucaucgacaugaucaacuccgucccccuccgccagaucuacggcugcccccucggcggcaucggcggcggcaccaucacccgcggcuggcgcggccaguucugccgcuggcagcucaaccccggcauguaccagcaccgcaccgucaucgccgaccaguucaccgucugccuccgccgcgagggccagaccgucuaccagcagguccucucccucgagcgccccuccguccuccgcuccuggaacuggggccucugcggcuacuucgccuucuaccacgcccucuacccccgcgccuggaccgucuaccagcuccccggccagaacgucacccucaccugccgccagaucacccccauccucccccacgacuaccaggacuccucccuccccgucggcgucuucgucugggacgucgagaacgagggcgacgaggcccucgacgucuccaucauguucuccaugcgcaacggccucggcggcggcgacgacgcccccggcggccucuggaacgagcccuucugccucgagcgcuccggcgagaccguccgcggccuccuccuccaccaccccacccuccccaaccccuacaccauggccgucgccgcccgcgucaccgccgccaccaccgucacccacaucaccgccuucgaccccgacuccaccggccagcaggucuggcaggaccuccuccaggacggccagcucgacucccccaccggccaguccacccccacccagaagggcgucggcaucgccggcgccgucugcgucuccuccaagcuccgcccccgcggccagugccgccucgaguucucccucgccugggacaugccccgcaucauguucggcgccaagggccagguccacuaccgccgcuacacccgcuucuucggccaggacggcgacgccgcccccgcccucucccacuacgcccucugccgcuacgccgagugggaggagcgcaucuccgccuggcagucccccguccucgacgaccgcucccuccccgccugguacaaguccgcccucuucaacgagcucuacuuccucgccgacggcggcaccgucuggcucgagguccucgaggacucccuccccgaggagcucggccgcaacaugugccaccuccgccccacccuccgcgacuacggccgcuucggcuaccucgagggccaggaguaccgcauguacaacaccuacgacguccacuucuacgccuccuucgcccucaucaugcucuggcccaagcucgagcucucccuccaguacgacauggcccucgccacccuccgcgaggaccucacccgccgccgcuaccucauguccggcgucauggcccccgucaagcgccgcaacgucaucccccacgacaucggcgaccccgacgacgagcccuggcuccgcgucaacgccuaccucauccacgacaccgccgacuggaaggaccucaaccucaaguucguccuccaggucuaccgcgacuacuaccucaccggcgaccagaacuuccucaaggacauguggcccgucugccucgccgucauggaguccgagaugaaguucgacaaggaccacgacggccucaucgagaacggcggcuacgccgaccagaccuacgacggcugggucaccaccggccccuccgccuacugcggcggccucuggcucgccgccgucgccgucaugguccagauggccgcccucugcggcgcccaggacauccaggacaaguucuccuccauccucucccgcggccaggaggccuacgagcgccuccucuggaacggccgcuacuacaacuacgacuccuccucccgcccccagucccgcuccgucauguccgaccagugcgccggccagugguuccucaaggccugcggccucggcgagggcgacaccgaggucuuccccacccagcacgucguccgcgcccuccagaccaucuucgagcucaacguccaggccuucgccggcggcgccaugggcgccgucaacggcaugcagccccacggcguccccgacaaguccuccguccaguccgacgaggucugggucggcgucgucuacggccucgccgccaccaugauccaggagggccucaccugggagggcuuccagaccgccgagggcugcuaccgcaccgucugggagcgccucggccucgccuuccagacccccgaggccuacugccagcagcgcgucuuccgcucccucgccuacaugcgcccccucuccaucugggccaugcagcucgcccuccagcagcagcagcacaagaaggccuccuggcccaaggucaagcagggcaccggccuccgcaccggccccauguucggccccaaggaggccauggccaaccucucccccgaguga

SEQ ID NO: 43533 - RNA, 1350 nt, Artificial Sequence
  derived and/or modified sequence opt2 from GBA__Homo_sapiens__NP_001165282
auggagcucuccaugggccccauccaggccaaccacaccggcaccggccuccuccucacccuccagcccgagcagaaguuccagaaggucaagggcuucggcggcgccaugaccgacgccgccgcccucaacauccucgcccucuccccccccgcccagaaccuccuccucaaguccuacuucuccgaggagggcaucggcuacaacaucauccgcguccccauggccuccugcgacuucuccauccgcaccuacaccuacgccgacacccccgacgacuuccagcuccacaacuucucccuccccgaggaggacaccaagcucaagaucccccucauccaccgcgcccuccagcucgcccagcgccccgucucccuccucgccucccccuggaccucccccaccuggcucaagaccaacggcgccgucaacggcaagggcucccucaagggccagcccggcgacaucuaccaccagaccugggcccgcuacuucgucaaguuccucgacgccuacgccgagcacaagcuccaguucugggccgucaccgccgagaacgagcccuccgccggccuccucuccggcuaccccuuccagugccucggcuucacccccgagcaccagcgcgacuucaucgcccgcgaccucggccccacccucgccaacuccacccaccacaacguccgccuccucaugcucgacgaccagcgccuccuccucccccacugggccaaggucguccucaccgaccccgaggccgccaaguacguccacggcaucgccguccacugguaccucgacuuccucgcccccgccaaggccacccucggcgagacccaccgccucuuccccaacaccaugcucuucgccuccgaggccugcgucggcuccaaguucugggagcaguccguccgccucggcuccugggaccgcggcaugcaguacucccacuccaucaucaccaaccuccucuaccacgucgucggcuggaccgacuggaaccucgcccucaaccccgagggcggccccaacuggguccgcaacuucgucgacucccccaucaucgucgacaucaccaaggacaccuucuacaagcagcccauguucuaccaccucggccacuucuccaaguucauccccgagggcucccagcgcgucggccucgucgccucccagaagaacgaccucgacgccgucgcccucaugcaccccgacggcuccgccgucgucgucguccucaaccgcuccuccaaggacgucccccucaccaucaaggaccccgccgucggcuuccucgagaccaucucccccggcuacuccauccacaccuaccucuggcgccgccaguga

SEQ ID NO: 43534 - RNA, 744 nt, Artificial Sequence
  derived and/or modified sequence opt2 from GBAS__Homo_sapiens__NP_001189398
auggccgcccgcguccuccgcgcccgcggcgccgccugggccggcggccuccuccagcgcgccgcccccugcucccuccucccccgccuccgcaccuggaccuccuccuccaaccgcucccgcgaggacuccuggcucaagucccucuucguccgcaaggucgacccccgcaaggacgcccacuccaaccuccucgccaagaaggagaccuccaaccucuacaagcuccaguucaagcgcugcugccagcgcuucaccaagaucaacaccacccucguccucugguggggccucggcacccgcggcauggccucccgcaccaagcucgaguuccucgaguuccgcaaggcccgcuccgacaugcuccucucccgcaagaaccagcuccuccucgaguucuccuucuggaacgagcccgucccccgcuccggccccaacaucuacgagcuccgcuccuaccagcuccgccccggcaccaugaucgaguggggcaacuacugggcccgcgccauccgcuuccgccaggacggcaacgaggccgucggcggcuucuucucccagaucggccagcucuacaugguccaccaccucugggccuaccgcgaccuccagacccgcgaggacauccgcaacgccgccuggcacaagcacggcugggaggagcucgucuacuacaccgucccccucauccaggagauggagucccgcaucaugaucccccucaagaccuccccccuccaguga

SEQ ID NO: 43535 - RNA, 2109 nt, Artificial Sequence
  derived and/or modified sequence opt2 from GBE1__Homo_sapiens__NP_000149
auggccgcccccaugacccccgccgcccgccccgaggacuacgaggccgcccucaacgccgcccucgccgacguccccgagcucgcccgccuccucgagaucgaccccuaccucaagcccuacgccgucgacuuccagcgccgcuacaagcaguucucccagauccucaagaacaucggcgagaacgagggcggcaucgacaaguucucccgcggcuacgaguccuucggcguccaccgcugcgccgacggcggccucuacugcaaggagugggcccccggcgccgagggcgucuuccucaccggcgacuucaacggcuggaaccccuucuccuaccccuacaagaagcucgacuacggcaagugggagcucuacaucccccccaagcagaacaaguccguccucgucccccacggcuccaagcucaaggucgucaucaccuccaaguccggcgagauccucuaccgcaucucccccugggccaaguacgucguccgcgagggcgacaacgucaacuacgacuggauccacugggaccccgagcacuccuacgaguucaagcacucccgccccaagaagccccgcucccuccgcaucuacgagucccacgucggcaucuccucccacgagggcaaggucgccuccuacaagcacuucaccugcaacguccucccccgcaucaagggccucggcuacaacugcauccagcucauggccaucauggagcacgccuacuacgccuccuucggcuaccagaucaccuccuucuucgccgccuccucccgcuacggcacccccgaggagcuccaggagcucgucgacaccgcccacuccaugggcaucaucguccuccucgacgucguccacucccacgccuccaagaacuccgccgacggccucaacauguucgacggcaccgacuccugcuacuuccacuccggcccccgcggcacccacgaccucugggacucccgccucuucgccuacuccuccugggagguccuccgcuuccuccucuccaacauccgcugguggcucgaggaguaccgcuucgacggcuuccgcuucgacggcgucaccuccaugcucuaccaccaccacggcgucggccagggcuucuccggcgacuacuccgaguacuucggccuccaggucgacgaggacgcccucaccuaccucaugcucgccaaccaccucguccacacccucugccccgacuccaucaccaucgccgaggacgucuccggcaugcccgcccucugcucccccaucucccagggcggcggcggcuucgacuaccgccucgccauggccauccccgacaaguggauccagcuccucaaggaguucaaggacgaggacuggaacaugggcgacaucgucuacacccucaccaaccgccgcuaccucgagaagugcaucgccuacgccgagucccacgaccaggcccucgucggcgacaagucccucgccuucuggcucauggacgccgagauguacaccaacauguccguccucacccccuucacccccgucaucgaccgcggcauccagcuccacaagaugauccgccucaucacccacggccucggcggcgagggcuaccucaacuucaugggcaacgaguucggccaccccgaguggcucgacuucccccgcaagggcaacaacgaguccuaccacuacgcccgccgccaguuccaccucaccgacgacgaccuccuccgcuacaaguuccucaacaacuucgaccgcgacaugaaccgccucgaggagcgcuacggcuggcucgccgccccccaggccuacgucuccgagaagcacgagggcaacaagaucaucgccuucgagcgcgccggccuccucuucaucuucaacuuccaccccuccaaguccuacaccgacuaccgcgucggcaccgcccuccccggcaaguucaagaucguccucgacuccgacgccgccgaguacggcggccaccagcgccucgaccacuccaccgacuucuucuccgaggccuucgagcacaacggccgccccuacucccuccucgucuacauccccucccgcgucgcccucauccuccagaacgucgaccuccccaacuga

SEQ ID NO: 43536 - RNA, 5580 nt, Artificial Sequence
  derived and/or modified sequence opt2 from GBF1__Homo_sapiens__NP_004184
auggucgacaagaacaucuacaucauccagggcgagaucaacaucgucgucggcgccaucaagcgcaacgcccgcugguccacccacaccccccucgacgaggagcgcgacccccuccuccacuccuucggccaccucaaggagguccucaacuccaucaccgagcucuccgagaucgagcccaacgucuuccuccgccccuuccucgaggucauccgcuccgaggacaccaccggccccaucaccggccucgcccucaccuccgucaacaaguuccucuccuacgcccucaucgaccccacccacgagggcaccgccgagggcauggagaacauggccgacgccgucacccacgcccgcuucgucggcaccgaccccgccuccgacgaggucguccucaugaagauccuccagguccuccgcacccuccuccucacccccgucggcgcccaccucaccaacgaguccgucugcgagaucaugcaguccugcuuccgcaucugcuucgagaugcgccucuccgagcuccuccgcaaguccgccgagcacacccucgucgacaugguccagcuccucuucacccgccucccccaguucaaggaggagcccaagaacuacgucggcaccaacaugaagaagcucaagaugcgcgccggcggcauguccgacuccuccaaguggaagaagcagaagcgcuccccccgccccccccgccacaugaccaaggucacccccggcuccgagcuccccacccccaacggcaccacccucuccuccaaccucaccggcggcaugcccuucaucgacguccccacccccaucuccuccgccuccuccgaggccgccuccgccgucgucucccccuccaccgacuccggccucgaguucuccucccagaccaccuccaaggaggaccucaccgaccucgagcagcccggcucccccggcuacuccaccgccaccgagcccggcuccuccgagcucggcguccccgagcagcccgaccuccaggagggcacccacgucgagaagucccaguccgccuccgucgaguccauccccgagguccucgaggagugcaccucccccgccgaccacuccgacuccgccuccguccacgacauggacuacgucaacccccgcggcguccgcuucacccaguccucccagaaggagggcaccgcccucguccccuacggccuccccugcauccgcgagcucuuccgcuuccucaucucccucaccaacccccacgaccgccacaacuccgaggucaugauccacaugggccuccaccuccucaccgucgcccucgaguccgcccccgucgcccagugccagacccuccucggccucaucaaggacgagaugugccgccaccucuuccagcuccucuccaucgagcgccucaaccucuacgccgccucccuccgcgucugcuuccuccucuucgaguccaugcgcgagcaccucaaguuccagauggagauguacaucaagaagcucauggagaucaucaccgucgagaaccccaagaugcccuacgagaugaaggagauggcccucgaggccaucguccagcucuggcgcauccccuccuucgucaccgagcucuacaucaacuacgacugcgacuacuacugcuccaaccucuucgaggagcucaccaagcuccucuccaagaacgccuuccccgucuccggccagcucuacaccacccaccuccucucccucgacgcccuccucaccgucaucgacuccaccgaggcccacugccaggccaagguccucaacucccucacccagcaggagaagaaggagaccgcccgccccuccugcgagaucgucgacggcacccgcgaggccuccaacaccgagcgcaccgccuccgacggcaaggccgucggcauggccuccgacauccccggccuccaccuccccggcggcggccgccucccccccgagcacggcaaguccggcugcuccgaccucgaggaggccgucgacuccggcgccgacaagaaguucgcccgcaagcccccccgcuucuccugccuccuccccgacccccgcgagcucaucgagaucaagaacaagaagaagcuccucaucaccggcaccgagcaguucaaccagaagcccaagaagggcauccaguuccuccaggagaagggccuccucaccauccccauggacaacaccgaggucgcccaguggcuccgcgagaacccccgccucgacaagaagaugaucggcgaguucgucuccgaccgcaagaacaucgaccuccucgaguccuucgucuccaccuucuccuuccagggccuccgccucgacgaggcccuccgccucuaccucgaggccuuccgccuccccggcgaggcccccgucauccagcgccuccucgaggccuucaccgagcgcuggaugaacugcaacggcucccccuucgccaacuccgacgccugcuucucccucgccuacgccgucaucaugcucaacaccgaccagcacaaccacaacguccgcaagcagaacgcccccaugacccucgaggaguuccgcaagaaccucaagggcgucaacggcggcaaggacuucgagcaggacauccucgaggacauguaccacgccaucaagaacgaggagaucgucaugcccgaggagcagaccggccucguccgcgagaacuacgucuggaacguccuccuccaccgcggcgccacccccgagggcaucuuccuccgcguccccaccgccuccuacgaccucgaccucuucaccaugaccuggggccccaccaucgccgcccucuccuacgucuucgacaagucccucgaggagaccaucauccagaaggccaucuccggcuuccgcaagugcgccaugaucuccgcccacuacggccucuccgacgucuucgacaaccucaucaucucccucugcaaguucaccgcccucuccuccgaguccaucgagaaccuccccuccgucuucggcuccaaccccaaggcccacaucgccgccaagaccgucuuccaccucgcccaccgccacggcgacauccuccgcgagggcuggaagaacaucauggaggccaugcuccagcucuuccgcgcccagcuccuccccaaggccaugaucgaggucgaggacuucgucgaccccaacggcaagaucucccuccagcgcgaggagacccccuccaaccgcggcgaguccaccguccucuccuucgucuccuggcucacccucuccggccccgagcaguccuccguccgcggccccuccaccgagaaccaggaggccaagcgcgucgcccucgagugcaucaagcagugcgaccccgagaagaugaucaccgaguccaaguuccuccagcucgagucccuccaggagcucaugaaggcccucgucuccgucacccccgacgaggagaccuacgacgaggaggacgccgccuucugccucgagaugcuccuccgcaucguccucgagaaccgcgaccgcgucggcugcgucuggcagaccguccgcgaccaccucuaccaccucugcguccaggcccaggacuucugcuuccucgucgagcgcgccgucgucggccuccuccgccucgccauccgccuccuccgccgcgaggagaucuccgcccagguccuccucucccuccgcauccuccuccucaugaagcccuccguccucucccgcgucucccaccaggucgccuacggccuccacgagcuccucaagaccaacgccgccaacauccacuccggcgacgacugggccacccucuucacccuccucgagugcaucggcuccggcgucaagccccccgccgcccuccaggccaccgcccgcgccgacgcccccgacgccggcgcccaguccgacuccgagcuccccuccuaccaccagaacgacgucucccucgaccgcggcuacaccuccgacuccgaggucuacaccgaccacggccgccccggcaagauccaccgcuccgccaccgacgccgacgucgucaacuccggcuggcucgucgucggcaaggacgacgucgacaacuccaagcccggccccucccgccccggccccuccccccucaucaaccaguacucccucaccgucggccucgaccucggcccccacgacaccaagucccuccucaagugcgucgagucccucuccuucaucguccgcgacgccgcccacaucacccccgacaacuucgagcucugcgucaagacccuccgcaucuucgucgaggccucccucaacggcggcugcaagucccaggagaagcgcggcaagucccacaaguacgacuccaagggcaaccgcuucaagaagaaguccaaggagggcuccaugcuccgccgcccccgcaccuccucccagcacgccucccgcggcggccaguccgacgacgacgaggacgagggcguccccgccuccuaccacaccgucucccuccaggucucccaggaccuccucgaccucaugcacacccuccacacccgcgccgccuccaucuacuccuccugggccgaggagcagcgccaccucgagaccggcggccagaagaucgaggccgacucccgcacccucugggcccacugcuggugcccccuccuccagggcaucgccugccucugcugcgacgcccgccgccagguccgcaugcaggcccucaccuaccuccagcgcgcccuccucguccacgaccuccagaagcucgacgcccucgagugggaguccugcuucaacaagguccucuucccccuccucaccaagcuccucgagaacaucucccccgccgacgucggcggcauggaggagacccgcaugcgcgccuccacccuccucuccaaggucuuccuccagcaccucuccccccuccucucccucuccaccuucgccgcccucuggcucaccauccucgacuucauggacaaguacaugcacgccggcuccuccgaccuccucuccgaggccauccccgagucccucaagaacaugcuccucgucauggacaccgccgagaucuuccacuccgccgacgcccgcggcggcggccccuccgcccucugggagaucaccugggagcgcaucgacugcuuccucccccaccuccgcgacgagcucuucaagcagaccgucauccaggaccccaugcccauggagccccagggccagaagccccucgccuccgcccaccucaccuccgccgccggcgacacccgcacccccggccacccccccccccccgagauccccuccgagcucggcgccugcgacuucgagaagcccgaguccccccgcgccgccuccuccuccucccccggcucccccgucgccuccucccccucccgccucucccccacccccgacggcccccccccccucgcccagcccccccucauccuccagccccucgccuccccccuccaggucggcgucccccccaugacccuccccaucauccucaaccccgcccucaucgaggccaccucccccgucccccuccucgccaccccccgccccaccgaccccauccccaccuccgaggucaacuga

SEQ ID NO: 43537 - RNA, 885 nt, Artificial Sequence
  derived and/or modified sequence opt2 from GBGT1__Homo_sapiens__NP_001269558
augcaccgccgccgccucgcccucggccucggcuucugccuccucgccggcaccucccucuccguccucugggucuaccucgagaacuggcuccccgucuccuacguccccuacuaccuccccugccccgagaucuucaacaugaagcuccacuacaagcgcgagaagccccuccagcccgucgucuggucccaguacccccagcccaagcuccucgagcaccgccccacccagcuccucacccucacccccuggcucgcccccaucgucuccgagggcaccuucaaccccgagcuccuccagcacaucuaccagccccucaaccucaccaucggcgucaccgucuucgccgucggcaaccccuccuggucccagccccgcuccuccuccugcgucggcaccggcugcaccaccaccuccucccucaccacccuccagcccuuccccggcucccgcuggguccccaccggcuucuccgcccccucccccucccgcgucacccccaccggccgccgccaccccugcgccggcuggcgccccuccgccuccacccuccuccgcggccucaccggccgcuggaccaccuccuccgcccucauguggaccuggugcuucggcacccgcggcgcccuccgccccugggagaccugguggcuccccuucacccaggccaccacccccuuccccgccuccuccucccccauguccgccggcgucuucccccucccccucuggcagaccgccaagggcaccuccaucauggucggccaguccuccggcggccgcuggcccggcuacaugucccuccucggcgccgccaccuggcccuccuggcgcacccgccccauggccuccuggcuccccggcggccgcaaggccaccuga

SEQ ID NO: 43538 - RNA, 1092 nt, Artificial Sequence
  derived and/or modified sequence opt2 from GBX1__Homo_sapiens__NP_001092304
augcagcgcgccggcggcggcuccgcccccggcggcaacggcggcggcggcggcggcggccccggcaccgccuucuccaucgacucccucaucggccccccccccccccgcuccggccaccuccucuacaccggcuaccccauguucaugcccuaccgcccccucguccucccccaggcccucgcccccgccccccuccccgccggccuccccccccucgccccccucgccuccuucgccggccgccucaccaacaccuucugcgccggccucggccaggccguccccuccauggucgcccucaccaccgcccuccccuccuucgccgagccccccgacgccuucuacggcccccaggagcucgccgccgccgccgccgccgccgccgccaccgccgcccgcaacaaccccgagcccggcggccgccgccccgagggcggccucgaggccgacgagcuccuccccgcccgcgagaaggucgccgagccccccccccccccccccccccacuucuccgagaccuuccccucccuccccgccgagggcaaggucuacuccuccgacgaggagaagcucgaggccuccgccggcgaccccgccggcuccgagcaggaggaggagggcuccggcggcgacuccgaggacgacggcuuccucgacuccuccgccggcggccccggcgcccuccucggccccaagcccaagcucaagggcucccucggcaccggcgccgaggagggcgcccccgucaccgccggcgucaccgcccccggcggcaagucccgccgccgccgcaccgccuucaccuccgagcagcuccucgagcucgagaaggaguuccacugcaagaaguaccucucccucaccgagcgcucccagaucgcccacgcccucaagcucuccgagguccaggucaagaucugguuccagaaccgccgcgccaaguggaagcgcaucaaggccggcaacgucuccucccgcuccggcgagcccguccgcaaccccaagaucgucguccccauccccguccacgucaaccgcuucgccguccgcucccagcaccagcagauggagcagggcgcccgccccuga

SEQ ID NO: 43539 - RNA, 1047 nt, Artificial Sequence
  derived and/or modified sequence opt2 from GBX2__Homo_sapiens__NP_001476
auguccgccgccuucccccccucccucaugaugaugcagcgcccccucggcuccuccaccgccuucuccaucgacucccucaucggcucccccccccagcccucccccggccacuucgucuacaccggcuaccccauguucaugcccuaccgccccgucguccucccccccccccccccccccccccccgcccucccccaggccgcccuccagcccgcccucccccccgcccacccccaccaccagauccccucccuccccaccggcuucugcuccucccucgcccagggcauggcccucaccuccacccucauggccacccuccccggcggcuucuccgccuccccccagcaccaggaggccgccgccgcccgcaaguucgccccccagccccuccccggcggcggcaacuucgacaaggccgaggcccuccaggccgacgccgaggacggcaagggcuuccucgccaaggagggcucccuccucgccuucuccgccgccgagaccguccaggccucccucgucggcgccguccgcggccagggcaaggacgaguccaaggucgaggacgaccccaagggcaaggaggaguccuucucccucgaguccgacgucgacuacuccuccgacgacaaccucaccggccaggccgcccacaaggaggaggaccccggccacgcccucgaggagaccccccccuccuccggcgccgccggcuccaccaccuccaccggcaagaaccgccgccgccgcaccgccuucaccuccgagcagcuccucgagcucgagaaggaguuccacugcaagaaguaccucucccucaccgagcgcucccagaucgcccacgcccucaagcucuccgagguccaggucaagaucugguuccagaaccgccgcgccaaguggaagcgcgucaaggccggcaacgccaacuccaagaccggcgagcccucccgcaaccccaagaucgucguccccauccccguccacgucucccgcuucgccauccgcucccagcaccagcagcucgagcaggcccgccccuga

SEQ ID NO: 43540 - RNA, 654 nt, Artificial Sequence
  derived and/or modified sequence opt2 from GCA__Homo_sapiens__NP_036330
auggccuaccccggcuacggcggcggcuucggcaacuucuccauccagguccccggcaugcagaugggccagcccguccccgagaccggccccgccauccuccucgacggcuacuccggccccgccuacuccgacaccuacuccuccgccggcgacuccgucuacaccuacuucuccgccgucgccggccaggacggcgaggucgacgccgaggagcuccagcgcugccucacccaguccggcaucaacggcaccuacucccccuucucccucgagaccugccgcaucaugaucgccaugcucgaccgcgaccacaccggcaagaugggcuucaacgccuucaaggagcucugggccgcccucaacgccuggaaggagaacuucaugaccgucgaccaggacggcuccggcaccgucgagcaccacgagcuccgccaggccaucggccucaugggcuaccgccucuccccccagacccucaccaccaucgucaagcgcuacuccaagaacggccgcaucuucuucgacgacuacgucgccugcugcgucaagcuccgcgcccucaccgacuucuuccgcaagcgcgaccaccuccagcagggcuccgccaacuucaucuacgacgacuuccuccagggcaccauggccaucuga

SEQ ID NO: 43541 - RNA, 2328 nt, Artificial Sequence
  derived and/or modified sequence opt2 from GCC1__Homo_sapiens__NP_078799
auggagaaguucggcaugaacuucggcggcggccccuccaagaaggaccuccucgagaccaucgagacccagaagaagcagcuccuccaguaccaggcccgccucaaggacgucguccgcgccuacaagucccuccucaaggagaaggaggcccucgaggccuccaucaagguccucuccgucucccacgaggccgacgucggccucgccggcguccagcuccccggccucaccuuccccgacuccgucgacgaccgcugcuccacccacuccgaggacuccaccggcaccgccaccucccucgacaccgccgccucccucaccuccaccaagggcgaguucggcgucgaggacgaccgccccgcccgcggcccccccccccccaaguccgaggaggccuccugguccgaguccggcgucuccuccuccuccggcgacggccccuucgccggcggcgaggucgacaagcgccuccaccagcucaagacccagcucgccacccucaccuccucccucgccaccgucacccaggagaagucccgcauggaggccuccuaccucgccgacaagaagaagaugaagcaggaccucgaggacgccuccaacaaggccgaggaggagcgcgcccgccucgagggcgagcucaagggccuccaggagcagaucgccgagaccaaggcccgccucaucacccagcagcacgaccgcgcccaggagcaguccgaccacgcccucaugcuccgcgagcuccagaagcuccuccaggaggagcgcacccagcgccaggaccucgagcuccgccucgaggagacccgcgaggcccucgccggccgcgccuacgccgccgagcagauggagggcuucgagcuccagaccaagcagcucacccgcgaggucgaggagcucaaguccgagcuccaggccauccgcgacgagaagaaccagcccgacccccgccuccaggagcuccaggaggaggccgcccgccucaagucccacuuccaggcccagcuccagcaggagaugcgcaagaccgcccucgccgaggaccagcuccgccagcagucccaggucgaggagcagcgcgucgccgcccucgagaaccagaucuccgaggucuccgagcuccucggcaccuacgagaaggccaagcagaaggaccagcucgccauccagaagcucaaggagcgcauccuccagcucgaccucgagaacaagacccucgcccucgccgccuccucccgcuccccccucgacucccacggcgaggaguccucccucgacgucaacguccucaaggacaagauggagaagcucaagcgccuccuccaggucgccgcccgcaagucccaggucacccucgacgucgagaagcucugcgaccucgagaucaugcccuccuccgaggccgccgacggcgagaaggccaccgcccucuacuaccagcaggagcucaagcagcucaaggaggaguucgagcgcuacaagaugcgcgcccaggucguccucaaguccaagaacaccaaggacggcaaccucggcaaggagcucgaggccgcccaggagcagcucgccgagcucaaggagaaguacaucucccuccgccucuccugcgaggagcucgagcaccagcaccagcaggaggccgacgacuggaagcaggagcucgcccgccuccagcagcuccaccgccaggagcucgagcgcugccagcucgacuuccgcgaccgcacccucaagcucgaggaggagcuccacaagcagcgcgaccgcgcccucgccguccucaccgagaaggaccucgagcucgagcagcuccgcuccgucgcccucgccuccggccuccccggccgccgcucccccgucggcggcggcggccccggcgaccccgccgacaccuccuccuccgacucccucacccaggcccuccagcucgccgccgccaacgagcccaccuucuuccucuacgccgagcagcucgcccgcaaggaggucgagaucaccucccuccgcaagcagaagcaccgccucgaggucgagguccaccagcuccaggaccgccuccucgaggagggcgagcgccaccgcgaggaggucgccgcccuccagucccacaucgagaagaacauccgcgaccagucccgcgagggcgccaaccucgaguaccucaagaacaucaucuaccgcuuccucacccuccccgacucccucggccgccagcagacccucaccgccauccucaccauccuccacuucucccccgaggagaagcaggucaucaugcgccuccccaccuccgccuccugguggcccuccggcaagcgcuga

SEQ ID NO: 43542 - RNA, 1317 nt, Artificial Sequence
  derived and/or modified sequence opt2 from GCDH__Homo_sapiens__NP_000150
auggcccuccgcggcgucuccguccgccuccucucccgcggccccggccuccacguccuccgcaccugggucuccuccgccgcccagaccgagaagggcggccgcacccagucccagcucgccaaguccucccgccccgaguucgacuggcaggacccccucguccucgaggagcagcucaccaccgacgagauccucauccgcgacaccuuccgcaccuacugccaggagcgccucaugccccgcauccuccucgccaaccgcaacgaggucuuccaccgcgagaucaucuccgagaugggcgagcucggcguccucggccccaccaucaagggcuacggcugcgccggcgucuccuccgucgccuacggccuccucgcccgcgagcucgagcgcgucgacuccggcuaccgcuccgccauguccguccaguccucccucgucaugcaccccaucuacgccuacggcuccgaggagcagcgccagaaguaccucccccagcucgccaagggcgagcuccucggcugcuucggccucaccgagcccaacuccggcuccgaccccuccuccauggagacccgcgcccacuacaacuccuccaacaaguccuacacccucaacggcaccaagaccuggaucaccaacucccccauggccgaccucuucgucgucugggcccgcugcgaggacggcugcauccgcggcuuccuccucgagaagggcaugcgcggccucuccgccccccgcauccagggcaaguucucccuccgcgccuccgccaccggcaugaucaucauggacggcgucgagguccccgaggagaacguccuccccggcgccuccucccucggcggccccuucggcugccucaacaacgcccgcuacggcaucgccuggggcguccucggcgccuccgaguucugccuccacaccgcccgccaguacgcccucgaccgcaugcaguucggcgucccccucgcccgcaaccagcucauccagaagaagcucgccgacaugcucaccgagaucacccucggccuccacgccugccuccagcucggccgccucaaggaccaggacaaggccgcccccgagauggucucccuccucaagcgcaacaacugcggcaaggcccucgacaucgcccgccaggcccgcgacaugcucggcggcaacggcaucuccgacgaguaccacgucauccgccacgccaugaaccucgaggccgucaacaccuacgagggcacccacgacauccacgcccucauccucggccgcgccaucaccggcauccaggccuucaccgccuccaaguga

SEQ ID NO: 43543 - RNA, 2346 nt, Artificial Sequence
  derived and/or modified sequence opt2 from GCFC2__Homo_sapiens__NP_003194
auggcccaccgccccaagcgcaccuuccgccagcgcgccgccgacuccuccgacuccgacggcgccgaggagucccccgccgagcccggcgccccccgcgagcuccccguccccggcuccgccgaggaggagccccccuccggcggcggccgcgcccaggucgccggccucccccaccgcguccgcggcccccgcggccgcggccgcgucugggccuccucccgccgcgccaccaaggccgccccccgcgccgacgagggcuccgagucccgcacccucgacgucuccaccgacgaggaggacaagauccaccacuccuccgaguccaaggacgaccagggccucuccuccgacuccuccuccucccucggcgagaaggagcucuccuccaccgucaagauccccgacgccgccuucauccaggccgcccgccgcaagcgcgagcucgcccgcgcccaggacgacuacaucucccucgacguccagcacaccuccuccaucuccggcaugaagcgcgaguccgaggacgaccccgaguccgagcccgacgaccacgagaagcgcauccccuucacccuccgcccccagacccuccgccagcgcauggccgaggaguccaucucccgcaacgaggagaccuccgaggagucccaggaggacgagaagcaggacaccugggagcagcagcagaugcgcaaggccgucaagaucaucgaggagcgcgacaucgaccucuccugcggcaacggcuccuccaaggucaagaaguucgacaccuccaucuccuucccccccgucaaccucgagaucaucaagaagcagcucaacacccgccucacccuccuccaggagacccaccgcucccaccuccgcgaguacgagaaguacguccaggacgucaaguccuccaaguccaccauccagaaccucgaguccuccuccaaccaggcccucaacugcaaguucuacaaguccaugaagaucuacgucgagaaccucaucgacugccucaacgagaagaucaucaacauccaggagaucgaguccuccaugcacgcccuccuccucaagcaggccaugaccuucaugaagcgccgccaggacgagcucaagcacgaguccaccuaccuccagcagcucucccgcaaggacgagaccuccaccuccggcaacuucuccgucgacgagaagacccaguggauccucgaggagaucgagucccgccgcaccaagcgccgccaggcccgcguccucuccggcaacugcaaccaccaggagggcaccuccuccgacgacgagcuccccuccgccgagaugaucgacuuccagaagucccagggcgacauccuccagaagcagaagaaggucuucgaggagguccaggacgacuucugcaacauccagaacauccuccucaaguuccagcaguggcgcgagaaguuccccgacuccuacuacgaggccuucaucucccucugcauccccaagcuccucaacccccucauccgcguccagcucaucgacuggaacccccucaagcucgaguccaccggccucaaggagaugcccugguucaaguccgucgaggaguucauggacuccuccgucgaggacuccaagaaggaguccuccuccgacaagaagguccucuccgccaucaucaacaagaccaucaucccccgccucaccgacuucgucgaguuccucugggacccccucuccaccucccagaccaccucccucaucacccacugccgcgucauccucgaggagcacuccaccugcgagaacgaggucuccaagucccgccaggaccuccucaaguccaucgucucccgcaugaagaaggccgucgaggacgacgucuucaucccccucuaccccaaguccgccgucgagaacaagaccuccccccacuccaaguuccaggagcgccaguucugguccggccucaagcucuuccgcaacauccuccucuggaacggccuccucaccgacgacacccuccaggagcucggccucggcaagcuccucaaccgcuaccucaucaucgcccuccucaacgccacccccggccccgacgucgucaagaagugcaaccaggucgccgccugccuccccgagaagugguucgagaacuccgccaugcgcaccuccaucccccagcucgagaacuucauccaguuccuccuccaguccgcccacaagcucucccgcuccgaguuccgcgacgaggucgaggagaucauccucauccucgucaagaucaaggcccucaaccaggccgaguccuucaucggcgagcaccaccucgaccaccucaagucccucaucaaggaggacuga

SEQ ID NO: 43544 - RNA, 543 nt, Artificial Sequence
  derived and/or modified sequence opt2 from GCG__Homo_sapiens__NP_002045
augaaguccaucuacuucgucgccggccucuucgucaugcucguccagggcuccuggcagcgcucccuccaggacaccgaggagaagucccgcuccuucuccgccucccaggccgacccccucuccgaccccgaccagaugaacgaggacaagcgccacucccagggcaccuucaccuccgacuacuccaaguaccucgacucccgccgcgcccaggacuucguccaguggcucaugaacaccaagcgcaaccgcaacaacaucgccaagcgccacgacgaguucgagcgccacgccgagggcaccuucaccuccgacgucuccuccuaccucgagggccaggccgccaaggaguucaucgccuggcucgucaagggccgcggccgccgcgacuuccccgaggaggucgccaucgucgaggagcucggccgccgccacgccgacggcuccuucuccgacgagaugaacaccauccucgacaaccucgccgcccgcgacuucaucaacuggcucauccagaccaagaucaccgaccgcaaguga

SEQ ID NO: 43545 - RNA, 1434 nt, Artificial Sequence
  derived and/or modified sequence opt2 from GCGR__Homo_sapiens__XP_006722340
augccccccugccagccccagcgcccccuccuccuccuccuccuccuccucgccugccagccccagguccccuccgcccaggucauggacuuccucuucgagaaguggaagcucuacggcgaccagugccaccacaaccucucccuccuccccccccccaccgagcucgucugcaaccgcaccuucgacaaguacuccugcuggcccgacacccccgccaacaccaccgccaacaucuccugccccugguaccuccccuggcaccacaagguccagcaccgcuucgucuucaagcgcugcggccccgacggccaguggguccgcggcccccgcggccagcccuggcgcgacgccucccagugccagauggacggcgaggagaucgagguccagaaggaggucgccaagauguacuccuccuuccaggucauguacaccgucggcuacucccucucccucggcgcccuccuccucgcccucgccauccucggcggccucuccaagcuccacugcacccgcaacgccauccacgccaaccucuucgccuccuucguccucaaggccuccuccguccucgucaucgacggccuccuccgcacccgcuacucccagaagaucggcgacgaccucuccgucuccaccuggcucuccgacggcgccgucgccggcugccgcgucgccgccgucuucaugcaguacggcaucgucgccaacuacugcuggcuccucgucgagggccucuaccuccacaaccuccucggccucgccacccuccccgagcgcuccuucuucucccucuaccucggcaucggcuggggcgcccccaugcucuucgucguccccugggccgucgucaagugccucuucgagaacguccagugcuggaccuccaacgacaacaugggcuucugguggauccuccgcuuccccgucuuccucgccauccucaucaacuucuucaucuucguccgcaucguccagcuccucgucgccaagcuccgcgcccgccagaugcaccacaccgacuacaaguuccgccucgccaaguccacccucacccucaucccccuccucggcguccacgaggucgucuucgccuucgucaccgacgagcacgcccagggcacccuccgcuccgccaagcucuucuucgaccucuuccucuccuccuuccagggccuccucgucgccguccucuacugcuuccucaacaaggagguccaguccgagcuccgccgccgcuggcaccgcuggcgccucggcaagguccucugggaggagcgcaacaccuccaaccaccgcgccuccuccucccccggccacggcccccccuccaaggagcuccaguucggccgcggcggcggcucccaggacuccuccgccgagaccccccucgccggcggccucccccgccucgccgagucccccuucuga

SEQ ID NO: 43546 - RNA, 753 nt, Artificial Sequence
  derived and/or modified sequence opt2 from GCH1__Homo_sapiens__NP_001019195
auggagaagggccccguccgcgcccccgccgagaagccccgcggcgcccgcugcuccaacggcuuccccgagcgcgaccccccccgccccggccccucccgccccgccgagaagcccccccgccccgaggccaaguccgcccagcccgccgacggcuggaagggcgagcgcccccgcuccgaggaggacaacgagcucaaccuccccaaccucgccgccgccuacuccuccauccucuccucccucggcgagaacccccagcgccagggccuccucaagacccccuggcgcgccgccuccgccaugcaguucuucaccaagggcuaccaggagaccaucuccgacguccucaacgacgccaucuucgacgaggaccacgacgagauggucaucgucaaggacaucgacauguucuccaugugcgagcaccaccucguccccuucgucggcaagguccacaucggcuaccuccccaacaagcagguccucggccucuccaagcucgcccgcaucgucgagaucuacucccgccgccuccagguccaggagcgccucaccaagcagaucgccgucgccaucaccgaggcccuccgccccgccggcgucggcgucgucgucgaggccacccacaugugcauggucaugcgcggcguccagaagaugaacuccaagaccgucaccuccaccaugcucggcgucuuccgcgaggaccccaagacccgcgaggaguuccucacccucauccgcuccuga

SEQ ID NO: 43547 - RNA, 255 nt, Artificial Sequence
  derived and/or modified sequence opt2 from GCHFR__Homo_sapiens__NP_005249
augcccuaccuccucaucuccacccagauccgcauggaggucggccccaccauggucggcgacgagcaguccgaccccgagcucaugcagcaccucggcgccuccaagcgccgcgcccucggcaacaacuucuacgaguacuacgucgacgaccccccccgcaucguccucgacaagcucgagcgccgcggcuuccgcguccucuccaugaccggcgucggccagacccucgucuggugccuccacaaggaguga

SEQ ID NO: 43548 - RNA, 1425 nt, Artificial Sequence
  derived and/or modified sequence opt2 from GC__Homo_sapiens__NP_000574
augaagcgcguccucguccuccuccucgccgucgccuucggccacgcccucgagcgcggccgcgacuacgagaagaacaaggucugcaaggaguucucccaccucggcaaggaggacuucaccucccucucccucguccucuacucccgcaaguuccccuccggcaccuucgagcaggucucccagcucgucaaggaggucgucucccucaccgaggccugcugcgccgagggcgccgaccccgacugcuacgacacccgcaccuccgcccucuccgccaaguccugcgaguccaacucccccuuccccguccaccccggcaccgccgagugcugcaccaaggagggccucgagcgcaagcucugcauggccgcccucaagcaccagccccaggaguuccccaccuacgucgagcccaccaacgacgagaucugcgaggccuuccgcaaggaccccaaggaguacgccaaccaguucaugugggaguacuccaccaacuacggccaggccccccucucccuccucgucuccuacaccaaguccuaccucuccauggucggcuccugcugcaccuccgccucccccaccgucugcuuccucaaggagcgccuccagcucaagcaccucucccuccucaccacccucuccaaccgcgucugcucccaguacgccgccuacggcgagaagaagucccgccucuccaaccucaucaagcucgcccagaagguccccaccgccgaccucgaggacguccucccccucgccgaggacaucaccaacauccucuccaagugcugcgaguccgccuccgaggacugcauggccaaggagcuccccgagcacaccgucaagcucugcgacaaccucuccaccaagaacuccaaguucgaggacugcugccaggagaagaccgccauggacgucuucgucugcaccuacuucaugcccgccgcccagcuccccgagcuccccgacgucgagcuccccaccaacaaggacgucugcgaccccggcaacaccaaggucauggacaaguacaccuucgagcucucccgccgcacccaccuccccgaggucuuccucuccaagguccucgagcccacccucaagucccucggcgagugcugcgacgucgaggacuccaccaccugcuucaacgccaagggcccccuccucaagaaggagcucuccuccuucaucgacaagggccaggagcucugcgccgacuacuccgagaacaccuucaccgaguacaagaagaagcucgccgagcgccucaaggccaagcuccccgacgccacccccaccgagcucgccaagcucgucaacaagcacuccgacuucgccuccaacugcugcuccaucaacucccccccccucuacugcgacuccgagaucgacgccgagcucaagaacauccucuga

SEQ ID NO: 43549 - RNA, 1398 nt, Artificial Sequence
  derived and/or modified sequence opt2 from GCK__Homo_sapiens__NP_000153
augcucgacgaccgcgcccgcauggaggccgccaagaaggagaaggucgagcagauccucgccgaguuccagcuccaggaggaggaccucaagaaggucaugcgccgcaugcagaaggagauggaccgcggccuccgccucgagacccacgaggaggccuccgucaagaugcuccccaccuacguccgcuccacccccgagggcuccgaggucggcgacuuccucucccucgaccucggcggcaccaacuuccgcgucaugcucgucaaggucggcgagggcgaggagggccagugguccgucaagaccaagcaccagauguacuccauccccgaggacgccaugaccggcaccgccgagaugcucuucgacuacaucuccgagugcaucuccgacuuccucgacaagcaccagaugaagcacaagaagcucccccucggcuucaccuucuccuuccccguccgccacgaggacaucgacaagggcauccuccucaacuggaccaagggcuucaaggccuccggcgccgagggcaacaacgucgucggccuccuccgcgacgccaucaagcgccgcggcgacuucgagauggacgucgucgccauggucaacgacaccgucgccaccaugaucuccugcuacuacgaggaccaccagugcgaggucggcaugaucgucggcaccggcugcaacgccugcuacauggaggagaugcagaacgucgagcucgucgagggcgacgagggccgcaugugcgucaacaccgaguggggcgccuucggcgacuccggcgagcucgacgaguuccuccucgaguacgaccgccucgucgacgaguccuccgccaaccccggccagcagcucuacgagaagcucaucggcggcaaguacaugggcgagcucguccgccucguccuccuccgccucgucgacgagaaccuccucuuccacggcgaggccuccgagcagcuccgcacccgcggcgccuucgagacccgcuucgucucccaggucgaguccgacaccggcgaccgcaagcagaucuacaacauccucuccacccucggccuccgccccuccaccaccgacugcgacaucguccgccgcgccugcgaguccgucuccacccgcgccgcccacaugugcuccgccggccucgccggcgucaucaaccgcaugcgcgagucccgcuccgaggacgucaugcgcaucaccgucggcgucgacggcuccgucuacaagcuccaccccuccuucaaggagcgcuuccacgccuccguccgccgccucacccccuccugcgagaucaccuucaucgaguccgaggagggcuccggccgcggcgccgcccucgucuccgccgucgccugcaagaaggccugcaugcucggccaguga

SEQ ID NO: 43550 - RNA, 1878 nt, Artificial Sequence
  derived and/or modified sequence opt2 from GCKR__Homo_sapiens__NP_001477
augcccggcaccaagcgcuuccagcacgucaucgagacccccgagcccggcaagugggagcucuccggcuacgaggccgccguccccaucaccgagaaguccaacccccucacccaggaccucgacaaggccgacgccgagaacaucguccgccuccucggccagugcgacgccgagaucuuccaggaggagggccaggcccucuccaccuaccagcgccucuacuccgaguccauccucaccaccaugguccaggucgccggcaagguccaggagguccucaaggagcccgacggcggccucgucguccucuccggcggcggcaccuccggccgcauggccuuccucauguccgucuccuucaaccagcucaugaagggccucggccagaagccccucuacaccuaccucaucgccggcggcgaccgcuccgucgucgccucccgcgagggcaccgaggacuccgcccuccacggcaucgaggagcucaagaaggucgccgccggcaagaagcgcgucaucgucaucggcaucuccgucggccucuccgcccccuucgucgccggccagauggacugcugcaugaacaacaccgccgucuuccuccccguccucgucggcuucaaccccgucuccauggcccgcaacgaccccaucgaggacugguccuccaccuuccgccaggucgccgagcgcaugcagaagaugcaggagaagcagaaggccuucguccucaaccccgccaucggccccgagggccucuccggcuccucccgcaugaagggcggcuccgccaccaagauccuccucgagacccuccuccucgccgcccacaagaccgucgaccagggcaucgccgccucccagcgcugccuccucgagauccuccgcaccuucgagcgcgcccaccaggucaccuacucccagucccccaagaucgccacccucaugaaguccgucuccaccucccucgagaagaagggccacgucuaccucgucggcuggcagacccucggcaucaucgccaucauggacggcgucgagugcauccacaccuucggcgccgacuuccgcgacguccgcggcuuccucaucggcgaccacuccgacauguucaaccagaaggccgagcucaccaaccagggcccccaguucaccuucucccaggaggacuuccucaccuccauccuccccucccucaccgagaucgacaccgucgucuucaucuucacccucgacgacaaccucaccgagguccagaccaucgucgagcaggucaaggagaagaccaaccacauccaggcccucgcccacuccaccgucggccagacccuccucaucccccucaagaagcucuuccccuccaucaucuccaucaccuggccccuccucuucuucgaguacgagggcaacuucauccagaaguuccagcgcgagcucuccaccaaguggguccucaacaccgucuccaccggcgcccacguccuccucggcaagauccuccagaaccacaugcucgaccuccgcaucuccaacuccaagcucuucuggcgcgcccucgccaugcuccagcgcuucuccggccaguccaaggcccgcugcaucgagucccuccuccgcgccauccacuucccccagccccucuccgacgacauccgcgccgcccccaucuccugccacguccaggucgcccacgagaaggagcaggucauccccaucgcccuccucucccuccucuuccgcugcuccaucaccgaggcccaggcccaccucgccgccgcccccuccgucugcgaggccguccgcuccgcccucgccggccccggccagaagcgcaccgccgacccccucgagauccucgagcccgacguccaguga

SEQ ID NO: 43551 - RNA, 1914 nt, Artificial Sequence
  derived and/or modified sequence opt2 from GCLC__Homo_sapiens__NP_001489
augggccuccucucccagggcuccccccucuccugggaggagaccaagcgccacgccgaccacguccgccgccacggcauccuccaguuccuccacaucuaccacgccgucaaggaccgccacaaggacguccucaaguggggcgacgaggucgaguacaugcucgucuccuucgaccacgagaacaagaagguccgccucguccucuccggcgagaagguccucgagacccuccaggagaagggcgagcgcaccaaccccaaccaccccacccucuggcgccccgaguacggcuccuacaugaucgagggcacccccggccagcccuacggcggcaccauguccgaguucaacaccgucgaggccaacaugcgcaagcgccgcaaggaggccaccuccauccucgaggagaaccaggcccucugcaccaucaccuccuucccccgccucggcugccccggcuucacccuccccgaggucaagcccaaccccgucgagggcggcgccuccaagucccucuucuuccccgacgaggccaucaacaagcacccccgcuucuccacccucacccgcaacauccgccaccgccgcggcgagaaggucgucaucaacguccccaucuucaaggacaagaacacccccucccccuucaucgagaccuucaccgaggacgacgaggccucccgcgccuccaagcccgaccacaucuacauggacgccaugggcuucggcaugggcaacugcugccuccaggucaccuuccaggccugcuccaucuccgaggcccgcuaccucuacgaccagcucgccaccaucugccccaucgucauggcccucuccgccgccucccccuucuaccgcggcuacgucuccgacaucgacugccgcuggggcgucaucuccgccuccgucgacgaccgcacccgcgaggagcgcggccucgagccccucaagaacaacaacuaccgcaucuccaagucccgcuacgacuccaucgacuccuaccucuccaagugcggcgagaaguacaacgacaucgaccucaccaucgacaaggagaucuacgagcagcuccuccaggagggcaucgaccaccuccucgcccagcacgucgcccaccucuucauccgcgacccccucacccucuucgaggagaagauccaccucgacgacgccaacgaguccgaccacuucgagaacauccaguccaccaacuggcagaccaugcgcuucaagccccccccccccaacuccgacaucggcuggcgcgucgaguuccgccccauggagguccagcucaccgacuucgagaacuccgccuacgucgucuucgucguccuccucacccgcgucauccucuccuacaagcucgacuuccucaucccccucuccaaggucgacgagaacaugaaggucgcccagaagcgcgacgccguccuccagggcauguucuacuuccgcaaggacaucugcaagggcggcaacgccgucgucgacggcugcggcaaggcccagaacuccaccgagcucgccgccgaggaguacacccucauguccaucgacaccaucaucaacggcaaggagggcgucuuccccggccucauccccauccucaacuccuaccucgagaacauggaggucgacgucgacacccgcugcuccauccucaacuaccucaagcucaucaagaagcgcgccuccggcgagcucaugaccgucgcccgcuggaugcgcgaguucaucgccaaccaccccgacuacaagcaggacuccgucaucaccgacgagaugaacuacucccucauccucaagugcaaccagaucgccaacgagcucugcgagugccccgagcuccucggcuccgccuuccgcaaggucaaguacuccggcuccaagaccgacuccuccaacuga

SEQ ID NO: 43552 - RNA, 1311 nt, Artificial Sequence
  derived and/or modified sequence opt2 from GCM1__Homo_sapiens__NP_003634
auggagcccgacgacuucgacuccgaggacaaggagauccucuccugggacaucaacgacgucaagcucccccagaacgucaagaagaccgacugguuccaggaguggcccgacuccuacgccaagcacaucuacuccuccgaggacaagaacgcccagcgccaccucuccuccugggccaugcgcaacaccaacaaccacaacucccgcauccucaagaaguccugccucggcgucgucgucugcggccgcgacugccucgccgaggagggccgcaagaucuaccuccgccccgccaucugcgacaaggcccgccagaagcagcagcgcaagcgcugccccaacugcgacggcccccucaagcucauccccugccgcggccacggcggcuuccccgucaccaacuucuggcgccacgacggccgcuucaucuucuuccaguccaagggcgagcacgaccaccccaagcccgagaccaagcucgaggccgaggcccgccgcgccaugaagaaggucaacaccgcccccuccuccgucucccucucccucaagggcuccaccgagacccgcucccuccccggcgagacccagucccagggcucccucccccucaccugguccuuccaggagggcguccagcuccccggcuccuacuccggccaccucaucgccaacaccccccagcagaacucccucaacgacugcuucuccuucuccaaguccuacggccucggcggcaucaccgaccucaccgaccagaccuccaccgucgaccccaugaagcucuacgagaagcgcaagcucuccuccucccgcaccuacuccuccggcgaccuccucccccccuccgccuccggcgucuacuccgaccacggcgaccuccaggccugguccaagaacgccgcccucggccgcaaccaccucgccgacaacugcuacuccaacuaccccuucccccucaccuccuggcccugcuccuucucccccucccagaacuccuccgagcccuucuaccagcagcucccccucgagccccccgccgccaagaccggcugccccccccucuggcccaaccccgccggcaaccucuacgaggagaagguccacgucgacuucaacuccuacguccagucccccgccuaccacuccccccaggaggaccccuuccucuucaccuacgccucccacccccaccagcaguacucccuccccuccaaguccuccaagugggacuucgaggaggagaugaccuaccucggccucgaccacugcaacaacgacaugcuccucaaccucugcccccuccgcuga

SEQ ID NO: 43553 - RNA, 1521 nt, Artificial Sequence
  derived and/or modified sequence opt2 from GCM2__Homo_sapiens__XP_011513293
augcccgccgccgccguccaggaggccgucggcgucugcuccuacggcaugcagcucuccugggacaucaacgacccccagaugccccaggagcucgcccucuucgaccaguuccgcgaguggcccgacggcuacguccgcuucaucuacuccuccgacgagaagaaggcccagcgccaccucuccggcugggccaugcgcaacaccaacaaccacaacggccacauccucaagaaguccugccucggcgucgucgucugcacccaggccugcacccuccccgacggcucccgccuccagcuccgccccgccaucugcgacaaggcccgccucaagcagcagaagaaggccugccccaacugccacuccgcccucgagcucauccccugccgcggccacuccggcuaccccgucaccaacuucuggcgccucgacggcaacgccaucuucuuccaggccaagggcguccacgaccacccccgccccgaguccaaguccgagaccgaggcccgccgcuccgccaucaagcgccagauggccuccuucuaccagccccagaagaagcgcauccgcgaguccgaggccgaggagaaccaggacuccuccggccacuucuccaacauccccccccucgagaaccccgaggacuucgacaucgucaccgagaccuccuuccccauccccggccagcccugccccuccuuccccaaguccgacgucuacaaggccaccugcgaccucgccaccuuccagggcgacaagaugccccccuuccagaaguacuccuccccccgcaucuaccucccccgcccccccugcuccuacgagcucgccaaccccggcuacaccaacuccucccccuaccccacccucuacaaggacuccaccuccauccccaacgacaccgacuggguccaccucaacacccuccagugcaacgucaacuccuacuccuccuacgagcgcuccuucgacuucaccaacaagcagcacggcuggaagcccgcccucggcaagcccucccucgucgagcgcaccaaccacggccaguuccaggccauggccacccgccccuacuacaaccccgagcuccccugccgcuaccucaccacccccccccccggcgcccccgcccuccagaccgucaucaccaccaccaccaaggucuccuaccaggccuaccagccccccgccaugaaguacuccgacuccguccgcgaggucaagucccucuccuccugcaacuacgcccccgaggacaccggcauguccgucuaccccgagcccuggggcccccccgucaccgucacccgcgccgccucccccuccggccccccccccaugaagaucgccggcgacugccgcgccauccgccccaccgucgccaucccccacgagcccgucuccucccgcaccgacgaggccgagaccugggacgucugccucuccggccucggcuccgccgucuccuacuccgaccgcgucggccccuucuucaccuacaacaacgaggacuucuga

SEQ ID NO: 43554 - RNA, 8016 nt, Artificial Sequence
  derived and/or modified sequence opt2 from GCN1L1__Homo_sapiens__NP_006827
auggccgccgacacccaggucuccgagacccucaagcgcuucgccggcaaggucaccaccgccuccgucaaggagcgccgcgagauccucuccgagcucggcaagugcgucgccggcaaggaccuccccgagggcgccgucaagggccucugcaagcucuucugccucacccuccaccgcuaccgcgacgccgccucccgccgcgcccuccaggccgccauccagcagcucgccgaggcccagcccgaggccaccgccaagaaccuccuccacucccuccaguccuccggcaucggcuccaaggccggcguccccuccaaguccuccggcuccgccgcccuccucgcccucaccuggaccugccuccucguccgcaucgucuuccccucccgcgccaagcgccagggcgacaucuggaacaagcucgucgagguccagugccuccuccuccucgagguccucggcggcucccacaagcacgccgucgacggcgccgucaagaagcucaccaagcucuggaaggagaaccccggccucgucgagcaguaccucuccgccauccucucccucgagcccaaccagaacuacgccggcaugcucggccuccucguccaguucugcaccucccacaaggagauggacgucgucucccagcacaaguccgcccuccucgacuucuacaugaagaacauccucauguccaaggucaagccccccaaguaccuccucgacuccugcgccccccuccuccgcuaccucucccacuccgaguucaaggaccucauccuccccaccauccagaagucccuccuccgcucccccgagaacgucaucgagaccaucuccucccuccucgccuccgucacccucgaccucucccaguacgccauggacaucgucaagggccucgccggccaccucaaguccaacuccccccgccucauggacgaggccguccucgcccuccgcaaccucgcccgccagugcuccgacuccuccgccauggagucccucaccaagcaccucuucgccauccucggcggcuccgagggcaagcucaccgucgucgcccagaagauguccguccucuccggcaucggcuccgucucccaccacgucgucuccggccccuccucccagguccucaacggcaucgucgccgagcucuucauccccuuccuccagcaggagguccacgagggcacccucguccacgccgucuccguccucgcccucuggugcaaccgcuucaccauggagguccccaagaagcucaccgagugguucaagaaggccuucucccucaagaccuccaccuccgccguccgccacgccuaccuccagugcaugcucgccuccuaccgcggcgacacccuccuccaggcccucgaccuccucccccuccucauccagaccgucgagaaggccgccucccaguccacccagguccccaccaucaccgagggcgucgccgccgcccuccuccuccucaagcucuccgucgccgacucccaggccgaggccaagcucuccuccuucuggcagcucaucgucgacgagaagaagcaggucuucaccuccgagaaguuccucgucauggccuccgaggacgcccucugcaccguccuccaccucaccgagcgccucuuccucgaccacccccaccgccucaccggcaacaagguccagcaguaccaccgcgcccucgucgccguccuccucucccgcaccuggcacguccgccgccaggcccagcagaccguccgcaagcuccucuccucccucggcggcuucaagcucgcccacggccuccucgaggagcucaagaccguccucuccucccacaagguccucccccucgaggcccucgucaccgacgccggcgaggucaccgaggccggcaaggccuacguccccccccgcguccuccaggaggcccucugcgucaucuccggcguccccggccucaagggcgacgucaccgacaccgagcagcucgcccaggagaugcucaucaucucccaccaccccucccucgucgccguccaguccggccucuggcccgcccuccucgcccgcaugaagaucgaccccgaggccuucaucacccgccaccucgaccagaucaucccccgcaugaccacccaguccccccucaaccaguccuccaugaacgccaugggcucccucuccguccucucccccgaccgcguccucccccagcucaucuccaccaucaccgccuccguccagaaccccgcccuccgccucgucacccgcgaggaguucgccaucaugcagacccccgccggcgagcucuacgacaaguccaucauccaguccgcccagcaggacuccaucaagaaggccaacaugaagcgcgagaacaaggccuacuccuucaaggagcagaucaucgagcucgagcucaaggaggagaucaagaagaagaagggcaucaaggaggagguccagcucaccuccaagcagaaggagaugcuccaggcccagcucgaccgcgaggcccagguccgccgccgccuccaggagcucgacggcgagcucgaggccgcccucggccuccucgacaucauccucgccaagaaccccuccggccucacccaguacauccccguccucgucgacuccuuccucccccuccucaaguccccccucgccgccccccgcaucaagaaccccuuccucucccucgccgccugcgucaugcccucccgccucaaggcccucggcacccucgucucccacgucacccuccgccuccucaagcccgagugcguccucgacaaguccuggugccaggaggagcucuccgucgccgucaagcgcgccgucaugcuccuccacacccacaccaucaccucccgcgucggcaagggcgagcccggcgccgccccccucuccgcccccgccuucucccucgucuuccccuuccucaagaugguccucaccgagaugccccaccacuccgaggaggaggaggaguggauggcccagauccuccagauccucaccguccaggcccagcuccgcgccucccccaacaccccccccggccgcgucgacgagaacggccccgagcuccucccccgcgucgccaugcuccgccuccucaccugggucaucggcaccggcuccccccgccuccagguccucgccuccgacacccucaccacccucugcgccuccuccuccggcgacgacggcugcgccuucgccgagcaggaggaggucgacguccuccucugcgcccuccagucccccugcgccuccguccgcgagaccguccuccgcggccucauggagcuccacaugguccuccccgcccccgacaccgacgagaagaacggccucaaccuccuccgccgccucugggucgucaaguucgacaaggaggaggagauccgcaagcucgccgagcgccucugguccaugaugggccucgaccuccagcccgaccucugcucccuccucaucgacgacgucaucuaccacgaggccgccguccgccaggccggcgccgaggcccucucccaggccgucgcccgcuaccagcgccaggccgccgaggucaugggccgccucauggagaucuaccaggagaagcucuaccgccccccccccguccucgacgcccucggccgcgucaucuccgaguccccccccgaccagugggaggcccgcugcggccucgcccucgcccucaacaagcucucccaguaccucgacuccucccaggucaagccccucuuccaguucuucguccccgacgcccucaacgaccgccaccccgacguccgcaagugcaugcucgacgccgcccucgccacccucaacacccacggcaaggagaacgucaacucccuccuccccgucuucgaggaguuccucaagaacgcccccaacgacgccuccuacgacgccguccgccaguccgucgucguccucaugggcucccucgccaagcaccucgacaaguccgaccccaaggucaagcccaucgucgccaagcucaucgccgcccucuccacccccucccagcagguccaggaguccgucgccuccugccuccccccccucguccccgccaucaaggaggacgccggcggcaugauccagcgccucaugcagcagcuccucgaguccgacaaguacgccgagcgcaagggcgccgccuacggccucgccggccucgucaagggccucggcauccucucccucaagcagcaggagaugauggccgcccucaccgacgccauccaggacaagaagaacuuccgccgccgcgagggcgcccucuucgccuucgagaugcucugcaccaugcucggcaagcucuucgagcccuacgucguccacguccucccccaccuccuccucugcuucggcgacggcaaccaguacguccgcgaggccgccgacgacugcgccaaggccgucauguccaaccucuccgcccacggcgucaagcucguccuccccucccuccucgccgcccucgaggaggaguccuggcgcaccaaggccggcuccgucgagcuccucggcgccauggccuacugcgcccccaagcagcucuccuccugccuccccaacaucguccccaagcucaccgagguccucaccgacucccacgucaagguccagaaggccggccagcaggcccuccgccagaucggcuccgucauccgcaaccccgagauccucgccaucgcccccguccuccucgacgcccucaccgaccccucccgcaagacccagaagugccuccagacccuccucgacaccaaguucguccacuucaucgacgcccccucccucgcccucaucaugcccaucguccagcgcgccuuccaggaccgcuccaccgacacccgcaagauggccgcccagaucaucggcaacauguacucccucaccgaccagaaggaccucgcccccuaccuccccuccgucacccccggccucaaggccucccuccucgaccccguccccgagguccgcaccgucuccgccaaggcccucggcgccauggucaagggcaugggcgaguccugcuucgaggaccuccuccccuggcucauggagacccucaccuacgagcaguccuccgucgaccgcuccggcgccgcccagggccucgccgaggucauggccggccucggcgucgagaagcucgagaagcucaugcccgagaucgucgccaccgccuccaaggucgacaucgccccccacguccgcgacggcuacaucaugauguucaacuaccuccccaucaccuucggcgacaaguucacccccuacgucggccccaucauccccugcauccucaaggcccucgccgacgagaacgaguucguccgcgacaccgcccuccgcgccggccagcgcgucaucuccauguacgccgagaccgccaucgcccuccuccucccccagcucgagcagggccucuucgacgaccucuggcgcauccgcuucuccuccguccagcuccucggcgaccuccucuuccacaucuccggcgucaccggcaagaugaccaccgagaccgccuccgaggacgacaacuucggcaccgcccaguccaacaaggccaucaucaccgcccucggcgucgagcgccgcaaccgcguccucgccggccucuacaugggccgcuccgacacccagcucgucguccgccaggccucccuccacgucuggaagaucgucgucuccaacaccccccgcacccuccgcgagauccuccccacccucuucggccuccuccucggcuuccucgccuccaccugcgccgacaagcgcaccaucgccgcccgcacccucggcgaccucguccgcaagcucggcgagaagauccuccccgagaucauccccauccucgaggagggccuccgcucccagaaguccgacgagcgccagggcgucugcaucggccucuccgagaucaugaaguccaccucccgcgacgccguccucuacuucuccgagucccucguccccaccgcccgcaaggcccucugcgacccccucgaggagguccgcgaggccgccgccaagaccuucgagcagcuccacuccaccaucggccaccaggcccucgaggacauccuccccuuccuccucaagcagcucgacgacgaggaggucuccgaguucgcccucgacggccucaagcaggucauggccaucaagucccgcgucguccuccccuaccucguccccaagcucaccaccccccccgucaacacccgcguccucgccuuccucuccuccgucgccggcgacgcccucacccgccaccucggcgucauccuccccgccgucaugcucgcccucaaggagaagcucggcacccccgacgagcagcucgagauggccaacugccaggccgucauccucuccgucgaggacgacaccggccaccgcaucaucaucgaggaccuccucgaggccacccgcucccccgaggucggcaugcgccaggccgccgccaucauccucaacaucuacugcucccgcuccaaggccgacuacaccucccaccuccgcucccucgucuccggccucauccgccucuucaacgacuccucccccgucguccucgaggaguccugggacgcccucaacgccaucaccaagaagcucgacgccggcaaccagcucgcccucaucgaggagcuccacaaggagauccgccucaucggcaacgaguccaagggcgagcacguccccggcuucugccuccccaagaagggcgucaccuccauccuccccguccuccgcgagggcguccucaccggcucccccgagcagaaggaggaggccgccaaggcccucggccucgucauccgccucaccuccgccgacgcccuccgccccuccgucgucuccaucaccggcccccucauccgcauccucggcgaccgcuucuccuggaacgucaaggccgcccuccucgagacccucucccuccuccucgccaaggucggcaucgcccucaagcccuuccucccccagcuccagaccaccuucaccaaggcccuccaggacuccaaccgcggcguccgccucaaggccgccgacgcccucggcaagcucaucuccauccacaucaaggucgacccccucuucaccgagcuccucaacggcauccgcgccauggaggaccccggcguccgcgacaccaugcuccaggcccuccgcuucgucauccagggcgccggcgccaaggucgacgccgucauccgcaagaacaucgucucccuccuccucuccaugcucggccacgacgaggacaacacccgcaucuccuccgccggcugccucggcgagcucugcgccuuccucaccgaggaggagcucuccgccguccuccagcagugccuccucgccgacgucuccggcaucgacuggaugguccgccacggccgcucccucgcccucuccgucgccgucaacgucgcccccggccgccucugcgccggccgcuacuccuccgacguccaggagaugauccucuccuccgccaccgccgaccgcauccccaucgccgucuccggcguccgcggcaugggcuuccucaugcgccaccacaucgagaccggcggcggccagcuccccgccaagcucuccucccucuucgucaagugccuccagaaccccuccuccgacauccgccucgucgccgagaagaugaucuggugggccaacaaggacccccuccccccccucgacccccaggccaucaagcccauccucaaggcccuccucgacaacaccaaggacaagaacaccgucguccgcgccuacuccgaccaggccaucgucaaccuccucaagaugcgccagggcgaggaggucuuccagucccucuccaagauccucgacgucgccucccucgagguccucaacgaggucaaccgccgcucccucaagaagcucgccucccaggccgacuccaccgagcaggucgacgacaccauccucaccuga

SEQ ID NO: 43555 - RNA, 1287 nt, Artificial Sequence
  derived and/or modified sequence opt2 from GCNT1__Homo_sapiens__XP_006717115
augcuccgcacccuccuccgccgccgccucuucuccuaccccaccaaguacuacuucaugguccucguccucucccucaucaccuucuccguccuccgcauccaccagaagcccgaguucgucuccguccgccaccucgagcucgccggcgagaaccccuccuccgacaucaacugcaccaagguccuccagggcgacgucaacgagauccagaaggucaagcucgagauccucaccgucaaguucaagaagcgcccccgcuggacccccgacgacuacaucaacaugaccuccgacugcuccuccuucaucaagcgccgcaaguacaucgucgagccccucuccaaggaggaggccgaguuccccaucgccuacuccaucgucguccaccacaagaucgagaugcucgaccgccuccuccgcgccaucuacaugccccagaacuucuacugcauccacgucgacaccaaguccgaggacuccuaccucgccgccgucaugggcaucgccuccugcuucuccaacgucuucgucgccucccgccucgaguccgucgucuacgccuccuggucccgcguccaggccgaccucaacugcaugaaggaccucuacgccauguccgccaacuggaaguaccucaucaaccucugcggcauggacuuccccaucaagaccaaccucgagaucguccgcaagcucaagcuccucaugggcgagaacaaccucgagaccgagcgcaugcccucccacaaggaggagcgcuggaagaagcgcuacgaggucgucaacggcaagcucaccaacaccggcaccgucaagaugcuccccccccucgagaccccccucuucuccggcuccgccuacuucgucgucucccgcgaguacgucggcuacguccuccagaacgagaagauccagaagcucauggagugggcccaggacaccuacucccccgacgaguaccucugggccaccauccagcgcauccccgagguccccggcucccuccccgccucccacaaguacgaccucuccgacaugcaggccgucgcccgcuucgucaaguggcaguacuucgagggcgacgucuccaagggcgcccccuacccccccugcgacggcguccacguccgcuccgucugcaucuucggcgccggcgaccucaacuggaugcuccgcaagcaccaccucuucgccaacaaguucgacgucgacgucgaccucuucgccauccagugccucgacgagcaccuccgccacaaggcccucgagacccucaagcacuga

SEQ ID NO: 43556 - RNA, 1203 nt, Artificial Sequence
  derived and/or modified sequence opt2 from GCNT2__Homo_sapiens__NP_001482
augccccucuccaugcgcuaccucuucaucaucuccgucuccuccgucaucaucuucaucgucuucuccgucuucaacuucggcggcgaccccuccuuccagcgccucaacaucuccgacccccuccgccucacccaggucugcaccuccuucaucaacggcaagacccgcuuccucuggaagaacaagcucaugauccacgagaaguccuccugcaaggaguaccucacccagucccacuacaucaccgccccccucuccaaggaggaggccgacuucccccucgccuacaucauggucauccaccaccacuucgacaccuucgcccgccucuuccgcgccaucuacaugccccagaacaucuacugcguccacgucgacgagaaggccaccaccgaguucaaggacgccgucgagcagcuccucuccugcuuccccaacgccuuccucgccuccaagauggagcccgucgucuacggcggcaucucccgccuccaggccgaccucaacugcauccgcgaccucuccgccuucgaggucuccuggaaguacgucaucaacaccugcggccaggacuucccccucaagaccaacaaggagaucguccaguaccucaagggcuucaagggcaagaacaucacccccggcguccucccccccgcccacgccaucggccgcaccaaguacguccaccaggagcaccucggcaaggagcucuccuacgucauccgcaccaccgcccucaagcccccccccccccacaaccucaccaucuacuucggcuccgccuacgucgcccucucccgcgaguucgccaacuucguccuccacgacccccgcgccgucgaccuccuccagugguccaaggacaccuucucccccgacgagcacuucugggucacccucaaccgcauccccggcguccccggcuccaugcccaacgccuccuggaccggcaaccuccgcgccaucaagugguccgacauggaggaccgccacggcggcugccacggccacuacguccacggcaucugcaucuacggcaacggcgaccucaaguggcucgucaacucccccucccucuucgccaacaaguucgagcucaacaccuacccccucaccgucgagugccucgagcuccgccaccgcgagcgcacccucaaccaguccgagaccgccauccagcccuccugguacuucuga

SEQ ID NO: 43557 - RNA, 1317 nt, Artificial Sequence
  derived and/or modified sequence opt2 from GCNT3__Homo_sapiens__NP_004742
augguccaguggaagcgccucugccagcuccacuaccucugggcccucggcugcuacaugcuccucgccaccgucgcccucaagcucuccuuccgccucaagugcgacuccgaccaccucggccucgagucccgcgagucccagucccaguacugccgcaacauccucuacaacuuccucaagcuccccgccaagcgcuccaucaacugcuccggcgucacccgcggcgaccaggaggccguccuccaggccauccucaacaaccucgaggucaagaagaagcgcgagcccuucaccgacacccacuaccucucccucacccgcgacugcgagcacuucaaggccgagcgcaaguucauccaguucccccucuccaaggaggaggucgaguuccccaucgccuacuccauggucauccacgagaagaucgagaacuucgagcgccuccuccgcgccgucuacgccccccagaacaucuacugcguccacgucgacgagaagucccccgagaccuucaaggaggccgucaaggccaucaucuccugcuuccccaacgucuucaucgccuccaagcucguccgcgucgucuacgccuccuggucccgcguccaggccgaccucaacugcauggaggaccuccuccaguccuccguccccuggaaguacuuccucaacaccugcggcaccgacuuccccaucaaguccaacgccgagaugguccaggcccucaagaugcucaacggccgcaacuccauggaguccgaggucccccccaagcacaaggagacccgcuggaaguaccacuucgaggucguccgcgacacccuccaccucaccaacaagaagaaggaccccccccccuacaaccucaccauguucaccggcaacgccuacaucgucgccucccgcgacuucguccagcacguccucaagaaccccaagucccagcagcucaucgagugggucaaggacaccuacucccccgacgagcaccucugggccacccuccagcgcgcccgcuggaugcccggcuccguccccaaccaccccaaguacgacaucuccgacaugaccuccaucgcccgccucgucaaguggcagggccacgagggcgacaucgacaagggcgcccccuacgcccccugcuccggcauccaccagcgcgccaucugcgucuacggcgccggcgaccucaacuggaugcuccagaaccaccaccuccucgccaacaaguucgaccccaaggucgacgacaacgcccuccagugccucgaggaguaccuccgcuacaaggccaucuacggcaccgagcucuga

SEQ ID NO: 43558 - RNA, 1293 nt, Artificial Sequence
  derived and/or modified sequence opt2 from GCNT7__Homo_sapiens__NP_542182
augucccagcuccgcgccaccaaguccggccucgucguccgcgccgucaucugcaucuucaucuuccucuaccuccgcaaccccacccccgccgaguccgaggaggagcccgcccagcccgaggucgucgagugcggcuucuaccccgacgagcucugcuccgcccucuucgagggcaagggcgccgccccccagaucgccaaguucugcaagaccccccacaaguccgagauccacgcccaccuccacacccccggcaacugcucccgcaucucccgcggccuccacuucaucacccgcccccucuccgccgaggagggcgacuucucccucgccuacaucaucaccauccacaaggagcucgccauguucguccagcuccuccgcgccaucuacgucccccagaacgucuacugcauccacgucgacgagaaggcccccaugaaguacaagaccgccguccagacccucgucaacugcuucgagaacgucuucaucuccuccaagaccgagaaggucgccuacgccggcuucacccgccuccaggccgacaucaacugcaugaagguccucguccacuccaaguuccaguggaacuacgucaucaaccucugcggccaggacuuccccaucaagaccaaccgcgagaucauccacuacauccgcuccaagugguccgacaagaacaucacccccggcgucauccagccccuccacaucaaguccaagaccucccagucccaccucgaguucguccccaagggcuccaucuacgccccccccaacaaccgcuucaaggacaagcccccccacaaccucaccaucuacuucggcuccgccuacuacguccucacccgcaaguucgucgaguucauccucaccgacauccacgccaaggacaugcuccagugguccaaggacauccgcucccccgagcagcacuacugggucacccucaaccgccucaaggacgcccccggcgccacccccaacgccggcugggagggcaacguccgcgccaucaagcgcaaguccgaggagggcaacguccacgacggcugcaagggccgcuacgucgaggacaucugcgucuacggccccggcgaccuccccuggcucauccagucccccucccucuucgccaacaaguucgagcccuccaccgacccccucgucgucaccugccucgagcgccgccaccgccuccagguccuccgccaggccgagguccccaucgagccccacuggcacuuccagcagcagucccacuucaacaugcgccucaaccgcuga

SEQ ID NO: 43559 - RNA, 1653 nt, Artificial Sequence
  derived and/or modified sequence opt2 from GCOM1__Homo_sapiens__NP_001018100
augcuccgcuccaccuccaccgucacccuccucuccggcggcgccgcccgcacccccggcgcccccucccgccgcgccaacgucugccgccuccgccucaccgucccccccgagucccccguccccgagcagugcgagaagaagaucgagcgcaaggagcagcuccucgaccucuccaacggcgagcccacccgcaagcucccccagggcgucgucuacggcgucguccgccgcuccgaccagaaccagcagaaggagauggucgucuacggcugguccaccucccagcucaaggaggagaugaacuacaucaaggacguccgcgccacccucgagaagguccgcaagcgcauguacggcgacuacgacgagaugcgccagaagauccgccagcucacccaggagcucuccgucucccacgcccagcaggaguaccucgagaaccacauccagacccaguccuccgcccucgaccgcuucaacgccaugaacuccgcccucgccuccgacuccaucggccuccagaagacccucgucgacgucacccucgagaacuccaacaucaaggaccagauccgcaaccuccagcagaccuacgaggccuccauggacaagcuccgcgagaagcagcgccagcucgaggucgcccaggucgagaaccagcuccucaagaugaaggucgaguccucccaggaggccaacgccgaggucaugcgcgagaugaccaagaagcucuacucccaguacgaggagaagcuccaggaggagcagcgcaagcacuccgccgagaaggaggcccuccucgaggagaccaacuccuuccucaaggccaucgaggaggccaacaagaagaugcaggccgccgagaucucccucgaggagaaggaccagcgcaucggcgagcucgaccgccucaucgagcgcauggagaaggagcgccaccagcuccagcuccagcuccucgagcacgagaccgagauguccggcgagcucaccgacuccgacaaggagcgcuaccagcagcucgaggaggccuccgccucccuccgcgagcgcauccgccaccucgacgacaugguccacugccagcagaagaaggucaagcagauggucgaggagaucgagucccucaagaagaagcuccagcagaagcagcuccucauccuccagcuccucgagaagaucuccuuccucgagggcgagaacaacgagcuccagucccgccucgacuaccucaccgagacccaggccaagaccgaggucgagacccgcgagaucggcgucggcugcgaccuccucccccgccuccccuuccgccagaacgacuccuccucccacugccagaaguccggcucccccaucuccuccgaggagcgccgccgccgcgacaagcagcaccucgacgacaucaccgccgcccgccuccucccccuccaccacaugcccacccagcuccucuccaucgaggagucccucgcccuccagaagcagcagaagcagaacuacgaggagaugcaggccaagcucgccgcccagaagcucgccgagcgccucaacaucaagaugcgcuccuacaaccccgagggcgaguccuccggccgcuaccgcgagguccgcgacgaggacgacgacugguccuccgacgaguucuga

SEQ ID NO: 43560 - RNA, 543 nt, Artificial Sequence
  derived and/or modified sequence opt2 from GCSAM__Homo_sapiens__NP_001177188
augggcaacucccuccuccgcgagaacuccuuccgccgccagcagaacacccaggagaugcccuggaacguccgcaugcagucccccaagcagcgcaccucccgcugcugggaccaccacaucgccgagggcugcuucugccuccccuggaagaagauccucaucuucgagaagcgccaggacucccagaacgagaacgagcgcauguccuccacccccauccaggacaacgucgaccagaccuacuccgaggagcucugcuacacccucaucaaccaccgcguccucugcacccgccccuccggcaacuccgccgaggaguacuacgagaacguccccugcaaggccgagcgcccccgcgagucccucggcggcaccgagaccgaguacucccuccuccacaugcccuccaccgacccccgccacgcccgcucccccgaggacgaguacgagcuccucaugccccaccgcaucuccucccacuuccuccagcagccccgcccccucauggcccccuccgagacccaguucucccaccucuga

SEQ ID NO: 43561 - RNA, 348 nt, Artificial Sequence
  derived and/or modified sequence opt2 from GCSAML__Homo_sapiens__NP_001268764
augggcaacuaccuccuccgcaagcuccgccaggagaugaccaccuucgagcgcaagcuccaggaccaggacaagaagucccaggaggucuccuccaccuccaaccaggagaacgagaacggcuccggcuccgaggaggucugcuacaccgucaucaaccacaucccccaccagcgcuccucccucuccuccaacgacgacggcuacgagaacaucgacucccucacccgcaagguccgccaguuccgcgagcgcuccgagaccgaguacgcccuccuccgcaccuccgucucccgccccugcuccugcacccacgagcacgacuacgaggucgucuucccccacuga

SEQ ID NO: 43562 - RNA, 522 nt, Artificial Sequence
  derived and/or modified sequence opt2 from GCSH__Homo_sapiens__NP_004474
auggcccuccgcgucguccgcuccguccgcgcccuccucugcacccuccgcgccguccccucccccgccgcccccugccccccccgccccuggcagcucggcgucggcgccguccgcacccuccgcaccggccccgcccuccucuccguccgcaaguucaccgagaagcacgagugggucaccaccgagaacggcaucggcaccgucggcaucuccaacuucgcccaggaggcccucggcgacgucgucuacugcucccuccccgaggucggcaccaagcucaacaagcaggacgaguucggcgcccucgaguccgucaaggccgccuccgagcucuacuccccccucuccggcgaggucaccgagaucaacgaggcccucgccgagaaccccggccucgucaacaaguccugcuacgaggacggcuggcucaucaagaugacccucuccaaccccuccgagcucgacgagcucauguccgaggaggccuacgagaaguacaucaaguccaucgaggaguga

SEQ ID NO: 43563 - RNA, 1416 nt, Artificial Sequence
  derived and/or modified sequence opt2 from GDA__Homo_sapiens__NP_001229434
augugcgccgcccagaugcccccccucgcccacaucuuccgcggcaccuucguccacuccaccuggaccugccccauggagguccuccgcgaccaccuccucggcgucuccgacuccggcaagaucgucuuccucgaggaggccucccagcaggagaagcucgccaaggaguggugcuucaagcccugcgagauccgcgagcucucccaccacgaguucuucaugcccggccucgucgacacccacauccacgccucccaguacuccuucgccggcuccuccaucgaccucccccuccucgaguggcucaccaaguacaccuuccccgccgagcaccgcuuccagaacaucgacuucgccgaggaggucuacacccgcgucguccgccgcacccucaagaacggcaccaccaccgccugcuacuucgccaccauccacaccgacuccucccuccuccucgccgacaucaccgacaaguucggccagcgcgccuucgucggcaaggucugcauggaccucaacgacaccuuccccgaguacaaggagaccaccgaggaguccaucaaggagaccgagcgcuucgucuccgagaugcuccagaagaacuacucccgcgucaagcccaucgucaccccccgcuucucccucuccugcuccgagacccucaugggcgagcucggcaacaucgccaagacccgcgaccuccacauccagucccacaucuccgagaaccgcgacgaggucgaggccgucaagaaccucuaccccuccuacaagaacuacaccuccgucuacgacaagaacaaccuccucaccaacaagaccgucauggcccacggcugcuaccucuccgccgaggagcucaacgucuuccacgagcgcggcgccuccaucgcccacugccccaacuccaaccucucccucuccuccggcuuccucaacguccucgagguccucaagcacgaggucaagaucggccucggcaccgacgucgccggcggcuacuccuacuccaugcucgacgccauccgccgcgccgucauggucuccaacauccuccucaucaacaaggucaacgagaagucccucacccucaaggaggucuuccgccucgccacccucggcggcucccaggcccucggccucgacggcgagaucggcaacuucgaggucggcaaggaguucgacgccauccucaucaaccccaaggccuccgacucccccaucgaccucuucuacggcgacuucuucggcgacaucuccgaggccgucauccagaaguuccucuaccucggcgacgaccgcaacaucgaggaggucuacgucggcggcaagcaggucguccccuucuccuccuccgucaaggagaccauccaccuccccgccuccuccccccaccccccccccuuccccuga

SEQ ID NO: 43564 - RNA, 873 nt, Artificial Sequence
  derived and/or modified sequence opt2 from GDAP1__Homo_sapiens__NP_001035808
augcgccucaacuccaccggcgagguccccguccucauccacggcgagaacaucaucugcgaggccacccagaucaucgacuaccucgagcagaccuuccucgacgagcgcaccccccgccucaugcccgacaaggaguccauguacuacccccgcguccagcacuaccgcgagcuccucgacucccuccccauggacgccuacacccacggcugcauccuccaccccgagcucaccgucgacuccaugauccccgccuacgccaccacccgcauccgcucccagaucggcaacaccgaguccgagcucaagaagcucgccgaggagaaccccgaccuccaggaggccuacaucgccaagcagaagcgccucaaguccaagcuccucgaccacgacaacgucaaguaccucaagaagauccucgacgagcucgagaagguccucgaccaggucgagaccgagcuccagcgccgcaacgaggagacccccgaggagggccagcagcccuggcucugcggcgaguccuucacccucgccgacgucucccucgccgucacccuccaccgccucaaguuccucggcuucgcccgccgcaacuggggcaacggcaagcgccccaaccucgagaccuacuacgagcgcguccucaagcgcaagaccuucaacaagguccucggccacgucaacaacauccucaucuccgccguccuccccaccgccuuccgcgucgccaagaagcgcgcccccaagguccucggcaccacccucgucgucggccuccucgccggcgucggcuacuucgccuucaugcucuuccgcaagcgccucggcuccaugauccucgccuuccgcccccgccccaacuacuucuga

SEQ ID NO: 43565 - RNA, 996 nt, Artificial Sequence
  derived and/or modified sequence opt2 from GDE1__Homo_sapiens__NP_057725
auguggcucugggaggaccagggcggccuccucggccccuucuccuuccuccuccucguccuccuccucgucacccgcucccccgucaacgccugccuccucaccggcucccucuucguccuccuccgcgucuucuccuucgagcccguccccuccugccgcgcccuccagguccucaagccccgcgaccgcaucuccgccaucgcccaccgcggcggcucccacgacgcccccgagaacacccucgccgccauccgccaggccgccaagaacggcgccaccggcgucgagcucgacaucgaguucaccuccgacggcauccccguccucaugcacgacaacaccgucgaccgcaccaccgacggcaccggccgccucugcgaccucaccuucgagcagauccgcaagcucaaccccgccgccaaccaccgccuccgcaacgacuuccccgacgagaagauccccacccuccgcgaggccgucgccgagugccucaaccacaaccucaccaucuucuucgacgucaagggccacgcccacaaggccaccgaggcccucaagaagauguacauggaguucccccagcucuacaacaacuccgucgucugcuccuuccuccccgaggucaucuacaagaugcgccagaccgaccgcgacgucaucaccgcccucacccaccgccccuggucccucucccacaccggcgacggcaagccccgcuacgacaccuucuggaagcacuucaucuucgucaugauggacauccuccucgacugguccaugcacaacauccucugguaccucugcggcaucuccgccuuccucaugcagaaggacuucgucucccccgccuaccucaagaagugguccgccaagggcauccaggucgucggcuggaccgucaacaccuucgacgagaaguccuacuacgagucccaccucggcuccuccuacaucaccgacuccauggucgaggacugcgagccccacuucuga

SEQ ID NO: 43566 - RNA, 1437 nt, Artificial Sequence
  derived and/or modified sequence opt2 from GDF10__Homo_sapiens__NP_004953
auggcccacguccccgcccgcaccucccccggccccggcccccagcuccuccuccuccuccucccccucuuccuccuccuccuccgcgacgucgccggcucccaccgcgcccccgccugguccgcccuccccgccgccgccgacggccuccagggcgaccgcgaccuccagcgccaccccggcgacgccgccgccacccucggccccuccgcccaggacauggucgccguccacaugcaccgccucuacgagaaguacucccgccagggcgcccgccccggcggcggcaacaccguccgcuccuuccgcgcccgccucgaggucgucgaccagaaggccgucuacuucuucaaccucaccuccaugcaggacuccgagaugauccucaccgccaccuuccacuucuacuccgagcccccccgcuggccccgcgcccucgagguccucugcaagccccgcgccaagaacgccuccggccgcccccucccccucggcccccccacccgccagcaccuccucuuccgcucccucucccagaacaccgccacccagggccuccuccgcggcgccauggcccucgccccccccccccgcggccucuggcaggccaaggacaucucccccaucgucaaggccgcccgccgcgacggcgagcuccuccucuccgcccagcucgacuccgaggagcgcgaccccggcgucccccgccccucccccuacgcccccuacauccucgucuacgccaacgaccucgccaucuccgagcccaacuccgucgccgucacccuccagcgcuacgaccccuuccccgccggcgaccccgagccccgcgccgcccccaacaacuccgccgacccccgcguccgccgcgccgcccaggccaccggcccccuccaggacaacgagcuccccggccucgacgagcgccccccccgcgcccacgcccagcacuuccacaagcaccagcucuggcccucccccuuccgcgcccucaagccccgccccggccgcaaggaccgccgcaagaagggccaggaggucuucauggccgccucccagguccucgacuucgacgagaagaccaugcagaaggcccgccgcaagcagugggacgagccccgcgucugcucccgccgcuaccucaaggucgacuucgccgacaucggcuggaacgaguggaucaucucccccaaguccuucgacgccuacuacugcgccggcgccugcgaguuccccaugcccaagaucguccgccccuccaaccacgccaccauccaguccaucguccgcgccgucggcaucauccccggcauccccgagcccugcugcguccccgacaagaugaacucccucggcguccucuuccucgacgagaaccgcaacgucguccucaaggucuaccccaacauguccgucgacaccugcgccugccgcuga

SEQ ID NO: 43567 - RNA, 1224 nt, Artificial Sequence
  derived and/or modified sequence opt2 from GDF11__Homo_sapiens__XP_006719257
augguccucgccgccccccuccuccucggcuuccuccuccucgcccucgagcuccgcccccgcggcgaggccgccgagggccccgccgccgccgccgccgccgccgccgccgccgccgccgccggcgucggcggcgagcgcuccucccgccccgcccccuccgucgcccccgagcccgacggcugccccgucugcgucuggcgccagcacucccgcgagcuccgccucgaguccaucaagucccagauccucuccaagcuccgccucaaggaggcccccaacaucucccgcgaggucgucaagcagcuccuccccaaggcccccccccuccagcagauccucgaccuccacgacuuccagggcgacgcccuccagcccgaggacuuccucgaggaggacgaguaccacgccaccaccgagaccgucaucuccauggcccaggagaccgaccccgccguccagaccgacggcuccccccucugcugccacuuccacuucucccccaaggucauguucaccaagguccucaaggcccagcucugggucuaccuccgccccgucccccgccccgccaccgucuaccuccagauccuccgccucaagccccucaccggcgagggcaccgccggcggcggcggcggcggccgccgccacauccgcauccgcucccucaagaucgagcuccacucccgcuccggccacuggcaguccaucgacuucaagcagguccuccacuccugguuccgccagccccaguccaacuggggcaucgagaucaacgccuucgaccccuccggcaccgaccucgccgucaccucccucggccccggcgccgagggccuccaccccuucauggagcuccgcguccucgagaacaccaagcgcucccgccgcaaccucggccucgacugcgacgagcacuccuccgagucccgcugcugccgcuacccccucaccgucgacuucgaggccuucggcugggacuggaucaucgcccccaagcgcuacaaggccaacuacugcuccggccagugcgaguacauguucaugcagaaguacccccacacccaccucguccagcaggccaacccccgcggcuccgccggccccugcugcacccccaccaagaugucccccaucaacaugcucuacuucaacgacaagcagcagaucaucuacggcaagauccccggcauggucgucgaccgcugcggcugcuccuga

SEQ ID NO: 43568 - RNA, 927 nt, Artificial Sequence
  derived and/or modified sequence opt2 from GDF15__Homo_sapiens__NP_004855
augcccggccaggagcuccgcaccgucaacggcucccagaugcuccucguccuccucguccucuccuggcucccccacggcggcgcccucucccucgccgaggccucccgcgccuccuuccccggccccuccgagcuccacuccgaggacucccgcuuccgcgagcuccgcaagcgcuacgaggaccuccucacccgccuccgcgccaaccaguccugggaggacuccaacaccgaccucguccccgcccccgccguccgcauccucacccccgagguccgccucggcuccggcggccaccuccaccuccgcaucucccgcgccgcccuccccgagggccuccccgaggccucccgccuccaccgcgcccucuuccgccucucccccaccgccucccgcuccugggacgucacccgcccccuccgccgccagcucucccucgcccgcccccaggcccccgcccuccaccuccgccucucccccccccccucccaguccgaccagcuccucgccgaguccuccuccgcccgcccccagcucgagcuccaccuccgcccccaggccgcccgcggccgccgccgcgcccgcgcccgcaacggcgaccacugcccccucggccccggccgcugcugccgccuccacaccguccgcgccucccucgaggaccucggcugggccgacuggguccucuccccccgcgagguccaggucaccaugugcaucggcgccugccccucccaguuccgcgccgccaacaugcacgcccagaucaagaccucccuccaccgccucaagcccgacaccguccccgcccccugcugcguccccgccuccuacaaccccaugguccucauccagaagaccgacaccggcgucucccuccagaccuacgacgaccuccucgccaaggacugccacugcaucuga

SEQ ID NO: 43569 - RNA, 1119 nt, Artificial Sequence
  derived and/or modified sequence opt2 from GDF1__Homo_sapiens__NP_001483
augccccccccccagcagggccccugcggccaccaccuccuccuccuccucgcccuccuccuccccucccucccccucacccgcgcccccgucccccccggccccgccgccgcccuccuccaggcccucggccuccgcgacgagccccagggcgccccccgccuccgccccgucccccccgucauguggcgccucuuccgccgccgcgacccccaggagacccgcuccggcucccgccgcaccucccccggcgucacccuccagcccugccacgucgaggagcucggcgucgccggcaacaucguccgccacauccccgaccgcggcgcccccacccgcgccuccgagcccgccuccgccgccggccacugccccgaguggaccgucgucuucgaccucuccgccgucgagcccgccgagcgccccucccgcgcccgccucgagcuccgcuucgccgccgccgccgccgccgcccccgagggcggcugggagcucuccgucgcccaggccggccagggcgccggcgccgaccccggccccguccuccuccgccagcucguccccgcccucggcccccccguccgcgccgagcuccucggcgccgccugggcccgcaacgccuccuggccccgcucccuccgccucgcccucgcccuccgcccccgcgcccccgccgccugcgcccgccucgccgaggccucccuccuccucgucacccucgacccccgccucugccacccccucgcccgcccccgccgcgacgccgagcccguccucggcggcggccccggcggcgccugccgcgcccgccgccucuacgucuccuuccgcgaggucggcuggcaccgcugggucaucgccccccgcggcuuccucgccaacuacugccagggccagugcgcccuccccgucgcccucuccggcuccggcggcccccccgcccucaaccacgccguccuccgcgcccucaugcacgccgccgcccccggcgccgccgaccuccccugcugcguccccgcccgccucucccccaucuccguccucuucuucgacaacuccgacaacgucguccuccgccaguacgaggacauggucgucgacgagugcggcugccgcuga

SEQ ID NO: 43570 - RNA, 1290 nt, Artificial Sequence
  derived and/or modified sequence opt2 from GDF2__Homo_sapiens__NP_057288
augugccccggcgcccucugggucgcccucccccuccucucccuccucgccggcucccuccagggcaagccccuccaguccuggggccgcggcuccgccggcggcaacgcccacuccccccucggcguccccggcggcggccuccccgagcacaccuucaaccucaagauguuccucgagaacgucaaggucgacuuccuccgcucccucaaccucuccggcguccccucccaggacaagacccgcgucgagcccccccaguacaugaucgaccucuacaaccgcuacaccuccgacaaguccaccacccccgccuccaacaucguccgcuccuucuccauggaggacgccaucuccaucaccgccaccgaggacuuccccuuccagaagcacauccuccucuucaacaucuccaucccccgccacgagcagaucacccgcgccgagcuccgccucuacgucuccugccagaaccacgucgaccccucccacgaccucaagggcuccgucgucaucuacgacguccucgacggcaccgacgccugggacuccgccaccgagaccaagaccuuccucgucucccaggacauccaggacgagggcugggagacccucgaggucuccuccgccgucaagcgcuggguccgcuccgacuccaccaaguccaagaacaagcucgaggucaccgucgagucccaccgcaagggcugcgacacccucgacaucuccgucccccccggcucccgcaaccuccccuucuucgucgucuucuccaacgaccacuccuccggcaccaaggagacccgccucgagcuccgcgagaugaucucccacgagcaggaguccguccucaagaagcucuccaaggacggcuccaccgaggccggcgaguccucccacgaggaggacaccgacggccacgucgccgccggcuccacccucgcccgccgcaagcgcuccgccggcgccggcucccacugccagaagaccucccuccgcgucaacuucgaggacaucggcugggacuccuggaucaucgcccccaaggaguacgaggccuacgagugcaagggcggcugcuucuucccccucgccgacgacgucacccccaccaagcacgccaucguccagacccucguccaccucaaguuccccaccaaggucggcaaggccugcugcguccccaccaagcucucccccaucuccguccucuacaaggacgacaugggcguccccacccucaaguaccacuacgagggcauguccgucgccgagugcggcugccgcuga

SEQ ID NO: 43571 - RNA, 1095 nt, Artificial Sequence
  derived and/or modified sequence opt2 from GDF3__Homo_sapiens__NP_065685
augcuccgcuuccuccccgaccucgccuucuccuuccuccucauccucgcccucggccaggccguccaguuccaggaguacgucuuccuccaguuccucggccucgacaaggcccccuccccccagaaguuccagcccguccccuacauccucaagaagaucuuccaggaccgcgaggccgccgccaccaccggcgucucccgcgaccucugcuacgucaaggagcucggcguccgcggcaacguccuccgcuuccuccccgaccagggcuucuuccucuaccccaagaagaucucccaggccuccuccugccuccagaagcuccucuacuucaaccucuccgccaucaaggagcgcgagcagcucacccucgcccagcucggccucgaccucggccccaacuccuacuacaaccucggccccgagcucgagcucgcccucuuccucguccaggagccccacgucuggggccagaccacccccaagcccggcaagauguucguccuccgcuccguccccuggccccagggcgccguccacuucaaccuccucgacgucgccaaggacuggaacgacaacccccgcaagaacuucggccucuuccucgagauccucgucaaggaggaccgcgacuccggcgucaacuuccagcccgaggacaccugcgcccgccuccgcugcucccuccacgccucccuccucgucgucacccucaaccccgaccagugccaccccucccgcaagcgccgcgccgccauccccguccccaagcucuccugcaagaaccucugccaccgccaccagcucuucaucaacuuccgcgaccucggcuggcacaaguggaucaucgcccccaagggcuucauggccaacuacugccacggcgagugccccuucucccucaccaucucccucaacuccuccaacuacgccuucaugcaggcccucaugcacgccgucgaccccgagaucccccaggccgucugcauccccaccaagcucucccccaucuccaugcucuaccaggacaacaacgacaacgucauccuccgccacuacgaggacauggucgucgacgagugcggcugcggcuga

SEQ ID NO: 43572 - RNA, 1506 nt, Artificial Sequence
  derived and/or modified sequence opt2 from GDF5__Homo_sapiens__NP_001306067
augcgccuccccaagcuccucaccuuccuccucugguaccucgccuggcucgaccucgaguucaucugcaccguccucggcgcccccgaccucggccagcgcccccagggcacccgccccggccucgccaaggccgaggccaaggagcgccccccccucgcccgcaacgucuuccgccccggcggccacuccuacggcggcggcgccaccaacgccaacgcccgcgccaagggcggcaccggccagaccggcggccucacccagcccaagaaggacgagcccaagaagcuccccccccgccccggcggccccgagcccaagcccggccaccccccccagacccgccaggccaccgcccgcaccgucacccccaagggccagcuccccggcggcaaggccccccccaaggccggcuccguccccuccuccuuccuccucaagaaggcccgcgagcccggccccccccgcgagcccaaggagcccuuccgccccccccccaucaccccccacgaguacaugcucucccucuaccgcacccucuccgacgccgaccgcaagggcggcaacuccuccgucaagcucgaggccggccucgccaacaccaucaccuccuucaucgacaagggccaggacgaccgcggccccgucguccgcaagcagcgcuacgucuucgacaucuccgcccucgagaaggacggccuccucggcgccgagcuccgcauccuccgcaagaagcccuccgacaccgccaagcccgccgcccccggcggcggccgcgccgcccagcucaagcucuccuccugccccuccggccgccagcccgccgcccuccucgacguccgcuccguccccggccucgacggcuccggcugggaggucuucgacaucuggaagcucuuccgcaacuucaagaacuccgcccagcucugccucgagcucgaggccugggagcgcggccgcgccgucgaccuccgcggccucggcuucgaccgcgccgcccgccagguccacgagaaggcccucuuccucgucuucggccgcaccaagaagcgcgaccucuucuucaacgagaucaaggcccgcuccggccaggacgacaagaccgucuacgaguaccucuucucccagcgccgcaagcgccgcgccccccucgccacccgccagggcaagcgccccuccaagaaccucaaggcccgcugcucccgcaaggcccuccacgucaacuucaaggacaugggcugggacgacuggaucaucgccccccucgaguacgaggccuuccacugcgagggccucugcgaguucccccuccgcucccaccucgagcccaccaaccacgccgucauccagacccucaugaacuccauggaccccgaguccaccccccccaccugcugcguccccacccgccucucccccaucuccauccucuucaucgacuccgccaacaacgucgucuacaagcaguacgaggacauggucgucgaguccugcggcugccgcuga

SEQ ID NO: 43573 - RNA, 1368 nt, Artificial Sequence
  derived and/or modified sequence opt2 from GDF6__Homo_sapiens__NP_001001557
auggacaccccccgcguccuccucuccgccgucuuccucaucuccuuccucugggaccuccccggcuuccagcaggccuccaucuccuccuccuccuccuccgccgagcucggcuccaccaagggcaugcgcucccgcaaggagggcaagaugcagcgcgccccccgcgacuccgacgccggccgcgagggccaggagccccagccccgcccccaggacgagccccgcgcccagcagccccgcgcccaggagccccccggccgcggcccccgcgucgucccccacgaguacaugcucuccaucuaccgcaccuacuccaucgccgagaagcucggcaucaacgccuccuucuuccaguccuccaaguccgccaacaccaucaccuccuucgucgaccgcggccucgacgaccucucccacaccccccuccgccgccagaaguaccucuucgacgucuccaugcucuccgacaaggaggagcucgucggcgccgagcuccgccucuuccgccaggcccccuccgcccccuggggcccccccgccggcccccuccacguccagcucuuccccugccucuccccccuccuccucgacgcccgcacccucgacccccagggcgccccccccgccggcugggaggucuucgacgucuggcagggccuccgccaccagcccuggaagcagcucugccucgagcuccgcgccgccuggggcgagcucgacgccggcgaggccgaggcccgcgcccgcggcccccagcagccccccccccccgaccuccgcucccucggcuucggccgccgcguccgccccccccaggagcgcgcccuccucgucgucuucacccgcucccagcgcaagaaccucuucgccgagaugcgcgagcagcucggcuccgccgaggccgccggccccggcgccggcgccgagggcuccuggcccccccccuccggcgcccccgacgcccgccccuggcuccccucccccggccgccgccgccgccgcaccgccuucgccucccgccacggcaagcgccacggcaagaagucccgccuccgcugcuccaagaagccccuccacgucaacuucaaggagcucggcugggacgacuggaucaucgccccccucgaguacgaggccuaccacugcgagggcgucugcgacuucccccuccgcucccaccucgagcccaccaaccacgccaucauccagacccucaugaacuccauggaccccggcuccaccccccccuccugcugcguccccaccaagcucacccccaucuccauccucuacaucgacgccggcaacaacgucgucuacaagcaguacgaggacauggucgucgaguccugcggcugccgcuga

SEQ ID NO: 43574 - RNA, 1353 nt, Artificial Sequence
  derived and/or modified sequence opt2 from GDF7__Homo_sapiens__NP_878248
auggaccucuccgccgccgccgcccucugccucuggcuccucuccgccugccgcccccgcgacggccucgaggccgccgccguccuccgcgccgccggcgccggccccguccgcucccccggcggcggcggcggcggcggcggcggcggccgcacccucgcccaggccgccggcgccgccgccguccccgccgccgccgucccccgcgcccgcgccgcccgccgcgccgccggcuccggcuuccgcaacggcuccgucgucccccaccacuucaugaugucccucuaccgcucccucgccggccgcgcccccgccggcgccgccgccgucuccgccuccggccacggccgcgccgacaccaucaccggcuucaccgaccaggccacccaggacgaguccgccgccgagaccggccaguccuuccucuucgacgucuccucccucaacgacgccgacgaggucgucggcgccgagcuccgcguccuccgccgcggcucccccgaguccggccccggcuccuggaccucccccccccuccuccuccucuccaccugccccggcgccgcccgcgccccccgccuccucuacucccgcgccgccgagccccucgucggccagcgcugggaggccuucgacgucgccgacgccaugcgccgccaccgccgcgagccccgccccccccgcgccuucugccuccuccuccgcgccgucgccggccccguccccuccccccucgcccuccgccgccucggcuucggcuggcccggcggcggcggcuccgccgccgaggagcgcgccguccucgucgucuccucccgcacccagcgcaaggagucccucuuccgcgagauccgcgcccaggcccgcgcccucggcgccgcccucgccuccgagccccuccccgaccccggcaccggcaccgccuccccccgcgccgucaucggcggccgccgccgccgccgcaccgcccucgccggcacccgcaccgcccagggcuccggcggcggcgccggccgcggccacggccgccgcggccgcucccgcugcucccgcaagccccuccacgucgacuucaaggagcucggcugggacgacuggaucaucgccccccucgacuacgaggccuaccacugcgagggccucugcgacuucccccuccgcucccaccucgagcccaccaaccacgccaucauccagacccuccucaacuccauggcccccgacgccgcccccgccuccugcugcguccccgcccgccucucccccaucuccauccucuacaucgacgccgccaacaacgucgucuacaagcaguacgaggacauggucgucgaggccugcggcugccgcuga

SEQ ID NO: 43575 - RNA, 1365 nt, Artificial Sequence
  derived and/or modified sequence opt2 from GDF9__Homo_sapiens__XP_011541610
auggcccgccccaacaaguuccuccucugguucugcugcuucgccuggcucugcuuccccaucucccucggcucccaggccuccggcggcgaggcccagaucgccgccuccgccgagcucgaguccggcgccaugcccuggucccuccuccagcacaucgacgagcgcgaccgcgccggccuccuccccgcccucuucaagguccucuccgucggccgcggcggcuccccccgccuccagcccgacucccgcgcccuccacuacaugaagaagcucuacaagaccuacgccaccaaggagggcauccccaaguccaaccgcucccaccucuacaacaccguccgccucuucacccccugcacccgccacaagcaggcccccggcgaccaggucaccggcauccuccccuccgucgagcuccucuucaaccucgaccgcaucaccaccgucgagcaccuccucaaguccguccuccucuacaacaucaacaacuccgucuccuucuccuccgccgucaagugcgucugcaaccucaugaucaaggagcccaaguccuccucccgcacccucggccgcgcccccuacuccuucaccuucaacucccaguucgaguucggcaagaagcacaaguggauccagaucgacgucaccucccuccuccagccccucgucgccuccaacaagcgcuccauccacauguccaucaacuucaccugcaugaaggaccagcucgagcaccccuccgcccagaacggccucuucaacaugacccucgucucccccucccucauccucuaccucaacgacaccuccgcccaggccuaccacuccugguacucccuccacuacaagcgccgccccucccagggccccgaccaggagcgcucccucuccgccuaccccgucggcgaggaggccgccgaggacggccgcuccucccaccaccgccaccgccgcggccaggagaccgucuccuccgagcucaagaagccccucggccccgccuccuucaaccucuccgaguacuuccgccaguuccuccucccccagaacgagugcgagcuccacgacuuccgccucuccuucucccagcucaagugggacaacuggaucgucgccccccaccgcuacaacccccgcuacugcaagggcgacugcccccgcgccgucggccaccgcuacggcucccccguccacaccaugguccagaacaucaucuacgagaagcucgacuccuccgucccccgccccuccugcguccccgccaaguacuccccccucuccguccucaccaucgagcccgacggcuccaucgccuacaaggaguacgaggacaugaucgccaccaagugcaccugccgcuga

SEQ ID NO: 43576 - RNA, 1344 nt, Artificial Sequence
  derived and/or modified sequence opt2 from GDI1__Homo_sapiens__NP_001484
auggacgaggaguacgacgucaucguccucggcaccggccucaccgagugcauccucuccggcaucauguccgucaacggcaagaagguccuccacauggaccgcaaccccuacuacggcggcgaguccuccuccaucaccccccucgaggagcucuacaagcgcuuccagcuccucgagggcccccccgaguccaugggccgcggccgcgacuggaacgucgaccucauccccaaguuccucauggccaacggccagcucgucaagaugcuccucuacaccgaggucacccgcuaccucgacuucaaggucgucgagggcuccuucgucuacaagggcggcaagaucuacaagguccccuccaccgagaccgaggcccucgccuccaaccucaugggcauguucgagaagcgccgcuuccgcaaguuccucgucuucgucgccaacuucgacgagaacgaccccaagaccuucgagggcgucgacccccagaccaccuccaugcgcgacgucuaccgcaaguucgaccucggccaggacgucaucgacuucaccggccacgcccucgcccucuaccgcaccgacgacuaccucgaccagcccugccucgagaccgucaaccgcaucaagcucuacuccgagucccucgcccgcuacggcaagucccccuaccucuacccccucuacggccucggcgagcucccccagggcuucgcccgccucuccgccaucuacggcggcaccuacaugcucaacaagcccgucgacgacaucaucauggagaacggcaaggucgucggcgucaaguccgagggcgaggucgcccgcugcaagcagcucaucugcgaccccuccuacauccccgaccgcguccgcaaggccggccaggucauccgcaucaucugcauccucucccaccccaucaagaacaccaacgacgccaacuccugccagaucaucaucccccagaaccaggucaaccgcaaguccgacaucuacgucugcaugaucuccuacgcccacaacgucgccgcccagggcaaguacaucgccaucgccuccaccaccgucgagaccaccgaccccgagaaggaggucgagcccgcccucgagcuccucgagcccaucgaccagaaguucgucgccaucuccgaccucuacgagcccaucgacgacggcugcgagucccaggucuucugcuccugcuccuacgacgccaccacccacuucgagaccaccugcaacgacaucaaggacaucuacaagcgcauggccggcaccgccuucgacuucgagaacaugaagcgcaagcagaacgacgucuucggcgaggccgagcaguga

SEQ ID NO: 43577 - RNA, 1203 nt, Artificial Sequence
  derived and/or modified sequence opt2 from GDI2__Homo_sapiens__NP_001108628
augaacgaggaguacgacgucaucguccucggcaccggccucaccgagugcauccucuccggcaucauguccgucaacggcaagaagguccuccacauggaccgcaaccccuacuacggcggcgaguccgccuccaucaccccccucgaggaccucuacaagcgcuucaagauccccggcuccccccccgaguccaugggccgcggccgcgacuggaacgucgaccucauccccaaguuccucauggccaacggccucaugggccucuucgagaagcgccgcuuccgcaaguuccucgucuacgucgccaacuucgacgagaaggacccccgcaccuucgagggcaucgaccccaagaagaccaccaugcgcgacgucuacaagaaguucgaccucggccaggacgucaucgacuucaccggccacgcccucgcccucuaccgcaccgacgacuaccucgaccagcccugcuacgagaccaucaaccgcaucaagcucuacuccgagucccucgcccgcuacggcaagucccccuaccucuacccccucuacggccucggcgagcucccccagggcuucgcccgccucuccgccaucuacggcggcaccuacaugcucaacaagcccaucgaggagaucaucguccagaacggcaaggucaucggcgucaaguccgagggcgagaucgcccgcugcaagcagcucaucugcgaccccuccuacgucaaggaccgcgucgagaaggucggccaggucauccgcgucaucugcauccucucccaccccaucaagaacaccaacgacgccaacuccugccagaucaucaucccccagaaccaggucaaccgcaaguccgacaucuacgucugcaugaucuccuucgcccacaacgucgccgcccagggcaaguacaucgccaucgucuccaccaccgucgagaccaaggagcccgagaaggagauccgccccgcccucgagcuccucgagcccaucgagcagaaguucgucuccaucuccgaccuccucguccccaaggaccucggcaccgagucccagaucuucaucucccgcaccuacgacgccaccacccacuucgagaccaccugcgacgacaucaagaacaucuacaagcgcaugaccggcuccgaguucgacuucgaggagaugaagcgcaagaagaacgacaucuacggcgaggacuga

SEQ ID NO: 43578 - RNA, 687 nt, Artificial Sequence
  derived and/or modified sequence opt2 from GDNF__Homo_sapiens__NP_001177397
augcagucccuccccaacuccaacggcgccgccgccggccgcgacuucaagaugaagcucugggacgucgucgccgucugccucguccuccuccacaccgccuccgccuucccccuccccgccggcaagcgcccccccgaggcccccgccgaggaccgcucccucggccgccgccgcgcccccuucgcccucuccuccgacuccaacaugcccgaggacuaccccgaccaguucgacgacgucauggacuucauccaggccaccaucaagcgccucaagcgcucccccgacaagcagauggccguccucccccgccgcgagcgcaaccgccaggccgccgccgccaaccccgagaacucccgcggcaagggccgccgcggccagcgcggcaagaaccgcggcugcguccucaccgccauccaccucaacgucaccgaccucggccucggcuacgagaccaaggaggagcucaucuuccgcuacugcuccggcuccugcgacgccgccgagaccaccuacgacaagauccucaagaaccucucccgcaaccgccgccucgucuccgacaaggucggccaggccugcugccgccccaucgccuucgacgacgaccucuccuuccucgacgacaaccucgucuaccacauccuccgcaagcacuccgccaagcgcugcggcugcaucuga

SEQ ID NO: 43579 - RNA, 957 nt, Artificial Sequence
  derived and/or modified sequence opt2 from GDPD3__Homo_sapiens__NP_077283
augucccuccuccucuacuacgcccuccccgcccucggcuccuacgccaugcucuccaucuucuuccuccgccgcccccaccuccuccacaccccccgcgcccccaccuuccgcauccgccucggcgcccaccgcggcggcuccggcgagcuccucgagaacaccauggaggccauggagaacuccauggcccagcgcuccgaccuccucgagcucgacugccagcucacccgcgaccgcgucgucgucgucucccacgacgagaaccucugccgccaguccggccucaaccgcgacgucggcucccucgacuucgaggaccucccccucuacaaggagaagcucgaggucuacuucucccccggccacuucgcccacggcuccgaccgccgcaugguccgccucgaggaccucuuccagcgcuucccccgcacccccauguccgucgagaucaagggcaagaacgaggagcucauccgcgagaucgccggccucguccgccgcuacgaccgcaacgagaucaccaucugggccuccgagaaguccuccgucaugaagaagugcaaggccgccaaccccgagaugccccucuccuucaccaucucccgcggcuucuggguccuccucuccuacuaccucggccuccuccccuucauccccauccccgagaaguucuucuucugcuuccuccccaacaucaucaaccgcaccuacuuccccuucuccugcuccugccucaaccagcuccucgccgucgucuccaaguggcucaucaugcgcaagucccucauccgccaccucgaggagcgcggcguccaggucgucuucuggugccucaacgaggaguccgacuucgaggccgccuucuccgucggcgccaccggcgucaucaccgacuaccccaccgcccuccgccacuaccucgacaaccacggccccgccgcccgcaccuccuga

SEQ ID NO: 43580 - RNA, 1818 nt, Artificial Sequence
  derived and/or modified sequence opt2 from GDPD5__Homo_sapiens__NP_110419
augguccgccaccagccccuccaguacuacgagccccagcucugccucuccugccucaccggcaucuacggcugccgcuggaagcgcuaccagcgcucccacgacgacaccacccccugggagcgccucugguuccuccuccucaccuucaccuucggccucacccucaccuggcucuacuucuggugggagguccacaacgacuacgacgaguucaacugguaccucuacaaccgcaugggcuacugguccgacuggcccguccccauccucgucaccaccgccgccgccuucgccuacaucgccggccuccucguccucgcccucugccacaucgccgucggccagcagaugaaccuccacuggcuccacaagaucggccucgucgucauccucgccuccaccgucgucgccauguccgccgucgcccagcucugggaggacgagugggagguccuccucaucucccuccagggcaccgcccccuuccuccacgucggcgccgucgccgccgucaccaugcucuccuggaucgucgccggccaguucgcccgcgccgagcgcaccuccucccaggucaccauccucugcaccuucuucaccgucgucuucgcccucuaccucgccccccucaccaucuccucccccugcaucauggagaagaaggaccucggccccaagcccgcccucaucggccaccgcggcgcccccaugcucgcccccgagcacacccucauguccuuccgcaaggcccucgagcagaagcucuacggccuccaggccgacaucaccaucucccucgacggcguccccuuccucaugcacgacaccacccuccgccgcaccaccaacgucgaggaggaguuccccgagcucgcccgccgccccgccuccaugcucaacuggaccacccuccagcgccucaacgccggccagugguuccucaagaccgaccccuucuggaccgccuccucccucucccccuccgaccaccgcgaggcccagaaccaguccaucugcucccucgccgagcuccucgagcucgccaagggcaacgccacccuccuccucaaccuccgcgaccccccccgcgagcaccccuaccgcuccuccuucaucaacgucacccucgaggccguccuccacuccggcuucccccagcaccaggucauguggcuccccucccgccagcgcccccucguccgcaaggucgcccccggcuuccagcagaccuccggcuccaaggaggccgucgccucccuccgccgcggccacauccagcgccucaaccuccgcuacacccaggucucccgccaggagcuccgcgacuacgccuccuggaaccucuccgucaaccucuacaccgucaacgcccccuggcucuucucccuccucuggugcgccggcguccccuccgucaccuccgacaacucccacgcccucucccagguccccuccccccucuggaucaugccccccgacgaguacugccucaugugggucaccgccgaccucgucuccuucacccucaucgucggcaucuucguccuccagaaguggcgccucggcggcauccgcuccuacaaccccgagcagaucaugcucuccgccgccguccgccgcaccucccgcgacgucuccaucaugaaggagaagcucaucuucuccgagaucuccgacggcgucgaggucuccgacguccucuccgucugcuccgacaacuccuacgacaccuacgccaacuccaccgccacccccgucggcccccgcggcggcggcucccacaccaagacccucaucgagcgcuccggccgcuga

SEQ ID NO: 43581 - RNA, 891 nt, Artificial Sequence
  derived and/or modified sequence opt2 from GEM__Homo_sapiens__NP_859053
augacccucaacaacgucaccaugcgccagggcaccgucggcaugcagccccagcagcagcgcugguccauccccgccgacggccgccaccucaugguccagaaggagccccaccaguacucccaccgcaaccgccacuccgccacccccgaggaccacugccgccgcuccugguccuccgacuccaccgacuccgucaucuccuccgaguccggcaacaccuacuaccgcgucguccucaucggcgagcagggcgucggcaaguccacccucgccaacaucuucgccggcguccacgacuccauggacuccgacugcgagguccucggcgaggacaccuacgagcgcacccucauggucgacggcgaguccgccaccaucauccuccucgacaugugggagaacaagggcgagaacgaguggcuccacgaccacugcaugcaggucggcgacgccuaccucaucgucuacuccaucaccgaccgcgccuccuucgagaaggccuccgagcuccgcauccagcuccgccgcgcccgccagaccgaggacauccccaucauccucgucggcaacaaguccgaccucguccgcugccgcgaggucuccgucuccgagggccgcgccugcgccgucgucuucgacugcaaguucaucgagaccuccgccgccguccagcacaacgucaaggagcucuucgagggcaucguccgccagguccgccuccgccgcgacuccaaggagaagaacgagcgccgccucgccuaccagaagcgcaaggaguccaugccccgcaaggcccgccgcuucuggggcaagaucgucgccaagaacaacaagaacauggccuucaagcucaaguccaaguccugccacgaccucuccguccucuga

SEQ ID NO: 43582 - RNA, 798 nt, Artificial Sequence
  derived and/or modified sequence opt2 from GEMIN2__Homo_sapiens__NP_001009182
augcgccgcgccgagcucgccggccucaagaccauggccuggguccccgccgaguccgccgucgaggagcucaugccccgccuccuccccgucgagcccugcgaccucaccgagggcuucgaccccuccguccccccccgcaccccccaggaguaccuccgccgcguccagaucgaggccgcccagugccccgacgucgucgucgcccagaucgaccccaagaagcucaagcgcaagcaguccgucaacaucucccucuccggcugccagcccgcccccgagggcuacucccccacccuccaguggcagcagcagcaggucgcccaguucuccaccguccgccagaacgucaacaagcaccgcucccacuggaagucccagcagcucgacuccaacgucaccaugcccaaguccgaggacgaggagggcuggaagaaguucugccucggcgagaagcucugcgccgacggcgccgucggccccgccaccaacgagucccccggcaucgacuacguccaggccaccgucaccuccguccucgaguaccucuccaacugguucggcgagcgcgacuucacccccgagcucggccgcuggcucuacgcccuccucgccugccucgagaagccccuccuccccgaggcccacucccucauccgccagcucgcccgccgcugcuccgagguccgccuccucgucgacuccaaggacgacgagcgcguccccgcccucaaccuccucaucugccucgucucccgcuacuucgaccagcgcgaccucgccgacgagcccuccuga

SEQ ID NO: 43583 - RNA, 3177 nt, Artificial Sequence
  derived and/or modified sequence opt2 from GEMIN4__Homo_sapiens__NP_056536
auggaccucggcccccucaacaucugcgaggagaugaccauccuccacggcggcuuccuccucgccgagcagcucuuccaccccaaggcccucgccgagcucaccaaguccgacugggagcgcgucggccgccccaucgucgaggcccuccgcgagaucuccuccgccgccgcccacucccagcccuucgccuggaagaagaaggcccucaucaucaucugggccaagguccuccagccccaccccgucacccccuccgacaccgagacccgcuggcaggaggaccucuucuucuccgucggcaacaugauccccaccaucaaccacaccauccucuucgagcuccucaagucccucgaggccuccggccucuucauccagcuccucauggcccuccccaccaccaucugccacgccgagcucgagcgcuuccucgagcacgucaccgucgacaccuccgccgaggacgucgccuucuuccucgacgucuggugggaggucaugaagcacaagggccacccccaggacccccuccucucccaguucuccgccauggcccacaaguaccuccccgcccucgacgaguucccccacccccccaagcgccuccgcuccgaccccgacgccugccccaccaugccccuccucgccaugcuccuccgcggccucacccagauccagucccgcauccucggccccggccgcaagugcugcgcccucgccaaccucgccgacaugcucaccgucuucgcccucaccgaggacgacccccaggaggucuccgccaccgucuaccucgacaagcucgccaccgucaucuccgucuggaacuccgacacccagaaccccuaccaccagcaggcccucgccgagaaggucaaggaggccgagcgcgacgucucccucaccucccucgccaagcuccccuccgagaccaucuucgucggcugcgaguuccuccaccaccuccuccgcgaguggggcgaggagcuccaggccguccuccgcuccucccagggcaccuccuacgacuccuaccgccucugcgacucccucaccuccuucucccagaacgccacccucuaccucaaccgcaccucccucuccaaggaggaccgccaggucgucuccgagcucgccgagugcguccgcgacuuccuccgcaagaccuccaccguccucaagaaccgcgcccucgaggacaucaccgccuccaucgccauggccgucauccagcagaagauggaccgccacauggaggucugcuacaucuucgccuccgagaagaagugggccuucuccgacgagugggucgccugccucggcuccaaccgcgcccucuuccgccagcccgaccucguccuccgccuccucgagaccgucaucgacgucuccaccgccgaccgcgccauccccgagucccagauccgccaggucauccaccucauccucgagugcuacgccgaccucucccuccccggcaagaacaagguccucgccggcauccuccgcuccuggggccgcaagggccucuccgagaagcuccucgccuacgucgagggcuuccaggaggaccucaacaccaccuucaaccagcucacccaguccgccuccgagcagggccucgccaaggccgucgccuccgucgcccgccucgucaucguccaccccgaggucaccgucaagaagaugugcucccucgccgucgucaaccucggcacccacaaguuccucgcccagauccucaccgccuuccccgcccuccgcuucgucgaggagcagggccccaacuccuccgccaccuucauggucuccugccucaaggagaccgucuggaugaaguucuccacccccaaggaggagaagcaguuccucgagcuccucaacugccucaugucccccgucaagccccagggcauccccgucgccgcccuccucgagcccgacgagguccucaaggaguucguccuccccuuccuccgccucgacgucgaggaggucgaccucucccuccgcaucuucauccagacccucgaggccaacgccugccgcgaggaguacuggcuccagaccugcucccccuucccccuccucuucucccucugccagcuccucgaccgcuucuccaaguacuggcagcuccccaaggagaagcgcugccucucccucgaccgcaaggaccucgccauccacauccucgagcuccucugcgagaucgucuccgccaacgccgagaccuucucccccgacgucuggaucaagucccucuccuggcuccaccgcaagcucgagcagcucgacuggaccgucggccuccgccucaaguccuucuucgagggccacuucaagugcgagguccccgccacccucuucgagaucugcaagcucuccgaggacgaguggaccucccaggcccaccccggcuacggcgccggcaccggccuccucgccuggauggagugcugcugcgucuccuccggcaucuccgagcgcaugcucucccuccucgucgucgacgucggcaaccccgaggagguccgccucuucuccaagggcuuccucgucgcccucguccaggucaugcccuggugcuccccccaggaguggcagcgccuccaccagcucacccgccgccuccucgagaagcagcuccuccacguccccuacucccucgaguacauccaguucgucccccuccucaaccucaagcccuucgcccaggagcuccagcucuccguccucuuccuccgcaccuuccaguuccucugcucccacuccugccgcgacuggcucccccucgagggcuggaaccacgucgucaagcuccucugcggcucccucacccgccuccucgacuccguccgcgccauccaggccgccggccccuggguccagggccccgagcaggaccucacccaggaggcccucuucgucuacacccaggucuucugccacgcccuccacaucauggccaugcuccaccccgaggucugcgagccccucuacguccucgcccucgagacccucaccugcuacgagacccucuccaagaccaaccccuccgucuccucccuccuccagcgcgcccacgagcagcgcuuccucaaguccaucgccgagggcaucggccccgaggagcgccgccagacccuccuccagaagauguccuccuucuga

SEQ ID NO: 43584 - RNA, 504 nt, Artificial Sequence
  derived and/or modified sequence opt2 from GEMIN6__Homo_sapiens__NP_079051
auguccgaguggaugaagaagggcccccucgaguggcaggacuacaucuacaaggagguccgcgucaccgccuccgagaagaacgaguacaagggcuggguccucaccaccgaccccgucuccgccaacaucguccucgucaacuuccucgaggacggcuccauguccgucaccggcaucaugggccacgccguccagaccgucgagaccaugaacgagggcgaccaccgcguccgcgagaagcucaugcaccucuucaccuccggcgacugcaaggccuacucccccgaggaccucgaggagcgcaagaacucccucaagaaguggcucgagaagaaccacauccccaucaccgagcagggcgacgccccccgcacccucugcgucgccggcguccucaccaucgacccccccuacggccccgagaacugcuccuccuccaacgagaucauccucucccgcguccaggaccucaucgagggccaccucaccgccucccaguga

SEQ ID NO: 43585 - RNA, 2727 nt, Artificial Sequence
  derived and/or modified sequence opt2 from GEN1__Homo_sapiens__NP_872431
augggcgucaacgaccucuggcagauccucgagcccgucaagcagcacaucccccuccgcaaccucggcggcaagaccaucgccgucgaccucucccucugggucugcgaggcccagaccgucaagaagaugaugggcuccgucaugaagccccaccuccgcaaccucuucuuccgcaucuccuaccucacccagauggacgucaagcucgucuucgucauggagggcgagccccccaagcucaaggccgacgucaucuccaagcgcaaccagucccgcuacggcuccuccggcaaguccuggucccagaagaccggccgcucccacuucaaguccguccuccgcgagugccuccacaugcucgagugccucggcauccccuggguccaggccgccggcgaggccgaggccaugugcgccuaccucaacgccggcggccacgucgacggcugccucaccaacgacggcgacaccuuccucuacggcgcccagaccgucuaccgcaacuucaccaugaacaccaaggacccccacgucgacugcuacaccauguccuccaucaaguccaagcucggccucgaccgcgacgcccucgucggccucgccauccuccucggcugcgacuaccuccccaagggcguccccggcgucggcaaggagcaggcccucaagcucauccagauccucaagggccagucccuccuccagcgcuucaaccgcuggaacgagaccuccugcaacuccuccccccagcuccucgucaccaagaagcucgcccacugcuccgucugcucccaccccggcucccccaaggaccacgagcgcaacggcugccgccucugcaaguccgacaaguacugcgagccccacgacuacgaguacugcugccccugcgaguggcaccgcaccgagcacgaccgccagcucaacgaggucgagaacaacaucaagaagaaggccugcugcugcgagggcuuccccuuccacgaggucauccaggaguuccuccucaacaaggacaagcucgucaaggucauccgcuaccagcgccccgaccuccuccucuuccagcgcuucacccucgagaagauggaguggcccaaccacuacgccugcgagaagcuccucguccuccucacccacuacgacaugaucgagcgcaagcucggcucccgcaacuccaaccagcuccagcccauccgcaucgucaagacccgcauccgcaacggcguccacugcuucgagaucgagugggagaagcccgagcacuacgccauggaggacaagcagcacggcgaguucgcccuccucaccaucgaggaggagucccucuucgaggccgccuaccccgagaucgucgccgucuaccagaagcagaagcucgagaucaagggcaagaagcagaagcgcaucaagcccaaggagaacaaccuccccgagcccgacgaggucauguccuuccagucccacaugacccucaagcccaccugcgagaucuuccacaagcagaacuccaagcucaacuccggcaucucccccgaccccacccucccccaggaguccaucuccgccucccucaacucccuccuccuccccaagaacacccccugccucaacgcccaggagcaguucauguccucccuccgcccccucgccauccagcagaucaaggccgucuccaagucccucaucuccgaguccucccagcccaacaccuccucccacaacaucuccgucaucgccgaccuccaccucuccaccaucgacugggagggcaccuccuucuccaacucccccgccauccagcgcaacaccuucucccacgaccucaaguccgaggucgaguccgagcucuccgccauccccgacggcuucgagaacauccccgagcagcucuccugcgaguccgagcgcuacaccgccaacaucaagaagguccucgacgaggacuccgacggcaucucccccgaggagcaccuccucuccggcaucaccgaccucugccuccaggaccucccccucaaggagcgcaucuucaccaagcucuccuacccccaggacaaccuccagcccgacgucaaccucaagacccucuccauccucuccgucaaggaguccugcaucgccaacuccggcuccgacugcaccucccaccucuccaaggaccuccccggcaucccccuccagaacgagucccgcgacuccaagauccucaagggcgaccagcuccuccaggaggacuacaaggucaacaccuccguccccuacuccgucuccaacaccgucgucaagaccugcaacguccgcccccccaacaccgcccucgaccacucccgcaaggucgacaugcagaccacccgcaagauccucaugaagaaguccgucugccucgaccgccacuccuccgacgagcaguccgcccccgucuucggcaaggccaaguacaccacccagcgcaugaagcacuccucccagaagcacaacuccucccacuucaaggaguccggccacaacaagcucuccucccccaagauccacaucaaggagaccgagcagugcguccgcuccuacgagaccgccgagaacgaggaguccugcuuccccgacuccaccaaguccucccucuccucccuccagugccacaagaaggagaacaacuccggcaccugccucgacuccccccucccccuccgccagcgccucaagcuccgcuuccaguccaccuga

SEQ ID NO: 43586 - RNA, 984 nt, Artificial Sequence
  derived and/or modified sequence opt2 from GET4__Homo_sapiens__NP_057033
auggccgccgccgccgccauggccgagcaggaguccgcccgcaacggcggccgcaaccgcggcggcguccagcgcgucgagggcaagcuccgcgccuccgucgagaagggcgacuacuacgaggcccaccagauguaccgcacccucuucuuccgcuacaugucccaguccaagcacaccgaggcccgcgagcucauguacuccggcgcccuccucuucuucucccacggccagcagaacuccgccgccgaccucuccaugcucguccucgagucccucgagaaggccgaggucgaggucgccgacgagcuccucgagaaccucgccaaggucuucucccucauggaccccaacucccccgagcgcgucaccuucgucucccgcgcccucaagugguccuccggcggcuccggcaagcucggccacccccgccuccaccagcuccucgcccucacccucuggaaggagcagaacuacugcgagucccgcuaccacuuccuccacuccgccgacggcgagggcugcgccaacaugcucgucgaguacuccaccucccgcggcuuccgcuccgaggucgacauguucgucgcccaggccguccuccaguuccucugccucaagaacaaguccuccgccuccgucgucuucaccaccuacacccagaagcaccccuccaucgaggacggcccccccuucgucgagccccuccucaacuucaucugguuccuccuccucgccgucgacggcggcaagcucaccgucuucaccguccucugcgagcaguaccagcccucccuccgccgcgaccccauguacaacgaguaccucgaccgcaucggccagcucuucuucggcgucccccccaagcagaccuccuccuacggcggccuccucggcaaccuccucaccucccucaugggcuccuccgagcaggaggacggcgaggagucccccuccgacggcucccccaucgagcucgacuga

SEQ ID NO: 43587 - RNA, 1296 nt, Artificial Sequence
  derived and/or modified sequence opt2 from GFAP__Homo_sapiens__NP_001124491
auggagcgccgccgcaucaccuccgccgcccgccgcuccuacgucuccuccggcgagaugauggucggcggccucgcccccggccgccgccucggccccggcacccgccucucccucgcccgcaugccccccccccuccccacccgcgucgacuucucccucgccggcgcccucaacgccggcuucaaggagacccgcgccuccgagcgcgccgagaugauggagcucaacgaccgcuucgccuccuacaucgagaagguccgcuuccucgagcagcagaacaaggcccucgccgccgagcucaaccagcuccgcgccaaggagcccaccaagcucgccgacgucuaccaggccgagcuccgcgagcuccgccuccgccucgaccagcucaccgccaacuccgcccgccucgaggucgagcgcgacaaccucgcccaggaccucgccaccguccgccagaagcuccaggacgagaccaaccuccgccucgaggccgagaacaaccucgccgccuaccgccaggaggccgacgaggccacccucgcccgccucgaccucgagcgcaagaucgagucccucgaggaggagauccgcuuccuccgcaagauccacgaggaggagguccgcgagcuccaggagcagcucgcccgccagcagguccacgucgagcucgacgucgccaagcccgaccucaccgccgcccucaaggagauccgcacccaguacgaggccauggccuccuccaacaugcacgaggccgaggagugguaccgcuccaaguucgccgaccucaccgacgccgccgcccgcaacgccgagcuccuccgccaggccaagcacgaggccaacgacuaccgccgccagcuccagucccucaccugcgaccucgagucccuccgcggcaccaacgagucccucgagcgccagaugcgcgagcaggaggagcgccacguccgcgaggccgccuccuaccaggaggcccucgcccgccucgaggaggagggccagucccucaaggacgagauggcccgccaccuccaggaguaccaggaccuccucaacgucaagcucgcccucgacaucgagaucgccaccuaccgcaagcuccucgagggcgaggagaaccgcaucaccauccccguccagaccuucuccaaccuccagauccgcggcggcaaguccaccaaggacggcgagaaccacaaggucacccgcuaccucaagucccucaccauccgcgucauccccauccaggcccaccagaucgucaacggcaccccccccgcccgcggcuga

SEQ ID NO: 43588 - RNA, 618 nt, Artificial Sequence
  derived and/or modified sequence opt2 from GFER__Homo_sapiens__NP_005253
auggccgcccccggcgagcgcggccgcuuccacggcggcaaccucuucuuccuccccggcggcgcccgcuccgagaugauggacgaccucgccaccgacgcccgcggccgcggcgccggccgccgcgacgccgccgccuccgccuccacccccgcccaggcccccaccuccgacucccccgucgccgaggacgccucccgccgccgccccugccgcgccugcgucgacuucaagaccuggaugcgcacccagcagaagcgcgacaccaaguuccgcgaggacugcccccccgaccgcgaggagcucggccgccacuccugggccguccuccacacccucgccgccuacuaccccgaccuccccacccccgagcagcagcaggacauggcccaguucauccaccucuucuccaaguucuaccccugcgaggagugcgccgaggaccuccgcaagcgccucugccgcaaccaccccgacacccgcacccgcgccugcuucacccaguggcucugccaccuccacaacgaggucaaccgcaagcucggcaagcccgacuucgacugcuccaaggucgacgagcgcuggcgcgacggcuggaaggacggcuccugcgacuga

SEQ ID NO: 43589 - RNA, 855 nt, Artificial Sequence
  derived and/or modified sequence opt2 from GFI1B__Homo_sapiens__NP_001128503
augccccgcuccuuccucgucaaguccaagaaggcccacaccuaccaccagccccgcguccaggaggacgagccccucuggccccccgcccucacccccgucccccgcgaccaggcccccuccaacucccccguccucuccacccucuuccccaaccagugccucgacuggaccaaccucaagcgcgagcccgagcucgagcaggaccagaaccucgcccgcauggcccccgcccccgagggccccaucguccucucccgcccccaggacggcgacuccccccucuccgacuccccccccuucuacaagcccuccuucuccugggacacccucgccaccaccuacggccacuccuaccgccaggcccccuccaccaugcaguccgccuuccucgagcacuccgucucccucuacggcuccccccucguccccuccaccgagcccgcccucgacuucucccuccgcuacucccccggcauggacgccuaccacugcgucaagugcaacaaggagcgcuccuucgagugccgcaugugcggcaaggccuucaagcgcuccuccacccucuccacccaccuccucauccacuccgacacccgccccuaccccugccaguucugcggcaagcgcuuccaccagaaguccgacaugaagaagcacaccuacauccacaccggcgagaagccccacaagugccaggucugcggcaaggccuucucccaguccuccaaccucaucacccacucccgcaagcacaccggcuucaagcccuucuccugcgagcucugcaccaagggcuuccagcgcaaggucgaccuccgccgccaccgcgagucccagcacaaccucaaguga

SEQ ID NO: 43590 - RNA, 1269 nt, Artificial Sequence
  derived and/or modified sequence opt2 from GFI1__Homo_sapiens__XP_011539548
augccccgcuccuuccucgucaaguccaagaaggcccacuccuaccaccagccccgcucccccggccccgacuacucccuccgccucgagaacguccccgcccccucccgcgccgacuccaccuccaacgccggcggcgccaaggccgagccccgcgaccgccucucccccgagucccagcucaccgaggcccccgaccgcgccuccgccucccccgacuccugcgagggcuccgucugcgagcgcuccuccgaguucgaggacuucuggcgcccccccucccccuccgccucccccgccuccgagaaguccaugugccccucccucgacgaggcccagcccuucccccuccccuucaagcccuacuccugguccggccucgccggcuccgaccuccgccaccucguccaguccuaccgccccugcggcgcccucgagcgcggcgccggccucggccucuucugcgagcccgcccccgagcccggccaccccgccgcccucuacggccccaagcgcgccgccggcggcgccggcgccggcgcccccggcuccugcuccgccggcgccggcgccaccgccggccccggccucggccucuacggcgacuucggcuccgccgccgccggccucuacgagcgccccaccgccgccgccggccuccucuaccccgagcgcggccacggccuccacgccgacaagggcgccggcgucaaggucgaguccgagcuccucugcacccgccuccuccucggcggcggcuccuacaagugcaucaagugcuccaaggucuucuccaccccccacggccucgagguccacguccgccgcucccacuccggcacccgccccuucgccugcgagaugugcggcaagaccuucggccacgccgucucccucgagcagcacaaggccguccacucccaggagcgcuccuucgacugcaagaucugcggcaaguccuucaagcgcuccuccacccucuccacccaccuccucauccacuccgacacccgccccuaccccugccaguacugcggcaagcgcuuccaccagaaguccgacaugaagaagcacaccuucauccacaccggcgagaagccccacaagugccaggucugcggcaaggccuucucccaguccuccaaccucaucacccacucccgcaagcacaccggcuucaagcccuucggcugcgaccucugcggcaagggcuuccagcgcaaggucgaccuccgccgccaccgcgagacccagcacggccucaaguga

SEQ ID NO: 43591 - RNA, 2256 nt, Artificial Sequence
  derived and/or modified sequence opt2 from GFM1__Homo_sapiens__NP_079272
augcgccuccucggcgccgccgccgucgccgcccucggccgcggccgcgcccccgccucccucggcuggcagcgcaagcaggucaacuggaaggccugccgcugguccuccuccggcgucauccccaacgagaagauccgcaacaucggcaucuccgcccacaucgacuccggcaagaccacccucaccgagcgcguccucuacuacaccggccgcaucgccaagaugcacgaggucaagggcaaggacggcgucggcgccgucauggacuccauggagcucgagcgccagcgcggcaucaccauccaguccgccgccaccuacaccauguggaaggacgucaacaucaacaucaucgacacccccggccacgucgacuucaccaucgaggucgagcgcgcccuccgcguccucgacggcgccguccucguccucugcgccgucggcggcguccagugccagaccaugaccgucaaccgccagaugaagcgcuacaacguccccuuccucaccuucaucaacaagcucgaccgcaugggcuccaaccccgcccgcgcccuccagcagaugcgcuccaagcucaaccacaacgccgccuucaugcagauccccaugggccucgagggcaacuucaagggcaucgucgaccucaucgaggagcgcgccaucuacuucgacggcgacuucggccagaucguccgcuacggcgagauccccgccgagcuccgcgccgccgccaccgaccaccgccaggagcucaucgagugcgucgccaacuccgacgagcagcucggcgagauguuccucgaggagaagauccccuccaucuccgaccucaagcucgccauccgccgcgccacccucaagcgcuccuucacccccgucuuccucggcuccgcccucaagaacaagggcguccagccccuccucgacgccguccucgaguaccuccccaaccccuccgagguccagaacuacgccauccucaacaaggaggacgacuccaaggagaagaccaagauccucaugaacuccucccgcgacaacucccaccccuucgucggccucgccuucaagcucgaggucggccgcuucggccagcucaccuacguccgcuccuaccagggcgagcucaagaagggcgacaccaucuacaacacccgcacccgcaagaagguccgccuccagcgccucgcccgcaugcacgccgacaugauggaggacgucgaggaggucuacgccggcgacaucugcgcccucuucggcaucgacugcgccuccggcgacaccuucaccgacaaggccaacuccggccucuccauggaguccauccacguccccgaccccgucaucuccaucgccaugaagcccuccaacaagaacgaccucgagaaguucuccaagggcaucggccgcuucacccgcgaggaccccaccuucaaggucuacuucgacaccgagaacaaggagaccgucaucuccggcaugggcgagcuccaccucgagaucuacgcccagcgccucgagcgcgaguacggcugccccugcaucaccggcaagcccaaggucgccuuccgcgagaccaucaccgcccccguccccuucgacuucacccacaagaagcaguccggcggcgccggccaguacggcaaggucaucggcguccucgagccccucgaccccgaggacuacaccaagcucgaguucuccgacgagaccuucggcuccaacauccccaagcaguucguccccgccgucgagaagggcuuccucgacgccugcgagaagggcccccucuccggccacaagcucuccggccuccgcuucguccuccaggacggcgcccaccacauggucgacuccaacgagaucuccuucauccgcgccggcgagggcgcccucaagcaggcccucgccaacgccacccucugcauccucgagcccaucauggccgucgaggucgucgcccccaacgaguuccagggccaggucaucgccggcaucaaccgccgccacggcgucaucaccggccaggacggcgucgaggacuacuucacccucuacgccgacgucccccucaacgacauguucggcuacuccaccgagcuccgcuccugcaccgagggcaagggcgaguacaccauggaguacucccgcuaccagcccugccuccccuccacccaggaggacgucaucaacaaguaccucgaggccaccggccagcuccccgucaagaagggcaaggccaagaacuga

SEQ ID NO: 43592 - RNA, 2100 nt, Artificial Sequence
  derived and/or modified sequence opt2 from GFPT1__Homo_sapiens__NP_001231639
augugcggcaucuucgccuaccucaacuaccacgucccccgcacccgccgcgagauccucgagacccucaucaagggccuccagcgccucgaguaccgcggcuacgacuccgccggcgucggcuucgacggcggcaacgacaaggacugggaggccaacgccugcaagauccagcucaucaagaagaagggcaaggucaaggcccucgacgaggagguccacaagcagcaggacauggaccucgacaucgaguucgacguccaccucggcaucgcccacacccgcugggccacccacggcgagcccucccccgucaacucccacccccagcgcuccgacaagaacaacgaguucaucgucauccacaacggcaucaucaccaacuacaaggaccucaagaaguuccucgaguccaagggcuacgacuucgaguccgagaccgacaccgagaccaucgccaagcucgucaaguacauguacgacaaccgcgagucccaggacaccuccuucaccacccucgucgagcgcgucauccagcagcucgagggcgccuucgcccucgucuucaaguccguccacuuccccggccaggccgucggcacccgccgcggcuccccccuccucaucggcguccgcuccgagcacaagcucuccaccgaccacauccccauccucuaccgcaccgcccgcacccagaucggcuccaaguucacccgcuggggcucccagggcgagcgcggcaaggacaagaagggcuccugcaaccucucccgcgucgacuccaccaccugccucuuccccgucgaggagaaggccgucgaguacuacuucgccuccgacgccuccgccgucaucgagcacaccaaccgcgucaucuuccucgaggacgacgacgucgccgccgucgucgacggccgccucuccauccaccgcaucaagcgcaccgccggcgaccaccccggccgcgccguccagacccuccagauggagcuccagcagaucaugaagggcaacuucuccuccuucaugcagaaggagaucuucgagcagcccgaguccgucgucaacaccaugcgcggccgcgucaacuucgacgacuacaccgucaaccucggcggccucaaggaccacaucaaggagauccagcgcugccgccgccucauccucaucgccugcggcaccuccuaccacgccggcgucgccacccgccagguccucgaggagcucaccgagcuccccgucauggucgagcucgccuccgacuuccucgaccgcaacacccccgucuuccgcgacgacgucugcuucuuccucucccaguccggcgagaccgccgacacccucaugggccuccgcuacugcaaggagcgcggcgcccucaccgucggcaucaccaacaccgucggcuccuccaucucccgcgagaccgacugcggcguccacaucaacgccggccccgagaucggcgucgccuccaccaaggccuacaccucccaguucgucucccucgucauguucgcccucaugaugugcgacgaccgcaucuccaugcaggagcgccgcaaggagaucaugcucggccucaagcgccuccccgaccucaucaaggagguccucuccauggacgacgagauccagaagcucgccaccgagcucuaccaccagaaguccguccucaucaugggccgcggcuaccacuacgccaccugccucgagggcgcccucaagaucaaggagaucaccuacaugcacuccgagggcauccucgccggcgagcucaagcacggcccccucgcccucgucgacaagcucaugcccgucaucaugaucaucaugcgcgaccacaccuacgccaagugccagaacgcccuccagcaggucgucgcccgccagggccgccccgucgucaucugcgacaaggaggacaccgagaccaucaagaacaccaagcgcaccaucaaggucccccacuccgucgacugccuccagggcauccucuccgucaucccccuccagcuccucgccuuccaccucgccguccuccgcggcuacgacgucgacuucccccgcaaccucgccaaguccgucaccgucgaguga

SEQ ID NO: 43593 - RNA, 2049 nt, Artificial Sequence
  derived and/or modified sequence opt2 from GFPT2__Homo_sapiens__NP_005101
augugcggcaucuucgccuacaugaacuaccgcgucccccgcacccgcaaggagaucuucgagacccucaucaagggccuccagcgccucgaguaccgcggcuacgacuccgccggcgucgccaucgacggcaacaaccacgaggucaaggagcgccacauccagcucgucaagaagcgcggcaaggucaaggcccucgacgaggagcucuacaagcaggacuccauggaccucaaggucgaguucgagacccacuucggcaucgcccacacccgcugggccacccacggcguccccuccgccgucaacucccacccccagcgcuccgacaagggcaacgaguucgucgucauccacaacggcaucaucaccaacuacaaggaccuccgcaaguuccucgaguccaagggcuacgaguucgaguccgagaccgacaccgagaccaucgccaagcucaucaaguacgucuucgacaaccgcgagaccgaggacaucaccuucuccacccucgucgagcgcgucauccagcagcucgagggcgccuucgcccucgucuucaaguccguccacuaccccggcgaggccgucgccacccgccgcggcuccccccuccucaucggcguccgcuccaaguacaagcucuccaccgagcagauccccauccucuaccgcaccugcacccucgagaacgucaagaacaucugcaagacccgcaugaagcgccucgacuccuccgccugccuccacgccgucggcgacaaggccgucgaguucuucuucgccuccgacgccuccgccaucaucgagcacaccaaccgcgucaucuuccucgaggacgacgacaucgccgccgucgccgacggcaagcucuccauccaccgcgucaagcgcuccgccuccgacgaccccucccgcgccauccagacccuccagauggagcuccagcagaucaugaagggcaacuucuccgccuucaugcagaaggagaucuucgagcagcccgaguccgucuucaacaccaugcgcggccgcgucaacuucgagaccaacaccguccuccucggcggccucaaggaccaccucaaggagauccgccgcugccgccgccucaucgucaucggcugcggcaccuccuaccacgccgccgucgccacccgccagguccucgaggagcucaccgagcuccccgucauggucgagcucgccuccgacuuccucgaccgcaacacccccgucuuccgcgacgacgucugcuucuucaucucccaguccggcgagaccgccgacacccuccucgcccuccgcuacugcaaggaccgcggcgcccucaccgucggcgucaccaacaccgucggcuccuccaucucccgcgagaccgacugcggcguccacaucaacgccggccccgagaucggcgucgccuccaccaaggccuacaccucccaguucaucucccucgucauguucggccucaugauguccgaggaccgcaucucccuccagaaccgccgccaggagaucauccgcggccuccgcucccuccccgagcucaucaaggagguccucucccucgaggagaagauccacgaccucgcccucgagcucuacacccagcgcucccuccucgucaugggccgcggcuacaacuacgccaccugccucgagggcgcccucaagaucaaggagaucaccuacaugcacuccgagggcauccucgccggcgagcucaagcacggcccccucgcccucaucgacaagcagaugcccgucaucauggucaucaugaaggaccccugcuucgccaagugccagaacgcccuccagcaggucaccgcccgccagggccgccccaucauccucugcuccaaggacgacaccgaguccuccaaguucgccuacaagaccaucgagcucccccacaccgucgacugccuccagggcauccucuccgucaucccccuccagcuccucuccuuccaccucgccguccuccgcggcuacgacgucgacuucccccgcaaccucgccaaguccgucaccgucgaguga

SEQ ID NO: 43594 - RNA, 1383 nt, Artificial Sequence
  derived and/or modified sequence opt2 from GFRA1__Homo_sapiens__NP_001138925
auguuccucgccacccucuacuucgcccucccccuccucgaccuccuccucuccgccgaggucuccggcggcgaccgccucgacugcgucaaggccuccgaccagugccucaaggagcaguccugcuccaccaaguaccgcacccuccgccagugcgucgccggcaaggagaccaacuucucccucgccuccggccucgaggccaaggacgagugccgcuccgccauggaggcccucaagcagaagucccucuacaacugccgcugcaagcgcggcaugaagaaggagaagaacugccuccgcaucuacugguccauguaccagucccuccagggcaacgaccuccucgaggacucccccuacgagcccgucaacucccgccucuccgacaucuuccgcgucguccccuucaucuccgucgagcacauccccaagggcaacaacugccucgacgccgccaaggccugcaaccucgacgacaucugcaagaaguaccgcuccgccuacaucacccccugcaccaccuccgucuccaacgacgucugcaaccgccgcaagugccacaaggcccuccgccaguucuucgacaagguccccgccaagcacuccuacggcaugcucuucugcuccugccgcgacaucgccugcaccgagcgccgccgccagaccaucguccccgucugcuccuacgaggagcgcgagaagcccaacugccucaaccuccaggacuccugcaagaccaacuacaucugccgcucccgccucgccgacuucuucaccaacugccagcccgagucccgcuccgucuccuccugccucaaggagaacuacgccgacugccuccucgccuacuccggccucaucggcaccgucaugacccccaacuacaucgacuccuccucccucuccgucgcccccuggugcgacugcuccaacuccggcaacgaccucgaggagugccucaaguuccucaacuucuucaaggacaacaccugccucaagaacgccauccaggccuucggcaacggcuccgacgucaccgucuggcagcccgccuuccccguccagaccaccaccgccaccaccaccaccgcccuccgcgucaagaacaagccccucggccccgccggcuccgagaacgagauccccacccacguccucccccccugcgccaaccuccaggcccagaagcucaaguccaacgucuccggcaacacccaccucugcaucuccaacggcaacuacgagaaggagggccucggcgccuccucccacaucaccaccaaguccauggccgccccccccuccugcggccucuccccccuccucguccucgucgucaccgcccucuccacccuccucucccucaccgagaccuccuga

SEQ ID NO: 43595 - RNA, 996 nt, Artificial Sequence
  derived and/or modified sequence opt2 from GFRA2__Homo_sapiens__NP_001158511
augauccucgccaacgucuucugccucuucuucuuccucggcaccggcgccgaccccgucgucuccgccaaguccaaccacugccucgacgccgccaaggccugcaaccucaacgacaacugcaagaagcuccgcuccuccuacaucuccaucugcaaccgcgagaucucccccaccgagcgcugcaaccgccgcaagugccacaaggcccuccgccaguucuucgaccgcguccccuccgaguacaccuaccgcaugcucuucugcuccugccaggaccaggccugcgccgagcgccgccgccagaccauccuccccuccugcuccuacgaggacaaggagaagcccaacugccucgaccuccgcggcgucugccgcaccgaccaccucugccgcucccgccucgccgacuuccacgccaacugccgcgccuccuaccagaccgucaccuccugccccgccgacaacuaccaggccugccucggcuccuacgccggcaugaucggcuucgacaugacccccaacuacgucgacuccucccccaccggcaucgucgucucccccuggugcuccugccgcggcuccggcaacauggaggaggagugcgagaaguuccuccgcgacuucaccgagaaccccugccuccgcaacgccauccaggccuucggcaacggcaccgacgucaacgucucccccaagggccccuccuuccaggccacccaggccccccgcgucgagaagacccccucccuccccgacgaccucuccgacuccaccucccucggcaccuccgucaucaccaccugcaccuccguccaggagcagggccucaaggccaacaacuccaaggagcucuccaugugcuucaccgagcucaccaccaacaucauccccggcuccaacaaggucaucaagcccaacuccggccccucccgcgcccgccccuccgccgcccucaccguccucuccguccucaugcucaagcucgcccucuga

SEQ ID NO: 43596 - RNA, 1203 nt, Artificial Sequence
  derived and/or modified sequence opt2 from GFRA3__Homo_sapiens__NP_001487
augguccgcccccucaacccccgcccccucccccccgucguccucaugcuccuccuccuccucccccccuccccccucccccucgccgccggcgacccccuccccaccgagucccgccucaugaacuccugccuccaggcccgccgcaagugccaggccgaccccaccugcuccgccgccuaccaccaccucgacuccugcaccuccuccaucuccaccccccuccccuccgaggagcccuccguccccgccgacugccucgaggccgcccagcagcuccgcaacuccucccucaucggcugcaugugccaccgccgcaugaagaaccaggucgccugccucgacaucuacuggaccguccaccgcgcccgcucccucggcaacuacgagcucgacgucucccccuacgaggacaccgucaccuccaagcccuggaagaugaaccucuccaagcucaacaugcucaagcccgacuccgaccucugccucaaguucgccaugcucugcacccucaacgacaagugcgaccgccuccgcaaggccuacggcgaggccugcuccggcccccacugccagcgccacgucugccuccgccagcuccucaccuucuucgagaaggccgccgagccccacgcccagggccuccuccucugccccugcgcccccaacgaccgcggcugcggcgagcgccgccgcaacaccaucgcccccaacugcgcccucccccccgucgcccccaacugccucgagcuccgccgccucugcuucuccgacccccucugccgcucccgccucgucgacuuccagacccacugccaccccauggacauccucggcaccugcgccaccgagcagucccgcugccuccgcgccuaccucggccucaucggcaccgccaugacccccaacuucgucuccaacgucaacaccuccgucgcccucuccugcaccugccgcggcuccggcaaccuccaggaggagugcgagaugcucgagggcuucuucucccacaaccccugccucaccgaggccaucgccgccaagaugcgcuuccacucccagcucuucucccaggacuggccccaccccaccuucgccgucauggcccaccagaacgagaaccccgccguccgcccccagcccuggguccccucccucuucuccugcacccucccccucauccuccuccucucccucugguga

SEQ ID NO: 43597 - RNA, 810 nt, Artificial Sequence
  derived and/or modified sequence opt2 from GFRA4__Homo_sapiens__NP_071422
augguccgcugccucggccccgcccuccuccuccuccuccuccucggcuccgccuccuccgucggcggcaaccgcugcgucgacgccgccgaggccugcaccgccgacgcccgcugccagcgccuccgcuccgaguacgucgcccagugccucggccgcgccgcccagggcggcugcccccgcgcccgcugccgccgcgcccuccgccgcuucuucgcccgcggcccccccgcccucacccacgcccuccucuucugccccugcgccggccccgccugcgccgagcgccgccgccagaccuucguccccuccugcgccuucuccggccccggccccgccccccccuccugccucgagccccucaacuucugcgagcgcucccgcgucugccgcccccgccuccucgccuuccaggucuccugcacccccgcccccuccgcccccgacggcugccuccucgaccagggcgcccgcugccuccgcgccuacgccggccucgucggcaccgccgucacccccaacuacgucgacaacgucuccgcccgcgucgcccccuggugcgacugcggcgccuccggcaaccgccgcgaggacugcgaggccuuccgcggccucuucacccgcaaccgcugccucgacggcgccauccaggccuucgccuccggcuggccccccguccuccucgaccagcucaacccccagggcgaccccgagcacucccuccuccaggucuccuccaccggccgcgcccucgagcgccgcucccuccucuccauccuccccguccucgcccuccccgcccuccucuga

SEQ ID NO: 43598 - RNA, 1659 nt, Artificial Sequence
  derived and/or modified sequence opt2 from GGA1__Homo_sapiens__NP_001001560
auggagcccgccauggagcccgagacccucgaggcccgcaucaaccgcgccaccaacccccucaacaaggagcucgacugggccuccaucaacggcuucugcgagcagcucaacgaggacuucgagggccccccccucgccacccgccuccucgcccacaagauccaguccccccaggagugggaggccauccaggcccucaccguccucgagaccugcaugaaguccugcggcaagcgcuuccacgacgaggucggcaaguuccgcuuccucaacgagcucaucaaggucgucucccccaaguaccucggcucccgcaccuccgagaaggucaagaacaagauccucgagcuccucuacuccuggaccgucggccuccccgaggaggucaagaucgccgaggccuaccagaugcucaagaagcagggcaucgucaaguccgaccccaagcuccccgacgacaccaccuucccccucccccccccccgccccaagaacgucaucuucgaggacgaggagaaguccaagaugcucgcccgccuccucaaguccucccaccccgaggaccuccgcgccgccaacaagcucaucaaggagaugguccaggaggaccagaagcgcauggagaagaucuccaagcgcgucaacgccaucgaggaggucaacaacaacgucaagcuccucaccgagauggucaugucccacucccagggcggcgccgccgccggcuccuccgaggaccucaugaaggagcucuaccagcgcugcgagcgcaugcgccccacccucuuccgccucgccuccgacaccgaggacaacgacgaggcccucggccucuccgaccccaccccccccuccggccccucccucgacggcaccggcuggaacuccuuccaguccuccgacgccaccgagccccccgcccccgcccucgcccaggcccccuccauggagucccgcccccccgcccagaccucccuccccgccuccuccggccucgacgaccucgaccuccucggcaagacccuccuccagcagucccucccccccgagucccagcagguccgcugggagaagcagcagcccaccccccgccucacccuccgcgaccuccagaacaaguccuccuccugcuccucccccuccuccuccgccaccucccuccuccacaccgucucccccgagcccccccgccccccccagcagcccguccccaccgagcucucccucgccuccaucaccgucccccucgaguccaucaagcccuccaacauccuccccgucaccgucuacgaccagcacggcuuccgcauccucuuccacuucgcccgcgacccccuccccggccgcuccgacguccucgucgucgucgucuccaugcucuccaccgccccccagcccauccgcaacaucgucuuccaguccgccguccccaaggucaugaaggucaagcuccagccccccuccggcaccgagcuccccgccuucaaccccaucguccaccccuccgccaucacccagguccuccuccucgccaacccccagaaggagaagguccgccuccgcuacaagcucaccuucaccaugggcgaccagaccuacaacgagaugggcgacgucgaccaguuccccccccccgagaccuggggcucccucuga

SEQ ID NO: 43599 - RNA, 1779 nt, Artificial Sequence
  derived and/or modified sequence opt2 from GGA3__Homo_sapiens__NP_001166175
auggcccuccccgaggaggccaagaucaaggacgccuaccacaugcucaagcgccagggcaucguccaguccgacccccccauccccgucgaccgcacccucauccccuccccccccccccgccccaagaaccccgucuucgacgacgaggagaaguccaagcuccucgccaagcuccucaaguccaagaaccccgacgaccuccaggaggccaacaagcucaucaaguccauggucaaggaggacgaggcccgcauccagaaggucaccaagcgccuccacacccucgaggaggucaacaacaacguccgccuccucuccgagaugcuccuccacuacucccaggaggacuccuccgacggcgaccgcgagcucaugaaggagcucuucgaccagugcgagaacaagcgccgcacccucuucaagcucgccuccgagaccgaggacaacgacaacucccucggcgacauccuccaggccuccgacaaccucucccgcgucaucaacuccuacaagaccaucaucgagggccaggucaucaacggcgaggucgccacccucacccuccccgacuccgagggcaacucccagugcuccaaccagggcacccucaucgaccucgccgagcucgacaccaccaacucccucuccuccguccucgcccccgcccccaccccccccuccuccggcauccccauccuccccccccccccccaggccuccggccccccccgcucccgcuccuccucccaggccgaggccacccucggccccuccuccaccuccaacgcccucuccuggcucgacgaggagcuccucugccucggccucgccgaccccgcccccaacgucccccccaaggaguccgccggcaacucccaguggcaccuccuccagcgcgagcaguccgaccucgacuucuucuccccccgccccggcaccgccgccugcggcgccuccgacgccccccuccuccagcccuccgcccccuccuccuccuccucccaggccccccuccccccccccuuccccgcccccgucguccccgccuccguccccgcccccuccgccggcuccucccucuucuccaccggcgucgcccccgcccucgcccccaaggucgagcccgccguccccggccaccacggccucgcccucggcaacuccgcccuccaccaccucgacgcccucgaccagcuccucgaggaggccaaggucaccuccggccucgucaagcccaccaccuccccccucauccccaccaccacccccgcccgcccccuccuccccuucuccaccggccccggcuccccccucuuccagccccucuccuuccagucccagggcuccccccccaagggccccgagcucucccucgccuccauccacgucccccucgaguccaucaagcccuccuccgcccuccccgucaccgccuacgacaagaacggcuuccgcauccucuuccacuucgccaaggagugcccccccggccgccccgacguccucgucgucgucgucuccaugcucaacaccgccccccuccccgucaaguccaucguccuccaggccgccguccccaaguccaugaaggucaagcuccagccccccuccggcaccgagcucucccccuucucccccauccagccccccgccgccaucacccaggucaugcuccucgccaacccccucaagaagcagguccucuccuuccucggcaaggccugccuccagcccuggggccaggccauccuccucaccaccuccugccucgccuga

SEQ ID NO: 43600 - RNA, 462 nt, Artificial Sequence
  derived and/or modified sequence opt2 from GGACT__Homo_sapiens__NP_149101
auggcccucgucuucgucuacggcacccucaagcgcggccagcccaaccaccgcguccuccgcgacggcgcccacggcuccgccgccuuccgcgcccgcggccgcacccucgagcccuacccccucgucaucgccggcgagcacaacauccccuggcuccuccaccuccccggcuccggccgccucgucgagggcgaggucuacgccgucgacgagcgcaugcuccgcuuccucgacgacuucgaguccugccccgcccucuaccagcgcaccguccuccgcguccagcuccucgaggaccgcgcccccggcgccgaggagccccccgcccccaccgccguccagugcuucgucuacucccgcgccaccuucccccccgagugggcccagcucccccaccacgacuccuacgacuccgagggcccccacggccuccgcuacaacccccgcgagaaccgcuga

SEQ ID NO: 43601 - RNA, 501 nt, Artificial Sequence
  derived and/or modified sequence opt2 from GGCT__Homo_sapiens__NP_001186744
auggccaacuccggcugcaaggacgucaccggccccgacgaggaguccuuccucuacuucgccuacggcuccaaccuccucaccgagcgcauccaccuccgcaaccccuccgccgccuucuucugcgucgcccgccuccaggacuucaagcucgacuucggcaacucccagggcaagaccucccagaccuggcacggcggcaucgccaccaucuuccagucccccggcgacgaggucuggggcgucgucuggaagaugaacaaguccaaccucaacucccucgacgaguggcgcaagaagcgccacaccgccuuccagaaccagggcaaccaccccugcaagcacaagacccgcaugugggaccgcgaccccaagauccccguccagaaccucucccucgcccucugcuggcaggcccaguccggccacggcaccugcaaccgccucuucgccuggguccagaagaagauggucugccgcugguccaucaagcgcuccuga

SEQ ID NO: 43602 - RNA, 2277 nt, Artificial Sequence
  derived and/or modified sequence opt2 from GGCX__Homo_sapiens__NP_000812
auggccgucuccgccggcuccgcccgcaccucccccuccuccgacaagguccagaaggacaaggccgagcucaucuccggcccccgccaggacucccgcaucggcaagcuccucggcuucgaguggaccgaccucuccuccuggcgccgccucgucacccuccucaaccgccccaccgaccccgccucccucgccgucuuccgcuuccucuucggcuuccucaugguccucgacaucccccaggagcgcggccucuccucccucgaccgcaaguaccucgacggccucgacgucugccgcuucccccuccucgacgcccuccgcccccucccccucgacuggauguaccucgucuacaccaucauguuccucggcgcccucggcaugaugcucggccucugcuaccgcaucuccugcguccucuuccuccuccccuacugguacgucuuccuccucgacaagaccuccuggaacaaccacuccuaccucuacggccuccucgccuuccagcucaccuucauggacgccaaccacuacugguccgucgacggccuccucaacgcccaccgccgcaacgcccacgucccccucuggaacuacgccguccuccgcggccagaucuucaucgucuacuucaucgccggcgucaagaagcucgacgccgacugggucgagggcuacuccauggaguaccucucccgccacuggcucuucucccccuucaagcuccuccucuccgaggagcucaccucccuccucgucguccacuggggcggccuccuccucgaccucuccgccggcuuccuccucuucuucgacgucucccgcuccaucggccucuucuucgucuccuacuuccacugcaugaacucccagcucuucuccaucggcauguucuccuacgucaugcucgccuccuccccccucuucugcucccccgaguggccccgcaagcucgucuccuacugcccccgccgccuccagcagcuccucccccucaaggccgccccccagcccuccgucuccugcgucuacaagcgcucccgcggcaaguccggccagaagcccggccuccgccaccagcucggcgccgccuucacccuccucuaccuccucgagcagcucuuccuccccuacucccacuuccucacccagggcuacaacaacuggaccaacggccucuacggcuacuccugggacaugaugguccacucccgcucccaccagcacgucaagaucaccuaccgcgacggccgcaccggcgagcucggcuaccucaaccccggcgucuucacccagucccgccgcuggaaggaccacgccgacaugcucaagcaguacgccaccugccucucccgccuccuccccaaguacaacgucaccgagccccagaucuacuucgacaucugggucuccaucaacgaccgcuuccagcagcgcaucuucgacccccgcgucgacaucguccaggccgccuggucccccuuccagcgcaccuccuggguccagccccuccucauggaccucucccccuggcgcgccaagcuccaggagaucaaguccucccucgacaaccacaccgaggucgucuucaucgccgacuuccccggccuccaccucgagaacuucgucuccgaggaccucggcaacaccuccauccagcuccuccagggcgaggucaccgucgagcucgucgccgagcagaagaaccagacccuccgcgagggcgagaagaugcagcuccccgccggcgaguaccacaaggucuacaccaccucccccucccccuccugcuacauguacgucuacgucaacaccaccgagcucgcccucgagcaggaccucgccuaccuccaggagcucaaggagaaggucgagaacggcuccgagaccggcccccucccccccgagcuccagccccuccucgagggcgaggucaagggcggccccgagcccaccccccucguccagaccuuccuccgccgccagcagcgccuccaggagaucgagcgccgccgcaacacccccuuccacgagcgcuucuuccgcuuccuccuccgcaagcucuacgucuuccgccgcuccuuccucaugaccugcaucucccuccgcaaccucauccucggccgccccucccucgagcagcucgcccaggaggucaccuacgccaaccuccgccccuucgaggccgucggcgagcucaaccccuccaacaccgacuccucccacuccaacccccccgaguccaaccccgaccccguccacuccgaguucuga

SEQ ID NO: 43603 - RNA, 957 nt, Artificial Sequence
  derived and/or modified sequence opt2 from GGH__Homo_sapiens__NP_003869
auggccucccccggcugccuccucugcguccucggccuccuccucugcggcgccgccucccucgagcucucccgcccccacggcgacaccgccaagaagcccaucaucggcauccucaugcagaagugccgcaacaaggucaugaagaacuacggccgcuacuacaucgccgccuccuacgucaaguaccucgaguccgccggcgcccgcgucguccccguccgccucgaccucaccgagaaggacuacgagauccucuucaaguccaucaacggcauccucuuccccggcggcuccgucgaccuccgccgcuccgacuacgccaaggucgccaagaucuucuacaaccucuccauccaguccuucgacgacggcgacuacuuccccgucuggggcaccugccucggcuucgaggagcucucccuccucaucuccggcgagugccuccucaccgccaccgacaccgucgacgucgccaugccccucaacuucaccggcggccagcuccacucccgcauguuccagaacuuccccaccgagcuccuccucucccucgccgucgagccccucaccgccaacuuccacaaguggucccucuccgucaagaacuucaccaugaacgagaagcucaagaaguucuucaacguccucaccaccaacaccgacggcaagaucgaguucaucuccaccauggagggcuacaaguaccccgucuacggcguccaguggcaccccgagaaggcccccuacgaguggaagaaccucgacggcaucucccacgcccccaacgccgucaagaccgccuucuaccucgccgaguucuucgucaacgaggcccgcaagaacaaccaccacuucaaguccgaguccgaggaggagaaggcccucaucuaccaguucucccccaucuacaccggcaacaucuccuccuuccagcagugcuacaucuucgacuga

SEQ ID NO: 43604 - RNA, 2094 nt, Artificial Sequence
  derived and/or modified sequence opt2 from GGNBP2__Homo_sapiens__NP_079111
auggcccgccucgucgccgucugccgcgacggcgaggaggaguuccccuucgagcgccgccagaucccccucuacaucgacgacacccucaccauggucauggaguuccccgacaacguccucaaccucgacggccaccagaacaacggcgcccagcucaagcaguucauccagcgccacggcaugcucaagcagcaggaccucuccaucgccauggucgucaccucccgcgagguccucuccgcccucucccagcucguccccugcgucggcugccgccgcuccgucgagcgccucuucucccagcucgucgaguccggcaaccccgcccucgagccccucaccgucggccccaagggcguccucuccgucacccgcuccugcaugaccgacgccaagaagcucuacacccucuucuacguccacggcuccaagcucaacgacaugaucgacgccauccccaaguccaagaagaacaagcgcugccagcuccacucccucgacacccacaagcccaagccccucggcggcugcuggauggacgucugggagcucaugucccaggagugccgcgacgaggucguccucaucgacuccuccugccuccucgagacccucgagaccuaccuccgcaagcaccgcuucugcaccgacugcaagaacaagguccuccgcgccuacaacauccucaucggcgagcucgacugcuccaaggagaagggcuacugcgccgcccucuacgagggccuccgcugcugcccccacgagcgccacauccacgucugcugcgagaccgacuucaucgcccaccuccucggccgcgccgagcccgaguucgccggcggccgccgcgagcgccacgccaagaccaucgacaucgcccaggaggagguccucaccugccucggcauccaccucuacgagcgccuccaccgcaucuggcagaagcuccgcgccgaggagcagaccuggcagaugcucuucuaccucggcgucgacgcccuccgcaaguccuucgagaugaccgucgagaagguccagggcaucucccgccucgagcagcucugcgaggaguucuccgaggaggagcgcguccgcgagcucaagcaggagaagaagcgccagaagcgcaagaaccgccgcaagaacaagugcgucugcgacauccccaccccccuccagaccgccgacgagaaggaggucucccaggagaaggagaccgacuucaucgagaacuccuccugcaaggccugcggcuccaccgaggacggcaacaccugcgucgaggucaucgucaccaacgagaacaccuccugcaccugccccuccuccggcaaccuccucggcucccccaagaucaagaagggccucuccccccacugcaacggcuccgacugcggcuacuccuccuccauggagggcuccgagaccggcucccgcgagggcuccgacgucgccugcaccgagggcaucugcaaccacgacgagcacggcgacgacuccugcguccaccacugcgaggacaaggaggacgacggcgacuccugcgucgagugcugggccaacuccgaggagaacgacaccaagggcaagaacaagaagaagaagaagaaguccaagauccucaagugcgacgagcacauccagaagcucggcuccugcaucaccgaccccggcaaccgcgagaccuccggcaacaccaugcacaccgucuuccaccgcgacaagaccaaggacacccaccccgaguccugcugcuccuccgagaagggcggccagccccuccccugguucgagcaccgcaagaacgucccccaguucgccgagcccaccgagacccucuucggccccgacuccggcaagggcgccaagucccucgucgagcuccucgacgaguccgagugcaccuccgacgaggagaucuucaucucccaggacgagauccaguccuucauggccaacaaccaguccuucuacuccaaccgcgagcaguaccgccagcaccucaaggagaaguucaacaaguacugccgccucaacgaccacaagcgccccaucugcuccggcuggcucaccaccgccggcgccaacuga

SEQ ID NO: 43605 - RNA, 1959 nt, Artificial Sequence
  derived and/or modified sequence opt2 from GGN__Homo_sapiens__NP_689870
augggcaaccuccaguccgagcccuccgccggcggcggcucccgcaagguccagcccuccgaccgcgcccccgacucccgccgcaccucccucgucgagcccgagaugaccucccaggccaugcgccucacccgcggccucggcgucugguuccccggcuccgccaccccccccggccucauggucccccgcgagccccaggccucccccuccacccucccccucacccucgagcgccccucccccgucaugcccccccccgaggaggccgccgccgucuccgcccccccccccgcccccgccggcacccuccuccccggccccuccaaguggcagaagcccgccggcacccccgucccccgcauccgccgccuccucgaggccucccaccgcggccagggcgacccccccucccuccgcccccucaagccccccccccccccccgccagcucuccgucaaggacaccgucccccgcgcccccucccaguucccccccccccucgagaccuggaagcccccccccccccuccccuccgagcgccagcccgccgaccgccgcaucacccccgcccucgccacccccgccuccccccccaccgagucccaggccggcccccgcaaccagggccagaccgccggccgcgcccgcggcggcgcccccccccacgccggcgagggcgagauggcccagcccgccgacuccgaguccggccucucccuccucugcaagaucaccuucaagucccgccccucccucgccccccccgccgccuccuccucccucgccgccaaggccucccucggcggcggcggcggcggcggccucuucgccgccuccggcgccaucuccuacgccgagguccucaagcagggcccccucccccccggcgccgcccgcccccucggcgaggucucccgcggcgcccaggaggccgagggcggcgacggcgacggcgagggcugcuccggcccccccuccgcccccgccucccaggcccgcgcccucccccccccccccuacaccaccuuccccggcuccaagcccaaguucgacugggucuccgcccccgacggccccgagcgccacuuccgcuucaacggcgccggcggcggcaucggcgccccccgccgccgcgccgccgcccucuccggccccuggggcucccccccccccccccccgagcagauccacuccgcccccggcccccgccgccccgcccccgcccuccucgccccccccaccuucaucuuccccgcccccaccaacggcgagcccaugcgccccggcccccccggccuccaggagcuccccccccuccccccccccacccccccccccacccuccagccccccgcccuccagcccaccccccuccccgucgcccccccccucacccccggccucggccacaaggaguccgcccucgcccccaccgccgcccccgcccucccccccgcccucgccgccgaccaggcccccgcccccucccccgcccccgcccccaccgucgccgagcccuccccccccgucuccgcccccgcccccgccgccgcccccaucaagacccgcacccgccgcaacaagggcucccgcgccgcccgcggcgccacccgcaaggacggccuccacggcgacggcccccgcgagcgcgccaccgccaccguccccgacuccuccggcggcggcggcggcggcuccggcgccucccagaccggcgccgccaacacccgcgccgcccgccacuggcuccccuuccagguccucaacuccugccccugcaagugcuacugccaccaccagccccgccaccgccgccucccccgcaacgucuccgccuggcucuccaccuccaccaaccaccucggcgagccccccugggucgccaccaucaagcucuccggcucccucgucgccaagcucgagcacuacgaccuccaggccacccacuccaacuga

SEQ ID NO: 43606 - RNA, 903 nt, Artificial Sequence
  derived and/or modified sequence opt2 from GGPS1__Homo_sapiens__NP_001032354
auggagaagacccaggagaccguccagcgcauccuccucgagcccuacaaguaccuccuccagcuccccggcaagcagguccgcaccaagcucucccaggccuucaaccacuggcucaagguccccgaggacaagcuccagaucaucaucgaggucaccgagaugcuccacaacgccucccuccucaucgacgacaucgaggacaacuccaagcuccgccgcggcuuccccgucgcccacuccaucuacggcauccccuccgucaucaacuccgccaacuacgucuacuuccucggccucgagaagguccucacccucgaccaccccgacgccgucaagcucuucacccgccagcuccucgagcuccaccagggccagggccucgacaucuacuggcgcgacaacuacaccugccccaccgaggaggaguacaaggccaugguccuccagaagaccggcggccucuucggccucgccgucggccucaugcagcucuucuccgacuacaaggaggaccucaagccccuccucaacacccucggccucuucuuccagauccgcgacgacuacgccaaccuccacuccaaggaguacuccgagaacaaguccuucugcgaggaccucaccgagggcaaguucuccuuccccaccauccacgccaucuggucccgccccgaguccacccagguccagaacauccuccgccagcgcaccgagaacaucgacaucaagaaguacugcguccacuaccucgaggacgucggcuccuucgaguacacccgcaacacccucaaggagcucgaggccaaggccuacaagcagaucgacgcccgcggcggcaaccccgagcucgucgcccucgucaagcaccucuccaagauguucaaggaggagaacgaguga

SEQ ID NO: 43607 - RNA, 1710 nt, Artificial Sequence
  derived and/or modified sequence opt2 from GGT1__Homo_sapiens__NP_038347
augaagaagaagcucgucguccucggccuccucgccgucguccucguccucgucaucgucggccucugccucuggcuccccuccgccuccaaggagcccgacaaccacgucuacacccgcgccgccgucgccgccgacgccaagcagugcuccaagaucggccgcgacgcccuccgcgacggcggcuccgccgucgacgccgccaucgccgcccuccucugcgucggccucaugaacgcccacuccaugggcaucggcggcggccucuuccucaccaucuacaacuccaccacccgcaaggccgaggucaucaacgcccgcgaggucgccccccgccucgccuucgccaccauguucaacuccuccgagcagucccagaagggcggccucuccgucgccguccccggcgagauccgcggcuacgagcucgcccaccagcgccacggccgccuccccugggcccgccucuuccagcccuccauccagcucgcccgccagggcuuccccgucggcaagggccucgccgccgcccucgagaacaagcgcaccgucaucgagcagcagcccguccucugcgaggucuucugccgcgaccgcaagguccuccgcgagggcgagcgccucacccucccccagcucgccgacaccuacgagacccucgccaucgagggcgcccaggccuucuacaacggcucccucaccgcccagaucgucaaggacauccaggccgccggcggcaucgucaccgccgaggaccucaacaacuaccgcgccgagcucaucgagcacccccucaacaucucccucggcgacgucguccucuacaugcccuccgccccccucuccggccccguccucgcccucauccucaacauccucaagggcuacaacuucucccgcgaguccgucgagucccccgagcagaagggccucaccuaccaccgcaucgucgaggccuuccgcuucgccuacgccaagcgcacccuccucggcgaccccaaguucgucgacgucaccgaggucguccgcaacaugaccuccgaguucuucgccgcccagcuccgcgcccagaucuccgacgacaccacccaccccaucuccuacuacaagcccgaguucuacacccccgacgacggcggcaccgcccaccucuccgucgucgccgaggacggcuccgccgucuccgccaccuccaccaucaaccucuacuucggcuccaagguccgcucccccgucuccggcauccucuucaacaacgagauggacgacuucuccucccccuccaucaccaacgaguucggcgucccccccucccccgccaacuucauccagcccggcaagcagccccucuccuccaugugccccaccaucauggucggccaggacggccagguccgcauggucgucggcgccgccggcggcacccagaucaccaccgccaccgcccucgccaucaucuacaaccucugguucggcuacgacgucaagcgcgccgucgaggagccccgccuccacaaccagcuccuccccaacgucaccaccgucgagcgcaacaucgaccaggccgucaccgccgcccucgagacccgccaccaccacacccagaucgccuccaccuucaucgccgucguccaggccaucguccgcaccgccggcggcugggccgccgccuccgacucccgcaagggcggcgagcccgccggcuacuga

SEQ ID NO: 43608 - RNA, 678 nt, Artificial Sequence
  derived and/or modified sequence opt2 from GGT2__Homo_sapiens__XP_011528923
augaccuccgaguucuucgccgcccagcuccgcucccagaucuccgaccacaccacccaccccaucuccuacuacaagcccgaguucuacacccccgacgacggcggcaccgcccaccucuccgucgucgccgaggacggcuccgccgucuccgccaccuccaccaucaaccucuacuucggcuccaaggucugcucccccgucuccggcauccucuucaacaacgaguggaccaccuccgcccuccccgccuucaccaacgaguucggcgccccccccucccccgccaacuucauccagcccggcaagcagccccuccucuccaugugccucaccaucauggucggccaggacggccagguccgcauggucgucggcgccgccggcggcacccagaucaccaccgacaccgcccucgccaucaucuacaaccucugguucggcuacgacgucaagcgcgccgucgaggagccccgccuccacaacaagcuccuccccaacgucaccaccgucgagcgcaacaucgaccaggccgucaccgccgcccucgagacccgccaccaccacacccagaucgccuccaccuucaucgccgucguccaggccaucguccgcaccgccggcggcugggccgccgccuccgacucccgcaagggcggcgagcccgccggcuacuga

SEQ ID NO: 43609 - RNA, 1764 nt, Artificial Sequence
  derived and/or modified sequence opt2 from GGT5__Homo_sapiens__NP_001093251
auggcccgcggcuacggcgccaccgucucccucguccuccucggccucggccucgcccucgccgucaucguccucgccgucguccucucccgccaccaggcccccugcggcccccaggccuucgcccacgccgccgucgccgccgacuccaaggucugcuccgacaucggccgcgccauccuccagcagcagggcucccccgucgacgccaccaucgccgcccucgucugcaccuccgucgucaacccccaguccaugggccucggcggcggcgucaucuucaccaucuacaacgucaccaccggcaaggucgaggucaucaacgcccgcgagaccguccccgccucccacgcccccucccuccucgaccagugcgcccaggcccucccccucggcaccggcgcccaguggaucggcguccccggcgagcuccgcggcuacgccgaggcccaccgccgccacggccgccuccccugggcccagcucuuccagcccaccaucgcccuccuccgcggcggccacgucgucgcccccguccucucccgcuuccuccacaacuccauccuccgccccucccuccaggccuccacccuccgccagcucuucuucaacggcaccgagccccuccgcccccaggacccccuccccuggcccgcccucgccaccacccucgagaccgucgccaccgagggcgucgaggucuucuacaccggccgccucggccagaugcucgucgaggacaucgccaaggagggcucccagcucacccuccaggaccucgccaaguuccagcccgaggucgucgacgcccucgaggucccccucggcgacuacacccucuacuccccccccccccccgccggcggcgccauccucuccuucauccucaacguccuccgcggcuucaacuucuccaccgaguccauggcccgccccgagggccgcgucaacgucuaccaccaccucgucgagacccucaaguucgccaagggccagcgcuggcgccucggcgacccccgcucccaccccaagcuccagaacgccucccgcgaccuccucggcgagacccucgcccagcucauccgccagcagaucgacggccgcggcgaccaccagcucucccacuacucccucgccgaggccuggggccacggcaccggcaccucccacgucuccguccucggcgaggacggcuccgccgucgccgccaccuccaccaucaacacccccuucggcgccauggucuacuccccccgcaccggcaucauccucaacaacgagcuccucgaccucugcgagcgcugcccccgcggcuccggcaccacccccucccccgccgucuccggcgaccgcgucggcggcgcccccggccgcugcuggccccccguccccggcgagcgcucccccuccuccaugguccccuccauccucaucaacaaggcccagggcuccaagcucgucaucggcggcgccggcggcgagcucaucaucuccgccgucgcccaggccaucauguccaagcucuggcucggcuucgaccuccgcgccgccaucgccgcccccauccuccacgucaacuccaagggcugcgucgaguacgagcccaacuucucccaggagguccagcgcggccuccaggaccgcggccagaaccagacccagcgccccuucuuccucaacgucguccaggccgucucccaggagggcgccugcgucuacgccgucuccgaccuccgcaaguccggcgaggccgccggcuacuga

SEQ ID NO: 43610 - RNA, 678 nt, Artificial Sequence
  derived and/or modified sequence opt2 from GGTLC1__Homo_sapiens__XP_005260922
augaccuccgaguucuucuccgcccagcuccgcgcccagaucuccgacgacaccacccaccccaucuccuacuacaagcccgaguucuacaugcccgacgacggcggcaccgcccaccucuccgucgucgccgaggacggcuccgccgucuccgccaccuccaccaucaaccucuacuucggcuccaagguccgcucccccgucuccggcauccuccucaacaacgagauggacgacuucuccuccaccuccaucaccaacgaguucggcgucccccccucccccgccaacuucauccagcccggcaagcagccccucuccuccaugugccccaccaucauggucggccaggacggccagguccgcauggucgucggcgccgccggcggcacccagaucaccauggccaccgcccucgccaucaucuacaaccucugguucggcuacgacgucaagugggccgucgaggagccccgccuccacaaccagcuccuccccaacgucaccaccgucgagcgcaacaucgaccaggaggucaccgccgcccucgagacccgccaccaccacacccagaucaccuccaccuucaucgccgucguccaggccaucguccgcauggccggcggcugggccgccgccuccgacucccgcaagggcggcgagcccgccggcuacuga

SEQ ID NO: 43611 - RNA, 654 nt, Artificial Sequence
  derived and/or modified sequence opt2 from GH1__Homo_sapiens__NP_000506
auggccaccggcucccgcaccucccuccuccucgccuucggccuccucugccuccccuggcuccaggagggcuccgccuuccccaccaucccccucucccgccucuucgacaacgccaugcuccgcgcccaccgccuccaccagcucgccuucgacaccuaccaggaguucgaggaggccuacauccccaaggagcagaaguacuccuuccuccagaacccccagaccucccucugcuucuccgaguccauccccacccccuccaaccgcgaggagacccagcagaaguccaaccucgagcuccuccgcaucucccuccuccucauccaguccuggcucgagcccguccaguuccuccgcuccgucuucgccaacucccucgucuacggcgccuccgacuccaacgucuacgaccuccucaaggaccucgaggagggcauccagacccucaugggccgccucgaggacggcuccccccgcaccggccagaucuucaagcagaccuacuccaaguucgacaccaacucccacaacgacgacgcccuccucaagaacuacggccuccucuacugcuuccgcaaggacauggacaaggucgagaccuuccuccgcaucguccagugccgcuccgucgagggcuccugcggcuucuga

SEQ ID NO: 43612 - RNA, 654 nt, Artificial Sequence
  derived and/or modified sequence opt2 from GH2__Homo_sapiens__NP_002050
auggccgccggcucccgcaccucccuccuccucgccuucggccuccucugccucuccuggcuccaggagggcuccgccuuccccaccaucccccucucccgccucuucgacaacgccaugcuccgcgcccgccgccucuaccagcucgccuacgacaccuaccaggaguucgaggaggccuacauccucaaggagcagaaguacuccuuccuccagaacccccagaccucccucugcuucuccgaguccauccccacccccuccaaccgcgucaagacccagcagaaguccaaccucgagcuccuccgcaucucccuccuccucauccaguccuggcucgagcccguccagcuccuccgcuccgucuucgccaacucccucgucuacggcgccuccgacuccaacgucuaccgccaccucaaggaccucgaggagggcauccagacccucauguggcgccucgaggacggcuccccccgcaccggccagaucuucaaccaguccuacuccaaguucgacaccaagucccacaacgacgacgcccuccucaagaacuacggccuccucuacugcuuccgcaaggacauggacaaggucgagaccuuccuccgcaucguccagugccgcuccgucgagggcuccugcggcuucuga

SEQ ID NO: 43613 - RNA, 1038 nt, Artificial Sequence
  derived and/or modified sequence opt2 from GHITM__Homo_sapiens__NP_055209
augcucgccgcccgccucgucugccuccgcacccuccccucccgcgucuuccaccccgccuucaccaaggccucccccgucgucaagaacuccaucaccaagaaccaguggcuccucacccccucccgcgaguacgccaccaagacccgcaucggcauccgccgcggccgcaccggccaggagcucaaggaggccgcccucgagcccuccauggagaagaucuucaagaucgaccagaugggccgcugguucgucgccggcggcgccgccgucggccucggcgcccucugcuacuacggccucggccucuccaacgagaucggcgccaucgagaaggccgucaucuggccccaguacgucaaggaccgcauccacuccaccuacauguaccucgccggcuccaucggccucaccgcccucuccgccaucgccaucucccgcacccccguccucaugaacuucaugaugcgcggcuccugggucaccaucggcgucaccuucgccgccauggucggcgccggcaugcucguccgcuccauccccuacgaccagucccccggccccaagcaccucgccuggcuccuccacuccggcgucaugggcgccgucgucgccccccucaccauccucggcggcccccuccucauccgcgccgccugguacaccgccggcaucgucggcggccucuccaccgucgccaugugcgcccccuccgagaaguuccucaacaugggcgccccccucggcgucggccucggccucgucuucgucuccucccucggcuccauguuccucccccccaccaccgucgccggcgccacccucuacuccgucgccauguacggcggccucguccucuucuccauguuccuccucuacgacacccagaaggucaucaagcgcgccgaggucucccccauguacggcguccagaaguacgaccccaucaacuccaugcucuccaucuacauggacacccucaacaucuucaugcgcgucgccaccaugcucgccaccggcggcaaccgcaagaaguga

SEQ ID NO: 43614 - RNA, 327 nt, Artificial Sequence
  derived and/or modified sequence opt2 from GHRH__Homo_sapiens__XP_011527089
augccccucugggucuucuucuucgucauccucacccucuccaacuccucccacugcucccccccccccccccucacccuccgcaugcgccgcuacgccgacgccaucuucaccaacuccuaccgcaagguccucggccagcucuccgcccgcaagcuccuccaggacaucaugucccgccagcagggcgaguccaaccaggagcgcggcgcccgcgcccgccucggccgccaggucgacuccaugugggccgagcagaagcagauggagcucgaguccauccucgucgcccuccuccagaagcacucccgcaacucccagggcuga

SEQ ID NO: 43615 - RNA, 1938 nt, Artificial Sequence
  derived and/or modified sequence opt2 from GHR__Homo_sapiens__NP_001229328
augaacuggggccccaccggcauggaccucuggcagcuccuccucacccucgcccucgccggcuccuccgacgccuucuccggcuccgaggccaccgccgccauccucucccgcgcccccuggucccuccaguccgucaaccccggccucaagaccaacuccuccaaggagcccaaguucaccaagugccgcucccccgagcgcgagaccuucuccugccacuggaccgacgagguccaccacggcaccaagaaccucggccccauccagcucuucuacacccgccgcaacacccaggaguggacccaggaguggaaggagugccccgacuacgucuccgccggcgagaacuccugcuacuucaacuccuccuucaccuccaucuggauccccuacugcaucaagcucaccuccaacggcggcaccgucgacgagaagugcuucuccgucgacgagaucguccagcccgacccccccaucgcccucaacuggacccuccucaacgucucccucaccggcauccacgccgacauccagguccgcugggaggccccccgcaacgccgacauccagaagggcuggaugguccucgaguacgagcuccaguacaaggaggucaacgagaccaaguggaagaugauggaccccauccucaccaccuccguccccgucuacucccucaaggucgacaaggaguacgagguccgcguccgcuccaagcagcgcaacuccggcaacuacggcgaguucuccgagguccucuacgucacccucccccagaugucccaguucaccugcgaggaggacuucuacuuccccuggcuccucaucaucaucuucggcaucuucggccucaccgucaugcucuucgucuuccucuucuccaagcagcagcgcaucaagaugcucauccucccccccguccccguccccaagaucaagggcaucgaccccgaccuccucaaggagggcaagcucgaggaggucaacaccauccucgccauccacgacuccuacaagcccgaguuccacuccgacgacuccugggucgaguucaucgagcucgacaucgacgagcccgacgagaagaccgaggaguccgacaccgaccgccuccucuccuccgaccacgagaagucccacuccaaccucggcgucaaggacggcgacuccggccgcaccuccugcugcgagcccgacauccucgagaccgacuucaacgccaacgacauccacgagggcaccuccgaggucgcccagccccagcgccucaagggcgaggccgaccuccucugccucgaccagaagaaccagaacaacucccccuaccacgacgccugccccgccacccagcagcccuccgucauccaggccgagaagaacaagccccagccccuccccaccgagggcgccgaguccacccaccaggccgcccacauccagcucuccaaccccuccucccucuccaacaucgacuucuacgcccaggucuccgacaucacccccgccggcuccgucguccucucccccggccagaagaacaaggccggcaugucccagugcgacaugcaccccgagauggucucccucugccaggagaacuuccucauggacaacgccuacuucugcgaggccgacgccaagaagugcauccccgucgccccccacaucaaggucgagucccacauccagcccucccucaaccaggaggacaucuacaucaccaccgagucccucaccaccgccgccggccgccccggcaccggcgagcacguccccggcuccgagaugcccguccccgacuacaccuccauccacaucguccaguccccccagggccucauccucaacgccaccgcccucccccuccccgacaaggaguuccucuccuccugcggcuacgucuccaccgaccagcucaacaagaucaugcccuga

SEQ ID NO: 43616 - RNA, 1272 nt, Artificial Sequence
  derived and/or modified sequence opt2 from GHRHR__Homo_sapiens__NP_000814
auggaccgccgcauguggggcgcccacgucuucugcguccucuccccccuccccaccguccucggccacaugcaccccgagugcgacuucaucacccagcuccgcgaggacgaguccgccugccuccaggccgccgaggagaugcccaacaccacccucggcugccccgccaccugggacggccuccucugcuggcccaccgccggcuccggcgagugggucacccuccccugccccgacuucuucucccacuucuccuccgaguccggcgccgucaagcgcgacugcaccaucaccggcugguccgagcccuucccccccuaccccgucgccugccccgucccccucgagcuccucgccgaggaggaguccuacuucuccaccgucaagaucaucuacaccgucggccacuccaucuccaucgucgcccucuucgucgccaucaccauccucgucgcccuccgccgccuccacugcccccgcaacuacguccacacccagcucuucaccaccuucauccucaaggccggcgccgucuuccucaaggacgccgcccucuuccacuccgacgacaccgaccacugcuccuucuccaccguccucugcaaggucuccgucgccgccucccacuucgccaccaugaccaacuucuccuggcuccucgccgaggccgucuaccucaacugccuccucgccuccaccucccccuccucccgccgcgccuucugguggcucguccucgccggcuggggccuccccguccucuucaccggcaccugggucuccugcaagcucgccuucgaggacaucgccugcugggaccucgacgacaccucccccuacugguggaucaucaagggccccaucguccucuccgucggcgucaacuucggccucuuccucaacaucauccgcauccucguccgcaagcucgagcccgcccagggcucccuccacacccagucccaguacuggcgccucuccaaguccacccucuuccucaucccccucuucggcauccacuacaucaucuucaacuuccuccccgacaacgccggccucggcauccgccucccccucgagcucggccucggcuccuuccagggcuucaucgucgccauccucuacugcuuccucaaccaggagguccgcaccgagaucucccgcaaguggcacggccacgaccccgagcuccuccccgccuggcgcacccgcgccaaguggaccacccccucccgcuccgccgccaagguccucaccuccaugugcuga

SEQ ID NO: 43617 - RNA, 318 nt, Artificial Sequence
  derived and/or modified sequence opt2 from GHRL__Homo_sapiens__NP_001128416
auguucaccugcuggugguccuaccuccgcuccacccucgccgccguccccggcgaggccucccgcguccagcagcgcaaggaguccaagaagccccccgccaagcuccagccccgcgcccucgccggcuggcuccgccccgaggacggcggccaggccgagggcgccgaggacgagcucgagguccgcuucaacgcccccuucgacgucggcaucaagcucuccggcguccaguaccagcagcacucccaggcccucggcaaguuccuccaggacauccucugggaggaggccaaggaggcccccgccgacaaguga

SEQ ID NO: 43618 - RNA, 870 nt, Artificial Sequence
  derived and/or modified sequence opt2 from GHSR__Homo_sapiens__NP_004113
auguggaacgccacccccuccgaggagcccggcuucaaccucacccucgccgaccucgacugggacgccucccccggcaacgacucccucggcgacgagcuccuccagcucuuccccgccccccuccucgccggcgucaccgccaccugcgucgcccucuucgucgucggcaucgccggcaaccuccucaccaugcucgucgucucccgcuuccgcgagcuccgcaccaccaccaaccucuaccucuccuccauggccuucuccgaccuccucaucuuccucugcaugccccucgaccucguccgccucuggcaguaccgccccuggaacuucggcgaccuccucugcaagcucuuccaguucgucuccgaguccugcaccuacgccaccguccucaccaucaccgcccucuccgucgagcgcuacuucgccaucugcuucccccuccgcgccaaggucgucgucaccaagggccgcgucaagcucgucaucuucgucaucugggccgucgccuucugcuccgccggccccaucuucguccucgucggcgucgagcacgagaacggcaccgaccccugggacaccaacgagugccgccccaccgaguucgccguccgcuccggccuccucaccgucauggucugggucuccuccaucuucuucuuccuccccgucuucugccucaccguccucuacucccucaucggccgcaagcucuggcgccgccgccgcggcgacgccgucgucggcgccucccuccgcgaccagaaccacaagcagaccgucaagaugcucggcggcucccagcgcgcccuccgccucucccucgccggccccauccucucccucugccuccuccccucccucuga

SEQ ID NO: 43619 - RNA, 687 nt, Artificial Sequence
  derived and/or modified sequence opt2 from GID8__Homo_sapiens__NP_060366
auguccuacgccgagaagcccgacgagaucaccaaggacgaguggauggagaagcucaacaaccuccacguccagcgcgccgacaugaaccgccucaucaugaacuaccucgucaccgagggcuucaaggaggccgccgagaaguuccgcauggaguccggcaucgagcccuccgucgaccucgagacccucgacgagcgcaucaagauccgcgagaugauccucaagggccagauccaggaggccaucgcccucaucaacucccuccaccccgagcuccucgacaccaaccgcuaccucuacuuccaccuccagcagcagcaccucaucgagcucauccgccagcgcgagaccgaggccgcccucgaguucgcccagacccagcucgccgagcagggcgaggagucccgcgagugccucaccgagauggagcgcacccucgcccuccucgccuucgacucccccgaggagucccccuucggcgaccuccuccacaccaugcagcgccagaaggucugguccgaggucaaccaggccguccucgacuacgagaaccgcgaguccacccccaagcucgccaagcuccucaagcuccuccucugggcccagaacgagcucgaccagaagaaggucaaguaccccaagaugaccgaccucuccaagggcgucaucgaggagcccaaguga

SEQ ID NO: 43620 - RNA, 1254 nt, Artificial Sequence
  derived and/or modified sequence opt2 from GIF__Homo_sapiens__NP_005133
auggccugguucgcccucuaccuccucucccuccucugggccaccgccggcaccuccacccagacccaguccuccugcuccguccccuccgcccaggagccccucgucaacggcauccagguccucauggagaacuccgucaccuccuccgccuaccccaaccccuccauccucaucgccaugaaccucgccggcgccuacaaccucaaggcccagaagcuccucaccuaccagcucauguccuccgacaacaacgaccucaccaucggccagcucggccucaccaucauggcccucaccuccuccugccgcgaccccggcgacaaggucuccauccuccagcgccagauggagaacugggcccccuccucccccaacgccgaggccuccgccuucuacggccccucccucgccauccucgcccucugccagaagaacuccgaggccacccuccccaucgccguccgcuucgccaagacccuccucgccaacuccucccccuucaacgucgacaccggcgccauggccacccucgcccucaccugcauguacaacaagauccccgucggcuccgaggagggcuaccgcucccucuucggccagguccucaaggacaucgucgagaagaucuccaugaagaucaaggacaacggcaucaucggcgacaucuacuccaccggccucgccaugcaggcccucuccgucacccccgagcccuccaagaaggaguggaacugcaagaagaccaccgacaugauccucaacgagaucaagcagggcaaguuccacaaccccauguccaucgcccagauccuccccucccucaagggcaagaccuaccucgacgucccccaggucaccugcucccccgaccacgagguccagcccacccuccccuccaaccccggccccggccccaccuccgccuccaacaucaccgucaucuacaccaucaacaaccagcuccgcggcgucgagcuccucuucaacgagaccaucaacgucuccgucaaguccggcuccguccuccucgucguccucgaggaggcccagcgcaagaaccccauguucaaguucgagaccaccaugaccuccuggggccucgucgucuccuccaucaacaacaucgccgagaacgucaaccacaagaccuacuggcaguuccucuccggcgucaccccccucaacgagggcgucgccgacuacauccccuucaaccacgagcacaucaccgccaacuucacccaguacuga

SEQ ID NO: 43621 - RNA, 3108 nt, Artificial Sequence
  derived and/or modified sequence opt2 from GIGYF1__Homo_sapiens__XP_005250589
auggccgccgagacccucaacuucggccccgaguggcuccgcgcccucuccggcggcggcuccgucgccucccccccccccucccccgccaugcccaaguacaagcucgccgacuaccgcuacggccgcgaggagaugcucgcccucuacgucaaggagaacaagguccccgaggagcuccaggacaaggaguucgccgccguccuccaggacgagccccuccagccccucgcccucgagccccucaccgaggaggagcagcgcaacuucucccucuccgucaacuccgucgccguccuccgccucaugggcaagggcgccggccccccccucgccggcaccucccgcggccgcggcuccacccgcucccgcggccgcggccgcggcgacuccugcuucuaccagcgcuccaucgaggagggcgacggcgccuucggccgcuccccccgcgagauccagcgcucccaguccugggacgaccgcggcgagcgccgcuucgagaaguccgcccgccgcgacggcgcccgcugcggcuucgaggagggcggcgccggcccccgcaaggagcacgcccgcuccgacuccgagaacuggcgcucccuccgcgaggagcaggaggaggaggaggagggcuccuggcgccucggcgccggcccccgccgcgacggcgaccgcuggcgcuccgccucccccgacggcggcccccgcuccgccggcuggcgcgagcacggcgagcgccgccgcaaguucgaguucgaccuccgcggcgaccgcggcggcugcggcgaggaggagggccgcggcggcggcggcuccucccaccuccgccgcugccgcgcccccgagggcuucgaggaggacaaggacggccuccccgaguggugccucgacgacgaggacgaggagaugggcaccuucgacgccuccggcgccuuccucccccucaagaagggccccaaggagcccauccccgaggagcaggagcucgacuuccagggccucgaggaggaggaggagcccuccgagggccucgaggaggagggccccgaggccggcggcaaggagcucaccccccuccccccccaggaggagaaguccuccucccccuccccccuccccacccucggcccccucuggggcaccaacggcgacggcgacgagaccgccgagaaggagccccccgccgccgaggacgacauccgcggcauccagcucucccccggcgucggcuccuccgccggcccccccggcgaccucgaggacgacgagggccucaagcaccuccagcaggaggccgagaagcucgucgccucccuccaggacuccucccucgaggaggagcaguucaccgccgccaugcagacccagggccuccgccacuccgccgccgccaccgcccucccccucucccacggcgccgcccgcaagugguucuacaaggacccccagggcgagauccagggccccuucaccacccaggagauggccgagugguuccaggccggcuacuucuccaugucccuccucgucaagcgcggcugcgacgagggcuuccagccccucggcgaggucaucaagauguggggccgcguccccuucgcccccggccccuccccccccccccuccucggcaacauggaccaggagcgccucaagaagcagcaggagcucgccgccgccgcccucuaccagcagcuccagcaccagcaguuccuccagcucgucuccucccgccagcucccccagugcgcccuccgcgagaaggccgcccucggcgaccucaccccccccccccccccccccccccagcagcagcagcagcagcucaccgccuuccuccagcagcuccaggcccucaagcccccccgcggcggcgaccagaaccuccuccccaccaugucccgcucccucuccguccccgacuccggccgccucugggacguccacaccuccgccuccucccaguccggcggcgaggccucccucugggacauccccaucaacuccuccacccagggccccauccucgagcagcuccagcuccagcacaaguuccaggagcgccgcgaggucgagcuccgcgccaagcgcgaggaggaggagcgcaagcgccgcgaggagaagcgccgccagcagcagcaggaggagcagaagcgccgccaggaggaggaggagcucuuccgccgcaagcacguccgccagcaggagcuccuccucaagcuccuccagcagcagcaggccguccccgucccccccgcccccuccuccccccccccccucugggccggccucgccaagcagggccucuccaugaagacccuccucgagcuccagcucgagggcgagcgccagcuccacaagcagccccccccccgcgagcccgcccgcgcccaggcccccaaccaccgcguccagcucggcggccucggcaccgccccccucaaccagugggucuccgaggccggcccccucuggggcggccccgacaaguccggcggcggcuccuccggccucggccucugggaggacacccccaaguccggcggcucccucguccgcggccucggccucaagaacucccgcuccucccccucccucuccgacuccuacucccaccucuccggccgccccauccgcaagaagaccgaggaggaggagaagcuccucaagcuccuccagggcaucccccgcccccaggacggcuucacccaguggugcgagcagaugcuccacacccucuccgccaccggcucccucgacguccccauggccgucgccauccucaaggaggucgagucccccuacgacguccacgacuacauccgcuccugccucggcgacacccucgaggccaaggaguucgccaagcaguuccucgagcgccgcgccaagcagaaggccucccagcagcgccagcagcagcaggaggccuggcucuccuccgccucccuccagaccgccuuccaggccaaccacuccaccaagcucggccccggcgagggcuccaaggccaagcgccgcgcccucaugcuccacuccgaccccuccauccucggcuacucccuccacggcuccuccggcgagaucgaguccgucgacgacuacuga

SEQ ID NO: 43622 - RNA, 3900 nt, Artificial Sequence
  derived and/or modified sequence opt2 from GIGYF2__Homo_sapiens__NP_001096616
auggccgccgagacccagacccucaacuucggccccgaguggcuccgcgcccucuccuccggcggcuccaucaccucccccccccucucccccgcccuccccaaguacaagcucgccgacuaccgcuacggccgcgaggagaugcucgcccucuuccucaaggacaacaagauccccuccgaccuccucgacaaggaguuccuccccauccuccaggaggagccccuccccccccucgcccucguccccuucaccgaggaggagcagcgcaacuucuccauguccgucaacuccgccgccguccuccgccucaccggccgcggcggcggcggcaccgucgucggcgccccccgcggccgcuccuccucccgcggccgcggccgcggccgcggcgagugcggcuucuaccagcgcuccuucgacgaggucgagggcgucuucggccgcggcggcggccgcgagaugcaccgcucccaguccugggaggagcgcggcgaccgccgcuucgagaagcccggccgcaaggacgucggccgccccaacuucgaggagggcggccccaccuccgucggccgcaagcacgaguucauccgcuccgaguccgagaacuggcgcaucuuccgcgaggagcagaacggcgaggacgaggacggcggcuggcgccucgccggcucccgccgcgacggcgagcgcuggcgcccccacucccccgacggcccccgcuccgccggcuggcgcgagcacauggagcgccgccgccgcuucgaguucgacuuccgcgaccgcgacgacgagcgcggcuaccgccgcguccgcuccggcuccggcuccaucgacgacgaccgcgacucccuccccgaguggugccucgaggacgccgaggaggagaugggcaccuucgacuccuccggcgccuuccucucccucaagaagguccagaaggagcccauccccgaggagcaggagauggacuuccgccccgucgacgagggcgaggagugcuccgacuccgagggcucccacaacgaggaggccaaggagcccgacaagaccaacaagaaggagggcgagaagaccgaccgcgucggcgucgaggccuccgaggagaccccccagaccuccuccuccuccgcccgccccggcacccccuccgaccaccagucccaggaggccucccaguucgagcgcaaggacgagcccaagaccgagcagaccgagaaggccgaggaggagacccgcauggagaacucccuccccgccaagguccccucccgcggcgacgagauggucgccgacguccagcagccccucucccagauccccuccgacaccgccuccccccuccucauccuccccccccccguccccaaccccucccccacccuccgccccgucgagacccccgucgucggcgcccccggcaugggcuccgucuccaccgagcccgacgacgaggagggccucaagcaccucgagcagcaggccgagaagauggucgccuaccuccaggacuccgcccucgacgacgagcgccucgccuccaagcuccaggagcaccgcgccaagggcgucuccaucccccucaugcacgaggccaugcagaagugguacuacaaggacccccagggcgagauccagggccccuucaacaaccaggagauggccgagugguuccaggccggcuacuucaccaugucccuccucgucaagcgcgccugcgacgaguccuuccagccccucggcgacaucaugaagauguggggccgcguccccuucucccccggccccgccccccccccccacaugggcgagcucgaccaggagcgccucacccgccagcaggagcucaccgcccucuaccagaugcagcaccuccaguaccagcaguuccucauccagcagcaguacgcccagguccucgcccagcagcagaaggccgcccucuccucccagcagcagcagcagcucgcccuccuccuccagcaguuccagacccucaagaugcgcaucuccgaccagaacaucauccccuccgucacccgcuccgucuccguccccgacaccggcuccaucugggagcuccagcccaccgccucccagcccaccgucugggagggcggcuccgucugggaccucccccucgacaccaccacccccggccccgcccucgagcagcuccagcagcucgagaaggccaaggccgccaagcucgagcaggagcgccgcgaggccgagaugcgcgccaagcgcgaggaggaggagcgcaagcgccaggaggagcuccgccgccagcaggaggagauccuccgccgccagcaggaggaggagcgcaagcgccgcgaggaggaggagcucgcccgccgcaagcaggaggaggcccuccgccgccagcgcgagcaggagaucgcccuccgccgccagcgcgaggaggaggagcgccagcagcaggaggaggcccuccgccgccucgaggagcgccgccgcgaggaggaggagcgccgcaagcaggaggagcuccuccgcaagcaggaggaggaggccgccaagugggcccgcgaggaggaggaggcccagcgccgccucgaggagaaccgccuccgcauggaggaggaggccgcccgccuccgccacgaggaggaggagcgcaagcgcaaggagcucgagguccagcgccagaaggagcucaugcgccagcgccagcagcagcaggaggcccuccgccgccuccagcagcagcagcagcagcagcagcucgcccagaugaagcuccccuccuccuccaccuggggccagcaguccaacaccaccgccugccagucccaggccacccucucccucgccgagauccagaagcucgaggaggagcgcgagcgccagcuccgcgaggagcagcgccgccagcagcgcgagcucaugaaggcccuccagcagcagcagcagcagcagcagcagaagcucuccggcuggggcaacgucuccaagcccuccggcaccaccaagucccuccucgagauccagcaggaggaggcccgccagaugcagaagcagcagcagcagcagcagcagcaccagcagcccaaccgcgcccgcaacaacacccacuccaaccuccacaccuccaucggcaacuccgucuggggcuccaucaacaccggcccccccaaccagugggccuccgaccucgucuccuccaucugguccaacgccgacaccaagaacuccaacaugggcuucugggacgacgccgucaaggaggucggcccccgcaacuccaccaacaagaacaagaacaacgccucccucuccaaguccgucggcgucuccaaccgccagaacaagaaggucgaggaggaggagaagcuccucaagcucuuccagggcgucaacaaggcccaggacggcuucacccaguggugcgagcagaugcuccacgcccucaacaccgccaacaaccucgacguccccaccuucgucuccuuccucaaggaggucgagucccccuacgagguccacgacuacauccgcgccuaccucggcgacaccuccgaggccaaggaguucgccaagcaguuccucgagcgccgcgccaagcagaaggccaaccagcagcgccagcagcagcagcucccccagcagcagcagcagcagcccccccagcagcccccccagcagccccagcagcaggacuccgucuggggcaugaaccacuccacccuccacuccgucuuccagaccaaccaguccaacaaccagcaguccaacuucgaggccguccaguccggcaagaagaagaagaagcagaagaugguccgcgccgaccccucccuccucggcuucuccgucaacgccuccuccgagcgccucaacaugggcgagaucgagacccucgacgacuacuga

SEQ ID NO: 43623 - RNA, 924 nt, Artificial Sequence
  derived and/or modified sequence opt2 from GIMAP5__Homo_sapiens__NP_060854
augggcggcuuccagcgcggcaaguacggcaccauggccgagggccgcuccgaggacaaccucuccgccaccccccccgcccuccgcaucauccucgucggcaagaccggcugcggcaaguccgccaccggcaacuccauccucggccagcccgucuucgaguccaagcuccgcgcccaguccgucacccgcaccugccaggucaagaccggcaccuggaacggccgcaagguccucgucgucgacacccccuccaucuucgagucccaggccgacacccaggagcucuacaagaacaucggcgacugcuaccuccucuccgcccccggcccccacguccuccuccucgucauccagcucggccgcuucaccgcccaggacaccgucgccauccgcaaggucaaggaggucuucggcaccggcgccaugcgccacgucgucauccucuucacccacaaggaggaccucggcggccaggcccucgacgacuacgucgccaacaccgacaacugcucccucaaggaccucguccgcgagugcgagcgccgcuacugcgccuucaacaacuggggcuccgucgaggagcagcgccagcagcaggccgagcuccucgccgucaucgagcgccucggccgcgagcgcgagggcuccuuccacuccaacgaccucuuccucgacgcccagcuccuccagcgcaccggcgccggcgccugccaggaggacuaccgccaguaccaggccaaggucgaguggcaggucgagaagcacaagcaggagcuccgcgagaacgaguccaacugggccuacaaggcccuccuccgcgucaagcaccucaugcuccuccacuacgagaucuucgucuuccuccuccucugcuccauccucuucuucaucaucuuccucuucaucuuccacuacaucuga

SEQ ID NO: 43624 - RNA, 903 nt, Artificial Sequence
  derived and/or modified sequence opt2 from GIMAP7__Homo_sapiens__NP_694968
auggccgaguccgaggaccgcucccuccgcaucguccucgucggcaagaccggcuccggcaaguccgccaccgccaacaccauccucggcgaggagaucuucgacucccgcaucgccgcccaggccgucaccaagaacugccagaaggccucccgcgaguggcagggccgcgaccuccucgucgucgacacccccggccucuucgacaccaaggagucccucgacaccaccugcaaggagaucucccgcugcaucaucuccuccugccccggcccccacgccaucguccucguccuccuccucggccgcuacaccgaggaggagcagaagaccgucgcccucaucaaggccgucuucggcaaguccgccaugaagcacauggucauccucuucacccgcaaggaggagcucgagggccaguccuuccacgacuucaucgccgacgccgacgucggccucaaguccaucgucaaggagugcggcaaccgcugcugcgccuucuccaacuccaagaagaccuccaaggccgagaaggagucccagguccaggagcucgucgagcucaucgagaagaugguccagugcaacgagggcgccuacuucuccgacgacaucuacaaggacaccgaggagcgccucaagcagcgcgaggagguccuccgcaagaucuacaccgaccagcucaacgaggagaucaagcucgucgaggaggacaagcacaaguccgaggaggagaaggagaaggagaucaagcuccucaagcucaaguacgacgagaagaucaagaacauccgcgaggaggccgagcgcaacaucuucaaggacgucuucaaccgcaucuggaagaugcucuccgagaucuggcaccgcuuccucuccaagugcaaguucuacuccuccuga

SEQ ID NO: 43625 - RNA, 1998 nt, Artificial Sequence
  derived and/or modified sequence opt2 from GIMAP8__Homo_sapiens__XP_005250007
auguccgagcaguccugccagauguccgagcuccgccuccuccuccucggcaagugccgcuccggcaaguccgccaccggcaacgccauccucggcaagcacgucuucaaguccaaguucuccgaccagaccgucaucaagaugugccagcgcgaguccuggguccuccgcgagcgcaaggucgucgucaucgacacccccgaccucuucuccuccaucgccugcgccgaggacaagcagcgcaacauccagcacugccucgagcucuccgcccccucccuccacgcccuccuccucgucaucgccaucggccacuucacccgcgaggacgaggagaccgccaagggcauccagcaggucuucggcgccgaggcccgccgccacaucaucaucgucuucacccgcaaggacgaccucggcgacgaccuccuccaggacuucaucgagaagaacaagccccucaagcagcucguccaggacuacgagggccgcuacugcaucuucaacaacaagaccaacuccaaggacgagcagaucacccagguccucgagcuccuccgcaaggucgagucccucgucaacaccaacggcggccccuaccacgucaacuucaagaccgagggcucccgcuuccaggacugcgucaacgaggccgccucccaggagggcgacaagccccagggcccccgcgagcgccagcuccaguccaccggccccgagcagaaccccggcaccuccgagcucaccguccuccucgucggcaagcgcggcgccggcaaguccgccgccggcaacuccauccucggccgccaggccuuccagaccggcuucuccgagcaguccgucacccaguccuuccucuccgagucccgcuccuggcgcaagaagaaggucuccaucaucgacgcccccgacaucuccucccucaagaacaucgacuccgagguccgcaagcacaucugcaccggcccccacgccuuccuccucgucaccccccucggcuucuacaccaagaacgacgaggccguccucuccaccauccagaacaacuucggcgagaaguucuucgaguacaugaucauccuccucacccgcaaggaggaccucggcgaccaggaccucgacaccuuccuccgcaacuccaacaaggcccucuacggccucauccagaagugcaagaaccgcuacuccgccuucaacuaccgcgccaccggcgaggaggagcagcgccaggccgacgagcuccucgagaagaucgaguccaugguccaccagaacggcaacaagcacugcgucuuccgcgagaaggagacccucaacaucguccucgucggccgcuccggcaccggcaaguccgccaccggcaacuccauccucggcucccucgucuucaccucccgccuccgcgcccagcccgucaccaagaccucccaguccggccgccgcaccugggacggccaggaggucgucgucgucgacacccccuccuucaaccagaugcucgacgucgagaaggaccccucccgccucgaggaggaggucaagcgcugccucuccugcugcgagaagggcgacaccuucuucguccucgucuuccagcucggccgcuucaccgaggaggacaagaccgccgucgccaagcucgaggccaucuucggcgccgacuucaccaaguacgccaucaugcucuucacccgcaaggaggaccucggcgccggcaaccucgaggacuucaugaagaacuccgacaacaaggcccuccgccgcaucuucaagaagugcggccgccgcgucugcgccuucaacaacaaggagaccggccaggcccaggagacccaggucaaggcccuccucaccaaggucaacgaccuccgcaaggaguccggcugguccggcuacccccacacccaggagaacgucuccaagcucaucaagaacguccaggagaugucccaggccgagaagcuccucaagaaccucaucggcauccuccaguga

SEQ ID NO: 43626 - RNA, 1569 nt, Artificial Sequence
  derived and/or modified sequence opt2 from GIN1__Homo_sapiens__NP_060146
augguccgcuccggcaagaacggcgaccuccaccucaagcagaucgccuacuacaagcgcaccggcgaguaccacuccaccacccuccccuccgagcgcuccggcauccgccgcgccgccaagaaguucgucuucaaggagaagaagcucuucuacgucggcaaggaccgcaagcagaaccgccucgucaucgucuccgaggaggagaagaagaagguccuccgcgagugccacgagaacgacuccggcgcccaccacggcaucucccgcacccucacccucgucgaguccaacuacuacuggaccuccgucaccaacgacgucaagcagugggucuacgccugccagcacugccaggucgccaagaacaccgucaucgucgcccccaagcagcaccuccucaaggucgagaaccccuggucccucgucaccgucgaccucaugggccccuuccacaccuccaaccgcucccacgucuacgccaucaucaugaccgaccucuucaccaaguggaucgucauccucccccucugcgacgucuccgccuccgaggucuccaaggccaucaucaacaucuucuuccucuacggccccccccagaagaucaucauggaccagcgcgacgaguucauccagcagaucaacaucgagcucuaccgccucuucggcaucaagcagaucgucaucucccacaccuccggcaccgucaaccccaccgaguccacccccaacaccaucaaggccuuccucuccaagcacugcgccgaccaccccaacaacugggacgaccaccucuccgccgucuccuucgccuucaacgucacccaccucgagcccaccaagaacacccccuacuuccagauguucucccgcaaccccuacaugcccgagaccuccgacucccuccacgaggucgacggcgacaacaccuccauguucgccaagauccucgacgccaucaaggaggccgacaagaucauggagaacaagaccaccucccucggccagauggagaacaacaaccucgacgagcucaacaaguccaagaucaucgucaagaagaagcccaagcagcucaaccccuuccaccucaaggucggccacgagguccuccgccagcgcaagaacugguggaaggacggccgcuuccaguccgagugggucggccccugcgucaucgacuacaucaccgaguccggcugcgccguccuccgcgacaacaccggcguccgccucaagcgccccaucaagaugucccaccucaagcccuacauccgcgaguccuccgagcaggagucccucuaccuccuccagggcuccgucgucgccgaccacgacuacaucggccuccccgagauccccaucggcgccuaccaggccaacauccucgucgaggacgccaccaucggcaucgucgacaacgagcuccucaccuccuccaaggaccgcgagcuccucgaguaccgcaacaccaagaucuccccccucaucgacgaccacuccucccucgagaagcagaccuucucccuccucgacuccuccaaccagguccucgaguaccucuccuga

SEQ ID NO: 43627 - RNA, 591 nt, Artificial Sequence
  derived and/or modified sequence opt2 from GINS1__Homo_sapiens__NP_066545
auguucugcgagaaggccauggagcucauccgcgagcuccaccgcgcccccgagggccagcuccccgccuucaacgaggacggccuccgccagguccucgaggagaugaaggcccucuacgagcagaaccaguccgacgucaacgaggccaaguccggcggccgcuccgaccucauccccaccaucaaguuccgccacugcucccuccuccgcaaccgccgcugcaccgucgccuaccucuacgaccgccuccuccgcauccgcgcccuccgcugggaguacggcuccguccuccccaacgcccuccgcuuccacauggccgccgaggagauggagugguucaacaacuacaagcgcucccucgccaccuacaugcgcucccucggcggcgacgagggccucgacaucacccaggacaugaagccccccaagucccucuacaucgagguccgcugccucaaggacuacggcgaguucgaggucgacgacggcaccuccguccuccucaagaagaacucccagcacuuccucccccgcuggaagugcgagcagcucauccgccagggcguccucgagcacauccucuccuga

SEQ ID NO: 43628 - RNA, 558 nt, Artificial Sequence
  derived and/or modified sequence opt2 from GINS2__Homo_sapiens__NP_057179
auggacgccgccgaggucgaguuccucgccgagaaggagcucgucaccaucauccccaacuucucccucgacaagaucuaccucaucggcggcgaccucggccccuucaaccccggccuccccgucgaggucccccucuggcucgccaucaaccucaagcagcgccagaagugccgccuccucccccccgaguggauggacgucgagaagcucgagaagaugcgcgaccacgagcgcaaggaggagaccuucacccccaugcccucccccuacuacauggagcucaccaagcuccuccucaaccacgccuccgacaacauccccaaggccgacgagauccgcacccucgucaaggacaugugggacacccgcaucgccaagcuccgcgucuccgccgacuccuucguccgccagcaggaggcccacgccaagcucgacaaccucacccucauggagaucaacaccuccggcaccuuccucacccaggcccucaaccacauguacaagcuccgcaccaaccuccagccccucgaguccacccagucccaggacuucuga

SEQ ID NO: 43629 - RNA, 1002 nt, Artificial Sequence
  derived and/or modified sequence opt2 from GIPC1__Homo_sapiens__NP_005707
augccccucggccucggccgccgcaagaaggcccccccccucgucgagaacgaggaggccgagcccggccgcggcggccucggcgucggcgagcccggcccccucggcggcggcggcuccggcggcccccagaugggccuccccccccccccccccgcccuccgcccccgccucgucuuccacacccagcucgcccacggcucccccaccggccgcaucgagggcuucaccaacgucaaggagcucuacggcaagaucgccgaggccuuccgccuccccaccgccgaggucauguucugcacccucaacacccacaaggucgacauggacaagcuccucggcggccagaucggccucgaggacuucaucuucgcccacgucaagggccagcgcaaggaggucgaggucuucaaguccgaggacgcccucggccucaccaucaccgacaacggcgccggcuacgccuucaucaagcgcaucaaggagggcuccgucaucgaccacauccaccucaucuccgucggcgacaugaucgaggccaucaacggccagucccuccucggcugccgccacuacgaggucgcccgccuccucaaggagcucccccgcggccgcaccuucacccucaagcucaccgagccccgcaaggccuucgacaugaucucccagcgcuccgccggcggccgccccggcuccggcccccagcucggcaccggccgcggcacccuccgccuccgcucccgcggccccgccaccgucgaggaccuccccuccgccuucgaggagaaggccaucgagaaggucgacgaccuccucgaguccuacaugggcauccgcgacaccgagcucgccgccaccauggucgagcucggcaaggacaagcgcaaccccgacgagcucgccgaggcccucgacgagcgccucggcgacuucgccuuccccgacgaguucgucuucgacgucuggggcgccaucggcgacgccaaggucggccgcuacuga

SEQ ID NO: 43630 - RNA, 939 nt, Artificial Sequence
  derived and/or modified sequence opt2 from GIPC3__Homo_sapiens__NP_573568
auggagggcgccgccgcccgcgaggcccgcggcaccgagaccccccgcgccuccgcccccccccccgcccccuccgagccccccgccgccccccgcgcccgcccccgccucgucuuccgcacccagcucgcccacggcucccccaccggcaagaucgagggcuucaccaacguccgcgagcucuacgccaagaucgccgaggccuucggcaucgcccccaccgagauccucuucugcacccucaacucccacaaggucgacaugcagaagcuccucggcggccagaucggccucgaggacuucaucuucgcccacguccgcggcgagaccaaggaggucgaggucaccaagaccgaggacgcccucggccucaccaucaccgacaacggcgccggcuacgccuucaucaagcgcaucaaggagggcuccaucaucaaccgcaucgaggccgucugcgucggcgacuccaucgaggccaucaacgaccacuccaucgucggcugccgccacuacgaggucgccaagaugcuccgcgagcuccccaagucccagcccuucacccuccgccucguccagcccaagcgcgccuucgacaugaucggccagcgcucccgcuccuccaagugccccgucgaggccaaggucaccuccggccgcgagacccuccgccuccgcuccggcggcgccgccaccgucgaggaggcccccuccgaguucgaggaggaggccucccgcaaggucgacgaccuccucgaguccuacaugggcauccgcgaccccgagcucgccuccaccauggucgagaccuccaagaagaccgccuccgcccaggaguucgcccgcugccucgacuccguccucggcgaguucgccuuccccgacgaguucgucgucgaggucugggccgccaucggcgaggcccgcgaggccugcggcuga

SEQ ID NO: 43631 - RNA, 462 nt, Artificial Sequence
  derived and/or modified sequence opt2 from GIP__Homo_sapiens__NP_004114
auggucgccaccaagaccuucgcccuccuccuccucucccucuuccucgccgucggccucggcgagaagaaggagggccacuucuccgcccuccccucccuccccgucggcucccacgccaaggucuccuccccccagccccgcggcccccgcuacgccgagggcaccuucaucuccgacuacuccaucgccauggacaagauccaccagcaggacuucgucaacuggcuccucgcccagaagggcaagaagaacgacuggaagcacaacaucacccagcgcgaggcccgcgcccucgagcucgccucccaggccaaccgcaaggaggaggaggccgucgagccccaguccucccccgccaagaaccccuccgacgaggaccuccuccgcgaccuccucauccaggagcuccucgccugccuccucgaccagaccaaccucugccgccuccgcucccgcuga
